United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 31

SEQ ID NO: 1367202 - RNA, 13 nt, Human
cacagacuauuuu

SEQ ID NO: 1367203 - RNA, 23 nt, Human
cacagacggaaggguaaacaaua

SEQ ID NO: 1367204 - RNA, 10 nt, Human
cacacuuguc

SEQ ID NO: 1367205 - RNA, 14 nt, Human
cacacuucucagga

SEQ ID NO: 1367206 - RNA, 18 nt, Human
cacacuucaaacuacuuu

SEQ ID NO: 1367207 - RNA, 13 nt, Human
cacacuucaaacu

SEQ ID NO: 1367208 - RNA, 17 nt, Human
cacacuucucaggacac

SEQ ID NO: 1367209 - RNA, 23 nt, Human
cacacuucucaggacacaggccu

SEQ ID NO: 1367210 - RNA, 12 nt, Human
cacacugcacaa

SEQ ID NO: 1367211 - RNA, 18 nt, Human
cacacugaugcuuagaug

SEQ ID NO: 1367212 - RNA, 14 nt, Human
cacacugaugcuua

SEQ ID NO: 1367213 - RNA, 20 nt, Human
cacacucagauccuccucau

SEQ ID NO: 1367214 - RNA, 19 nt, Human
cacacucagauccuccuca

SEQ ID NO: 1367215 - RNA, 21 nt, Human
cacacuaccgaaugugucuuu

SEQ ID NO: 1367216 - RNA, 22 nt, Human
cacacuaccgaaugugucuuua

SEQ ID NO: 1367217 - RNA, 18 nt, Human
cacacuaccgaauguguc

SEQ ID NO: 1367218 - RNA, 16 nt, Human
cacacuaccgaaugug

SEQ ID NO: 1367219 - RNA, 14 nt, Human
cacacuuacuuuuu

SEQ ID NO: 1367220 - RNA, 16 nt, Human
cacacuuacuuuuucu

SEQ ID NO: 1367221 - RNA, 22 nt, Human
cacacugggugguggccugguc

SEQ ID NO: 1367222 - RNA, 19 nt, Human
cacacugggacuugcaaaa

SEQ ID NO: 1367223 - RNA, 14 nt, Human
cacagcagccuggg

SEQ ID NO: 1367224 - RNA, 16 nt, Human
cacagccaaauuuaaa

SEQ ID NO: 1367225 - RNA, 16 nt, Human
cacagcauuguauaug

SEQ ID NO: 1367226 - RNA, 19 nt, Human
cacagccuccccugccagg

SEQ ID NO: 1367227 - RNA, 17 nt, Human
cacagccuccccugcca

SEQ ID NO: 1367228 - RNA, 14 nt, Human
cacagccuccccug

SEQ ID NO: 1367229 - RNA, 22 nt, Human
cacagccaacacgcaccugccu

SEQ ID NO: 1367230 - RNA, 12 nt, Human
cacagcagccug

SEQ ID NO: 1367231 - RNA, 16 nt, Human
cacagcaccagaaugu

SEQ ID NO: 1367232 - RNA, 19 nt, Human
cacagcaccagaauguaua

SEQ ID NO: 1367233 - RNA, 14 nt, Human
cacagauggccagc

SEQ ID NO: 1367234 - RNA, 13 nt, Human
cacagauggccag

SEQ ID NO: 1367235 - RNA, 20 nt, Human
cacagaguuguuacauuuuu

SEQ ID NO: 1367236 - RNA, 21 nt, Human
cacagaguuguuacauuuuua

SEQ ID NO: 1367237 - RNA, 13 nt, Human
cacaguuugaaau

SEQ ID NO: 1367238 - RNA, 12 nt, Human
cacauaaaacuu

SEQ ID NO: 1367239 - RNA, 15 nt, Human
cacaguuugaaauaa

SEQ ID NO: 1367240 - RNA, 18 nt, Human
cacaguugaagggagggg

SEQ ID NO: 1367241 - RNA, 23 nt, Human
cacaguucuuugggccagacaug

SEQ ID NO: 1367242 - RNA, 23 nt, Human
cacaguugaagggaggggcugug

SEQ ID NO: 1367243 - RNA, 13 nt, Human
cacaggcccuccc

SEQ ID NO: 1367244 - RNA, 16 nt, Human
cacaggaguguccucu

SEQ ID NO: 1367245 - RNA, 23 nt, Human
cacaggcagccagugcccugagc

SEQ ID NO: 1367246 - RNA, 20 nt, Human
cacaggcagccagugcccug

SEQ ID NO: 1367247 - RNA, 19 nt, Human
cacaggcagccagugcccu

SEQ ID NO: 1367248 - RNA, 17 nt, Human
cacaggcagccagugcc

SEQ ID NO: 1367249 - RNA, 16 nt, Human
cacaggcagccagugc

SEQ ID NO: 1367250 - RNA, 15 nt, Human
cacaggcagccagug

SEQ ID NO: 1367251 - RNA, 11 nt, Human
cacaggcagcc

SEQ ID NO: 1367252 - RNA, 22 nt, Human
cacaggaguguccucuucccuc

SEQ ID NO: 1367253 - RNA, 10 nt, Human
cacaggcagc

SEQ ID NO: 1367254 - RNA, 20 nt, Human
cacaggaguguccucuuccc

SEQ ID NO: 1367255 - RNA, 22 nt, Human
cacaggaagccugcaguccugg

SEQ ID NO: 1367256 - RNA, 23 nt, Human
cacagccuccccugccagggcag

SEQ ID NO: 1367257 - RNA, 21 nt, Human
cacagccuccccugccagggc

SEQ ID NO: 1367258 - RNA, 20 nt, Human
cacagccuccccugccaggg

SEQ ID NO: 1367259 - RNA, 20 nt, Human
cacaggaaccacaagacugc

SEQ ID NO: 1367260 - RNA, 18 nt, Human
caccacuagccucagggg

SEQ ID NO: 1367261 - RNA, 15 nt, Human
caccacuagccucag

SEQ ID NO: 1367262 - RNA, 19 nt, Human
caccacuacauucuguuaa

SEQ ID NO: 1367263 - RNA, 20 nt, Human
caccacuacauucuguuaau

SEQ ID NO: 1367264 - RNA, 16 nt, Human
caccacuacauucugu

SEQ ID NO: 1367265 - RNA, 17 nt, Human
caccacuacauucuguu

SEQ ID NO: 1367266 - RNA, 18 nt, Human
caccacuacauucuguua

SEQ ID NO: 1367267 - RNA, 20 nt, Human
caccacccugcucauccacu

SEQ ID NO: 1367268 - RNA, 13 nt, Human
caccaccaagcca

SEQ ID NO: 1367269 - RNA, 16 nt, Human
caccaagcuaggugcu

SEQ ID NO: 1367270 - RNA, 19 nt, Human
caccacagccagcaccugg

SEQ ID NO: 1367271 - RNA, 17 nt, Human
caccacagccagcaccu

SEQ ID NO: 1367272 - RNA, 13 nt, Human
caccacagccagc

SEQ ID NO: 1367273 - RNA, 21 nt, Human
cacauuggaagagcagcaccu

SEQ ID NO: 1367274 - RNA, 20 nt, Human
cacauugcugugaacaggaa

SEQ ID NO: 1367275 - RNA, 17 nt, Human
cacauuggaaacaaguc

SEQ ID NO: 1367276 - RNA, 18 nt, Human
cacauuggagauguuuag

SEQ ID NO: 1367277 - RNA, 15 nt, Human
cacauauuuuaaaau

SEQ ID NO: 1367278 - RNA, 14 nt, Human
cacauauuuuaaaa

SEQ ID NO: 1367279 - RNA, 12 nt, Human
cacauauuuuaa

SEQ ID NO: 1367280 - RNA, 17 nt, Human
cacauauuucagugagg

SEQ ID NO: 1367281 - RNA, 18 nt, Human
cacaucagcacgauuucu

SEQ ID NO: 1367282 - RNA, 19 nt, Human
cacaucagcacgauuucug

SEQ ID NO: 1367283 - RNA, 23 nt, Human
cacauggccccucccccugccag

SEQ ID NO: 1367284 - RNA, 20 nt, Human
cacaucacaagacuaugcca

SEQ ID NO: 1367285 - RNA, 13 nt, Human
cacaucaaagagg

SEQ ID NO: 1367286 - RNA, 17 nt, Human
cacauauuuuaaaauuu

SEQ ID NO: 1367287 - RNA, 17 nt, Human
cacauguaucuaugcau

SEQ ID NO: 1367288 - RNA, 18 nt, Human
cacaugggugaacacuca

SEQ ID NO: 1367289 - RNA, 12 nt, Human
cacauguccagu

SEQ ID NO: 1367290 - RNA, 12 nt, Human
cacaugucuuaa

SEQ ID NO: 1367291 - RNA, 13 nt, Human
cacaugucuuaau

SEQ ID NO: 1367292 - RNA, 14 nt, Human
cacaugucuuaaug

SEQ ID NO: 1367293 - RNA, 15 nt, Human
cacaugucuuaauga

SEQ ID NO: 1367294 - RNA, 15 nt, Human
cacauguuuccucua

SEQ ID NO: 1367295 - RNA, 14 nt, Human
cacauguuuccucu

SEQ ID NO: 1367296 - RNA, 12 nt, Human
cacauguuuccu

SEQ ID NO: 1367297 - RNA, 12 nt, Human
cacauguguggu

SEQ ID NO: 1367298 - RNA, 14 nt, Human
cacaugugcugccc

SEQ ID NO: 1367299 - RNA, 22 nt, Human
cacaugugagcaugucacuucc

SEQ ID NO: 1367300 - RNA, 16 nt, Human
cacaugucuuaaugaa

SEQ ID NO: 1367301 - RNA, 17 nt, Human
cacaugucuuaaugaag

SEQ ID NO: 1367302 - RNA, 18 nt, Human
cacaugucuuaaugaagu

SEQ ID NO: 1367303 - RNA, 22 nt, Human
cacaugucuuaaugaaguuuga

SEQ ID NO: 1367304 - RNA, 23 nt, Human
cacaugucuuaaugaaguuugaa

SEQ ID NO: 1367305 - RNA, 21 nt, Human
cacauuaggaaaaguugcuau

SEQ ID NO: 1367306 - RNA, 21 nt, Human
cacauuagaagacaauugaca

SEQ ID NO: 1367307 - RNA, 20 nt, Human
cacauuaaagaagaccugag

SEQ ID NO: 1367308 - RNA, 16 nt, Human
cacauuaaagaagacc

SEQ ID NO: 1367309 - RNA, 12 nt, Human
cacauuaaagaa

SEQ ID NO: 1367310 - RNA, 15 nt, Human
cacauguuuucucug

SEQ ID NO: 1367311 - RNA, 23 nt, Human
cacauucagggcuauuuuuuccc

SEQ ID NO: 1367312 - RNA, 22 nt, Human
cacauucaaaauaggguauauu

SEQ ID NO: 1367313 - RNA, 16 nt, Human
cacauuccugaacagg

SEQ ID NO: 1367314 - RNA, 13 nt, Human
caaggaaaggcac

SEQ ID NO: 1367315 - RNA, 16 nt, Human
caagcggugucucucc

SEQ ID NO: 1367316 - RNA, 15 nt, Human
caagcggugucucuc

SEQ ID NO: 1367317 - RNA, 13 nt, Human
caagcggugucuc

SEQ ID NO: 1367318 - RNA, 15 nt, Human
caaggaaaaacaggu

SEQ ID NO: 1367319 - RNA, 17 nt, Human
caaggauagaugcuggc

SEQ ID NO: 1367320 - RNA, 16 nt, Human
caaggauagaugcugg

SEQ ID NO: 1367321 - RNA, 15 nt, Human
caaggauagaugcug

SEQ ID NO: 1367322 - RNA, 17 nt, Human
caaggauagaaguauac

SEQ ID NO: 1367323 - RNA, 16 nt, Human
caaggagucagacauu

SEQ ID NO: 1367324 - RNA, 18 nt, Human
caaggagucacugagacc

SEQ ID NO: 1367325 - RNA, 17 nt, Human
caaggagucacugagac

SEQ ID NO: 1367326 - RNA, 23 nt, Human
caaggauagaugcuggcccaggg

SEQ ID NO: 1367327 - RNA, 22 nt, Human
caaggauagaugcuggcccagg

SEQ ID NO: 1367328 - RNA, 21 nt, Human
caaggauagaugcuggcccag

SEQ ID NO: 1367329 - RNA, 20 nt, Human
caaggauagaugcuggccca

SEQ ID NO: 1367330 - RNA, 23 nt, Human
caagccaagggaaccuguguccg

SEQ ID NO: 1367331 - RNA, 22 nt, Human
caagccaagggaaccugugucc

SEQ ID NO: 1367332 - RNA, 21 nt, Human
caagccaagggaaccuguguc

SEQ ID NO: 1367333 - RNA, 18 nt, Human
caagaaacugaggaauuu

SEQ ID NO: 1367334 - RNA, 18 nt, Human
caagaaaauaagagcuca

SEQ ID NO: 1367335 - RNA, 20 nt, Human
caagaaaauaagagcucagg

SEQ ID NO: 1367336 - RNA, 23 nt, Human
caagaaaacaggcacugcccugg

SEQ ID NO: 1367337 - RNA, 22 nt, Human
caagaaaacaggcacugcccug

SEQ ID NO: 1367338 - RNA, 21 nt, Human
caagaaaacaggcacugcccu

SEQ ID NO: 1367339 - RNA, 20 nt, Human
caagaaaacaggcacugccc

SEQ ID NO: 1367340 - RNA, 19 nt, Human
caagaaaacaggcacugcc

SEQ ID NO: 1367341 - RNA, 19 nt, Human
caagaaacugaggaauuuu

SEQ ID NO: 1367342 - RNA, 18 nt, Human
caagccaagggaaccugu

SEQ ID NO: 1367343 - RNA, 14 nt, Human
caagcacuucuuuu

SEQ ID NO: 1367344 - RNA, 17 nt, Human
caagcacuaaacaaaga

SEQ ID NO: 1367345 - RNA, 18 nt, Human
caaguccugccucuuaaa

SEQ ID NO: 1367346 - RNA, 13 nt, Human
caaggucuuuaaa

SEQ ID NO: 1367347 - RNA, 14 nt, Human
caaggucuuugguu

SEQ ID NO: 1367348 - RNA, 14 nt, Human
caaggucugcuuuu

SEQ ID NO: 1367349 - RNA, 20 nt, Human
caagggcuuuguuuugcaca

SEQ ID NO: 1367350 - RNA, 20 nt, Human
caagucuguuuacugcaagg

SEQ ID NO: 1367351 - RNA, 14 nt, Human
caagucuguuuacu

SEQ ID NO: 1367352 - RNA, 21 nt, Human
caagucuuucucuuucccugg

SEQ ID NO: 1367353 - RNA, 20 nt, Human
caagucuuucucuuucccug

SEQ ID NO: 1367354 - RNA, 19 nt, Human
caagucuuucucuuucccu

SEQ ID NO: 1367355 - RNA, 17 nt, Human
caagucuuucucuuucc

SEQ ID NO: 1367356 - RNA, 17 nt, Human
caaguggguacccccag

SEQ ID NO: 1367357 - RNA, 19 nt, Human
caaguggguacccccagga

SEQ ID NO: 1367358 - RNA, 23 nt, Human
caagucuuucucuuucccugguc

SEQ ID NO: 1367359 - RNA, 22 nt, Human
caagugcagggccuguaauccc

SEQ ID NO: 1367360 - RNA, 23 nt, Human
caacauguuauuuguaauagaug

SEQ ID NO: 1367361 - RNA, 20 nt, Human
caacauguuuccagcauucc

SEQ ID NO: 1367362 - RNA, 23 nt, Human
caacauguugggaaacuuggcuc

SEQ ID NO: 1367363 - RNA, 22 nt, Human
caacauguugggaaacuuggcu

SEQ ID NO: 1367364 - RNA, 19 nt, Human
caacauguugggaaacuug

SEQ ID NO: 1367365 - RNA, 22 nt, Human
caacauguuauuuguaauagau

SEQ ID NO: 1367366 - RNA, 15 nt, Human
caacauguuauuugu

SEQ ID NO: 1367367 - RNA, 13 nt, Human
caacauggcuuug

SEQ ID NO: 1367368 - RNA, 12 nt, Human
caacauggcuuu

SEQ ID NO: 1367369 - RNA, 22 nt, Human
caacaugaugagguaguaccuu

SEQ ID NO: 1367370 - RNA, 15 nt, Human
caacaugcacugaug

SEQ ID NO: 1367371 - RNA, 15 nt, Human
caacaugaugaggua

SEQ ID NO: 1367372 - RNA, 19 nt, Human
caacaugaggccacuggag

SEQ ID NO: 1367373 - RNA, 14 nt, Human
caaccacacccaca

SEQ ID NO: 1367374 - RNA, 14 nt, Human
caaccaauggaaug

SEQ ID NO: 1367375 - RNA, 22 nt, Human
caaccaagaauguuaugugcaa

SEQ ID NO: 1367376 - RNA, 17 nt, Human
caacauuucucaauaau

SEQ ID NO: 1367377 - RNA, 16 nt, Human
caacauuucucaauaa

SEQ ID NO: 1367378 - RNA, 14 nt, Human
caacauuucucaau

SEQ ID NO: 1367379 - RNA, 22 nt, Human
caacauuucuauagccaaaaau

SEQ ID NO: 1367380 - RNA, 16 nt, Human
caacauuguagccuca

SEQ ID NO: 1367381 - RNA, 16 nt, Human
caacaucacagcccag

SEQ ID NO: 1367382 - RNA, 14 nt, Human
caacaucacagccc

SEQ ID NO: 1367383 - RNA, 16 nt, Human
caacagugaagacaga

SEQ ID NO: 1367384 - RNA, 17 nt, Human
caacaguaaaccacuga

SEQ ID NO: 1367385 - RNA, 22 nt, Human
caacaguaaaccacugaaaaaa

SEQ ID NO: 1367386 - RNA, 17 nt, Human
caacaucacagcccagc

SEQ ID NO: 1367387 - RNA, 20 nt, Human
caacaucacagcccagcccg

SEQ ID NO: 1367388 - RNA, 15 nt, Human
caacaguaaaccacu

SEQ ID NO: 1367389 - RNA, 19 nt, Human
caaauuuaaaacuguugga

SEQ ID NO: 1367390 - RNA, 16 nt, Human
caaauucgcaaacuuu

SEQ ID NO: 1367391 - RNA, 15 nt, Human
caaauucugucucug

SEQ ID NO: 1367392 - RNA, 18 nt, Human
caaauucugucucuggau

SEQ ID NO: 1367393 - RNA, 18 nt, Human
caacccuucccucaccuu

SEQ ID NO: 1367394 - RNA, 17 nt, Human
caacccuucccucaccu

SEQ ID NO: 1367395 - RNA, 22 nt, Human
caacccucagggcaaagccagg

SEQ ID NO: 1367396 - RNA, 21 nt, Human
caacccucagggcaaagccag

SEQ ID NO: 1367397 - RNA, 13 nt, Human
caacccucagggc

SEQ ID NO: 1367398 - RNA, 12 nt, Human
caacccucaggg

SEQ ID NO: 1367399 - RNA, 11 nt, Human
caacccucagg

SEQ ID NO: 1367400 - RNA, 24 nt, Human
caaccugaauacccuuuucugacc

SEQ ID NO: 1367401 - RNA, 15 nt, Human
caaccucuuggccug

SEQ ID NO: 1367402 - RNA, 13 nt, Human
caaccucuuggcc

SEQ ID NO: 1367403 - RNA, 21 nt, Human
caaccugaauacccuuuucug

SEQ ID NO: 1367404 - RNA, 14 nt, Human
caacgcuauuccag

SEQ ID NO: 1367405 - RNA, 15 nt, Human
caacugccuacucca

SEQ ID NO: 1367406 - RNA, 14 nt, Human
caacugccuacucc

SEQ ID NO: 1367407 - RNA, 21 nt, Human
caacucuucccccucucccag

SEQ ID NO: 1367408 - RNA, 22 nt, Human
caacucucuuauugccucacuu

SEQ ID NO: 1367409 - RNA, 21 nt, Human
caacucucuuauugccucacu

SEQ ID NO: 1367410 - RNA, 16 nt, Human
caacucucuuauugcc

SEQ ID NO: 1367411 - RNA, 13 nt, Human
caacucucuuauu

SEQ ID NO: 1367412 - RNA, 21 nt, Human
caacucugaaggguaauuaua

SEQ ID NO: 1367413 - RNA, 22 nt, Human
caacuuaauacucaaaugagua

SEQ ID NO: 1367414 - RNA, 22 nt, Human
caacugcucccaccuccugaca

SEQ ID NO: 1367415 - RNA, 19 nt, Human
caacugcucccaccuccug

SEQ ID NO: 1367416 - RNA, 23 nt, Human
caacugccucgaaacacagaaac

SEQ ID NO: 1367417 - RNA, 21 nt, Human
caacugccucgaaacacagaa

SEQ ID NO: 1367418 - RNA, 22 nt, Human
caacugccuacuccaaaauguu

SEQ ID NO: 1367419 - RNA, 18 nt, Human
caacugccuacuccaaaa

SEQ ID NO: 1367420 - RNA, 18 nt, Human
caacugcucccaccuccu

SEQ ID NO: 1367421 - RNA, 17 nt, Human
caacugcucccaccucc

SEQ ID NO: 1367422 - RNA, 15 nt, Human
caacugcucccaccu

SEQ ID NO: 1367423 - RNA, 14 nt, Human
caacugcucccacc

SEQ ID NO: 1367424 - RNA, 11 nt, Human
caacugcuccc

SEQ ID NO: 1367425 - RNA, 15 nt, Human
caacugcuaaucuac

SEQ ID NO: 1367426 - RNA, 14 nt, Human
caacuucuaauugc

SEQ ID NO: 1367427 - RNA, 14 nt, Human
caacuucguuuccu

SEQ ID NO: 1367428 - RNA, 11 nt, Human
caacuuauuaa

SEQ ID NO: 1367429 - RNA, 14 nt, Human
caacuucaguccaa

SEQ ID NO: 1367430 - RNA, 11 nt, Human
caacuuuguau

SEQ ID NO: 1367431 - RNA, 17 nt, Human
caagaaaacaggcacug

SEQ ID NO: 1367432 - RNA, 16 nt, Human
caagaaaacaggcacu

SEQ ID NO: 1367433 - RNA, 15 nt, Human
caagaaaacaggcac

SEQ ID NO: 1367434 - RNA, 12 nt, Human
caacuuuguaua

SEQ ID NO: 1367435 - RNA, 16 nt, Human
caacuucuaauugcca

SEQ ID NO: 1367436 - RNA, 18 nt, Human
caaaugugcuuugagaag

SEQ ID NO: 1367437 - RNA, 14 nt, Human
caaaugugcuuuga

SEQ ID NO: 1367438 - RNA, 12 nt, Human
caaauguucuaa

SEQ ID NO: 1367439 - RNA, 16 nt, Human
caaauguuaaaaugug

SEQ ID NO: 1367440 - RNA, 15 nt, Human
caaauguuaaaaugu

SEQ ID NO: 1367441 - RNA, 21 nt, Human
caaauguucuaaguuucuaag

SEQ ID NO: 1367442 - RNA, 19 nt, Human
caaauguucuaaguuucua

SEQ ID NO: 1367443 - RNA, 15 nt, Human
caaauguucuaaguu

SEQ ID NO: 1367444 - RNA, 14 nt, Human
caaauguucuaagu

SEQ ID NO: 1367445 - RNA, 23 nt, Human
caaauguucuaaguuucuaagau

SEQ ID NO: 1367446 - RNA, 22 nt, Human
caaauguucuaaguuucuaaga

SEQ ID NO: 1367447 - RNA, 18 nt, Human
caaauucaguuucauaaa

SEQ ID NO: 1367448 - RNA, 20 nt, Human
caaauucaguuucauaaaag

SEQ ID NO: 1367449 - RNA, 17 nt, Human
caaauucaguuucauaa

SEQ ID NO: 1367450 - RNA, 22 nt, Human
caaaucagaagucaucuugcua

SEQ ID NO: 1367451 - RNA, 15 nt, Human
caaaucagaagucau

SEQ ID NO: 1367452 - RNA, 14 nt, Human
caaaucagaaguca

SEQ ID NO: 1367453 - RNA, 15 nt, Human
caaaucacugaacuu

SEQ ID NO: 1367454 - RNA, 15 nt, Human
caaaucaccacaaac

SEQ ID NO: 1367455 - RNA, 20 nt, Human
caaaucaccacaaacuguaa

SEQ ID NO: 1367456 - RNA, 19 nt, Human
caaaucaccacaaacugua

SEQ ID NO: 1367457 - RNA, 14 nt, Human
caaaucacugaacu

SEQ ID NO: 1367458 - RNA, 18 nt, Human
caaauaaaaagugcuuuu

SEQ ID NO: 1367459 - RNA, 17 nt, Human
caaauaaaaagugcuuu

SEQ ID NO: 1367460 - RNA, 19 nt, Human
caaaguuuaccagaaagca

SEQ ID NO: 1367461 - RNA, 20 nt, Human
caaaguuuaauaaauuuauu

SEQ ID NO: 1367462 - RNA, 13 nt, Human
caaaggaugugau

SEQ ID NO: 1367463 - RNA, 15 nt, Human
caaaggcaagcacuu

SEQ ID NO: 1367464 - RNA, 21 nt, Human
caaaggaugugauauauaagu

SEQ ID NO: 1367465 - RNA, 17 nt, Human
caaaggaugugauauau

SEQ ID NO: 1367466 - RNA, 14 nt, Human
caaaggaugugaua

SEQ ID NO: 1367467 - RNA, 13 nt, Human
caaaguuuaauaa

SEQ ID NO: 1367468 - RNA, 22 nt, Human
caaaguuguuguaaccugcugu

SEQ ID NO: 1367469 - RNA, 15 nt, Human
caaaguuguuguaac

SEQ ID NO: 1367470 - RNA, 19 nt, Human
caaauacauuuaaaacauu

SEQ ID NO: 1367471 - RNA, 20 nt, Human
caaauaauuuuucacuucaa

SEQ ID NO: 1367472 - RNA, 18 nt, Human
caaauaggaugcuuggga

SEQ ID NO: 1367473 - RNA, 15 nt, Human
caaauagcauaaguu

SEQ ID NO: 1367474 - RNA, 16 nt, Human
caaauagaaaaugguc

SEQ ID NO: 1367475 - RNA, 12 nt, Human
caaauauauuca

SEQ ID NO: 1367476 - RNA, 16 nt, Human
caaagcuuuuuccaga

SEQ ID NO: 1367477 - RNA, 23 nt, Human
caaagcuuuccugccccaggccu

SEQ ID NO: 1367478 - RNA, 22 nt, Human
caaagcuuuccugccccaggcc

SEQ ID NO: 1367479 - RNA, 18 nt, Human
caaagcuuuccugcccca

SEQ ID NO: 1367480 - RNA, 18 nt, Human
caaaggagcgagcauguc

SEQ ID NO: 1367481 - RNA, 16 nt, Human
caaagcuuuccugccc

SEQ ID NO: 1367482 - RNA, 14 nt, Human
caaagcuuuccugc

SEQ ID NO: 1367483 - RNA, 13 nt, Human
caaagcuuuccug

SEQ ID NO: 1367484 - RNA, 19 nt, Human
caaagcaugggauuauuag

SEQ ID NO: 1367485 - RNA, 13 nt, Human
caaagagguauuu

SEQ ID NO: 1367486 - RNA, 23 nt, Human
caaagaggcugccccucucacca

SEQ ID NO: 1367487 - RNA, 22 nt, Human
caaagaggcugccccucucacc

SEQ ID NO: 1367488 - RNA, 21 nt, Human
caaagaggcugccccucucac

SEQ ID NO: 1367489 - RNA, 16 nt, Human
caaagaggcugccccu

SEQ ID NO: 1367490 - RNA, 15 nt, Human
caaagaggcugcccc

SEQ ID NO: 1367491 - RNA, 13 nt, Human
caaagaggcugcc

SEQ ID NO: 1367492 - RNA, 12 nt, Human
caaagaggcugc

SEQ ID NO: 1367493 - RNA, 22 nt, Human
caaagaggcugaggcuggcaca

SEQ ID NO: 1367494 - RNA, 20 nt, Human
caaagaggcugaggcuggca

SEQ ID NO: 1367495 - RNA, 14 nt, Human
caaagaaaguguau

SEQ ID NO: 1367496 - RNA, 13 nt, Human
caaagaaagugua

SEQ ID NO: 1367497 - RNA, 17 nt, Human
caaagaaacaaagaugu

SEQ ID NO: 1367498 - RNA, 16 nt, Human
caaagaaacaaagaug

SEQ ID NO: 1367499 - RNA, 20 nt, Human
caaacuuugcaucucaguau

SEQ ID NO: 1367500 - RNA, 13 nt, Human
caaacuuugcauc

SEQ ID NO: 1367501 - RNA, 12 nt, Human
caaacuuugcau

SEQ ID NO: 1367502 - RNA, 18 nt, Human
caaacuuuuauacucuuu

SEQ ID NO: 1367503 - RNA, 18 nt, Human
caaacuuggauacuugga

SEQ ID NO: 1367504 - RNA, 18 nt, Human
auuuuuuuaauuuacaaa

SEQ ID NO: 1367505 - RNA, 18 nt, Human
auuuuuuuacuaauagac

SEQ ID NO: 1367506 - RNA, 17 nt, Human
auuuuuuuagaaagcau

SEQ ID NO: 1367507 - RNA, 23 nt, Human
auuuuuuuagaaagcauuugaau

SEQ ID NO: 1367508 - RNA, 14 nt, Human
caaaaaagaaaacc

SEQ ID NO: 1367509 - RNA, 12 nt, Human
caaaaaagaaaa

SEQ ID NO: 1367510 - RNA, 11 nt, Human
caaaaaacuac

SEQ ID NO: 1367511 - RNA, 15 nt, Human
caaaaaacuacuucu

SEQ ID NO: 1367512 - RNA, 23 nt, Human
caccacugcccccugcugccaug

SEQ ID NO: 1367513 - RNA, 21 nt, Human
caccacucuggcagccacacu

SEQ ID NO: 1367514 - RNA, 19 nt, Human
caccacucuggcagccaca

SEQ ID NO: 1367515 - RNA, 18 nt, Human
caccacucuggcagccac

SEQ ID NO: 1367516 - RNA, 17 nt, Human
caccacucuggcagcca

SEQ ID NO: 1367517 - RNA, 15 nt, Human
caccacucuggcagc

SEQ ID NO: 1367518 - RNA, 14 nt, Human
caccacucuggcag

SEQ ID NO: 1367519 - RNA, 13 nt, Human
caccacucuggca

SEQ ID NO: 1367520 - RNA, 12 nt, Human
caccacucuggc

SEQ ID NO: 1367521 - RNA, 20 nt, Human
cacccaccaacccucagggc

SEQ ID NO: 1367522 - RNA, 18 nt, Human
cacccaccaacccucagg

SEQ ID NO: 1367523 - RNA, 17 nt, Human
cacccaccaacccucag

SEQ ID NO: 1367524 - RNA, 16 nt, Human
cacccaccaacccuca

SEQ ID NO: 1367525 - RNA, 17 nt, Human
cacccaauucaaaacau

SEQ ID NO: 1367526 - RNA, 16 nt, Human
cacccaauucaaaaca

SEQ ID NO: 1367527 - RNA, 14 nt, Human
caccagacacccag

SEQ ID NO: 1367528 - RNA, 17 nt, Human
caccccauucccgcagu

SEQ ID NO: 1367529 - RNA, 15 nt, Human
caccccauucccgca

SEQ ID NO: 1367530 - RNA, 13 nt, Human
caccccauucccg

SEQ ID NO: 1367531 - RNA, 14 nt, Human
caccccaugcuggc

SEQ ID NO: 1367532 - RNA, 15 nt, Human
caccccaugcuggcc

SEQ ID NO: 1367533 - RNA, 20 nt, Human
caccccaugcuggccuugcc

SEQ ID NO: 1367534 - RNA, 19 nt, Human
caccccagggcagccaggg

SEQ ID NO: 1367535 - RNA, 22 nt, Human
caccccagggcagccagggaga

SEQ ID NO: 1367536 - RNA, 18 nt, Human
caccccagggcagccagg

SEQ ID NO: 1367537 - RNA, 16 nt, Human
caccccagggcagcca

SEQ ID NO: 1367538 - RNA, 13 nt, Human
caccccagggcag

SEQ ID NO: 1367539 - RNA, 16 nt, Human
cacccaccccugcaca

SEQ ID NO: 1367540 - RNA, 14 nt, Human
cacccaccccugca

SEQ ID NO: 1367541 - RNA, 22 nt, Human
cacccaccaguugaauuucauc

SEQ ID NO: 1367542 - RNA, 17 nt, Human
cacccccugcagcuugu

SEQ ID NO: 1367543 - RNA, 14 nt, Human
cacccccugcagcu

SEQ ID NO: 1367544 - RNA, 13 nt, Human
cacccccugcagc

SEQ ID NO: 1367545 - RNA, 12 nt, Human
cacccccugcag

SEQ ID NO: 1367546 - RNA, 18 nt, Human
cacccccucaccccucca

SEQ ID NO: 1367547 - RNA, 11 nt, Human
cacccccguca

SEQ ID NO: 1367548 - RNA, 21 nt, Human
cacccccggcagcagccccca

SEQ ID NO: 1367549 - RNA, 18 nt, Human
cacccccggcagcagccc

SEQ ID NO: 1367550 - RNA, 18 nt, Human
cacccccuucuccaucca

SEQ ID NO: 1367551 - RNA, 16 nt, Human
caccccgccugcccuc

SEQ ID NO: 1367552 - RNA, 14 nt, Human
cacccccuuuccug

SEQ ID NO: 1367553 - RNA, 12 nt, Human
cacccccuuucc

SEQ ID NO: 1367554 - RNA, 16 nt, Human
caccccgacuuuuguu

SEQ ID NO: 1367555 - RNA, 15 nt, Human
caccccccaagcugu

SEQ ID NO: 1367556 - RNA, 14 nt, Human
caccccccaagcug

SEQ ID NO: 1367557 - RNA, 12 nt, Human
cacccccagcuu

SEQ ID NO: 1367558 - RNA, 14 nt, Human
cacccccagcucaa

SEQ ID NO: 1367559 - RNA, 13 nt, Human
cacccccagcuca

SEQ ID NO: 1367560 - RNA, 12 nt, Human
cacccccagcuc

SEQ ID NO: 1367561 - RNA, 19 nt, Human
cacccccagccugggccua

SEQ ID NO: 1367562 - RNA, 18 nt, Human
cacccccagccugggccu

SEQ ID NO: 1367563 - RNA, 17 nt, Human
cacccccagccugggcc

SEQ ID NO: 1367564 - RNA, 16 nt, Human
cacccccagccugggc

SEQ ID NO: 1367565 - RNA, 15 nt, Human
cacccccagccuggg

SEQ ID NO: 1367566 - RNA, 14 nt, Human
cacccccagccugg

SEQ ID NO: 1367567 - RNA, 13 nt, Human
cacccccagccug

SEQ ID NO: 1367568 - RNA, 12 nt, Human
cacccccagccu

SEQ ID NO: 1367569 - RNA, 17 nt, Human
cacccccacccccagcu

SEQ ID NO: 1367570 - RNA, 14 nt, Human
cacccccaccccca

SEQ ID NO: 1367571 - RNA, 11 nt, Human
cacccccaccc

SEQ ID NO: 1367572 - RNA, 12 nt, Human
cacccccaaggu

SEQ ID NO: 1367573 - RNA, 19 nt, Human
caccccauucccgcagugg

SEQ ID NO: 1367574 - RNA, 23 nt, Human
caccccuaaaagaaacccugcac

SEQ ID NO: 1367575 - RNA, 21 nt, Human
ccagauugacgacaagugcug

SEQ ID NO: 1367576 - RNA, 19 nt, Human
ccagauugacgacaagugc

SEQ ID NO: 1367577 - RNA, 18 nt, Human
ccagauugacgacaagug

SEQ ID NO: 1367578 - RNA, 13 nt, Human
ccagauugacgac

SEQ ID NO: 1367579 - RNA, 20 nt, Human
ccagagcuacccgcagaguu

SEQ ID NO: 1367580 - RNA, 20 nt, Human
ccagagccuggggcucuaac

SEQ ID NO: 1367581 - RNA, 18 nt, Human
ccagagccuggggcucua

SEQ ID NO: 1367582 - RNA, 16 nt, Human
ccagagccuggggcuc

SEQ ID NO: 1367583 - RNA, 15 nt, Human
ccagagccuggggcu

SEQ ID NO: 1367584 - RNA, 14 nt, Human
ccagagccuggggc

SEQ ID NO: 1367585 - RNA, 13 nt, Human
ccagagccugggg

SEQ ID NO: 1367586 - RNA, 12 nt, Human
ccagagccuggg

SEQ ID NO: 1367587 - RNA, 11 nt, Human
ccagagccugg

SEQ ID NO: 1367588 - RNA, 15 nt, Human
ccagagcccaggcuc

SEQ ID NO: 1367589 - RNA, 14 nt, Human
ccagagcccaggcu

SEQ ID NO: 1367590 - RNA, 18 nt, Human
ccagagcccagcuccaag

SEQ ID NO: 1367591 - RNA, 17 nt, Human
ccagagcccagcuccaa

SEQ ID NO: 1367592 - RNA, 11 nt, Human
ccagagcccac

SEQ ID NO: 1367593 - RNA, 16 nt, Human
ccagauuuuuacacau

SEQ ID NO: 1367594 - RNA, 24 nt, Human
ccagcaaagcccccagagcccagg

SEQ ID NO: 1367595 - RNA, 21 nt, Human
ccagcaaagcccccagagccc

SEQ ID NO: 1367596 - RNA, 19 nt, Human
ccagcaaagcccccagagc

SEQ ID NO: 1367597 - RNA, 17 nt, Human
ccagcaaagcccccaga

SEQ ID NO: 1367598 - RNA, 16 nt, Human
ccagcaaagcccccag

SEQ ID NO: 1367599 - RNA, 15 nt, Human
ccagcaaagccccca

SEQ ID NO: 1367600 - RNA, 21 nt, Human
ccagauuugcuaauuuauccu

SEQ ID NO: 1367601 - RNA, 22 nt, Human
ccagauuuuuuaaaauuuauau

SEQ ID NO: 1367602 - RNA, 17 nt, Human
ccagcacagcuugaccu

SEQ ID NO: 1367603 - RNA, 13 nt, Human
ccagcacagcuug

SEQ ID NO: 1367604 - RNA, 22 nt, Human
ccagcacagcuuagauuucaua

SEQ ID NO: 1367605 - RNA, 20 nt, Human
ccagcacagcuuagauuuca

SEQ ID NO: 1367606 - RNA, 19 nt, Human
ccagcacagcuuagauuuc

SEQ ID NO: 1367607 - RNA, 16 nt, Human
ccagcacacagggcag

SEQ ID NO: 1367608 - RNA, 23 nt, Human
ccagcaaagcccccagagcccag

SEQ ID NO: 1367609 - RNA, 21 nt, Human
ccagcaccggaccagccuggc

SEQ ID NO: 1367610 - RNA, 15 nt, Human
ccagcaccuggcauc

SEQ ID NO: 1367611 - RNA, 18 nt, Human
ccagcaccggaccagccu

SEQ ID NO: 1367612 - RNA, 20 nt, Human
ccagcaccggaccagccugg

SEQ ID NO: 1367613 - RNA, 19 nt, Human
ccagcaccggaccagccug

SEQ ID NO: 1367614 - RNA, 21 nt, Human
ccagcccugccuggaggaccu

SEQ ID NO: 1367615 - RNA, 22 nt, Human
ccagcccugccuggaggaccug

SEQ ID NO: 1367616 - RNA, 18 nt, Human
ccagcccugccuggagga

SEQ ID NO: 1367617 - RNA, 17 nt, Human
ccagcccugccuggagg

SEQ ID NO: 1367618 - RNA, 16 nt, Human
ccagcccugccuggag

SEQ ID NO: 1367619 - RNA, 15 nt, Human
ccagcccugccugga

SEQ ID NO: 1367620 - RNA, 14 nt, Human
ccagcccugccugg

SEQ ID NO: 1367621 - RNA, 13 nt, Human
ccagcccugccug

SEQ ID NO: 1367622 - RNA, 14 nt, Human
ccagcccauggaga

SEQ ID NO: 1367623 - RNA, 21 nt, Human
ccagcccagggcuccugcacu

SEQ ID NO: 1367624 - RNA, 19 nt, Human
ccagcccagggcuccugca

SEQ ID NO: 1367625 - RNA, 17 nt, Human
ccagcccagggcuccug

SEQ ID NO: 1367626 - RNA, 23 nt, Human
ccagcccauggagauugaccugg

SEQ ID NO: 1367627 - RNA, 20 nt, Human
ccagccggggcgaguggcac

SEQ ID NO: 1367628 - RNA, 21 nt, Human
ccagccggggcgaguggcacg

SEQ ID NO: 1367629 - RNA, 23 nt, Human
ccagccgcuuggcgaugccagcc

SEQ ID NO: 1367630 - RNA, 22 nt, Human
ccagccgcuuggcgaugccagc

SEQ ID NO: 1367631 - RNA, 19 nt, Human
ccagccgcgcaucagacug

SEQ ID NO: 1367632 - RNA, 23 nt, Human
ccagccgacccccucucccugca

SEQ ID NO: 1367633 - RNA, 22 nt, Human
ccagccgacccccucucccugc

SEQ ID NO: 1367634 - RNA, 20 nt, Human
ccagccgacccccucucccu

SEQ ID NO: 1367635 - RNA, 18 nt, Human
ccagccgacccccucucc

SEQ ID NO: 1367636 - RNA, 15 nt, Human
ccagcccagggcucc

SEQ ID NO: 1367637 - RNA, 14 nt, Human
ccagcccagggcuc

SEQ ID NO: 1367638 - RNA, 13 nt, Human
ccagcccagggcu

SEQ ID NO: 1367639 - RNA, 16 nt, Human
ccagcccagccccacu

SEQ ID NO: 1367640 - RNA, 23 nt, Human
ccagcccagagacauacuugaag

SEQ ID NO: 1367641 - RNA, 22 nt, Human
ccagcccagagacauacuugaa

SEQ ID NO: 1367642 - RNA, 14 nt, Human
ccagcccagagaca

SEQ ID NO: 1367643 - RNA, 13 nt, Human
ccagcccagagac

SEQ ID NO: 1367644 - RNA, 12 nt, Human
ccagcccagaga

SEQ ID NO: 1367645 - RNA, 11 nt, Human
ccagcccagag

SEQ ID NO: 1367646 - RNA, 18 nt, Human
ccagcccacccccggcag

SEQ ID NO: 1367647 - RNA, 21 nt, Human
ccagcccacccccggcagcag

SEQ ID NO: 1367648 - RNA, 17 nt, Human
ccagcccacccccggca

SEQ ID NO: 1367649 - RNA, 14 nt, Human
ccagcccacccccg

SEQ ID NO: 1367650 - RNA, 13 nt, Human
ccagcccaccccc

SEQ ID NO: 1367651 - RNA, 20 nt, Human
ccagccaucaagagacugag

SEQ ID NO: 1367652 - RNA, 18 nt, Human
ccagccaucaagagacug

SEQ ID NO: 1367653 - RNA, 18 nt, Human
ccagccaucaaaaugcuu

SEQ ID NO: 1367654 - RNA, 16 nt, Human
ccagccaucaaaaugc

SEQ ID NO: 1367655 - RNA, 20 nt, Human
ccagccugggaaagccccug

SEQ ID NO: 1367656 - RNA, 22 nt, Human
ccagccuggccuccugccucua

SEQ ID NO: 1367657 - RNA, 21 nt, Human
ccagccuggccuccugccucu

SEQ ID NO: 1367658 - RNA, 20 nt, Human
ccagccuggccuccugccuc

SEQ ID NO: 1367659 - RNA, 13 nt, Human
ccagccugggccu

SEQ ID NO: 1367660 - RNA, 11 nt, Human
ccagccugggc

SEQ ID NO: 1367661 - RNA, 12 nt, Human
ccagccugggcc

SEQ ID NO: 1367662 - RNA, 21 nt, Human
ccagccugggccuauggagag

SEQ ID NO: 1367663 - RNA, 19 nt, Human
ccagccugggccuauggag

SEQ ID NO: 1367664 - RNA, 17 nt, Human
ccagccugggccuaugg

SEQ ID NO: 1367665 - RNA, 14 nt, Human
ccagccugggccua

SEQ ID NO: 1367666 - RNA, 20 nt, Human
ccagcuccggccuguccucc

SEQ ID NO: 1367667 - RNA, 19 nt, Human
ccagcuccggccuguccuc

SEQ ID NO: 1367668 - RNA, 18 nt, Human
ccagcuccggccuguccu

SEQ ID NO: 1367669 - RNA, 17 nt, Human
ccagcucccuucuuccc

SEQ ID NO: 1367670 - RNA, 22 nt, Human
ccagcucccugugcccccaggg

SEQ ID NO: 1367671 - RNA, 19 nt, Human
ccagcucccugugccccca

SEQ ID NO: 1367672 - RNA, 18 nt, Human
ccagcucccugugccccc

SEQ ID NO: 1367673 - RNA, 23 nt, Human
ccagccuuuguuccccacuggag

SEQ ID NO: 1367674 - RNA, 21 nt, Human
ccagccuuuguuccccacugg

SEQ ID NO: 1367675 - RNA, 16 nt, Human
ccagccuuuguucccc

SEQ ID NO: 1367676 - RNA, 15 nt, Human
ccagccuuuguuccc

SEQ ID NO: 1367677 - RNA, 10 nt, Human
ccagccuguc

SEQ ID NO: 1367678 - RNA, 18 nt, Human
ccagccugucagauccag

SEQ ID NO: 1367679 - RNA, 13 nt, Human
ccagccugggguc

SEQ ID NO: 1367680 - RNA, 22 nt, Human
ccagccugggccuauggagagc

SEQ ID NO: 1367681 - RNA, 21 nt, Human
ccagccuggggcugaggcuga

SEQ ID NO: 1367682 - RNA, 21 nt, Human
ccaccugguacucccucucag

SEQ ID NO: 1367683 - RNA, 22 nt, Human
ccaccuggcucucaccucuagg

SEQ ID NO: 1367684 - RNA, 19 nt, Human
ccaccuggcucucaccucu

SEQ ID NO: 1367685 - RNA, 18 nt, Human
ccaccuggcucucaccuc

SEQ ID NO: 1367686 - RNA, 15 nt, Human
ccaccuggcucucac

SEQ ID NO: 1367687 - RNA, 12 nt, Human
ccaccuggcuca

SEQ ID NO: 1367688 - RNA, 20 nt, Human
ccaccuggaccccugcauug

SEQ ID NO: 1367689 - RNA, 21 nt, Human
ccaccuggaccccugcauugg

SEQ ID NO: 1367690 - RNA, 19 nt, Human
ccaccuggaccccugcauu

SEQ ID NO: 1367691 - RNA, 18 nt, Human
ccaccuggaccccugcau

SEQ ID NO: 1367692 - RNA, 17 nt, Human
ccaccuggaccccugca

SEQ ID NO: 1367693 - RNA, 12 nt, Human
ccaccuggaccc

SEQ ID NO: 1367694 - RNA, 11 nt, Human
ccaccuggacc

SEQ ID NO: 1367695 - RNA, 17 nt, Human
ccaccucugcugccucc

SEQ ID NO: 1367696 - RNA, 13 nt, Human
ccaccucugcugc

SEQ ID NO: 1367697 - RNA, 20 nt, Human
ccacccugcucauccacucu

SEQ ID NO: 1367698 - RNA, 13 nt, Human
ccacccugcucau

SEQ ID NO: 1367699 - RNA, 21 nt, Human
ccacccugaguugcuuuucag

SEQ ID NO: 1367700 - RNA, 20 nt, Human
ccacccugaguugcuuuuca

SEQ ID NO: 1367701 - RNA, 23 nt, Human
ccacccugaggagucugaggucc

SEQ ID NO: 1367702 - RNA, 21 nt, Human
ccacccugaggagucugaggu

SEQ ID NO: 1367703 - RNA, 15 nt, Human
ccacccugaggaguc

SEQ ID NO: 1367704 - RNA, 22 nt, Human
ccacccugagccggccccaggc

SEQ ID NO: 1367705 - RNA, 21 nt, Human
ccacccugagccggccccagg

SEQ ID NO: 1367706 - RNA, 21 nt, Human
ccaccuccugacacccuucuc

SEQ ID NO: 1367707 - RNA, 19 nt, Human
ccaccuccugacacccuuc

SEQ ID NO: 1367708 - RNA, 14 nt, Human
ccaccuccugacac

SEQ ID NO: 1367709 - RNA, 18 nt, Human
ccaccucuaacagcacca

SEQ ID NO: 1367710 - RNA, 15 nt, Human
ccaccucuaacagca

SEQ ID NO: 1367711 - RNA, 14 nt, Human
ccaccucuaacagc

SEQ ID NO: 1367712 - RNA, 20 nt, Human
ccaccucgcagguucaagca

SEQ ID NO: 1367713 - RNA, 21 nt, Human
ccaccucgcagguucaagcaa

SEQ ID NO: 1367714 - RNA, 21 nt, Human
ccaccucuaacagcaccaaau

SEQ ID NO: 1367715 - RNA, 20 nt, Human
ccaccucuaacagcaccaaa

SEQ ID NO: 1367716 - RNA, 13 nt, Human
ccaccucucaaua

SEQ ID NO: 1367717 - RNA, 14 nt, Human
ccaccucucaauau

SEQ ID NO: 1367718 - RNA, 23 nt, Human
ccaccucucaauauucaauaaag

SEQ ID NO: 1367719 - RNA, 14 nt, Human
ccacccccggcagc

SEQ ID NO: 1367720 - RNA, 16 nt, Human
ccacccccagcucaau

SEQ ID NO: 1367721 - RNA, 13 nt, Human
ccacccccagcuc

SEQ ID NO: 1367722 - RNA, 15 nt, Human
ccacccccaccccca

SEQ ID NO: 1367723 - RNA, 22 nt, Human
ccacccucggggauguguccug

SEQ ID NO: 1367724 - RNA, 20 nt, Human
ccacccucggggaugugucc

SEQ ID NO: 1367725 - RNA, 19 nt, Human
ccacccucggggauguguc

SEQ ID NO: 1367726 - RNA, 17 nt, Human
ccacccucguggacacc

SEQ ID NO: 1367727 - RNA, 18 nt, Human
ccacccucguggacaccu

SEQ ID NO: 1367728 - RNA, 15 nt, Human
ccacccugagccggc

SEQ ID NO: 1367729 - RNA, 13 nt, Human
ccacccugagccg

SEQ ID NO: 1367730 - RNA, 19 nt, Human
ccacccucguggacaccug

SEQ ID NO: 1367731 - RNA, 21 nt, Human
ccacuguccugggccugcaga

SEQ ID NO: 1367732 - RNA, 20 nt, Human
ccacuguccugggccugcag

SEQ ID NO: 1367733 - RNA, 19 nt, Human
ccacuguccugggccugca

SEQ ID NO: 1367734 - RNA, 15 nt, Human
ccacuguccugggcc

SEQ ID NO: 1367735 - RNA, 18 nt, Human
ccacuggggcucagagcc

SEQ ID NO: 1367736 - RNA, 15 nt, Human
ccacuggggcucaga

SEQ ID NO: 1367737 - RNA, 14 nt, Human
ccacuggggcucag

SEQ ID NO: 1367738 - RNA, 14 nt, Human
ccacugcuuuuccc

SEQ ID NO: 1367739 - RNA, 20 nt, Human
ccacugcugauauuuucucu

SEQ ID NO: 1367740 - RNA, 22 nt, Human
ccacugcugauauuuucucuag

SEQ ID NO: 1367741 - RNA, 19 nt, Human
ccacugcugauauuuucuc

SEQ ID NO: 1367742 - RNA, 18 nt, Human
ccacugcugauauuuucu

SEQ ID NO: 1367743 - RNA, 12 nt, Human
ccacugccuucg

SEQ ID NO: 1367744 - RNA, 23 nt, Human
ccaccugguacucccucucagga

SEQ ID NO: 1367745 - RNA, 21 nt, Human
ccagaaugcuguacaucuauu

SEQ ID NO: 1367746 - RNA, 14 nt, Human
ccacugugccucag

SEQ ID NO: 1367747 - RNA, 18 nt, Human
ccacugugcagguuccca

SEQ ID NO: 1367748 - RNA, 14 nt, Human
ccacuguuaucaaa

SEQ ID NO: 1367749 - RNA, 13 nt, Human
ccacuguguuccu

SEQ ID NO: 1367750 - RNA, 20 nt, Human
ccacugugccucagagacca

SEQ ID NO: 1367751 - RNA, 22 nt, Human
ccacugugccucagagaccagg

SEQ ID NO: 1367752 - RNA, 19 nt, Human
ccacugugccucagagacc

SEQ ID NO: 1367753 - RNA, 18 nt, Human
ccacugugccucagagac

SEQ ID NO: 1367754 - RNA, 16 nt, Human
ccacugugccucagag

SEQ ID NO: 1367755 - RNA, 15 nt, Human
ccacugugccucaga

SEQ ID NO: 1367756 - RNA, 16 nt, Human
ccacuguguuccuucc

SEQ ID NO: 1367757 - RNA, 15 nt, Human
ccacuguuuggaaau

SEQ ID NO: 1367758 - RNA, 14 nt, Human
ccacuuuuuagaaa

SEQ ID NO: 1367759 - RNA, 13 nt, Human
ccacuuuuugcag

SEQ ID NO: 1367760 - RNA, 20 nt, Human
ccagaacuugacccugagcu

SEQ ID NO: 1367761 - RNA, 22 nt, Human
ccagaagaaaauagugguguga

SEQ ID NO: 1367762 - RNA, 14 nt, Human
ccacuuuuugcagc

SEQ ID NO: 1367763 - RNA, 15 nt, Human
ccacuuuuugcagcu

SEQ ID NO: 1367764 - RNA, 17 nt, Human
ccacuuuuugcagcuuu

SEQ ID NO: 1367765 - RNA, 13 nt, Human
ccagaaaacaaaa

SEQ ID NO: 1367766 - RNA, 16 nt, Human
ccagaaaacaaaacug

SEQ ID NO: 1367767 - RNA, 16 nt, Human
ccacuuuuugcagcuu

SEQ ID NO: 1367768 - RNA, 16 nt, Human
ccagaaccaauuauuu

SEQ ID NO: 1367769 - RNA, 18 nt, Human
ccagaaaccuuuguuugc

SEQ ID NO: 1367770 - RNA, 23 nt, Human
ccagagccaggggggugaggagc

SEQ ID NO: 1367771 - RNA, 22 nt, Human
ccagagccaggggggugaggag

SEQ ID NO: 1367772 - RNA, 12 nt, Human
ccagagccaggg

SEQ ID NO: 1367773 - RNA, 11 nt, Human
ccagagccagg

SEQ ID NO: 1367774 - RNA, 13 nt, Human
ccagagccaaggg

SEQ ID NO: 1367775 - RNA, 13 nt, Human
ccagagauccaaa

SEQ ID NO: 1367776 - RNA, 13 nt, Human
ccagacacccagg

SEQ ID NO: 1367777 - RNA, 20 nt, Human
ccagacaugccacaaggacu

SEQ ID NO: 1367778 - RNA, 14 nt, Human
ccagacaugccaca

SEQ ID NO: 1367779 - RNA, 18 nt, Human
ccagacauaaaggaaaag

SEQ ID NO: 1367780 - RNA, 17 nt, Human
ccagacauaaaggaaaa

SEQ ID NO: 1367781 - RNA, 16 nt, Human
ccagacauaaaggaaa

SEQ ID NO: 1367782 - RNA, 14 nt, Human
ccagaccauggaca

SEQ ID NO: 1367783 - RNA, 20 nt, Human
ccagaaguaccagacuagau

SEQ ID NO: 1367784 - RNA, 16 nt, Human
ccagaaguaccagacu

SEQ ID NO: 1367785 - RNA, 19 nt, Human
ccagaagcucccccagcaa

SEQ ID NO: 1367786 - RNA, 20 nt, Human
ccagaagcucccccagcaaa

SEQ ID NO: 1367787 - RNA, 18 nt, Human
ccagaagcucccccagca

SEQ ID NO: 1367788 - RNA, 17 nt, Human
ccagaagcucccccagc

SEQ ID NO: 1367789 - RNA, 16 nt, Human
ccagaagcucccccag

SEQ ID NO: 1367790 - RNA, 15 nt, Human
ccagaagcuccccca

SEQ ID NO: 1367791 - RNA, 23 nt, Human
ccagaauaaguuauugcaguuua

SEQ ID NO: 1367792 - RNA, 22 nt, Human
ccagaauaaguuauugcaguuu

SEQ ID NO: 1367793 - RNA, 21 nt, Human
ccagaauaaguuauugcaguu

SEQ ID NO: 1367794 - RNA, 19 nt, Human
ccagaauaaguuauugcag

SEQ ID NO: 1367795 - RNA, 15 nt, Human
ccagaauaaguuauu

SEQ ID NO: 1367796 - RNA, 19 nt, Human
ccagacacaggcccucccu

SEQ ID NO: 1367797 - RNA, 17 nt, Human
ccagaaugcuguacauc

SEQ ID NO: 1367798 - RNA, 16 nt, Human
ccagaaugcuguacau

SEQ ID NO: 1367799 - RNA, 16 nt, Human
ccagaaugagacaucc

SEQ ID NO: 1367800 - RNA, 16 nt, Human
ccagugcacuugcugg

SEQ ID NO: 1367801 - RNA, 14 nt, Human
ccagugcacugaaa

SEQ ID NO: 1367802 - RNA, 20 nt, Human
ccagugcacuugcuggaaga

SEQ ID NO: 1367803 - RNA, 19 nt, Human
ccagugagcagccuggagc

SEQ ID NO: 1367804 - RNA, 16 nt, Human
ccagugaccaaccuuu

SEQ ID NO: 1367805 - RNA, 14 nt, Human
ccagugacagcuag

SEQ ID NO: 1367806 - RNA, 12 nt, Human
ccagugacagcu

SEQ ID NO: 1367807 - RNA, 21 nt, Human
ccagugacagacaggcucuua

SEQ ID NO: 1367808 - RNA, 19 nt, Human
ccagugacagacaggcucu

SEQ ID NO: 1367809 - RNA, 18 nt, Human
ccagugacagacaggcuc

SEQ ID NO: 1367810 - RNA, 17 nt, Human
ccagugacagacaggcu

SEQ ID NO: 1367811 - RNA, 15 nt, Human
ccagugacagacagg

SEQ ID NO: 1367812 - RNA, 23 nt, Human
ccaguaaaugggggugcauuuga

SEQ ID NO: 1367813 - RNA, 24 nt, Human
ccagguuggcucugccaguccugu

SEQ ID NO: 1367814 - RNA, 20 nt, Human
ccagguuggcucugccaguc

SEQ ID NO: 1367815 - RNA, 19 nt, Human
ccagguuggcucugccagu

SEQ ID NO: 1367816 - RNA, 20 nt, Human
ccaguaaaugggggugcauu

SEQ ID NO: 1367817 - RNA, 21 nt, Human
ccaguaaaugggggugcauuu

SEQ ID NO: 1367818 - RNA, 22 nt, Human
ccaguaaaugggggugcauuug

SEQ ID NO: 1367819 - RNA, 20 nt, Human
ccagguaggggccccucuca

SEQ ID NO: 1367820 - RNA, 21 nt, Human
ccagguaggccaagguguccu

SEQ ID NO: 1367821 - RNA, 15 nt, Human
ccagguaggccaagg

SEQ ID NO: 1367822 - RNA, 14 nt, Human
ccagguaggccaag

SEQ ID NO: 1367823 - RNA, 20 nt, Human
ccagguauucguuaucuaau

SEQ ID NO: 1367824 - RNA, 21 nt, Human
ccagguauucguuaucuaaua

SEQ ID NO: 1367825 - RNA, 23 nt, Human
ccauauuaaauuuuuuguugaca

SEQ ID NO: 1367826 - RNA, 22 nt, Human
ccauauuaaauuuuuuguugac

SEQ ID NO: 1367827 - RNA, 20 nt, Human
ccauauuaaauuuuuuguug

SEQ ID NO: 1367828 - RNA, 12 nt, Human
ccauauuaaauu

SEQ ID NO: 1367829 - RNA, 21 nt, Human
ccauaugcuaccaccagcugu

SEQ ID NO: 1367830 - RNA, 19 nt, Human
ccauaugcuaccaccagcu

SEQ ID NO: 1367831 - RNA, 18 nt, Human
ccauaugcuaccaccagc

SEQ ID NO: 1367832 - RNA, 17 nt, Human
ccauaugcuaccaccag

SEQ ID NO: 1367833 - RNA, 22 nt, Human
ccauaugcuaccaccagcugug

SEQ ID NO: 1367834 - RNA, 13 nt, Human
ccaucaucuccug

SEQ ID NO: 1367835 - RNA, 15 nt, Human
ccaucauccucuggc

SEQ ID NO: 1367836 - RNA, 14 nt, Human
ccaucauccucugg

SEQ ID NO: 1367837 - RNA, 13 nt, Human
ccaucauccucug

SEQ ID NO: 1367838 - RNA, 18 nt, Human
ccaucaaggguacacugc

SEQ ID NO: 1367839 - RNA, 19 nt, Human
ccauauuaccacagacaua

SEQ ID NO: 1367840 - RNA, 16 nt, Human
ccaucauccucuggcu

SEQ ID NO: 1367841 - RNA, 20 nt, Human
ccaucaucuauagaaagcua

SEQ ID NO: 1367842 - RNA, 24 nt, Human
ccagggccccucuccccagggaag

SEQ ID NO: 1367843 - RNA, 22 nt, Human
ccagggccccucuccccaggga

SEQ ID NO: 1367844 - RNA, 15 nt, Human
ccagggccccucucc

SEQ ID NO: 1367845 - RNA, 11 nt, Human
ccagggccccu

SEQ ID NO: 1367846 - RNA, 22 nt, Human
ccagggccccucacccugccuu

SEQ ID NO: 1367847 - RNA, 21 nt, Human
ccagggccccucacccugccu

SEQ ID NO: 1367848 - RNA, 17 nt, Human
ccagggcccccaucuca

SEQ ID NO: 1367849 - RNA, 20 nt, Human
ccagggcacaggagcuaccu

SEQ ID NO: 1367850 - RNA, 22 nt, Human
ccagggcacaggagcuaccugu

SEQ ID NO: 1367851 - RNA, 17 nt, Human
ccagggcacaggagcua

SEQ ID NO: 1367852 - RNA, 16 nt, Human
ccagggcacaggagcu

SEQ ID NO: 1367853 - RNA, 15 nt, Human
ccagggcacaggagc

SEQ ID NO: 1367854 - RNA, 14 nt, Human
ccagggcacaggag

SEQ ID NO: 1367855 - RNA, 13 nt, Human
ccagggcacagga

SEQ ID NO: 1367856 - RNA, 10 nt, Human
ccagggcaca

SEQ ID NO: 1367857 - RNA, 17 nt, Human
ccagggaggcugguccu

SEQ ID NO: 1367858 - RNA, 20 nt, Human
ccaggcuucugcuggggccu

SEQ ID NO: 1367859 - RNA, 18 nt, Human
ccaggcuucugcuggggc

SEQ ID NO: 1367860 - RNA, 16 nt, Human
ccaggcuucugcuggg

SEQ ID NO: 1367861 - RNA, 15 nt, Human
ccaggcuucugcugg

SEQ ID NO: 1367862 - RNA, 13 nt, Human
ccaggcuucugcu

SEQ ID NO: 1367863 - RNA, 20 nt, Human
ccaggcuggucuaaaacucc

SEQ ID NO: 1367864 - RNA, 17 nt, Human
ccaggcuggucuaaaac

SEQ ID NO: 1367865 - RNA, 16 nt, Human
ccaggcuggucuaaaa

SEQ ID NO: 1367866 - RNA, 15 nt, Human
ccagggucuccagaa

SEQ ID NO: 1367867 - RNA, 17 nt, Human
ccagggucuccagaaag

SEQ ID NO: 1367868 - RNA, 13 nt, Human
ccagggucuccag

SEQ ID NO: 1367869 - RNA, 12 nt, Human
ccagggucucca

SEQ ID NO: 1367870 - RNA, 23 nt, Human
ccaggguccugggaggagagaca

SEQ ID NO: 1367871 - RNA, 16 nt, Human
ccaggguccugggagg

SEQ ID NO: 1367872 - RNA, 14 nt, Human
ccaggguccuggga

SEQ ID NO: 1367873 - RNA, 16 nt, Human
ccagguacuugagaaa

SEQ ID NO: 1367874 - RNA, 14 nt, Human
ccagggugugugcu

SEQ ID NO: 1367875 - RNA, 20 nt, Human
ccagguagaggguguguaag

SEQ ID NO: 1367876 - RNA, 14 nt, Human
ccaggguggcagca

SEQ ID NO: 1367877 - RNA, 16 nt, Human
ccaggguggcagcaac

SEQ ID NO: 1367878 - RNA, 17 nt, Human
ccaggguggcagcaaca

SEQ ID NO: 1367879 - RNA, 13 nt, Human
ccaggccaccucc

SEQ ID NO: 1367880 - RNA, 17 nt, Human
ccaggagggacaaagga

SEQ ID NO: 1367881 - RNA, 16 nt, Human
ccaggagggacaaagg

SEQ ID NO: 1367882 - RNA, 17 nt, Human
ccaggccaccuccccag

SEQ ID NO: 1367883 - RNA, 16 nt, Human
ccaggccaccucccca

SEQ ID NO: 1367884 - RNA, 13 nt, Human
ccagcuccuuugg

SEQ ID NO: 1367885 - RNA, 20 nt, Human
ccagcucuacccugcauggc

SEQ ID NO: 1367886 - RNA, 14 nt, Human
ccagcuccuuuggg

SEQ ID NO: 1367887 - RNA, 23 nt, Human
ccagcuccugacacugcuggaga

SEQ ID NO: 1367888 - RNA, 20 nt, Human
ccagcuccugacacugcugg

SEQ ID NO: 1367889 - RNA, 12 nt, Human
ccagcuccugac

SEQ ID NO: 1367890 - RNA, 11 nt, Human
ccagcuccuga

SEQ ID NO: 1367891 - RNA, 21 nt, Human
ccaggccaccuccccagcauu

SEQ ID NO: 1367892 - RNA, 12 nt, Human
ccaggcuggguc

SEQ ID NO: 1367893 - RNA, 16 nt, Human
ccaggcugggucgccc

SEQ ID NO: 1367894 - RNA, 21 nt, Human
ccaggcugggucgcccuggac

SEQ ID NO: 1367895 - RNA, 22 nt, Human
ccaggcugggucgcccuggacu

SEQ ID NO: 1367896 - RNA, 23 nt, Human
ccaggcugggucgcccuggacug

SEQ ID NO: 1367897 - RNA, 24 nt, Human
ccaggcugggucgcccuggacugu

SEQ ID NO: 1367898 - RNA, 15 nt, Human
ccauucgugaaaaca

SEQ ID NO: 1367899 - RNA, 16 nt, Human
ccauuccuucccagag

SEQ ID NO: 1367900 - RNA, 13 nt, Human
ccauuccuuccca

SEQ ID NO: 1367901 - RNA, 20 nt, Human
ccauuauaaccuuaauuuau

SEQ ID NO: 1367902 - RNA, 20 nt, Human
ccauuauaaugaauuuagug

SEQ ID NO: 1367903 - RNA, 18 nt, Human
ccauucuccacagcaacc

SEQ ID NO: 1367904 - RNA, 16 nt, Human
ccauucuccacagcaa

SEQ ID NO: 1367905 - RNA, 15 nt, Human
ccauucuccacagca

SEQ ID NO: 1367906 - RNA, 13 nt, Human
ccauucuccacag

SEQ ID NO: 1367907 - RNA, 21 nt, Human
ccauucucacaggucccaaau

SEQ ID NO: 1367908 - RNA, 17 nt, Human
ccauucucaagcccugc

SEQ ID NO: 1367909 - RNA, 18 nt, Human
ccauucucaagcccugca

SEQ ID NO: 1367910 - RNA, 13 nt, Human
ccauucugacucg

SEQ ID NO: 1367911 - RNA, 12 nt, Human
ccauucugacuc

SEQ ID NO: 1367912 - RNA, 13 nt, Human
ccauucuccugag

SEQ ID NO: 1367913 - RNA, 22 nt, Human
ccauuugcauuuguuuauguaa

SEQ ID NO: 1367914 - RNA, 12 nt, Human
ccauuugcauuu

SEQ ID NO: 1367915 - RNA, 19 nt, Human
ccauuucugaggugcacug

SEQ ID NO: 1367916 - RNA, 20 nt, Human
ccauucugacucgguuucuc

SEQ ID NO: 1367917 - RNA, 22 nt, Human
ccauuuuaaaguuaguaucuuu

SEQ ID NO: 1367918 - RNA, 16 nt, Human
ccauuugcuuuuucac

SEQ ID NO: 1367919 - RNA, 15 nt, Human
ccauuugcauuuguu

SEQ ID NO: 1367920 - RNA, 17 nt, Human
ccauguguccugguucc

SEQ ID NO: 1367921 - RNA, 14 nt, Human
ccauguguccuggu

SEQ ID NO: 1367922 - RNA, 21 nt, Human
ccaucuugcuucccuaaucua

SEQ ID NO: 1367923 - RNA, 20 nt, Human
ccaucuugcuucccuaaucu

SEQ ID NO: 1367924 - RNA, 21 nt, Human
ccaucuugcccgcucaggcug

SEQ ID NO: 1367925 - RNA, 19 nt, Human
ccaucuugcccgcucaggc

SEQ ID NO: 1367926 - RNA, 15 nt, Human
ccaucugucugccaa

SEQ ID NO: 1367927 - RNA, 23 nt, Human
ccaucucugauuuucaaagcuuu

SEQ ID NO: 1367928 - RNA, 18 nt, Human
ccaucucugauuuucaaa

SEQ ID NO: 1367929 - RNA, 20 nt, Human
ccauuaaagaauaugaaaca

SEQ ID NO: 1367930 - RNA, 16 nt, Human
ccauuaaagaauauga

SEQ ID NO: 1367931 - RNA, 14 nt, Human
ccauuaaagaauau

SEQ ID NO: 1367932 - RNA, 12 nt, Human
ccauuaaagaau

SEQ ID NO: 1367933 - RNA, 23 nt, Human
ccauuaaacgauuuuuaaaaugu

SEQ ID NO: 1367934 - RNA, 10 nt, Human
ccauuaaacg

SEQ ID NO: 1367935 - RNA, 19 nt, Human
ccauuaaaccaucucccug

SEQ ID NO: 1367936 - RNA, 18 nt, Human
ccauuaaaccaucucccu

SEQ ID NO: 1367937 - RNA, 12 nt, Human
ccauuaaaccau

SEQ ID NO: 1367938 - RNA, 16 nt, Human
ccauuaccauguaaug

SEQ ID NO: 1367939 - RNA, 17 nt, Human
ccauuaaucaguucauu

SEQ ID NO: 1367940 - RNA, 22 nt, Human
ccauuaaccagaucuagucaau

SEQ ID NO: 1367941 - RNA, 18 nt, Human
ccauuaaagaauaugaaa

SEQ ID NO: 1367942 - RNA, 22 nt, Human
ccauguucugucccuugccccc

SEQ ID NO: 1367943 - RNA, 15 nt, Human
ccauguucugucccu

SEQ ID NO: 1367944 - RNA, 18 nt, Human
ccauguuagccaggcugg

SEQ ID NO: 1367945 - RNA, 16 nt, Human
ccauguguuauguuuu

SEQ ID NO: 1367946 - RNA, 20 nt, Human
ccauguuaaccccuccacuc

SEQ ID NO: 1367947 - RNA, 12 nt, Human
ccauuuuuccuu

SEQ ID NO: 1367948 - RNA, 22 nt, Human
ccauuuuguuauugacuaacag

SEQ ID NO: 1367949 - RNA, 23 nt, Human
ccauuuuguuauugacuaacagg

SEQ ID NO: 1367950 - RNA, 16 nt, Human
cccaacacugccagca

SEQ ID NO: 1367951 - RNA, 15 nt, Human
cccaacacugccagc

SEQ ID NO: 1367952 - RNA, 14 nt, Human
cccaacacugccag

SEQ ID NO: 1367953 - RNA, 18 nt, Human
ccauuuuguuauugacua

SEQ ID NO: 1367954 - RNA, 14 nt, Human
ccauuuucugguuc

SEQ ID NO: 1367955 - RNA, 17 nt, Human
cccaaccauuuccucag

SEQ ID NO: 1367956 - RNA, 18 nt, Human
cccaaccauuuccucaga

SEQ ID NO: 1367957 - RNA, 15 nt, Human
cccaacagcuggacc

SEQ ID NO: 1367958 - RNA, 23 nt, Human
cccaacagcuggacccugaccag

SEQ ID NO: 1367959 - RNA, 22 nt, Human
cccacacucagauccuccucau

SEQ ID NO: 1367960 - RNA, 20 nt, Human
cccaagugagucucucuggg

SEQ ID NO: 1367961 - RNA, 13 nt, Human
cccaagugagucu

SEQ ID NO: 1367962 - RNA, 23 nt, Human
cccaaguagcugggauuacaggu

SEQ ID NO: 1367963 - RNA, 17 nt, Human
cccaagguaccauccua

SEQ ID NO: 1367964 - RNA, 18 nt, Human
cccaaggggccugagcag

SEQ ID NO: 1367965 - RNA, 17 nt, Human
cccaacccguggaggcu

SEQ ID NO: 1367966 - RNA, 13 nt, Human
cccaacccgugga

SEQ ID NO: 1367967 - RNA, 14 nt, Human
cccacaucccuggg

SEQ ID NO: 1367968 - RNA, 13 nt, Human
cccacaucccugg

SEQ ID NO: 1367969 - RNA, 17 nt, Human
cccacaucccaucgucu

SEQ ID NO: 1367970 - RNA, 19 nt, Human
cccacagugucaggcacug

SEQ ID NO: 1367971 - RNA, 21 nt, Human
cccacagugucaggcacuggg

SEQ ID NO: 1367972 - RNA, 12 nt, Human
cccacagcaggc

SEQ ID NO: 1367973 - RNA, 18 nt, Human
cccaccucagccucccaa

SEQ ID NO: 1367974 - RNA, 17 nt, Human
cccaccgugggcaggga

SEQ ID NO: 1367975 - RNA, 15 nt, Human
cccaccgugggcagg

SEQ ID NO: 1367976 - RNA, 23 nt, Human
cccacaucccugggccugcugcu

SEQ ID NO: 1367977 - RNA, 24 nt, Human
cccacaucccugggccugcugcug

SEQ ID NO: 1367978 - RNA, 22 nt, Human
cccacaucccugggccugcugc

SEQ ID NO: 1367979 - RNA, 21 nt, Human
cccacaucccugggccugcug

SEQ ID NO: 1367980 - RNA, 20 nt, Human
cccacaucccugggccugcu

SEQ ID NO: 1367981 - RNA, 19 nt, Human
cccacaucccugggccugc

SEQ ID NO: 1367982 - RNA, 18 nt, Human
cccacaucccugggccug

SEQ ID NO: 1367983 - RNA, 17 nt, Human
cccacaucccugggccu

SEQ ID NO: 1367984 - RNA, 16 nt, Human
cccacaucccugggcc

SEQ ID NO: 1367985 - RNA, 15 nt, Human
cccacaucccugggc

SEQ ID NO: 1367986 - RNA, 20 nt, Human
cccaccguugucucaugcca

SEQ ID NO: 1367987 - RNA, 17 nt, Human
cccaccguugucucaug

SEQ ID NO: 1367988 - RNA, 19 nt, Human
cccaccgugggcagggagc

SEQ ID NO: 1367989 - RNA, 15 nt, Human
cccacgcucaccccc

SEQ ID NO: 1367990 - RNA, 16 nt, Human
cccacgcucacccccu

SEQ ID NO: 1367991 - RNA, 14 nt, Human
cccacgccuuaucc

SEQ ID NO: 1367992 - RNA, 15 nt, Human
cccacgucagcuggg

SEQ ID NO: 1367993 - RNA, 15 nt, Human
cccacggccuuucua

SEQ ID NO: 1367994 - RNA, 15 nt, Human
cccacggcuccucga

SEQ ID NO: 1367995 - RNA, 20 nt, Human
cccacggagucguggggugu

SEQ ID NO: 1367996 - RNA, 19 nt, Human
cccagaauaaguuauugca

SEQ ID NO: 1367997 - RNA, 22 nt, Human
cccagaauaaguuauugcaguu

SEQ ID NO: 1367998 - RNA, 12 nt, Human
cccagaaugaga

SEQ ID NO: 1367999 - RNA, 18 nt, Human
cccagaaugagacaucca

SEQ ID NO: 1368000 - RNA, 16 nt, Human
ccccacuccucugcug

SEQ ID NO: 1368001 - RNA, 21 nt, Human
ccccacuccucugcugaccug

SEQ ID NO: 1368002 - RNA, 12 nt, Human
ccccacuccucu

SEQ ID NO: 1368003 - RNA, 14 nt, Human
ccccacucccucac

SEQ ID NO: 1368004 - RNA, 13 nt, Human
ccccacucccuca

SEQ ID NO: 1368005 - RNA, 15 nt, Human
ccccacucccucaca

SEQ ID NO: 1368006 - RNA, 14 nt, Human
ccccacucccacau

SEQ ID NO: 1368007 - RNA, 19 nt, Human
ccccacuuguccuuagccu

SEQ ID NO: 1368008 - RNA, 15 nt, Human
ccccacuuucuuucu

SEQ ID NO: 1368009 - RNA, 21 nt, Human
ccccacuugccucuuccuuga

SEQ ID NO: 1368010 - RNA, 16 nt, Human
ccccacuugccucuuc

SEQ ID NO: 1368011 - RNA, 15 nt, Human
ccccacuugccucuu

SEQ ID NO: 1368012 - RNA, 14 nt, Human
ccccacuugccucu

SEQ ID NO: 1368013 - RNA, 13 nt, Human
ccccacuugccuc

SEQ ID NO: 1368014 - RNA, 14 nt, Human
ccccacuguaucua

SEQ ID NO: 1368015 - RNA, 21 nt, Human
ccccacgagggcuggcuggcc

SEQ ID NO: 1368016 - RNA, 18 nt, Human
ccccacgagggcuggcug

SEQ ID NO: 1368017 - RNA, 17 nt, Human
ccccacgagggcuggcu

SEQ ID NO: 1368018 - RNA, 16 nt, Human
ccccacgagggcuggc

SEQ ID NO: 1368019 - RNA, 15 nt, Human
ccccacgagggcugg

SEQ ID NO: 1368020 - RNA, 14 nt, Human
ccccacgagggcug

SEQ ID NO: 1368021 - RNA, 13 nt, Human
ccccacgagggcu

SEQ ID NO: 1368022 - RNA, 14 nt, Human
ccccaccuggcuca

SEQ ID NO: 1368023 - RNA, 22 nt, Human
ccccaccguugucucaugccag

SEQ ID NO: 1368024 - RNA, 21 nt, Human
ccccacccuguuccugcugcu

SEQ ID NO: 1368025 - RNA, 20 nt, Human
ccccacccuguuccugcugc

SEQ ID NO: 1368026 - RNA, 19 nt, Human
ccccacccuguuccugcug

SEQ ID NO: 1368027 - RNA, 18 nt, Human
ccccacccuguuccugcu

SEQ ID NO: 1368028 - RNA, 17 nt, Human
ccccacccuguuccugc

SEQ ID NO: 1368029 - RNA, 14 nt, Human
ccccacccuguucc

SEQ ID NO: 1368030 - RNA, 20 nt, Human
ccccacccuggugggccaac

SEQ ID NO: 1368031 - RNA, 14 nt, Human
ccccaauccuccca

SEQ ID NO: 1368032 - RNA, 13 nt, Human
ccccaagguucuc

SEQ ID NO: 1368033 - RNA, 20 nt, Human
ccccacaccagggccagccu

SEQ ID NO: 1368034 - RNA, 18 nt, Human
ccccacaagugcccucca

SEQ ID NO: 1368035 - RNA, 18 nt, Human
cccauucauuccauucug

SEQ ID NO: 1368036 - RNA, 22 nt, Human
cccauucauuccauucuggaag

SEQ ID NO: 1368037 - RNA, 18 nt, Human
cccauuccugaagaacca

SEQ ID NO: 1368038 - RNA, 13 nt, Human
cccauuccugaag

SEQ ID NO: 1368039 - RNA, 12 nt, Human
cccauuccugaa

SEQ ID NO: 1368040 - RNA, 18 nt, Human
cccauucccgcaguggga

SEQ ID NO: 1368041 - RNA, 16 nt, Human
cccauucccgcagugg

SEQ ID NO: 1368042 - RNA, 15 nt, Human
cccauucccgcagug

SEQ ID NO: 1368043 - RNA, 12 nt, Human
cccauucccgca

SEQ ID NO: 1368044 - RNA, 21 nt, Human
cccauucauuccauucuggaa

SEQ ID NO: 1368045 - RNA, 20 nt, Human
ccccacccccagcucaaugg

SEQ ID NO: 1368046 - RNA, 17 nt, Human
ccccacccccagcucaa

SEQ ID NO: 1368047 - RNA, 16 nt, Human
ccccacccccagcuca

SEQ ID NO: 1368048 - RNA, 13 nt, Human
ccccacccccagc

SEQ ID NO: 1368049 - RNA, 20 nt, Human
ccccaccccagggcagccag

SEQ ID NO: 1368050 - RNA, 16 nt, Human
ccccaccccagggcag

SEQ ID NO: 1368051 - RNA, 15 nt, Human
ccccaccccagggca

SEQ ID NO: 1368052 - RNA, 14 nt, Human
ccccaccccagggc

SEQ ID NO: 1368053 - RNA, 13 nt, Human
ccccacccacuuc

SEQ ID NO: 1368054 - RNA, 22 nt, Human
ccccacccaccaacccucaggg

SEQ ID NO: 1368055 - RNA, 21 nt, Human
ccccacccaccaacccucagg

SEQ ID NO: 1368056 - RNA, 16 nt, Human
ccccacccacuucugc

SEQ ID NO: 1368057 - RNA, 18 nt, Human
ccccacccaggccaggca

SEQ ID NO: 1368058 - RNA, 14 nt, Human
ccccacccacuucu

SEQ ID NO: 1368059 - RNA, 15 nt, Human
ccccacccucgggga

SEQ ID NO: 1368060 - RNA, 14 nt, Human
ccccacccccaagg

SEQ ID NO: 1368061 - RNA, 12 nt, Human
ccccacccucau

SEQ ID NO: 1368062 - RNA, 23 nt, Human
ccccacccucggggauguguccu

SEQ ID NO: 1368063 - RNA, 21 nt, Human
ccccacccucggggauguguc

SEQ ID NO: 1368064 - RNA, 21 nt, Human
ccccacccucguggacaccug

SEQ ID NO: 1368065 - RNA, 22 nt, Human
ccccacccucguggacaccugc

SEQ ID NO: 1368066 - RNA, 23 nt, Human
ccccacccucguggacaccugcc

SEQ ID NO: 1368067 - RNA, 14 nt, Human
ccccacccuggccu

SEQ ID NO: 1368068 - RNA, 20 nt, Human
ccccacccugggcccugggc

SEQ ID NO: 1368069 - RNA, 15 nt, Human
ccccacccugggccc

SEQ ID NO: 1368070 - RNA, 14 nt, Human
ccccacccugggcc

SEQ ID NO: 1368071 - RNA, 12 nt, Human
ccccacccuggg

SEQ ID NO: 1368072 - RNA, 22 nt, Human
cccauggacaggcuggcuccag

SEQ ID NO: 1368073 - RNA, 20 nt, Human
cccauggacaggcuggcucc

SEQ ID NO: 1368074 - RNA, 15 nt, Human
cccauggacaggcug

SEQ ID NO: 1368075 - RNA, 18 nt, Human
cccaugcuguccauccau

SEQ ID NO: 1368076 - RNA, 23 nt, Human
cccaugcuggccuugccacacuc

SEQ ID NO: 1368077 - RNA, 22 nt, Human
cccaugcacugugaaggacccu

SEQ ID NO: 1368078 - RNA, 20 nt, Human
cccaugcacugugaaggacc

SEQ ID NO: 1368079 - RNA, 19 nt, Human
cccaugcacugugaaggac

SEQ ID NO: 1368080 - RNA, 18 nt, Human
cccaugcacugugaagga

SEQ ID NO: 1368081 - RNA, 16 nt, Human
cccaugcacugugaag

SEQ ID NO: 1368082 - RNA, 14 nt, Human
cccaugcacuguga

SEQ ID NO: 1368083 - RNA, 12 nt, Human
cccaugcacugu

SEQ ID NO: 1368084 - RNA, 15 nt, Human
cccaugaucccugug

SEQ ID NO: 1368085 - RNA, 23 nt, Human
cccaugaguuggggucuggcagc

SEQ ID NO: 1368086 - RNA, 22 nt, Human
cccaugagcuccuuaaggcucu

SEQ ID NO: 1368087 - RNA, 15 nt, Human
cccaugagcuccuua

SEQ ID NO: 1368088 - RNA, 14 nt, Human
cccaugagcuccuu

SEQ ID NO: 1368089 - RNA, 16 nt, Human
cccaugaccuccagcu

SEQ ID NO: 1368090 - RNA, 15 nt, Human
cccaugaccuccagc

SEQ ID NO: 1368091 - RNA, 14 nt, Human
cccaugaccuccag

SEQ ID NO: 1368092 - RNA, 13 nt, Human
cccaugagcuccu

SEQ ID NO: 1368093 - RNA, 18 nt, Human
cccaugaccccaaagcca

SEQ ID NO: 1368094 - RNA, 17 nt, Human
cccaucugucugccaac

SEQ ID NO: 1368095 - RNA, 18 nt, Human
cccaucugcauucccagc

SEQ ID NO: 1368096 - RNA, 22 nt, Human
cccaucucaugccccuggcugg

SEQ ID NO: 1368097 - RNA, 21 nt, Human
cccaucucaugccccuggcug

SEQ ID NO: 1368098 - RNA, 22 nt, Human
cccaguuggagcuccagccuga

SEQ ID NO: 1368099 - RNA, 21 nt, Human
cccaguuggagcuccagccug

SEQ ID NO: 1368100 - RNA, 17 nt, Human
cccaguuggagcuccag

SEQ ID NO: 1368101 - RNA, 16 nt, Human
cccaguuggagcucca

SEQ ID NO: 1368102 - RNA, 15 nt, Human
cccaguuggagcucc

SEQ ID NO: 1368103 - RNA, 20 nt, Human
cccaguugcacucaggugac

SEQ ID NO: 1368104 - RNA, 17 nt, Human
cccaguugccaucugcg

SEQ ID NO: 1368105 - RNA, 15 nt, Human
cccaguugccaucug

SEQ ID NO: 1368106 - RNA, 19 nt, Human
cccaguugcacucagguga

SEQ ID NO: 1368107 - RNA, 21 nt, Human
cccaguuccuguggcucccuc

SEQ ID NO: 1368108 - RNA, 18 nt, Human
cccaguuccuguggcucc

SEQ ID NO: 1368109 - RNA, 16 nt, Human
cccaguuccuguggcu

SEQ ID NO: 1368110 - RNA, 15 nt, Human
cccagagacccagcg

SEQ ID NO: 1368111 - RNA, 14 nt, Human
cccagagacccagc

SEQ ID NO: 1368112 - RNA, 13 nt, Human
cccagagacccag

SEQ ID NO: 1368113 - RNA, 23 nt, Human
cccagagacauacuugaagggcc

SEQ ID NO: 1368114 - RNA, 22 nt, Human
cccagagacauacuugaagggc

SEQ ID NO: 1368115 - RNA, 21 nt, Human
cccagagacauacuugaaggg

SEQ ID NO: 1368116 - RNA, 18 nt, Human
cccagagacauacuugaa

SEQ ID NO: 1368117 - RNA, 22 nt, Human
cccagagaaaggggagcccacu

SEQ ID NO: 1368118 - RNA, 13 nt, Human
cccagagaagcca

SEQ ID NO: 1368119 - RNA, 20 nt, Human
cccagaaugagacauccagc

SEQ ID NO: 1368120 - RNA, 21 nt, Human
ccccaguuccuguggcucccu

SEQ ID NO: 1368121 - RNA, 22 nt, Human
ccccaguuccuguggcucccuc

SEQ ID NO: 1368122 - RNA, 15 nt, Human
ccccagugacagcua

SEQ ID NO: 1368123 - RNA, 20 nt, Human
ccccaucagugcucccucac

SEQ ID NO: 1368124 - RNA, 14 nt, Human
ccccaucagugcuc

SEQ ID NO: 1368125 - RNA, 13 nt, Human
ccccaucagugcu

SEQ ID NO: 1368126 - RNA, 15 nt, Human
ccccauacuccuaug

SEQ ID NO: 1368127 - RNA, 11 nt, Human
ccccagggcac

SEQ ID NO: 1368128 - RNA, 22 nt, Human
ccccagggaagcagcagccucg

SEQ ID NO: 1368129 - RNA, 20 nt, Human
ccccagggaagcagcagccu

SEQ ID NO: 1368130 - RNA, 18 nt, Human
ccccagggaagcagcagc

SEQ ID NO: 1368131 - RNA, 16 nt, Human
ccccagggaagcagca

SEQ ID NO: 1368132 - RNA, 13 nt, Human
ccccaggcugaag

SEQ ID NO: 1368133 - RNA, 18 nt, Human
ccccaggcucguggacug

SEQ ID NO: 1368134 - RNA, 15 nt, Human
ccccaggcucgugga

SEQ ID NO: 1368135 - RNA, 23 nt, Human
ccccaggccugaaagaggcugag

SEQ ID NO: 1368136 - RNA, 21 nt, Human
ccccaggccugaaagaggcug

SEQ ID NO: 1368137 - RNA, 18 nt, Human
ccccagacuagauguagu

SEQ ID NO: 1368138 - RNA, 15 nt, Human
ccccagacuagaugu

SEQ ID NO: 1368139 - RNA, 13 nt, Human
ccccagacacugg

SEQ ID NO: 1368140 - RNA, 22 nt, Human
ccccagggcacaggagcuaccu

SEQ ID NO: 1368141 - RNA, 23 nt, Human
ccccagggcacaggagcuaccug

SEQ ID NO: 1368142 - RNA, 13 nt, Human
ccccaguaaaauu

SEQ ID NO: 1368143 - RNA, 14 nt, Human
ccccaguaaaauug

SEQ ID NO: 1368144 - RNA, 19 nt, Human
ccccagggcacaggagcua

SEQ ID NO: 1368145 - RNA, 18 nt, Human
ccccagggcacaggagcu

SEQ ID NO: 1368146 - RNA, 17 nt, Human
ccccagggcacaggagc

SEQ ID NO: 1368147 - RNA, 16 nt, Human
ccccagggcacaggag

SEQ ID NO: 1368148 - RNA, 15 nt, Human
ccccagggcacagga

SEQ ID NO: 1368149 - RNA, 14 nt, Human
ccccagggcacagg

SEQ ID NO: 1368150 - RNA, 12 nt, Human
ccccagggcaca

SEQ ID NO: 1368151 - RNA, 12 nt, Human
ccccagggagag

SEQ ID NO: 1368152 - RNA, 14 nt, Human
ccccaguacacagg

SEQ ID NO: 1368153 - RNA, 18 nt, Human
ccccaguaucucuucagu

SEQ ID NO: 1368154 - RNA, 17 nt, Human
ccccaguaaaauugcca

SEQ ID NO: 1368155 - RNA, 14 nt, Human
cccccacccccagc

SEQ ID NO: 1368156 - RNA, 14 nt, Human
ccccaucccaugcu

SEQ ID NO: 1368157 - RNA, 17 nt, Human
ccccaucauccucuggc

SEQ ID NO: 1368158 - RNA, 16 nt, Human
ccccaucauccucugg

SEQ ID NO: 1368159 - RNA, 17 nt, Human
ccccaucauugguaccc

SEQ ID NO: 1368160 - RNA, 22 nt, Human
cccccacuugccucuuccuuga

SEQ ID NO: 1368161 - RNA, 22 nt, Human
cccccagaaaagaaagcuacag

SEQ ID NO: 1368162 - RNA, 18 nt, Human
cccccacccuguuccugc

SEQ ID NO: 1368163 - RNA, 14 nt, Human
cccccacccuguuc

SEQ ID NO: 1368164 - RNA, 11 nt, Human
cccccacccug

SEQ ID NO: 1368165 - RNA, 17 nt, Human
cccccacccccagcuca

SEQ ID NO: 1368166 - RNA, 15 nt, Human
cccccacccccagcu

SEQ ID NO: 1368167 - RNA, 20 nt, Human
cccccaccuggcucaccuug

SEQ ID NO: 1368168 - RNA, 15 nt, Human
cccccaccuggcuca

SEQ ID NO: 1368169 - RNA, 20 nt, Human
cccccaccucugcugccucc

SEQ ID NO: 1368170 - RNA, 14 nt, Human
cccccacucccuca

SEQ ID NO: 1368171 - RNA, 17 nt, Human
cccccacugccuuugac

SEQ ID NO: 1368172 - RNA, 15 nt, Human
ccccucuccuucuua

SEQ ID NO: 1368173 - RNA, 22 nt, Human
ccccucucccuugggcucugau

SEQ ID NO: 1368174 - RNA, 19 nt, Human
ccccucuccuuccugugug

SEQ ID NO: 1368175 - RNA, 14 nt, Human
ccccucuccuuccu

SEQ ID NO: 1368176 - RNA, 15 nt, Human
ccccucucccuuggg

SEQ ID NO: 1368177 - RNA, 18 nt, Human
ccccucucccugcauggc

SEQ ID NO: 1368178 - RNA, 12 nt, Human
ccccucucccuu

SEQ ID NO: 1368179 - RNA, 14 nt, Human
ccccucucccugca

SEQ ID NO: 1368180 - RNA, 17 nt, Human
ccccucucccaguuguc

SEQ ID NO: 1368181 - RNA, 14 nt, Human
ccccucucagcccu

SEQ ID NO: 1368182 - RNA, 15 nt, Human
ccccucucagcccuc

SEQ ID NO: 1368183 - RNA, 13 nt, Human
ccccucucagccc

SEQ ID NO: 1368184 - RNA, 12 nt, Human
ccccucucacca

SEQ ID NO: 1368185 - RNA, 14 nt, Human
ccccuccuucccaa

SEQ ID NO: 1368186 - RNA, 21 nt, Human
ccccuccucuagcuguggggg

SEQ ID NO: 1368187 - RNA, 19 nt, Human
ccccuccgcccugccacuc

SEQ ID NO: 1368188 - RNA, 18 nt, Human
ccccuccgcccugccacu

SEQ ID NO: 1368189 - RNA, 17 nt, Human
ccccuccgcccugccac

SEQ ID NO: 1368190 - RNA, 19 nt, Human
ccccuccucuagcuguggg

SEQ ID NO: 1368191 - RNA, 17 nt, Human
ccccuccucuagcugug

SEQ ID NO: 1368192 - RNA, 14 nt, Human
ccccucccuggaug

SEQ ID NO: 1368193 - RNA, 16 nt, Human
ccccuccgcccugcca

SEQ ID NO: 1368194 - RNA, 14 nt, Human
ccccucaccuccuc

SEQ ID NO: 1368195 - RNA, 13 nt, Human
ccccucaccuccu

SEQ ID NO: 1368196 - RNA, 12 nt, Human
ccccucaccucc

SEQ ID NO: 1368197 - RNA, 16 nt, Human
ccccucacccugccuu

SEQ ID NO: 1368198 - RNA, 13 nt, Human
ccccucacccugc

SEQ ID NO: 1368199 - RNA, 23 nt, Human
ccccucagccucuccccugccug

SEQ ID NO: 1368200 - RNA, 20 nt, Human
ccccucaucucucugcccaa

SEQ ID NO: 1368201 - RNA, 16 nt, Human
ccccuccaaaaugugc

SEQ ID NO: 1368202 - RNA, 21 nt, Human
ccccuccaaaaugugccuauu

SEQ ID NO: 1368203 - RNA, 12 nt, Human
ccccuccacucu

SEQ ID NO: 1368204 - RNA, 17 nt, Human
ccccuccacucuuucuu

SEQ ID NO: 1368205 - RNA, 13 nt, Human
cccccucccccac

SEQ ID NO: 1368206 - RNA, 15 nt, Human
cccccagcuccggcc

SEQ ID NO: 1368207 - RNA, 15 nt, Human
cccccagcucccacc

SEQ ID NO: 1368208 - RNA, 21 nt, Human
cccccagcuaagaaccuggaa

SEQ ID NO: 1368209 - RNA, 18 nt, Human
cccccagcuaagaaccug

SEQ ID NO: 1368210 - RNA, 13 nt, Human
cccccagcuaaga

SEQ ID NO: 1368211 - RNA, 13 nt, Human
cccccagccuguc

SEQ ID NO: 1368212 - RNA, 12 nt, Human
cccccagccugu

SEQ ID NO: 1368213 - RNA, 16 nt, Human
cccccagccugggccu

SEQ ID NO: 1368214 - RNA, 15 nt, Human
cccccagccugggcc

SEQ ID NO: 1368215 - RNA, 14 nt, Human
cccccagccugggc

SEQ ID NO: 1368216 - RNA, 13 nt, Human
cccccagccuggg

SEQ ID NO: 1368217 - RNA, 12 nt, Human
cccccagccugg

SEQ ID NO: 1368218 - RNA, 11 nt, Human
cccccagccug

SEQ ID NO: 1368219 - RNA, 15 nt, Human
cccccagccucuggc

SEQ ID NO: 1368220 - RNA, 20 nt, Human
cccccagcaaagcccccaga

SEQ ID NO: 1368221 - RNA, 12 nt, Human
cccccagauauc

SEQ ID NO: 1368222 - RNA, 23 nt, Human
cccccagagcccaggcucggccu

SEQ ID NO: 1368223 - RNA, 16 nt, Human
cccccagagcccaggc

SEQ ID NO: 1368224 - RNA, 16 nt, Human
cccccugccccccagc

SEQ ID NO: 1368225 - RNA, 14 nt, Human
cccccugcaggaag

SEQ ID NO: 1368226 - RNA, 12 nt, Human
cccccugcagga

SEQ ID NO: 1368227 - RNA, 23 nt, Human
cccccugcagcuuguagccagcc

SEQ ID NO: 1368228 - RNA, 14 nt, Human
cccccugcagcuug

SEQ ID NO: 1368229 - RNA, 17 nt, Human
cccccugaccacucaga

SEQ ID NO: 1368230 - RNA, 11 nt, Human
cccccugcagc

SEQ ID NO: 1368231 - RNA, 14 nt, Human
cccccucccuggau

SEQ ID NO: 1368232 - RNA, 19 nt, Human
cccccuccgcccugccacu

SEQ ID NO: 1368233 - RNA, 16 nt, Human
cccccucccuggauga

SEQ ID NO: 1368234 - RNA, 13 nt, Human
cccccucccugga

SEQ ID NO: 1368235 - RNA, 12 nt, Human
cccccucccucc

SEQ ID NO: 1368236 - RNA, 16 nt, Human
cccccucugucuugug

SEQ ID NO: 1368237 - RNA, 12 nt, Human
cccccucugucc

SEQ ID NO: 1368238 - RNA, 12 nt, Human
cccccugugcag

SEQ ID NO: 1368239 - RNA, 18 nt, Human
cccccuguacacaacuca

SEQ ID NO: 1368240 - RNA, 20 nt, Human
cccccuguacacaacucacu

SEQ ID NO: 1368241 - RNA, 12 nt, Human
cccccuguacac

SEQ ID NO: 1368242 - RNA, 17 nt, Human
cccccugguccccuccu

SEQ ID NO: 1368243 - RNA, 15 nt, Human
cccccugguccccuc

SEQ ID NO: 1368244 - RNA, 21 nt, Human
cccccugccccccagccucug

SEQ ID NO: 1368245 - RNA, 23 nt, Human
cccccugucucucagggccaggc

SEQ ID NO: 1368246 - RNA, 21 nt, Human
cccccugugcagccgcugagc

SEQ ID NO: 1368247 - RNA, 13 nt, Human
ccccucaccccuc

SEQ ID NO: 1368248 - RNA, 20 nt, Human
ccccucacaguauugcucac

SEQ ID NO: 1368249 - RNA, 18 nt, Human
ccccucaaaucguccagc

SEQ ID NO: 1368250 - RNA, 20 nt, Human
ccccuagcgcuaucucccug

SEQ ID NO: 1368251 - RNA, 15 nt, Human
ccccuagccugccuc

SEQ ID NO: 1368252 - RNA, 19 nt, Human
ccccuggccucccccacuu

SEQ ID NO: 1368253 - RNA, 21 nt, Human
ccccuggcagagaugccuccc

SEQ ID NO: 1368254 - RNA, 12 nt, Human
ccccuggcagag

SEQ ID NO: 1368255 - RNA, 15 nt, Human
ccccuggagggggaa

SEQ ID NO: 1368256 - RNA, 20 nt, Human
ccccuggaggcacugaagug

SEQ ID NO: 1368257 - RNA, 14 nt, Human
ccccugcuuugggc

SEQ ID NO: 1368258 - RNA, 22 nt, Human
ccccugcuuugggcuugggccu

SEQ ID NO: 1368259 - RNA, 15 nt, Human
ccccugccugcccug

SEQ ID NO: 1368260 - RNA, 19 nt, Human
ccccugccugcccugguga

SEQ ID NO: 1368261 - RNA, 18 nt, Human
ccccugcccccugcagga

SEQ ID NO: 1368262 - RNA, 17 nt, Human
ccccugcccccugcagg

SEQ ID NO: 1368263 - RNA, 16 nt, Human
ccccugcccccugcag

SEQ ID NO: 1368264 - RNA, 15 nt, Human
ccccugcccccugca

SEQ ID NO: 1368265 - RNA, 18 nt, Human
ccccucugaccugcacug

SEQ ID NO: 1368266 - RNA, 15 nt, Human
ccccucugaccugca

SEQ ID NO: 1368267 - RNA, 13 nt, Human
ccccugccccucc

SEQ ID NO: 1368268 - RNA, 14 nt, Human
ccccugccucucug

SEQ ID NO: 1368269 - RNA, 15 nt, Human
ccccugccucucugc

SEQ ID NO: 1368270 - RNA, 16 nt, Human
ccccugccucucugca

SEQ ID NO: 1368271 - RNA, 17 nt, Human
ccccugccucucugcag

SEQ ID NO: 1368272 - RNA, 19 nt, Human
ccccugccucucugcaggu

SEQ ID NO: 1368273 - RNA, 22 nt, Human
cccgagcagcugagcagggccg

SEQ ID NO: 1368274 - RNA, 21 nt, Human
cccgagcagcugagcagggcc

SEQ ID NO: 1368275 - RNA, 19 nt, Human
cccgagcagcugagcaggg

SEQ ID NO: 1368276 - RNA, 16 nt, Human
cccgagcagcugagca

SEQ ID NO: 1368277 - RNA, 15 nt, Human
cccgagcagcugagc

SEQ ID NO: 1368278 - RNA, 13 nt, Human
cccgagcagcuga

SEQ ID NO: 1368279 - RNA, 12 nt, Human
cccgagcagcug

SEQ ID NO: 1368280 - RNA, 20 nt, Human
cccgagaaaacaaacccagg

SEQ ID NO: 1368281 - RNA, 21 nt, Human
cccgagaacauggccuaaggg

SEQ ID NO: 1368282 - RNA, 17 nt, Human
cccgacuggggcagggu

SEQ ID NO: 1368283 - RNA, 16 nt, Human
cccgcagacaccuugg

SEQ ID NO: 1368284 - RNA, 15 nt, Human
cccgcagacaccuug

SEQ ID NO: 1368285 - RNA, 14 nt, Human
cccgagcuccucuu

SEQ ID NO: 1368286 - RNA, 17 nt, Human
cccgagcuccucuucca

SEQ ID NO: 1368287 - RNA, 23 nt, Human
cccgcagugggagcaaacugcau

SEQ ID NO: 1368288 - RNA, 20 nt, Human
ccccugugcagccgcugagc

SEQ ID NO: 1368289 - RNA, 19 nt, Human
ccccugugcagccgcugag

SEQ ID NO: 1368290 - RNA, 14 nt, Human
ccccugugccuugu

SEQ ID NO: 1368291 - RNA, 14 nt, Human
ccccuguucaugcc

SEQ ID NO: 1368292 - RNA, 14 nt, Human
ccccuuccacugag

SEQ ID NO: 1368293 - RNA, 16 nt, Human
ccccuucauccucuga

SEQ ID NO: 1368294 - RNA, 20 nt, Human
ccccugggguggccaccagu

SEQ ID NO: 1368295 - RNA, 19 nt, Human
ccccugggguggccaccag

SEQ ID NO: 1368296 - RNA, 13 nt, Human
ccccugggguggc

SEQ ID NO: 1368297 - RNA, 23 nt, Human
ccccuggcugggacguggcucag

SEQ ID NO: 1368298 - RNA, 22 nt, Human
ccccuggcugggacguggcuca

SEQ ID NO: 1368299 - RNA, 11 nt, Human
ccccugugcag

SEQ ID NO: 1368300 - RNA, 23 nt, Human
ccccugucucucagggccaggcc

SEQ ID NO: 1368301 - RNA, 22 nt, Human
ccccugucucucagggccaggc

SEQ ID NO: 1368302 - RNA, 21 nt, Human
ccccugguccccuccuuccca

SEQ ID NO: 1368303 - RNA, 17 nt, Human
ccccugguccccuccuu

SEQ ID NO: 1368304 - RNA, 17 nt, Human
ccccuggucccucugca

SEQ ID NO: 1368305 - RNA, 18 nt, Human
ccccuggucccucugcag

SEQ ID NO: 1368306 - RNA, 23 nt, Human
ccccuggugcacuggccccaccc

SEQ ID NO: 1368307 - RNA, 14 nt, Human
cccucuccuuccug

SEQ ID NO: 1368308 - RNA, 17 nt, Human
cccucuccuuccugugu

SEQ ID NO: 1368309 - RNA, 22 nt, Human
cccucucccuugggcucugaug

SEQ ID NO: 1368310 - RNA, 17 nt, Human
cccucucccugcauggc

SEQ ID NO: 1368311 - RNA, 16 nt, Human
cccucucccugcaugg

SEQ ID NO: 1368312 - RNA, 15 nt, Human
cccucucccugcaug

SEQ ID NO: 1368313 - RNA, 14 nt, Human
cccucucccugcau

SEQ ID NO: 1368314 - RNA, 13 nt, Human
cccucucccugca

SEQ ID NO: 1368315 - RNA, 22 nt, Human
cccucuccccugcccccugcag

SEQ ID NO: 1368316 - RNA, 18 nt, Human
cccucuccccugcccccu

SEQ ID NO: 1368317 - RNA, 15 nt, Human
cccucuccccugccc

SEQ ID NO: 1368318 - RNA, 14 nt, Human
cccucucccaggcc

SEQ ID NO: 1368319 - RNA, 22 nt, Human
cccucuccccagggaagcagca

SEQ ID NO: 1368320 - RNA, 15 nt, Human
cccucuacagagcuu

SEQ ID NO: 1368321 - RNA, 20 nt, Human
cccucucccaggccccauga

SEQ ID NO: 1368322 - RNA, 13 nt, Human
cccucucccaggc

SEQ ID NO: 1368323 - RNA, 19 nt, Human
cccucucccacccucuucc

SEQ ID NO: 1368324 - RNA, 12 nt, Human
cccucucccagg

SEQ ID NO: 1368325 - RNA, 18 nt, Human
cccucucccacccucuuc

SEQ ID NO: 1368326 - RNA, 17 nt, Human
cccucucccacccucuu

SEQ ID NO: 1368327 - RNA, 13 nt, Human
cccucucccaccc

SEQ ID NO: 1368328 - RNA, 12 nt, Human
cccucucccacc

SEQ ID NO: 1368329 - RNA, 11 nt, Human
cccucucccac

SEQ ID NO: 1368330 - RNA, 16 nt, Human
cccucucauuuagccu

SEQ ID NO: 1368331 - RNA, 20 nt, Human
cccucucccaaaaaacuacu

SEQ ID NO: 1368332 - RNA, 16 nt, Human
cccucugggcucugag

SEQ ID NO: 1368333 - RNA, 12 nt, Human
cccucugggcuc

SEQ ID NO: 1368334 - RNA, 11 nt, Human
cccucugggcu

SEQ ID NO: 1368335 - RNA, 10 nt, Human
cccucugggc

SEQ ID NO: 1368336 - RNA, 19 nt, Human
cccucuuccuacuggucuc

SEQ ID NO: 1368337 - RNA, 14 nt, Human
cccucuuccuacug

SEQ ID NO: 1368338 - RNA, 22 nt, Human
cccucuuccuacuggucucucu

SEQ ID NO: 1368339 - RNA, 18 nt, Human
cccucuguuccuucccug

SEQ ID NO: 1368340 - RNA, 17 nt, Human
cccucugggcucugagu

SEQ ID NO: 1368341 - RNA, 20 nt, Human
cccucuguguauuugcuuuu

SEQ ID NO: 1368342 - RNA, 21 nt, Human
cccucuuuggcuccccuguac

SEQ ID NO: 1368343 - RNA, 20 nt, Human
cccucuuuggcuccccugua

SEQ ID NO: 1368344 - RNA, 19 nt, Human
cccucuuuggcuccccugu

SEQ ID NO: 1368345 - RNA, 17 nt, Human
cccucuuuggcuccccu

SEQ ID NO: 1368346 - RNA, 23 nt, Human
cccucuuggagaagucucagcua

SEQ ID NO: 1368347 - RNA, 15 nt, Human
cccucuuggagaagu

SEQ ID NO: 1368348 - RNA, 13 nt, Human
cccucuuccuucc

SEQ ID NO: 1368349 - RNA, 21 nt, Human
cccuccccuugccugugccag

SEQ ID NO: 1368350 - RNA, 23 nt, Human
cccuccccuugccugugccaggu

SEQ ID NO: 1368351 - RNA, 14 nt, Human
cccuccccuugccu

SEQ ID NO: 1368352 - RNA, 14 nt, Human
cccuccccuucucu

SEQ ID NO: 1368353 - RNA, 17 nt, Human
cccucccagagcaccug

SEQ ID NO: 1368354 - RNA, 15 nt, Human
cccucccuacccuaa

SEQ ID NO: 1368355 - RNA, 16 nt, Human
cccucccuacccuaac

SEQ ID NO: 1368356 - RNA, 16 nt, Human
cccucguggacaccug

SEQ ID NO: 1368357 - RNA, 17 nt, Human
cccucguggacaccugc

SEQ ID NO: 1368358 - RNA, 18 nt, Human
cccucguggacaccugcc

SEQ ID NO: 1368359 - RNA, 19 nt, Human
cccucguggacaccugccc

SEQ ID NO: 1368360 - RNA, 22 nt, Human
cccucguggacaccugcccugc

SEQ ID NO: 1368361 - RNA, 23 nt, Human
cccucguggacaccugcccugcc

SEQ ID NO: 1368362 - RNA, 12 nt, Human
cccuggggccug

SEQ ID NO: 1368363 - RNA, 18 nt, Human
cccuggggccuguacugc

SEQ ID NO: 1368364 - RNA, 17 nt, Human
cccuggggccuguacug

SEQ ID NO: 1368365 - RNA, 13 nt, Human
cccuggggccugu

SEQ ID NO: 1368366 - RNA, 16 nt, Human
cccugcugcugccugc

SEQ ID NO: 1368367 - RNA, 17 nt, Human
cccugcugcugccugcc

SEQ ID NO: 1368368 - RNA, 18 nt, Human
cccugcugcugccugccu

SEQ ID NO: 1368369 - RNA, 14 nt, Human
cccugggcuggaau

SEQ ID NO: 1368370 - RNA, 13 nt, Human
cccugggcuggaa

SEQ ID NO: 1368371 - RNA, 16 nt, Human
cccugcuuccugcuug

SEQ ID NO: 1368372 - RNA, 19 nt, Human
cccugcuuccugcuugcca

SEQ ID NO: 1368373 - RNA, 15 nt, Human
cccugcuuccugcuu

SEQ ID NO: 1368374 - RNA, 14 nt, Human
cccuuaaaggggag

SEQ ID NO: 1368375 - RNA, 20 nt, Human
cccuguuuuccccccaaggg

SEQ ID NO: 1368376 - RNA, 16 nt, Human
cccuguuuucccccca

SEQ ID NO: 1368377 - RNA, 22 nt, Human
cccuguuuucccacgaggaauc

SEQ ID NO: 1368378 - RNA, 17 nt, Human
cccuguuccugcugcug

SEQ ID NO: 1368379 - RNA, 20 nt, Human
cccuguuccugcugcugucu

SEQ ID NO: 1368380 - RNA, 16 nt, Human
cccuguuccugcugcu

SEQ ID NO: 1368381 - RNA, 15 nt, Human
cccuguuccugcugc

SEQ ID NO: 1368382 - RNA, 14 nt, Human
cccuguuccugcug

SEQ ID NO: 1368383 - RNA, 13 nt, Human
cccuguuccugcu

SEQ ID NO: 1368384 - RNA, 17 nt, Human
cccuguuccccagagaa

SEQ ID NO: 1368385 - RNA, 16 nt, Human
cccuguuccccagaga

SEQ ID NO: 1368386 - RNA, 14 nt, Human
cccuguuccccaga

SEQ ID NO: 1368387 - RNA, 21 nt, Human
cccuguccaaacugccuaagc

SEQ ID NO: 1368388 - RNA, 20 nt, Human
cccugucauccagcucacuc

SEQ ID NO: 1368389 - RNA, 14 nt, Human
cccuguccaaacug

SEQ ID NO: 1368390 - RNA, 15 nt, Human
cccugucagcaugaa

SEQ ID NO: 1368391 - RNA, 18 nt, Human
cccugucagcaugaauuu

SEQ ID NO: 1368392 - RNA, 15 nt, Human
cccuguaggccucag

SEQ ID NO: 1368393 - RNA, 14 nt, Human
cccuguaggccuca

SEQ ID NO: 1368394 - RNA, 21 nt, Human
cccuggugcacuggccccacc

SEQ ID NO: 1368395 - RNA, 12 nt, Human
cccuuauuuuca

SEQ ID NO: 1368396 - RNA, 19 nt, Human
cccuuaugcgguuaauuuu

SEQ ID NO: 1368397 - RNA, 17 nt, Human
cccuuaugacugccaag

SEQ ID NO: 1368398 - RNA, 16 nt, Human
cccuuauccucccugu

SEQ ID NO: 1368399 - RNA, 21 nt, Human
cccuuauccucccuguaacuu

SEQ ID NO: 1368400 - RNA, 13 nt, Human
cccuuccacugag

SEQ ID NO: 1368401 - RNA, 16 nt, Human
cccuuccacugagggc

SEQ ID NO: 1368402 - RNA, 14 nt, Human
cccuuauccucccu

SEQ ID NO: 1368403 - RNA, 22 nt, Human
cccuuagacagaggcccucaag

SEQ ID NO: 1368404 - RNA, 21 nt, Human
cccuuagacagaggcccucaa

SEQ ID NO: 1368405 - RNA, 16 nt, Human
cccuuagacagaggcc

SEQ ID NO: 1368406 - RNA, 15 nt, Human
cccuuagacagaggc

SEQ ID NO: 1368407 - RNA, 12 nt, Human
cccuuagacaga

SEQ ID NO: 1368408 - RNA, 15 nt, Human
cccuugcugugaauu

SEQ ID NO: 1368409 - RNA, 20 nt, Human
cccuugccugugccagguga

SEQ ID NO: 1368410 - RNA, 19 nt, Human
cccuugccugugccaggug

SEQ ID NO: 1368411 - RNA, 15 nt, Human
cccuugccugugcca

SEQ ID NO: 1368412 - RNA, 22 nt, Human
cccuugccccccuggccucccc

SEQ ID NO: 1368413 - RNA, 18 nt, Human
cccuugccccccuggccu

SEQ ID NO: 1368414 - RNA, 17 nt, Human
cccuugccccccuggcc

SEQ ID NO: 1368415 - RNA, 15 nt, Human
cccuugccccccugg

SEQ ID NO: 1368416 - RNA, 21 nt, Human
cccuugaucagccccacccug

SEQ ID NO: 1368417 - RNA, 16 nt, Human
cccuugaguccccauu

SEQ ID NO: 1368418 - RNA, 18 nt, Human
cccuugaggucucagccc

SEQ ID NO: 1368419 - RNA, 15 nt, Human
cccuugaggucucag

SEQ ID NO: 1368420 - RNA, 13 nt, Human
cccuucccucacc

SEQ ID NO: 1368421 - RNA, 15 nt, Human
cccuugaugaagaag

SEQ ID NO: 1368422 - RNA, 17 nt, Human
cccuugagcccucuaug

SEQ ID NO: 1368423 - RNA, 17 nt, Human
cccuucccuugagcccu

SEQ ID NO: 1368424 - RNA, 13 nt, Human
cccugcugccaug

SEQ ID NO: 1368425 - RNA, 13 nt, Human
cccugcugcugcc

SEQ ID NO: 1368426 - RNA, 17 nt, Human
cccugcucccacagaac

SEQ ID NO: 1368427 - RNA, 15 nt, Human
cccugcucauccacu

SEQ ID NO: 1368428 - RNA, 16 nt, Human
cccugcucaguaaagc

SEQ ID NO: 1368429 - RNA, 16 nt, Human
cccugcuacaccuauu

SEQ ID NO: 1368430 - RNA, 13 nt, Human
cccugcuacaccu

SEQ ID NO: 1368431 - RNA, 17 nt, Human
cccugcgguagauggga

SEQ ID NO: 1368432 - RNA, 22 nt, Human
cccugcgggugaacaaagcagc

SEQ ID NO: 1368433 - RNA, 22 nt, Human
cccugccuuaucuugcacccca

SEQ ID NO: 1368434 - RNA, 15 nt, Human
cccugccucucugca

SEQ ID NO: 1368435 - RNA, 20 nt, Human
cccugccucucccaggcagg

SEQ ID NO: 1368436 - RNA, 16 nt, Human
cccugccucucugcag

SEQ ID NO: 1368437 - RNA, 18 nt, Human
cccugcaggcugagugca

SEQ ID NO: 1368438 - RNA, 23 nt, Human
cccugcaggaaggagcugccugg

SEQ ID NO: 1368439 - RNA, 22 nt, Human
cccugcaggaaggagcugccug

SEQ ID NO: 1368440 - RNA, 21 nt, Human
cccugcaggaaggagcugccu

SEQ ID NO: 1368441 - RNA, 20 nt, Human
cccugcaggaaggagcugcc

SEQ ID NO: 1368442 - RNA, 19 nt, Human
cccugcaggaaggagcugc

SEQ ID NO: 1368443 - RNA, 18 nt, Human
cccugcaggaaggagcug

SEQ ID NO: 1368444 - RNA, 17 nt, Human
cccugcaggaaggagcu

SEQ ID NO: 1368445 - RNA, 15 nt, Human
cccugcaggaaggag

SEQ ID NO: 1368446 - RNA, 22 nt, Human
cccugcagcuuguagccagccg

SEQ ID NO: 1368447 - RNA, 21 nt, Human
cccugcagcuuguagccagcc

SEQ ID NO: 1368448 - RNA, 20 nt, Human
cccugcagcuuguagccagc

SEQ ID NO: 1368449 - RNA, 19 nt, Human
cccugcagcuuguagccag

SEQ ID NO: 1368450 - RNA, 21 nt, Human
cccugaggagucugagguccu

SEQ ID NO: 1368451 - RNA, 16 nt, Human
cccugaggagucugag

SEQ ID NO: 1368452 - RNA, 15 nt, Human
cccugaggagucuga

SEQ ID NO: 1368453 - RNA, 14 nt, Human
cccugaggagucug

SEQ ID NO: 1368454 - RNA, 13 nt, Human
cccugaggagucu

SEQ ID NO: 1368455 - RNA, 22 nt, Human
cccugaggagucugagguccug

SEQ ID NO: 1368456 - RNA, 19 nt, Human
cccugaggagucugagguc

SEQ ID NO: 1368457 - RNA, 18 nt, Human
cccugaggagucugaggu

SEQ ID NO: 1368458 - RNA, 23 nt, Human
cccugcccuuguuuggggcagga

SEQ ID NO: 1368459 - RNA, 19 nt, Human
cccugccucucccaggcag

SEQ ID NO: 1368460 - RNA, 15 nt, Human
cccugccucucccag

SEQ ID NO: 1368461 - RNA, 14 nt, Human
cccugccucuccca

SEQ ID NO: 1368462 - RNA, 17 nt, Human
cccugccuccugccggc

SEQ ID NO: 1368463 - RNA, 22 nt, Human
cccugccucucaucaacugaau

SEQ ID NO: 1368464 - RNA, 13 nt, Human
cccugccucucug

SEQ ID NO: 1368465 - RNA, 14 nt, Human
cccugccucucugc

SEQ ID NO: 1368466 - RNA, 20 nt, Human
ccgcucuacaucuucugccu

SEQ ID NO: 1368467 - RNA, 17 nt, Human
ccgaggacccaggaaag

SEQ ID NO: 1368468 - RNA, 17 nt, Human
ccgaggagggagagucu

SEQ ID NO: 1368469 - RNA, 13 nt, Human
ccgaggacccagg

SEQ ID NO: 1368470 - RNA, 16 nt, Human
ccgcagacaccuugga

SEQ ID NO: 1368471 - RNA, 15 nt, Human
ccgcagacaccuugg

SEQ ID NO: 1368472 - RNA, 13 nt, Human
ccgcagaaggaag

SEQ ID NO: 1368473 - RNA, 15 nt, Human
ccgcagaaggaaggc

SEQ ID NO: 1368474 - RNA, 14 nt, Human
ccgcagacaccuug

SEQ ID NO: 1368475 - RNA, 18 nt, Human
ccgcagaaggaaggcagg

SEQ ID NO: 1368476 - RNA, 18 nt, Human
ccgccucagccucccaaa

SEQ ID NO: 1368477 - RNA, 21 nt, Human
ccgagaggugggccagucugu

SEQ ID NO: 1368478 - RNA, 19 nt, Human
ccgagaggugggccagucu

SEQ ID NO: 1368479 - RNA, 15 nt, Human
ccgagaggugggcca

SEQ ID NO: 1368480 - RNA, 17 nt, Human
ccgacugcuuuggaccu

SEQ ID NO: 1368481 - RNA, 16 nt, Human
ccgacugcuuuggacc

SEQ ID NO: 1368482 - RNA, 20 nt, Human
ccgagaguccaucagccucc

SEQ ID NO: 1368483 - RNA, 21 nt, Human
ccgagaguccaucagccucca

SEQ ID NO: 1368484 - RNA, 19 nt, Human
ccgagaucaguauuuaacu

SEQ ID NO: 1368485 - RNA, 23 nt, Human
ccgacucacaccacuagccucag

SEQ ID NO: 1368486 - RNA, 14 nt, Human
ccgacucacaccac

SEQ ID NO: 1368487 - RNA, 20 nt, Human
ccgacucacaccacuagccu

SEQ ID NO: 1368488 - RNA, 14 nt, Human
ccgacugcuuugga

SEQ ID NO: 1368489 - RNA, 20 nt, Human
ccgacugaaaauauuguuuu

SEQ ID NO: 1368490 - RNA, 19 nt, Human
ccgcucuacaucuucugcc

SEQ ID NO: 1368491 - RNA, 18 nt, Human
ccgcucuacaucuucugc

SEQ ID NO: 1368492 - RNA, 20 nt, Human
ccggaggcggugggccuggu

SEQ ID NO: 1368493 - RNA, 14 nt, Human
ccgccuggccuggc

SEQ ID NO: 1368494 - RNA, 17 nt, Human
ccgccugggucuccuaa

SEQ ID NO: 1368495 - RNA, 22 nt, Human
ccgccuggaugcggauggccgg

SEQ ID NO: 1368496 - RNA, 16 nt, Human
ccgccugcccucaugg

SEQ ID NO: 1368497 - RNA, 14 nt, Human
ccgccugcccucau

SEQ ID NO: 1368498 - RNA, 20 nt, Human
ccgccucgaccucucucaaa

SEQ ID NO: 1368499 - RNA, 13 nt, Human
ccgggccacuccu

SEQ ID NO: 1368500 - RNA, 15 nt, Human
ccggcuccuggucac

SEQ ID NO: 1368501 - RNA, 17 nt, Human
ccggcucucaccuggcc

SEQ ID NO: 1368502 - RNA, 17 nt, Human
ccggcuccuggucaccu

SEQ ID NO: 1368503 - RNA, 14 nt, Human
ccggcuccugguca

SEQ ID NO: 1368504 - RNA, 18 nt, Human
ccggcucccuucuacagc

SEQ ID NO: 1368505 - RNA, 18 nt, Human
ccgggccacuccuuccug

SEQ ID NO: 1368506 - RNA, 20 nt, Human
ccggggugggguggcugcag

SEQ ID NO: 1368507 - RNA, 18 nt, Human
ccggggugggguggcugc

SEQ ID NO: 1368508 - RNA, 20 nt, Human
ccggggugcccacaggccgc

SEQ ID NO: 1368509 - RNA, 22 nt, Human
ccggggugagggggggcucccu

SEQ ID NO: 1368510 - RNA, 20 nt, Human
ccggggccugggcaggaggg

SEQ ID NO: 1368511 - RNA, 21 nt, Human
ccgggggcagucugagagagg

SEQ ID NO: 1368512 - RNA, 16 nt, Human
ccggggggucucuucu

SEQ ID NO: 1368513 - RNA, 23 nt, Human
ccuaggccugggcaguggauggc

SEQ ID NO: 1368514 - RNA, 13 nt, Human
ccuaggccugggc

SEQ ID NO: 1368515 - RNA, 15 nt, Human
ccuaggccugggcag

SEQ ID NO: 1368516 - RNA, 17 nt, Human
ccuagguguuuuguuca

SEQ ID NO: 1368517 - RNA, 16 nt, Human
ccuaggcuaggguggg

SEQ ID NO: 1368518 - RNA, 13 nt, Human
ccuacccucuaga

SEQ ID NO: 1368519 - RNA, 21 nt, Human
ccuacagggggucuggcuggu

SEQ ID NO: 1368520 - RNA, 19 nt, Human
ccuacagggggucuggcug

SEQ ID NO: 1368521 - RNA, 18 nt, Human
ccuacagggggucuggcu

SEQ ID NO: 1368522 - RNA, 23 nt, Human
ccuacucacacaggcauuuccug

SEQ ID NO: 1368523 - RNA, 16 nt, Human
ccuacuccaaaauguu

SEQ ID NO: 1368524 - RNA, 22 nt, Human
ccuacucacacaggcauuuccu

SEQ ID NO: 1368525 - RNA, 16 nt, Human
ccuacucacacaggca

SEQ ID NO: 1368526 - RNA, 15 nt, Human
ccuacucacacaggc

SEQ ID NO: 1368527 - RNA, 14 nt, Human
ccuacucacacagg

SEQ ID NO: 1368528 - RNA, 16 nt, Human
ccuacuagucaccaga

SEQ ID NO: 1368529 - RNA, 23 nt, Human
ccguucaugggggagggggcaga

SEQ ID NO: 1368530 - RNA, 16 nt, Human
ccguucaugggggagg

SEQ ID NO: 1368531 - RNA, 15 nt, Human
ccguucaugggggag

SEQ ID NO: 1368532 - RNA, 14 nt, Human
ccguucacaugugu

SEQ ID NO: 1368533 - RNA, 22 nt, Human
ccguggcccuuccuggacagcu

SEQ ID NO: 1368534 - RNA, 20 nt, Human
ccguggcccuuccuggacag

SEQ ID NO: 1368535 - RNA, 19 nt, Human
ccguggcccuuccuggaca

SEQ ID NO: 1368536 - RNA, 17 nt, Human
ccguggcccuuccugga

SEQ ID NO: 1368537 - RNA, 16 nt, Human
ccguggcccuuccugg

SEQ ID NO: 1368538 - RNA, 14 nt, Human
ccguggcccuuccu

SEQ ID NO: 1368539 - RNA, 20 nt, Human
ccguggcugcugugggaaau

SEQ ID NO: 1368540 - RNA, 17 nt, Human
ccguggcugcuguggga

SEQ ID NO: 1368541 - RNA, 16 nt, Human
ccguggcugcuguggg

SEQ ID NO: 1368542 - RNA, 21 nt, Human
ccguggcccuuccuggacagc

SEQ ID NO: 1368543 - RNA, 23 nt, Human
ccguggcuguggcauccagaguc

SEQ ID NO: 1368544 - RNA, 20 nt, Human
ccgugccaaguccagguccu

SEQ ID NO: 1368545 - RNA, 21 nt, Human
ccgugccaaguccagguccug

SEQ ID NO: 1368546 - RNA, 14 nt, Human
ccgugccaagucca

SEQ ID NO: 1368547 - RNA, 21 nt, Human
ccggggugggguggcugcagc

SEQ ID NO: 1368548 - RNA, 16 nt, Human
ccuacagggggucugg

SEQ ID NO: 1368549 - RNA, 13 nt, Human
ccuaaccugccga

SEQ ID NO: 1368550 - RNA, 12 nt, Human
ccuaaccugccg

SEQ ID NO: 1368551 - RNA, 12 nt, Human
ccguugcauuug

SEQ ID NO: 1368552 - RNA, 18 nt, Human
ccuaaccucgggccugcu

SEQ ID NO: 1368553 - RNA, 13 nt, Human
ccuaacccuuugu

SEQ ID NO: 1368554 - RNA, 11 nt, Human
ccuaaccaagu

SEQ ID NO: 1368555 - RNA, 19 nt, Human
ccuggacuuuccugcaacu

SEQ ID NO: 1368556 - RNA, 17 nt, Human
ccuggacuuuccugcaa

SEQ ID NO: 1368557 - RNA, 16 nt, Human
ccuggacuuuccugca

SEQ ID NO: 1368558 - RNA, 15 nt, Human
ccuggacuuuccugc

SEQ ID NO: 1368559 - RNA, 15 nt, Human
ccugcuaggccagag

SEQ ID NO: 1368560 - RNA, 14 nt, Human
ccuggacuuuccug

SEQ ID NO: 1368561 - RNA, 13 nt, Human
ccuggacuuuccu

SEQ ID NO: 1368562 - RNA, 16 nt, Human
ccugcuaggccagagc

SEQ ID NO: 1368563 - RNA, 14 nt, Human
ccugcuaggccaga

SEQ ID NO: 1368564 - RNA, 13 nt, Human
ccugcuaggccag

SEQ ID NO: 1368565 - RNA, 21 nt, Human
ccugcuacaccuauuauccca

SEQ ID NO: 1368566 - RNA, 23 nt, Human
ccugcuacaccuauuaucccagc

SEQ ID NO: 1368567 - RNA, 20 nt, Human
ccugcuacaccuauuauccc

SEQ ID NO: 1368568 - RNA, 14 nt, Human
ccugcuacaccuau

SEQ ID NO: 1368569 - RNA, 23 nt, Human
ccugccuguggcgccgucuccag

SEQ ID NO: 1368570 - RNA, 19 nt, Human
ccuggcaugucaacagcgu

SEQ ID NO: 1368571 - RNA, 23 nt, Human
ccuggcaucgcaccauucugacu

SEQ ID NO: 1368572 - RNA, 21 nt, Human
ccuggcaucgcaccauucuga

SEQ ID NO: 1368573 - RNA, 21 nt, Human
ccuggcaguccgugggacggg

SEQ ID NO: 1368574 - RNA, 15 nt, Human
ccuggagaccccacc

SEQ ID NO: 1368575 - RNA, 18 nt, Human
ccuggguagcgggggagg

SEQ ID NO: 1368576 - RNA, 18 nt, Human
ccuggggugacccggcac

SEQ ID NO: 1368577 - RNA, 15 nt, Human
ccuggggugacccgg

SEQ ID NO: 1368578 - RNA, 14 nt, Human
ccuggggucuggag

SEQ ID NO: 1368579 - RNA, 22 nt, Human
ccugggguauaaaacuuuccuc

SEQ ID NO: 1368580 - RNA, 22 nt, Human
ccugggagaaucgcuccugcag

SEQ ID NO: 1368581 - RNA, 22 nt, Human
ccugggagaaaucuggcuucug

SEQ ID NO: 1368582 - RNA, 23 nt, Human
ccugggaccgcuacaccacucug

SEQ ID NO: 1368583 - RNA, 17 nt, Human
ccugggaggagagacac

SEQ ID NO: 1368584 - RNA, 12 nt, Human
ccugggaggaga

SEQ ID NO: 1368585 - RNA, 21 nt, Human
ccuggcuuucauuuucucuca

SEQ ID NO: 1368586 - RNA, 16 nt, Human
ccuggcucucaccucu

SEQ ID NO: 1368587 - RNA, 15 nt, Human
ccuggcucucaccuc

SEQ ID NO: 1368588 - RNA, 14 nt, Human
ccuggcucucaccu

SEQ ID NO: 1368589 - RNA, 13 nt, Human
ccuggcucucacc

SEQ ID NO: 1368590 - RNA, 22 nt, Human
ccuggcuccuugugccagagaa

SEQ ID NO: 1368591 - RNA, 21 nt, Human
ccuggcuccuugugccagaga

SEQ ID NO: 1368592 - RNA, 20 nt, Human
ccuggcuccuugugccagag

SEQ ID NO: 1368593 - RNA, 21 nt, Human
ccuggcuccguccaggagccu

SEQ ID NO: 1368594 - RNA, 23 nt, Human
ccugggacaacugcucccaccuc

SEQ ID NO: 1368595 - RNA, 22 nt, Human
ccugggacaacugcucccaccu

SEQ ID NO: 1368596 - RNA, 19 nt, Human
ccugggacaacugcuccca

SEQ ID NO: 1368597 - RNA, 18 nt, Human
ccugggacaacugcuccc

SEQ ID NO: 1368598 - RNA, 15 nt, Human
ccugggacaacugcu

SEQ ID NO: 1368599 - RNA, 18 nt, Human
ccugggaaauauucccua

SEQ ID NO: 1368600 - RNA, 17 nt, Human
ccugggaaauauucccu

SEQ ID NO: 1368601 - RNA, 18 nt, Human
ccugggaaagccccugcc

SEQ ID NO: 1368602 - RNA, 22 nt, Human
ccuggcuuucauuuucucucag

SEQ ID NO: 1368603 - RNA, 23 nt, Human
ccuggcuuucauuuucucucagg

SEQ ID NO: 1368604 - RNA, 18 nt, Human
ccuggccccauggucagc

SEQ ID NO: 1368605 - RNA, 13 nt, Human
ccuggccccagga

SEQ ID NO: 1368606 - RNA, 12 nt, Human
ccuggccccagg

SEQ ID NO: 1368607 - RNA, 15 nt, Human
ccuggcccaucaggg

SEQ ID NO: 1368608 - RNA, 16 nt, Human
ccuggcccagccuuug

SEQ ID NO: 1368609 - RNA, 14 nt, Human
ccuggcccagccuu

SEQ ID NO: 1368610 - RNA, 13 nt, Human
ccuggcccagccu

SEQ ID NO: 1368611 - RNA, 12 nt, Human
ccuggcccagcc

SEQ ID NO: 1368612 - RNA, 22 nt, Human
ccuggcccaccccacccacuuc

SEQ ID NO: 1368613 - RNA, 21 nt, Human
ccuggcccaccccacccacuu

SEQ ID NO: 1368614 - RNA, 14 nt, Human
ccuggcccacccca

SEQ ID NO: 1368615 - RNA, 16 nt, Human
ccuggguuaaguauua

SEQ ID NO: 1368616 - RNA, 19 nt, Human
ccuggguccaaugcucagg

SEQ ID NO: 1368617 - RNA, 19 nt, Human
ccuggucucacccuggagg

SEQ ID NO: 1368618 - RNA, 21 nt, Human
ccuggucucacccuggaggca

SEQ ID NO: 1368619 - RNA, 18 nt, Human
ccuggucucacccuggag

SEQ ID NO: 1368620 - RNA, 17 nt, Human
ccuggucucacccugga

SEQ ID NO: 1368621 - RNA, 13 nt, Human
ccuggucucaccc

SEQ ID NO: 1368622 - RNA, 23 nt, Human
ccuguagaacucaaccucuacag

SEQ ID NO: 1368623 - RNA, 22 nt, Human
ccuguagaacucaaccucuaca

SEQ ID NO: 1368624 - RNA, 17 nt, Human
ccuguaccccagcacuu

SEQ ID NO: 1368625 - RNA, 14 nt, Human
ccuguaccccagca

SEQ ID NO: 1368626 - RNA, 12 nt, Human
ccuguaccucuu

SEQ ID NO: 1368627 - RNA, 16 nt, Human
ccuguacauuguggga

SEQ ID NO: 1368628 - RNA, 14 nt, Human
ccuguacaguguua

SEQ ID NO: 1368629 - RNA, 22 nt, Human
ccuguacaguagauuuuccaaa

SEQ ID NO: 1368630 - RNA, 10 nt, Human
ccuguaccuc

SEQ ID NO: 1368631 - RNA, 21 nt, Human
ccuguacaguagauuuuccaa

SEQ ID NO: 1368632 - RNA, 20 nt, Human
ccuguacaguagauuuucca

SEQ ID NO: 1368633 - RNA, 14 nt, Human
ccuguacaguagau

SEQ ID NO: 1368634 - RNA, 22 nt, Human
ccuguagccccagugacagcua

SEQ ID NO: 1368635 - RNA, 20 nt, Human
ccuguagccccagugacagc

SEQ ID NO: 1368636 - RNA, 17 nt, Human
ccuguagcacuuacugg

SEQ ID NO: 1368637 - RNA, 13 nt, Human
ccugucagcauga

SEQ ID NO: 1368638 - RNA, 12 nt, Human
ccugucagcaug

SEQ ID NO: 1368639 - RNA, 23 nt, Human
ccugucagauccaggagcuccag

SEQ ID NO: 1368640 - RNA, 22 nt, Human
ccugucagauccaggagcucca

SEQ ID NO: 1368641 - RNA, 20 nt, Human
ccugucagauccaggagcuc

SEQ ID NO: 1368642 - RNA, 19 nt, Human
ccugucagauccaggagcu

SEQ ID NO: 1368643 - RNA, 17 nt, Human
ccugucagauccaggag

SEQ ID NO: 1368644 - RNA, 16 nt, Human
ccuguaugucuccagu

SEQ ID NO: 1368645 - RNA, 19 nt, Human
ccuguauaccuccuccagc

SEQ ID NO: 1368646 - RNA, 14 nt, Human
ccuguauaccuccu

SEQ ID NO: 1368647 - RNA, 13 nt, Human
ccugucccacccc

SEQ ID NO: 1368648 - RNA, 11 nt, Human
ccugucccacc

SEQ ID NO: 1368649 - RNA, 20 nt, Human
ccugucaugguguccagaca

SEQ ID NO: 1368650 - RNA, 17 nt, Human
ccuguccaaacugccua

SEQ ID NO: 1368651 - RNA, 20 nt, Human
ccugucauccagcucacuca

SEQ ID NO: 1368652 - RNA, 20 nt, Human
ccugucagcaugaauuugua

SEQ ID NO: 1368653 - RNA, 22 nt, Human
ccugucagcaugaauuuguaau

SEQ ID NO: 1368654 - RNA, 17 nt, Human
ccugucagcaugaauuu

SEQ ID NO: 1368655 - RNA, 16 nt, Human
ccugucagcaugaauu

SEQ ID NO: 1368656 - RNA, 19 nt, Human
ccugucaucaucauggcca

SEQ ID NO: 1368657 - RNA, 18 nt, Human
ccugucccacccccaccc

SEQ ID NO: 1368658 - RNA, 17 nt, Human
ccugucccacccccacc

SEQ ID NO: 1368659 - RNA, 15 nt, Human
ccugucccaccccca

SEQ ID NO: 1368660 - RNA, 18 nt, Human
ccugagcugaggcagcag

SEQ ID NO: 1368661 - RNA, 14 nt, Human
ccugagcucagcgu

SEQ ID NO: 1368662 - RNA, 16 nt, Human
ccugagcugaggcagc

SEQ ID NO: 1368663 - RNA, 15 nt, Human
ccugagcugaggcag

SEQ ID NO: 1368664 - RNA, 17 nt, Human
ccugagcugaccagccg

SEQ ID NO: 1368665 - RNA, 14 nt, Human
ccugagcucugaua

SEQ ID NO: 1368666 - RNA, 13 nt, Human
ccugagcucagcg

SEQ ID NO: 1368667 - RNA, 12 nt, Human
ccugagcucagc

SEQ ID NO: 1368668 - RNA, 23 nt, Human
ccugagcgaguggagucugccac

SEQ ID NO: 1368669 - RNA, 22 nt, Human
ccugagcgaguggagucugcca

SEQ ID NO: 1368670 - RNA, 21 nt, Human
ccugagcgaguggagucugcc

SEQ ID NO: 1368671 - RNA, 20 nt, Human
ccugagcgaguggagucugc

SEQ ID NO: 1368672 - RNA, 19 nt, Human
ccugagcgaguggagucug

SEQ ID NO: 1368673 - RNA, 23 nt, Human
ccugagccugccgagcaaccgug

SEQ ID NO: 1368674 - RNA, 21 nt, Human
ccugagccugccgagcaaccg

SEQ ID NO: 1368675 - RNA, 20 nt, Human
ccugagccugccgagcaacc

SEQ ID NO: 1368676 - RNA, 17 nt, Human
ccugagccugccgagca

SEQ ID NO: 1368677 - RNA, 16 nt, Human
ccugagccugccgagc

SEQ ID NO: 1368678 - RNA, 15 nt, Human
ccugagccugccgag

SEQ ID NO: 1368679 - RNA, 14 nt, Human
ccugagccugccga

SEQ ID NO: 1368680 - RNA, 13 nt, Human
ccugagccugccg

SEQ ID NO: 1368681 - RNA, 12 nt, Human
ccugagccugcc

SEQ ID NO: 1368682 - RNA, 17 nt, Human
ccugagccggccccagg

SEQ ID NO: 1368683 - RNA, 16 nt, Human
ccugagccggccccag

SEQ ID NO: 1368684 - RNA, 21 nt, Human
ccugaauacccuuuucugacc

SEQ ID NO: 1368685 - RNA, 21 nt, Human
ccugagccccagggagagggg

SEQ ID NO: 1368686 - RNA, 12 nt, Human
ccugcaaacugg

SEQ ID NO: 1368687 - RNA, 20 nt, Human
ccugauccuggaggcccagu

SEQ ID NO: 1368688 - RNA, 19 nt, Human
ccugauccuggaggcccag

SEQ ID NO: 1368689 - RNA, 18 nt, Human
ccugauccuggaggccca

SEQ ID NO: 1368690 - RNA, 15 nt, Human
ccugauccuggaggc

SEQ ID NO: 1368691 - RNA, 13 nt, Human
ccugauccuggag

SEQ ID NO: 1368692 - RNA, 19 nt, Human
ccugaucccagagagcccg

SEQ ID NO: 1368693 - RNA, 17 nt, Human
ccugaucccagagagcc

SEQ ID NO: 1368694 - RNA, 14 nt, Human
ccugaucccagaga

SEQ ID NO: 1368695 - RNA, 13 nt, Human
ccugaucagagcc

SEQ ID NO: 1368696 - RNA, 19 nt, Human
ccugaucagaccacggcuc

SEQ ID NO: 1368697 - RNA, 18 nt, Human
ccugaucagaccacggcu

SEQ ID NO: 1368698 - RNA, 14 nt, Human
ccugaucagaccac

SEQ ID NO: 1368699 - RNA, 22 nt, Human
ccugcaaacugggaaccccuuu

SEQ ID NO: 1368700 - RNA, 20 nt, Human
ccugcaaacugggaaccccu

SEQ ID NO: 1368701 - RNA, 16 nt, Human
ccugcaaacugggaac

SEQ ID NO: 1368702 - RNA, 13 nt, Human
ccugcaaacuggg

SEQ ID NO: 1368703 - RNA, 22 nt, Human
ccugcacagugacuucugagau

SEQ ID NO: 1368704 - RNA, 21 nt, Human
ccugcacagugacuucugaga

SEQ ID NO: 1368705 - RNA, 20 nt, Human
ccugcacagugacuucugag

SEQ ID NO: 1368706 - RNA, 18 nt, Human
ccugcacagugacuucug

SEQ ID NO: 1368707 - RNA, 17 nt, Human
ccugcacagugacuucu

SEQ ID NO: 1368708 - RNA, 15 nt, Human
ccugcacagugacuu

SEQ ID NO: 1368709 - RNA, 19 nt, Human
ccugcacaauaaaaauguu

SEQ ID NO: 1368710 - RNA, 20 nt, Human
ccugcacaauaaaaauguuu

SEQ ID NO: 1368711 - RNA, 14 nt, Human
ccugcacuguaaaa

SEQ ID NO: 1368712 - RNA, 13 nt, Human
ccugcacuguaaa

SEQ ID NO: 1368713 - RNA, 12 nt, Human
ccugcacuguaa

SEQ ID NO: 1368714 - RNA, 11 nt, Human
ccugcacugua

SEQ ID NO: 1368715 - RNA, 21 nt, Human
ccugcacuggggagcccgucu

SEQ ID NO: 1368716 - RNA, 14 nt, Human
ccugcacuggggag

SEQ ID NO: 1368717 - RNA, 17 nt, Human
ccugcaccggggccugg

SEQ ID NO: 1368718 - RNA, 19 nt, Human
ccugcaccaugcugcuggg

SEQ ID NO: 1368719 - RNA, 15 nt, Human
ccugcaccggggccu

SEQ ID NO: 1368720 - RNA, 19 nt, Human
ccugccaccaggccaccuc

SEQ ID NO: 1368721 - RNA, 18 nt, Human
ccugccaccaggccaccu

SEQ ID NO: 1368722 - RNA, 15 nt, Human
ccugccaccaggcca

SEQ ID NO: 1368723 - RNA, 14 nt, Human
ccugccaccaggcc

SEQ ID NO: 1368724 - RNA, 13 nt, Human
ccugccaccaggc

SEQ ID NO: 1368725 - RNA, 12 nt, Human
ccugccaccagg

SEQ ID NO: 1368726 - RNA, 12 nt, Human
ccugccacagcc

SEQ ID NO: 1368727 - RNA, 17 nt, Human
ccugcacuuacuugcuu

SEQ ID NO: 1368728 - RNA, 14 nt, Human
ccugcacuuacuug

SEQ ID NO: 1368729 - RNA, 15 nt, Human
ccugcacuguaaaau

SEQ ID NO: 1368730 - RNA, 16 nt, Human
ccugcacuguaaaaug

SEQ ID NO: 1368731 - RNA, 23 nt, Human
ccugcauuggaacuggaggcagg

SEQ ID NO: 1368732 - RNA, 22 nt, Human
ccugcauuggaacuggaggcag

SEQ ID NO: 1368733 - RNA, 21 nt, Human
ccugcauuggaacuggaggca

SEQ ID NO: 1368734 - RNA, 20 nt, Human
ccugcauuggaacuggaggc

SEQ ID NO: 1368735 - RNA, 19 nt, Human
ccugcauuggaacuggagg

SEQ ID NO: 1368736 - RNA, 18 nt, Human
ccugcauuggaacuggag

SEQ ID NO: 1368737 - RNA, 16 nt, Human
ccugcauuggaacugg

SEQ ID NO: 1368738 - RNA, 18 nt, Human
ccugccacccagccccag

SEQ ID NO: 1368739 - RNA, 17 nt, Human
ccugccacccagcccca

SEQ ID NO: 1368740 - RNA, 14 nt, Human
ccugccacccagcc

SEQ ID NO: 1368741 - RNA, 18 nt, Human
ccugccaccuccccccac

SEQ ID NO: 1368742 - RNA, 13 nt, Human
ccugccaccuccc

SEQ ID NO: 1368743 - RNA, 14 nt, Human
ccugccaccuccug

SEQ ID NO: 1368744 - RNA, 16 nt, Human
ccugccaccuccugcc

SEQ ID NO: 1368745 - RNA, 19 nt, Human
ccugccaccuccugccuca

SEQ ID NO: 1368746 - RNA, 13 nt, Human
ccugaaauuccaa

SEQ ID NO: 1368747 - RNA, 20 nt, Human
ccugaaggggccaugauggc

SEQ ID NO: 1368748 - RNA, 23 nt, Human
ccugaaggccugagguuacugga

SEQ ID NO: 1368749 - RNA, 16 nt, Human
ccugaaggccugaggu

SEQ ID NO: 1368750 - RNA, 20 nt, Human
ccugaagcuaucguaaaauu

SEQ ID NO: 1368751 - RNA, 17 nt, Human
ccuaugauauuuucugu

SEQ ID NO: 1368752 - RNA, 14 nt, Human
ccucuucagaggcc

SEQ ID NO: 1368753 - RNA, 13 nt, Human
ccucuucagaggc

SEQ ID NO: 1368754 - RNA, 16 nt, Human
ccucuuccaugcugug

SEQ ID NO: 1368755 - RNA, 14 nt, Human
ccucuuccagucuu

SEQ ID NO: 1368756 - RNA, 12 nt, Human
ccucuuccaguc

SEQ ID NO: 1368757 - RNA, 18 nt, Human
ccucuucauggauggggg

SEQ ID NO: 1368758 - RNA, 16 nt, Human
ccucuucagaggcccu

SEQ ID NO: 1368759 - RNA, 12 nt, Human
ccuaucuuugcc

SEQ ID NO: 1368760 - RNA, 22 nt, Human
ccuaugacuugggcacccccag

SEQ ID NO: 1368761 - RNA, 17 nt, Human
ccuaugacuugggcacc

SEQ ID NO: 1368762 - RNA, 16 nt, Human
ccuaugacuugggcac

SEQ ID NO: 1368763 - RNA, 13 nt, Human
ccuaucuuugcca

SEQ ID NO: 1368764 - RNA, 15 nt, Human
ccuaucuuugccacc

SEQ ID NO: 1368765 - RNA, 19 nt, Human
ccuaucuuugccacccuca

SEQ ID NO: 1368766 - RNA, 20 nt, Human
ccuaucuuugccacccucau

SEQ ID NO: 1368767 - RNA, 15 nt, Human
ccugaaacaacuugg

SEQ ID NO: 1368768 - RNA, 22 nt, Human
ccugaaaagguuuaugaaaaag

SEQ ID NO: 1368769 - RNA, 18 nt, Human
ccugaaaacacugugcac

SEQ ID NO: 1368770 - RNA, 23 nt, Human
ccucuucuacucacuuuucccac

SEQ ID NO: 1368771 - RNA, 18 nt, Human
ccucuucuauuuuguaaa

SEQ ID NO: 1368772 - RNA, 17 nt, Human
ccucuucuauuuuguaa

SEQ ID NO: 1368773 - RNA, 21 nt, Human
ccucuucuacucacuuuuccc

SEQ ID NO: 1368774 - RNA, 15 nt, Human
ccucuucuacucacu

SEQ ID NO: 1368775 - RNA, 15 nt, Human
ccucuucccccaaga

SEQ ID NO: 1368776 - RNA, 16 nt, Human
ccucuucccccaagau

SEQ ID NO: 1368777 - RNA, 22 nt, Human
ccucuuccccagacgccuggcu

SEQ ID NO: 1368778 - RNA, 21 nt, Human
ccucuuccccagacgccuggc

SEQ ID NO: 1368779 - RNA, 13 nt, Human
ccucuuccccaga

SEQ ID NO: 1368780 - RNA, 12 nt, Human
ccucuuccccag

SEQ ID NO: 1368781 - RNA, 23 nt, Human
ccucuuccuucccugcugugaaa

SEQ ID NO: 1368782 - RNA, 19 nt, Human
ccugcccccugcaggaagg

SEQ ID NO: 1368783 - RNA, 22 nt, Human
ccugccccuccucucccucauc

SEQ ID NO: 1368784 - RNA, 23 nt, Human
ccugcccucauggccccucugac

SEQ ID NO: 1368785 - RNA, 21 nt, Human
ccugcccucauggccccucug

SEQ ID NO: 1368786 - RNA, 18 nt, Human
ccugcccuaccugcccca

SEQ ID NO: 1368787 - RNA, 20 nt, Human
ccugcccccugcaggaagga

SEQ ID NO: 1368788 - RNA, 16 nt, Human
ccugcccccugcagga

SEQ ID NO: 1368789 - RNA, 15 nt, Human
ccugcccccugcagg

SEQ ID NO: 1368790 - RNA, 14 nt, Human
ccugcccccugcag

SEQ ID NO: 1368791 - RNA, 22 nt, Human
ccugccccccagccucuggcau

SEQ ID NO: 1368792 - RNA, 18 nt, Human
ccugccccccagccucug

SEQ ID NO: 1368793 - RNA, 17 nt, Human
ccugccccccagccucu

SEQ ID NO: 1368794 - RNA, 15 nt, Human
ccugccccccagccu

SEQ ID NO: 1368795 - RNA, 19 nt, Human
ccugccagggcagggcccc

SEQ ID NO: 1368796 - RNA, 17 nt, Human
ccugccagggcagggcc

SEQ ID NO: 1368797 - RNA, 13 nt, Human
ccugccagggcag

SEQ ID NO: 1368798 - RNA, 23 nt, Human
ccugccaggaggacccagggcuc

SEQ ID NO: 1368799 - RNA, 19 nt, Human
ccugccaggaggacccagg

SEQ ID NO: 1368800 - RNA, 15 nt, Human
ccugccaggaggacc

SEQ ID NO: 1368801 - RNA, 22 nt, Human
ccugccacucacuaggccccca

SEQ ID NO: 1368802 - RNA, 21 nt, Human
ccugccacucacuaggccccc

SEQ ID NO: 1368803 - RNA, 18 nt, Human
ccugccacucacuaggcc

SEQ ID NO: 1368804 - RNA, 16 nt, Human
ccugccacucacuagg

SEQ ID NO: 1368805 - RNA, 15 nt, Human
ccugccacucacuag

SEQ ID NO: 1368806 - RNA, 13 nt, Human
ccugccacucacu

SEQ ID NO: 1368807 - RNA, 22 nt, Human
ccugccaggaggacccagggcu

SEQ ID NO: 1368808 - RNA, 22 nt, Human
ccugccaccuggaccccugcau

SEQ ID NO: 1368809 - RNA, 17 nt, Human
ccugccaccuggacccc

SEQ ID NO: 1368810 - RNA, 16 nt, Human
ccugccaccuggaccc

SEQ ID NO: 1368811 - RNA, 15 nt, Human
ccugccaccuggacc

SEQ ID NO: 1368812 - RNA, 13 nt, Human
ccugccaccugga

SEQ ID NO: 1368813 - RNA, 17 nt, Human
ccugccaccuccugccu

SEQ ID NO: 1368814 - RNA, 21 nt, Human
ccugccaccuggaccccugca

SEQ ID NO: 1368815 - RNA, 12 nt, Human
ccugccaccugu

SEQ ID NO: 1368816 - RNA, 13 nt, Human
ccugccaccuguc

SEQ ID NO: 1368817 - RNA, 14 nt, Human
ccugccaccugucu

SEQ ID NO: 1368818 - RNA, 15 nt, Human
ccugccaccugucug

SEQ ID NO: 1368819 - RNA, 16 nt, Human
ccugccaccugucugu

SEQ ID NO: 1368820 - RNA, 17 nt, Human
ccugccaccugucuguc

SEQ ID NO: 1368821 - RNA, 22 nt, Human
ccugcccuuguuuggggcagga

SEQ ID NO: 1368822 - RNA, 23 nt, Human
ccugccgagaguccaucagccuc

SEQ ID NO: 1368823 - RNA, 22 nt, Human
ccugccgagaguccaucagccu

SEQ ID NO: 1368824 - RNA, 21 nt, Human
ccugcccuuguuuggggcagg

SEQ ID NO: 1368825 - RNA, 14 nt, Human
ccugccgagagucc

SEQ ID NO: 1368826 - RNA, 14 nt, Human
ccugccuguggcca

SEQ ID NO: 1368827 - RNA, 12 nt, Human
ccugccuguggc

SEQ ID NO: 1368828 - RNA, 22 nt, Human
ccugccgagcaaccguggcccu

SEQ ID NO: 1368829 - RNA, 21 nt, Human
ccugcccugccaccugucugu

SEQ ID NO: 1368830 - RNA, 18 nt, Human
ccugcccugccaccuguc

SEQ ID NO: 1368831 - RNA, 15 nt, Human
ccugcccugcccugc

SEQ ID NO: 1368832 - RNA, 16 nt, Human
ccugcccugcccugcc

SEQ ID NO: 1368833 - RNA, 17 nt, Human
ccugcccugcccugcca

SEQ ID NO: 1368834 - RNA, 11 nt, Human
ccugcccugcc

SEQ ID NO: 1368835 - RNA, 12 nt, Human
ccugcccugcca

SEQ ID NO: 1368836 - RNA, 14 nt, Human
ccugcccugccacc

SEQ ID NO: 1368837 - RNA, 15 nt, Human
ccugcccugccaccu

SEQ ID NO: 1368838 - RNA, 17 nt, Human
ccugcccugccaccugu

SEQ ID NO: 1368839 - RNA, 13 nt, Human
ccuugugcugggg

SEQ ID NO: 1368840 - RNA, 23 nt, Human
ccuugugaugucauacagagaag

SEQ ID NO: 1368841 - RNA, 12 nt, Human
ccuugugccaga

SEQ ID NO: 1368842 - RNA, 20 nt, Human
ccuugugaugugcacguaaa

SEQ ID NO: 1368843 - RNA, 22 nt, Human
ccuugugaugucauacagagaa

SEQ ID NO: 1368844 - RNA, 21 nt, Human
ccuugugaugucauacagaga

SEQ ID NO: 1368845 - RNA, 20 nt, Human
ccuugugaaucaagggucag

SEQ ID NO: 1368846 - RNA, 21 nt, Human
ccuugucuuauucccuuccug

SEQ ID NO: 1368847 - RNA, 19 nt, Human
ccuugucuuauucccuucc

SEQ ID NO: 1368848 - RNA, 17 nt, Human
ccuuguauccccugcag

SEQ ID NO: 1368849 - RNA, 21 nt, Human
ccuugugggccugggcuccug

SEQ ID NO: 1368850 - RNA, 20 nt, Human
ccuugugggccugggcuccu

SEQ ID NO: 1368851 - RNA, 17 nt, Human
ccuugugggccugggcu

SEQ ID NO: 1368852 - RNA, 16 nt, Human
ccuugugggccugggc

SEQ ID NO: 1368853 - RNA, 15 nt, Human
ccuugugggccuggg

SEQ ID NO: 1368854 - RNA, 19 nt, Human
ccuuugggcuucagcugcc

SEQ ID NO: 1368855 - RNA, 22 nt, Human
ccuuugggcuucagcugccagu

SEQ ID NO: 1368856 - RNA, 24 nt, Human
ccuuuguauucucuccuguaccuc

SEQ ID NO: 1368857 - RNA, 22 nt, Human
ccuuuguauucucuccuguacc

SEQ ID NO: 1368858 - RNA, 23 nt, Human
ccuuuguauucucuccuguaccu

SEQ ID NO: 1368859 - RNA, 12 nt, Human
ccuuuuaaagaa

SEQ ID NO: 1368860 - RNA, 23 nt, Human
ccuuuguuggagucaaaaagaac

SEQ ID NO: 1368861 - RNA, 21 nt, Human
ccuuuguuccccacuggagca

SEQ ID NO: 1368862 - RNA, 20 nt, Human
ccuuuguuccccacuggagc

SEQ ID NO: 1368863 - RNA, 18 nt, Human
ccuuuguuccccacugga

SEQ ID NO: 1368864 - RNA, 20 nt, Human
ccuuugugugcucuccauuc

SEQ ID NO: 1368865 - RNA, 18 nt, Human
ccuuugugugcucuccau

SEQ ID NO: 1368866 - RNA, 17 nt, Human
ccuuugugugcucucca

SEQ ID NO: 1368867 - RNA, 14 nt, Human
ccuuugugugcucu

SEQ ID NO: 1368868 - RNA, 14 nt, Human
ccuuugugcccuau

SEQ ID NO: 1368869 - RNA, 13 nt, Human
ccuuugugcccua

SEQ ID NO: 1368870 - RNA, 22 nt, Human
ccuuugugcacauuuauuuccu

SEQ ID NO: 1368871 - RNA, 16 nt, Human
ccuuugugagucaaua

SEQ ID NO: 1368872 - RNA, 13 nt, Human
ccuuugugaguca

SEQ ID NO: 1368873 - RNA, 14 nt, Human
ccuuuuuuccccag

SEQ ID NO: 1368874 - RNA, 13 nt, Human
ccuuuuuugauca

SEQ ID NO: 1368875 - RNA, 12 nt, Human
ccuuuuuugauc

SEQ ID NO: 1368876 - RNA, 15 nt, Human
ccuuuuuucuguaua

SEQ ID NO: 1368877 - RNA, 15 nt, Human
ccuuuuuuccccaga

SEQ ID NO: 1368878 - RNA, 18 nt, Human
ccuuuuuuccccagacuu

SEQ ID NO: 1368879 - RNA, 23 nt, Human
cgaagcccagagggucugggggc

SEQ ID NO: 1368880 - RNA, 18 nt, Human
cgaagcccagagggucug

SEQ ID NO: 1368881 - RNA, 21 nt, Human
cgaagcguuguccucagcccc

SEQ ID NO: 1368882 - RNA, 17 nt, Human
cgaagcguuguccucag

SEQ ID NO: 1368883 - RNA, 16 nt, Human
cgaagcguuguccuca

SEQ ID NO: 1368884 - RNA, 15 nt, Human
cgaagcguuguccuc

SEQ ID NO: 1368885 - RNA, 22 nt, Human
cgaaauguuauuuuuuaauuau

SEQ ID NO: 1368886 - RNA, 14 nt, Human
cgaaauguuauuuu

SEQ ID NO: 1368887 - RNA, 13 nt, Human
cgaaauguuauuu

SEQ ID NO: 1368888 - RNA, 22 nt, Human
cgaaauaauuguuguucuguua

SEQ ID NO: 1368889 - RNA, 21 nt, Human
cgaaauaauuguuguucuguu

SEQ ID NO: 1368890 - RNA, 20 nt, Human
cgaaauaauuguuguucugu

SEQ ID NO: 1368891 - RNA, 19 nt, Human
cgaaauaauuguuguucug

SEQ ID NO: 1368892 - RNA, 16 nt, Human
cgaaauaauuguuguu

SEQ ID NO: 1368893 - RNA, 18 nt, Human
cgaaugugucuuuagaua

SEQ ID NO: 1368894 - RNA, 19 nt, Human
cgaaugugucuuuagauag

SEQ ID NO: 1368895 - RNA, 16 nt, Human
cgaaugugucuuuaga

SEQ ID NO: 1368896 - RNA, 15 nt, Human
cgaaugugucuuuag

SEQ ID NO: 1368897 - RNA, 14 nt, Human
cgaaugugucuuua

SEQ ID NO: 1368898 - RNA, 13 nt, Human
cgaaugugucuuu

SEQ ID NO: 1368899 - RNA, 13 nt, Human
cgaaugacacugu

SEQ ID NO: 1368900 - RNA, 16 nt, Human
cgaaugacacuguuca

SEQ ID NO: 1368901 - RNA, 12 nt, Human
cgaaugacacug

SEQ ID NO: 1368902 - RNA, 22 nt, Human
cgaaucucuuuuugcuuucgaa

SEQ ID NO: 1368903 - RNA, 16 nt, Human
cgaaucucugugccuu

SEQ ID NO: 1368904 - RNA, 12 nt, Human
cgaaucucugug

SEQ ID NO: 1368905 - RNA, 17 nt, Human
cgaaucuacuaauucca

SEQ ID NO: 1368906 - RNA, 23 nt, Human
cgaaggaaaagggcuuucucaau

SEQ ID NO: 1368907 - RNA, 17 nt, Human
cgaagcuaacagggaag

SEQ ID NO: 1368908 - RNA, 22 nt, Human
cgaagcuaacagggaaggcagg

SEQ ID NO: 1368909 - RNA, 20 nt, Human
ccuuguauccccugcaggcu

SEQ ID NO: 1368910 - RNA, 17 nt, Human
ccuuguagcuccucccc

SEQ ID NO: 1368911 - RNA, 15 nt, Human
ccuuguagcuccucc

SEQ ID NO: 1368912 - RNA, 14 nt, Human
ccuuguagcuccuc

SEQ ID NO: 1368913 - RNA, 19 nt, Human
ccuuguaauucuaaaugaa

SEQ ID NO: 1368914 - RNA, 16 nt, Human
ccuuguaauucuaaau

SEQ ID NO: 1368915 - RNA, 23 nt, Human
ccuugguuuuuacugcucugaga

SEQ ID NO: 1368916 - RNA, 21 nt, Human
ccuugguuuuuacugcucuga

SEQ ID NO: 1368917 - RNA, 22 nt, Human
ccuugguugucuggcaaggacu

SEQ ID NO: 1368918 - RNA, 21 nt, Human
ccuugguugucuggcaaggac

SEQ ID NO: 1368919 - RNA, 22 nt, Human
ccuugguucuugaggggaccag

SEQ ID NO: 1368920 - RNA, 13 nt, Human
ccuugguuccuaa

SEQ ID NO: 1368921 - RNA, 16 nt, Human
ccuugguucccccacu

SEQ ID NO: 1368922 - RNA, 20 nt, Human
ccuugggcucugaugaaaaa

SEQ ID NO: 1368923 - RNA, 15 nt, Human
ccuugggcucugaug

SEQ ID NO: 1368924 - RNA, 14 nt, Human
ccuugggcucugau

SEQ ID NO: 1368925 - RNA, 21 nt, Human
ccuugggcuccgugugggaga

SEQ ID NO: 1368926 - RNA, 13 nt, Human
ccuugggcucccu

SEQ ID NO: 1368927 - RNA, 12 nt, Human
ccuugggcuccc

SEQ ID NO: 1368928 - RNA, 16 nt, Human
ccuugggcucugauga

SEQ ID NO: 1368929 - RNA, 14 nt, Human
ccuuggccuguguu

SEQ ID NO: 1368930 - RNA, 15 nt, Human
ccuuggccuggagca

SEQ ID NO: 1368931 - RNA, 21 nt, Human
ccuuggccuggagcacaaaga

SEQ ID NO: 1368932 - RNA, 14 nt, Human
ccuuggccuggagc

SEQ ID NO: 1368933 - RNA, 13 nt, Human
ccuuggccuggag

SEQ ID NO: 1368934 - RNA, 12 nt, Human
ccuuggccugga

SEQ ID NO: 1368935 - RNA, 16 nt, Human
ccuuggccucuuuccu

SEQ ID NO: 1368936 - RNA, 19 nt, Human
ccuuccuguuuuucacauu

SEQ ID NO: 1368937 - RNA, 17 nt, Human
ccuuccuguuuuucaca

SEQ ID NO: 1368938 - RNA, 19 nt, Human
ccuuccuggggcaucuggc

SEQ ID NO: 1368939 - RNA, 17 nt, Human
ccuucgucuuucccaug

SEQ ID NO: 1368940 - RNA, 16 nt, Human
ccuucgucuuucccau

SEQ ID NO: 1368941 - RNA, 16 nt, Human
ccuucgggcugugccc

SEQ ID NO: 1368942 - RNA, 15 nt, Human
ccuucgggcugugcc

SEQ ID NO: 1368943 - RNA, 22 nt, Human
ccuuccuguuuuucacauuuuc

SEQ ID NO: 1368944 - RNA, 17 nt, Human
ccuuccagcuccuguaa

SEQ ID NO: 1368945 - RNA, 16 nt, Human
ccuuccagcuccugua

SEQ ID NO: 1368946 - RNA, 15 nt, Human
ccuuccagcuccugu

SEQ ID NO: 1368947 - RNA, 13 nt, Human
ccuuccagcuccu

SEQ ID NO: 1368948 - RNA, 12 nt, Human
ccuuccagcucc

SEQ ID NO: 1368949 - RNA, 20 nt, Human
ccuuccuggagacugcccag

SEQ ID NO: 1368950 - RNA, 22 nt, Human
ccuuccuggacagcugugccuc

SEQ ID NO: 1368951 - RNA, 21 nt, Human
ccuuccuggacagcugugccu

SEQ ID NO: 1368952 - RNA, 20 nt, Human
ccuuccuggacagcugugcc

SEQ ID NO: 1368953 - RNA, 19 nt, Human
ccuuccuggacagcugugc

SEQ ID NO: 1368954 - RNA, 18 nt, Human
ccuuccuggacagcugug

SEQ ID NO: 1368955 - RNA, 17 nt, Human
ccuuccuggacagcugu

SEQ ID NO: 1368956 - RNA, 23 nt, Human
ccuuccauggugugaucgucuga

SEQ ID NO: 1368957 - RNA, 23 nt, Human
ccuucuccccugcacuguaaaau

SEQ ID NO: 1368958 - RNA, 24 nt, Human
ccuucuccccugcacuguaaaaug

SEQ ID NO: 1368959 - RNA, 22 nt, Human
ccuucuccccugcacuguaaaa

SEQ ID NO: 1368960 - RNA, 17 nt, Human
ccuucuccccugcacug

SEQ ID NO: 1368961 - RNA, 16 nt, Human
ccuucuccccugcacu

SEQ ID NO: 1368962 - RNA, 15 nt, Human
ccuucuccccugcac

SEQ ID NO: 1368963 - RNA, 13 nt, Human
ccuucuccccugc

SEQ ID NO: 1368964 - RNA, 23 nt, Human
ccuucuccccagcucccaggacc

SEQ ID NO: 1368965 - RNA, 21 nt, Human
ccuucuccccagcucccagga

SEQ ID NO: 1368966 - RNA, 20 nt, Human
ccuucuccccagcucccagg

SEQ ID NO: 1368967 - RNA, 19 nt, Human
ccuucuccccagcucccag

SEQ ID NO: 1368968 - RNA, 18 nt, Human
ccuucuccccagcuccca

SEQ ID NO: 1368969 - RNA, 16 nt, Human
ccuucuauuuggggcu

SEQ ID NO: 1368970 - RNA, 22 nt, Human
ccuucuauuuggggcuugauga

SEQ ID NO: 1368971 - RNA, 15 nt, Human
ccuucuauuuggggc

SEQ ID NO: 1368972 - RNA, 14 nt, Human
ccuucuauuugggg

SEQ ID NO: 1368973 - RNA, 22 nt, Human
ccuucuccauccacaugggagc

SEQ ID NO: 1368974 - RNA, 16 nt, Human
ccuucuccauccacau

SEQ ID NO: 1368975 - RNA, 13 nt, Human
ccuucuccaucca

SEQ ID NO: 1368976 - RNA, 11 nt, Human
ccuucuccauc

SEQ ID NO: 1368977 - RNA, 22 nt, Human
ccuucuccauggcccugccaug

SEQ ID NO: 1368978 - RNA, 17 nt, Human
ccuucuccccagcuccc

SEQ ID NO: 1368979 - RNA, 14 nt, Human
ccuucuccccagcu

SEQ ID NO: 1368980 - RNA, 13 nt, Human
ccuucuccccagc

SEQ ID NO: 1368981 - RNA, 12 nt, Human
ccuucuccccag

SEQ ID NO: 1368982 - RNA, 20 nt, Human
ccuucucccacucuccuagg

SEQ ID NO: 1368983 - RNA, 18 nt, Human
ccuucucccacucuccua

SEQ ID NO: 1368984 - RNA, 17 nt, Human
ccuucucccacucuccu

SEQ ID NO: 1368985 - RNA, 15 nt, Human
ccuucucccacucuc

SEQ ID NO: 1368986 - RNA, 14 nt, Human
ccuucucccacucu

SEQ ID NO: 1368987 - RNA, 13 nt, Human
ccuucucccacuc

SEQ ID NO: 1368988 - RNA, 19 nt, Human
ccuucuccauggcccugcc

SEQ ID NO: 1368989 - RNA, 23 nt, Human
ccuuccagcuagugacccacaug

SEQ ID NO: 1368990 - RNA, 15 nt, Human
ccuucauuuccuccg

SEQ ID NO: 1368991 - RNA, 14 nt, Human
ccuucauuuccucc

SEQ ID NO: 1368992 - RNA, 13 nt, Human
ccuucauuuccuc

SEQ ID NO: 1368993 - RNA, 12 nt, Human
ccuucauuuccu

SEQ ID NO: 1368994 - RNA, 23 nt, Human
ccuucauugccuuaacuggagcc

SEQ ID NO: 1368995 - RNA, 23 nt, Human
ccuucauucugcaaguauacuag

SEQ ID NO: 1368996 - RNA, 20 nt, Human
ccuucauugccuuaacugga

SEQ ID NO: 1368997 - RNA, 15 nt, Human
ccuucaugcauggaa

SEQ ID NO: 1368998 - RNA, 19 nt, Human
ccugugguucugagauggc

SEQ ID NO: 1368999 - RNA, 15 nt, Human
ccugugguucugaga

SEQ ID NO: 1369000 - RNA, 16 nt, Human
ccuguggucacugacu

SEQ ID NO: 1369001 - RNA, 22 nt, Human
ccugugggggguaaucccugcu

SEQ ID NO: 1369002 - RNA, 18 nt, Human
ccuucaugacagccucca

SEQ ID NO: 1369003 - RNA, 17 nt, Human
ccuucaugacagccucc

SEQ ID NO: 1369004 - RNA, 12 nt, Human
ccuucaugcaug

SEQ ID NO: 1369005 - RNA, 21 nt, Human
ccuucaugcauggaaauuccc

SEQ ID NO: 1369006 - RNA, 17 nt, Human
ccugugcucagcccuga

SEQ ID NO: 1369007 - RNA, 16 nt, Human
ccugugcucagcccug

SEQ ID NO: 1369008 - RNA, 15 nt, Human
ccugugcucagcccu

SEQ ID NO: 1369009 - RNA, 14 nt, Human
ccugugcucagccc

SEQ ID NO: 1369010 - RNA, 15 nt, Human
ccugugccugacccu

SEQ ID NO: 1369011 - RNA, 9 nt, Human
ccuguccuc

SEQ ID NO: 1369012 - RNA, 14 nt, Human
ccugugggagccuc

SEQ ID NO: 1369013 - RNA, 13 nt, Human
ccugugggagccu

SEQ ID NO: 1369014 - RNA, 22 nt, Human
ccuguggcgccgucuccagggg

SEQ ID NO: 1369015 - RNA, 17 nt, Human
ccugugggagccucgca

SEQ ID NO: 1369016 - RNA, 16 nt, Human
ccugugggagccucgc

SEQ ID NO: 1369017 - RNA, 15 nt, Human
ccugugggagccucg

SEQ ID NO: 1369018 - RNA, 21 nt, Human
ccuguggcgccgucuccaggg

SEQ ID NO: 1369019 - RNA, 12 nt, Human
ccuguggauauu

SEQ ID NO: 1369020 - RNA, 18 nt, Human
ccuguggaucaaauccag

SEQ ID NO: 1369021 - RNA, 16 nt, Human
cgcuuugauucauagu

SEQ ID NO: 1369022 - RNA, 18 nt, Human
cgcccacaggaagccugc

SEQ ID NO: 1369023 - RNA, 15 nt, Human
cgaugcaaugaacac

SEQ ID NO: 1369024 - RNA, 23 nt, Human
cgaggccuaccccgcagacaccu

SEQ ID NO: 1369025 - RNA, 17 nt, Human
cgaggccuaccccgcag

SEQ ID NO: 1369026 - RNA, 13 nt, Human
cgaggcccgcaug

SEQ ID NO: 1369027 - RNA, 22 nt, Human
cgaggaguaacaauacaaaugg

SEQ ID NO: 1369028 - RNA, 21 nt, Human
cgaggaguaacaauacaaaug

SEQ ID NO: 1369029 - RNA, 14 nt, Human
cgaggaguaacaau

SEQ ID NO: 1369030 - RNA, 13 nt, Human
cgaggaguaacaa

SEQ ID NO: 1369031 - RNA, 12 nt, Human
cgaggaguaaca

SEQ ID NO: 1369032 - RNA, 22 nt, Human
cgaggaggugucucaggcugcc

SEQ ID NO: 1369033 - RNA, 21 nt, Human
cgaggaggugucucaggcugc

SEQ ID NO: 1369034 - RNA, 20 nt, Human
cgaggaggugucucaggcug

SEQ ID NO: 1369035 - RNA, 18 nt, Human
cgaggaggugucucaggc

SEQ ID NO: 1369036 - RNA, 18 nt, Human
cgaggagggagagucucc

SEQ ID NO: 1369037 - RNA, 23 nt, Human
cgaggagggagagucucccaggg

SEQ ID NO: 1369038 - RNA, 17 nt, Human
cgaggagguaaugaauu

SEQ ID NO: 1369039 - RNA, 20 nt, Human
cgaggaggcuccagagggca

SEQ ID NO: 1369040 - RNA, 19 nt, Human
cgaggaggcuccagagggc

SEQ ID NO: 1369041 - RNA, 15 nt, Human
cgaggacccaggaaa

SEQ ID NO: 1369042 - RNA, 14 nt, Human
cgagcgcccugcag

SEQ ID NO: 1369043 - RNA, 13 nt, Human
cgagcgcccugca

SEQ ID NO: 1369044 - RNA, 19 nt, Human
cgagcgcccagcuccugac

SEQ ID NO: 1369045 - RNA, 15 nt, Human
cgagcgcccagcucc

SEQ ID NO: 1369046 - RNA, 17 nt, Human
cgagagauguguguuga

SEQ ID NO: 1369047 - RNA, 14 nt, Human
cgagagaugugugu

SEQ ID NO: 1369048 - RNA, 13 nt, Human
cgagagaugugug

SEQ ID NO: 1369049 - RNA, 12 nt, Human
cgagagaugugu

SEQ ID NO: 1369050 - RNA, 17 nt, Human
cgagagaucaaagauga

SEQ ID NO: 1369051 - RNA, 16 nt, Human
cgagagaucaaagaug

SEQ ID NO: 1369052 - RNA, 14 nt, Human
cgagacuuuccauu

SEQ ID NO: 1369053 - RNA, 22 nt, Human
cgcacugugacccccagcuccg

SEQ ID NO: 1369054 - RNA, 17 nt, Human
cgcacugugacccccag

SEQ ID NO: 1369055 - RNA, 14 nt, Human
cgaugcccagagac

SEQ ID NO: 1369056 - RNA, 13 nt, Human
cgaugcccagaga

SEQ ID NO: 1369057 - RNA, 12 nt, Human
cgaugcccagag

SEQ ID NO: 1369058 - RNA, 13 nt, Human
cgaugccagccaa

SEQ ID NO: 1369059 - RNA, 16 nt, Human
cgcaccugccucagga

SEQ ID NO: 1369060 - RNA, 15 nt, Human
cgcaccugccucagg

SEQ ID NO: 1369061 - RNA, 14 nt, Human
cgcaccugccucag

SEQ ID NO: 1369062 - RNA, 16 nt, Human
cgcacggcagccacag

SEQ ID NO: 1369063 - RNA, 15 nt, Human
cgcuucuugccucug

SEQ ID NO: 1369064 - RNA, 20 nt, Human
cgcuuaucaacuaaugauuu

SEQ ID NO: 1369065 - RNA, 13 nt, Human
cgcuguugcugaa

SEQ ID NO: 1369066 - RNA, 14 nt, Human
cgcuguugcugaau

SEQ ID NO: 1369067 - RNA, 17 nt, Human
cgcuguugcugaauagg

SEQ ID NO: 1369068 - RNA, 18 nt, Human
cgcuccugcagccccagc

SEQ ID NO: 1369069 - RNA, 14 nt, Human
cgcuccugcagccc

SEQ ID NO: 1369070 - RNA, 17 nt, Human
cgcuccccacucugcuc

SEQ ID NO: 1369071 - RNA, 19 nt, Human
cgcuccccacucugcucug

SEQ ID NO: 1369072 - RNA, 16 nt, Human
cgcuccccacucugcu

SEQ ID NO: 1369073 - RNA, 15 nt, Human
cgcuccccacucugc

SEQ ID NO: 1369074 - RNA, 16 nt, Human
cgcuccagcugccccg

SEQ ID NO: 1369075 - RNA, 18 nt, Human
cgcuccagcugccccggc

SEQ ID NO: 1369076 - RNA, 17 nt, Human
cgcuccuggcccagccu

SEQ ID NO: 1369077 - RNA, 18 nt, Human
cgcuccuggcccagccuu

SEQ ID NO: 1369078 - RNA, 16 nt, Human
cgcuccuggcccagcc

SEQ ID NO: 1369079 - RNA, 15 nt, Human
cgcuccuggcccagc

SEQ ID NO: 1369080 - RNA, 23 nt, Human
cgcuccugcuaacggugcucagg

SEQ ID NO: 1369081 - RNA, 22 nt, Human
cgcuccugcuaacggugcucag

SEQ ID NO: 1369082 - RNA, 14 nt, Human
cgcuuuccugaauc

SEQ ID NO: 1369083 - RNA, 17 nt, Human
cgcuucuugccucugug

SEQ ID NO: 1369084 - RNA, 16 nt, Human
cgcuucuugccucugu

SEQ ID NO: 1369085 - RNA, 23 nt, Human
cggacuuagaaaaccagcucagc

SEQ ID NO: 1369086 - RNA, 23 nt, Human
cggagucguggggugugcuggga

SEQ ID NO: 1369087 - RNA, 22 nt, Human
cggagucguggggugugcuggg

SEQ ID NO: 1369088 - RNA, 16 nt, Human
cggacuuuucugcaaa

SEQ ID NO: 1369089 - RNA, 15 nt, Human
cggacuuuucugcaa

SEQ ID NO: 1369090 - RNA, 14 nt, Human
cggacuuuucugca

SEQ ID NO: 1369091 - RNA, 19 nt, Human
cggaccaaagggagucugc

SEQ ID NO: 1369092 - RNA, 23 nt, Human
cggacaguuccagaagugugacu

SEQ ID NO: 1369093 - RNA, 21 nt, Human
cggacaguuccagaaguguga

SEQ ID NO: 1369094 - RNA, 12 nt, Human
cggaccagccug

SEQ ID NO: 1369095 - RNA, 22 nt, Human
cggacuuagaaaaccagcucag

SEQ ID NO: 1369096 - RNA, 21 nt, Human
cggaccacccucacuggcucu

SEQ ID NO: 1369097 - RNA, 23 nt, Human
cggaccaaagggagucugccagg

SEQ ID NO: 1369098 - RNA, 21 nt, Human
cggaccaaagggagucugcca

SEQ ID NO: 1369099 - RNA, 22 nt, Human
cgcccaaaggacgcacugagca

SEQ ID NO: 1369100 - RNA, 20 nt, Human
cgcccaaaggacgcacugag

SEQ ID NO: 1369101 - RNA, 18 nt, Human
cgcccaaaggacgcacug

SEQ ID NO: 1369102 - RNA, 17 nt, Human
cgcccaaaggacgcacu

SEQ ID NO: 1369103 - RNA, 18 nt, Human
cgccauucucaagcccug

SEQ ID NO: 1369104 - RNA, 23 nt, Human
cgcgggagccaugcgcccccucc

SEQ ID NO: 1369105 - RNA, 16 nt, Human
cgcggcugggaggagg

SEQ ID NO: 1369106 - RNA, 12 nt, Human
cgcggcugggag

SEQ ID NO: 1369107 - RNA, 11 nt, Human
cgcggcuggga

SEQ ID NO: 1369108 - RNA, 13 nt, Human
cgccuuucccagg

SEQ ID NO: 1369109 - RNA, 17 nt, Human
cgcccguccugccugug

SEQ ID NO: 1369110 - RNA, 15 nt, Human
cgcccguccugccug

SEQ ID NO: 1369111 - RNA, 14 nt, Human
cgcccguccugccu

SEQ ID NO: 1369112 - RNA, 12 nt, Human
cgcccguccugc

SEQ ID NO: 1369113 - RNA, 16 nt, Human
cgccuuggccuguguu

SEQ ID NO: 1369114 - RNA, 13 nt, Human
cgcuaaaagaaac

SEQ ID NO: 1369115 - RNA, 15 nt, Human
cgcuaaaagaaacuu

SEQ ID NO: 1369116 - RNA, 21 nt, Human
cggccuccuucugagcuccug

SEQ ID NO: 1369117 - RNA, 22 nt, Human
cggccuccuucugagcuccugu

SEQ ID NO: 1369118 - RNA, 20 nt, Human
cggccuccuucugagcuccu

SEQ ID NO: 1369119 - RNA, 12 nt, Human
cggccuccuucu

SEQ ID NO: 1369120 - RNA, 21 nt, Human
cggccuccguccaggagccug

SEQ ID NO: 1369121 - RNA, 22 nt, Human
cggccuccguccaggagccugg

SEQ ID NO: 1369122 - RNA, 15 nt, Human
cggccucccaaagug

SEQ ID NO: 1369123 - RNA, 21 nt, Human
cggcccucaguagucccugca

SEQ ID NO: 1369124 - RNA, 17 nt, Human
cggauccuaagcaucua

SEQ ID NO: 1369125 - RNA, 14 nt, Human
cggauccuaagcau

SEQ ID NO: 1369126 - RNA, 21 nt, Human
cggauccagggaggcuggucc

SEQ ID NO: 1369127 - RNA, 22 nt, Human
cggccagccccuggccccagga

SEQ ID NO: 1369128 - RNA, 23 nt, Human
cggagugcggaccacccucacug

SEQ ID NO: 1369129 - RNA, 14 nt, Human
cggagugcggacca

SEQ ID NO: 1369130 - RNA, 18 nt, Human
cggagugaguuuuuuagu

SEQ ID NO: 1369131 - RNA, 22 nt, Human
cggauccagggaggcugguccu

SEQ ID NO: 1369132 - RNA, 18 nt, Human
cggauccagggaggcugg

SEQ ID NO: 1369133 - RNA, 13 nt, Human
cggauccagggag

SEQ ID NO: 1369134 - RNA, 16 nt, Human
cggcuucaugccagcu

SEQ ID NO: 1369135 - RNA, 15 nt, Human
cggcuucaugccagc

SEQ ID NO: 1369136 - RNA, 22 nt, Human
cggcugugugugcacgcgugug

SEQ ID NO: 1369137 - RNA, 13 nt, Human
cggcugugugugc

SEQ ID NO: 1369138 - RNA, 21 nt, Human
cggcuggccauggagaaagcu

SEQ ID NO: 1369139 - RNA, 20 nt, Human
cggcuggccauggagaaagc

SEQ ID NO: 1369140 - RNA, 13 nt, Human
cggcuggccaugg

SEQ ID NO: 1369141 - RNA, 15 nt, Human
cgggaaaaagcccac

SEQ ID NO: 1369142 - RNA, 19 nt, Human
cggcuucaugccagcuacu

SEQ ID NO: 1369143 - RNA, 16 nt, Human
cggcuugccacacccc

SEQ ID NO: 1369144 - RNA, 19 nt, Human
cgggacaccuaggcuaggg

SEQ ID NO: 1369145 - RNA, 18 nt, Human
cgggacaccuaggcuagg

SEQ ID NO: 1369146 - RNA, 18 nt, Human
cgggaauuuucaucuagg

SEQ ID NO: 1369147 - RNA, 20 nt, Human
cgggaauuuucaucuaggau

SEQ ID NO: 1369148 - RNA, 18 nt, Human
cuaaaauaauuuuguaau

SEQ ID NO: 1369149 - RNA, 17 nt, Human
cuaaaauaauuuuguaa

SEQ ID NO: 1369150 - RNA, 15 nt, Human
cuaaaauaauuuugu

SEQ ID NO: 1369151 - RNA, 22 nt, Human
cuaaaauaaagaaauagaacaa

SEQ ID NO: 1369152 - RNA, 16 nt, Human
cuaaaauaaagaaaua

SEQ ID NO: 1369153 - RNA, 14 nt, Human
cuaaaauaaagaaa

SEQ ID NO: 1369154 - RNA, 20 nt, Human
cuaaaagugggcuugauucu

SEQ ID NO: 1369155 - RNA, 23 nt, Human
cuaaaagugggcuugauucugca

SEQ ID NO: 1369156 - RNA, 21 nt, Human
cuaaaaauagacuuaaaucuc

SEQ ID NO: 1369157 - RNA, 11 nt, Human
cuaaaaauaaa

SEQ ID NO: 1369158 - RNA, 15 nt, Human
cuaaaaaaaagauga

SEQ ID NO: 1369159 - RNA, 14 nt, Human
cuaaaaaaaagaug

SEQ ID NO: 1369160 - RNA, 16 nt, Human
cguuuuauaagcauca

SEQ ID NO: 1369161 - RNA, 13 nt, Human
cguuuuaaaaaag

SEQ ID NO: 1369162 - RNA, 19 nt, Human
cguuuguuuguuuguuuaa

SEQ ID NO: 1369163 - RNA, 18 nt, Human
cgggaccacccugagccg

SEQ ID NO: 1369164 - RNA, 17 nt, Human
cgggaccacccugagcc

SEQ ID NO: 1369165 - RNA, 16 nt, Human
cgggaccacccugagc

SEQ ID NO: 1369166 - RNA, 11 nt, Human
cggcugugugu

SEQ ID NO: 1369167 - RNA, 13 nt, Human
cgggaccuggugc

SEQ ID NO: 1369168 - RNA, 20 nt, Human
cguuuguguucuguuuuguu

SEQ ID NO: 1369169 - RNA, 19 nt, Human
cguuuguguucuguuuugu

SEQ ID NO: 1369170 - RNA, 11 nt, Human
cguuuguguuc

SEQ ID NO: 1369171 - RNA, 18 nt, Human
cguuuggugcuucucaga

SEQ ID NO: 1369172 - RNA, 19 nt, Human
cuaaauaccucaaucaguc

SEQ ID NO: 1369173 - RNA, 23 nt, Human
cuaaauaaagcuugcaacaaaau

SEQ ID NO: 1369174 - RNA, 20 nt, Human
cuaaauaaaauuuguugcau

SEQ ID NO: 1369175 - RNA, 15 nt, Human
cuaaauaaaauuugu

SEQ ID NO: 1369176 - RNA, 22 nt, Human
cuaaauaaaaugcuagguucua

SEQ ID NO: 1369177 - RNA, 21 nt, Human
cuaaauaaaaugcuagguucu

SEQ ID NO: 1369178 - RNA, 19 nt, Human
cuaaauaaaaugcuagguu

SEQ ID NO: 1369179 - RNA, 15 nt, Human
cuaaauaaaaugcua

SEQ ID NO: 1369180 - RNA, 13 nt, Human
cuaaauaaaaugc

SEQ ID NO: 1369181 - RNA, 20 nt, Human
cuaaacugagacaaugccuu

SEQ ID NO: 1369182 - RNA, 17 nt, Human
cuaaauauauuuuaaga

SEQ ID NO: 1369183 - RNA, 21 nt, Human
cuaaaucuccaaaauaaaacu

SEQ ID NO: 1369184 - RNA, 23 nt, Human
cuaaaaugugauguucuaaggcu

SEQ ID NO: 1369185 - RNA, 22 nt, Human
cuaaaaugugauguucuaaggc

SEQ ID NO: 1369186 - RNA, 21 nt, Human
cuaaaaugugauguucuaagg

SEQ ID NO: 1369187 - RNA, 20 nt, Human
cuaaaaugugauguucuaag

SEQ ID NO: 1369188 - RNA, 19 nt, Human
cuaaaaugugauguucuaa

SEQ ID NO: 1369189 - RNA, 18 nt, Human
cuaaaaugugauguucua

SEQ ID NO: 1369190 - RNA, 23 nt, Human
cuaaaauauuuauuuuuuuuaag

SEQ ID NO: 1369191 - RNA, 15 nt, Human
cuaaaauauuuauuu

SEQ ID NO: 1369192 - RNA, 14 nt, Human
cuaaaauauuuauu

SEQ ID NO: 1369193 - RNA, 22 nt, Human
cuaaaaucuuauaguucuaggc

SEQ ID NO: 1369194 - RNA, 21 nt, Human
cuaaaaucuuauaguucuagg

SEQ ID NO: 1369195 - RNA, 19 nt, Human
cuaaaaucuuauaguucua

SEQ ID NO: 1369196 - RNA, 17 nt, Human
cuaaaaucuuauaguuc

SEQ ID NO: 1369197 - RNA, 20 nt, Human
cuaagaucuuagauucucug

SEQ ID NO: 1369198 - RNA, 17 nt, Human
cuaagaucuuagauucu

SEQ ID NO: 1369199 - RNA, 16 nt, Human
cuaagaucuuagauuc

SEQ ID NO: 1369200 - RNA, 14 nt, Human
cuaagaucuuagau

SEQ ID NO: 1369201 - RNA, 12 nt, Human
cuaagaucuuag

SEQ ID NO: 1369202 - RNA, 23 nt, Human
cuaagaggcugcccuccugugcu

SEQ ID NO: 1369203 - RNA, 22 nt, Human
cuaagagugcugggcauuuuua

SEQ ID NO: 1369204 - RNA, 18 nt, Human
cuaagaggcugcccuccu

SEQ ID NO: 1369205 - RNA, 16 nt, Human
cuaagaggcugcccuc

SEQ ID NO: 1369206 - RNA, 14 nt, Human
cuaagaggcugccc

SEQ ID NO: 1369207 - RNA, 17 nt, Human
cuaaccucgggccugcu

SEQ ID NO: 1369208 - RNA, 22 nt, Human
cuaacccuuugugugcucucca

SEQ ID NO: 1369209 - RNA, 15 nt, Human
cuaaccucaucuucu

SEQ ID NO: 1369210 - RNA, 12 nt, Human
cuaaccucaucu

SEQ ID NO: 1369211 - RNA, 23 nt, Human
cuaacccuuugugugcucuccau

SEQ ID NO: 1369212 - RNA, 23 nt, Human
cuaacccuauacuguaguauucu

SEQ ID NO: 1369213 - RNA, 18 nt, Human
cuaaccauguguuauguu

SEQ ID NO: 1369214 - RNA, 16 nt, Human
cuaagagagcaccugg

SEQ ID NO: 1369215 - RNA, 21 nt, Human
cuaagagaaguuguaaaguau

SEQ ID NO: 1369216 - RNA, 15 nt, Human
cuaagagagaaugag

SEQ ID NO: 1369217 - RNA, 14 nt, Human
cuaagagagaauga

SEQ ID NO: 1369218 - RNA, 23 nt, Human
cuaacauauaauguuguuauuua

SEQ ID NO: 1369219 - RNA, 22 nt, Human
cuaacauauaauguuguuauuu

SEQ ID NO: 1369220 - RNA, 12 nt, Human
cuaacauauaau

SEQ ID NO: 1369221 - RNA, 18 nt, Human
cuaacagggaaggcaggc

SEQ ID NO: 1369222 - RNA, 21 nt, Human
cuaacagggaaggcaggcagg

SEQ ID NO: 1369223 - RNA, 17 nt, Human
cuaacagggaaggcagg

SEQ ID NO: 1369224 - RNA, 16 nt, Human
cuaacagggaaggcag

SEQ ID NO: 1369225 - RNA, 15 nt, Human
cuaacagggaaggca

SEQ ID NO: 1369226 - RNA, 14 nt, Human
cuaacagggaaggc

SEQ ID NO: 1369227 - RNA, 22 nt, Human
cuaacagcccuccucugcacuc

SEQ ID NO: 1369228 - RNA, 21 nt, Human
cuaacagcccuccucugcacu

SEQ ID NO: 1369229 - RNA, 12 nt, Human
cuaacagcccuc

SEQ ID NO: 1369230 - RNA, 22 nt, Human
cuaacaagucauagguuaauau

SEQ ID NO: 1369231 - RNA, 21 nt, Human
cuaacauuuuugauaaagccu

SEQ ID NO: 1369232 - RNA, 20 nt, Human
cuaaccaagcugaguuuccu

SEQ ID NO: 1369233 - RNA, 15 nt, Human
cuaaccaagcugagu

SEQ ID NO: 1369234 - RNA, 10 nt, Human
cuaaccaagu

SEQ ID NO: 1369235 - RNA, 21 nt, Human
cuaaccaagcugaguuuccua

SEQ ID NO: 1369236 - RNA, 12 nt, Human
cuaaccaaguuc

SEQ ID NO: 1369237 - RNA, 16 nt, Human
cuaacaaccaaagacu

SEQ ID NO: 1369238 - RNA, 20 nt, Human
cuaacaacauuguagccuca

SEQ ID NO: 1369239 - RNA, 17 nt, Human
cuaaauuuuccuguccu

SEQ ID NO: 1369240 - RNA, 16 nt, Human
cuaaauuuuccugucc

SEQ ID NO: 1369241 - RNA, 19 nt, Human
cuaaauuuuccuguccucu

SEQ ID NO: 1369242 - RNA, 14 nt, Human
cuaaaugaauguuu

SEQ ID NO: 1369243 - RNA, 12 nt, Human
cuaaaugaaugu

SEQ ID NO: 1369244 - RNA, 15 nt, Human
cuaaaugaauguuua

SEQ ID NO: 1369245 - RNA, 20 nt, Human
cuaaaucuuuuauaggauuu

SEQ ID NO: 1369246 - RNA, 19 nt, Human
cuaaauucuuucauuuuag

SEQ ID NO: 1369247 - RNA, 13 nt, Human
cguuuucaaaauu

SEQ ID NO: 1369248 - RNA, 16 nt, Human
cuaagauucuaaaggu

SEQ ID NO: 1369249 - RNA, 15 nt, Human
cuaauucaauucaaa

SEQ ID NO: 1369250 - RNA, 20 nt, Human
cuaauucaaggaauuucuua

SEQ ID NO: 1369251 - RNA, 18 nt, Human
cuaauucaaggaauuucu

SEQ ID NO: 1369252 - RNA, 16 nt, Human
cuaauucaaggaauuu

SEQ ID NO: 1369253 - RNA, 18 nt, Human
cuaauuauguagcucuuu

SEQ ID NO: 1369254 - RNA, 17 nt, Human
cuaauuauguagcucuu

SEQ ID NO: 1369255 - RNA, 15 nt, Human
cuaauuauguagcuc

SEQ ID NO: 1369256 - RNA, 18 nt, Human
cuaauggcaugagaaaua

SEQ ID NO: 1369257 - RNA, 16 nt, Human
cuaauggcaugagaaa

SEQ ID NO: 1369258 - RNA, 14 nt, Human
cuaauggcaugaga

SEQ ID NO: 1369259 - RNA, 18 nt, Human
cuaaugccuuacucuucu

SEQ ID NO: 1369260 - RNA, 14 nt, Human
cuaaucaugaaacu

SEQ ID NO: 1369261 - RNA, 21 nt, Human
cuaaucagggaggucauuuug

SEQ ID NO: 1369262 - RNA, 20 nt, Human
cuaaucagggaggucauuuu

SEQ ID NO: 1369263 - RNA, 19 nt, Human
cuaaucagggaggucauuu

SEQ ID NO: 1369264 - RNA, 20 nt, Human
cuaauauggccacaguaguc

SEQ ID NO: 1369265 - RNA, 17 nt, Human
cuaauauggcaaccauu

SEQ ID NO: 1369266 - RNA, 10 nt, Human
cuaauucaua

SEQ ID NO: 1369267 - RNA, 22 nt, Human
cuaauucacagugcucuuuucu

SEQ ID NO: 1369268 - RNA, 16 nt, Human
cuaauucacagugcuc

SEQ ID NO: 1369269 - RNA, 15 nt, Human
cuaauucacagugcu

SEQ ID NO: 1369270 - RNA, 17 nt, Human
cuaauuccacaccuuuu

SEQ ID NO: 1369271 - RNA, 15 nt, Human
cuaauuccacaccuu

SEQ ID NO: 1369272 - RNA, 18 nt, Human
cuacaccacucuggcagc

SEQ ID NO: 1369273 - RNA, 16 nt, Human
cuacaccacucuggca

SEQ ID NO: 1369274 - RNA, 15 nt, Human
cuacaccacucuggc

SEQ ID NO: 1369275 - RNA, 14 nt, Human
cuacaccacucugg

SEQ ID NO: 1369276 - RNA, 13 nt, Human
cuacaccacucug

SEQ ID NO: 1369277 - RNA, 16 nt, Human
cuaaugccucuucauu

SEQ ID NO: 1369278 - RNA, 14 nt, Human
cuacacuaagagag

SEQ ID NO: 1369279 - RNA, 23 nt, Human
cuacacgagauacagaauuuuau

SEQ ID NO: 1369280 - RNA, 18 nt, Human
cuacaccuauuaucccag

SEQ ID NO: 1369281 - RNA, 17 nt, Human
cuacaccuauuauccca

SEQ ID NO: 1369282 - RNA, 16 nt, Human
cuacaccuauuauccc

SEQ ID NO: 1369283 - RNA, 18 nt, Human
cuacacccuuuuccagcu

SEQ ID NO: 1369284 - RNA, 16 nt, Human
cuacacccuuuuccag

SEQ ID NO: 1369285 - RNA, 22 nt, Human
cuacaccacucuggcagccaca

SEQ ID NO: 1369286 - RNA, 21 nt, Human
cuacaccacucuggcagccac

SEQ ID NO: 1369287 - RNA, 20 nt, Human
cuacaccacucuggcagcca

SEQ ID NO: 1369288 - RNA, 19 nt, Human
cuacaccacucuggcagcc

SEQ ID NO: 1369289 - RNA, 11 nt, Human
cuacacccagc

SEQ ID NO: 1369290 - RNA, 12 nt, Human
cuacacccagca

SEQ ID NO: 1369291 - RNA, 13 nt, Human
cuacacccagcaa

SEQ ID NO: 1369292 - RNA, 14 nt, Human
cuacacccagcaau

SEQ ID NO: 1369293 - RNA, 16 nt, Human
cuacacccagcaauag

SEQ ID NO: 1369294 - RNA, 23 nt, Human
cuaagaugugauauucuaagacu

SEQ ID NO: 1369295 - RNA, 22 nt, Human
cuaagaugugauauucuaagac

SEQ ID NO: 1369296 - RNA, 21 nt, Human
cuaagaugugauauucuaaga

SEQ ID NO: 1369297 - RNA, 20 nt, Human
cuaagaugugauauucuaag

SEQ ID NO: 1369298 - RNA, 19 nt, Human
cuaagaugugauauucuaa

SEQ ID NO: 1369299 - RNA, 18 nt, Human
cuaagaugugauauucua

SEQ ID NO: 1369300 - RNA, 23 nt, Human
cuaagauuacaaaucagaaguca

SEQ ID NO: 1369301 - RNA, 22 nt, Human
cuaagauuacaaaucagaaguc

SEQ ID NO: 1369302 - RNA, 21 nt, Human
cuaagauuacaaaucagaagu

SEQ ID NO: 1369303 - RNA, 19 nt, Human
cuaagauuacaaaucagaa

SEQ ID NO: 1369304 - RNA, 15 nt, Human
cuaagauucuaaagg

SEQ ID NO: 1369305 - RNA, 14 nt, Human
cuaagauucuaaag

SEQ ID NO: 1369306 - RNA, 16 nt, Human
cuaagcucacguccug

SEQ ID NO: 1369307 - RNA, 13 nt, Human
cuaagauucuaaa

SEQ ID NO: 1369308 - RNA, 12 nt, Human
cuaagauucuaa

SEQ ID NO: 1369309 - RNA, 11 nt, Human
cuaagauucua

SEQ ID NO: 1369310 - RNA, 21 nt, Human
cuaagcuucacuguaaaauaa

SEQ ID NO: 1369311 - RNA, 17 nt, Human
cuaagguucuaaggccu

SEQ ID NO: 1369312 - RNA, 16 nt, Human
cuaagguucuaaggcc

SEQ ID NO: 1369313 - RNA, 15 nt, Human
cuaagguucuaaggc

SEQ ID NO: 1369314 - RNA, 14 nt, Human
cuaagguucuaagg

SEQ ID NO: 1369315 - RNA, 13 nt, Human
cuaagguucuaag

SEQ ID NO: 1369316 - RNA, 19 nt, Human
cuaaggcucugagagucua

SEQ ID NO: 1369317 - RNA, 15 nt, Human
cuaaggcucugagag

SEQ ID NO: 1369318 - RNA, 14 nt, Human
cuaaggcucugaga

SEQ ID NO: 1369319 - RNA, 13 nt, Human
cuaaggcucugag

SEQ ID NO: 1369320 - RNA, 11 nt, Human
cuaaggcucug

SEQ ID NO: 1369321 - RNA, 23 nt, Human
cuaaggcucuaugagucuagaug

SEQ ID NO: 1369322 - RNA, 22 nt, Human
cuaaggcucuaugagucuagau

SEQ ID NO: 1369323 - RNA, 21 nt, Human
cuaaggcucuaugagucuaga

SEQ ID NO: 1369324 - RNA, 20 nt, Human
cuaaggcucuaugagucuag

SEQ ID NO: 1369325 - RNA, 19 nt, Human
cuaaggcucuaugagucua

SEQ ID NO: 1369326 - RNA, 18 nt, Human
cuaaggcucuaugagucu

SEQ ID NO: 1369327 - RNA, 16 nt, Human
cuaaggcuccuguuuu

SEQ ID NO: 1369328 - RNA, 22 nt, Human
cuaaggccuaggauucuaaaau

SEQ ID NO: 1369329 - RNA, 21 nt, Human
cuaaggccuaggauucuaaaa

SEQ ID NO: 1369330 - RNA, 20 nt, Human
cuaaggccuaggauucuaaa

SEQ ID NO: 1369331 - RNA, 19 nt, Human
cuaaggccuaggauucuaa

SEQ ID NO: 1369332 - RNA, 14 nt, Human
cuaaggccuaggau

SEQ ID NO: 1369333 - RNA, 13 nt, Human
cuaaggccuacuu

SEQ ID NO: 1369334 - RNA, 22 nt, Human
cuaaggaccugaaauuccaaag

SEQ ID NO: 1369335 - RNA, 20 nt, Human
cuaaggaccugaaauuccaa

SEQ ID NO: 1369336 - RNA, 19 nt, Human
cuaaggaccugaaauucca

SEQ ID NO: 1369337 - RNA, 14 nt, Human
cuaaggaaccaaca

SEQ ID NO: 1369338 - RNA, 17 nt, Human
cuaauaacaugugaaaa

SEQ ID NO: 1369339 - RNA, 23 nt, Human
cuaauacagcaacaauuuaugaa

SEQ ID NO: 1369340 - RNA, 19 nt, Human
cuaauacagcaacaauuua

SEQ ID NO: 1369341 - RNA, 18 nt, Human
cuaauaauuucuaauguu

SEQ ID NO: 1369342 - RNA, 17 nt, Human
cuaauaauuucuaaugu

SEQ ID NO: 1369343 - RNA, 16 nt, Human
cuaauaauuucuaaug

SEQ ID NO: 1369344 - RNA, 15 nt, Human
cuaauaauuucuaau

SEQ ID NO: 1369345 - RNA, 14 nt, Human
cuaauaauuucuaa

SEQ ID NO: 1369346 - RNA, 21 nt, Human
cuaauagaauaaaggcaguuu

SEQ ID NO: 1369347 - RNA, 20 nt, Human
cuaauagaauaaaggcaguu

SEQ ID NO: 1369348 - RNA, 18 nt, Human
cuaauagaaaaguauguu

SEQ ID NO: 1369349 - RNA, 17 nt, Human
cuaauagacaauuuauu

SEQ ID NO: 1369350 - RNA, 19 nt, Human
cuaauagacaauuuauuau

SEQ ID NO: 1369351 - RNA, 23 nt, Human
cuaauagacaauuuauuauggca

SEQ ID NO: 1369352 - RNA, 17 nt, Human
cuaauauauuuaaaaau

SEQ ID NO: 1369353 - RNA, 16 nt, Human
cuaauauauuuaaaaa

SEQ ID NO: 1369354 - RNA, 15 nt, Human
cuaauauauuuaaaa

SEQ ID NO: 1369355 - RNA, 14 nt, Human
cuaauauauuuaaa

SEQ ID NO: 1369356 - RNA, 13 nt, Human
cuaauauauuuaa

SEQ ID NO: 1369357 - RNA, 23 nt, Human
cuaauagaauaaaggcaguuuuc

SEQ ID NO: 1369358 - RNA, 22 nt, Human
cuaauagggcaauuaauuccuu

SEQ ID NO: 1369359 - RNA, 17 nt, Human
cuacuggucuuguggaa

SEQ ID NO: 1369360 - RNA, 21 nt, Human
cuacagucaggaaaggaauca

SEQ ID NO: 1369361 - RNA, 18 nt, Human
cuacagucaggaaaggaa

SEQ ID NO: 1369362 - RNA, 15 nt, Human
cuacagucaggaaag

SEQ ID NO: 1369363 - RNA, 14 nt, Human
cuacagucaggaaa

SEQ ID NO: 1369364 - RNA, 17 nt, Human
cuacaggguccaacaua

SEQ ID NO: 1369365 - RNA, 23 nt, Human
cuacagggggucuggcugguguu

SEQ ID NO: 1369366 - RNA, 22 nt, Human
cuacagggggucuggcuggugu

SEQ ID NO: 1369367 - RNA, 21 nt, Human
cuacagggggucuggcuggug

SEQ ID NO: 1369368 - RNA, 20 nt, Human
cuacagggggucuggcuggu

SEQ ID NO: 1369369 - RNA, 19 nt, Human
cuacagggggucuggcugg

SEQ ID NO: 1369370 - RNA, 17 nt, Human
cuacagggggucuggcu

SEQ ID NO: 1369371 - RNA, 15 nt, Human
cuacagggggucugg

SEQ ID NO: 1369372 - RNA, 21 nt, Human
cuacaggcgugagccaccaug

SEQ ID NO: 1369373 - RNA, 20 nt, Human
cuacaggccucacacacaau

SEQ ID NO: 1369374 - RNA, 16 nt, Human
cuacaggccucacaca

SEQ ID NO: 1369375 - RNA, 12 nt, Human
cuacaggccuca

SEQ ID NO: 1369376 - RNA, 15 nt, Human
cuacacucaccugca

SEQ ID NO: 1369377 - RNA, 14 nt, Human
cuacagccucagaa

SEQ ID NO: 1369378 - RNA, 18 nt, Human
cuacagccucagaaacca

SEQ ID NO: 1369379 - RNA, 14 nt, Human
cuacagaugaguca

SEQ ID NO: 1369380 - RNA, 22 nt, Human
cuacagcuggggugcagggaug

SEQ ID NO: 1369381 - RNA, 18 nt, Human
cuacagcuggggugcagg

SEQ ID NO: 1369382 - RNA, 17 nt, Human
cuacagcuggggugcag

SEQ ID NO: 1369383 - RNA, 18 nt, Human
cuacccccagcugugcuu

SEQ ID NO: 1369384 - RNA, 19 nt, Human
cuacccccagcugugcuua

SEQ ID NO: 1369385 - RNA, 16 nt, Human
cuacccuaaccaaguu

SEQ ID NO: 1369386 - RNA, 16 nt, Human
cuacccuuuuucucca

SEQ ID NO: 1369387 - RNA, 14 nt, Human
cuacccugcauggc

SEQ ID NO: 1369388 - RNA, 20 nt, Human
cuacccugcauggcugagcu

SEQ ID NO: 1369389 - RNA, 18 nt, Human
cuacccugagcugaggca

SEQ ID NO: 1369390 - RNA, 17 nt, Human
cuacccugagcugaggc

SEQ ID NO: 1369391 - RNA, 12 nt, Human
cuacccugagcu

SEQ ID NO: 1369392 - RNA, 16 nt, Human
cuacccucuagagaaa

SEQ ID NO: 1369393 - RNA, 14 nt, Human
cuacccucuagaga

SEQ ID NO: 1369394 - RNA, 13 nt, Human
cuacccucuagag

SEQ ID NO: 1369395 - RNA, 17 nt, Human
cuacccccagcugugcu

SEQ ID NO: 1369396 - RNA, 19 nt, Human
cuaccccauggugcuagga

SEQ ID NO: 1369397 - RNA, 22 nt, Human
cuacauguauugcacauuguaa

SEQ ID NO: 1369398 - RNA, 21 nt, Human
cuacauguauugcacauugua

SEQ ID NO: 1369399 - RNA, 18 nt, Human
cuacauguauugcacauu

SEQ ID NO: 1369400 - RNA, 13 nt, Human
cuacauguauugc

SEQ ID NO: 1369401 - RNA, 23 nt, Human
cuacaugguugaaaccccaucuc

SEQ ID NO: 1369402 - RNA, 12 nt, Human
cuacauucauuu

SEQ ID NO: 1369403 - RNA, 14 nt, Human
cuaccaaagcaccu

SEQ ID NO: 1369404 - RNA, 13 nt, Human
cuacauucuguua

SEQ ID NO: 1369405 - RNA, 14 nt, Human
cuacauucuguuaa

SEQ ID NO: 1369406 - RNA, 13 nt, Human
cuaccauuucaga

SEQ ID NO: 1369407 - RNA, 12 nt, Human
cuaccauuucag

SEQ ID NO: 1369408 - RNA, 18 nt, Human
cuaccaccagcugugucc

SEQ ID NO: 1369409 - RNA, 19 nt, Human
cuaccaccagcugugucca

SEQ ID NO: 1369410 - RNA, 16 nt, Human
cuaccaccagcugugu

SEQ ID NO: 1369411 - RNA, 15 nt, Human
cuaccaccagcugug

SEQ ID NO: 1369412 - RNA, 14 nt, Human
cuaccaccagcugu

SEQ ID NO: 1369413 - RNA, 13 nt, Human
cuaccaccagcug

SEQ ID NO: 1369414 - RNA, 15 nt, Human
cuaccaaagcaccuu

SEQ ID NO: 1369415 - RNA, 20 nt, Human
cuaccaaggucuucuuaaua

SEQ ID NO: 1369416 - RNA, 22 nt, Human
cuaggaaauauuuauuuuaaua

SEQ ID NO: 1369417 - RNA, 18 nt, Human
cucagaggcgcacuguga

SEQ ID NO: 1369418 - RNA, 17 nt, Human
cucagaggcgcacugug

SEQ ID NO: 1369419 - RNA, 19 nt, Human
cucagaggcgcacugugac

SEQ ID NO: 1369420 - RNA, 16 nt, Human
cucagaggguguccug

SEQ ID NO: 1369421 - RNA, 20 nt, Human
cucagauggcagcuuuuaaa

SEQ ID NO: 1369422 - RNA, 17 nt, Human
cucagauggcagcuuuu

SEQ ID NO: 1369423 - RNA, 21 nt, Human
cucagauggcagcuuuuaaaa

SEQ ID NO: 1369424 - RNA, 16 nt, Human
cucagauggcagcuuu

SEQ ID NO: 1369425 - RNA, 15 nt, Human
cucagauggcagcuu

SEQ ID NO: 1369426 - RNA, 14 nt, Human
cucagauggcagcu

SEQ ID NO: 1369427 - RNA, 13 nt, Human
cucagauggcagc

SEQ ID NO: 1369428 - RNA, 12 nt, Human
cucagauggcag

SEQ ID NO: 1369429 - RNA, 21 nt, Human
cucagaugcacaugagcuggc

SEQ ID NO: 1369430 - RNA, 21 nt, Human
cucacuggcucuccuggcccu

SEQ ID NO: 1369431 - RNA, 19 nt, Human
cucacuggcucuccuggcc

SEQ ID NO: 1369432 - RNA, 18 nt, Human
cucacuggcucuccuggc

SEQ ID NO: 1369433 - RNA, 17 nt, Human
cucacuggcucuccugg

SEQ ID NO: 1369434 - RNA, 15 nt, Human
cucacuggcucuccu

SEQ ID NO: 1369435 - RNA, 19 nt, Human
cucacugugucacccaggc

SEQ ID NO: 1369436 - RNA, 20 nt, Human
cucagcucccacaagccucu

SEQ ID NO: 1369437 - RNA, 22 nt, Human
cucagcucccacaagccucugc

SEQ ID NO: 1369438 - RNA, 18 nt, Human
cucagcucccacaagccu

SEQ ID NO: 1369439 - RNA, 13 nt, Human
cucagcucccaca

SEQ ID NO: 1369440 - RNA, 14 nt, Human
cucagcucauccau

SEQ ID NO: 1369441 - RNA, 20 nt, Human
cucagcuccagguggcucug

SEQ ID NO: 1369442 - RNA, 19 nt, Human
cucagcuccagguggcucu

SEQ ID NO: 1369443 - RNA, 15 nt, Human
cucagcuaagcucac

SEQ ID NO: 1369444 - RNA, 15 nt, Human
cucagcucacugcaa

SEQ ID NO: 1369445 - RNA, 20 nt, Human
cucagcucacuacaaccucc

SEQ ID NO: 1369446 - RNA, 14 nt, Human
cucagcucacugca

SEQ ID NO: 1369447 - RNA, 20 nt, Human
cucagcucacugcaaccucc

SEQ ID NO: 1369448 - RNA, 18 nt, Human
cucagcccucacacaccc

SEQ ID NO: 1369449 - RNA, 17 nt, Human
cucagcccucacacacc

SEQ ID NO: 1369450 - RNA, 16 nt, Human
cucagccccuuucccu

SEQ ID NO: 1369451 - RNA, 21 nt, Human
cucagccccaccccagggcag

SEQ ID NO: 1369452 - RNA, 19 nt, Human
cucagccccaccccagggc

SEQ ID NO: 1369453 - RNA, 22 nt, Human
cucagccccaccccagggcagc

SEQ ID NO: 1369454 - RNA, 17 nt, Human
cucagccccgcguggaa

SEQ ID NO: 1369455 - RNA, 16 nt, Human
cucaggugcuggggcc

SEQ ID NO: 1369456 - RNA, 22 nt, Human
cucaggugcuggggccugguuc

SEQ ID NO: 1369457 - RNA, 15 nt, Human
cucaggugcuggggc

SEQ ID NO: 1369458 - RNA, 13 nt, Human
cucaggugcuggg

SEQ ID NO: 1369459 - RNA, 20 nt, Human
cucagggccaugcugaggcc

SEQ ID NO: 1369460 - RNA, 19 nt, Human
cucagggccaugcugaggc

SEQ ID NO: 1369461 - RNA, 18 nt, Human
cucagggccaugcugagg

SEQ ID NO: 1369462 - RNA, 17 nt, Human
cucagggccaugcugag

SEQ ID NO: 1369463 - RNA, 15 nt, Human
cucagggccaugcug

SEQ ID NO: 1369464 - RNA, 21 nt, Human
cucagggccaggccucucccu

SEQ ID NO: 1369465 - RNA, 13 nt, Human
cucagggccaugc

SEQ ID NO: 1369466 - RNA, 18 nt, Human
cucagggccaggccucuc

SEQ ID NO: 1369467 - RNA, 16 nt, Human
cucagggccaggccuc

SEQ ID NO: 1369468 - RNA, 14 nt, Human
cucagggccaggcc

SEQ ID NO: 1369469 - RNA, 20 nt, Human
cucagggcagcgccaggcug

SEQ ID NO: 1369470 - RNA, 16 nt, Human
cucaggagccugugac

SEQ ID NO: 1369471 - RNA, 18 nt, Human
cucaggaggcaggaccuu

SEQ ID NO: 1369472 - RNA, 17 nt, Human
cucaggaggcaggaccu

SEQ ID NO: 1369473 - RNA, 16 nt, Human
cucaggaggcaggacc

SEQ ID NO: 1369474 - RNA, 14 nt, Human
cucaggagccugug

SEQ ID NO: 1369475 - RNA, 24 nt, Human
cucaggagcccugggaggcucugg

SEQ ID NO: 1369476 - RNA, 23 nt, Human
cucaggaaacgagacuuuccauu

SEQ ID NO: 1369477 - RNA, 22 nt, Human
cucaggaaacgagacuuuccau

SEQ ID NO: 1369478 - RNA, 14 nt, Human
cucagcuuucuaag

SEQ ID NO: 1369479 - RNA, 20 nt, Human
cucaggacacaggccugugu

SEQ ID NO: 1369480 - RNA, 19 nt, Human
cucaggacacaggccugug

SEQ ID NO: 1369481 - RNA, 18 nt, Human
cucaggacacaggccugu

SEQ ID NO: 1369482 - RNA, 17 nt, Human
cucaggacacaggccug

SEQ ID NO: 1369483 - RNA, 16 nt, Human
cucaggacacaggccu

SEQ ID NO: 1369484 - RNA, 15 nt, Human
cucaggacacaggcc

SEQ ID NO: 1369485 - RNA, 14 nt, Human
cucaggacacaggc

SEQ ID NO: 1369486 - RNA, 13 nt, Human
cucaggacacagg

SEQ ID NO: 1369487 - RNA, 19 nt, Human
cucaggaaccgaggcaggg

SEQ ID NO: 1369488 - RNA, 18 nt, Human
cucaggaaccgaggcagg

SEQ ID NO: 1369489 - RNA, 17 nt, Human
cucaggaaccgaggcag

SEQ ID NO: 1369490 - RNA, 19 nt, Human
cucagcugucaaggcucag

SEQ ID NO: 1369491 - RNA, 18 nt, Human
cucagcugucaaggcuca

SEQ ID NO: 1369492 - RNA, 11 nt, Human
cucagcugcau

SEQ ID NO: 1369493 - RNA, 23 nt, Human
cucagcucugacauucugauucg

SEQ ID NO: 1369494 - RNA, 23 nt, Human
cucagcucugggccauucuccac

SEQ ID NO: 1369495 - RNA, 14 nt, Human
cucagcucugggcc

SEQ ID NO: 1369496 - RNA, 20 nt, Human
cucagcucucaguugcagcc

SEQ ID NO: 1369497 - RNA, 21 nt, Human
cucaggacacaggccugugua

SEQ ID NO: 1369498 - RNA, 22 nt, Human
cucaggaccaaagcuuucaugu

SEQ ID NO: 1369499 - RNA, 21 nt, Human
cucaggaccaaagcuuucaug

SEQ ID NO: 1369500 - RNA, 20 nt, Human
cucaggaccaaagcuuucau

SEQ ID NO: 1369501 - RNA, 19 nt, Human
cucaggacagaugccacac

SEQ ID NO: 1369502 - RNA, 18 nt, Human
cucaggacagaugccaca

SEQ ID NO: 1369503 - RNA, 16 nt, Human
cucaggacagaugcca

SEQ ID NO: 1369504 - RNA, 14 nt, Human
cucaggacagaugc

SEQ ID NO: 1369505 - RNA, 12 nt, Human
cucaggacagau

SEQ ID NO: 1369506 - RNA, 23 nt, Human
cucaggacugggagcccccagcc

SEQ ID NO: 1369507 - RNA, 15 nt, Human
cucaggacugggagc

SEQ ID NO: 1369508 - RNA, 14 nt, Human
cucaggacugggag

SEQ ID NO: 1369509 - RNA, 14 nt, Human
cucaggacugcgac

SEQ ID NO: 1369510 - RNA, 12 nt, Human
cucaggagcccu

SEQ ID NO: 1369511 - RNA, 13 nt, Human
cucaggagcccug

SEQ ID NO: 1369512 - RNA, 14 nt, Human
cucaggagcccugg

SEQ ID NO: 1369513 - RNA, 15 nt, Human
cucaggagcccuggg

SEQ ID NO: 1369514 - RNA, 16 nt, Human
cucaggagcccuggga

SEQ ID NO: 1369515 - RNA, 17 nt, Human
cucaggagcccugggag

SEQ ID NO: 1369516 - RNA, 20 nt, Human
cucaggagcccugggaggcu

SEQ ID NO: 1369517 - RNA, 21 nt, Human
cucaggagcccugggaggcuc

SEQ ID NO: 1369518 - RNA, 22 nt, Human
cucaggagcccugggaggcucu

SEQ ID NO: 1369519 - RNA, 23 nt, Human
cucaggagcccugggaggcucug

SEQ ID NO: 1369520 - RNA, 18 nt, Human
cucauuuagccuguccug

SEQ ID NO: 1369521 - RNA, 21 nt, Human
cucauuuccaagcaaguauua

SEQ ID NO: 1369522 - RNA, 17 nt, Human
cucauuuccaagcaagu

SEQ ID NO: 1369523 - RNA, 14 nt, Human
cucauuuccaagca

SEQ ID NO: 1369524 - RNA, 13 nt, Human
cucauuuccaagc

SEQ ID NO: 1369525 - RNA, 12 nt, Human
cucauuuccaag

SEQ ID NO: 1369526 - RNA, 12 nt, Human
cucauuucagga

SEQ ID NO: 1369527 - RNA, 13 nt, Human
cucauuucaggau

SEQ ID NO: 1369528 - RNA, 22 nt, Human
cuccaaggaggggcuguaaaau

SEQ ID NO: 1369529 - RNA, 21 nt, Human
cuccaaggaggggcuguaaaa

SEQ ID NO: 1369530 - RNA, 20 nt, Human
cuccaaggaggggcuguaaa

SEQ ID NO: 1369531 - RNA, 19 nt, Human
cuccaaggaggggcuguaa

SEQ ID NO: 1369532 - RNA, 23 nt, Human
cuccaaacugaagcagccucucc

SEQ ID NO: 1369533 - RNA, 22 nt, Human
cuccaaacugaagcagccucuc

SEQ ID NO: 1369534 - RNA, 18 nt, Human
cuccaaacugaagcagcc

SEQ ID NO: 1369535 - RNA, 16 nt, Human
cuccaaaaugugccua

SEQ ID NO: 1369536 - RNA, 13 nt, Human
cucauuuuuuaaa

SEQ ID NO: 1369537 - RNA, 22 nt, Human
cucauuuuuccguaaaaaugau

SEQ ID NO: 1369538 - RNA, 18 nt, Human
cucauuuuaggcaaauau

SEQ ID NO: 1369539 - RNA, 23 nt, Human
cucauuuuuauaaugucccuuca

SEQ ID NO: 1369540 - RNA, 22 nt, Human
cuccaaaauguuggucauuuua

SEQ ID NO: 1369541 - RNA, 15 nt, Human
cuccaaaaugugccu

SEQ ID NO: 1369542 - RNA, 14 nt, Human
cuccaaaaugugcc

SEQ ID NO: 1369543 - RNA, 13 nt, Human
cuccaaaccacuu

SEQ ID NO: 1369544 - RNA, 22 nt, Human
cuccaaaccacuuuuugcagcu

SEQ ID NO: 1369545 - RNA, 19 nt, Human
cucauuuagccuguccugu

SEQ ID NO: 1369546 - RNA, 18 nt, Human
cucaggcaggggccucca

SEQ ID NO: 1369547 - RNA, 19 nt, Human
cucauucugaaggagcccc

SEQ ID NO: 1369548 - RNA, 17 nt, Human
cucauucugaaggagcc

SEQ ID NO: 1369549 - RNA, 18 nt, Human
cucauucuccuuguguua

SEQ ID NO: 1369550 - RNA, 22 nt, Human
cucauucuccuuguguuacuaa

SEQ ID NO: 1369551 - RNA, 14 nt, Human
cucaguuuucauaa

SEQ ID NO: 1369552 - RNA, 13 nt, Human
cucaguuuucaua

SEQ ID NO: 1369553 - RNA, 18 nt, Human
cucaguuuuaucauuuuc

SEQ ID NO: 1369554 - RNA, 17 nt, Human
cucaguuuuaucauuuu

SEQ ID NO: 1369555 - RNA, 22 nt, Human
cucaguuugugugucuuaauua

SEQ ID NO: 1369556 - RNA, 15 nt, Human
cucaguuucuugcuu

SEQ ID NO: 1369557 - RNA, 20 nt, Human
cucaguugugacuaacuaga

SEQ ID NO: 1369558 - RNA, 20 nt, Human
cucaguugauuuucuggauu

SEQ ID NO: 1369559 - RNA, 18 nt, Human
cucaguugauuuucugga

SEQ ID NO: 1369560 - RNA, 16 nt, Human
cucaguugauuuucug

SEQ ID NO: 1369561 - RNA, 15 nt, Human
cucaguugauuuucu

SEQ ID NO: 1369562 - RNA, 13 nt, Human
cucaguugcagcc

SEQ ID NO: 1369563 - RNA, 19 nt, Human
cuccagccccucuuggaga

SEQ ID NO: 1369564 - RNA, 18 nt, Human
cuccagccccucuuggag

SEQ ID NO: 1369565 - RNA, 16 nt, Human
cuccagccccucuugg

SEQ ID NO: 1369566 - RNA, 22 nt, Human
cuccagauuagagccuguaaac

SEQ ID NO: 1369567 - RNA, 23 nt, Human
cuccagccaucaagagacugagu

SEQ ID NO: 1369568 - RNA, 19 nt, Human
cuccagauuagagccugua

SEQ ID NO: 1369569 - RNA, 21 nt, Human
cuccagagaguaucugaggca

SEQ ID NO: 1369570 - RNA, 23 nt, Human
cuccagaccugauccuggaggcc

SEQ ID NO: 1369571 - RNA, 19 nt, Human
cuccagaccugauccugga

SEQ ID NO: 1369572 - RNA, 14 nt, Human
cuccagaccugauc

SEQ ID NO: 1369573 - RNA, 12 nt, Human
cuccagaccuga

SEQ ID NO: 1369574 - RNA, 11 nt, Human
cuccagaccug

SEQ ID NO: 1369575 - RNA, 21 nt, Human
cuccagaugcagggcagucau

SEQ ID NO: 1369576 - RNA, 18 nt, Human
cuccagaugcagggcagu

SEQ ID NO: 1369577 - RNA, 17 nt, Human
cuccagaugcagggcag

SEQ ID NO: 1369578 - RNA, 16 nt, Human
cuccagaugcagggca

SEQ ID NO: 1369579 - RNA, 20 nt, Human
cuccagaggggcucagguca

SEQ ID NO: 1369580 - RNA, 21 nt, Human
cuccagagggcacucugcuug

SEQ ID NO: 1369581 - RNA, 20 nt, Human
cuccagagggcacucugcuu

SEQ ID NO: 1369582 - RNA, 13 nt, Human
cuccagagggcac

SEQ ID NO: 1369583 - RNA, 22 nt, Human
cuccacucaugugacucuuucc

SEQ ID NO: 1369584 - RNA, 16 nt, Human
cuccacucaugugacu

SEQ ID NO: 1369585 - RNA, 20 nt, Human
cuccacguucugcucaucau

SEQ ID NO: 1369586 - RNA, 15 nt, Human
cuccaccuagacugu

SEQ ID NO: 1369587 - RNA, 18 nt, Human
cuccaccgcagaaggaag

SEQ ID NO: 1369588 - RNA, 20 nt, Human
cuccaaggggaaucagaacu

SEQ ID NO: 1369589 - RNA, 16 nt, Human
cuccaccgcagaagga

SEQ ID NO: 1369590 - RNA, 17 nt, Human
cuccaccgcagaaggaa

SEQ ID NO: 1369591 - RNA, 22 nt, Human
cucccauccagggcccccaucu

SEQ ID NO: 1369592 - RNA, 15 nt, Human
cucccauccagggcc

SEQ ID NO: 1369593 - RNA, 14 nt, Human
cucccauccagggc

SEQ ID NO: 1369594 - RNA, 18 nt, Human
cuccccacgagggcuggc

SEQ ID NO: 1369595 - RNA, 15 nt, Human
cuccccacgagggcu

SEQ ID NO: 1369596 - RNA, 19 nt, Human
cucccauuccugaagaacc

SEQ ID NO: 1369597 - RNA, 17 nt, Human
cucccauuccugaagaa

SEQ ID NO: 1369598 - RNA, 16 nt, Human
cucccauuccugaaga

SEQ ID NO: 1369599 - RNA, 15 nt, Human
cucccauuccugaag

SEQ ID NO: 1369600 - RNA, 14 nt, Human
cucccauuccugaa

SEQ ID NO: 1369601 - RNA, 23 nt, Human
cucccacaagccugagggaaagg

SEQ ID NO: 1369602 - RNA, 16 nt, Human
cucccacaagccugag

SEQ ID NO: 1369603 - RNA, 15 nt, Human
cucccacaagccuga

SEQ ID NO: 1369604 - RNA, 23 nt, Human
cucccacaagccucugcccaggc

SEQ ID NO: 1369605 - RNA, 21 nt, Human
cucccacaagccucugcccag

SEQ ID NO: 1369606 - RNA, 15 nt, Human
cucccacaagccucu

SEQ ID NO: 1369607 - RNA, 21 nt, Human
cucccaauuucagacucccau

SEQ ID NO: 1369608 - RNA, 19 nt, Human
cucccaauuucagacuccc

SEQ ID NO: 1369609 - RNA, 13 nt, Human
cucccaauucauc

SEQ ID NO: 1369610 - RNA, 17 nt, Human
cucccacaagccugagg

SEQ ID NO: 1369611 - RNA, 22 nt, Human
cucccagggagcaugagaggag

SEQ ID NO: 1369612 - RNA, 15 nt, Human
cucccaaaugagcca

SEQ ID NO: 1369613 - RNA, 22 nt, Human
cucccaaagugcugagauuaca

SEQ ID NO: 1369614 - RNA, 20 nt, Human
cucccaaagugcugagauua

SEQ ID NO: 1369615 - RNA, 20 nt, Human
cucccaaacgcccuuuccuc

SEQ ID NO: 1369616 - RNA, 18 nt, Human
cucccaaacgcccuuucc

SEQ ID NO: 1369617 - RNA, 20 nt, Human
cuccagcugggcucugcaau

SEQ ID NO: 1369618 - RNA, 19 nt, Human
cuccagcugggcucugcaa

SEQ ID NO: 1369619 - RNA, 15 nt, Human
cuccagcugggcucu

SEQ ID NO: 1369620 - RNA, 13 nt, Human
cuccagcugcccc

SEQ ID NO: 1369621 - RNA, 11 nt, Human
cuccagcugcc

SEQ ID NO: 1369622 - RNA, 14 nt, Human
cuccagcugccccg

SEQ ID NO: 1369623 - RNA, 20 nt, Human
cuccagcugcucugucuucu

SEQ ID NO: 1369624 - RNA, 20 nt, Human
cuccagcugacuaaacuuuu

SEQ ID NO: 1369625 - RNA, 21 nt, Human
cuccagccccucuuggagaag

SEQ ID NO: 1369626 - RNA, 20 nt, Human
cuccagccccucuuggagaa

SEQ ID NO: 1369627 - RNA, 22 nt, Human
cuccagccccucuuggagaagu

SEQ ID NO: 1369628 - RNA, 15 nt, Human
cuccauggcccugcc

SEQ ID NO: 1369629 - RNA, 16 nt, Human
cuccauggcccugcca

SEQ ID NO: 1369630 - RNA, 19 nt, Human
cuccauggcccugccaugc

SEQ ID NO: 1369631 - RNA, 13 nt, Human
cuccccagcccag

SEQ ID NO: 1369632 - RNA, 19 nt, Human
cuccccacucugcucugau

SEQ ID NO: 1369633 - RNA, 23 nt, Human
cuccccagcauuccagccccucu

SEQ ID NO: 1369634 - RNA, 22 nt, Human
cuccccagcauuccagccccuc

SEQ ID NO: 1369635 - RNA, 21 nt, Human
cuccccagcauuccagccccu

SEQ ID NO: 1369636 - RNA, 17 nt, Human
cuccccacucugcucug

SEQ ID NO: 1369637 - RNA, 16 nt, Human
cuccccacucugcucu

SEQ ID NO: 1369638 - RNA, 14 nt, Human
cuccccacucugcu

SEQ ID NO: 1369639 - RNA, 13 nt, Human
cuccccacucugc

SEQ ID NO: 1369640 - RNA, 12 nt, Human
cuccccacucug

SEQ ID NO: 1369641 - RNA, 16 nt, Human
cuccccacgagggcug

SEQ ID NO: 1369642 - RNA, 20 nt, Human
cuccccacgucagcugggac

SEQ ID NO: 1369643 - RNA, 16 nt, Human
cuccccucuccuuccu

SEQ ID NO: 1369644 - RNA, 17 nt, Human
cuccccagcccagagac

SEQ ID NO: 1369645 - RNA, 16 nt, Human
cuccccagcccagaga

SEQ ID NO: 1369646 - RNA, 15 nt, Human
cuccccagcccagag

SEQ ID NO: 1369647 - RNA, 14 nt, Human
cuccccagcccaga

SEQ ID NO: 1369648 - RNA, 18 nt, Human
cuccccagcccagagaca

SEQ ID NO: 1369649 - RNA, 21 nt, Human
cuccccugcacuguaaaaugu

SEQ ID NO: 1369650 - RNA, 18 nt, Human
cuccccugcacuguaaaa

SEQ ID NO: 1369651 - RNA, 17 nt, Human
cuccccugcacuguaaa

SEQ ID NO: 1369652 - RNA, 16 nt, Human
cuccccugcacuguaa

SEQ ID NO: 1369653 - RNA, 15 nt, Human
cuccccugcacugua

SEQ ID NO: 1369654 - RNA, 14 nt, Human
cuccccugcacugu

SEQ ID NO: 1369655 - RNA, 13 nt, Human
cuccccugcacug

SEQ ID NO: 1369656 - RNA, 12 nt, Human
cuccccugcacu

SEQ ID NO: 1369657 - RNA, 22 nt, Human
cuccccugaccugugagcccag

SEQ ID NO: 1369658 - RNA, 17 nt, Human
cuccccugaccugugag

SEQ ID NO: 1369659 - RNA, 16 nt, Human
cuccccugaccuguga

SEQ ID NO: 1369660 - RNA, 16 nt, Human
cuccccugccagggca

SEQ ID NO: 1369661 - RNA, 15 nt, Human
cuccccugccagggc

SEQ ID NO: 1369662 - RNA, 23 nt, Human
cuccccugccaccaggccaccuc

SEQ ID NO: 1369663 - RNA, 18 nt, Human
cuccccugccaccaggcc

SEQ ID NO: 1369664 - RNA, 13 nt, Human
cuccccugccacc

SEQ ID NO: 1369665 - RNA, 12 nt, Human
cuccccugccac

SEQ ID NO: 1369666 - RNA, 12 nt, Human
cucccuggaaug

SEQ ID NO: 1369667 - RNA, 23 nt, Human
cucccuggaaugaguugaggcca

SEQ ID NO: 1369668 - RNA, 12 nt, Human
cucccuggauga

SEQ ID NO: 1369669 - RNA, 23 nt, Human
cucccuggaucagaacaggagcu

SEQ ID NO: 1369670 - RNA, 18 nt, Human
cucccuggaucagaacag

SEQ ID NO: 1369671 - RNA, 14 nt, Human
cuccccuguaccuu

SEQ ID NO: 1369672 - RNA, 21 nt, Human
cuccccuggagggggaauggc

SEQ ID NO: 1369673 - RNA, 19 nt, Human
cuccccugcacuguaaaau

SEQ ID NO: 1369674 - RNA, 22 nt, Human
cuccccuggaacugucucucau

SEQ ID NO: 1369675 - RNA, 21 nt, Human
cuccccugccagggcagggcc

SEQ ID NO: 1369676 - RNA, 19 nt, Human
cucccgagcuccucuucca

SEQ ID NO: 1369677 - RNA, 18 nt, Human
cucccgagcuccucuucc

SEQ ID NO: 1369678 - RNA, 14 nt, Human
cucccgagcuccuc

SEQ ID NO: 1369679 - RNA, 12 nt, Human
cucccgagcucc

SEQ ID NO: 1369680 - RNA, 24 nt, Human
cucccgagcuccucuuccaugcug

SEQ ID NO: 1369681 - RNA, 13 nt, Human
cucccucaaccuc

SEQ ID NO: 1369682 - RNA, 17 nt, Human
cucccucaaccucaucc

SEQ ID NO: 1369683 - RNA, 15 nt, Human
cuauuuaacugacua

SEQ ID NO: 1369684 - RNA, 14 nt, Human
cuauuuaacugacu

SEQ ID NO: 1369685 - RNA, 13 nt, Human
cuauuuaacugac

SEQ ID NO: 1369686 - RNA, 15 nt, Human
cuauuuaaagccucc

SEQ ID NO: 1369687 - RNA, 17 nt, Human
cuauuuaaaacuuguaa

SEQ ID NO: 1369688 - RNA, 16 nt, Human
cuauuuaaaacuugua

SEQ ID NO: 1369689 - RNA, 21 nt, Human
cuauugcuagagcuccucccu

SEQ ID NO: 1369690 - RNA, 19 nt, Human
cuauugcuagagcuccucc

SEQ ID NO: 1369691 - RNA, 18 nt, Human
cuauugcuagagcuccuc

SEQ ID NO: 1369692 - RNA, 17 nt, Human
cuauugcuagagcuccu

SEQ ID NO: 1369693 - RNA, 14 nt, Human
cuauugcauuuaua

SEQ ID NO: 1369694 - RNA, 17 nt, Human
cuauugcauuuauaugu

SEQ ID NO: 1369695 - RNA, 19 nt, Human
cuauugcauuuauauguac

SEQ ID NO: 1369696 - RNA, 19 nt, Human
cucacacuggucugcuguc

SEQ ID NO: 1369697 - RNA, 18 nt, Human
cucacacuggucugcugu

SEQ ID NO: 1369698 - RNA, 15 nt, Human
cucacaccugaacug

SEQ ID NO: 1369699 - RNA, 23 nt, Human
cucaagguuuuagguucuaaagu

SEQ ID NO: 1369700 - RNA, 22 nt, Human
cucaagguuuuagguucuaaag

SEQ ID NO: 1369701 - RNA, 20 nt, Human
cucaagguuuuagguucuaa

SEQ ID NO: 1369702 - RNA, 19 nt, Human
cucaagguuuuagguucua

SEQ ID NO: 1369703 - RNA, 14 nt, Human
cucaagguuuuagg

SEQ ID NO: 1369704 - RNA, 23 nt, Human
cucaaggcggugcuugauagaaa

SEQ ID NO: 1369705 - RNA, 17 nt, Human
cucaaggcggugcuuga

SEQ ID NO: 1369706 - RNA, 12 nt, Human
cucaagcccugc

SEQ ID NO: 1369707 - RNA, 13 nt, Human
cucaagcccugca

SEQ ID NO: 1369708 - RNA, 23 nt, Human
cucaagcagcgaccgcccccucc

SEQ ID NO: 1369709 - RNA, 22 nt, Human
cucaagcagcgaccgcccccuc

SEQ ID NO: 1369710 - RNA, 18 nt, Human
cuauuucuuaaacacuug

SEQ ID NO: 1369711 - RNA, 16 nt, Human
cuauuucuccuccaug

SEQ ID NO: 1369712 - RNA, 15 nt, Human
cuauuucuccuccau

SEQ ID NO: 1369713 - RNA, 16 nt, Human
cuauuugauguaauac

SEQ ID NO: 1369714 - RNA, 19 nt, Human
cuauuugauguaauacuuc

SEQ ID NO: 1369715 - RNA, 16 nt, Human
cuauuucuuaaacacu

SEQ ID NO: 1369716 - RNA, 14 nt, Human
cucaaauuucuaaa

SEQ ID NO: 1369717 - RNA, 14 nt, Human
cuauuucacuggag

SEQ ID NO: 1369718 - RNA, 13 nt, Human
cuauuucacugga

SEQ ID NO: 1369719 - RNA, 21 nt, Human
cucaacaggccucagggcucc

SEQ ID NO: 1369720 - RNA, 22 nt, Human
cucaacaggccucagggcuccu

SEQ ID NO: 1369721 - RNA, 15 nt, Human
cucaaauuucuaaau

SEQ ID NO: 1369722 - RNA, 17 nt, Human
cucaaauuucuaaaucu

SEQ ID NO: 1369723 - RNA, 23 nt, Human
cucaaccccuccccuccaucccu

SEQ ID NO: 1369724 - RNA, 21 nt, Human
cucaaccccuccccuccaucc

SEQ ID NO: 1369725 - RNA, 19 nt, Human
cucaaccccuccccuccau

SEQ ID NO: 1369726 - RNA, 23 nt, Human
cucaacuccgugcuuaaccaaag

SEQ ID NO: 1369727 - RNA, 12 nt, Human
cuauaauuuaaa

SEQ ID NO: 1369728 - RNA, 13 nt, Human
cuauaauuuaaau

SEQ ID NO: 1369729 - RNA, 23 nt, Human
cuauacugcuuggagcugagcaa

SEQ ID NO: 1369730 - RNA, 21 nt, Human
cuauacugcauacuuuuuaaa

SEQ ID NO: 1369731 - RNA, 19 nt, Human
cuauacugcauacuuuuua

SEQ ID NO: 1369732 - RNA, 17 nt, Human
cuauacugcauacuuuu

SEQ ID NO: 1369733 - RNA, 19 nt, Human
cuauacgcagcgugcuuua

SEQ ID NO: 1369734 - RNA, 13 nt, Human
cuauaccuguguu

SEQ ID NO: 1369735 - RNA, 15 nt, Human
cuauaccaauaaagu

SEQ ID NO: 1369736 - RNA, 16 nt, Human
cuauaccaauaaagug

SEQ ID NO: 1369737 - RNA, 15 nt, Human
cuauacccacccaga

SEQ ID NO: 1369738 - RNA, 16 nt, Human
cuauacccacccagaa

SEQ ID NO: 1369739 - RNA, 19 nt, Human
cuauauagcugaucaguuu

SEQ ID NO: 1369740 - RNA, 19 nt, Human
cuauauaccaaagcacauu

SEQ ID NO: 1369741 - RNA, 19 nt, Human
cuaugaaauauuauguuaa

SEQ ID NO: 1369742 - RNA, 14 nt, Human
cuauauaccaaagc

SEQ ID NO: 1369743 - RNA, 14 nt, Human
cuauaguucuagac

SEQ ID NO: 1369744 - RNA, 13 nt, Human
cuauaguucuaga

SEQ ID NO: 1369745 - RNA, 20 nt, Human
cuauaguuauuaaguucuuu

SEQ ID NO: 1369746 - RNA, 19 nt, Human
cuauauaagacaagaacuc

SEQ ID NO: 1369747 - RNA, 15 nt, Human
cuauaguucuagaca

SEQ ID NO: 1369748 - RNA, 12 nt, Human
cuauacugcuug

SEQ ID NO: 1369749 - RNA, 23 nt, Human
cuauaccuguguuucuugccuca

SEQ ID NO: 1369750 - RNA, 15 nt, Human
cuauagcuaaguaca

SEQ ID NO: 1369751 - RNA, 17 nt, Human
cuauagcuaaguacaca

SEQ ID NO: 1369752 - RNA, 16 nt, Human
cuaugccucucuacag

SEQ ID NO: 1369753 - RNA, 15 nt, Human
cuaugccucucuaca

SEQ ID NO: 1369754 - RNA, 20 nt, Human
cuaugauuuaauuugaaaua

SEQ ID NO: 1369755 - RNA, 19 nt, Human
cuaugauuuaauuugaaau

SEQ ID NO: 1369756 - RNA, 14 nt, Human
cuaugauuauuaac

SEQ ID NO: 1369757 - RNA, 13 nt, Human
cuaugaaggcugu

SEQ ID NO: 1369758 - RNA, 22 nt, Human
cuaugaaguuuuuuuuauacag

SEQ ID NO: 1369759 - RNA, 22 nt, Human
cuauucuuuaacucccauuacc

SEQ ID NO: 1369760 - RNA, 22 nt, Human
cuauucuugauguaaaaucuug

SEQ ID NO: 1369761 - RNA, 20 nt, Human
cuauucuugauguaaaaucu

SEQ ID NO: 1369762 - RNA, 19 nt, Human
cuauucuugauguaaaauc

SEQ ID NO: 1369763 - RNA, 18 nt, Human
cuauucuugauguaaaau

SEQ ID NO: 1369764 - RNA, 17 nt, Human
cuauucuugauguaaaa

SEQ ID NO: 1369765 - RNA, 16 nt, Human
cuauucuugauguaaa

SEQ ID NO: 1369766 - RNA, 14 nt, Human
cuauucuugaugua

SEQ ID NO: 1369767 - RNA, 20 nt, Human
cuauucugucccuagguguu

SEQ ID NO: 1369768 - RNA, 16 nt, Human
cuauucugucccuagg

SEQ ID NO: 1369769 - RNA, 15 nt, Human
cuauucugucccuag

SEQ ID NO: 1369770 - RNA, 14 nt, Human
cuauucugucccua

SEQ ID NO: 1369771 - RNA, 12 nt, Human
cuauucuguccc

SEQ ID NO: 1369772 - RNA, 23 nt, Human
cuauucagcuucguuuauuuuca

SEQ ID NO: 1369773 - RNA, 22 nt, Human
cuauuauuuucacuguagaaug

SEQ ID NO: 1369774 - RNA, 20 nt, Human
cuauuauuuucacuguagaa

SEQ ID NO: 1369775 - RNA, 23 nt, Human
cuauuaugaaugugaagccuucc

SEQ ID NO: 1369776 - RNA, 22 nt, Human
cuauuaugaaugugaagccuuc

SEQ ID NO: 1369777 - RNA, 21 nt, Human
cuauuaugaaugugaagccuu

SEQ ID NO: 1369778 - RNA, 19 nt, Human
cuauuaucugucagcugca

SEQ ID NO: 1369779 - RNA, 17 nt, Human
cuauuauccccauuucu

SEQ ID NO: 1369780 - RNA, 16 nt, Human
cuauuauccccauuuc

SEQ ID NO: 1369781 - RNA, 19 nt, Human
cuauuaucccagcugccua

SEQ ID NO: 1369782 - RNA, 18 nt, Human
cuauuaucccagcugccu

SEQ ID NO: 1369783 - RNA, 22 nt, Human
cuauguaacauguaggaaguag

SEQ ID NO: 1369784 - RNA, 23 nt, Human
cuauggggaagguuaucagugcu

SEQ ID NO: 1369785 - RNA, 17 nt, Human
cuaugcucaggggcccu

SEQ ID NO: 1369786 - RNA, 22 nt, Human
cuaugcucaggggcccuggagc

SEQ ID NO: 1369787 - RNA, 19 nt, Human
cuagcgggauggggcuccc

SEQ ID NO: 1369788 - RNA, 16 nt, Human
cuagcgggauggggcu

SEQ ID NO: 1369789 - RNA, 20 nt, Human
cuagcgcuaucucccugccu

SEQ ID NO: 1369790 - RNA, 17 nt, Human
cuagcgcuaucucccug

SEQ ID NO: 1369791 - RNA, 22 nt, Human
cuagcgcaguuuuuuuuuucuu

SEQ ID NO: 1369792 - RNA, 21 nt, Human
cuagcgcaguuuuuuuuuucu

SEQ ID NO: 1369793 - RNA, 14 nt, Human
cuagcgcaguuuuu

SEQ ID NO: 1369794 - RNA, 15 nt, Human
cuagccuugcuuguu

SEQ ID NO: 1369795 - RNA, 22 nt, Human
cuagccuuggccucuuuccuca

SEQ ID NO: 1369796 - RNA, 14 nt, Human
cuagccuugcuugu

SEQ ID NO: 1369797 - RNA, 13 nt, Human
cuagccuugcuug

SEQ ID NO: 1369798 - RNA, 11 nt, Human
cuagccuugcu

SEQ ID NO: 1369799 - RNA, 22 nt, Human
cuagccuuaaucagguccucag

SEQ ID NO: 1369800 - RNA, 21 nt, Human
cuagauaucgacuuguuuuug

SEQ ID NO: 1369801 - RNA, 14 nt, Human
cuagauaucgacuu

SEQ ID NO: 1369802 - RNA, 24 nt, Human
cuagauacuguaucaugacaaaga

SEQ ID NO: 1369803 - RNA, 13 nt, Human
cuagauacuguau

SEQ ID NO: 1369804 - RNA, 16 nt, Human
cuagauacuguaucau

SEQ ID NO: 1369805 - RNA, 14 nt, Human
cuagcugugggggu

SEQ ID NO: 1369806 - RNA, 17 nt, Human
cuagcuguccuuuuucc

SEQ ID NO: 1369807 - RNA, 20 nt, Human
cuagcugaauguuuuucuaa

SEQ ID NO: 1369808 - RNA, 19 nt, Human
cuagcugaauguuuuucua

SEQ ID NO: 1369809 - RNA, 18 nt, Human
cuagcugaauguuuuucu

SEQ ID NO: 1369810 - RNA, 17 nt, Human
cuagcugaauguuuuuc

SEQ ID NO: 1369811 - RNA, 21 nt, Human
cuagcucuuguugagccgugg

SEQ ID NO: 1369812 - RNA, 15 nt, Human
cuaggaaaauaaaac

SEQ ID NO: 1369813 - RNA, 14 nt, Human
cuaggaaaauaaaa

SEQ ID NO: 1369814 - RNA, 23 nt, Human
cuagcugugugaauaccugcuca

SEQ ID NO: 1369815 - RNA, 23 nt, Human
cuagcuguccuuuuuccucucca

SEQ ID NO: 1369816 - RNA, 20 nt, Human
cuaggaaauauuuauuuuaa

SEQ ID NO: 1369817 - RNA, 19 nt, Human
cuaggaaauauuuauuuua

SEQ ID NO: 1369818 - RNA, 15 nt, Human
cuaggaaauauuuau

SEQ ID NO: 1369819 - RNA, 14 nt, Human
cuaggaaauauuua

SEQ ID NO: 1369820 - RNA, 21 nt, Human
cuacucuccccacgagggcug

SEQ ID NO: 1369821 - RNA, 20 nt, Human
cuacucuccccacgagggcu

SEQ ID NO: 1369822 - RNA, 19 nt, Human
cuacucuccccacgagggc

SEQ ID NO: 1369823 - RNA, 17 nt, Human
cuacucuccccacgagg

SEQ ID NO: 1369824 - RNA, 20 nt, Human
cuacucugugccagagccug

SEQ ID NO: 1369825 - RNA, 19 nt, Human
cuacucugugccagagccu

SEQ ID NO: 1369826 - RNA, 18 nt, Human
cuacucugugccagagcc

SEQ ID NO: 1369827 - RNA, 17 nt, Human
cuacucugugccagagc

SEQ ID NO: 1369828 - RNA, 13 nt, Human
cuacucugugcca

SEQ ID NO: 1369829 - RNA, 22 nt, Human
cuacucuccccacgagggcugg

SEQ ID NO: 1369830 - RNA, 23 nt, Human
cuacucuccccacgagggcuggc

SEQ ID NO: 1369831 - RNA, 14 nt, Human
cuacugauuccgca

SEQ ID NO: 1369832 - RNA, 22 nt, Human
cuacucugugccagagccuggg

SEQ ID NO: 1369833 - RNA, 21 nt, Human
cuacucugugccagagccugg

SEQ ID NO: 1369834 - RNA, 21 nt, Human
cuacugcccaggcacugcaaa

SEQ ID NO: 1369835 - RNA, 15 nt, Human
cuacugcccaggcac

SEQ ID NO: 1369836 - RNA, 21 nt, Human
cuacugccgucagugcugugc

SEQ ID NO: 1369837 - RNA, 20 nt, Human
cuacuggggaaacuggccau

SEQ ID NO: 1369838 - RNA, 22 nt, Human
cuacuggggaaacuggccaugg

SEQ ID NO: 1369839 - RNA, 19 nt, Human
cuacuggggaaacuggcca

SEQ ID NO: 1369840 - RNA, 17 nt, Human
cuacuggggaaacuggc

SEQ ID NO: 1369841 - RNA, 16 nt, Human
cuacuggggaaacugg

SEQ ID NO: 1369842 - RNA, 15 nt, Human
cuacuggggaaacug

SEQ ID NO: 1369843 - RNA, 14 nt, Human
cuacugggaaggcu

SEQ ID NO: 1369844 - RNA, 20 nt, Human
cuacuggucucucuaugccu

SEQ ID NO: 1369845 - RNA, 15 nt, Human
cuacuggucucucua

SEQ ID NO: 1369846 - RNA, 13 nt, Human
cuacuggucucuc

SEQ ID NO: 1369847 - RNA, 18 nt, Human
cuaccucaggcagcucaa

SEQ ID NO: 1369848 - RNA, 17 nt, Human
cuaccucaggcagcuca

SEQ ID NO: 1369849 - RNA, 16 nt, Human
cuaccgucuuuuccug

SEQ ID NO: 1369850 - RNA, 14 nt, Human
cuaccgaguucaag

SEQ ID NO: 1369851 - RNA, 13 nt, Human
cuaccgaguucaa

SEQ ID NO: 1369852 - RNA, 18 nt, Human
cuaccgaaugugucuuua

SEQ ID NO: 1369853 - RNA, 17 nt, Human
cuaccgaaugugucuuu

SEQ ID NO: 1369854 - RNA, 19 nt, Human
cuacccuuuuucuccagcu

SEQ ID NO: 1369855 - RNA, 18 nt, Human
cuacccuuuuucuccagc

SEQ ID NO: 1369856 - RNA, 22 nt, Human
cuaccuccaaagcuucccacgg

SEQ ID NO: 1369857 - RNA, 20 nt, Human
cuagaaacaacacuguagua

SEQ ID NO: 1369858 - RNA, 18 nt, Human
cuagaaacaacacuguag

SEQ ID NO: 1369859 - RNA, 17 nt, Human
cuagaaacaacacugua

SEQ ID NO: 1369860 - RNA, 14 nt, Human
cuagaaacaacacu

SEQ ID NO: 1369861 - RNA, 16 nt, Human
cuagaaaaacaggcac

SEQ ID NO: 1369862 - RNA, 17 nt, Human
cuagaaaaacaggcacu

SEQ ID NO: 1369863 - RNA, 15 nt, Human
cuagaaaaacaggca

SEQ ID NO: 1369864 - RNA, 14 nt, Human
cuagaaaaacaggc

SEQ ID NO: 1369865 - RNA, 11 nt, Human
cuagaaaaaca

SEQ ID NO: 1369866 - RNA, 22 nt, Human
cuacuuacaugcauuacugcau

SEQ ID NO: 1369867 - RNA, 22 nt, Human
cuacuguucuaaagcucugaca

SEQ ID NO: 1369868 - RNA, 20 nt, Human
cuacuguucuaaagcucuga

SEQ ID NO: 1369869 - RNA, 18 nt, Human
cuacuguucuaaagcucu

SEQ ID NO: 1369870 - RNA, 15 nt, Human
cuacuguucuaaagc

SEQ ID NO: 1369871 - RNA, 14 nt, Human
cuacuguucuaaag

SEQ ID NO: 1369872 - RNA, 12 nt, Human
cuacuguucuaa

SEQ ID NO: 1369873 - RNA, 19 nt, Human
cuagaaacaacacuguagu

SEQ ID NO: 1369874 - RNA, 16 nt, Human
cuagaaacuuccaaau

SEQ ID NO: 1369875 - RNA, 14 nt, Human
cuagaaacuuccaa

SEQ ID NO: 1369876 - RNA, 18 nt, Human
cuagagaagacaggcugg

SEQ ID NO: 1369877 - RNA, 22 nt, Human
cuagagaagacaggcuggaaga

SEQ ID NO: 1369878 - RNA, 17 nt, Human
cuagagaagacaggcug

SEQ ID NO: 1369879 - RNA, 15 nt, Human
cuagagaagacaggc

SEQ ID NO: 1369880 - RNA, 21 nt, Human
cuagagaaauaagaucuuuuu

SEQ ID NO: 1369881 - RNA, 19 nt, Human
cuagagaaauaagaucuuu

SEQ ID NO: 1369882 - RNA, 23 nt, Human
cuagaggcuuccuucauuuccuc

SEQ ID NO: 1369883 - RNA, 21 nt, Human
cuagaggcuuccuucauuucc

SEQ ID NO: 1369884 - RNA, 19 nt, Human
cuagaggcuuccuucauuu

SEQ ID NO: 1369885 - RNA, 18 nt, Human
cuagaggcuuccuucauu

SEQ ID NO: 1369886 - RNA, 15 nt, Human
cuagagcagggauua

SEQ ID NO: 1369887 - RNA, 14 nt, Human
cuagagcagggauu

SEQ ID NO: 1369888 - RNA, 18 nt, Human
cuagagcacugccaccag

SEQ ID NO: 1369889 - RNA, 20 nt, Human
cuagagcagacuacagcugg

SEQ ID NO: 1369890 - RNA, 15 nt, Human
cuagagcacugccac

SEQ ID NO: 1369891 - RNA, 14 nt, Human
cuagagcacugcca

SEQ ID NO: 1369892 - RNA, 24 nt, Human
cuagagugacucacuaauucauua

SEQ ID NO: 1369893 - RNA, 19 nt, Human
cuagaguuuagcuggaaaa

SEQ ID NO: 1369894 - RNA, 18 nt, Human
cuagaguuuagcuggaaa

SEQ ID NO: 1369895 - RNA, 17 nt, Human
cuagagguucaaagaua

SEQ ID NO: 1369896 - RNA, 18 nt, Human
cuagagguucaaagauau

SEQ ID NO: 1369897 - RNA, 21 nt, Human
cuagagguucaaagauauuuu

SEQ ID NO: 1369898 - RNA, 17 nt, Human
cugccuuggccucccaa

SEQ ID NO: 1369899 - RNA, 14 nt, Human
cugccuuggccucc

SEQ ID NO: 1369900 - RNA, 22 nt, Human
cugccucuucugggagggcagc

SEQ ID NO: 1369901 - RNA, 17 nt, Human
cugccucuucugggagg

SEQ ID NO: 1369902 - RNA, 16 nt, Human
cugccucuucugggag

SEQ ID NO: 1369903 - RNA, 22 nt, Human
cugccucucugcaggucccuaa

SEQ ID NO: 1369904 - RNA, 20 nt, Human
cugccucucugcaggucccu

SEQ ID NO: 1369905 - RNA, 21 nt, Human
cugccucucugcaggucccua

SEQ ID NO: 1369906 - RNA, 13 nt, Human
cugccuaagcccu

SEQ ID NO: 1369907 - RNA, 23 nt, Human
cugcccuuguuuggggcaggagu

SEQ ID NO: 1369908 - RNA, 22 nt, Human
cugcccuuguuuggggcaggag

SEQ ID NO: 1369909 - RNA, 21 nt, Human
cugcccuuguuuggggcagga

SEQ ID NO: 1369910 - RNA, 17 nt, Human
cugcccuugaucagccc

SEQ ID NO: 1369911 - RNA, 16 nt, Human
cugcccuugaucagcc

SEQ ID NO: 1369912 - RNA, 20 nt, Human
cugcccuuguuuggggcagg

SEQ ID NO: 1369913 - RNA, 12 nt, Human
cugcccuuguuu

SEQ ID NO: 1369914 - RNA, 14 nt, Human
cugccgagcaaccg

SEQ ID NO: 1369915 - RNA, 23 nt, Human
cugccgagaguccaucagccucc

SEQ ID NO: 1369916 - RNA, 22 nt, Human
cugccgagaguccaucagccuc

SEQ ID NO: 1369917 - RNA, 17 nt, Human
cugccgcaacaguuuuu

SEQ ID NO: 1369918 - RNA, 21 nt, Human
cugccgagcaaccguggcccu

SEQ ID NO: 1369919 - RNA, 16 nt, Human
cugccgagcaaccgug

SEQ ID NO: 1369920 - RNA, 21 nt, Human
cugccguggggccgccgccuc

SEQ ID NO: 1369921 - RNA, 20 nt, Human
cugccguggggccgccgccu

SEQ ID NO: 1369922 - RNA, 13 nt, Human
cugccguggggcc

SEQ ID NO: 1369923 - RNA, 21 nt, Human
cugccguccccuagaguccca

SEQ ID NO: 1369924 - RNA, 22 nt, Human
cugccguccccuagagucccag

SEQ ID NO: 1369925 - RNA, 20 nt, Human
cugccgucagugcugugcug

SEQ ID NO: 1369926 - RNA, 19 nt, Human
cugccgucagugcugugcu

SEQ ID NO: 1369927 - RNA, 13 nt, Human
cugccgucagugc

SEQ ID NO: 1369928 - RNA, 23 nt, Human
cugccgguucuuaaauccauccu

SEQ ID NO: 1369929 - RNA, 15 nt, Human
cugccguaauuuaac

SEQ ID NO: 1369930 - RNA, 23 nt, Human
cugccggggcagcccccucacag

SEQ ID NO: 1369931 - RNA, 20 nt, Human
cugccggggcagcccccuca

SEQ ID NO: 1369932 - RNA, 19 nt, Human
cugccggggcagcccccuc

SEQ ID NO: 1369933 - RNA, 17 nt, Human
cugccggggcagccccc

SEQ ID NO: 1369934 - RNA, 13 nt, Human
cugccggggcagc

SEQ ID NO: 1369935 - RNA, 12 nt, Human
cugcccucaugg

SEQ ID NO: 1369936 - RNA, 19 nt, Human
cugcccucauggccccucu

SEQ ID NO: 1369937 - RNA, 19 nt, Human
cucccuucaugcauggaaa

SEQ ID NO: 1369938 - RNA, 17 nt, Human
cugcugccacugagggg

SEQ ID NO: 1369939 - RNA, 16 nt, Human
cugcugccacugaggg

SEQ ID NO: 1369940 - RNA, 15 nt, Human
cugcugccacugagg

SEQ ID NO: 1369941 - RNA, 14 nt, Human
cugcugccacugag

SEQ ID NO: 1369942 - RNA, 13 nt, Human
cugcugccacuga

SEQ ID NO: 1369943 - RNA, 12 nt, Human
cugcugccacug

SEQ ID NO: 1369944 - RNA, 11 nt, Human
cugcugccacu

SEQ ID NO: 1369945 - RNA, 17 nt, Human
cugcugcccauguuuca

SEQ ID NO: 1369946 - RNA, 17 nt, Human
cugcucccaccuccuga

SEQ ID NO: 1369947 - RNA, 16 nt, Human
cugcucccaccuccug

SEQ ID NO: 1369948 - RNA, 22 nt, Human
cugcucccaaggggccugagca

SEQ ID NO: 1369949 - RNA, 23 nt, Human
cugcucccaaggggccugagcag

SEQ ID NO: 1369950 - RNA, 21 nt, Human
cugcucccaaggggccugagc

SEQ ID NO: 1369951 - RNA, 20 nt, Human
cugcucccaaggggccugag

SEQ ID NO: 1369952 - RNA, 18 nt, Human
cugcucccaaggggccug

SEQ ID NO: 1369953 - RNA, 17 nt, Human
cugcucccaaggggccu

SEQ ID NO: 1369954 - RNA, 12 nt, Human
cugcucccaagg

SEQ ID NO: 1369955 - RNA, 18 nt, Human
cugcucuccucuucuacu

SEQ ID NO: 1369956 - RNA, 17 nt, Human
cugcucuccucuucuac

SEQ ID NO: 1369957 - RNA, 14 nt, Human
cugcucuccucuuc

SEQ ID NO: 1369958 - RNA, 13 nt, Human
cugcucuccucuu

SEQ ID NO: 1369959 - RNA, 11 nt, Human
cugcucuccuc

SEQ ID NO: 1369960 - RNA, 15 nt, Human
cugcgagugguuucu

SEQ ID NO: 1369961 - RNA, 20 nt, Human
cugcgacuuucugccuggag

SEQ ID NO: 1369962 - RNA, 19 nt, Human
cugcgacuuucugccugga

SEQ ID NO: 1369963 - RNA, 18 nt, Human
cugcgacuuucugccugg

SEQ ID NO: 1369964 - RNA, 17 nt, Human
cugcgacuuucugccug

SEQ ID NO: 1369965 - RNA, 16 nt, Human
cugcgacuuucugccu

SEQ ID NO: 1369966 - RNA, 14 nt, Human
cugcgacuuucugc

SEQ ID NO: 1369967 - RNA, 15 nt, Human
cugccuuuauugugu

SEQ ID NO: 1369968 - RNA, 17 nt, Human
cugccuuuauuguguuu

SEQ ID NO: 1369969 - RNA, 18 nt, Human
cugccuuuauuguguuug

SEQ ID NO: 1369970 - RNA, 14 nt, Human
cugccuuguguaca

SEQ ID NO: 1369971 - RNA, 12 nt, Human
cugccuuuauug

SEQ ID NO: 1369972 - RNA, 19 nt, Human
cugcuggggaagacagugg

SEQ ID NO: 1369973 - RNA, 18 nt, Human
cugcuggggaagacagug

SEQ ID NO: 1369974 - RNA, 17 nt, Human
cugcuggggaagacagu

SEQ ID NO: 1369975 - RNA, 15 nt, Human
cugcuggggaagaca

SEQ ID NO: 1369976 - RNA, 14 nt, Human
cugcuggggaagac

SEQ ID NO: 1369977 - RNA, 22 nt, Human
cugcuggggaagacaguggccc

SEQ ID NO: 1369978 - RNA, 21 nt, Human
cugcuggggaagacaguggcc

SEQ ID NO: 1369979 - RNA, 20 nt, Human
cugcuggggaagacaguggc

SEQ ID NO: 1369980 - RNA, 16 nt, Human
cugcuggccucugcga

SEQ ID NO: 1369981 - RNA, 21 nt, Human
cugcuggccucugcgaguggu

SEQ ID NO: 1369982 - RNA, 15 nt, Human
cugcuggccucugcg

SEQ ID NO: 1369983 - RNA, 14 nt, Human
cugcuggccucugc

SEQ ID NO: 1369984 - RNA, 19 nt, Human
cugcuggagaggccccagc

SEQ ID NO: 1369985 - RNA, 21 nt, Human
cugcuggaguuucauguacaa

SEQ ID NO: 1369986 - RNA, 20 nt, Human
cugcuggaguuucauguaca

SEQ ID NO: 1369987 - RNA, 21 nt, Human
cugcuggagaggccccagccg

SEQ ID NO: 1369988 - RNA, 18 nt, Human
cugcuggagaggccccag

SEQ ID NO: 1369989 - RNA, 15 nt, Human
cugcuggagaggccc

SEQ ID NO: 1369990 - RNA, 17 nt, Human
cugcugcugucugggug

SEQ ID NO: 1369991 - RNA, 18 nt, Human
cugcugcugucugggugc

SEQ ID NO: 1369992 - RNA, 16 nt, Human
cugcugcugucugggu

SEQ ID NO: 1369993 - RNA, 17 nt, Human
cugcugcugggcucagu

SEQ ID NO: 1369994 - RNA, 14 nt, Human
cugcugcugucccu

SEQ ID NO: 1369995 - RNA, 16 nt, Human
cugcugcugggcucag

SEQ ID NO: 1369996 - RNA, 15 nt, Human
cugcugcugggcuca

SEQ ID NO: 1369997 - RNA, 14 nt, Human
cugcugcugggcuc

SEQ ID NO: 1369998 - RNA, 13 nt, Human
cugcugcugggcu

SEQ ID NO: 1369999 - RNA, 12 nt, Human
cugcugcugggc

SEQ ID NO: 1370000 - RNA, 23 nt, Human
cugcugcugagaaccuggccuuc

SEQ ID NO: 1370001 - RNA, 20 nt, Human
cugcugcugagaaccuggcc

SEQ ID NO: 1370002 - RNA, 19 nt, Human
cugcugcugagaaccuggc

SEQ ID NO: 1370003 - RNA, 17 nt, Human
cugcugcugagaaccug

SEQ ID NO: 1370004 - RNA, 16 nt, Human
cugcugcugagaaccu

SEQ ID NO: 1370005 - RNA, 14 nt, Human
cugcugcugagaac

SEQ ID NO: 1370006 - RNA, 13 nt, Human
cugcugcugagaa

SEQ ID NO: 1370007 - RNA, 11 nt, Human
cugcugcugag

SEQ ID NO: 1370008 - RNA, 23 nt, Human
cugcugcucuuggcuggacccag

SEQ ID NO: 1370009 - RNA, 22 nt, Human
cugcugcugagaaccuggccuu

SEQ ID NO: 1370010 - RNA, 21 nt, Human
cugcugcugagaaccuggccu

SEQ ID NO: 1370011 - RNA, 14 nt, Human
cugcugcugccugc

SEQ ID NO: 1370012 - RNA, 15 nt, Human
cugcugcugccugcc

SEQ ID NO: 1370013 - RNA, 22 nt, Human
cugcugcucuuggcuggaccca

SEQ ID NO: 1370014 - RNA, 21 nt, Human
cugcugcucuuggcuggaccc

SEQ ID NO: 1370015 - RNA, 15 nt, Human
cugcugcucuuggcu

SEQ ID NO: 1370016 - RNA, 23 nt, Human
cugcugcucccucagacuggggc

SEQ ID NO: 1370017 - RNA, 21 nt, Human
cugcugcucccucagacuggg

SEQ ID NO: 1370018 - RNA, 17 nt, Human
cugcugcucccucagac

SEQ ID NO: 1370019 - RNA, 16 nt, Human
cugcugcucccucaga

SEQ ID NO: 1370020 - RNA, 15 nt, Human
cugcugcucccucag

SEQ ID NO: 1370021 - RNA, 14 nt, Human
cugcugcucccuca

SEQ ID NO: 1370022 - RNA, 13 nt, Human
cugcugcucccuc

SEQ ID NO: 1370023 - RNA, 12 nt, Human
cugcugcucccu

SEQ ID NO: 1370024 - RNA, 16 nt, Human
cugcugcuacaauguc

SEQ ID NO: 1370025 - RNA, 17 nt, Human
cuggaccucugacagca

SEQ ID NO: 1370026 - RNA, 15 nt, Human
cuggaccucugacag

SEQ ID NO: 1370027 - RNA, 13 nt, Human
cuggaccucugac

SEQ ID NO: 1370028 - RNA, 13 nt, Human
cuggaccucacca

SEQ ID NO: 1370029 - RNA, 15 nt, Human
cuggacccuguugcu

SEQ ID NO: 1370030 - RNA, 16 nt, Human
cuggacccuguugcua

SEQ ID NO: 1370031 - RNA, 17 nt, Human
cuggacccuguugcuaa

SEQ ID NO: 1370032 - RNA, 18 nt, Human
cuggacccuguugcuaag

SEQ ID NO: 1370033 - RNA, 21 nt, Human
cuggaccucugacagcagcau

SEQ ID NO: 1370034 - RNA, 14 nt, Human
cuggaccucugggu

SEQ ID NO: 1370035 - RNA, 19 nt, Human
cuggaccucugacagcagc

SEQ ID NO: 1370036 - RNA, 18 nt, Human
cuggaccucugacagcag

SEQ ID NO: 1370037 - RNA, 23 nt, Human
cuggaccccugcauuggaacugg

SEQ ID NO: 1370038 - RNA, 18 nt, Human
cuggaccccugcauugga

SEQ ID NO: 1370039 - RNA, 15 nt, Human
cuggaccccugcauu

SEQ ID NO: 1370040 - RNA, 14 nt, Human
cuggaccccugcau

SEQ ID NO: 1370041 - RNA, 13 nt, Human
cuggaccccugca

SEQ ID NO: 1370042 - RNA, 23 nt, Human
cuggaccccccuuucacaggcag

SEQ ID NO: 1370043 - RNA, 22 nt, Human
cuggaccccccuuucacaggca

SEQ ID NO: 1370044 - RNA, 19 nt, Human
cuggaccccccuuucacag

SEQ ID NO: 1370045 - RNA, 21 nt, Human
cuggacccugaccagcucccc

SEQ ID NO: 1370046 - RNA, 20 nt, Human
cuggacccugaccagcuccc

SEQ ID NO: 1370047 - RNA, 14 nt, Human
cuggacccuguugc

SEQ ID NO: 1370048 - RNA, 13 nt, Human
cuggacccugacc

SEQ ID NO: 1370049 - RNA, 12 nt, Human
cuggacccugac

SEQ ID NO: 1370050 - RNA, 23 nt, Human
cuggacccguucaugggggaggg

SEQ ID NO: 1370051 - RNA, 20 nt, Human
cuggacccguucauggggga

SEQ ID NO: 1370052 - RNA, 15 nt, Human
cuggagaucaccagu

SEQ ID NO: 1370053 - RNA, 22 nt, Human
cuggacccagccaggcccagcc

SEQ ID NO: 1370054 - RNA, 21 nt, Human
cuggacccagccaggcccagc

SEQ ID NO: 1370055 - RNA, 20 nt, Human
cuggacccagccaggcccag

SEQ ID NO: 1370056 - RNA, 19 nt, Human
cuggacccagccaggccca

SEQ ID NO: 1370057 - RNA, 18 nt, Human
cuggacccagccaggccc

SEQ ID NO: 1370058 - RNA, 17 nt, Human
cuggacccagccaggcc

SEQ ID NO: 1370059 - RNA, 17 nt, Human
cuggacccagccagaac

SEQ ID NO: 1370060 - RNA, 14 nt, Human
cuggacccagccag

SEQ ID NO: 1370061 - RNA, 13 nt, Human
cuggacccagcca

SEQ ID NO: 1370062 - RNA, 12 nt, Human
cuggacccagcc

SEQ ID NO: 1370063 - RNA, 11 nt, Human
cuggacccagc

SEQ ID NO: 1370064 - RNA, 18 nt, Human
cuggaccagccucuccac

SEQ ID NO: 1370065 - RNA, 14 nt, Human
cuggaccagccucu

SEQ ID NO: 1370066 - RNA, 17 nt, Human
cuggacacucagaccug

SEQ ID NO: 1370067 - RNA, 16 nt, Human
cuggacacucagaccu

SEQ ID NO: 1370068 - RNA, 15 nt, Human
cuggacacucagacc

SEQ ID NO: 1370069 - RNA, 14 nt, Human
cugcuuccuccugg

SEQ ID NO: 1370070 - RNA, 13 nt, Human
cugcuuccuccug

SEQ ID NO: 1370071 - RNA, 12 nt, Human
cugcuuccuccu

SEQ ID NO: 1370072 - RNA, 15 nt, Human
cugcuucccugaagc

SEQ ID NO: 1370073 - RNA, 16 nt, Human
cugcuucccugaagcu

SEQ ID NO: 1370074 - RNA, 14 nt, Human
cugcuuccagugua

SEQ ID NO: 1370075 - RNA, 18 nt, Human
cugcuuccuccuggaaau

SEQ ID NO: 1370076 - RNA, 16 nt, Human
cugcuuccuccuggaa

SEQ ID NO: 1370077 - RNA, 15 nt, Human
cugcuuccuccugga

SEQ ID NO: 1370078 - RNA, 13 nt, Human
cuggaauuugaaa

SEQ ID NO: 1370079 - RNA, 15 nt, Human
cuggagucaaaacac

SEQ ID NO: 1370080 - RNA, 20 nt, Human
cuggagggggaauggcagca

SEQ ID NO: 1370081 - RNA, 19 nt, Human
cuggagggggaauggcagc

SEQ ID NO: 1370082 - RNA, 15 nt, Human
cuggagggggaaugg

SEQ ID NO: 1370083 - RNA, 13 nt, Human
cuggaggggaggg

SEQ ID NO: 1370084 - RNA, 20 nt, Human
cuggagggguguggcuccuu

SEQ ID NO: 1370085 - RNA, 16 nt, Human
cuggagggguguggcu

SEQ ID NO: 1370086 - RNA, 22 nt, Human
cuggagggggaauggcagcagg

SEQ ID NO: 1370087 - RNA, 21 nt, Human
cuggagggggaauggcagcag

SEQ ID NO: 1370088 - RNA, 14 nt, Human
cuggaggccccaac

SEQ ID NO: 1370089 - RNA, 21 nt, Human
cuggaggcccaguucacccug

SEQ ID NO: 1370090 - RNA, 15 nt, Human
cuggaggcccaguuc

SEQ ID NO: 1370091 - RNA, 14 nt, Human
cuggaggcccaguu

SEQ ID NO: 1370092 - RNA, 13 nt, Human
cuggaggcccagu

SEQ ID NO: 1370093 - RNA, 19 nt, Human
cuggaggcccaggcuggga

SEQ ID NO: 1370094 - RNA, 18 nt, Human
cuggaggcccaggcuggg

SEQ ID NO: 1370095 - RNA, 17 nt, Human
cuggaggcccaggcugg

SEQ ID NO: 1370096 - RNA, 15 nt, Human
cuggaggcccaggcu

SEQ ID NO: 1370097 - RNA, 14 nt, Human
cuggaggcccaggc

SEQ ID NO: 1370098 - RNA, 13 nt, Human
cuggaggcccagg

SEQ ID NO: 1370099 - RNA, 12 nt, Human
cuggaggcccag

SEQ ID NO: 1370100 - RNA, 22 nt, Human
cuggaggcaggggcuuccuggu

SEQ ID NO: 1370101 - RNA, 21 nt, Human
cuggaggcaggggcuuccugg

SEQ ID NO: 1370102 - RNA, 20 nt, Human
cuggaggcaggggcuuccug

SEQ ID NO: 1370103 - RNA, 19 nt, Human
cuggaggcaggggcuuccu

SEQ ID NO: 1370104 - RNA, 18 nt, Human
cuggaggcaggggcuucc

SEQ ID NO: 1370105 - RNA, 15 nt, Human
cuggaggcagggaac

SEQ ID NO: 1370106 - RNA, 24 nt, Human
cuggaggcaccugguggccaugcu

SEQ ID NO: 1370107 - RNA, 22 nt, Human
cuggagcacaauaaauggcugu

SEQ ID NO: 1370108 - RNA, 13 nt, Human
cuggagccccauc

SEQ ID NO: 1370109 - RNA, 15 nt, Human
cuggagcccuggaga

SEQ ID NO: 1370110 - RNA, 17 nt, Human
cuggagauccuccugca

SEQ ID NO: 1370111 - RNA, 16 nt, Human
cuggagauccuccugc

SEQ ID NO: 1370112 - RNA, 15 nt, Human
cuggagauccuccug

SEQ ID NO: 1370113 - RNA, 14 nt, Human
cuggagauccuccu

SEQ ID NO: 1370114 - RNA, 20 nt, Human
cuggagauccuccugcagac

SEQ ID NO: 1370115 - RNA, 18 nt, Human
cuggagauccuccugcag

SEQ ID NO: 1370116 - RNA, 23 nt, Human
cuggagauccuccugcagaccac

SEQ ID NO: 1370117 - RNA, 16 nt, Human
cuggagaugaggccag

SEQ ID NO: 1370118 - RNA, 17 nt, Human
cuggagaugaggccaga

SEQ ID NO: 1370119 - RNA, 18 nt, Human
cuggagaugaggccagac

SEQ ID NO: 1370120 - RNA, 20 nt, Human
cuggagaugaggccagacca

SEQ ID NO: 1370121 - RNA, 23 nt, Human
cuggagcacaaagacccuggcuu

SEQ ID NO: 1370122 - RNA, 22 nt, Human
cuggagcacaaagacccuggcu

SEQ ID NO: 1370123 - RNA, 19 nt, Human
cuggagcacaaagacccug

SEQ ID NO: 1370124 - RNA, 16 nt, Human
cuggagcacaaagacc

SEQ ID NO: 1370125 - RNA, 13 nt, Human
cuggagcacaaag

SEQ ID NO: 1370126 - RNA, 19 nt, Human
cuggagaugaggccagacc

SEQ ID NO: 1370127 - RNA, 15 nt, Human
cuggcugagggcagu

SEQ ID NO: 1370128 - RNA, 23 nt, Human
cuggcugagggcaguucgcagcc

SEQ ID NO: 1370129 - RNA, 13 nt, Human
cuggcugagggca

SEQ ID NO: 1370130 - RNA, 12 nt, Human
cuggcugagggc

SEQ ID NO: 1370131 - RNA, 13 nt, Human
cuggcuaaagcuc

SEQ ID NO: 1370132 - RNA, 15 nt, Human
cuggcggggggccca

SEQ ID NO: 1370133 - RNA, 16 nt, Human
cuggcggggggcccau

SEQ ID NO: 1370134 - RNA, 20 nt, Human
cuggcggcuggggucccagc

SEQ ID NO: 1370135 - RNA, 22 nt, Human
cuggcggcuggggucccagcag

SEQ ID NO: 1370136 - RNA, 19 nt, Human
cuggcggcuggggucccag

SEQ ID NO: 1370137 - RNA, 18 nt, Human
cuggcggcugggguccca

SEQ ID NO: 1370138 - RNA, 18 nt, Human
cuggccuugccacacucu

SEQ ID NO: 1370139 - RNA, 19 nt, Human
cuggccuggccauacugug

SEQ ID NO: 1370140 - RNA, 19 nt, Human
cuggccuggccagugcccu

SEQ ID NO: 1370141 - RNA, 12 nt, Human
cuggccucugcg

SEQ ID NO: 1370142 - RNA, 22 nt, Human
cuggccuggacuguuuucucuc

SEQ ID NO: 1370143 - RNA, 17 nt, Human
cuggccuggccagugcc

SEQ ID NO: 1370144 - RNA, 15 nt, Human
cuggccuggccagug

SEQ ID NO: 1370145 - RNA, 14 nt, Human
cuggccuggccagu

SEQ ID NO: 1370146 - RNA, 13 nt, Human
cuggccuggccag

SEQ ID NO: 1370147 - RNA, 18 nt, Human
cuggccuggacuguuuuc

SEQ ID NO: 1370148 - RNA, 14 nt, Human
cuggccucugcuuu

SEQ ID NO: 1370149 - RNA, 23 nt, Human
cuggcccagggcccagagcccag

SEQ ID NO: 1370150 - RNA, 22 nt, Human
cuggcccagggcccagagccca

SEQ ID NO: 1370151 - RNA, 21 nt, Human
cuggcccagggcccagagccc

SEQ ID NO: 1370152 - RNA, 20 nt, Human
cuggcccagggcccagagcc

SEQ ID NO: 1370153 - RNA, 19 nt, Human
cuggcccagggcccagagc

SEQ ID NO: 1370154 - RNA, 18 nt, Human
cuggcccagggcccagag

SEQ ID NO: 1370155 - RNA, 17 nt, Human
cuggcccagggcccaga

SEQ ID NO: 1370156 - RNA, 22 nt, Human
cuggcccaucaggguaggcugg

SEQ ID NO: 1370157 - RNA, 13 nt, Human
cuggcccaucagg

SEQ ID NO: 1370158 - RNA, 23 nt, Human
cuggccccacccucguggacacc

SEQ ID NO: 1370159 - RNA, 13 nt, Human
cuggccccaggac

SEQ ID NO: 1370160 - RNA, 12 nt, Human
cuggccccaccc

SEQ ID NO: 1370161 - RNA, 11 nt, Human
cuggcccagcc

SEQ ID NO: 1370162 - RNA, 16 nt, Human
cuggccauggagaaag

SEQ ID NO: 1370163 - RNA, 15 nt, Human
cuggccauggagaaa

SEQ ID NO: 1370164 - RNA, 12 nt, Human
cuggccauggag

SEQ ID NO: 1370165 - RNA, 16 nt, Human
cuggcccagggcccag

SEQ ID NO: 1370166 - RNA, 21 nt, Human
cuggccagugcccugauccca

SEQ ID NO: 1370167 - RNA, 20 nt, Human
cuggccagugcccugauccc

SEQ ID NO: 1370168 - RNA, 17 nt, Human
cuggccagugcccugau

SEQ ID NO: 1370169 - RNA, 23 nt, Human
cuggccaguccaggcugccgugg

SEQ ID NO: 1370170 - RNA, 22 nt, Human
cuggccaguccaggcugccgug

SEQ ID NO: 1370171 - RNA, 20 nt, Human
cuggccaguguuuaaaacuu

SEQ ID NO: 1370172 - RNA, 13 nt, Human
cuggccaguguuu

SEQ ID NO: 1370173 - RNA, 22 nt, Human
cuggccagugcccugaucccag

SEQ ID NO: 1370174 - RNA, 15 nt, Human
cuggccaguguuuaa

SEQ ID NO: 1370175 - RNA, 16 nt, Human
cuggccauacuguguc

SEQ ID NO: 1370176 - RNA, 23 nt, Human
cuggcaucgcaccauucugacuc

SEQ ID NO: 1370177 - RNA, 22 nt, Human
cuggcaucgcaccauucugacu

SEQ ID NO: 1370178 - RNA, 20 nt, Human
cuggcaucgcaccauucuga

SEQ ID NO: 1370179 - RNA, 19 nt, Human
cuggcaucgcaccauucug

SEQ ID NO: 1370180 - RNA, 18 nt, Human
cuggcaucgcaccauucu

SEQ ID NO: 1370181 - RNA, 17 nt, Human
cuggcaucgcaccauuc

SEQ ID NO: 1370182 - RNA, 19 nt, Human
cuggcauacuauguggaug

SEQ ID NO: 1370183 - RNA, 22 nt, Human
cuggcaguuuauauuuaacucu

SEQ ID NO: 1370184 - RNA, 20 nt, Human
cuggcaguuuauauuuaacu

SEQ ID NO: 1370185 - RNA, 19 nt, Human
cuggcaguccgugggacgg

SEQ ID NO: 1370186 - RNA, 22 nt, Human
cuggcaguccuggaagccagcu

SEQ ID NO: 1370187 - RNA, 16 nt, Human
cuggcaguccguggga

SEQ ID NO: 1370188 - RNA, 19 nt, Human
cuggcaguggaacuaagaa

SEQ ID NO: 1370189 - RNA, 19 nt, Human
cuggccagacacaggcccu

SEQ ID NO: 1370190 - RNA, 18 nt, Human
cuggccagacacaggccc

SEQ ID NO: 1370191 - RNA, 17 nt, Human
cuggccagacacaggcc

SEQ ID NO: 1370192 - RNA, 15 nt, Human
cuggccagacacagg

SEQ ID NO: 1370193 - RNA, 13 nt, Human
cuggccagacaca

SEQ ID NO: 1370194 - RNA, 21 nt, Human
cuggccaguccaggcugccgu

SEQ ID NO: 1370195 - RNA, 19 nt, Human
cuggccaguccaggcugcc

SEQ ID NO: 1370196 - RNA, 21 nt, Human
cuggccagacacaggcccucc

SEQ ID NO: 1370197 - RNA, 14 nt, Human
cuggagugcagugg

SEQ ID NO: 1370198 - RNA, 20 nt, Human
cugguacucccucucaggau

SEQ ID NO: 1370199 - RNA, 19 nt, Human
cugguacucccucucagga

SEQ ID NO: 1370200 - RNA, 18 nt, Human
cugguacucccucucagg

SEQ ID NO: 1370201 - RNA, 16 nt, Human
cugguacccuccuggc

SEQ ID NO: 1370202 - RNA, 15 nt, Human
cugguacccuccugg

SEQ ID NO: 1370203 - RNA, 14 nt, Human
cugguacccuccug

SEQ ID NO: 1370204 - RNA, 23 nt, Human
cugguacaguauggggguuguaa

SEQ ID NO: 1370205 - RNA, 21 nt, Human
cuggggugcagggaugugggu

SEQ ID NO: 1370206 - RNA, 21 nt, Human
cuggggugacccggcaccccc

SEQ ID NO: 1370207 - RNA, 22 nt, Human
cuggggucuggaguugaucugg

SEQ ID NO: 1370208 - RNA, 13 nt, Human
cuggggucuggag

SEQ ID NO: 1370209 - RNA, 22 nt, Human
cuggggucccagcagcugccag

SEQ ID NO: 1370210 - RNA, 20 nt, Human
cuggggucccagcagcugcc

SEQ ID NO: 1370211 - RNA, 18 nt, Human
cuggggucccagcagcug

SEQ ID NO: 1370212 - RNA, 16 nt, Human
cuggggucccagcagc

SEQ ID NO: 1370213 - RNA, 15 nt, Human
cuggggucccagcag

SEQ ID NO: 1370214 - RNA, 14 nt, Human
cuggggucccagca

SEQ ID NO: 1370215 - RNA, 13 nt, Human
cuggggucccagc

SEQ ID NO: 1370216 - RNA, 15 nt, Human
cugggggguggccag

SEQ ID NO: 1370217 - RNA, 23 nt, Human
cuggguacuucuugaaggugcug

SEQ ID NO: 1370218 - RNA, 20 nt, Human
cuggguacuucuugaaggug

SEQ ID NO: 1370219 - RNA, 17 nt, Human
cuggguacuucuugaag

SEQ ID NO: 1370220 - RNA, 15 nt, Human
cuggguacuucuuga

SEQ ID NO: 1370221 - RNA, 16 nt, Human
cuggguaauaaaagug

SEQ ID NO: 1370222 - RNA, 18 nt, Human
cuggguaaugaaacaaag

SEQ ID NO: 1370223 - RNA, 20 nt, Human
cuggggugcagggauguggg

SEQ ID NO: 1370224 - RNA, 15 nt, Human
cuggggugcagggau

SEQ ID NO: 1370225 - RNA, 12 nt, Human
cuggggugcagg

SEQ ID NO: 1370226 - RNA, 13 nt, Human
cugggggguggcc

SEQ ID NO: 1370227 - RNA, 12 nt, Human
cugggggguggc

SEQ ID NO: 1370228 - RNA, 20 nt, Human
cugggggcacaagacugacg

SEQ ID NO: 1370229 - RNA, 22 nt, Human
cugggggcacaagacugacgcc

SEQ ID NO: 1370230 - RNA, 18 nt, Human
cugggggcacaagacuga

SEQ ID NO: 1370231 - RNA, 15 nt, Human
cuggggcuggccucc

SEQ ID NO: 1370232 - RNA, 18 nt, Human
cuggggcuggccucccaa

SEQ ID NO: 1370233 - RNA, 14 nt, Human
cuggggcuggccuc

SEQ ID NO: 1370234 - RNA, 19 nt, Human
cugggcuuccuggagcaga

SEQ ID NO: 1370235 - RNA, 22 nt, Human
cugggcuuccuggagcagaagc

SEQ ID NO: 1370236 - RNA, 17 nt, Human
cugggcuuccuggagca

SEQ ID NO: 1370237 - RNA, 16 nt, Human
cugggcuuccuggagc

SEQ ID NO: 1370238 - RNA, 15 nt, Human
cugggcuuccuggag

SEQ ID NO: 1370239 - RNA, 14 nt, Human
cugggcuuccugga

SEQ ID NO: 1370240 - RNA, 13 nt, Human
cugggcuuccugg

SEQ ID NO: 1370241 - RNA, 12 nt, Human
cugggcuuccug

SEQ ID NO: 1370242 - RNA, 19 nt, Human
cugggcuucaucuggcaac

SEQ ID NO: 1370243 - RNA, 15 nt, Human
cugggcuucaucugg

SEQ ID NO: 1370244 - RNA, 22 nt, Human
cugguggcccucuccccugccc

SEQ ID NO: 1370245 - RNA, 20 nt, Human
cugguggcccucuccccugc

SEQ ID NO: 1370246 - RNA, 18 nt, Human
cugguggcccucuccccu

SEQ ID NO: 1370247 - RNA, 17 nt, Human
cugguggcccucucccc

SEQ ID NO: 1370248 - RNA, 21 nt, Human
cugguucccguuucuccaccu

SEQ ID NO: 1370249 - RNA, 18 nt, Human
cugguucccguuucucca

SEQ ID NO: 1370250 - RNA, 14 nt, Human
cuguaauguuaaua

SEQ ID NO: 1370251 - RNA, 18 nt, Human
cuguaaugguacugacuu

SEQ ID NO: 1370252 - RNA, 14 nt, Human
cuguaaucuaugaa

SEQ ID NO: 1370253 - RNA, 19 nt, Human
cuguaaucauauaauaaau

SEQ ID NO: 1370254 - RNA, 19 nt, Human
cuguaauguuaauauugau

SEQ ID NO: 1370255 - RNA, 18 nt, Human
cuguaauguuaauauuga

SEQ ID NO: 1370256 - RNA, 17 nt, Human
cuguaauguuaauauug

SEQ ID NO: 1370257 - RNA, 15 nt, Human
cuguaauguuaauau

SEQ ID NO: 1370258 - RNA, 22 nt, Human
cuguaaugugcgagggacccag

SEQ ID NO: 1370259 - RNA, 21 nt, Human
cugguccuauggccucauguu

SEQ ID NO: 1370260 - RNA, 17 nt, Human
cugguccuauggccuca

SEQ ID NO: 1370261 - RNA, 21 nt, Human
cugguccgugggacggugccc

SEQ ID NO: 1370262 - RNA, 19 nt, Human
cugguccgugggacggugc

SEQ ID NO: 1370263 - RNA, 16 nt, Human
cugguccgugggacgg

SEQ ID NO: 1370264 - RNA, 15 nt, Human
cugguccgugggacg

SEQ ID NO: 1370265 - RNA, 22 nt, Human
cuggucccuuguauccccugca

SEQ ID NO: 1370266 - RNA, 24 nt, Human
cuggucccuuguauccccugcagg

SEQ ID NO: 1370267 - RNA, 19 nt, Human
cuggucccuuguauccccu

SEQ ID NO: 1370268 - RNA, 23 nt, Human
cuggucccuguuuucccacgagg

SEQ ID NO: 1370269 - RNA, 17 nt, Human
cugguauuguucucaca

SEQ ID NO: 1370270 - RNA, 21 nt, Human
cugguacucccucucaggauc

SEQ ID NO: 1370271 - RNA, 20 nt, Human
cuggucaacuugagcauguu

SEQ ID NO: 1370272 - RNA, 19 nt, Human
cuggucaacuugagcaugu

SEQ ID NO: 1370273 - RNA, 9 nt, Human
cuggucccu

SEQ ID NO: 1370274 - RNA, 19 nt, Human
cuggugcugccucuaccug

SEQ ID NO: 1370275 - RNA, 14 nt, Human
cuggugcugccucu

SEQ ID NO: 1370276 - RNA, 21 nt, Human
cuguccccugcuacaccuauu

SEQ ID NO: 1370277 - RNA, 15 nt, Human
cuguccccugcuaca

SEQ ID NO: 1370278 - RNA, 21 nt, Human
cugucccuccgggaccuggug

SEQ ID NO: 1370279 - RNA, 17 nt, Human
cugucccuccgggaccu

SEQ ID NO: 1370280 - RNA, 19 nt, Human
cuguccaggcacugagaua

SEQ ID NO: 1370281 - RNA, 22 nt, Human
cuguccucagccuugccagaga

SEQ ID NO: 1370282 - RNA, 21 nt, Human
cuguccucagccuugccagag

SEQ ID NO: 1370283 - RNA, 20 nt, Human
cuguccucagccuugccaga

SEQ ID NO: 1370284 - RNA, 18 nt, Human
cuguccucagccuugcca

SEQ ID NO: 1370285 - RNA, 14 nt, Human
cuguccucagccuu

SEQ ID NO: 1370286 - RNA, 21 nt, Human
cuguccguucacauguguggu

SEQ ID NO: 1370287 - RNA, 18 nt, Human
cugucuacuugcucaggu

SEQ ID NO: 1370288 - RNA, 20 nt, Human
cugucuacuugcucagguac

SEQ ID NO: 1370289 - RNA, 23 nt, Human
cuguccuccaacaccaagcacag

SEQ ID NO: 1370290 - RNA, 15 nt, Human
cuguccuccaacacc

SEQ ID NO: 1370291 - RNA, 14 nt, Human
cuguccagcuccaa

SEQ ID NO: 1370292 - RNA, 13 nt, Human
cuguccagcucca

SEQ ID NO: 1370293 - RNA, 12 nt, Human
cuguccagcucc

SEQ ID NO: 1370294 - RNA, 16 nt, Human
cuguccaggcacugag

SEQ ID NO: 1370295 - RNA, 21 nt, Human
cuguccagcuccaaccugcaa

SEQ ID NO: 1370296 - RNA, 18 nt, Human
cuguccagcuccaaccug

SEQ ID NO: 1370297 - RNA, 17 nt, Human
cuguccagcuccaaccu

SEQ ID NO: 1370298 - RNA, 14 nt, Human
cugucaaggcucag

SEQ ID NO: 1370299 - RNA, 13 nt, Human
cugucaaggcuca

SEQ ID NO: 1370300 - RNA, 23 nt, Human
cuguauccagguucccucccaga

SEQ ID NO: 1370301 - RNA, 20 nt, Human
cuguauuuuaaaagaaugau

SEQ ID NO: 1370302 - RNA, 22 nt, Human
cuguauuuuaaaagaaugauua

SEQ ID NO: 1370303 - RNA, 20 nt, Human
cuguagugucacucaaggcg

SEQ ID NO: 1370304 - RNA, 20 nt, Human
cuguagugcuacagggucca

SEQ ID NO: 1370305 - RNA, 16 nt, Human
cuguagugcuacaggg

SEQ ID NO: 1370306 - RNA, 15 nt, Human
cuguacacugcacga

SEQ ID NO: 1370307 - RNA, 13 nt, Human
cuguacacugcac

SEQ ID NO: 1370308 - RNA, 22 nt, Human
cuguacacaacucacuccuuuu

SEQ ID NO: 1370309 - RNA, 20 nt, Human
cuguacacaacucacuccuu

SEQ ID NO: 1370310 - RNA, 17 nt, Human
cuguacacaacucacuc

SEQ ID NO: 1370311 - RNA, 16 nt, Human
cuguacacaacucacu

SEQ ID NO: 1370312 - RNA, 14 nt, Human
cuguauaaaugucu

SEQ ID NO: 1370313 - RNA, 15 nt, Human
cuguauaaaugucuu

SEQ ID NO: 1370314 - RNA, 23 nt, Human
cuguaucaggacccagaggaagg

SEQ ID NO: 1370315 - RNA, 22 nt, Human
cuguaucaggacccagaggaag

SEQ ID NO: 1370316 - RNA, 16 nt, Human
cuguaucaggacccag

SEQ ID NO: 1370317 - RNA, 22 nt, Human
cuguauauuacagauauuuguc

SEQ ID NO: 1370318 - RNA, 14 nt, Human
cuguauauucagga

SEQ ID NO: 1370319 - RNA, 15 nt, Human
cuguauauacuuuuu

SEQ ID NO: 1370320 - RNA, 14 nt, Human
cuguauauacuuuu

SEQ ID NO: 1370321 - RNA, 18 nt, Human
cuguggcaggccagcugu

SEQ ID NO: 1370322 - RNA, 23 nt, Human
cuguggcaggccagcugugguuu

SEQ ID NO: 1370323 - RNA, 23 nt, Human
cuguggcagaguuacaguucugu

SEQ ID NO: 1370324 - RNA, 22 nt, Human
cuguggcagaguuacaguucug

SEQ ID NO: 1370325 - RNA, 19 nt, Human
cuguggcagaguuacaguu

SEQ ID NO: 1370326 - RNA, 18 nt, Human
cuguggcagaguuacagu

SEQ ID NO: 1370327 - RNA, 17 nt, Human
cuguggcagaguuacag

SEQ ID NO: 1370328 - RNA, 23 nt, Human
cuguggauuuuuuccuucaaagu

SEQ ID NO: 1370329 - RNA, 20 nt, Human
cuguggcgccgucuccaggg

SEQ ID NO: 1370330 - RNA, 19 nt, Human
cuguggcgccgucuccagg

SEQ ID NO: 1370331 - RNA, 17 nt, Human
cuguggcgccgucucca

SEQ ID NO: 1370332 - RNA, 18 nt, Human
cuguggcaugggugaaga

SEQ ID NO: 1370333 - RNA, 19 nt, Human
cuguggcaggccagcugug

SEQ ID NO: 1370334 - RNA, 24 nt, Human
cuguggcgccgucuccaggggcug

SEQ ID NO: 1370335 - RNA, 21 nt, Human
cuguggcgccgucuccagggg

SEQ ID NO: 1370336 - RNA, 17 nt, Human
cugugcuuuuaaaugca

SEQ ID NO: 1370337 - RNA, 21 nt, Human
cugugcuucgggcccuuccca

SEQ ID NO: 1370338 - RNA, 20 nt, Human
cugugcuucgggcccuuccc

SEQ ID NO: 1370339 - RNA, 16 nt, Human
cugugccucagagacc

SEQ ID NO: 1370340 - RNA, 13 nt, Human
cugugcugugugu

SEQ ID NO: 1370341 - RNA, 11 nt, Human
cugugcugugu

SEQ ID NO: 1370342 - RNA, 14 nt, Human
cugugcuggccagc

SEQ ID NO: 1370343 - RNA, 16 nt, Human
cugugcuuaugguacc

SEQ ID NO: 1370344 - RNA, 18 nt, Human
cugugcugugugugacgu

SEQ ID NO: 1370345 - RNA, 19 nt, Human
cugugcuucgggcccuucc

SEQ ID NO: 1370346 - RNA, 17 nt, Human
cugugcuucgggcccuu

SEQ ID NO: 1370347 - RNA, 13 nt, Human
cugugcuggccag

SEQ ID NO: 1370348 - RNA, 12 nt, Human
cugugcuggcca

SEQ ID NO: 1370349 - RNA, 24 nt, Human
cugugccucgcuccccacucugcu

SEQ ID NO: 1370350 - RNA, 23 nt, Human
cugugccucgcuccccacucugc

SEQ ID NO: 1370351 - RNA, 22 nt, Human
cugugccucgcuccccacucug

SEQ ID NO: 1370352 - RNA, 17 nt, Human
cugugccucgcucccca

SEQ ID NO: 1370353 - RNA, 21 nt, Human
cugugccuccucccucccucu

SEQ ID NO: 1370354 - RNA, 18 nt, Human
cugugccuccucccuccc

SEQ ID NO: 1370355 - RNA, 17 nt, Human
cugugccuccucccucc

SEQ ID NO: 1370356 - RNA, 16 nt, Human
cugugccuccucccuc

SEQ ID NO: 1370357 - RNA, 15 nt, Human
cugugccuccucccu

SEQ ID NO: 1370358 - RNA, 14 nt, Human
cugugccuccuccc

SEQ ID NO: 1370359 - RNA, 19 nt, Human
cugugccucagagaccagg

SEQ ID NO: 1370360 - RNA, 16 nt, Human
cugugccuccucaccc

SEQ ID NO: 1370361 - RNA, 15 nt, Human
cugugccuccucacc

SEQ ID NO: 1370362 - RNA, 13 nt, Human
cugugccuccuca

SEQ ID NO: 1370363 - RNA, 22 nt, Human
cugugccucagagaccagggcu

SEQ ID NO: 1370364 - RNA, 18 nt, Human
cugugccucagagaccag

SEQ ID NO: 1370365 - RNA, 15 nt, Human
cugugccauguguuu

SEQ ID NO: 1370366 - RNA, 21 nt, Human
cugugcacaucugugucuugu

SEQ ID NO: 1370367 - RNA, 20 nt, Human
cugugcacaucugugucuug

SEQ ID NO: 1370368 - RNA, 21 nt, Human
cugugcacaccccacucccac

SEQ ID NO: 1370369 - RNA, 17 nt, Human
cugugcacaccccacuc

SEQ ID NO: 1370370 - RNA, 22 nt, Human
cugugcacaaaacccagaccug

SEQ ID NO: 1370371 - RNA, 19 nt, Human
cugugcacaucugugucuu

SEQ ID NO: 1370372 - RNA, 18 nt, Human
cugugcacaucugugucu

SEQ ID NO: 1370373 - RNA, 22 nt, Human
cugugcacaccccacucccaca

SEQ ID NO: 1370374 - RNA, 18 nt, Human
cugugaguucucccugua

SEQ ID NO: 1370375 - RNA, 20 nt, Human
cugugcacaaaacccagacc

SEQ ID NO: 1370376 - RNA, 19 nt, Human
cugugcacaaaacccagac

SEQ ID NO: 1370377 - RNA, 20 nt, Human
cugugcaagguauuacacuc

SEQ ID NO: 1370378 - RNA, 16 nt, Human
cugugcaaggccuggu

SEQ ID NO: 1370379 - RNA, 17 nt, Human
cugugaguucucccugu

SEQ ID NO: 1370380 - RNA, 16 nt, Human
cugugaguucucccug

SEQ ID NO: 1370381 - RNA, 22 nt, Human
cugugaguucucccuguacagu

SEQ ID NO: 1370382 - RNA, 15 nt, Human
cugugaguucucccu

SEQ ID NO: 1370383 - RNA, 23 nt, Human
cugugagucuuugguucuaagga

SEQ ID NO: 1370384 - RNA, 22 nt, Human
cugugagucuuugguucuaagg

SEQ ID NO: 1370385 - RNA, 21 nt, Human
cugugagucuuugguucuaag

SEQ ID NO: 1370386 - RNA, 20 nt, Human
cugugagucuuugguucuaa

SEQ ID NO: 1370387 - RNA, 17 nt, Human
cugucuccucucucugu

SEQ ID NO: 1370388 - RNA, 17 nt, Human
cugucucaccuggacuu

SEQ ID NO: 1370389 - RNA, 14 nt, Human
cugucucaccugga

SEQ ID NO: 1370390 - RNA, 12 nt, Human
cugucucaccug

SEQ ID NO: 1370391 - RNA, 20 nt, Human
cugucucaagcucuuccuua

SEQ ID NO: 1370392 - RNA, 18 nt, Human
cugucucaagcucuuccu

SEQ ID NO: 1370393 - RNA, 13 nt, Human
cugucucagggug

SEQ ID NO: 1370394 - RNA, 20 nt, Human
cugucuccauggcccugcaa

SEQ ID NO: 1370395 - RNA, 21 nt, Human
cugucucccuccucugcccgg

SEQ ID NO: 1370396 - RNA, 13 nt, Human
cugucuccuagga

SEQ ID NO: 1370397 - RNA, 19 nt, Human
cugucuccuaccucugcuc

SEQ ID NO: 1370398 - RNA, 22 nt, Human
cugucuccuaagcuggagugca

SEQ ID NO: 1370399 - RNA, 15 nt, Human
cuguucucuugggaa

SEQ ID NO: 1370400 - RNA, 19 nt, Human
cuguucuaguuuuuuacuu

SEQ ID NO: 1370401 - RNA, 14 nt, Human
cuguucuaguuuuu

SEQ ID NO: 1370402 - RNA, 12 nt, Human
cuguucuaguuu

SEQ ID NO: 1370403 - RNA, 16 nt, Human
cuguucuaaagcucug

SEQ ID NO: 1370404 - RNA, 19 nt, Human
cuguucuacauagaugcuu

SEQ ID NO: 1370405 - RNA, 16 nt, Human
cuguuccugcugcugu

SEQ ID NO: 1370406 - RNA, 15 nt, Human
cuguuccugcugcug

SEQ ID NO: 1370407 - RNA, 14 nt, Human
cuguuccugcugcu

SEQ ID NO: 1370408 - RNA, 13 nt, Human
cuguuccugcugc

SEQ ID NO: 1370409 - RNA, 12 nt, Human
cuguuccugcug

SEQ ID NO: 1370410 - RNA, 17 nt, Human
cuguucccccugugcag

SEQ ID NO: 1370411 - RNA, 16 nt, Human
cuguucccccugugca

SEQ ID NO: 1370412 - RNA, 15 nt, Human
cuguucccccugugc

SEQ ID NO: 1370413 - RNA, 12 nt, Human
cuguucccccug

SEQ ID NO: 1370414 - RNA, 14 nt, Human
cuguuccuuuuaua

SEQ ID NO: 1370415 - RNA, 22 nt, Human
cuguuccuucccugugccuccu

SEQ ID NO: 1370416 - RNA, 13 nt, Human
cuguuccuucccu

SEQ ID NO: 1370417 - RNA, 21 nt, Human
cuguuccugcugcugucuggg

SEQ ID NO: 1370418 - RNA, 18 nt, Human
cuguuccugcugcugucu

SEQ ID NO: 1370419 - RNA, 17 nt, Human
cuguuccugcugcuguc

SEQ ID NO: 1370420 - RNA, 20 nt, Human
cuguucuacauagaugcuua

SEQ ID NO: 1370421 - RNA, 17 nt, Human
cuguucuaaagcucuga

SEQ ID NO: 1370422 - RNA, 12 nt, Human
cuguucuaaagc

SEQ ID NO: 1370423 - RNA, 12 nt, Human
cuguuccuuuua

SEQ ID NO: 1370424 - RNA, 18 nt, Human
cuguuacacuuuuuggaa

SEQ ID NO: 1370425 - RNA, 19 nt, Human
cuguuacacuuuuuggaag

SEQ ID NO: 1370426 - RNA, 20 nt, Human
cuguuccagugguaagcuau

SEQ ID NO: 1370427 - RNA, 22 nt, Human
cuguuccaaauucaguuucaua

SEQ ID NO: 1370428 - RNA, 21 nt, Human
cuguuccaaauucaguuucau

SEQ ID NO: 1370429 - RNA, 20 nt, Human
cuguuccaaauucaguuuca

SEQ ID NO: 1370430 - RNA, 18 nt, Human
cuguuccaaauucaguuu

SEQ ID NO: 1370431 - RNA, 17 nt, Human
cuguuccaaauucaguu

SEQ ID NO: 1370432 - RNA, 14 nt, Human
cuguuccaaauuca

SEQ ID NO: 1370433 - RNA, 11 nt, Human
cuguuccaaau

SEQ ID NO: 1370434 - RNA, 23 nt, Human
cuguucauggcagauguaggagg

SEQ ID NO: 1370435 - RNA, 16 nt, Human
cuguuccccagagaaa

SEQ ID NO: 1370436 - RNA, 15 nt, Human
cuguuccccagagaa

SEQ ID NO: 1370437 - RNA, 14 nt, Human
cuguuccccagaga

SEQ ID NO: 1370438 - RNA, 13 nt, Human
cuguuccccagag

SEQ ID NO: 1370439 - RNA, 23 nt, Human
cuguucaugaaagauucaaugcc

SEQ ID NO: 1370440 - RNA, 18 nt, Human
cuguucaugaaagauuca

SEQ ID NO: 1370441 - RNA, 17 nt, Human
cuguucaugaaagauuc

SEQ ID NO: 1370442 - RNA, 14 nt, Human
cuguucauggcaga

SEQ ID NO: 1370443 - RNA, 15 nt, Human
cuguucauuccucca

SEQ ID NO: 1370444 - RNA, 16 nt, Human
cuguucauuccuccag

SEQ ID NO: 1370445 - RNA, 17 nt, Human
cuguucauuccuccagg

SEQ ID NO: 1370446 - RNA, 17 nt, Human
cuguucauuuccucaaa

SEQ ID NO: 1370447 - RNA, 14 nt, Human
cuguucauuuccuc

SEQ ID NO: 1370448 - RNA, 22 nt, Human
cuguucauuccuccagguauuc

SEQ ID NO: 1370449 - RNA, 16 nt, Human
cuguguuuugaaagaa

SEQ ID NO: 1370450 - RNA, 22 nt, Human
cuguguuuggcuuucagggagg

SEQ ID NO: 1370451 - RNA, 23 nt, Human
cuguguuuggcuuucagggaggc

SEQ ID NO: 1370452 - RNA, 18 nt, Human
cuguguuuggcuuucagg

SEQ ID NO: 1370453 - RNA, 17 nt, Human
cuguguuuggcuuucag

SEQ ID NO: 1370454 - RNA, 16 nt, Human
cuguguuuggcuuuca

SEQ ID NO: 1370455 - RNA, 18 nt, Human
cuguguuucuugccucau

SEQ ID NO: 1370456 - RNA, 17 nt, Human
cuguguuucuugccuca

SEQ ID NO: 1370457 - RNA, 15 nt, Human
cuguguuucuugccu

SEQ ID NO: 1370458 - RNA, 13 nt, Human
cuguguuucuugc

SEQ ID NO: 1370459 - RNA, 23 nt, Human
cuguguuuccaucucaaagaagg

SEQ ID NO: 1370460 - RNA, 15 nt, Human
cuguguuuccaucuc

SEQ ID NO: 1370461 - RNA, 20 nt, Human
cuguguguuaagcucugcua

SEQ ID NO: 1370462 - RNA, 19 nt, Human
cuguguguuaagcucugcu

SEQ ID NO: 1370463 - RNA, 18 nt, Human
cuguguguuaagcucugc

SEQ ID NO: 1370464 - RNA, 17 nt, Human
cuguguguuaagcucug

SEQ ID NO: 1370465 - RNA, 21 nt, Human
cugugugugugaaugaacacu

SEQ ID NO: 1370466 - RNA, 23 nt, Human
cugugugugugaaugaacacucu

SEQ ID NO: 1370467 - RNA, 18 nt, Human
cugugugugugaaugaac

SEQ ID NO: 1370468 - RNA, 17 nt, Human
cugugugugugaaugaa

SEQ ID NO: 1370469 - RNA, 16 nt, Human
cugugugugugaauga

SEQ ID NO: 1370470 - RNA, 14 nt, Human
cugugugugugaau

SEQ ID NO: 1370471 - RNA, 12 nt, Human
cuguguguguga

SEQ ID NO: 1370472 - RNA, 15 nt, Human
cugugggcuggcagu

SEQ ID NO: 1370473 - RNA, 21 nt, Human
cugugggggguaaucccugcu

SEQ ID NO: 1370474 - RNA, 19 nt, Human
cugugugcucaggagcccu

SEQ ID NO: 1370475 - RNA, 16 nt, Human
cugugugcucaggagc

SEQ ID NO: 1370476 - RNA, 20 nt, Human
cugugugcucaggagcccug

SEQ ID NO: 1370477 - RNA, 21 nt, Human
cugugugcucaggagcccugg

SEQ ID NO: 1370478 - RNA, 13 nt, Human
cugugugcuuuuu

SEQ ID NO: 1370479 - RNA, 23 nt, Human
cugugugcucaggagcccuggga

SEQ ID NO: 1370480 - RNA, 23 nt, Human
cuguguggagagggaaugugaaa

SEQ ID NO: 1370481 - RNA, 22 nt, Human
cuguguggagagggaaugugaa

SEQ ID NO: 1370482 - RNA, 16 nt, Human
cuguguggagagggaa

SEQ ID NO: 1370483 - RNA, 15 nt, Human
cuguguggagaggga

SEQ ID NO: 1370484 - RNA, 12 nt, Human
cuguguggagag

SEQ ID NO: 1370485 - RNA, 20 nt, Human
cugugugcuuuuuuugugug

SEQ ID NO: 1370486 - RNA, 15 nt, Human
cuguguggcagucug

SEQ ID NO: 1370487 - RNA, 21 nt, Human
cuucuggggcaggcugggcca

SEQ ID NO: 1370488 - RNA, 22 nt, Human
cuucuggggcaggcugggccau

SEQ ID NO: 1370489 - RNA, 20 nt, Human
cuucuggggcaggcugggcc

SEQ ID NO: 1370490 - RNA, 19 nt, Human
cuucuggggcaggcugggc

SEQ ID NO: 1370491 - RNA, 16 nt, Human
cuucuggggcaggcug

SEQ ID NO: 1370492 - RNA, 15 nt, Human
cuucuggggcaggcu

SEQ ID NO: 1370493 - RNA, 14 nt, Human
cuucuggggcaggc

SEQ ID NO: 1370494 - RNA, 22 nt, Human
cuucugggcuucaucuggcaac

SEQ ID NO: 1370495 - RNA, 21 nt, Human
cuucugggcuucaucuggcaa

SEQ ID NO: 1370496 - RNA, 16 nt, Human
cuucugggccugacca

SEQ ID NO: 1370497 - RNA, 23 nt, Human
cuucugggagggcagcagggcua

SEQ ID NO: 1370498 - RNA, 22 nt, Human
cuucugggagggcagcagggcu

SEQ ID NO: 1370499 - RNA, 18 nt, Human
cuucugccuuagucucag

SEQ ID NO: 1370500 - RNA, 16 nt, Human
cuucugccuggagacu

SEQ ID NO: 1370501 - RNA, 15 nt, Human
cuucugccuggagac

SEQ ID NO: 1370502 - RNA, 14 nt, Human
cuucugccuggaga

SEQ ID NO: 1370503 - RNA, 13 nt, Human
cuucugccuggag

SEQ ID NO: 1370504 - RNA, 17 nt, Human
cuucugcccccugcaga

SEQ ID NO: 1370505 - RNA, 16 nt, Human
cuucugcccccugcag

SEQ ID NO: 1370506 - RNA, 15 nt, Human
cuucugcccccugca

SEQ ID NO: 1370507 - RNA, 21 nt, Human
cuucucugacuucugccugga

SEQ ID NO: 1370508 - RNA, 19 nt, Human
cuucugcuggggccuggga

SEQ ID NO: 1370509 - RNA, 21 nt, Human
cuucugcuggggccugggaca

SEQ ID NO: 1370510 - RNA, 18 nt, Human
cuucugcuggggccuggg

SEQ ID NO: 1370511 - RNA, 15 nt, Human
cuucugcuggggccu

SEQ ID NO: 1370512 - RNA, 13 nt, Human
cuucugcuggggc

SEQ ID NO: 1370513 - RNA, 20 nt, Human
cuucuguaauuguguggauu

SEQ ID NO: 1370514 - RNA, 15 nt, Human
cuucuguaauugugu

SEQ ID NO: 1370515 - RNA, 16 nt, Human
cuucucucugugggau

SEQ ID NO: 1370516 - RNA, 13 nt, Human
cuucucucucccu

SEQ ID NO: 1370517 - RNA, 14 nt, Human
cuucucuccagugc

SEQ ID NO: 1370518 - RNA, 19 nt, Human
cuucucuccagcugacuaa

SEQ ID NO: 1370519 - RNA, 18 nt, Human
cuucucuccagcugacua

SEQ ID NO: 1370520 - RNA, 17 nt, Human
cuucucuccagcugacu

SEQ ID NO: 1370521 - RNA, 16 nt, Human
cuucucuccagcugac

SEQ ID NO: 1370522 - RNA, 15 nt, Human
cuucucuccagcuga

SEQ ID NO: 1370523 - RNA, 14 nt, Human
cuucucuccagcug

SEQ ID NO: 1370524 - RNA, 20 nt, Human
cuucucugacuucugccugg

SEQ ID NO: 1370525 - RNA, 17 nt, Human
cuucucugacuucugcc

SEQ ID NO: 1370526 - RNA, 16 nt, Human
cuucucugacuucugc

SEQ ID NO: 1370527 - RNA, 15 nt, Human
cuucucugacuucug

SEQ ID NO: 1370528 - RNA, 14 nt, Human
cuucucugacuucu

SEQ ID NO: 1370529 - RNA, 12 nt, Human
cuucucugacuu

SEQ ID NO: 1370530 - RNA, 13 nt, Human
cuucucucugugg

SEQ ID NO: 1370531 - RNA, 16 nt, Human
cuucuccucuccuagc

SEQ ID NO: 1370532 - RNA, 16 nt, Human
cuucucccuggaauga

SEQ ID NO: 1370533 - RNA, 13 nt, Human
cuucucccuggaa

SEQ ID NO: 1370534 - RNA, 22 nt, Human
cuucuccccugcacuguaaaau

SEQ ID NO: 1370535 - RNA, 23 nt, Human
cuucuccccugcacuguaaaaug

SEQ ID NO: 1370536 - RNA, 21 nt, Human
cuucuccccugcacuguaaaa

SEQ ID NO: 1370537 - RNA, 20 nt, Human
cuucuccccugcacuguaaa

SEQ ID NO: 1370538 - RNA, 19 nt, Human
cuucuccccugcacuguaa

SEQ ID NO: 1370539 - RNA, 18 nt, Human
cuucuccccugcacugua

SEQ ID NO: 1370540 - RNA, 17 nt, Human
cuucuccccugcacugu

SEQ ID NO: 1370541 - RNA, 16 nt, Human
cuucuccccugcacug

SEQ ID NO: 1370542 - RNA, 14 nt, Human
cuucuccccugcac

SEQ ID NO: 1370543 - RNA, 13 nt, Human
cuucuccccugca

SEQ ID NO: 1370544 - RNA, 15 nt, Human
cuuccuggugcugga

SEQ ID NO: 1370545 - RNA, 23 nt, Human
cuuccugguagaccacugccaua

SEQ ID NO: 1370546 - RNA, 23 nt, Human
cuuccuggggcaucuggcgaauc

SEQ ID NO: 1370547 - RNA, 20 nt, Human
cuuccuggggcaucuggcga

SEQ ID NO: 1370548 - RNA, 11 nt, Human
cuuccuggccg

SEQ ID NO: 1370549 - RNA, 19 nt, Human
cuuccuggccgccuggguc

SEQ ID NO: 1370550 - RNA, 22 nt, Human
cuuccuggagcagaagcagcaa

SEQ ID NO: 1370551 - RNA, 16 nt, Human
cuuccuguccagcucc

SEQ ID NO: 1370552 - RNA, 18 nt, Human
cuugagcucuauuaugaa

SEQ ID NO: 1370553 - RNA, 16 nt, Human
cuugagcucuauuaug

SEQ ID NO: 1370554 - RNA, 15 nt, Human
cuugagcucuauuau

SEQ ID NO: 1370555 - RNA, 14 nt, Human
cuugagcucuauua

SEQ ID NO: 1370556 - RNA, 12 nt, Human
cuugagcucuau

SEQ ID NO: 1370557 - RNA, 11 nt, Human
cuugagcucua

SEQ ID NO: 1370558 - RNA, 15 nt, Human
cuugaggucucagcc

SEQ ID NO: 1370559 - RNA, 14 nt, Human
cuugaggucucagc

SEQ ID NO: 1370560 - RNA, 23 nt, Human
cuugaccugaggcuguggucaca

SEQ ID NO: 1370561 - RNA, 20 nt, Human
cuugaccugaggcugugguc

SEQ ID NO: 1370562 - RNA, 17 nt, Human
cuugaccugaggcugug

SEQ ID NO: 1370563 - RNA, 14 nt, Human
cuugaccugaggcu

SEQ ID NO: 1370564 - RNA, 14 nt, Human
cuugacccugagcu

SEQ ID NO: 1370565 - RNA, 15 nt, Human
cuugacccugagcug

SEQ ID NO: 1370566 - RNA, 12 nt, Human
cuugaccuccua

SEQ ID NO: 1370567 - RNA, 15 nt, Human
cuugagccuugaacu

SEQ ID NO: 1370568 - RNA, 17 nt, Human
cuugagccuugaacuuu

SEQ ID NO: 1370569 - RNA, 18 nt, Human
cuugagccuugaacuuug

SEQ ID NO: 1370570 - RNA, 13 nt, Human
cuugacccugagc

SEQ ID NO: 1370571 - RNA, 22 nt, Human
cuugaacguuuucuaauugcuu

SEQ ID NO: 1370572 - RNA, 22 nt, Human
cuugaagaacugcaggcccugg

SEQ ID NO: 1370573 - RNA, 20 nt, Human
cuugaagaacugcaggcccu

SEQ ID NO: 1370574 - RNA, 18 nt, Human
cuugaagaacugcaggcc

SEQ ID NO: 1370575 - RNA, 17 nt, Human
cuugaagaacugcaggc

SEQ ID NO: 1370576 - RNA, 12 nt, Human
cuugaagaacug

SEQ ID NO: 1370577 - RNA, 21 nt, Human
cuugaacguuuucuaauugcu

SEQ ID NO: 1370578 - RNA, 19 nt, Human
cuugaacguuuucuaauug

SEQ ID NO: 1370579 - RNA, 17 nt, Human
cuugaacuuugaccucu

SEQ ID NO: 1370580 - RNA, 21 nt, Human
cuugaacuuugaccucugcag

SEQ ID NO: 1370581 - RNA, 18 nt, Human
cuugaacguuuucuaauu

SEQ ID NO: 1370582 - RNA, 17 nt, Human
cuugaacguuuucuaau

SEQ ID NO: 1370583 - RNA, 16 nt, Human
cuugaacguuuucuaa

SEQ ID NO: 1370584 - RNA, 23 nt, Human
cuugaacccaggucucccuggau

SEQ ID NO: 1370585 - RNA, 21 nt, Human
cuucuugcuucuuucuagaaa

SEQ ID NO: 1370586 - RNA, 20 nt, Human
cuucuugcuucuuucuagaa

SEQ ID NO: 1370587 - RNA, 18 nt, Human
cuucuugccucugugcug

SEQ ID NO: 1370588 - RNA, 17 nt, Human
cuucuugccucugugcu

SEQ ID NO: 1370589 - RNA, 16 nt, Human
cuucuugccucugugc

SEQ ID NO: 1370590 - RNA, 15 nt, Human
cuucuugccucugug

SEQ ID NO: 1370591 - RNA, 13 nt, Human
cuucuugccucug

SEQ ID NO: 1370592 - RNA, 16 nt, Human
cuucuuguguguaugc

SEQ ID NO: 1370593 - RNA, 16 nt, Human
cuugaaaauaagaaua

SEQ ID NO: 1370594 - RNA, 20 nt, Human
cuugaaaaaaaacaguggau

SEQ ID NO: 1370595 - RNA, 15 nt, Human
cuugaaaaagacauu

SEQ ID NO: 1370596 - RNA, 18 nt, Human
cuugaaaaaaaacagugg

SEQ ID NO: 1370597 - RNA, 16 nt, Human
cuugaaaaaaaacagu

SEQ ID NO: 1370598 - RNA, 14 nt, Human
cuugaaaaaaaaca

SEQ ID NO: 1370599 - RNA, 14 nt, Human
cuucuuuagaacag

SEQ ID NO: 1370600 - RNA, 12 nt, Human
cuugaaaaaugc

SEQ ID NO: 1370601 - RNA, 18 nt, Human
cuugaaaaaugcauguug

SEQ ID NO: 1370602 - RNA, 17 nt, Human
cuugaaauuuuaaccua

SEQ ID NO: 1370603 - RNA, 16 nt, Human
cuugaaauuuuaaccu

SEQ ID NO: 1370604 - RNA, 15 nt, Human
cuugaaauuuuaacc

SEQ ID NO: 1370605 - RNA, 19 nt, Human
cuugaaagaagaaaagguu

SEQ ID NO: 1370606 - RNA, 21 nt, Human
cuugaaagaagaaaagguucu

SEQ ID NO: 1370607 - RNA, 12 nt, Human
cuugaaaauuaa

SEQ ID NO: 1370608 - RNA, 13 nt, Human
cuugaaaauuaac

SEQ ID NO: 1370609 - RNA, 13 nt, Human
cuugaaagaaaug

SEQ ID NO: 1370610 - RNA, 22 nt, Human
cuugaaaauaagaauagaaaua

SEQ ID NO: 1370611 - RNA, 18 nt, Human
cuugaaaauuaacaugaa

SEQ ID NO: 1370612 - RNA, 23 nt, Human
cuucaguacccucucagcuccag

SEQ ID NO: 1370613 - RNA, 22 nt, Human
cuucaguacccucucagcucca

SEQ ID NO: 1370614 - RNA, 19 nt, Human
cuucaguacccucucagcu

SEQ ID NO: 1370615 - RNA, 21 nt, Human
cuucaccauuuggcaaugcca

SEQ ID NO: 1370616 - RNA, 12 nt, Human
cuucauuucaga

SEQ ID NO: 1370617 - RNA, 19 nt, Human
cuucauugccuuaacugga

SEQ ID NO: 1370618 - RNA, 21 nt, Human
cuucauucaagucagcucuuc

SEQ ID NO: 1370619 - RNA, 15 nt, Human
cuuccacugagggca

SEQ ID NO: 1370620 - RNA, 14 nt, Human
cuuccacugagggc

SEQ ID NO: 1370621 - RNA, 20 nt, Human
cuuccacguacugcagccuc

SEQ ID NO: 1370622 - RNA, 19 nt, Human
cuuccacguacugcagccu

SEQ ID NO: 1370623 - RNA, 13 nt, Human
cuuccacccaggg

SEQ ID NO: 1370624 - RNA, 12 nt, Human
cuuccacccagu

SEQ ID NO: 1370625 - RNA, 14 nt, Human
cuuccacccagugc

SEQ ID NO: 1370626 - RNA, 21 nt, Human
cuuccccuuauccucccugua

SEQ ID NO: 1370627 - RNA, 20 nt, Human
cuuccccuuauccucccugu

SEQ ID NO: 1370628 - RNA, 18 nt, Human
cuuccccuuauccucccu

SEQ ID NO: 1370629 - RNA, 17 nt, Human
cuucccccucucccagu

SEQ ID NO: 1370630 - RNA, 16 nt, Human
cuucccccucucccag

SEQ ID NO: 1370631 - RNA, 18 nt, Human
cuucccccucucccaguu

SEQ ID NO: 1370632 - RNA, 15 nt, Human
cuucccaucgcuguc

SEQ ID NO: 1370633 - RNA, 17 nt, Human
cuucccauccccagcga

SEQ ID NO: 1370634 - RNA, 15 nt, Human
cuucccauccccagc

SEQ ID NO: 1370635 - RNA, 14 nt, Human
cuucccauccccag

SEQ ID NO: 1370636 - RNA, 21 nt, Human
cuuccaggggagguucaguga

SEQ ID NO: 1370637 - RNA, 23 nt, Human
cuucccuguuuuccccccaaggg

SEQ ID NO: 1370638 - RNA, 15 nt, Human
cuucccugugccucc

SEQ ID NO: 1370639 - RNA, 14 nt, Human
cuucccugugccuc

SEQ ID NO: 1370640 - RNA, 12 nt, Human
cuucccuaaucu

SEQ ID NO: 1370641 - RNA, 22 nt, Human
cuucccuguaugauuccuugau

SEQ ID NO: 1370642 - RNA, 22 nt, Human
cuucccuguguaguuugugcug

SEQ ID NO: 1370643 - RNA, 21 nt, Human
cuucccugugccuccucccuc

SEQ ID NO: 1370644 - RNA, 16 nt, Human
cuucccugugccuccu

SEQ ID NO: 1370645 - RNA, 16 nt, Human
cuucccuugagcccuc

SEQ ID NO: 1370646 - RNA, 20 nt, Human
cuucccuuuccugaguccca

SEQ ID NO: 1370647 - RNA, 23 nt, Human
cuuccucauccaccccaucccuc

SEQ ID NO: 1370648 - RNA, 22 nt, Human
cuuccucauccaccccaucccu

SEQ ID NO: 1370649 - RNA, 18 nt, Human
cuuccucauccaccccau

SEQ ID NO: 1370650 - RNA, 17 nt, Human
cuuccucagccagccuc

SEQ ID NO: 1370651 - RNA, 16 nt, Human
cuuccucagccagccu

SEQ ID NO: 1370652 - RNA, 15 nt, Human
cuuccucagccagcc

SEQ ID NO: 1370653 - RNA, 21 nt, Human
cuuccuaaauuuuccuguccu

SEQ ID NO: 1370654 - RNA, 20 nt, Human
cuuccuaaauuuuccugucc

SEQ ID NO: 1370655 - RNA, 19 nt, Human
cuuccuaaauuuuccuguc

SEQ ID NO: 1370656 - RNA, 16 nt, Human
cuuccuaaauuuuccu

SEQ ID NO: 1370657 - RNA, 22 nt, Human
cuuccuaaauauuaugagaugc

SEQ ID NO: 1370658 - RNA, 19 nt, Human
cuuccuaaauauuaugaga

SEQ ID NO: 1370659 - RNA, 14 nt, Human
cuucccuuuccuga

SEQ ID NO: 1370660 - RNA, 15 nt, Human
cuucccuugagcccu

SEQ ID NO: 1370661 - RNA, 17 nt, Human
cuucaccauuuggcaau

SEQ ID NO: 1370662 - RNA, 19 nt, Human
cuucacaccuacccuccuu

SEQ ID NO: 1370663 - RNA, 20 nt, Human
cuucaagcucugagggaaag

SEQ ID NO: 1370664 - RNA, 18 nt, Human
cuucaagcucugagggaa

SEQ ID NO: 1370665 - RNA, 15 nt, Human
cuuaucgaaacucau

SEQ ID NO: 1370666 - RNA, 19 nt, Human
cuuauccucccuguaacuu

SEQ ID NO: 1370667 - RNA, 20 nt, Human
cuuauccucccuguaacuug

SEQ ID NO: 1370668 - RNA, 18 nt, Human
cuuauccucccuguaacu

SEQ ID NO: 1370669 - RNA, 17 nt, Human
cuuauccucccuguaac

SEQ ID NO: 1370670 - RNA, 16 nt, Human
cuuauccucccuguaa

SEQ ID NO: 1370671 - RNA, 15 nt, Human
cuuauccucccugua

SEQ ID NO: 1370672 - RNA, 18 nt, Human
cuuaucuacuuccaaacu

SEQ ID NO: 1370673 - RNA, 23 nt, Human
cuuaucuaaucaugaaacucccu

SEQ ID NO: 1370674 - RNA, 16 nt, Human
cuuauuuauuguauuc

SEQ ID NO: 1370675 - RNA, 14 nt, Human
cuuauuuauuguau

SEQ ID NO: 1370676 - RNA, 19 nt, Human
cuuauuuauuguauucugg

SEQ ID NO: 1370677 - RNA, 17 nt, Human
cuuauuuauuguauucu

SEQ ID NO: 1370678 - RNA, 21 nt, Human
cuucaaaaguuuguuugcuua

SEQ ID NO: 1370679 - RNA, 16 nt, Human
cuuauuuguauauggu

SEQ ID NO: 1370680 - RNA, 15 nt, Human
cuuauuuccucauuu

SEQ ID NO: 1370681 - RNA, 11 nt, Human
cuucaaacuac

SEQ ID NO: 1370682 - RNA, 23 nt, Human
cuucaaaauguuaucuucucaag

SEQ ID NO: 1370683 - RNA, 22 nt, Human
cuucaaaauguuaucuucucaa

SEQ ID NO: 1370684 - RNA, 20 nt, Human
cuucaaaauguuaucuucuc

SEQ ID NO: 1370685 - RNA, 14 nt, Human
cuucaaacuacuuu

SEQ ID NO: 1370686 - RNA, 23 nt, Human
cuucaaacuagggccaagcccag

SEQ ID NO: 1370687 - RNA, 16 nt, Human
cuucaaaguuuaauaa

SEQ ID NO: 1370688 - RNA, 15 nt, Human
cuucaaaguuuaaua

SEQ ID NO: 1370689 - RNA, 15 nt, Human
cuuaguguaugauua

SEQ ID NO: 1370690 - RNA, 11 nt, Human
cuuaguguaug

SEQ ID NO: 1370691 - RNA, 21 nt, Human
cuuagucuagguccuuguugu

SEQ ID NO: 1370692 - RNA, 23 nt, Human
cuuagucucaguuugugugucuu

SEQ ID NO: 1370693 - RNA, 20 nt, Human
cuuagucucaguuugugugu

SEQ ID NO: 1370694 - RNA, 19 nt, Human
cuuagucucaguuugugug

SEQ ID NO: 1370695 - RNA, 18 nt, Human
cuuagucucaguuugugu

SEQ ID NO: 1370696 - RNA, 13 nt, Human
cuuagucucaguu

SEQ ID NO: 1370697 - RNA, 12 nt, Human
cuuagucucagu

SEQ ID NO: 1370698 - RNA, 15 nt, Human
cuuagucuagguccu

SEQ ID NO: 1370699 - RNA, 21 nt, Human
cuguucucuugggaacugaac

SEQ ID NO: 1370700 - RNA, 22 nt, Human
cuuagaugcaguucugaagaag

SEQ ID NO: 1370701 - RNA, 22 nt, Human
cuuauacgaaauaauuguuguu

SEQ ID NO: 1370702 - RNA, 21 nt, Human
cuuauacgaaauaauuguugu

SEQ ID NO: 1370703 - RNA, 20 nt, Human
cuuauacgaaauaauuguug

SEQ ID NO: 1370704 - RNA, 18 nt, Human
cuuauacgaaauaauugu

SEQ ID NO: 1370705 - RNA, 17 nt, Human
cuuauacgaaauaauug

SEQ ID NO: 1370706 - RNA, 16 nt, Human
cuuauacgaaauaauu

SEQ ID NO: 1370707 - RNA, 23 nt, Human
cuuaguuuguguguugucucuug

SEQ ID NO: 1370708 - RNA, 22 nt, Human
cuuaguuuguguguugucucuu

SEQ ID NO: 1370709 - RNA, 17 nt, Human
cuuaguuuguguguugu

SEQ ID NO: 1370710 - RNA, 23 nt, Human
cuuaguucaaguccugccucuua

SEQ ID NO: 1370711 - RNA, 16 nt, Human
cuuauacgaguaauau

SEQ ID NO: 1370712 - RNA, 15 nt, Human
cuuauauaauugcca

SEQ ID NO: 1370713 - RNA, 16 nt, Human
cuuauagccucugucu

SEQ ID NO: 1370714 - RNA, 14 nt, Human
cuuauccucccugu

SEQ ID NO: 1370715 - RNA, 12 nt, Human
cuuauccucccu

SEQ ID NO: 1370716 - RNA, 15 nt, Human
cuuauccuccaccgu

SEQ ID NO: 1370717 - RNA, 21 nt, Human
cuuauaucuggccucugcuuu

SEQ ID NO: 1370718 - RNA, 22 nt, Human
cuuauaucuggccucugcuuuc

SEQ ID NO: 1370719 - RNA, 16 nt, Human
cuuauaucuggccucu

SEQ ID NO: 1370720 - RNA, 19 nt, Human
cuuauaucuauauuuuaca

SEQ ID NO: 1370721 - RNA, 13 nt, Human
cuuauauuaugga

SEQ ID NO: 1370722 - RNA, 14 nt, Human
cuuugaccucugca

SEQ ID NO: 1370723 - RNA, 15 nt, Human
cuuugaccucugcag

SEQ ID NO: 1370724 - RNA, 17 nt, Human
cuuugaccucugcagca

SEQ ID NO: 1370725 - RNA, 18 nt, Human
cuuugaccucugcagcaa

SEQ ID NO: 1370726 - RNA, 20 nt, Human
cuuugaccucugcagcaaua

SEQ ID NO: 1370727 - RNA, 24 nt, Human
cuuugaccucugcagcaauaaagc

SEQ ID NO: 1370728 - RNA, 22 nt, Human
cuuugcagccggcacagggucu

SEQ ID NO: 1370729 - RNA, 14 nt, Human
cuuugaccugccuc

SEQ ID NO: 1370730 - RNA, 15 nt, Human
cuuugaccugccucc

SEQ ID NO: 1370731 - RNA, 12 nt, Human
cuuugccucaaa

SEQ ID NO: 1370732 - RNA, 18 nt, Human
cuuugaccugccucccuu

SEQ ID NO: 1370733 - RNA, 22 nt, Human
cuuugcauaacguauaaaagcc

SEQ ID NO: 1370734 - RNA, 22 nt, Human
cuuugugaauagaacucugaaa

SEQ ID NO: 1370735 - RNA, 23 nt, Human
cuuugucuacuucaaaaguuugu

SEQ ID NO: 1370736 - RNA, 13 nt, Human
cuuugugcauucu

SEQ ID NO: 1370737 - RNA, 23 nt, Human
cuuugugcacauuuauuuccucc

SEQ ID NO: 1370738 - RNA, 18 nt, Human
cuuugugcacauuuauuu

SEQ ID NO: 1370739 - RNA, 16 nt, Human
cuuugugcacauuuau

SEQ ID NO: 1370740 - RNA, 18 nt, Human
cuuugugcccuaucaccc

SEQ ID NO: 1370741 - RNA, 13 nt, Human
cuuugugcccuau

SEQ ID NO: 1370742 - RNA, 14 nt, Human
cuuugugcauucug

SEQ ID NO: 1370743 - RNA, 20 nt, Human
cuuugcgcuccuggcccagc

SEQ ID NO: 1370744 - RNA, 17 nt, Human
cuuugcgcuccuggccc

SEQ ID NO: 1370745 - RNA, 15 nt, Human
cuuugcgcuccuggc

SEQ ID NO: 1370746 - RNA, 13 nt, Human
cuuugcgcuccug

SEQ ID NO: 1370747 - RNA, 18 nt, Human
cuuugcuaaagacaugaa

SEQ ID NO: 1370748 - RNA, 21 nt, Human
cuuugcgcuccuggcccagcc

SEQ ID NO: 1370749 - RNA, 22 nt, Human
cuuugcgcuccuggcccagccu

SEQ ID NO: 1370750 - RNA, 14 nt, Human
cuuugucagggagu

SEQ ID NO: 1370751 - RNA, 15 nt, Human
cuuuggcuccccugu

SEQ ID NO: 1370752 - RNA, 13 nt, Human
cuuuggcuccccu

SEQ ID NO: 1370753 - RNA, 14 nt, Human
cuuuggcugcaugc

SEQ ID NO: 1370754 - RNA, 16 nt, Human
cuuuggcugcaugcga

SEQ ID NO: 1370755 - RNA, 18 nt, Human
cuuucccuacccucuaga

SEQ ID NO: 1370756 - RNA, 16 nt, Human
cuuucccuacccucua

SEQ ID NO: 1370757 - RNA, 15 nt, Human
cuuucccuacccucu

SEQ ID NO: 1370758 - RNA, 13 nt, Human
cuuucccuacccu

SEQ ID NO: 1370759 - RNA, 22 nt, Human
cuuuccauccauggccagcagc

SEQ ID NO: 1370760 - RNA, 21 nt, Human
cuuuccauccauggccagcag

SEQ ID NO: 1370761 - RNA, 20 nt, Human
cuuuccauccauggccagca

SEQ ID NO: 1370762 - RNA, 18 nt, Human
cuuuccauccauggccag

SEQ ID NO: 1370763 - RNA, 15 nt, Human
cuuuccauccauggc

SEQ ID NO: 1370764 - RNA, 12 nt, Human
cuuuccauuaca

SEQ ID NO: 1370765 - RNA, 18 nt, Human
cuuuccauuggaucucau

SEQ ID NO: 1370766 - RNA, 13 nt, Human
cuuucccaacacc

SEQ ID NO: 1370767 - RNA, 21 nt, Human
cuuuaugucuguggauuuuuu

SEQ ID NO: 1370768 - RNA, 19 nt, Human
cuuuauguaguuuuuauau

SEQ ID NO: 1370769 - RNA, 13 nt, Human
cuuuaugcuugca

SEQ ID NO: 1370770 - RNA, 20 nt, Human
cuuuccauaaauccuugaug

SEQ ID NO: 1370771 - RNA, 20 nt, Human
cuuuauguaguuuuuauaug

SEQ ID NO: 1370772 - RNA, 17 nt, Human
cuuucccuucaguaccc

SEQ ID NO: 1370773 - RNA, 13 nt, Human
cuuucccuggucc

SEQ ID NO: 1370774 - RNA, 13 nt, Human
cuuucccugccuc

SEQ ID NO: 1370775 - RNA, 18 nt, Human
cuuucuguauauacuuuu

SEQ ID NO: 1370776 - RNA, 13 nt, Human
cuuucuguauaua

SEQ ID NO: 1370777 - RNA, 20 nt, Human
cuuucuuccggccccucccc

SEQ ID NO: 1370778 - RNA, 16 nt, Human
cuuucuguaaccauaa

SEQ ID NO: 1370779 - RNA, 17 nt, Human
cuuucuggcuaugcauu

SEQ ID NO: 1370780 - RNA, 18 nt, Human
cuuucuggcuaugcauuu

SEQ ID NO: 1370781 - RNA, 19 nt, Human
cuuucuggcuaugcauuug

SEQ ID NO: 1370782 - RNA, 20 nt, Human
cuuucuggcuaugcauuuga

SEQ ID NO: 1370783 - RNA, 12 nt, Human
cuuucucugagg

SEQ ID NO: 1370784 - RNA, 22 nt, Human
cuuucucucuuuauacagcugu

SEQ ID NO: 1370785 - RNA, 22 nt, Human
cuuuccugaauccaaacuaauc

SEQ ID NO: 1370786 - RNA, 15 nt, Human
cuuuccugaauccaa

SEQ ID NO: 1370787 - RNA, 18 nt, Human
cuuucucugccagugaca

SEQ ID NO: 1370788 - RNA, 16 nt, Human
cuuucucugccaguga

SEQ ID NO: 1370789 - RNA, 14 nt, Human
cuuucucugccagu

SEQ ID NO: 1370790 - RNA, 13 nt, Human
cuuucucugccag

SEQ ID NO: 1370791 - RNA, 15 nt, Human
cuuucucugaggaca

SEQ ID NO: 1370792 - RNA, 14 nt, Human
cuuucucugaggac

SEQ ID NO: 1370793 - RNA, 23 nt, Human
cuuucuggauuauucugggggcu

SEQ ID NO: 1370794 - RNA, 21 nt, Human
cuuucucuuucccuggucccu

SEQ ID NO: 1370795 - RNA, 18 nt, Human
cuuucucuuucccugguc

SEQ ID NO: 1370796 - RNA, 16 nt, Human
cuuucucuuucccugg

SEQ ID NO: 1370797 - RNA, 16 nt, Human
cuuuagaucucugaag

SEQ ID NO: 1370798 - RNA, 15 nt, Human
cuuuagaucucugaa

SEQ ID NO: 1370799 - RNA, 21 nt, Human
cuuuagauagcccuguccugg

SEQ ID NO: 1370800 - RNA, 20 nt, Human
cuuuagauagcccuguccug

SEQ ID NO: 1370801 - RNA, 19 nt, Human
cuuuagauagcccuguccu

SEQ ID NO: 1370802 - RNA, 15 nt, Human
cuuuagauagcccug

SEQ ID NO: 1370803 - RNA, 18 nt, Human
cuuuaaaauuuuuuuaga

SEQ ID NO: 1370804 - RNA, 21 nt, Human
cuuuaaaauguaaagccaugc

SEQ ID NO: 1370805 - RNA, 21 nt, Human
cuuuaaaauuuuuuuagaaag

SEQ ID NO: 1370806 - RNA, 23 nt, Human
cuuuaaaauuuuuuuagaaagca

SEQ ID NO: 1370807 - RNA, 22 nt, Human
cuuuaccuuuuuuauacauaaa

SEQ ID NO: 1370808 - RNA, 13 nt, Human
cuuuacuauggcc

SEQ ID NO: 1370809 - RNA, 14 nt, Human
cuugugucccauga

SEQ ID NO: 1370810 - RNA, 15 nt, Human
cuugugucucugugc

SEQ ID NO: 1370811 - RNA, 18 nt, Human
cuuuaaaagaugcuuuua

SEQ ID NO: 1370812 - RNA, 16 nt, Human
cuuuaaaaggaaagaa

SEQ ID NO: 1370813 - RNA, 18 nt, Human
cuuuaaaaggaaagaaaa

SEQ ID NO: 1370814 - RNA, 17 nt, Human
cuuuaaaauaucuacau

SEQ ID NO: 1370815 - RNA, 17 nt, Human
cuuuaaaaggaaagaaa

SEQ ID NO: 1370816 - RNA, 19 nt, Human
cuuuaaaauguaaagccau

SEQ ID NO: 1370817 - RNA, 16 nt, Human
cuuuaaaauguaaagc

SEQ ID NO: 1370818 - RNA, 17 nt, Human
cuuuaaaauuacaacua

SEQ ID NO: 1370819 - RNA, 19 nt, Human
cuuuaaaauuacaacuaag

SEQ ID NO: 1370820 - RNA, 20 nt, Human
cuuuaaaauuacaacuaagu

SEQ ID NO: 1370821 - RNA, 22 nt, Human
cuuuauaugaagaaaaucacuu

SEQ ID NO: 1370822 - RNA, 13 nt, Human
cuuuauaugaaga

SEQ ID NO: 1370823 - RNA, 15 nt, Human
cuuuauagaucagcc

SEQ ID NO: 1370824 - RNA, 14 nt, Human
cuuuauacagcugu

SEQ ID NO: 1370825 - RNA, 23 nt, Human
cuuuauacagcuguauugucuga

SEQ ID NO: 1370826 - RNA, 19 nt, Human
cuuuaugauaauagauucu

SEQ ID NO: 1370827 - RNA, 20 nt, Human
cuuuaugauaauagauucuc

SEQ ID NO: 1370828 - RNA, 23 nt, Human
cuuuaucuugaauaauguaagac

SEQ ID NO: 1370829 - RNA, 18 nt, Human
cuuuaucuugaauaaugu

SEQ ID NO: 1370830 - RNA, 21 nt, Human
cuuuaucuugaauaauguaag

SEQ ID NO: 1370831 - RNA, 14 nt, Human
cuuuauccucuuua

SEQ ID NO: 1370832 - RNA, 16 nt, Human
cuuuauccucuuuaga

SEQ ID NO: 1370833 - RNA, 22 nt, Human
cuuggggguccuccuccaggga

SEQ ID NO: 1370834 - RNA, 21 nt, Human
cuuggggguccuccuccaggg

SEQ ID NO: 1370835 - RNA, 22 nt, Human
cuuguacauaaugcgugcauac

SEQ ID NO: 1370836 - RNA, 19 nt, Human
cuuguacauaaugcgugca

SEQ ID NO: 1370837 - RNA, 21 nt, Human
cuuguacauaaugcgugcaua

SEQ ID NO: 1370838 - RNA, 15 nt, Human
cuuguacauaaugcg

SEQ ID NO: 1370839 - RNA, 12 nt, Human
cuuguacauaau

SEQ ID NO: 1370840 - RNA, 23 nt, Human
cuuggggguccuccuccagggac

SEQ ID NO: 1370841 - RNA, 20 nt, Human
cuuggggguccuccuccagg

SEQ ID NO: 1370842 - RNA, 24 nt, Human
cuuggggggugaugagggcagcag

SEQ ID NO: 1370843 - RNA, 22 nt, Human
cuuggggggugaugagggcagc

SEQ ID NO: 1370844 - RNA, 20 nt, Human
cuuggggggugaugagggca

SEQ ID NO: 1370845 - RNA, 13 nt, Human
cuuggggggugau

SEQ ID NO: 1370846 - RNA, 22 nt, Human
cuuggggggguggccgcugagu

SEQ ID NO: 1370847 - RNA, 19 nt, Human
cuuggggggguggccgcug

SEQ ID NO: 1370848 - RNA, 18 nt, Human
cuuggggggguggccgcu

SEQ ID NO: 1370849 - RNA, 16 nt, Human
cuuggggggguggccg

SEQ ID NO: 1370850 - RNA, 14 nt, Human
cuuggggggguggc

SEQ ID NO: 1370851 - RNA, 13 nt, Human
cuugaguuugucg

SEQ ID NO: 1370852 - RNA, 16 nt, Human
cuugaguuugucgcuc

SEQ ID NO: 1370853 - RNA, 12 nt, Human
cuugaguuuguc

SEQ ID NO: 1370854 - RNA, 19 nt, Human
cuugaguuuaaauuguaau

SEQ ID NO: 1370855 - RNA, 19 nt, Human
cuugucauguguauaaaaa

SEQ ID NO: 1370856 - RNA, 18 nt, Human
cuugucauuuuuuuucuu

SEQ ID NO: 1370857 - RNA, 20 nt, Human
cuuguccaacccgaggcccg

SEQ ID NO: 1370858 - RNA, 22 nt, Human
cuugucauuguuauauaaucau

SEQ ID NO: 1370859 - RNA, 18 nt, Human
cuugucauguguauaaaa

SEQ ID NO: 1370860 - RNA, 17 nt, Human
cuugucauguguauaaa

SEQ ID NO: 1370861 - RNA, 16 nt, Human
cuugucauguguauaa

SEQ ID NO: 1370862 - RNA, 15 nt, Human
cuugucauguguaua

SEQ ID NO: 1370863 - RNA, 14 nt, Human
cuugucauguguau

SEQ ID NO: 1370864 - RNA, 13 nt, Human
cuugucaugugua

SEQ ID NO: 1370865 - RNA, 12 nt, Human
cuugucaugugu

SEQ ID NO: 1370866 - RNA, 18 nt, Human
cuugucacgccagacuuc

SEQ ID NO: 1370867 - RNA, 16 nt, Human
cuugucacgccagacu

SEQ ID NO: 1370868 - RNA, 13 nt, Human
cuugucacgccag

SEQ ID NO: 1370869 - RNA, 13 nt, Human
cuuguccagcuga

SEQ ID NO: 1370870 - RNA, 12 nt, Human
cuuguccagcug

SEQ ID NO: 1370871 - RNA, 19 nt, Human
cuuguauaagauccuagau

SEQ ID NO: 1370872 - RNA, 23 nt, Human
cuuguauauuuuaagaaauaaca

SEQ ID NO: 1370873 - RNA, 17 nt, Human
cuuguauauuuuaagaa

SEQ ID NO: 1370874 - RNA, 23 nt, Human
cuugucaauaaaauccauacauu

SEQ ID NO: 1370875 - RNA, 23 nt, Human
cuuguaggggaggggcuccuuuc

SEQ ID NO: 1370876 - RNA, 22 nt, Human
cuuguaggggaggggcuccuuu

SEQ ID NO: 1370877 - RNA, 17 nt, Human
cuuguacuuuauuuucu

SEQ ID NO: 1370878 - RNA, 23 nt, Human
gaaaccagcuuccuucagagagc

SEQ ID NO: 1370879 - RNA, 22 nt, Human
gaaaccagcuuccuucagagag

SEQ ID NO: 1370880 - RNA, 21 nt, Human
gaaaccagcuuccuucagaga

SEQ ID NO: 1370881 - RNA, 19 nt, Human
gaaaccagcuuccuucaga

SEQ ID NO: 1370882 - RNA, 17 nt, Human
gaaaccagcuuccuuca

SEQ ID NO: 1370883 - RNA, 13 nt, Human
gaaaccagcuucc

SEQ ID NO: 1370884 - RNA, 17 nt, Human
gaaaaugauacagcaga

SEQ ID NO: 1370885 - RNA, 15 nt, Human
gaaaaugauacagca

SEQ ID NO: 1370886 - RNA, 16 nt, Human
gaaaaugaaucccucu

SEQ ID NO: 1370887 - RNA, 13 nt, Human
gaaacacagaaac

SEQ ID NO: 1370888 - RNA, 16 nt, Human
gaaacacaacuauauu

SEQ ID NO: 1370889 - RNA, 19 nt, Human
gaaaccccuguaggccuca

SEQ ID NO: 1370890 - RNA, 19 nt, Human
gaaaccuacugcccaggca

SEQ ID NO: 1370891 - RNA, 13 nt, Human
gaaaccuacugcc

SEQ ID NO: 1370892 - RNA, 21 nt, Human
gaaacccugcacccauuagca

SEQ ID NO: 1370893 - RNA, 15 nt, Human
gaaacuccagaugcc

SEQ ID NO: 1370894 - RNA, 23 nt, Human
gaaacucguuaauuuguaguguu

SEQ ID NO: 1370895 - RNA, 19 nt, Human
gaaacuaggugcauauuua

SEQ ID NO: 1370896 - RNA, 16 nt, Human
gaaacgucuucuaaac

SEQ ID NO: 1370897 - RNA, 14 nt, Human
gaaaccuuccaccc

SEQ ID NO: 1370898 - RNA, 17 nt, Human
gaaagagaacuuccaga

SEQ ID NO: 1370899 - RNA, 18 nt, Human
gaaagagaaacaguuggu

SEQ ID NO: 1370900 - RNA, 13 nt, Human
gaaagagaaacac

SEQ ID NO: 1370901 - RNA, 21 nt, Human
gaaagaggcaccaggaagccg

SEQ ID NO: 1370902 - RNA, 20 nt, Human
gaaagaggcaccaggaagcc

SEQ ID NO: 1370903 - RNA, 17 nt, Human
gaaagaggcaccaggaa

SEQ ID NO: 1370904 - RNA, 16 nt, Human
gaaagaggcaccagga

SEQ ID NO: 1370905 - RNA, 13 nt, Human
gaaagaggaagca

SEQ ID NO: 1370906 - RNA, 20 nt, Human
gaaagaggugaccccagggc

SEQ ID NO: 1370907 - RNA, 19 nt, Human
gaaagaggugaccccaggg

SEQ ID NO: 1370908 - RNA, 14 nt, Human
gaaagaggugaccc

SEQ ID NO: 1370909 - RNA, 21 nt, Human
gaaagaggugaccccagggca

SEQ ID NO: 1370910 - RNA, 23 nt, Human
gaaagaggugaccccagggcaca

SEQ ID NO: 1370911 - RNA, 22 nt, Human
gaaagaggcugaggccuggacu

SEQ ID NO: 1370912 - RNA, 21 nt, Human
gaaagaggcugaggccuggac

SEQ ID NO: 1370913 - RNA, 20 nt, Human
gaaagaggcugaggccugga

SEQ ID NO: 1370914 - RNA, 21 nt, Human
gaaagaguacucuuguuuccu

SEQ ID NO: 1370915 - RNA, 18 nt, Human
gaaagcaguugagacaag

SEQ ID NO: 1370916 - RNA, 21 nt, Human
gaaagccccacccaggccagg

SEQ ID NO: 1370917 - RNA, 16 nt, Human
gaaagccccacccagg

SEQ ID NO: 1370918 - RNA, 13 nt, Human
gaaagccccaccc

SEQ ID NO: 1370919 - RNA, 17 nt, Human
gaaagcugccugguaua

SEQ ID NO: 1370920 - RNA, 21 nt, Human
gaaagcugacuuggcuggugu

SEQ ID NO: 1370921 - RNA, 18 nt, Human
gaaagcuucagugcugcc

SEQ ID NO: 1370922 - RNA, 16 nt, Human
gaaagcuucagugcug

SEQ ID NO: 1370923 - RNA, 17 nt, Human
gaaagcuucaaacugca

SEQ ID NO: 1370924 - RNA, 22 nt, Human
gaaagcugacuuggcuggugug

SEQ ID NO: 1370925 - RNA, 20 nt, Human
gaaagcugacuuggcuggug

SEQ ID NO: 1370926 - RNA, 19 nt, Human
gaaagcugacuuggcuggu

SEQ ID NO: 1370927 - RNA, 18 nt, Human
gaaagcugacuuggcugg

SEQ ID NO: 1370928 - RNA, 16 nt, Human
gaaagcugacuuggcu

SEQ ID NO: 1370929 - RNA, 15 nt, Human
gaaagcugacuuggc

SEQ ID NO: 1370930 - RNA, 12 nt, Human
gaaagcucuaga

SEQ ID NO: 1370931 - RNA, 13 nt, Human
gaaagcucuagaa

SEQ ID NO: 1370932 - RNA, 19 nt, Human
gaaagcuauauaagacaag

SEQ ID NO: 1370933 - RNA, 12 nt, Human
gaaagccugagu

SEQ ID NO: 1370934 - RNA, 10 nt, Human
gaaagccuga

SEQ ID NO: 1370935 - RNA, 23 nt, Human
gaaagccccugccccuccucucc

SEQ ID NO: 1370936 - RNA, 14 nt, Human
gaaagccccugccc

SEQ ID NO: 1370937 - RNA, 18 nt, Human
gaaagccccacccaggcc

SEQ ID NO: 1370938 - RNA, 14 nt, Human
gaaagccuucuuuu

SEQ ID NO: 1370939 - RNA, 17 nt, Human
gaaagcgccuccaaccc

SEQ ID NO: 1370940 - RNA, 22 nt, Human
gaaagcgccuccaacccuagca

SEQ ID NO: 1370941 - RNA, 18 nt, Human
gaaaacaggcacugcccu

SEQ ID NO: 1370942 - RNA, 12 nt, Human
gaaaacaggcac

SEQ ID NO: 1370943 - RNA, 15 nt, Human
gaaaacagaacacuu

SEQ ID NO: 1370944 - RNA, 16 nt, Human
gaaaacagaacacuua

SEQ ID NO: 1370945 - RNA, 14 nt, Human
gaaaaggccugggg

SEQ ID NO: 1370946 - RNA, 13 nt, Human
gaaaaggccuggg

SEQ ID NO: 1370947 - RNA, 16 nt, Human
gaaaaggccuggggug

SEQ ID NO: 1370948 - RNA, 12 nt, Human
gaaaaggccugg

SEQ ID NO: 1370949 - RNA, 22 nt, Human
gaaaaggcacccccgucaagag

SEQ ID NO: 1370950 - RNA, 23 nt, Human
gaaaagcuuagcuuuagaaacag

SEQ ID NO: 1370951 - RNA, 15 nt, Human
gaaaaguugaauuuu

SEQ ID NO: 1370952 - RNA, 14 nt, Human
gaaaaguugaauuu

SEQ ID NO: 1370953 - RNA, 11 nt, Human
gaaaaucauau

SEQ ID NO: 1370954 - RNA, 13 nt, Human
gaaaaugaaagcu

SEQ ID NO: 1370955 - RNA, 19 nt, Human
gaaaaucuuuauaaaugua

SEQ ID NO: 1370956 - RNA, 18 nt, Human
gaaaaucuuauaauuuaa

SEQ ID NO: 1370957 - RNA, 22 nt, Human
gaaaauauuguuuuacaauagu

SEQ ID NO: 1370958 - RNA, 15 nt, Human
gaaaauauuguuuua

SEQ ID NO: 1370959 - RNA, 23 nt, Human
gaaaaguuuagccccugaaagcc

SEQ ID NO: 1370960 - RNA, 21 nt, Human
gaaaacacugugcacaucugu

SEQ ID NO: 1370961 - RNA, 14 nt, Human
gaaaacacugugca

SEQ ID NO: 1370962 - RNA, 19 nt, Human
gaaaacacauuuuucuuag

SEQ ID NO: 1370963 - RNA, 17 nt, Human
gaaaaaggaugcacaga

SEQ ID NO: 1370964 - RNA, 18 nt, Human
gaaaacacauuuuucuua

SEQ ID NO: 1370965 - RNA, 13 nt, Human
gaaaaagcgaaaa

SEQ ID NO: 1370966 - RNA, 21 nt, Human
cuuuuuguucugguccuuuuu

SEQ ID NO: 1370967 - RNA, 15 nt, Human
cuuuuuguguuuuuu

SEQ ID NO: 1370968 - RNA, 22 nt, Human
cuuuuugugauaugcacaaugu

SEQ ID NO: 1370969 - RNA, 13 nt, Human
cuuuuuguauaaa

SEQ ID NO: 1370970 - RNA, 18 nt, Human
cuuuuuguauaaaauaga

SEQ ID NO: 1370971 - RNA, 19 nt, Human
cuuuuugggagagacuugu

SEQ ID NO: 1370972 - RNA, 23 nt, Human
cuuuuuggucgaggaguaacaau

SEQ ID NO: 1370973 - RNA, 20 nt, Human
cuuuuugggagagacuuguu

SEQ ID NO: 1370974 - RNA, 17 nt, Human
cuuuuugggagagacuu

SEQ ID NO: 1370975 - RNA, 17 nt, Human
cuuugugugcucuccau

SEQ ID NO: 1370976 - RNA, 14 nt, Human
cuuuguggcacugg

SEQ ID NO: 1370977 - RNA, 18 nt, Human
cuuuguuaagacugcuga

SEQ ID NO: 1370978 - RNA, 11 nt, Human
cuuuuguucuu

SEQ ID NO: 1370979 - RNA, 12 nt, Human
cuuuuguucuug

SEQ ID NO: 1370980 - RNA, 20 nt, Human
cuuuuucucuuuccaugaca

SEQ ID NO: 1370981 - RNA, 13 nt, Human
cuuuuguucgcau

SEQ ID NO: 1370982 - RNA, 20 nt, Human
cuuuuguucuugguuuguaa

SEQ ID NO: 1370983 - RNA, 17 nt, Human
cuuuuuauggccuguga

SEQ ID NO: 1370984 - RNA, 24 nt, Human
gacaugauuuccuugaauguggcu

SEQ ID NO: 1370985 - RNA, 22 nt, Human
gacaugauuuccuugaaugugg

SEQ ID NO: 1370986 - RNA, 20 nt, Human
gacaugauuuccuugaaugu

SEQ ID NO: 1370987 - RNA, 19 nt, Human
gacaugauuuccuugaaug

SEQ ID NO: 1370988 - RNA, 17 nt, Human
gacaugauuuccuugaa

SEQ ID NO: 1370989 - RNA, 16 nt, Human
gacaugauuuccuuga

SEQ ID NO: 1370990 - RNA, 14 nt, Human
gacaugauuuccuu

SEQ ID NO: 1370991 - RNA, 17 nt, Human
gacaugaauuuuagcuu

SEQ ID NO: 1370992 - RNA, 21 nt, Human
gacaugaauuuuagcuuuugu

SEQ ID NO: 1370993 - RNA, 11 nt, Human
gacaugaauuu

SEQ ID NO: 1370994 - RNA, 15 nt, Human
gacaucggaaaaaua

SEQ ID NO: 1370995 - RNA, 18 nt, Human
gacauccuccucccaccc

SEQ ID NO: 1370996 - RNA, 15 nt, Human
gacauccuccuccca

SEQ ID NO: 1370997 - RNA, 23 nt, Human
gacauacuugaagggccagagcc

SEQ ID NO: 1370998 - RNA, 22 nt, Human
gacauacuugaagggccagagc

SEQ ID NO: 1370999 - RNA, 20 nt, Human
gacauacuugaagggccaga

SEQ ID NO: 1371000 - RNA, 19 nt, Human
gacauacuugaagggccag

SEQ ID NO: 1371001 - RNA, 18 nt, Human
gacauacuugaagggcca

SEQ ID NO: 1371002 - RNA, 17 nt, Human
gacauacuugaagggcc

SEQ ID NO: 1371003 - RNA, 15 nt, Human
gacauacuugaaggg

SEQ ID NO: 1371004 - RNA, 14 nt, Human
gacauacuugaagg

SEQ ID NO: 1371005 - RNA, 23 nt, Human
gacaguguugaaaauguucagaa

SEQ ID NO: 1371006 - RNA, 21 nt, Human
gacaguguuccccgauaccau

SEQ ID NO: 1371007 - RNA, 20 nt, Human
gacaguguuccccgauacca

SEQ ID NO: 1371008 - RNA, 20 nt, Human
gacagggaauuaggccccca

SEQ ID NO: 1371009 - RNA, 20 nt, Human
gacagcuuguaggggagggg

SEQ ID NO: 1371010 - RNA, 21 nt, Human
gacagcuuguggcaagugaau

SEQ ID NO: 1371011 - RNA, 16 nt, Human
gacagaguugauuuuu

SEQ ID NO: 1371012 - RNA, 15 nt, Human
gacagagccaggaga

SEQ ID NO: 1371013 - RNA, 16 nt, Human
gacagagccaggagaa

SEQ ID NO: 1371014 - RNA, 13 nt, Human
gacagagccagga

SEQ ID NO: 1371015 - RNA, 19 nt, Human
gacagagaggacuguaggg

SEQ ID NO: 1371016 - RNA, 19 nt, Human
gacagagccccacccucag

SEQ ID NO: 1371017 - RNA, 14 nt, Human
gacacccaggacuu

SEQ ID NO: 1371018 - RNA, 13 nt, Human
gacacccaggacu

SEQ ID NO: 1371019 - RNA, 16 nt, Human
gacagagaggacugua

SEQ ID NO: 1371020 - RNA, 15 nt, Human
gacagagaggacugu

SEQ ID NO: 1371021 - RNA, 17 nt, Human
gaccggacuuuucugca

SEQ ID NO: 1371022 - RNA, 23 nt, Human
gaccgcuacaccacucuggcagc

SEQ ID NO: 1371023 - RNA, 21 nt, Human
gaccgcuacaccacucuggca

SEQ ID NO: 1371024 - RNA, 20 nt, Human
gaccgcuacaccacucuggc

SEQ ID NO: 1371025 - RNA, 19 nt, Human
gaccgcuacaccacucugg

SEQ ID NO: 1371026 - RNA, 15 nt, Human
gaccgcccccugucu

SEQ ID NO: 1371027 - RNA, 16 nt, Human
gaccgcccccuccucu

SEQ ID NO: 1371028 - RNA, 15 nt, Human
gaccgcccccuccuc

SEQ ID NO: 1371029 - RNA, 14 nt, Human
gaccgcccccuccu

SEQ ID NO: 1371030 - RNA, 12 nt, Human
gaccgcccccuc

SEQ ID NO: 1371031 - RNA, 18 nt, Human
gacccuuuuggguuucug

SEQ ID NO: 1371032 - RNA, 12 nt, Human
gacccuuuucau

SEQ ID NO: 1371033 - RNA, 18 nt, Human
gaccgaggagggagaguc

SEQ ID NO: 1371034 - RNA, 22 nt, Human
gaccgcuacaccacucuggcag

SEQ ID NO: 1371035 - RNA, 15 nt, Human
gacccuggcuuucau

SEQ ID NO: 1371036 - RNA, 23 nt, Human
gacccuggcuccuugugccagag

SEQ ID NO: 1371037 - RNA, 13 nt, Human
gacccuggcuccu

SEQ ID NO: 1371038 - RNA, 16 nt, Human
gacccuggaggcccca

SEQ ID NO: 1371039 - RNA, 11 nt, Human
gacccugcccu

SEQ ID NO: 1371040 - RNA, 14 nt, Human
gaccagccucucca

SEQ ID NO: 1371041 - RNA, 16 nt, Human
gaccauugucucagag

SEQ ID NO: 1371042 - RNA, 20 nt, Human
gaccagaagcucccccagca

SEQ ID NO: 1371043 - RNA, 17 nt, Human
gaccagaagcuccccca

SEQ ID NO: 1371044 - RNA, 14 nt, Human
gaccacuguuauca

SEQ ID NO: 1371045 - RNA, 13 nt, Human
gaccacggcucga

SEQ ID NO: 1371046 - RNA, 16 nt, Human
gaccacguuucuaaag

SEQ ID NO: 1371047 - RNA, 22 nt, Human
gaccaccuuuguuucuccccca

SEQ ID NO: 1371048 - RNA, 22 nt, Human
gaccacgcccguccugccugug

SEQ ID NO: 1371049 - RNA, 14 nt, Human
gaccacguuucuaa

SEQ ID NO: 1371050 - RNA, 16 nt, Human
gacaugggacauuugc

SEQ ID NO: 1371051 - RNA, 20 nt, Human
gaccaccccgccugcccuca

SEQ ID NO: 1371052 - RNA, 19 nt, Human
gaccaccccgccugcccuc

SEQ ID NO: 1371053 - RNA, 18 nt, Human
gaccaccccgccugcccu

SEQ ID NO: 1371054 - RNA, 17 nt, Human
gacaugcgguagccagc

SEQ ID NO: 1371055 - RNA, 16 nt, Human
gacaugcgguagccag

SEQ ID NO: 1371056 - RNA, 17 nt, Human
gacaugggacauuugcu

SEQ ID NO: 1371057 - RNA, 15 nt, Human
gaccacccugagccg

SEQ ID NO: 1371058 - RNA, 14 nt, Human
gaccacccugagcc

SEQ ID NO: 1371059 - RNA, 19 nt, Human
gaccacccucacuggcucu

SEQ ID NO: 1371060 - RNA, 14 nt, Human
gaccacccucacug

SEQ ID NO: 1371061 - RNA, 21 nt, Human
gaccacgcccguccugccugu

SEQ ID NO: 1371062 - RNA, 19 nt, Human
gaccacgcccguccugccu

SEQ ID NO: 1371063 - RNA, 17 nt, Human
gaccacgcccguccugc

SEQ ID NO: 1371064 - RNA, 16 nt, Human
gaccaccucucaauau

SEQ ID NO: 1371065 - RNA, 14 nt, Human
gacaccaaaguucu

SEQ ID NO: 1371066 - RNA, 15 nt, Human
gacaccaaaguucua

SEQ ID NO: 1371067 - RNA, 23 nt, Human
gacacauuuuuuaggaaauguuu

SEQ ID NO: 1371068 - RNA, 20 nt, Human
gacacauuuuuuaggaaaug

SEQ ID NO: 1371069 - RNA, 19 nt, Human
gacacauuuuuuaggaaau

SEQ ID NO: 1371070 - RNA, 19 nt, Human
gacacaugcaaggucauuu

SEQ ID NO: 1371071 - RNA, 21 nt, Human
gacacaugaagguaaauaaaa

SEQ ID NO: 1371072 - RNA, 20 nt, Human
gacacaugaagguaaauaaa

SEQ ID NO: 1371073 - RNA, 19 nt, Human
gacacaugaagguaaauaa

SEQ ID NO: 1371074 - RNA, 17 nt, Human
gacacaggcccucccug

SEQ ID NO: 1371075 - RNA, 13 nt, Human
gacacaggcccuc

SEQ ID NO: 1371076 - RNA, 14 nt, Human
gacacaugcaaggu

SEQ ID NO: 1371077 - RNA, 15 nt, Human
gacacaaacacacac

SEQ ID NO: 1371078 - RNA, 19 nt, Human
gacacaaacacacacaaaa

SEQ ID NO: 1371079 - RNA, 16 nt, Human
gacaauggaccggaga

SEQ ID NO: 1371080 - RNA, 14 nt, Human
gacaauggaccgga

SEQ ID NO: 1371081 - RNA, 22 nt, Human
gacaauugagguaaguuuuuug

SEQ ID NO: 1371082 - RNA, 13 nt, Human
gacaagcuucuga

SEQ ID NO: 1371083 - RNA, 12 nt, Human
gacaagcuucug

SEQ ID NO: 1371084 - RNA, 15 nt, Human
gacaagacccccagc

SEQ ID NO: 1371085 - RNA, 16 nt, Human
gacaaggaaaaaauaa

SEQ ID NO: 1371086 - RNA, 16 nt, Human
gacaagacccccagca

SEQ ID NO: 1371087 - RNA, 21 nt, Human
gacaacuucuaauugccaugu

SEQ ID NO: 1371088 - RNA, 17 nt, Human
gacaacuggcaggcagg

SEQ ID NO: 1371089 - RNA, 18 nt, Human
gacaacuggcaggcaggc

SEQ ID NO: 1371090 - RNA, 16 nt, Human
gacaacuggcaggcag

SEQ ID NO: 1371091 - RNA, 15 nt, Human
gacaacuggcaggca

SEQ ID NO: 1371092 - RNA, 13 nt, Human
gacaacuggcagg

SEQ ID NO: 1371093 - RNA, 12 nt, Human
gacaacuggcag

SEQ ID NO: 1371094 - RNA, 22 nt, Human
gacaacugcucccaccuccuga

SEQ ID NO: 1371095 - RNA, 21 nt, Human
gacaacugcucccaccuccug

SEQ ID NO: 1371096 - RNA, 19 nt, Human
gacaacugcucccaccucc

SEQ ID NO: 1371097 - RNA, 17 nt, Human
gacaacugcucccaccu

SEQ ID NO: 1371098 - RNA, 15 nt, Human
gacaacgugcucuuu

SEQ ID NO: 1371099 - RNA, 17 nt, Human
gacaacguuucagcgac

SEQ ID NO: 1371100 - RNA, 19 nt, Human
gacaaccacuggucuguag

SEQ ID NO: 1371101 - RNA, 17 nt, Human
gacaaccacuggucugu

SEQ ID NO: 1371102 - RNA, 15 nt, Human
gacaaccacuggucu

SEQ ID NO: 1371103 - RNA, 22 nt, Human
gacaacauuucuauagccaaaa

SEQ ID NO: 1371104 - RNA, 20 nt, Human
gacaaaucacauauuuuaaa

SEQ ID NO: 1371105 - RNA, 18 nt, Human
gacaaaucacauauuuua

SEQ ID NO: 1371106 - RNA, 16 nt, Human
gacaaaucacauauuu

SEQ ID NO: 1371107 - RNA, 16 nt, Human
gacaacacccauuuuu

SEQ ID NO: 1371108 - RNA, 16 nt, Human
gaauugggagcuuggg

SEQ ID NO: 1371109 - RNA, 24 nt, Human
gaauugcuuguuugcuucaacugu

SEQ ID NO: 1371110 - RNA, 17 nt, Human
gaauugggagcuuggga

SEQ ID NO: 1371111 - RNA, 18 nt, Human
gaauuucuuaacuucuug

SEQ ID NO: 1371112 - RNA, 17 nt, Human
gaauuucuuaacuucuu

SEQ ID NO: 1371113 - RNA, 16 nt, Human
gaauuucuuaacuucu

SEQ ID NO: 1371114 - RNA, 15 nt, Human
gaauuucuuaacuuc

SEQ ID NO: 1371115 - RNA, 14 nt, Human
gaauuucuuaacuu

SEQ ID NO: 1371116 - RNA, 13 nt, Human
gaauuucuuaacu

SEQ ID NO: 1371117 - RNA, 14 nt, Human
gaauuucccucucu

SEQ ID NO: 1371118 - RNA, 16 nt, Human
gaauuguaacuguucu

SEQ ID NO: 1371119 - RNA, 20 nt, Human
gaauuucuaggacugaauua

SEQ ID NO: 1371120 - RNA, 19 nt, Human
gaauuucuaggacugaauu

SEQ ID NO: 1371121 - RNA, 21 nt, Human
gaauuucuuaacuucuugcuu

SEQ ID NO: 1371122 - RNA, 19 nt, Human
gaauuucuuaacuucuugc

SEQ ID NO: 1371123 - RNA, 22 nt, Human
gaauuucuuuugccguuauuaa

SEQ ID NO: 1371124 - RNA, 20 nt, Human
gaauuugauaugugaacagu

SEQ ID NO: 1371125 - RNA, 20 nt, Human
gaauuugccugcugggauuc

SEQ ID NO: 1371126 - RNA, 17 nt, Human
gaauuugagugcucuga

SEQ ID NO: 1371127 - RNA, 19 nt, Human
gaauuuggggcuuccaagu

SEQ ID NO: 1371128 - RNA, 18 nt, Human
gaauuuggggcuuccaag

SEQ ID NO: 1371129 - RNA, 14 nt, Human
gaauuugccugcug

SEQ ID NO: 1371130 - RNA, 20 nt, Human
gaauuuguaaugucuugagc

SEQ ID NO: 1371131 - RNA, 20 nt, Human
gaauuugugaagguggaaau

SEQ ID NO: 1371132 - RNA, 13 nt, Human
gaaucuauauuua

SEQ ID NO: 1371133 - RNA, 15 nt, Human
gaaucuacuaauucc

SEQ ID NO: 1371134 - RNA, 22 nt, Human
gaaucuacccccagauccaagc

SEQ ID NO: 1371135 - RNA, 18 nt, Human
gaaucuacccccagaucc

SEQ ID NO: 1371136 - RNA, 20 nt, Human
gaaucgcuccugcagcccca

SEQ ID NO: 1371137 - RNA, 16 nt, Human
gaaucgcuccugcagc

SEQ ID NO: 1371138 - RNA, 12 nt, Human
gaauccuuucag

SEQ ID NO: 1371139 - RNA, 22 nt, Human
gaauccugucgauuagacugga

SEQ ID NO: 1371140 - RNA, 19 nt, Human
gaaucccaaauuugauuga

SEQ ID NO: 1371141 - RNA, 17 nt, Human
gaaucccaaauuugauu

SEQ ID NO: 1371142 - RNA, 16 nt, Human
gaaucccaaauuugau

SEQ ID NO: 1371143 - RNA, 17 nt, Human
gaaucaguuuaaaagca

SEQ ID NO: 1371144 - RNA, 17 nt, Human
gaaucaucaggacccug

SEQ ID NO: 1371145 - RNA, 23 nt, Human
gaaucaggaauauuuuccaaaga

SEQ ID NO: 1371146 - RNA, 21 nt, Human
gaaucaggaauauuuuccaaa

SEQ ID NO: 1371147 - RNA, 16 nt, Human
gaaaggccagcacucg

SEQ ID NO: 1371148 - RNA, 15 nt, Human
gaaaggccagcacuc

SEQ ID NO: 1371149 - RNA, 14 nt, Human
gaaaggccagcacu

SEQ ID NO: 1371150 - RNA, 14 nt, Human
gaaaggccuuuaaa

SEQ ID NO: 1371151 - RNA, 15 nt, Human
gaaaggccuuuaaaa

SEQ ID NO: 1371152 - RNA, 18 nt, Human
gaaaggccuuuaaaauuu

SEQ ID NO: 1371153 - RNA, 22 nt, Human
gaaucugcaauucaaaaguucc

SEQ ID NO: 1371154 - RNA, 21 nt, Human
gaaucugcaauucaaaaguuc

SEQ ID NO: 1371155 - RNA, 15 nt, Human
gaaucugcaauucaa

SEQ ID NO: 1371156 - RNA, 18 nt, Human
gaaucucuuuuugcuuuc

SEQ ID NO: 1371157 - RNA, 15 nt, Human
gaaucucugugccuu

SEQ ID NO: 1371158 - RNA, 14 nt, Human
gaaucucugugccu

SEQ ID NO: 1371159 - RNA, 13 nt, Human
gaaucucugugcc

SEQ ID NO: 1371160 - RNA, 17 nt, Human
gaaucuauauuuaacaa

SEQ ID NO: 1371161 - RNA, 18 nt, Human
gaaucucugaauuugaga

SEQ ID NO: 1371162 - RNA, 23 nt, Human
gaaugaaauccugcuucagugua

SEQ ID NO: 1371163 - RNA, 20 nt, Human
gaaugaacacucuuuugcuu

SEQ ID NO: 1371164 - RNA, 11 nt, Human
gaauggcagca

SEQ ID NO: 1371165 - RNA, 23 nt, Human
gaaugcuucuaaguaaauacaau

SEQ ID NO: 1371166 - RNA, 22 nt, Human
gaaugcuucuaaguaaauacaa

SEQ ID NO: 1371167 - RNA, 14 nt, Human
gaaugcuucuaagu

SEQ ID NO: 1371168 - RNA, 20 nt, Human
gaaugcacaagaauggauca

SEQ ID NO: 1371169 - RNA, 21 nt, Human
gaaugcacaagaauggaucac

SEQ ID NO: 1371170 - RNA, 19 nt, Human
gaaugcacaagaauggauc

SEQ ID NO: 1371171 - RNA, 18 nt, Human
gaaugcacaagaauggau

SEQ ID NO: 1371172 - RNA, 23 nt, Human
gaauguugggacugcuaaauaaa

SEQ ID NO: 1371173 - RNA, 20 nt, Human
gaauguugauuacagugcag

SEQ ID NO: 1371174 - RNA, 14 nt, Human
gaauguucucagau

SEQ ID NO: 1371175 - RNA, 16 nt, Human
gaauguuaaauaaauu

SEQ ID NO: 1371176 - RNA, 18 nt, Human
gaauguuaaauaaauugu

SEQ ID NO: 1371177 - RNA, 21 nt, Human
gaauguuaaauaaauuguaua

SEQ ID NO: 1371178 - RNA, 21 nt, Human
gaauguuuacacucuuuguaa

SEQ ID NO: 1371179 - RNA, 20 nt, Human
gaauguuuacacucuuugua

SEQ ID NO: 1371180 - RNA, 14 nt, Human
gaauguugggacug

SEQ ID NO: 1371181 - RNA, 13 nt, Human
gaauugcauugac

SEQ ID NO: 1371182 - RNA, 12 nt, Human
gaauugcauuga

SEQ ID NO: 1371183 - RNA, 14 nt, Human
gaauugcagaguac

SEQ ID NO: 1371184 - RNA, 22 nt, Human
gaauugauuugcauugaacaca

SEQ ID NO: 1371185 - RNA, 16 nt, Human
gaauuggagcucgugg

SEQ ID NO: 1371186 - RNA, 20 nt, Human
gaauguuaagacuugacagu

SEQ ID NO: 1371187 - RNA, 22 nt, Human
gaauguguuucacaguuugaaa

SEQ ID NO: 1371188 - RNA, 21 nt, Human
gaauguguuucacaguuugaa

SEQ ID NO: 1371189 - RNA, 20 nt, Human
gaauguguuucacaguuuga

SEQ ID NO: 1371190 - RNA, 13 nt, Human
gaauguuaaauaa

SEQ ID NO: 1371191 - RNA, 14 nt, Human
gaauguuaaauaaa

SEQ ID NO: 1371192 - RNA, 14 nt, Human
gaauguguuucaca

SEQ ID NO: 1371193 - RNA, 13 nt, Human
gaauguguuucac

SEQ ID NO: 1371194 - RNA, 15 nt, Human
gaaugugucuuuaga

SEQ ID NO: 1371195 - RNA, 14 nt, Human
gaaugugucuuuag

SEQ ID NO: 1371196 - RNA, 13 nt, Human
gaaugugucuuua

SEQ ID NO: 1371197 - RNA, 12 nt, Human
gaaugugucuuu

SEQ ID NO: 1371198 - RNA, 22 nt, Human
gaauguggccccugaacaagaa

SEQ ID NO: 1371199 - RNA, 18 nt, Human
gaauguggcuugagaaau

SEQ ID NO: 1371200 - RNA, 18 nt, Human
gaaugugauaaggaaauc

SEQ ID NO: 1371201 - RNA, 19 nt, Human
gaaugugauaaggaaauca

SEQ ID NO: 1371202 - RNA, 20 nt, Human
gaaugugaagccuuccccuu

SEQ ID NO: 1371203 - RNA, 16 nt, Human
gaaugugaagccuucc

SEQ ID NO: 1371204 - RNA, 15 nt, Human
gaaugugaagccuuc

SEQ ID NO: 1371205 - RNA, 14 nt, Human
gaaugugaagccuu

SEQ ID NO: 1371206 - RNA, 13 nt, Human
gaaugugaagccu

SEQ ID NO: 1371207 - RNA, 19 nt, Human
gaauggcuauguuuuuaau

SEQ ID NO: 1371208 - RNA, 17 nt, Human
gaauggcuauguuuuua

SEQ ID NO: 1371209 - RNA, 19 nt, Human
gaauguaaucaauguuucu

SEQ ID NO: 1371210 - RNA, 18 nt, Human
gaauguaaucaauguuuc

SEQ ID NO: 1371211 - RNA, 16 nt, Human
gaauguaaucaauguu

SEQ ID NO: 1371212 - RNA, 13 nt, Human
gaauguaaucaau

SEQ ID NO: 1371213 - RNA, 11 nt, Human
gaauguaauca

SEQ ID NO: 1371214 - RNA, 18 nt, Human
gacucagacauuggcacc

SEQ ID NO: 1371215 - RNA, 18 nt, Human
gacuagauguaguauuuu

SEQ ID NO: 1371216 - RNA, 17 nt, Human
gacuagauguaguauuu

SEQ ID NO: 1371217 - RNA, 17 nt, Human
gacuagauggaccugcc

SEQ ID NO: 1371218 - RNA, 21 nt, Human
gacuagaugauggaugccaau

SEQ ID NO: 1371219 - RNA, 16 nt, Human
gacuagaugauggaug

SEQ ID NO: 1371220 - RNA, 14 nt, Human
gacuagaugaugga

SEQ ID NO: 1371221 - RNA, 20 nt, Human
gacucagccuucagacagag

SEQ ID NO: 1371222 - RNA, 19 nt, Human
gacucagccuucagacaga

SEQ ID NO: 1371223 - RNA, 15 nt, Human
gacucagccuucaga

SEQ ID NO: 1371224 - RNA, 14 nt, Human
gacucagccuucag

SEQ ID NO: 1371225 - RNA, 12 nt, Human
gacucagccuuc

SEQ ID NO: 1371226 - RNA, 12 nt, Human
gacucagcucug

SEQ ID NO: 1371227 - RNA, 16 nt, Human
gaccuauaccuguguu

SEQ ID NO: 1371228 - RNA, 20 nt, Human
gaccuauaccuguguuucuu

SEQ ID NO: 1371229 - RNA, 18 nt, Human
gaccuacuguucuaaagc

SEQ ID NO: 1371230 - RNA, 17 nt, Human
gaccuacuguucuaaag

SEQ ID NO: 1371231 - RNA, 15 nt, Human
gaccuacuguucuaa

SEQ ID NO: 1371232 - RNA, 18 nt, Human
gacuacagucaggaaagg

SEQ ID NO: 1371233 - RNA, 17 nt, Human
gaccucaagugaucugc

SEQ ID NO: 1371234 - RNA, 15 nt, Human
gacuccuagcugucc

SEQ ID NO: 1371235 - RNA, 19 nt, Human
gacuccuagcuguccuuuu

SEQ ID NO: 1371236 - RNA, 14 nt, Human
gacuccuagcuguc

SEQ ID NO: 1371237 - RNA, 16 nt, Human
gacuccguuggccacu

SEQ ID NO: 1371238 - RNA, 17 nt, Human
gacuccguuggccacuc

SEQ ID NO: 1371239 - RNA, 17 nt, Human
gacuccuccuuuuucca

SEQ ID NO: 1371240 - RNA, 13 nt, Human
gacuccuccuuuu

SEQ ID NO: 1371241 - RNA, 16 nt, Human
gacuccuccuuuuucc

SEQ ID NO: 1371242 - RNA, 20 nt, Human
gacucucagucucugagcag

SEQ ID NO: 1371243 - RNA, 18 nt, Human
gacucucagucucugagc

SEQ ID NO: 1371244 - RNA, 16 nt, Human
gacucucagucucuga

SEQ ID NO: 1371245 - RNA, 14 nt, Human
gacucucagucucu

SEQ ID NO: 1371246 - RNA, 14 nt, Human
gacucuauucuuua

SEQ ID NO: 1371247 - RNA, 21 nt, Human
gacugaguacguugugcauuu

SEQ ID NO: 1371248 - RNA, 22 nt, Human
gacugaguacguugugcauuug

SEQ ID NO: 1371249 - RNA, 18 nt, Human
gacucuauucuuuaacuc

SEQ ID NO: 1371250 - RNA, 19 nt, Human
gacucuagaguccaagguu

SEQ ID NO: 1371251 - RNA, 18 nt, Human
gacucuagaguccaaggu

SEQ ID NO: 1371252 - RNA, 16 nt, Human
gacucuagaguccaag

SEQ ID NO: 1371253 - RNA, 15 nt, Human
gacugagugggaagc

SEQ ID NO: 1371254 - RNA, 14 nt, Human
gacugagugggaag

SEQ ID NO: 1371255 - RNA, 15 nt, Human
gacucuauucuuuaa

SEQ ID NO: 1371256 - RNA, 23 nt, Human
gacugaguacguugugcauuugg

SEQ ID NO: 1371257 - RNA, 16 nt, Human
gacugcauuauauuua

SEQ ID NO: 1371258 - RNA, 14 nt, Human
gacugcauuauauu

SEQ ID NO: 1371259 - RNA, 24 nt, Human
gacugcauuauauuuauuacugua

SEQ ID NO: 1371260 - RNA, 18 nt, Human
gacugcuugcccuaagca

SEQ ID NO: 1371261 - RNA, 17 nt, Human
gacugcuugcccuaagc

SEQ ID NO: 1371262 - RNA, 15 nt, Human
gacugcuugcccuaa

SEQ ID NO: 1371263 - RNA, 13 nt, Human
gacugcuugcccu

SEQ ID NO: 1371264 - RNA, 12 nt, Human
gacugcuugccc

SEQ ID NO: 1371265 - RNA, 19 nt, Human
gacugcuguggccaggagg

SEQ ID NO: 1371266 - RNA, 20 nt, Human
gacugcuguggccaggaggu

SEQ ID NO: 1371267 - RNA, 18 nt, Human
gacugcuguggccaggag

SEQ ID NO: 1371268 - RNA, 17 nt, Human
gacugcuguggccagga

SEQ ID NO: 1371269 - RNA, 16 nt, Human
gacugcuguggccagg

SEQ ID NO: 1371270 - RNA, 15 nt, Human
gacugcuguggccag

SEQ ID NO: 1371271 - RNA, 12 nt, Human
gacugcuguggc

SEQ ID NO: 1371272 - RNA, 16 nt, Human
gacugcugguuuguag

SEQ ID NO: 1371273 - RNA, 15 nt, Human
gacugcugguuugua

SEQ ID NO: 1371274 - RNA, 15 nt, Human
gacuggaacacuaga

SEQ ID NO: 1371275 - RNA, 21 nt, Human
gacugcuuuggaccuaaaugg

SEQ ID NO: 1371276 - RNA, 23 nt, Human
gacugcuugcccuaagcagaaag

SEQ ID NO: 1371277 - RNA, 22 nt, Human
gacugcuugcccuaagcagaaa

SEQ ID NO: 1371278 - RNA, 21 nt, Human
gacugcuugcccuaagcagaa

SEQ ID NO: 1371279 - RNA, 20 nt, Human
gacugcuugcccuaagcaga

SEQ ID NO: 1371280 - RNA, 15 nt, Human
gacuggacagcuugu

SEQ ID NO: 1371281 - RNA, 16 nt, Human
gacuggauaguccguc

SEQ ID NO: 1371282 - RNA, 21 nt, Human
gacuggacagcuuguggcaag

SEQ ID NO: 1371283 - RNA, 14 nt, Human
gacuggacagcuug

SEQ ID NO: 1371284 - RNA, 13 nt, Human
gacuggacagcuu

SEQ ID NO: 1371285 - RNA, 20 nt, Human
gacuggaagcuaauuugcau

SEQ ID NO: 1371286 - RNA, 21 nt, Human
gacuggaagcuaauuugcauu

SEQ ID NO: 1371287 - RNA, 21 nt, Human
gacugggcugagggagccugg

SEQ ID NO: 1371288 - RNA, 16 nt, Human
gacugggcugagggag

SEQ ID NO: 1371289 - RNA, 15 nt, Human
gacugggcugaggga

SEQ ID NO: 1371290 - RNA, 14 nt, Human
gacugggcugaggg

SEQ ID NO: 1371291 - RNA, 22 nt, Human
gacugggagcccccagccuguc

SEQ ID NO: 1371292 - RNA, 23 nt, Human
gacugggagcccccagccuguca

SEQ ID NO: 1371293 - RNA, 13 nt, Human
gacuggggcaggg

SEQ ID NO: 1371294 - RNA, 11 nt, Human
gacuggggcag

SEQ ID NO: 1371295 - RNA, 14 nt, Human
gacuggggcagggu

SEQ ID NO: 1371296 - RNA, 17 nt, Human
gacuggguaggaaagag

SEQ ID NO: 1371297 - RNA, 13 nt, Human
gacuucuggggua

SEQ ID NO: 1371298 - RNA, 13 nt, Human
gacuucugagauc

SEQ ID NO: 1371299 - RNA, 17 nt, Human
gacuucugccuggagac

SEQ ID NO: 1371300 - RNA, 16 nt, Human
gacuucugccuggaga

SEQ ID NO: 1371301 - RNA, 15 nt, Human
gacuucugccuggag

SEQ ID NO: 1371302 - RNA, 14 nt, Human
gacuucugccugga

SEQ ID NO: 1371303 - RNA, 13 nt, Human
gacuucugccugg

SEQ ID NO: 1371304 - RNA, 12 nt, Human
gacuucugagau

SEQ ID NO: 1371305 - RNA, 18 nt, Human
gacuucucuuugccucaa

SEQ ID NO: 1371306 - RNA, 14 nt, Human
gacuucucuuugcc

SEQ ID NO: 1371307 - RNA, 17 nt, Human
gacuucuauuuuaaaga

SEQ ID NO: 1371308 - RNA, 21 nt, Human
gacuuaagcccagugcacuga

SEQ ID NO: 1371309 - RNA, 22 nt, Human
gacuuaagcaucuggcucuaau

SEQ ID NO: 1371310 - RNA, 20 nt, Human
gacuuaagcaucuggcucua

SEQ ID NO: 1371311 - RNA, 20 nt, Human
gacuugguugguaggguggg

SEQ ID NO: 1371312 - RNA, 17 nt, Human
gacuugguugguagggu

SEQ ID NO: 1371313 - RNA, 15 nt, Human
gacuugguugguagg

SEQ ID NO: 1371314 - RNA, 22 nt, Human
gacuugggcacccccagccugg

SEQ ID NO: 1371315 - RNA, 23 nt, Human
gacuugggcacccccagccuggg

SEQ ID NO: 1371316 - RNA, 21 nt, Human
gacuugggcacccccagccug

SEQ ID NO: 1371317 - RNA, 20 nt, Human
gacuugggcacccccagccu

SEQ ID NO: 1371318 - RNA, 19 nt, Human
gacuugggcacccccagcc

SEQ ID NO: 1371319 - RNA, 18 nt, Human
gacuugggcacccccagc

SEQ ID NO: 1371320 - RNA, 14 nt, Human
gacuugggcacccc

SEQ ID NO: 1371321 - RNA, 23 nt, Human
gacuuggcuggugugguacagag

SEQ ID NO: 1371322 - RNA, 22 nt, Human
gacuuggcuggugugguacaga

SEQ ID NO: 1371323 - RNA, 14 nt, Human
gacuuggcuggugu

SEQ ID NO: 1371324 - RNA, 16 nt, Human
gacuugacaguggaac

SEQ ID NO: 1371325 - RNA, 15 nt, Human
gacuuggccucucuc

SEQ ID NO: 1371326 - RNA, 14 nt, Human
gacuuggccucucu

SEQ ID NO: 1371327 - RNA, 13 nt, Human
gacuuggccucuc

SEQ ID NO: 1371328 - RNA, 12 nt, Human
gacuuggccucu

SEQ ID NO: 1371329 - RNA, 15 nt, Human
gacuuggccccugcc

SEQ ID NO: 1371330 - RNA, 13 nt, Human
gacuugaaagaaa

SEQ ID NO: 1371331 - RNA, 21 nt, Human
gagaaagggcccugggccugc

SEQ ID NO: 1371332 - RNA, 21 nt, Human
gagaaagcugacuuggcuggu

SEQ ID NO: 1371333 - RNA, 22 nt, Human
gagaaagcugacuuggcuggug

SEQ ID NO: 1371334 - RNA, 20 nt, Human
gagaaagcugacuuggcugg

SEQ ID NO: 1371335 - RNA, 15 nt, Human
gagaaagcugacuug

SEQ ID NO: 1371336 - RNA, 13 nt, Human
gagaaagcugacu

SEQ ID NO: 1371337 - RNA, 14 nt, Human
gagaaagcucaaag

SEQ ID NO: 1371338 - RNA, 19 nt, Human
gagaaagaggcaccaggaa

SEQ ID NO: 1371339 - RNA, 18 nt, Human
gagaaaggggagcccacu

SEQ ID NO: 1371340 - RNA, 17 nt, Human
gagaaaggggagcccac

SEQ ID NO: 1371341 - RNA, 19 nt, Human
gagaaauucguguguuuuu

SEQ ID NO: 1371342 - RNA, 17 nt, Human
gagaaauucguguguuu

SEQ ID NO: 1371343 - RNA, 21 nt, Human
gagaaaugaaaaaauauauau

SEQ ID NO: 1371344 - RNA, 22 nt, Human
gagaaccuagggugauauuaac

SEQ ID NO: 1371345 - RNA, 21 nt, Human
gagaaccuagggugauauuaa

SEQ ID NO: 1371346 - RNA, 23 nt, Human
gagaaccuggguugcagacagga

SEQ ID NO: 1371347 - RNA, 16 nt, Human
gagaaccuggccuuca

SEQ ID NO: 1371348 - RNA, 15 nt, Human
gagaaccuggccuuc

SEQ ID NO: 1371349 - RNA, 14 nt, Human
gagaaccuggccuu

SEQ ID NO: 1371350 - RNA, 13 nt, Human
gagaaccuggccu

SEQ ID NO: 1371351 - RNA, 12 nt, Human
gagaaccuggcc

SEQ ID NO: 1371352 - RNA, 14 nt, Human
gagaaauuuauaaa

SEQ ID NO: 1371353 - RNA, 13 nt, Human
gagaagaacugaa

SEQ ID NO: 1371354 - RNA, 16 nt, Human
gagaagaaagaacgga

SEQ ID NO: 1371355 - RNA, 21 nt, Human
gagaagaaagaacggaagaag

SEQ ID NO: 1371356 - RNA, 21 nt, Human
gagaaccuggguugcagacag

SEQ ID NO: 1371357 - RNA, 23 nt, Human
gagaacuuccagauccuggaaau

SEQ ID NO: 1371358 - RNA, 22 nt, Human
gagaacuuccagauccuggaaa

SEQ ID NO: 1371359 - RNA, 22 nt, Human
gagaagaaagaggugaccccag

SEQ ID NO: 1371360 - RNA, 18 nt, Human
gagaagcauucucauugg

SEQ ID NO: 1371361 - RNA, 18 nt, Human
gagaagccaaaagauugg

SEQ ID NO: 1371362 - RNA, 14 nt, Human
gagaagccagcuug

SEQ ID NO: 1371363 - RNA, 13 nt, Human
gagaagccagcuu

SEQ ID NO: 1371364 - RNA, 11 nt, Human
gagaagccagc

SEQ ID NO: 1371365 - RNA, 17 nt, Human
gagaaugagagacacac

SEQ ID NO: 1371366 - RNA, 16 nt, Human
gagagcagaggucucc

SEQ ID NO: 1371367 - RNA, 22 nt, Human
gagagcaagggaagugguucuu

SEQ ID NO: 1371368 - RNA, 22 nt, Human
gagagauguguguugauacugu

SEQ ID NO: 1371369 - RNA, 14 nt, Human
gagagauguguguu

SEQ ID NO: 1371370 - RNA, 13 nt, Human
gagagaugugugu

SEQ ID NO: 1371371 - RNA, 12 nt, Human
gagagaugugug

SEQ ID NO: 1371372 - RNA, 15 nt, Human
gagagaucaaagaug

SEQ ID NO: 1371373 - RNA, 14 nt, Human
gagagaucaaagau

SEQ ID NO: 1371374 - RNA, 13 nt, Human
gagagagcuggag

SEQ ID NO: 1371375 - RNA, 23 nt, Human
gagagcccgaggaggugucucag

SEQ ID NO: 1371376 - RNA, 18 nt, Human
gagagccccucacacagc

SEQ ID NO: 1371377 - RNA, 20 nt, Human
gagagcccaggagcuccccu

SEQ ID NO: 1371378 - RNA, 16 nt, Human
gagagcccaggagcuc

SEQ ID NO: 1371379 - RNA, 15 nt, Human
gagagcccaggagcu

SEQ ID NO: 1371380 - RNA, 14 nt, Human
gagagcccaggagc

SEQ ID NO: 1371381 - RNA, 17 nt, Human
gagagccugcaggaucu

SEQ ID NO: 1371382 - RNA, 14 nt, Human
gagagccugcagga

SEQ ID NO: 1371383 - RNA, 15 nt, Human
gagagcccugggacc

SEQ ID NO: 1371384 - RNA, 14 nt, Human
gagagcccugggac

SEQ ID NO: 1371385 - RNA, 13 nt, Human
gagagcccuggga

SEQ ID NO: 1371386 - RNA, 16 nt, Human
gagagacacugguggg

SEQ ID NO: 1371387 - RNA, 18 nt, Human
gagagacacuggugggga

SEQ ID NO: 1371388 - RNA, 21 nt, Human
gagagaaauaagugcccucuc

SEQ ID NO: 1371389 - RNA, 20 nt, Human
gagagacuuguuuuggaugc

SEQ ID NO: 1371390 - RNA, 12 nt, Human
gagagacuuguu

SEQ ID NO: 1371391 - RNA, 13 nt, Human
gagagacgggccc

SEQ ID NO: 1371392 - RNA, 17 nt, Human
gagagaccgaggaggga

SEQ ID NO: 1371393 - RNA, 19 nt, Human
gagagaccgaggagggaga

SEQ ID NO: 1371394 - RNA, 17 nt, Human
gagaguaaugaggcuug

SEQ ID NO: 1371395 - RNA, 19 nt, Human
gagagggggcuggugggug

SEQ ID NO: 1371396 - RNA, 13 nt, Human
gagagggggcugg

SEQ ID NO: 1371397 - RNA, 21 nt, Human
gagaggggccgaugcccagag

SEQ ID NO: 1371398 - RNA, 20 nt, Human
gagaggggccgaugcccaga

SEQ ID NO: 1371399 - RNA, 13 nt, Human
gagagucuagauu

SEQ ID NO: 1371400 - RNA, 15 nt, Human
gagagucucccaggg

SEQ ID NO: 1371401 - RNA, 16 nt, Human
gagagucucccaggga

SEQ ID NO: 1371402 - RNA, 16 nt, Human
gagagucuagauucuc

SEQ ID NO: 1371403 - RNA, 15 nt, Human
gagaguggggguggg

SEQ ID NO: 1371404 - RNA, 12 nt, Human
gagagugggggu

SEQ ID NO: 1371405 - RNA, 15 nt, Human
gagauaccagcgagg

SEQ ID NO: 1371406 - RNA, 11 nt, Human
gagagugugac

SEQ ID NO: 1371407 - RNA, 16 nt, Human
gagagaaaggacuccu

SEQ ID NO: 1371408 - RNA, 14 nt, Human
gagagaaaggacuc

SEQ ID NO: 1371409 - RNA, 14 nt, Human
gagacugggcugag

SEQ ID NO: 1371410 - RNA, 13 nt, Human
gagacugggcuga

SEQ ID NO: 1371411 - RNA, 22 nt, Human
gagacugggaaggcuugggauu

SEQ ID NO: 1371412 - RNA, 17 nt, Human
gagacugggaaggcuug

SEQ ID NO: 1371413 - RNA, 14 nt, Human
gagacugggaaggc

SEQ ID NO: 1371414 - RNA, 21 nt, Human
gagacugggcugagggagccu

SEQ ID NO: 1371415 - RNA, 20 nt, Human
gagacugggcugagggagcc

SEQ ID NO: 1371416 - RNA, 17 nt, Human
gagacugggcugaggga

SEQ ID NO: 1371417 - RNA, 15 nt, Human
gagacugggcugagg

SEQ ID NO: 1371418 - RNA, 15 nt, Human
gagacuggguaggaa

SEQ ID NO: 1371419 - RNA, 18 nt, Human
gagacaguucaagaaagc

SEQ ID NO: 1371420 - RNA, 16 nt, Human
gagacaguucaagaaa

SEQ ID NO: 1371421 - RNA, 19 nt, Human
gagacaggguuucaccaug

SEQ ID NO: 1371422 - RNA, 19 nt, Human
gagaauggcuuuggucucu

SEQ ID NO: 1371423 - RNA, 19 nt, Human
gagacagcuugaucaaagg

SEQ ID NO: 1371424 - RNA, 20 nt, Human
gagaaugcccuucuccuuau

SEQ ID NO: 1371425 - RNA, 15 nt, Human
gagaagccagcuugu

SEQ ID NO: 1371426 - RNA, 21 nt, Human
gagaaugagagacacacugaa

SEQ ID NO: 1371427 - RNA, 20 nt, Human
gagaaugagagacacacuga

SEQ ID NO: 1371428 - RNA, 23 nt, Human
gagcccaggccaggacucugcag

SEQ ID NO: 1371429 - RNA, 21 nt, Human
gagcccaggccaggacucugc

SEQ ID NO: 1371430 - RNA, 18 nt, Human
gagcccaggccaggacuc

SEQ ID NO: 1371431 - RNA, 17 nt, Human
gagcccaggccaggacu

SEQ ID NO: 1371432 - RNA, 16 nt, Human
gagcccaggccaggac

SEQ ID NO: 1371433 - RNA, 13 nt, Human
gagcccaggccag

SEQ ID NO: 1371434 - RNA, 21 nt, Human
gagcccaggagcuccccuccc

SEQ ID NO: 1371435 - RNA, 17 nt, Human
gagcccaggagcucccc

SEQ ID NO: 1371436 - RNA, 13 nt, Human
gagcccaggagcu

SEQ ID NO: 1371437 - RNA, 12 nt, Human
gagcccaggagc

SEQ ID NO: 1371438 - RNA, 22 nt, Human
gagcccagcugggucaggcagg

SEQ ID NO: 1371439 - RNA, 21 nt, Human
gagcccagcugggucaggcag

SEQ ID NO: 1371440 - RNA, 19 nt, Human
gagcccagcugggucaggc

SEQ ID NO: 1371441 - RNA, 13 nt, Human
gagcccagcuggg

SEQ ID NO: 1371442 - RNA, 21 nt, Human
gagcccagcucugaaaccagu

SEQ ID NO: 1371443 - RNA, 14 nt, Human
gagcccagcucuga

SEQ ID NO: 1371444 - RNA, 12 nt, Human
gagcccagcucu

SEQ ID NO: 1371445 - RNA, 14 nt, Human
gagcccagcuccaa

SEQ ID NO: 1371446 - RNA, 13 nt, Human
gagcccagcucca

SEQ ID NO: 1371447 - RNA, 12 nt, Human
gagcccagcucc

SEQ ID NO: 1371448 - RNA, 24 nt, Human
gagcccacuguccugggccugcag

SEQ ID NO: 1371449 - RNA, 19 nt, Human
gagcccacuguccugggcc

SEQ ID NO: 1371450 - RNA, 17 nt, Human
gagccagggucuccaga

SEQ ID NO: 1371451 - RNA, 22 nt, Human
gagccagggucuccagaaagcc

SEQ ID NO: 1371452 - RNA, 13 nt, Human
gagccaccaguuc

SEQ ID NO: 1371453 - RNA, 21 nt, Human
gagccagcagccuggcucucc

SEQ ID NO: 1371454 - RNA, 22 nt, Human
gagcauguuuagacuuuaacau

SEQ ID NO: 1371455 - RNA, 20 nt, Human
gagcaggacuccaggcccaa

SEQ ID NO: 1371456 - RNA, 15 nt, Human
gagcaugucguggac

SEQ ID NO: 1371457 - RNA, 19 nt, Human
gagcaggacuccaggccca

SEQ ID NO: 1371458 - RNA, 16 nt, Human
gagcaggacuccaggc

SEQ ID NO: 1371459 - RNA, 15 nt, Human
gagcaggacuccagg

SEQ ID NO: 1371460 - RNA, 14 nt, Human
gagcaggaauggga

SEQ ID NO: 1371461 - RNA, 20 nt, Human
gagcagcugagcagggccgg

SEQ ID NO: 1371462 - RNA, 19 nt, Human
gagcagcugagcagggccg

SEQ ID NO: 1371463 - RNA, 18 nt, Human
gagcagcugagcagggcc

SEQ ID NO: 1371464 - RNA, 17 nt, Human
gagcagcugagcagggc

SEQ ID NO: 1371465 - RNA, 16 nt, Human
gagcagcugagcaggg

SEQ ID NO: 1371466 - RNA, 15 nt, Human
gagcagcugagcagg

SEQ ID NO: 1371467 - RNA, 14 nt, Human
gagcagcugagcag

SEQ ID NO: 1371468 - RNA, 17 nt, Human
gagcagcgagccugcua

SEQ ID NO: 1371469 - RNA, 13 nt, Human
gagcagcugagca

SEQ ID NO: 1371470 - RNA, 15 nt, Human
gagcagcgagccugc

SEQ ID NO: 1371471 - RNA, 16 nt, Human
gagccaagggauggac

SEQ ID NO: 1371472 - RNA, 15 nt, Human
gagccaagggaugga

SEQ ID NO: 1371473 - RNA, 14 nt, Human
gagccaagggaugg

SEQ ID NO: 1371474 - RNA, 20 nt, Human
gagcauuucucaucaguagu

SEQ ID NO: 1371475 - RNA, 19 nt, Human
gagcauuucucaucaguag

SEQ ID NO: 1371476 - RNA, 15 nt, Human
gagcauuucucauca

SEQ ID NO: 1371477 - RNA, 12 nt, Human
gagccaccaguu

SEQ ID NO: 1371478 - RNA, 18 nt, Human
gagccaaggggcuucagg

SEQ ID NO: 1371479 - RNA, 22 nt, Human
gagccaagggauggacaucuug

SEQ ID NO: 1371480 - RNA, 19 nt, Human
gagccaagggauggacauc

SEQ ID NO: 1371481 - RNA, 18 nt, Human
gagccaagggauggacau

SEQ ID NO: 1371482 - RNA, 17 nt, Human
gagccaagggauggaca

SEQ ID NO: 1371483 - RNA, 18 nt, Human
gagcaagcaggaaucaga

SEQ ID NO: 1371484 - RNA, 16 nt, Human
gagcacaaagacccug

SEQ ID NO: 1371485 - RNA, 22 nt, Human
gagcaaccguggcccuuccugg

SEQ ID NO: 1371486 - RNA, 21 nt, Human
gagcaaccguggcccuuccug

SEQ ID NO: 1371487 - RNA, 20 nt, Human
gagcaaccguggcccuuccu

SEQ ID NO: 1371488 - RNA, 16 nt, Human
gagcaaccguggcccu

SEQ ID NO: 1371489 - RNA, 15 nt, Human
gagcaaccguggccc

SEQ ID NO: 1371490 - RNA, 23 nt, Human
gagcaaccguggcccuuccugga

SEQ ID NO: 1371491 - RNA, 20 nt, Human
gagcaagaccccaucucaaa

SEQ ID NO: 1371492 - RNA, 20 nt, Human
gagcacaaagacccuggcuu

SEQ ID NO: 1371493 - RNA, 23 nt, Human
gagcacggcucuguccccagccu

SEQ ID NO: 1371494 - RNA, 22 nt, Human
gagcacggcucuguccccagcc

SEQ ID NO: 1371495 - RNA, 13 nt, Human
gagcacggcucug

SEQ ID NO: 1371496 - RNA, 17 nt, Human
gagcacugccaggaggg

SEQ ID NO: 1371497 - RNA, 16 nt, Human
gagcacugccaggagg

SEQ ID NO: 1371498 - RNA, 15 nt, Human
gagcacugccaggag

SEQ ID NO: 1371499 - RNA, 14 nt, Human
gagcacugccagga

SEQ ID NO: 1371500 - RNA, 13 nt, Human
gagcacugccagg

SEQ ID NO: 1371501 - RNA, 12 nt, Human
gagcacugccag

SEQ ID NO: 1371502 - RNA, 23 nt, Human
gagcagacuggcggggggcccau

SEQ ID NO: 1371503 - RNA, 19 nt, Human
gagcacugccaggagggac

SEQ ID NO: 1371504 - RNA, 18 nt, Human
gagcacugccaggaggga

SEQ ID NO: 1371505 - RNA, 20 nt, Human
gagcacugccaggagggaca

SEQ ID NO: 1371506 - RNA, 14 nt, Human
gagcagacuacagc

SEQ ID NO: 1371507 - RNA, 22 nt, Human
gagauccaaaagaagcccccag

SEQ ID NO: 1371508 - RNA, 21 nt, Human
gagauccaaaagaagccccca

SEQ ID NO: 1371509 - RNA, 21 nt, Human
gagaucaccaguguguggcuu

SEQ ID NO: 1371510 - RNA, 12 nt, Human
gagauccuccug

SEQ ID NO: 1371511 - RNA, 18 nt, Human
gagauccagggcaaggcc

SEQ ID NO: 1371512 - RNA, 20 nt, Human
gagaucccaacacugccagc

SEQ ID NO: 1371513 - RNA, 19 nt, Human
gagaucccaacacugccag

SEQ ID NO: 1371514 - RNA, 18 nt, Human
gagaucccaacacugcca

SEQ ID NO: 1371515 - RNA, 22 nt, Human
gagaugauacauccaaagcaga

SEQ ID NO: 1371516 - RNA, 15 nt, Human
gagaugaggccagac

SEQ ID NO: 1371517 - RNA, 13 nt, Human
gagaugaggccag

SEQ ID NO: 1371518 - RNA, 14 nt, Human
gagaugaggccaga

SEQ ID NO: 1371519 - RNA, 12 nt, Human
gagcccugucuc

SEQ ID NO: 1371520 - RNA, 22 nt, Human
gagcccaggccaggacucugca

SEQ ID NO: 1371521 - RNA, 21 nt, Human
gagcccuucuauacccaccca

SEQ ID NO: 1371522 - RNA, 22 nt, Human
gagcccuucuauacccacccag

SEQ ID NO: 1371523 - RNA, 22 nt, Human
gaggcaaugggagcugaggcca

SEQ ID NO: 1371524 - RNA, 13 nt, Human
gaggcaaaagaag

SEQ ID NO: 1371525 - RNA, 16 nt, Human
gaggcagagaagaaag

SEQ ID NO: 1371526 - RNA, 23 nt, Human
gaggcagggaacauggggaggag

SEQ ID NO: 1371527 - RNA, 14 nt, Human
gaggcagggaagga

SEQ ID NO: 1371528 - RNA, 18 nt, Human
gaggcagagaagaaagaa

SEQ ID NO: 1371529 - RNA, 14 nt, Human
gaggcccccagccc

SEQ ID NO: 1371530 - RNA, 22 nt, Human
gaggccccagccucccugaagc

SEQ ID NO: 1371531 - RNA, 19 nt, Human
gaggccccagccucccuga

SEQ ID NO: 1371532 - RNA, 13 nt, Human
gaggccccagccu

SEQ ID NO: 1371533 - RNA, 12 nt, Human
gaggccccagcc

SEQ ID NO: 1371534 - RNA, 15 nt, Human
gaggccccaacccug

SEQ ID NO: 1371535 - RNA, 20 nt, Human
gaggcccaguucacccugau

SEQ ID NO: 1371536 - RNA, 18 nt, Human
gaggcccaguucacccug

SEQ ID NO: 1371537 - RNA, 13 nt, Human
gaggcccaguuca

SEQ ID NO: 1371538 - RNA, 23 nt, Human
gaggcccaggcugggaacucauc

SEQ ID NO: 1371539 - RNA, 17 nt, Human
gaggcccaggcugggaa

SEQ ID NO: 1371540 - RNA, 16 nt, Human
gaggcccaggcuggga

SEQ ID NO: 1371541 - RNA, 15 nt, Human
gaggcccaggcuggg

SEQ ID NO: 1371542 - RNA, 18 nt, Human
gaggcccaggcugccguc

SEQ ID NO: 1371543 - RNA, 13 nt, Human
gaggccccagccg

SEQ ID NO: 1371544 - RNA, 23 nt, Human
gaggccccagccucccugaagcc

SEQ ID NO: 1371545 - RNA, 17 nt, Human
gaggcccaggcugccgu

SEQ ID NO: 1371546 - RNA, 16 nt, Human
gaggcccaggcugccg

SEQ ID NO: 1371547 - RNA, 15 nt, Human
gaggcccaggcugcc

SEQ ID NO: 1371548 - RNA, 14 nt, Human
gaggcccaggcugc

SEQ ID NO: 1371549 - RNA, 13 nt, Human
gaggcccaggcug

SEQ ID NO: 1371550 - RNA, 20 nt, Human
gaggcccacauuggaagagc

SEQ ID NO: 1371551 - RNA, 18 nt, Human
gaggcccacauuggaaga

SEQ ID NO: 1371552 - RNA, 19 nt, Human
gaggccauugugugagccu

SEQ ID NO: 1371553 - RNA, 22 nt, Human
gaggccauggacucuguccuga

SEQ ID NO: 1371554 - RNA, 20 nt, Human
gaggccauggacucuguccu

SEQ ID NO: 1371555 - RNA, 19 nt, Human
gaggccauggacucugucc

SEQ ID NO: 1371556 - RNA, 18 nt, Human
gaggccuaggaggguccu

SEQ ID NO: 1371557 - RNA, 18 nt, Human
gaggccuaccccgcagac

SEQ ID NO: 1371558 - RNA, 15 nt, Human
gaggccuaggagggu

SEQ ID NO: 1371559 - RNA, 20 nt, Human
gaggcgaagcguuguccuca

SEQ ID NO: 1371560 - RNA, 22 nt, Human
gaggcugcucggggugcacagg

SEQ ID NO: 1371561 - RNA, 21 nt, Human
gaggcugcucggggugcacag

SEQ ID NO: 1371562 - RNA, 18 nt, Human
gaggcugcucggggugca

SEQ ID NO: 1371563 - RNA, 13 nt, Human
gaggcugcucggg

SEQ ID NO: 1371564 - RNA, 21 nt, Human
gaggcgccccaacccguggag

SEQ ID NO: 1371565 - RNA, 22 nt, Human
gaggcgccccaacccguggagg

SEQ ID NO: 1371566 - RNA, 20 nt, Human
gaggcgccccaacccgugga

SEQ ID NO: 1371567 - RNA, 17 nt, Human
gaggcgccccaacccgu

SEQ ID NO: 1371568 - RNA, 21 nt, Human
gaggcgaagcguuguccucag

SEQ ID NO: 1371569 - RNA, 21 nt, Human
gaggcgcaugaauuugugaag

SEQ ID NO: 1371570 - RNA, 13 nt, Human
gaggcuggcacag

SEQ ID NO: 1371571 - RNA, 23 nt, Human
gaggcugcucggggugcacagga

SEQ ID NO: 1371572 - RNA, 24 nt, Human
gaggcugcucggggugcacaggag

SEQ ID NO: 1371573 - RNA, 23 nt, Human
gaggcugggaauggaggggcaga

SEQ ID NO: 1371574 - RNA, 23 nt, Human
gagggcaguucgcagccacccug

SEQ ID NO: 1371575 - RNA, 20 nt, Human
gagggcaguucgcagccacc

SEQ ID NO: 1371576 - RNA, 19 nt, Human
gagggcaguucgcagccac

SEQ ID NO: 1371577 - RNA, 18 nt, Human
gagggcaguucgcagcca

SEQ ID NO: 1371578 - RNA, 19 nt, Human
gagggcagcagggcuaccc

SEQ ID NO: 1371579 - RNA, 16 nt, Human
gagggcagcagggcua

SEQ ID NO: 1371580 - RNA, 16 nt, Human
gagggccacaugggag

SEQ ID NO: 1371581 - RNA, 14 nt, Human
gagggggagagggc

SEQ ID NO: 1371582 - RNA, 21 nt, Human
gagggauucugguuccagggu

SEQ ID NO: 1371583 - RNA, 18 nt, Human
gagggauucugguuccag

SEQ ID NO: 1371584 - RNA, 15 nt, Human
gagggcagcagggcu

SEQ ID NO: 1371585 - RNA, 14 nt, Human
gagggcagcagggc

SEQ ID NO: 1371586 - RNA, 12 nt, Human
gagggcagcagg

SEQ ID NO: 1371587 - RNA, 23 nt, Human
gagggcagcagccagcccugccu

SEQ ID NO: 1371588 - RNA, 22 nt, Human
gagggcagcagccagcccugcc

SEQ ID NO: 1371589 - RNA, 21 nt, Human
gagggcagcagccagcccugc

SEQ ID NO: 1371590 - RNA, 20 nt, Human
gagggcagcagccagcccug

SEQ ID NO: 1371591 - RNA, 17 nt, Human
gagggcagcagccagcc

SEQ ID NO: 1371592 - RNA, 16 nt, Human
gagggcagcagccagc

SEQ ID NO: 1371593 - RNA, 15 nt, Human
gagggcagcagccag

SEQ ID NO: 1371594 - RNA, 14 nt, Human
gagggcagcagcca

SEQ ID NO: 1371595 - RNA, 21 nt, Human
gagggguguggcuccuuccca

SEQ ID NO: 1371596 - RNA, 15 nt, Human
gaggggugggcuggu

SEQ ID NO: 1371597 - RNA, 19 nt, Human
gagggguaggggcugggaa

SEQ ID NO: 1371598 - RNA, 17 nt, Human
gagggguaggggcuggg

SEQ ID NO: 1371599 - RNA, 23 nt, Human
gagggguuccuccccuccagcuc

SEQ ID NO: 1371600 - RNA, 22 nt, Human
gagggguuccuccccuccagcu

SEQ ID NO: 1371601 - RNA, 15 nt, Human
gagggguuccucccc

SEQ ID NO: 1371602 - RNA, 13 nt, Human
gagggcagcagcc

SEQ ID NO: 1371603 - RNA, 17 nt, Human
gagggggaauggcagca

SEQ ID NO: 1371604 - RNA, 15 nt, Human
gagggguaggggcug

SEQ ID NO: 1371605 - RNA, 16 nt, Human
gagggaugaugaagag

SEQ ID NO: 1371606 - RNA, 18 nt, Human
gagggagugaguggcccu

SEQ ID NO: 1371607 - RNA, 21 nt, Human
gagggagacacuggccccuca

SEQ ID NO: 1371608 - RNA, 23 nt, Human
gaggcuguggucacagcggaggu

SEQ ID NO: 1371609 - RNA, 14 nt, Human
gaggcuguccugua

SEQ ID NO: 1371610 - RNA, 12 nt, Human
gaggcuguccug

SEQ ID NO: 1371611 - RNA, 16 nt, Human
gaggcugguccuaugg

SEQ ID NO: 1371612 - RNA, 18 nt, Human
gaggcugguccuauggcc

SEQ ID NO: 1371613 - RNA, 15 nt, Human
gaggcugguccuaug

SEQ ID NO: 1371614 - RNA, 22 nt, Human
gaggcugggaauggaggggcag

SEQ ID NO: 1371615 - RNA, 16 nt, Human
gagggagagucuccca

SEQ ID NO: 1371616 - RNA, 22 nt, Human
gagggagcaaguccuucccuuu

SEQ ID NO: 1371617 - RNA, 18 nt, Human
gaggguaggcaggauugg

SEQ ID NO: 1371618 - RNA, 22 nt, Human
gaggguaggcaggauuggggaa

SEQ ID NO: 1371619 - RNA, 15 nt, Human
gaggguaggcaggau

SEQ ID NO: 1371620 - RNA, 14 nt, Human
gaggguaggcagga

SEQ ID NO: 1371621 - RNA, 13 nt, Human
gaggguaggcagg

SEQ ID NO: 1371622 - RNA, 21 nt, Human
gaggguaggagggugggaagg

SEQ ID NO: 1371623 - RNA, 15 nt, Human
gagggucggugccuu

SEQ ID NO: 1371624 - RNA, 17 nt, Human
gagggucugggggcaca

SEQ ID NO: 1371625 - RNA, 13 nt, Human
gagggugggaagg

SEQ ID NO: 1371626 - RNA, 16 nt, Human
gagggugaguuggcuu

SEQ ID NO: 1371627 - RNA, 21 nt, Human
gagggugaagugaagacaaug

SEQ ID NO: 1371628 - RNA, 19 nt, Human
gagguauuuaucuuuacuu

SEQ ID NO: 1371629 - RNA, 13 nt, Human
gaggguguccugc

SEQ ID NO: 1371630 - RNA, 20 nt, Human
gagggugguucaacaaagaa

SEQ ID NO: 1371631 - RNA, 12 nt, Human
gagguaaguuuu

SEQ ID NO: 1371632 - RNA, 16 nt, Human
gaguaacauuugcugu

SEQ ID NO: 1371633 - RNA, 15 nt, Human
gaguaacauuugcug

SEQ ID NO: 1371634 - RNA, 13 nt, Human
gaguaacauuugc

SEQ ID NO: 1371635 - RNA, 21 nt, Human
gaguaacaauacaaauggauu

SEQ ID NO: 1371636 - RNA, 20 nt, Human
gaguaacaauacaaauggau

SEQ ID NO: 1371637 - RNA, 19 nt, Human
gaguaacaauacaaaugga

SEQ ID NO: 1371638 - RNA, 15 nt, Human
gaguaacaauacaaa

SEQ ID NO: 1371639 - RNA, 14 nt, Human
gagguugggugggc

SEQ ID NO: 1371640 - RNA, 14 nt, Human
gagguucuaaggcc

SEQ ID NO: 1371641 - RNA, 19 nt, Human
gaggugggccguggcccuu

SEQ ID NO: 1371642 - RNA, 23 nt, Human
gaggucagcaugucuauucagcu

SEQ ID NO: 1371643 - RNA, 21 nt, Human
gaggugggccagucuguggau

SEQ ID NO: 1371644 - RNA, 21 nt, Human
gaggucagcacaucucaacag

SEQ ID NO: 1371645 - RNA, 16 nt, Human
gagguguccaacuggc

SEQ ID NO: 1371646 - RNA, 15 nt, Human
gagguguccaacugg

SEQ ID NO: 1371647 - RNA, 14 nt, Human
gaggugggccgugg

SEQ ID NO: 1371648 - RNA, 16 nt, Human
gagguguggagccgag

SEQ ID NO: 1371649 - RNA, 19 nt, Human
gaggugucucaggcugccu

SEQ ID NO: 1371650 - RNA, 17 nt, Human
gaggugucucaggcugc

SEQ ID NO: 1371651 - RNA, 16 nt, Human
gaggugucucaggcug

SEQ ID NO: 1371652 - RNA, 15 nt, Human
gaggugucucaggcu

SEQ ID NO: 1371653 - RNA, 14 nt, Human
gaggugucucaggc

SEQ ID NO: 1371654 - RNA, 13 nt, Human
gaggugucucagg

SEQ ID NO: 1371655 - RNA, 20 nt, Human
gaggugucucaggcugccug

SEQ ID NO: 1371656 - RNA, 18 nt, Human
gagguugaaaaacaaaau

SEQ ID NO: 1371657 - RNA, 17 nt, Human
gaguagaauugcauuga

SEQ ID NO: 1371658 - RNA, 14 nt, Human
gaguagaauugcau

SEQ ID NO: 1371659 - RNA, 20 nt, Human
gaguacuccacacugcacaa

SEQ ID NO: 1371660 - RNA, 15 nt, Human
gaguagaaaggccuu

SEQ ID NO: 1371661 - RNA, 17 nt, Human
gaguagaaaggccuuua

SEQ ID NO: 1371662 - RNA, 23 nt, Human
gaguagaaaggccuuuaaaauuu

SEQ ID NO: 1371663 - RNA, 19 nt, Human
gaguagaaacugcagggaa

SEQ ID NO: 1371664 - RNA, 17 nt, Human
gaguacuccacacugca

SEQ ID NO: 1371665 - RNA, 16 nt, Human
gaguacuccacacugc

SEQ ID NO: 1371666 - RNA, 21 nt, Human
gaguacuccacacugcacaau

SEQ ID NO: 1371667 - RNA, 22 nt, Human
gaguaaugguguagaacacuaa

SEQ ID NO: 1371668 - RNA, 19 nt, Human
gaguaaugguguagaacac

SEQ ID NO: 1371669 - RNA, 17 nt, Human
gaguaaugguguagaac

SEQ ID NO: 1371670 - RNA, 14 nt, Human
gaguaaugguguag

SEQ ID NO: 1371671 - RNA, 13 nt, Human
gaguaaucaaucu

SEQ ID NO: 1371672 - RNA, 16 nt, Human
gaguaauaugccugcu

SEQ ID NO: 1371673 - RNA, 17 nt, Human
gaguaacauuugcuguu

SEQ ID NO: 1371674 - RNA, 22 nt, Human
gaguaauccaagcaaaugugaa

SEQ ID NO: 1371675 - RNA, 23 nt, Human
gaguauuaaaauguaugcauguu

SEQ ID NO: 1371676 - RNA, 22 nt, Human
gaguauuaaaauguaugcaugu

SEQ ID NO: 1371677 - RNA, 14 nt, Human
gaguauuaaaaugu

SEQ ID NO: 1371678 - RNA, 23 nt, Human
gagucccugccuggaccagccuc

SEQ ID NO: 1371679 - RNA, 21 nt, Human
gagucccugccuggaccagcc

SEQ ID NO: 1371680 - RNA, 11 nt, Human
gagucuagauu

SEQ ID NO: 1371681 - RNA, 16 nt, Human
gagucuagauguuuau

SEQ ID NO: 1371682 - RNA, 11 nt, Human
gagucuagaug

SEQ ID NO: 1371683 - RNA, 22 nt, Human
gagucuaaagauggaguuucua

SEQ ID NO: 1371684 - RNA, 21 nt, Human
gagucuaaagauggaguuucu

SEQ ID NO: 1371685 - RNA, 13 nt, Human
gagucuaaagaug

SEQ ID NO: 1371686 - RNA, 12 nt, Human
gagucuaaagau

SEQ ID NO: 1371687 - RNA, 11 nt, Human
gagucuaaaga

SEQ ID NO: 1371688 - RNA, 22 nt, Human
gagucguggggugugcugggag

SEQ ID NO: 1371689 - RNA, 14 nt, Human
gaguccuuaaaaug

SEQ ID NO: 1371690 - RNA, 19 nt, Human
gaguccuggaugauacuaa

SEQ ID NO: 1371691 - RNA, 15 nt, Human
gagugaauaaauguc

SEQ ID NO: 1371692 - RNA, 14 nt, Human
gagugaauaaaugu

SEQ ID NO: 1371693 - RNA, 22 nt, Human
gagucuuugguucuaaggaccu

SEQ ID NO: 1371694 - RNA, 18 nt, Human
gagucuuugguucuaagg

SEQ ID NO: 1371695 - RNA, 17 nt, Human
gagucuuugguucuaag

SEQ ID NO: 1371696 - RNA, 16 nt, Human
gagucuuugguucuaa

SEQ ID NO: 1371697 - RNA, 15 nt, Human
gagucuuugguucua

SEQ ID NO: 1371698 - RNA, 14 nt, Human
gagucuuugguucu

SEQ ID NO: 1371699 - RNA, 20 nt, Human
gagucuugcucugucgccca

SEQ ID NO: 1371700 - RNA, 23 nt, Human
gagucuggugaagcucacuucug

SEQ ID NO: 1371701 - RNA, 14 nt, Human
gagucuagauucuc

SEQ ID NO: 1371702 - RNA, 13 nt, Human
gagucuagauucu

SEQ ID NO: 1371703 - RNA, 23 nt, Human
gagucuagauucaaagguucuag

SEQ ID NO: 1371704 - RNA, 22 nt, Human
gagucuagauucaaagguucua

SEQ ID NO: 1371705 - RNA, 21 nt, Human
gagucuagauucaaagguucu

SEQ ID NO: 1371706 - RNA, 17 nt, Human
gagucuagauucaaagg

SEQ ID NO: 1371707 - RNA, 13 nt, Human
gagucuagauuca

SEQ ID NO: 1371708 - RNA, 21 nt, Human
gagucuauuuacggaacucaa

SEQ ID NO: 1371709 - RNA, 22 nt, Human
gauagauuuucugcuacuuugc

SEQ ID NO: 1371710 - RNA, 21 nt, Human
gauaacugaaaauuauuuaaa

SEQ ID NO: 1371711 - RNA, 20 nt, Human
gauaacugaaaauuauuuaa

SEQ ID NO: 1371712 - RNA, 13 nt, Human
gauagcugugacu

SEQ ID NO: 1371713 - RNA, 17 nt, Human
gauagcccuguccuggu

SEQ ID NO: 1371714 - RNA, 14 nt, Human
gauauaagugcugu

SEQ ID NO: 1371715 - RNA, 16 nt, Human
gauauaagugcuguau

SEQ ID NO: 1371716 - RNA, 21 nt, Human
gauagcccuguccugguggua

SEQ ID NO: 1371717 - RNA, 16 nt, Human
gauagcccuguccugg

SEQ ID NO: 1371718 - RNA, 15 nt, Human
gauagcccuguccug

SEQ ID NO: 1371719 - RNA, 23 nt, Human
gauagcaaagcgacguuagucgu

SEQ ID NO: 1371720 - RNA, 22 nt, Human
gaucacuuucucaguuuucaua

SEQ ID NO: 1371721 - RNA, 14 nt, Human
gaucagaaauacag

SEQ ID NO: 1371722 - RNA, 15 nt, Human
gaucagaaauacaga

SEQ ID NO: 1371723 - RNA, 17 nt, Human
gaucacaagauggaauu

SEQ ID NO: 1371724 - RNA, 14 nt, Human
gaucacaagaugga

SEQ ID NO: 1371725 - RNA, 13 nt, Human
gaucacaagaugg

SEQ ID NO: 1371726 - RNA, 12 nt, Human
gaucacaagaug

SEQ ID NO: 1371727 - RNA, 20 nt, Human
gaucacaacgugcauugugc

SEQ ID NO: 1371728 - RNA, 21 nt, Human
gaucacaacgugcauugugcu

SEQ ID NO: 1371729 - RNA, 22 nt, Human
gaucacaacgugcauugugcuu

SEQ ID NO: 1371730 - RNA, 23 nt, Human
gaucacaacgugcauugugcuuc

SEQ ID NO: 1371731 - RNA, 13 nt, Human
gaucacaaaaaca

SEQ ID NO: 1371732 - RNA, 21 nt, Human
gaucaauuauaguuucugagg

SEQ ID NO: 1371733 - RNA, 20 nt, Human
gaucaauuauaguuucugag

SEQ ID NO: 1371734 - RNA, 15 nt, Human
gaucacaacgugcau

SEQ ID NO: 1371735 - RNA, 16 nt, Human
gaucacaacgugcauu

SEQ ID NO: 1371736 - RNA, 17 nt, Human
gaucacaacgugcauug

SEQ ID NO: 1371737 - RNA, 18 nt, Human
gaucacaacgugcauugu

SEQ ID NO: 1371738 - RNA, 24 nt, Human
gauaugauucaaaugucuauaaac

SEQ ID NO: 1371739 - RNA, 22 nt, Human
gauaugauucaaaugucuauaa

SEQ ID NO: 1371740 - RNA, 14 nt, Human
gauaugauucaaau

SEQ ID NO: 1371741 - RNA, 15 nt, Human
gauauaagugugugu

SEQ ID NO: 1371742 - RNA, 18 nt, Human
gauauaagugcuguauaa

SEQ ID NO: 1371743 - RNA, 19 nt, Human
gauauaagugcuguauaaa

SEQ ID NO: 1371744 - RNA, 21 nt, Human
gauauaagugcuguauaaaau

SEQ ID NO: 1371745 - RNA, 22 nt, Human
gauauaagugcuguauaaaauc

SEQ ID NO: 1371746 - RNA, 15 nt, Human
gauaugaaagcugau

SEQ ID NO: 1371747 - RNA, 20 nt, Human
gauaucuuggacaaaucaca

SEQ ID NO: 1371748 - RNA, 23 nt, Human
gauauaagugcuguauaaaauca

SEQ ID NO: 1371749 - RNA, 17 nt, Human
gauauaaguguguguuu

SEQ ID NO: 1371750 - RNA, 17 nt, Human
gaguuacaguucugugg

SEQ ID NO: 1371751 - RNA, 16 nt, Human
gaguuacaguucugug

SEQ ID NO: 1371752 - RNA, 15 nt, Human
gaguuacaguucugu

SEQ ID NO: 1371753 - RNA, 14 nt, Human
gaguuacaguucug

SEQ ID NO: 1371754 - RNA, 13 nt, Human
gaguuacaguucu

SEQ ID NO: 1371755 - RNA, 21 nt, Human
gaguuaagaccuggcagcucu

SEQ ID NO: 1371756 - RNA, 17 nt, Human
gaguuaagaccuggcag

SEQ ID NO: 1371757 - RNA, 22 nt, Human
gauaaauggcuuccuggcaaua

SEQ ID NO: 1371758 - RNA, 15 nt, Human
gauaaaugauagaca

SEQ ID NO: 1371759 - RNA, 19 nt, Human
gaguguccucuucccucuc

SEQ ID NO: 1371760 - RNA, 18 nt, Human
gaguguagcaacuacagu

SEQ ID NO: 1371761 - RNA, 13 nt, Human
gaguguacaagua

SEQ ID NO: 1371762 - RNA, 21 nt, Human
gagugguuuaggcuauuugua

SEQ ID NO: 1371763 - RNA, 15 nt, Human
gaguggguggggagu

SEQ ID NO: 1371764 - RNA, 14 nt, Human
gaguggguggggag

SEQ ID NO: 1371765 - RNA, 13 nt, Human
gaguggggguggg

SEQ ID NO: 1371766 - RNA, 21 nt, Human
gagugggguuaucucuguguu

SEQ ID NO: 1371767 - RNA, 18 nt, Human
gagugaauucccucacuc

SEQ ID NO: 1371768 - RNA, 16 nt, Human
gagugaauucccucac

SEQ ID NO: 1371769 - RNA, 15 nt, Human
gagugaauucccuca

SEQ ID NO: 1371770 - RNA, 15 nt, Human
gaguguggacucugg

SEQ ID NO: 1371771 - RNA, 23 nt, Human
gagugugcgugguggucccuggg

SEQ ID NO: 1371772 - RNA, 18 nt, Human
gagugugcggcugugugu

SEQ ID NO: 1371773 - RNA, 14 nt, Human
gaguuaagaccugg

SEQ ID NO: 1371774 - RNA, 13 nt, Human
gaguuaagaccug

SEQ ID NO: 1371775 - RNA, 12 nt, Human
gaguuaagaccu

SEQ ID NO: 1371776 - RNA, 16 nt, Human
gcacagagagucugga

SEQ ID NO: 1371777 - RNA, 15 nt, Human
gcacagaguuguuac

SEQ ID NO: 1371778 - RNA, 14 nt, Human
gcacacuuugccau

SEQ ID NO: 1371779 - RNA, 13 nt, Human
gcacacuuugcca

SEQ ID NO: 1371780 - RNA, 20 nt, Human
gcacacuuugcacugauaua

SEQ ID NO: 1371781 - RNA, 13 nt, Human
gcacacugucugc

SEQ ID NO: 1371782 - RNA, 21 nt, Human
gcacacuuugguaccagauaa

SEQ ID NO: 1371783 - RNA, 22 nt, Human
gcacacuuugccauauuuucac

SEQ ID NO: 1371784 - RNA, 19 nt, Human
gcacaagacugacgccagg

SEQ ID NO: 1371785 - RNA, 12 nt, Human
gcacaagacuga

SEQ ID NO: 1371786 - RNA, 20 nt, Human
gcacaagacugacgccaggg

SEQ ID NO: 1371787 - RNA, 16 nt, Human
gcacaagaauggauca

SEQ ID NO: 1371788 - RNA, 15 nt, Human
gcacaagaauggauc

SEQ ID NO: 1371789 - RNA, 14 nt, Human
gcacaagaauggau

SEQ ID NO: 1371790 - RNA, 19 nt, Human
gcacaaauuaguuauauau

SEQ ID NO: 1371791 - RNA, 16 nt, Human
gcacaaauauuuauuu

SEQ ID NO: 1371792 - RNA, 15 nt, Human
gcacaaauauuuauu

SEQ ID NO: 1371793 - RNA, 14 nt, Human
gcacaaauauuuau

SEQ ID NO: 1371794 - RNA, 23 nt, Human
gcacaaauucugucucuggauua

SEQ ID NO: 1371795 - RNA, 13 nt, Human
gcacaaauauuua

SEQ ID NO: 1371796 - RNA, 18 nt, Human
gcacaaagacccuggcuu

SEQ ID NO: 1371797 - RNA, 17 nt, Human
gcacaaagacccuggcu

SEQ ID NO: 1371798 - RNA, 12 nt, Human
gcaauuuugugg

SEQ ID NO: 1371799 - RNA, 14 nt, Human
gcaauuuuguaacg

SEQ ID NO: 1371800 - RNA, 23 nt, Human
gcacaaaacccagaccuguuagc

SEQ ID NO: 1371801 - RNA, 13 nt, Human
gcacaaaacccag

SEQ ID NO: 1371802 - RNA, 14 nt, Human
gcaauuuugugguu

SEQ ID NO: 1371803 - RNA, 16 nt, Human
gcaauuuuuauauuaa

SEQ ID NO: 1371804 - RNA, 19 nt, Human
gcaauuucuaauuuuuaag

SEQ ID NO: 1371805 - RNA, 22 nt, Human
gcaauuucuaauuuuuaagaau

SEQ ID NO: 1371806 - RNA, 17 nt, Human
gcaauuucuaauuuuua

SEQ ID NO: 1371807 - RNA, 18 nt, Human
gcaauuuccuuuuuuguu

SEQ ID NO: 1371808 - RNA, 18 nt, Human
gcaauuucaagguucuaa

SEQ ID NO: 1371809 - RNA, 13 nt, Human
gcaauuucaaggu

SEQ ID NO: 1371810 - RNA, 13 nt, Human
gcaauugccuuuu

SEQ ID NO: 1371811 - RNA, 12 nt, Human
gcaauugccuuu

SEQ ID NO: 1371812 - RNA, 23 nt, Human
gcaauuggcaccgaagcccagag

SEQ ID NO: 1371813 - RNA, 13 nt, Human
gcaauuuaaaugu

SEQ ID NO: 1371814 - RNA, 12 nt, Human
gcaauugucuga

SEQ ID NO: 1371815 - RNA, 18 nt, Human
gcaauuuaaauguuauga

SEQ ID NO: 1371816 - RNA, 18 nt, Human
gcaauguguguauaugga

SEQ ID NO: 1371817 - RNA, 16 nt, Human
gcaauguguguauaug

SEQ ID NO: 1371818 - RNA, 14 nt, Human
gcaauguguguaua

SEQ ID NO: 1371819 - RNA, 23 nt, Human
gcaauguguauaaacaagaaaaa

SEQ ID NO: 1371820 - RNA, 20 nt, Human
gcaauguguauaaacaagaa

SEQ ID NO: 1371821 - RNA, 17 nt, Human
gcaauguguauaaacaa

SEQ ID NO: 1371822 - RNA, 16 nt, Human
gcaauguguauaaaca

SEQ ID NO: 1371823 - RNA, 23 nt, Human
gcaauguaaauauuuuaaagaau

SEQ ID NO: 1371824 - RNA, 20 nt, Human
gcaauguuaauuuaguggaa

SEQ ID NO: 1371825 - RNA, 20 nt, Human
gcaauguguguauauggaca

SEQ ID NO: 1371826 - RNA, 19 nt, Human
gcaauguguguauauggac

SEQ ID NO: 1371827 - RNA, 16 nt, Human
gcaauuaauuccuuca

SEQ ID NO: 1371828 - RNA, 20 nt, Human
gcaauuacaacggagucaaa

SEQ ID NO: 1371829 - RNA, 21 nt, Human
gcaauuccccucugcugcugu

SEQ ID NO: 1371830 - RNA, 18 nt, Human
gcaauuccccucugcugc

SEQ ID NO: 1371831 - RNA, 14 nt, Human
gcaauuccccucug

SEQ ID NO: 1371832 - RNA, 22 nt, Human
gcaauucaaaaguuccaagagu

SEQ ID NO: 1371833 - RNA, 16 nt, Human
gcaauucaaaaguucc

SEQ ID NO: 1371834 - RNA, 19 nt, Human
gcaauuaauuccuucagca

SEQ ID NO: 1371835 - RNA, 18 nt, Human
gcaacgcuauuccagcug

SEQ ID NO: 1371836 - RNA, 22 nt, Human
gcaacucaaggacuuugcagcc

SEQ ID NO: 1371837 - RNA, 23 nt, Human
gcaacuaucagacuaagccagca

SEQ ID NO: 1371838 - RNA, 22 nt, Human
gcaacuaucagacuaagccagc

SEQ ID NO: 1371839 - RNA, 19 nt, Human
gcaacuaucagacuaagcc

SEQ ID NO: 1371840 - RNA, 17 nt, Human
gcaacgcuauuccagcu

SEQ ID NO: 1371841 - RNA, 19 nt, Human
gcaauguaaauauuuuaaa

SEQ ID NO: 1371842 - RNA, 18 nt, Human
gcaauguaaauauuuuaa

SEQ ID NO: 1371843 - RNA, 15 nt, Human
gcaauguaaauauuu

SEQ ID NO: 1371844 - RNA, 13 nt, Human
gcaauguaaauau

SEQ ID NO: 1371845 - RNA, 20 nt, Human
gcaaugggagcugaggccac

SEQ ID NO: 1371846 - RNA, 19 nt, Human
gcaaugggagcugaggcca

SEQ ID NO: 1371847 - RNA, 13 nt, Human
gcaacucugaagg

SEQ ID NO: 1371848 - RNA, 18 nt, Human
gcaccaaaagaaguaaaa

SEQ ID NO: 1371849 - RNA, 16 nt, Human
gcaccaaaagaaguaa

SEQ ID NO: 1371850 - RNA, 15 nt, Human
gcaccaaaagaagua

SEQ ID NO: 1371851 - RNA, 14 nt, Human
gcaccaggaagccg

SEQ ID NO: 1371852 - RNA, 14 nt, Human
gcaccaaaagaagu

SEQ ID NO: 1371853 - RNA, 18 nt, Human
gcaccagggguuucucgc

SEQ ID NO: 1371854 - RNA, 16 nt, Human
gcaccagggguuucuc

SEQ ID NO: 1371855 - RNA, 18 nt, Human
gcaccaggaagccguccu

SEQ ID NO: 1371856 - RNA, 23 nt, Human
gcaccaggguugaccccagagga

SEQ ID NO: 1371857 - RNA, 19 nt, Human
gcaccagggguuucucgca

SEQ ID NO: 1371858 - RNA, 12 nt, Human
gcacauguuucc

SEQ ID NO: 1371859 - RNA, 19 nt, Human
gcacagugacuucugagau

SEQ ID NO: 1371860 - RNA, 18 nt, Human
gcacagugacuucugaga

SEQ ID NO: 1371861 - RNA, 17 nt, Human
gcacagugacuucugag

SEQ ID NO: 1371862 - RNA, 16 nt, Human
gcacagugacuucuga

SEQ ID NO: 1371863 - RNA, 16 nt, Human
gcacagucacugcucu

SEQ ID NO: 1371864 - RNA, 15 nt, Human
gcacaguauuuguaa

SEQ ID NO: 1371865 - RNA, 22 nt, Human
gcacagaguuguuacauuuuua

SEQ ID NO: 1371866 - RNA, 16 nt, Human
gcacagaguuguuaca

SEQ ID NO: 1371867 - RNA, 18 nt, Human
gcacagaguuguuacauu

SEQ ID NO: 1371868 - RNA, 19 nt, Human
gcacagaguuguuacauuu

SEQ ID NO: 1371869 - RNA, 21 nt, Human
gcacagaguuguuacauuuuu

SEQ ID NO: 1371870 - RNA, 22 nt, Human
gcaccugucccagaaaaagcau

SEQ ID NO: 1371871 - RNA, 19 nt, Human
gcaccugucccagaaaaag

SEQ ID NO: 1371872 - RNA, 15 nt, Human
gcaccugucccagaa

SEQ ID NO: 1371873 - RNA, 13 nt, Human
gcacgauuucugu

SEQ ID NO: 1371874 - RNA, 15 nt, Human
gcacgauuucuguuu

SEQ ID NO: 1371875 - RNA, 18 nt, Human
gcaccuguaaugugcgag

SEQ ID NO: 1371876 - RNA, 22 nt, Human
gcaccugguggccaugcuccuc

SEQ ID NO: 1371877 - RNA, 22 nt, Human
gcaccugggcccuggggccugu

SEQ ID NO: 1371878 - RNA, 23 nt, Human
gcaccugggcccuggggccugua

SEQ ID NO: 1371879 - RNA, 20 nt, Human
gcaccugggcccuggggccu

SEQ ID NO: 1371880 - RNA, 19 nt, Human
gcaccugggcccuggggcc

SEQ ID NO: 1371881 - RNA, 18 nt, Human
gcaccugggcccuggggc

SEQ ID NO: 1371882 - RNA, 23 nt, Human
gcacccccagccugggccuaugg

SEQ ID NO: 1371883 - RNA, 14 nt, Human
gcaccccccaagcu

SEQ ID NO: 1371884 - RNA, 21 nt, Human
gcacccccagccugggccuau

SEQ ID NO: 1371885 - RNA, 20 nt, Human
gcacccccagccugggccua

SEQ ID NO: 1371886 - RNA, 19 nt, Human
gcacccccagccugggccu

SEQ ID NO: 1371887 - RNA, 18 nt, Human
gcacccccagccugggcc

SEQ ID NO: 1371888 - RNA, 17 nt, Human
gcacccccagccugggc

SEQ ID NO: 1371889 - RNA, 16 nt, Human
gcacccccagccuggg

SEQ ID NO: 1371890 - RNA, 15 nt, Human
gcacccccagccugg

SEQ ID NO: 1371891 - RNA, 14 nt, Human
gcacccccagccug

SEQ ID NO: 1371892 - RNA, 13 nt, Human
gcacccccagccu

SEQ ID NO: 1371893 - RNA, 12 nt, Human
gcacccccagcc

SEQ ID NO: 1371894 - RNA, 22 nt, Human
gcaccccagcuggggccaggcu

SEQ ID NO: 1371895 - RNA, 23 nt, Human
gcagacagagccaggagaagcuc

SEQ ID NO: 1371896 - RNA, 22 nt, Human
gcagacagagccaggagaagcu

SEQ ID NO: 1371897 - RNA, 21 nt, Human
gcagacagagccaggagaagc

SEQ ID NO: 1371898 - RNA, 18 nt, Human
gcagacagagccaggaga

SEQ ID NO: 1371899 - RNA, 17 nt, Human
gcagacagagccaggag

SEQ ID NO: 1371900 - RNA, 16 nt, Human
gcagacagagccagga

SEQ ID NO: 1371901 - RNA, 15 nt, Human
gcagacagagccagg

SEQ ID NO: 1371902 - RNA, 14 nt, Human
gcagacagagccag

SEQ ID NO: 1371903 - RNA, 13 nt, Human
gcagacagagcca

SEQ ID NO: 1371904 - RNA, 12 nt, Human
gcagacagagcc

SEQ ID NO: 1371905 - RNA, 15 nt, Human
gcagacaccuuggac

SEQ ID NO: 1371906 - RNA, 18 nt, Human
gcacugugaaggacccuu

SEQ ID NO: 1371907 - RNA, 17 nt, Human
gcacugugaaggacccu

SEQ ID NO: 1371908 - RNA, 16 nt, Human
gcacugugaaggaccc

SEQ ID NO: 1371909 - RNA, 14 nt, Human
gcacugugaaggac

SEQ ID NO: 1371910 - RNA, 11 nt, Human
gcacugugaag

SEQ ID NO: 1371911 - RNA, 16 nt, Human
gcacugucuuaaggca

SEQ ID NO: 1371912 - RNA, 19 nt, Human
gcacugugacccccagcuc

SEQ ID NO: 1371913 - RNA, 19 nt, Human
gcacuguggguagacacac

SEQ ID NO: 1371914 - RNA, 16 nt, Human
gcagaaguguuuuuua

SEQ ID NO: 1371915 - RNA, 23 nt, Human
gcagaagggggucucuucuucca

SEQ ID NO: 1371916 - RNA, 12 nt, Human
gcagaaggaagg

SEQ ID NO: 1371917 - RNA, 13 nt, Human
gcagaaggaaggc

SEQ ID NO: 1371918 - RNA, 15 nt, Human
gcagaaggaaggcag

SEQ ID NO: 1371919 - RNA, 22 nt, Human
gcagaaggaaggcagggaggag

SEQ ID NO: 1371920 - RNA, 16 nt, Human
gcagaaggaaggcagg

SEQ ID NO: 1371921 - RNA, 21 nt, Human
gcacugagauaccagcgagga

SEQ ID NO: 1371922 - RNA, 16 nt, Human
gcacgauuucuguuua

SEQ ID NO: 1371923 - RNA, 17 nt, Human
gcacugcuugaggaaaa

SEQ ID NO: 1371924 - RNA, 16 nt, Human
gcacugcuugaggaaa

SEQ ID NO: 1371925 - RNA, 23 nt, Human
gcacuggggcaggggccgggggc

SEQ ID NO: 1371926 - RNA, 18 nt, Human
gcacuggggcaggggccg

SEQ ID NO: 1371927 - RNA, 15 nt, Human
gcacuggggcagggg

SEQ ID NO: 1371928 - RNA, 14 nt, Human
gcacuggccccacc

SEQ ID NO: 1371929 - RNA, 22 nt, Human
gauuuugggagugacucaagaa

SEQ ID NO: 1371930 - RNA, 17 nt, Human
gauuuucuuuugccuuu

SEQ ID NO: 1371931 - RNA, 18 nt, Human
gauuuugauagcaaagcg

SEQ ID NO: 1371932 - RNA, 23 nt, Human
gauuuugaaccugaugaaaauaa

SEQ ID NO: 1371933 - RNA, 14 nt, Human
gauuuuuacacaug

SEQ ID NO: 1371934 - RNA, 16 nt, Human
gauuuuuaaaauguac

SEQ ID NO: 1371935 - RNA, 13 nt, Human
gauuuuuaaaaug

SEQ ID NO: 1371936 - RNA, 19 nt, Human
gauuuuaggagcuaaggcu

SEQ ID NO: 1371937 - RNA, 16 nt, Human
gauuuuacaugaagua

SEQ ID NO: 1371938 - RNA, 13 nt, Human
gauuuuacaugaa

SEQ ID NO: 1371939 - RNA, 12 nt, Human
gauuuuacauga

SEQ ID NO: 1371940 - RNA, 20 nt, Human
gauuuuacaugaaguauuuu

SEQ ID NO: 1371941 - RNA, 18 nt, Human
gauuuuacauguggccca

SEQ ID NO: 1371942 - RNA, 21 nt, Human
gauuuuaaguuucucugcaga

SEQ ID NO: 1371943 - RNA, 17 nt, Human
gauuugcauugaacaca

SEQ ID NO: 1371944 - RNA, 15 nt, Human
gauuugcauugaaca

SEQ ID NO: 1371945 - RNA, 15 nt, Human
gauuuucuuuugccu

SEQ ID NO: 1371946 - RNA, 21 nt, Human
gauuuuaggagcuaaggcucu

SEQ ID NO: 1371947 - RNA, 20 nt, Human
gcaaaggaagguggauggcc

SEQ ID NO: 1371948 - RNA, 20 nt, Human
gcaaagccuguucauggcag

SEQ ID NO: 1371949 - RNA, 15 nt, Human
gcaaaggaaggugga

SEQ ID NO: 1371950 - RNA, 21 nt, Human
gcaaagccuguucauggcaga

SEQ ID NO: 1371951 - RNA, 14 nt, Human
gcaaagcgacguua

SEQ ID NO: 1371952 - RNA, 13 nt, Human
gcaaagcacagag

SEQ ID NO: 1371953 - RNA, 14 nt, Human
gcaaagcacagaga

SEQ ID NO: 1371954 - RNA, 12 nt, Human
gcaaagcacaga

SEQ ID NO: 1371955 - RNA, 16 nt, Human
gcaaagauuuaaucug

SEQ ID NO: 1371956 - RNA, 22 nt, Human
gcaaagaucuguccucagccuu

SEQ ID NO: 1371957 - RNA, 21 nt, Human
gcaaagaucuguccucagccu

SEQ ID NO: 1371958 - RNA, 20 nt, Human
gcaaagaucuguccucagcc

SEQ ID NO: 1371959 - RNA, 19 nt, Human
gcaaagaucuguccucagc

SEQ ID NO: 1371960 - RNA, 16 nt, Human
gcaaagauaucucauc

SEQ ID NO: 1371961 - RNA, 16 nt, Human
gcaaauugucacagga

SEQ ID NO: 1371962 - RNA, 19 nt, Human
gcaaauuugcauuaaauua

SEQ ID NO: 1371963 - RNA, 14 nt, Human
gcaacaauuuauga

SEQ ID NO: 1371964 - RNA, 20 nt, Human
gcaacaagguccucugucag

SEQ ID NO: 1371965 - RNA, 13 nt, Human
gcaacaauaaaua

SEQ ID NO: 1371966 - RNA, 17 nt, Human
gauugguguuuuuuucu

SEQ ID NO: 1371967 - RNA, 20 nt, Human
gauugguguuuuuuucuaug

SEQ ID NO: 1371968 - RNA, 21 nt, Human
gauuggguuuuuggacuucug

SEQ ID NO: 1371969 - RNA, 21 nt, Human
gauugcgagagauguguguug

SEQ ID NO: 1371970 - RNA, 22 nt, Human
gauugcgagagauguguguuga

SEQ ID NO: 1371971 - RNA, 22 nt, Human
gauuggggaagagagccugcag

SEQ ID NO: 1371972 - RNA, 13 nt, Human
gauuuaacagaaa

SEQ ID NO: 1371973 - RNA, 14 nt, Human
gauuuaacagaaau

SEQ ID NO: 1371974 - RNA, 13 nt, Human
gauuugacauugc

SEQ ID NO: 1371975 - RNA, 20 nt, Human
gauuugaagaacaugugaga

SEQ ID NO: 1371976 - RNA, 19 nt, Human
gauuugaagaacaugugag

SEQ ID NO: 1371977 - RNA, 18 nt, Human
gauuucuagguaggaaau

SEQ ID NO: 1371978 - RNA, 22 nt, Human
gauuuccuugaauguggcuuga

SEQ ID NO: 1371979 - RNA, 17 nt, Human
gauuuccuugaaugugg

SEQ ID NO: 1371980 - RNA, 13 nt, Human
gauuuccuugaau

SEQ ID NO: 1371981 - RNA, 12 nt, Human
gauuuccuucuu

SEQ ID NO: 1371982 - RNA, 22 nt, Human
gauuuccugcuuugggaagccg

SEQ ID NO: 1371983 - RNA, 13 nt, Human
gauuuccuaauac

SEQ ID NO: 1371984 - RNA, 15 nt, Human
gauuuaacagaaaug

SEQ ID NO: 1371985 - RNA, 22 nt, Human
gauuuccguuaaaauaccagcc

SEQ ID NO: 1371986 - RNA, 20 nt, Human
gauugcgagagauguguguu

SEQ ID NO: 1371987 - RNA, 19 nt, Human
gauugcgagagaugugugu

SEQ ID NO: 1371988 - RNA, 18 nt, Human
gauugcgagagaugugug

SEQ ID NO: 1371989 - RNA, 17 nt, Human
gauugcgagagaugugu

SEQ ID NO: 1371990 - RNA, 16 nt, Human
gauugcgagagaugug

SEQ ID NO: 1371991 - RNA, 15 nt, Human
gauugcgagagaugu

SEQ ID NO: 1371992 - RNA, 14 nt, Human
gauugcgagagaug

SEQ ID NO: 1371993 - RNA, 13 nt, Human
gauugcgagagau

SEQ ID NO: 1371994 - RNA, 17 nt, Human
gauugauuugaagaaca

SEQ ID NO: 1371995 - RNA, 15 nt, Human
gauugauuugaagaa

SEQ ID NO: 1371996 - RNA, 19 nt, Human
gauugauagaguguuauca

SEQ ID NO: 1371997 - RNA, 22 nt, Human
gauugaucggagccuccucucu

SEQ ID NO: 1371998 - RNA, 16 nt, Human
gauugagucugugcca

SEQ ID NO: 1371999 - RNA, 17 nt, Human
gauugagcucucugccc

SEQ ID NO: 1372000 - RNA, 22 nt, Human
gauucaaucuguaaacugugua

SEQ ID NO: 1372001 - RNA, 21 nt, Human
gauucaaucuguaaacugugu

SEQ ID NO: 1372002 - RNA, 20 nt, Human
gauucaaucuguaaacugug

SEQ ID NO: 1372003 - RNA, 20 nt, Human
gauucaaugccccugaauuu

SEQ ID NO: 1372004 - RNA, 19 nt, Human
gauucaaugccccugaauu

SEQ ID NO: 1372005 - RNA, 13 nt, Human
gauucucauaacu

SEQ ID NO: 1372006 - RNA, 18 nt, Human
gauucucaaaggagcgag

SEQ ID NO: 1372007 - RNA, 21 nt, Human
gauucuauuuauauguacaug

SEQ ID NO: 1372008 - RNA, 20 nt, Human
gauucuauuuauauguacau

SEQ ID NO: 1372009 - RNA, 15 nt, Human
gauucuauuuauaug

SEQ ID NO: 1372010 - RNA, 21 nt, Human
gauucaaugccccugaauuua

SEQ ID NO: 1372011 - RNA, 20 nt, Human
gauuaaagaugagcuuuguc

SEQ ID NO: 1372012 - RNA, 15 nt, Human
gauuaaacuuaaucu

SEQ ID NO: 1372013 - RNA, 14 nt, Human
gauuacaggcguga

SEQ ID NO: 1372014 - RNA, 20 nt, Human
gauuacaggcaugagccacu

SEQ ID NO: 1372015 - RNA, 18 nt, Human
gauuaaauaagauucuaa

SEQ ID NO: 1372016 - RNA, 17 nt, Human
gauuaaauaagauucua

SEQ ID NO: 1372017 - RNA, 16 nt, Human
gauuaaauaagauucu

SEQ ID NO: 1372018 - RNA, 14 nt, Human
gauuacacacguga

SEQ ID NO: 1372019 - RNA, 12 nt, Human
gauguucuaagg

SEQ ID NO: 1372020 - RNA, 22 nt, Human
gauguucagcacugucccuugc

SEQ ID NO: 1372021 - RNA, 20 nt, Human
gauguucagcacugucccuu

SEQ ID NO: 1372022 - RNA, 19 nt, Human
gauguucagcacugucccu

SEQ ID NO: 1372023 - RNA, 17 nt, Human
gauguucagcacugucc

SEQ ID NO: 1372024 - RNA, 18 nt, Human
gauguuuauucuucuaga

SEQ ID NO: 1372025 - RNA, 14 nt, Human
gauguuuauucuuc

SEQ ID NO: 1372026 - RNA, 16 nt, Human
gauguuuaguaaucau

SEQ ID NO: 1372027 - RNA, 21 nt, Human
gauggucuuacagcaggcagu

SEQ ID NO: 1372028 - RNA, 17 nt, Human
gauggucuuacagcagg

SEQ ID NO: 1372029 - RNA, 16 nt, Human
gauggucuuacagcag

SEQ ID NO: 1372030 - RNA, 17 nt, Human
gaugguaguuuuuucau

SEQ ID NO: 1372031 - RNA, 18 nt, Human
gauguggucacagcugua

SEQ ID NO: 1372032 - RNA, 17 nt, Human
gauguggucacagcugu

SEQ ID NO: 1372033 - RNA, 16 nt, Human
gauguggucacagcug

SEQ ID NO: 1372034 - RNA, 18 nt, Human
gauguggguuccacagac

SEQ ID NO: 1372035 - RNA, 16 nt, Human
gauguggguuccacag

SEQ ID NO: 1372036 - RNA, 22 nt, Human
gaugguucccuugaugaagaag

SEQ ID NO: 1372037 - RNA, 21 nt, Human
gaugcugacauucaccugccc

SEQ ID NO: 1372038 - RNA, 20 nt, Human
gaugcugacauucaccugcc

SEQ ID NO: 1372039 - RNA, 17 nt, Human
gaugcugaaaauguccu

SEQ ID NO: 1372040 - RNA, 21 nt, Human
gaugcuccuugggcccuuuga

SEQ ID NO: 1372041 - RNA, 16 nt, Human
gaugcuccuugggccc

SEQ ID NO: 1372042 - RNA, 14 nt, Human
gaugcuccuugggc

SEQ ID NO: 1372043 - RNA, 13 nt, Human
gaugcuccuuggg

SEQ ID NO: 1372044 - RNA, 23 nt, Human
gaugcccccuaauccccuucucc

SEQ ID NO: 1372045 - RNA, 11 nt, Human
gaugcccagag

SEQ ID NO: 1372046 - RNA, 17 nt, Human
gaugcccaaauccuuag

SEQ ID NO: 1372047 - RNA, 18 nt, Human
gaugccagccaagcucug

SEQ ID NO: 1372048 - RNA, 15 nt, Human
gaugccagccaagcu

SEQ ID NO: 1372049 - RNA, 23 nt, Human
gaucagagccgugguccuuuggg

SEQ ID NO: 1372050 - RNA, 16 nt, Human
gaucagagccgugguc

SEQ ID NO: 1372051 - RNA, 16 nt, Human
gaucagaccauaaugu

SEQ ID NO: 1372052 - RNA, 13 nt, Human
gaucagaacaaau

SEQ ID NO: 1372053 - RNA, 22 nt, Human
gaugccagccaagcucugcagu

SEQ ID NO: 1372054 - RNA, 20 nt, Human
gaugggagggaggcucaggu

SEQ ID NO: 1372055 - RNA, 18 nt, Human
gauggccggagaggaccg

SEQ ID NO: 1372056 - RNA, 12 nt, Human
gauggccccagc

SEQ ID NO: 1372057 - RNA, 14 nt, Human
gauggcccauccug

SEQ ID NO: 1372058 - RNA, 19 nt, Human
gauggccagccccuuagac

SEQ ID NO: 1372059 - RNA, 14 nt, Human
gauggccagccccu

SEQ ID NO: 1372060 - RNA, 13 nt, Human
gauggccagcccc

SEQ ID NO: 1372061 - RNA, 15 nt, Human
gauggccccagcaca

SEQ ID NO: 1372062 - RNA, 14 nt, Human
gauggccccagcac

SEQ ID NO: 1372063 - RNA, 12 nt, Human
gauggggcuccc

SEQ ID NO: 1372064 - RNA, 17 nt, Human
gaugggauucuggacag

SEQ ID NO: 1372065 - RNA, 13 nt, Human
gaugggauucugg

SEQ ID NO: 1372066 - RNA, 20 nt, Human
gaugggaugguggagggcca

SEQ ID NO: 1372067 - RNA, 19 nt, Human
gaugggaugguggagggcc

SEQ ID NO: 1372068 - RNA, 17 nt, Human
gaugggguuucaccaug

SEQ ID NO: 1372069 - RNA, 23 nt, Human
gcccgagcagcugagcagggccg

SEQ ID NO: 1372070 - RNA, 22 nt, Human
gcccgagcagcugagcagggcc

SEQ ID NO: 1372071 - RNA, 20 nt, Human
gcccgagcagcugagcaggg

SEQ ID NO: 1372072 - RNA, 19 nt, Human
gcccgagcagcugagcagg

SEQ ID NO: 1372073 - RNA, 18 nt, Human
gcccgagcagcugagcag

SEQ ID NO: 1372074 - RNA, 17 nt, Human
gcccgagcagcugagca

SEQ ID NO: 1372075 - RNA, 16 nt, Human
gcccgagcagcugagc

SEQ ID NO: 1372076 - RNA, 14 nt, Human
gcccgagcagcuga

SEQ ID NO: 1372077 - RNA, 13 nt, Human
gcccgagcagcug

SEQ ID NO: 1372078 - RNA, 12 nt, Human
gcccgagcagcu

SEQ ID NO: 1372079 - RNA, 17 nt, Human
gcccgcaugcggcccag

SEQ ID NO: 1372080 - RNA, 19 nt, Human
gcccgcaugcggcccagga

SEQ ID NO: 1372081 - RNA, 17 nt, Human
gccccuuagacagaggc

SEQ ID NO: 1372082 - RNA, 22 nt, Human
gccccuuagacagaggcccuca

SEQ ID NO: 1372083 - RNA, 16 nt, Human
gccccuuagacagagg

SEQ ID NO: 1372084 - RNA, 15 nt, Human
gcccggcagggcggg

SEQ ID NO: 1372085 - RNA, 21 nt, Human
gcccgcgauguggaacugcug

SEQ ID NO: 1372086 - RNA, 24 nt, Human
gcccgcgauguggaacugcugcca

SEQ ID NO: 1372087 - RNA, 17 nt, Human
gcccggcagggcgggca

SEQ ID NO: 1372088 - RNA, 18 nt, Human
gcccggcuaauuuuugua

SEQ ID NO: 1372089 - RNA, 12 nt, Human
gccccucucccu

SEQ ID NO: 1372090 - RNA, 18 nt, Human
gccccucuccccagggaa

SEQ ID NO: 1372091 - RNA, 20 nt, Human
gccccucucagcccucacac

SEQ ID NO: 1372092 - RNA, 16 nt, Human
gccccucucagcccuc

SEQ ID NO: 1372093 - RNA, 15 nt, Human
gccccucucagcccu

SEQ ID NO: 1372094 - RNA, 14 nt, Human
gccccucucagccc

SEQ ID NO: 1372095 - RNA, 13 nt, Human
gccccucucagcc

SEQ ID NO: 1372096 - RNA, 15 nt, Human
gccccucucaccaaa

SEQ ID NO: 1372097 - RNA, 14 nt, Human
gccccucucaccaa

SEQ ID NO: 1372098 - RNA, 17 nt, Human
gccccucuccuucuuag

SEQ ID NO: 1372099 - RNA, 23 nt, Human
gccccucucccuugggcucugau

SEQ ID NO: 1372100 - RNA, 21 nt, Human
gccccucucccuugggcucug

SEQ ID NO: 1372101 - RNA, 20 nt, Human
gccccucucccuugggcucu

SEQ ID NO: 1372102 - RNA, 14 nt, Human
gcagacguccauca

SEQ ID NO: 1372103 - RNA, 17 nt, Human
gcagaccuuuuuuagga

SEQ ID NO: 1372104 - RNA, 15 nt, Human
gcagacucagcucug

SEQ ID NO: 1372105 - RNA, 13 nt, Human
gcagacucacugu

SEQ ID NO: 1372106 - RNA, 16 nt, Human
gcagacucagcucuga

SEQ ID NO: 1372107 - RNA, 22 nt, Human
gcccucuccccugcccccugca

SEQ ID NO: 1372108 - RNA, 23 nt, Human
gcccucuccccugcccccugcag

SEQ ID NO: 1372109 - RNA, 21 nt, Human
gcccugaggacagaugccucc

SEQ ID NO: 1372110 - RNA, 22 nt, Human
gcccucugcauccucuggagcc

SEQ ID NO: 1372111 - RNA, 21 nt, Human
gcccucugcauccucuggagc

SEQ ID NO: 1372112 - RNA, 20 nt, Human
gcccucugcauccucuggag

SEQ ID NO: 1372113 - RNA, 19 nt, Human
gcccucugcauccucugga

SEQ ID NO: 1372114 - RNA, 18 nt, Human
gcccucugcauccucugg

SEQ ID NO: 1372115 - RNA, 17 nt, Human
gcccucugcauccucug

SEQ ID NO: 1372116 - RNA, 16 nt, Human
gcccucucugcucugc

SEQ ID NO: 1372117 - RNA, 20 nt, Human
gcccucuccccugcccccug

SEQ ID NO: 1372118 - RNA, 18 nt, Human
gcccucuccccugccccc

SEQ ID NO: 1372119 - RNA, 17 nt, Human
gcccucuccccugcccc

SEQ ID NO: 1372120 - RNA, 16 nt, Human
gcccucuccccugccc

SEQ ID NO: 1372121 - RNA, 15 nt, Human
gcccucuccccugcc

SEQ ID NO: 1372122 - RNA, 14 nt, Human
gcccucuccccugc

SEQ ID NO: 1372123 - RNA, 20 nt, Human
gcccucuccccucagccucu

SEQ ID NO: 1372124 - RNA, 17 nt, Human
gcccucuccccucagcc

SEQ ID NO: 1372125 - RNA, 20 nt, Human
gcccucucccacccucuucc

SEQ ID NO: 1372126 - RNA, 19 nt, Human
gcccucucccacccucuuc

SEQ ID NO: 1372127 - RNA, 16 nt, Human
gcccucucccacccuc

SEQ ID NO: 1372128 - RNA, 13 nt, Human
gcccucucccacc

SEQ ID NO: 1372129 - RNA, 17 nt, Human
gcccucgugguggaaac

SEQ ID NO: 1372130 - RNA, 23 nt, Human
gcccucgugguggaaacuuuucu

SEQ ID NO: 1372131 - RNA, 17 nt, Human
gcccucgcugccagcuc

SEQ ID NO: 1372132 - RNA, 15 nt, Human
gcccucgcugccagc

SEQ ID NO: 1372133 - RNA, 14 nt, Human
gcccucgcugccag

SEQ ID NO: 1372134 - RNA, 13 nt, Human
gcccggcuccugg

SEQ ID NO: 1372135 - RNA, 14 nt, Human
gcccggcuccuggu

SEQ ID NO: 1372136 - RNA, 22 nt, Human
gcccugcaccaugcugcugggg

SEQ ID NO: 1372137 - RNA, 21 nt, Human
gcccugcaccaugcugcuggg

SEQ ID NO: 1372138 - RNA, 17 nt, Human
gcccugcaccaugcugc

SEQ ID NO: 1372139 - RNA, 21 nt, Human
gcccugcaaaaggacucucag

SEQ ID NO: 1372140 - RNA, 15 nt, Human
gcccugcagacccug

SEQ ID NO: 1372141 - RNA, 14 nt, Human
gcccugcagacccu

SEQ ID NO: 1372142 - RNA, 13 nt, Human
gcccugcagaccc

SEQ ID NO: 1372143 - RNA, 17 nt, Human
gcccugaggacagaugc

SEQ ID NO: 1372144 - RNA, 18 nt, Human
gcccugcaaaaggacucu

SEQ ID NO: 1372145 - RNA, 14 nt, Human
gcccugcaaaagga

SEQ ID NO: 1372146 - RNA, 13 nt, Human
gcccugaucccag

SEQ ID NO: 1372147 - RNA, 15 nt, Human
gcccugaucccagag

SEQ ID NO: 1372148 - RNA, 23 nt, Human
gcccuggaucagcguggccuugu

SEQ ID NO: 1372149 - RNA, 21 nt, Human
gcccuggaucagcguggccuu

SEQ ID NO: 1372150 - RNA, 20 nt, Human
gcccuggaucagcguggccu

SEQ ID NO: 1372151 - RNA, 19 nt, Human
gcccuggaucagcguggcc

SEQ ID NO: 1372152 - RNA, 18 nt, Human
gcccuggaucagcguggc

SEQ ID NO: 1372153 - RNA, 17 nt, Human
gcccuggaucagcgugg

SEQ ID NO: 1372154 - RNA, 22 nt, Human
gcccuggagaccccaccagccu

SEQ ID NO: 1372155 - RNA, 15 nt, Human
gcccuggagcagcca

SEQ ID NO: 1372156 - RNA, 12 nt, Human
gcccuggacugu

SEQ ID NO: 1372157 - RNA, 16 nt, Human
gcccuggacugugugc

SEQ ID NO: 1372158 - RNA, 22 nt, Human
gcccuggacugugugcucagga

SEQ ID NO: 1372159 - RNA, 22 nt, Human
gcccugucagcaugaauuugua

SEQ ID NO: 1372160 - RNA, 20 nt, Human
gcccugucagcaugaauuug

SEQ ID NO: 1372161 - RNA, 15 nt, Human
gcccugguggcccuc

SEQ ID NO: 1372162 - RNA, 14 nt, Human
gcccugguggcccu

SEQ ID NO: 1372163 - RNA, 13 nt, Human
gcccugguggccc

SEQ ID NO: 1372164 - RNA, 20 nt, Human
gcccugguggcccucucccc

SEQ ID NO: 1372165 - RNA, 19 nt, Human
gcccugguggcccucuccc

SEQ ID NO: 1372166 - RNA, 18 nt, Human
gcccugguggcccucucc

SEQ ID NO: 1372167 - RNA, 23 nt, Human
gcccuggugguggcucgggaggc

SEQ ID NO: 1372168 - RNA, 18 nt, Human
gcccuuugagugcagucc

SEQ ID NO: 1372169 - RNA, 19 nt, Human
gcccuuucggauccaggga

SEQ ID NO: 1372170 - RNA, 22 nt, Human
gcccuuucggauccagggaggc

SEQ ID NO: 1372171 - RNA, 16 nt, Human
gcccuuuccuccucag

SEQ ID NO: 1372172 - RNA, 15 nt, Human
gcccuuuccuccuca

SEQ ID NO: 1372173 - RNA, 23 nt, Human
gcccuuguuuggggcaggaguag

SEQ ID NO: 1372174 - RNA, 22 nt, Human
gcccuuguuuggggcaggagua

SEQ ID NO: 1372175 - RNA, 17 nt, Human
gcccuggccuccccugc

SEQ ID NO: 1372176 - RNA, 16 nt, Human
gcccuggccuccccug

SEQ ID NO: 1372177 - RNA, 14 nt, Human
gcccuggccucccc

SEQ ID NO: 1372178 - RNA, 12 nt, Human
gcccuggccucc

SEQ ID NO: 1372179 - RNA, 15 nt, Human
gcccuggcaugucaa

SEQ ID NO: 1372180 - RNA, 22 nt, Human
gcccuggaucagcguggccuug

SEQ ID NO: 1372181 - RNA, 24 nt, Human
gcccuggccuccccugccaccagg

SEQ ID NO: 1372182 - RNA, 21 nt, Human
gcccuggccuccccugccacc

SEQ ID NO: 1372183 - RNA, 20 nt, Human
gcccuggccuccccugccac

SEQ ID NO: 1372184 - RNA, 19 nt, Human
gcccuggccuccccugcca

SEQ ID NO: 1372185 - RNA, 20 nt, Human
gcccugggaccgcuacacca

SEQ ID NO: 1372186 - RNA, 14 nt, Human
gcccugggaccgcu

SEQ ID NO: 1372187 - RNA, 13 nt, Human
gcccugggaggcu

SEQ ID NO: 1372188 - RNA, 14 nt, Human
gcccugggaggcuc

SEQ ID NO: 1372189 - RNA, 15 nt, Human
gcccugggaggcucu

SEQ ID NO: 1372190 - RNA, 16 nt, Human
gcccugggaggcucug

SEQ ID NO: 1372191 - RNA, 22 nt, Human
gcccuggggccuguacugccug

SEQ ID NO: 1372192 - RNA, 21 nt, Human
gcccuggggccuguacugccu

SEQ ID NO: 1372193 - RNA, 23 nt, Human
gcccuggggccuguacugccugc

SEQ ID NO: 1372194 - RNA, 19 nt, Human
gcccuggggccuguacugc

SEQ ID NO: 1372195 - RNA, 18 nt, Human
gcccuggggccuguacug

SEQ ID NO: 1372196 - RNA, 15 nt, Human
gcccuggggccugua

SEQ ID NO: 1372197 - RNA, 14 nt, Human
gcccuggggccugu

SEQ ID NO: 1372198 - RNA, 13 nt, Human
gcccuggggccug

SEQ ID NO: 1372199 - RNA, 12 nt, Human
gcccuggggccu

SEQ ID NO: 1372200 - RNA, 18 nt, Human
gcccugggcuggaaucag

SEQ ID NO: 1372201 - RNA, 16 nt, Human
gcccugggcuggaauc

SEQ ID NO: 1372202 - RNA, 14 nt, Human
gcccugggcuggaa

SEQ ID NO: 1372203 - RNA, 13 nt, Human
gcccugggcugga

SEQ ID NO: 1372204 - RNA, 12 nt, Human
gcccugggcugg

SEQ ID NO: 1372205 - RNA, 11 nt, Human
gcccugggcug

SEQ ID NO: 1372206 - RNA, 22 nt, Human
gcccugggccugccucaccacg

SEQ ID NO: 1372207 - RNA, 20 nt, Human
gcccugggccugccucacca

SEQ ID NO: 1372208 - RNA, 16 nt, Human
gcccugggccugccuc

SEQ ID NO: 1372209 - RNA, 15 nt, Human
gcccugggccugccu

SEQ ID NO: 1372210 - RNA, 13 nt, Human
gcccugggccugc

SEQ ID NO: 1372211 - RNA, 23 nt, Human
gcccugggagaaucgcuccugca

SEQ ID NO: 1372212 - RNA, 22 nt, Human
gcccugggaccgcuacaccacu

SEQ ID NO: 1372213 - RNA, 23 nt, Human
gcccugggaggcucuggagccca

SEQ ID NO: 1372214 - RNA, 17 nt, Human
gcccugggaggcucugg

SEQ ID NO: 1372215 - RNA, 18 nt, Human
gcccugggaggcucugga

SEQ ID NO: 1372216 - RNA, 19 nt, Human
gcccugggaggcucuggag

SEQ ID NO: 1372217 - RNA, 21 nt, Human
gcccugggaggcucuggagcc

SEQ ID NO: 1372218 - RNA, 15 nt, Human
gccgagcaggaggcc

SEQ ID NO: 1372219 - RNA, 14 nt, Human
gccgagcaggaggc

SEQ ID NO: 1372220 - RNA, 20 nt, Human
gccgagcaaccguggcccuu

SEQ ID NO: 1372221 - RNA, 19 nt, Human
gccgagcaaccguggcccu

SEQ ID NO: 1372222 - RNA, 14 nt, Human
gccgagcaaccgug

SEQ ID NO: 1372223 - RNA, 18 nt, Human
gccuaugacuugggcacc

SEQ ID NO: 1372224 - RNA, 17 nt, Human
gccuaugacuugggcac

SEQ ID NO: 1372225 - RNA, 16 nt, Human
gccuaugacuugggca

SEQ ID NO: 1372226 - RNA, 20 nt, Human
gccuaucagaguugcugcaa

SEQ ID NO: 1372227 - RNA, 14 nt, Human
gccucagggcuccu

SEQ ID NO: 1372228 - RNA, 18 nt, Human
gccucaggacugggagcc

SEQ ID NO: 1372229 - RNA, 16 nt, Human
gccucaggggucugag

SEQ ID NO: 1372230 - RNA, 23 nt, Human
gccucaggacugggagcccccag

SEQ ID NO: 1372231 - RNA, 17 nt, Human
gccucaggacugggagc

SEQ ID NO: 1372232 - RNA, 16 nt, Human
gccucaggacugggag

SEQ ID NO: 1372233 - RNA, 15 nt, Human
gccucaggacuggga

SEQ ID NO: 1372234 - RNA, 21 nt, Human
gccucagcucccacaagccuc

SEQ ID NO: 1372235 - RNA, 17 nt, Human
gccucagcucccacaag

SEQ ID NO: 1372236 - RNA, 16 nt, Human
gccucagcucccacaa

SEQ ID NO: 1372237 - RNA, 15 nt, Human
gccucagcucccaca

SEQ ID NO: 1372238 - RNA, 13 nt, Human
gccucagaagugc

SEQ ID NO: 1372239 - RNA, 16 nt, Human
gccucagccucccaag

SEQ ID NO: 1372240 - RNA, 17 nt, Human
gccucagaaaccagacu

SEQ ID NO: 1372241 - RNA, 23 nt, Human
gccucacuuuuaaugaacaaaug

SEQ ID NO: 1372242 - RNA, 19 nt, Human
gccucagaagugcaucugg

SEQ ID NO: 1372243 - RNA, 22 nt, Human
gccucacuuuuaaugaacaaau

SEQ ID NO: 1372244 - RNA, 15 nt, Human
gccucaaccucccaa

SEQ ID NO: 1372245 - RNA, 20 nt, Human
gccucacccaccccugcaca

SEQ ID NO: 1372246 - RNA, 19 nt, Human
gccucacccaccccugcac

SEQ ID NO: 1372247 - RNA, 18 nt, Human
gccucacccaccccugca

SEQ ID NO: 1372248 - RNA, 17 nt, Human
gccucacccaccccugc

SEQ ID NO: 1372249 - RNA, 15 nt, Human
gccucacccaccccu

SEQ ID NO: 1372250 - RNA, 19 nt, Human
gccucaccagcccuggcaa

SEQ ID NO: 1372251 - RNA, 20 nt, Human
gccuccccuuaaaggggaga

SEQ ID NO: 1372252 - RNA, 18 nt, Human
gccuccccugccagggca

SEQ ID NO: 1372253 - RNA, 17 nt, Human
gccuccccugccagggc

SEQ ID NO: 1372254 - RNA, 15 nt, Human
gccuccccugccagg

SEQ ID NO: 1372255 - RNA, 14 nt, Human
gccuccccugccag

SEQ ID NO: 1372256 - RNA, 19 nt, Human
gccuccccugccaccaggc

SEQ ID NO: 1372257 - RNA, 16 nt, Human
gccuccccugccacca

SEQ ID NO: 1372258 - RNA, 15 nt, Human
gccuccccugccacc

SEQ ID NO: 1372259 - RNA, 14 nt, Human
gccuccccugccac

SEQ ID NO: 1372260 - RNA, 21 nt, Human
gccuccccucuccuuccugug

SEQ ID NO: 1372261 - RNA, 19 nt, Human
gccuccccucuccuuccug

SEQ ID NO: 1372262 - RNA, 18 nt, Human
gccuccccucuccuuccu

SEQ ID NO: 1372263 - RNA, 20 nt, Human
gccucagugacccuggcucc

SEQ ID NO: 1372264 - RNA, 17 nt, Human
gccucagugacccuggc

SEQ ID NO: 1372265 - RNA, 17 nt, Human
gccucggccucccaaag

SEQ ID NO: 1372266 - RNA, 19 nt, Human
gccuccccuuaaaggggag

SEQ ID NO: 1372267 - RNA, 22 nt, Human
gccucucccuccuccaggaagc

SEQ ID NO: 1372268 - RNA, 23 nt, Human
gccucucccuccuccaggaagcc

SEQ ID NO: 1372269 - RNA, 14 nt, Human
gccucucccuccuc

SEQ ID NO: 1372270 - RNA, 22 nt, Human
gccucuagagcagacuacagcu

SEQ ID NO: 1372271 - RNA, 18 nt, Human
gccucuacugggaaggcu

SEQ ID NO: 1372272 - RNA, 17 nt, Human
gccucuacugggaaggc

SEQ ID NO: 1372273 - RNA, 16 nt, Human
gccucuacugggaagg

SEQ ID NO: 1372274 - RNA, 15 nt, Human
gccucuacugggaag

SEQ ID NO: 1372275 - RNA, 23 nt, Human
gccucuaccugacacucccuugg

SEQ ID NO: 1372276 - RNA, 19 nt, Human
gccucucgcuccucaaccc

SEQ ID NO: 1372277 - RNA, 19 nt, Human
gccucucugcaggucccua

SEQ ID NO: 1372278 - RNA, 21 nt, Human
gccuggccagacacaggcccu

SEQ ID NO: 1372279 - RNA, 20 nt, Human
gccuggccagacacaggccc

SEQ ID NO: 1372280 - RNA, 15 nt, Human
gccuggccagugccc

SEQ ID NO: 1372281 - RNA, 17 nt, Human
gccuggccagacacagg

SEQ ID NO: 1372282 - RNA, 16 nt, Human
gccuggccagacacag

SEQ ID NO: 1372283 - RNA, 14 nt, Human
gccuggccagacac

SEQ ID NO: 1372284 - RNA, 13 nt, Human
gccuggccagaca

SEQ ID NO: 1372285 - RNA, 20 nt, Human
gccuggcaguccgugggacg

SEQ ID NO: 1372286 - RNA, 20 nt, Human
gccuggaugcggauggccgg

SEQ ID NO: 1372287 - RNA, 24 nt, Human
gccuggaguguaugacugcacaug

SEQ ID NO: 1372288 - RNA, 22 nt, Human
gccuggaggaccugagccugcc

SEQ ID NO: 1372289 - RNA, 21 nt, Human
gccuggaggaccugagccugc

SEQ ID NO: 1372290 - RNA, 20 nt, Human
gccuggaggaccugagccug

SEQ ID NO: 1372291 - RNA, 19 nt, Human
gccuggaggaccugagccu

SEQ ID NO: 1372292 - RNA, 18 nt, Human
gccuggaggaccugagcc

SEQ ID NO: 1372293 - RNA, 21 nt, Human
gccuguagccccagugacagc

SEQ ID NO: 1372294 - RNA, 20 nt, Human
gccuguagccccagugacag

SEQ ID NO: 1372295 - RNA, 17 nt, Human
gccuguagaguugcuga

SEQ ID NO: 1372296 - RNA, 19 nt, Human
gccuguagaguugcugaga

SEQ ID NO: 1372297 - RNA, 16 nt, Human
gccuguagaguugcug

SEQ ID NO: 1372298 - RNA, 15 nt, Human
gccuguagaguugcu

SEQ ID NO: 1372299 - RNA, 13 nt, Human
gccuguagaguug

SEQ ID NO: 1372300 - RNA, 19 nt, Human
gccuguacugccugcuugg

SEQ ID NO: 1372301 - RNA, 20 nt, Human
gccuguacugccugcuuggg

SEQ ID NO: 1372302 - RNA, 18 nt, Human
gccuguacugccugcuug

SEQ ID NO: 1372303 - RNA, 17 nt, Human
gccuguacugccugcuu

SEQ ID NO: 1372304 - RNA, 15 nt, Human
gccugggucuccuaa

SEQ ID NO: 1372305 - RNA, 20 nt, Human
gccuggggcucuaacgccug

SEQ ID NO: 1372306 - RNA, 13 nt, Human
gccuggaggaccu

SEQ ID NO: 1372307 - RNA, 14 nt, Human
gccuggcccacccc

SEQ ID NO: 1372308 - RNA, 17 nt, Human
gccuggccagugcccug

SEQ ID NO: 1372309 - RNA, 18 nt, Human
gccuggccauacuguguc

SEQ ID NO: 1372310 - RNA, 20 nt, Human
gccugggggccuggcuggcu

SEQ ID NO: 1372311 - RNA, 19 nt, Human
gccugggggccuggcuggc

SEQ ID NO: 1372312 - RNA, 18 nt, Human
gccugggggccuggcugg

SEQ ID NO: 1372313 - RNA, 17 nt, Human
gccugggggccuggcug

SEQ ID NO: 1372314 - RNA, 16 nt, Human
gccugggggccuggcu

SEQ ID NO: 1372315 - RNA, 15 nt, Human
gccugggggccuggc

SEQ ID NO: 1372316 - RNA, 14 nt, Human
gccugggggccugg

SEQ ID NO: 1372317 - RNA, 13 nt, Human
gccugggggccug

SEQ ID NO: 1372318 - RNA, 23 nt, Human
gccuggggcucuaacgccugagc

SEQ ID NO: 1372319 - RNA, 14 nt, Human
gccuggggcuggcc

SEQ ID NO: 1372320 - RNA, 17 nt, Human
gccuggggcuggccucc

SEQ ID NO: 1372321 - RNA, 22 nt, Human
gccuggggcucuaacgccugag

SEQ ID NO: 1372322 - RNA, 21 nt, Human
gccuggggcucuaacgccuga

SEQ ID NO: 1372323 - RNA, 22 nt, Human
gccuggggcugaggcugaggca

SEQ ID NO: 1372324 - RNA, 18 nt, Human
gccugcuuuuuauggccu

SEQ ID NO: 1372325 - RNA, 19 nt, Human
gccugcuuuuuauggccug

SEQ ID NO: 1372326 - RNA, 17 nt, Human
gccuggaggaccugagc

SEQ ID NO: 1372327 - RNA, 16 nt, Human
gccuggaggaccugag

SEQ ID NO: 1372328 - RNA, 15 nt, Human
gccuggaggaccuga

SEQ ID NO: 1372329 - RNA, 14 nt, Human
gccuggaggaccug

SEQ ID NO: 1372330 - RNA, 22 nt, Human
gccugcuuuuuauggccuguga

SEQ ID NO: 1372331 - RNA, 16 nt, Human
gccugcagacucacug

SEQ ID NO: 1372332 - RNA, 16 nt, Human
gccugcagaauuuggg

SEQ ID NO: 1372333 - RNA, 16 nt, Human
gccugcacaauaaaaa

SEQ ID NO: 1372334 - RNA, 19 nt, Human
gccucugcgagugguuucu

SEQ ID NO: 1372335 - RNA, 22 nt, Human
gccucucgcuccucaaccccuc

SEQ ID NO: 1372336 - RNA, 23 nt, Human
gccucucugcaggucccuaauaa

SEQ ID NO: 1372337 - RNA, 20 nt, Human
gccucucugcaggucccuaa

SEQ ID NO: 1372338 - RNA, 21 nt, Human
gccucucugcaggucccuaau

SEQ ID NO: 1372339 - RNA, 15 nt, Human
gccugaccaaacagc

SEQ ID NO: 1372340 - RNA, 22 nt, Human
gccugacauuuggaguguuccc

SEQ ID NO: 1372341 - RNA, 15 nt, Human
gccugacacacuaac

SEQ ID NO: 1372342 - RNA, 22 nt, Human
gccugacacacuaaccaagcug

SEQ ID NO: 1372343 - RNA, 21 nt, Human
gccugacaaccacuggucugu

SEQ ID NO: 1372344 - RNA, 20 nt, Human
gccugacaaccacuggucug

SEQ ID NO: 1372345 - RNA, 22 nt, Human
gccugagucgugaccugcuagg

SEQ ID NO: 1372346 - RNA, 23 nt, Human
gccugagucgugaccugcuaggc

SEQ ID NO: 1372347 - RNA, 20 nt, Human
gccugagucgugaccugcua

SEQ ID NO: 1372348 - RNA, 18 nt, Human
gccugagucgugaccugc

SEQ ID NO: 1372349 - RNA, 23 nt, Human
gccugacccuacuucuuuugcuc

SEQ ID NO: 1372350 - RNA, 17 nt, Human
gccugacccucaucuuu

SEQ ID NO: 1372351 - RNA, 20 nt, Human
gccugaucagaccacggcuc

SEQ ID NO: 1372352 - RNA, 16 nt, Human
gccugaucagaccacg

SEQ ID NO: 1372353 - RNA, 20 nt, Human
gccugagugacagagcaaga

SEQ ID NO: 1372354 - RNA, 22 nt, Human
gcucugcuauuaggccagcaag

SEQ ID NO: 1372355 - RNA, 22 nt, Human
gcucugcuccccuaaagccuca

SEQ ID NO: 1372356 - RNA, 22 nt, Human
gcucugcgugucaccugugcuu

SEQ ID NO: 1372357 - RNA, 19 nt, Human
gcucuggacagccccaccc

SEQ ID NO: 1372358 - RNA, 16 nt, Human
gcucuggacagcccca

SEQ ID NO: 1372359 - RNA, 17 nt, Human
gcucugcgugucaccug

SEQ ID NO: 1372360 - RNA, 21 nt, Human
gcucuccauucugcuccuucc

SEQ ID NO: 1372361 - RNA, 19 nt, Human
gcucuccauucugcuccuu

SEQ ID NO: 1372362 - RNA, 18 nt, Human
gcucuccauucugcuccu

SEQ ID NO: 1372363 - RNA, 17 nt, Human
gcucuccauucugcucc

SEQ ID NO: 1372364 - RNA, 14 nt, Human
gcucuccauucugc

SEQ ID NO: 1372365 - RNA, 12 nt, Human
gcucuccauucu

SEQ ID NO: 1372366 - RNA, 11 nt, Human
gcuccuugggc

SEQ ID NO: 1372367 - RNA, 19 nt, Human
gcucgaaucucugugccuu

SEQ ID NO: 1372368 - RNA, 16 nt, Human
gcucgaaucucugugc

SEQ ID NO: 1372369 - RNA, 15 nt, Human
gcucgaaucucugug

SEQ ID NO: 1372370 - RNA, 12 nt, Human
gcucccuggggg

SEQ ID NO: 1372371 - RNA, 16 nt, Human
gcucccugugccccca

SEQ ID NO: 1372372 - RNA, 21 nt, Human
gcucccuguaaccucuucaga

SEQ ID NO: 1372373 - RNA, 20 nt, Human
gcucucuccaggcaggucug

SEQ ID NO: 1372374 - RNA, 19 nt, Human
gcucucucauugucugugu

SEQ ID NO: 1372375 - RNA, 19 nt, Human
gcucucggguugugugucu

SEQ ID NO: 1372376 - RNA, 19 nt, Human
gcucucgcacaccucugca

SEQ ID NO: 1372377 - RNA, 23 nt, Human
gcucuccuggcuucccaucccca

SEQ ID NO: 1372378 - RNA, 17 nt, Human
gcucuccuggcuuccca

SEQ ID NO: 1372379 - RNA, 15 nt, Human
gcucuccuggcuucc

SEQ ID NO: 1372380 - RNA, 14 nt, Human
gcucuccuggcuuc

SEQ ID NO: 1372381 - RNA, 13 nt, Human
gcucuccuggcuu

SEQ ID NO: 1372382 - RNA, 12 nt, Human
gcucuccuggcu

SEQ ID NO: 1372383 - RNA, 14 nt, Human
gcucuccuggcccu

SEQ ID NO: 1372384 - RNA, 23 nt, Human
gcucuccucuucuacucacuuuu

SEQ ID NO: 1372385 - RNA, 20 nt, Human
gcucuccauucugcuccuuc

SEQ ID NO: 1372386 - RNA, 15 nt, Human
gcucuccucuucuac

SEQ ID NO: 1372387 - RNA, 13 nt, Human
gcucuccucuucu

SEQ ID NO: 1372388 - RNA, 17 nt, Human
gcucuccuccaccucaa

SEQ ID NO: 1372389 - RNA, 15 nt, Human
gcucuuccuuacucc

SEQ ID NO: 1372390 - RNA, 22 nt, Human
gcucuggacagccccacccugg

SEQ ID NO: 1372391 - RNA, 20 nt, Human
gcucuggacagccccacccu

SEQ ID NO: 1372392 - RNA, 14 nt, Human
gcucuugaugccug

SEQ ID NO: 1372393 - RNA, 15 nt, Human
gcucuugaugccugg

SEQ ID NO: 1372394 - RNA, 16 nt, Human
gcucuugaugccuggc

SEQ ID NO: 1372395 - RNA, 22 nt, Human
gcugaccaugcucaucugcugg

SEQ ID NO: 1372396 - RNA, 21 nt, Human
gcugaccaugcucaucugcug

SEQ ID NO: 1372397 - RNA, 17 nt, Human
gcugacucacaccugaa

SEQ ID NO: 1372398 - RNA, 17 nt, Human
gcucuuucucugccagu

SEQ ID NO: 1372399 - RNA, 15 nt, Human
gcucuuucucugcca

SEQ ID NO: 1372400 - RNA, 14 nt, Human
gcucuuucucugcc

SEQ ID NO: 1372401 - RNA, 16 nt, Human
gcucuuucucugccag

SEQ ID NO: 1372402 - RNA, 21 nt, Human
gcucuuguugagccgugggca

SEQ ID NO: 1372403 - RNA, 17 nt, Human
gcucuugugaggaaagu

SEQ ID NO: 1372404 - RNA, 19 nt, Human
gcucuugugaggaaaguca

SEQ ID NO: 1372405 - RNA, 20 nt, Human
gcucuugugaggaaagucau

SEQ ID NO: 1372406 - RNA, 23 nt, Human
gcucuugauaccccccucugucu

SEQ ID NO: 1372407 - RNA, 22 nt, Human
gcucuugauaccccccucuguc

SEQ ID NO: 1372408 - RNA, 16 nt, Human
gcucuugugaggaaag

SEQ ID NO: 1372409 - RNA, 17 nt, Human
gcucuugaugccuggcg

SEQ ID NO: 1372410 - RNA, 20 nt, Human
gcugcauugaaaagagcuga

SEQ ID NO: 1372411 - RNA, 19 nt, Human
gcugcauugaaaagagcug

SEQ ID NO: 1372412 - RNA, 22 nt, Human
gcugcauggcagggggcugcug

SEQ ID NO: 1372413 - RNA, 17 nt, Human
gcugcauggcagggggc

SEQ ID NO: 1372414 - RNA, 17 nt, Human
gcugcauuuaaaagaua

SEQ ID NO: 1372415 - RNA, 23 nt, Human
gcugaugucaauuucuguguugc

SEQ ID NO: 1372416 - RNA, 20 nt, Human
gcugaugucaauuucugugu

SEQ ID NO: 1372417 - RNA, 17 nt, Human
gcugaugucaauuucug

SEQ ID NO: 1372418 - RNA, 20 nt, Human
gcugauguagcaugcuuguu

SEQ ID NO: 1372419 - RNA, 14 nt, Human
gcugacuguagcuu

SEQ ID NO: 1372420 - RNA, 12 nt, Human
gcugaguuuccu

SEQ ID NO: 1372421 - RNA, 11 nt, Human
gcugaguuucc

SEQ ID NO: 1372422 - RNA, 21 nt, Human
gcugaguggcaggggacagga

SEQ ID NO: 1372423 - RNA, 19 nt, Human
gcugaguggcaggggacag

SEQ ID NO: 1372424 - RNA, 17 nt, Human
gcugaguggcaggggac

SEQ ID NO: 1372425 - RNA, 15 nt, Human
gcugaguuuccuaug

SEQ ID NO: 1372426 - RNA, 13 nt, Human
gcugaguuuccua

SEQ ID NO: 1372427 - RNA, 16 nt, Human
gcugauggagaaggaa

SEQ ID NO: 1372428 - RNA, 17 nt, Human
gcugauggagaaggaag

SEQ ID NO: 1372429 - RNA, 20 nt, Human
gcuaacagggaaggcaggca

SEQ ID NO: 1372430 - RNA, 18 nt, Human
gcuaacagggaaggcagg

SEQ ID NO: 1372431 - RNA, 16 nt, Human
gcuaacagggaaggca

SEQ ID NO: 1372432 - RNA, 15 nt, Human
gcuaacagggaaggc

SEQ ID NO: 1372433 - RNA, 19 nt, Human
gcuaaauccuuuacuguua

SEQ ID NO: 1372434 - RNA, 21 nt, Human
gcuaaauaaaauuuguugcau

SEQ ID NO: 1372435 - RNA, 20 nt, Human
gcuaaauaaaauuuguugca

SEQ ID NO: 1372436 - RNA, 19 nt, Human
gcuaaauaaaauuuguugc

SEQ ID NO: 1372437 - RNA, 12 nt, Human
gcgugagcuuaa

SEQ ID NO: 1372438 - RNA, 23 nt, Human
gcgugagcuuaaaauacaagacu

SEQ ID NO: 1372439 - RNA, 16 nt, Human
gcuaaagcccagagac

SEQ ID NO: 1372440 - RNA, 14 nt, Human
gcgugagcugagca

SEQ ID NO: 1372441 - RNA, 13 nt, Human
gcgugacaauaaa

SEQ ID NO: 1372442 - RNA, 21 nt, Human
gcgucuuccugaguggugcca

SEQ ID NO: 1372443 - RNA, 14 nt, Human
gcgucuuccugagu

SEQ ID NO: 1372444 - RNA, 13 nt, Human
gcgucuuccugag

SEQ ID NO: 1372445 - RNA, 12 nt, Human
gcgucuuccuga

SEQ ID NO: 1372446 - RNA, 19 nt, Human
gcguauuauaccaaaaugu

SEQ ID NO: 1372447 - RNA, 20 nt, Human
gcguaggcuacagagaagcc

SEQ ID NO: 1372448 - RNA, 19 nt, Human
gcguaggcuacagagaagc

SEQ ID NO: 1372449 - RNA, 18 nt, Human
gcguaggcuacagagaag

SEQ ID NO: 1372450 - RNA, 17 nt, Human
gcguaggcuacagagaa

SEQ ID NO: 1372451 - RNA, 16 nt, Human
gcguaggcuacagaga

SEQ ID NO: 1372452 - RNA, 14 nt, Human
gcguaggcuacaga

SEQ ID NO: 1372453 - RNA, 13 nt, Human
gccugugccaggu

SEQ ID NO: 1372454 - RNA, 10 nt, Human
gccugugcca

SEQ ID NO: 1372455 - RNA, 15 nt, Human
gccugugcaaugcau

SEQ ID NO: 1372456 - RNA, 21 nt, Human
gccugugacauacccccuccc

SEQ ID NO: 1372457 - RNA, 23 nt, Human
gccugugacauacccccuccccc

SEQ ID NO: 1372458 - RNA, 21 nt, Human
gccugugaacccaggacaagc

SEQ ID NO: 1372459 - RNA, 19 nt, Human
gccugugaacccaggacaa

SEQ ID NO: 1372460 - RNA, 18 nt, Human
gccugugaacccaggaca

SEQ ID NO: 1372461 - RNA, 21 nt, Human
gccugggucucaccggcucuc

SEQ ID NO: 1372462 - RNA, 23 nt, Human
gccugugagcuaggaauuguguu

SEQ ID NO: 1372463 - RNA, 20 nt, Human
gcuaucucugugugcacaaa

SEQ ID NO: 1372464 - RNA, 16 nt, Human
gcuaucucugugugca

SEQ ID NO: 1372465 - RNA, 13 nt, Human
gcuaucucugugu

SEQ ID NO: 1372466 - RNA, 12 nt, Human
gcuaucucccug

SEQ ID NO: 1372467 - RNA, 20 nt, Human
gcuagcaguggcaggcagag

SEQ ID NO: 1372468 - RNA, 18 nt, Human
gcuagcaguggcaggcag

SEQ ID NO: 1372469 - RNA, 16 nt, Human
gcuagcaguggcaggc

SEQ ID NO: 1372470 - RNA, 14 nt, Human
gcuagcaguggcag

SEQ ID NO: 1372471 - RNA, 22 nt, Human
gcuacuaugauuuaauuugaaa

SEQ ID NO: 1372472 - RNA, 20 nt, Human
gcuacuaugauuuaauuuga

SEQ ID NO: 1372473 - RNA, 18 nt, Human
gcuagagguucaaagaua

SEQ ID NO: 1372474 - RNA, 19 nt, Human
gcuagagguucaaagauau

SEQ ID NO: 1372475 - RNA, 21 nt, Human
gcuagagguucaaagauauuu

SEQ ID NO: 1372476 - RNA, 14 nt, Human
gcuacguauuuaau

SEQ ID NO: 1372477 - RNA, 22 nt, Human
gcuacccgcagaguucucagaa

SEQ ID NO: 1372478 - RNA, 22 nt, Human
gcuaacagggaaggcaggcagg

SEQ ID NO: 1372479 - RNA, 17 nt, Human
gcuaagccccagcaagc

SEQ ID NO: 1372480 - RNA, 14 nt, Human
gcuaagcauuccaa

SEQ ID NO: 1372481 - RNA, 19 nt, Human
gcuaagcuaggaaugaaau

SEQ ID NO: 1372482 - RNA, 15 nt, Human
gcuaagcuaggaaug

SEQ ID NO: 1372483 - RNA, 18 nt, Human
gcuaagccccagcaagca

SEQ ID NO: 1372484 - RNA, 20 nt, Human
gcuaagccccagcaagcaau

SEQ ID NO: 1372485 - RNA, 22 nt, Human
gcuaagcucacguccugagaaa

SEQ ID NO: 1372486 - RNA, 20 nt, Human
gcuaagcucacguccugaga

SEQ ID NO: 1372487 - RNA, 16 nt, Human
gcuacccgcagaguuc

SEQ ID NO: 1372488 - RNA, 16 nt, Human
gcucacccccuucucc

SEQ ID NO: 1372489 - RNA, 13 nt, Human
gcucacccagugc

SEQ ID NO: 1372490 - RNA, 19 nt, Human
gcucacccagugcccucuc

SEQ ID NO: 1372491 - RNA, 20 nt, Human
gcucacccccuucuccaucc

SEQ ID NO: 1372492 - RNA, 18 nt, Human
gcucacccccuucuccau

SEQ ID NO: 1372493 - RNA, 21 nt, Human
gcucagaggguguccugcacc

SEQ ID NO: 1372494 - RNA, 22 nt, Human
gcucacccccuucuccauccac

SEQ ID NO: 1372495 - RNA, 14 nt, Human
gcucagccagcacu

SEQ ID NO: 1372496 - RNA, 13 nt, Human
gcucagccagcac

SEQ ID NO: 1372497 - RNA, 12 nt, Human
gcucagccagca

SEQ ID NO: 1372498 - RNA, 22 nt, Human
gcucagcacugccugcucccau

SEQ ID NO: 1372499 - RNA, 20 nt, Human
gcucagcacugccugcuccc

SEQ ID NO: 1372500 - RNA, 19 nt, Human
gcucagcacugccugcucc

SEQ ID NO: 1372501 - RNA, 18 nt, Human
gcucagcacugccugcuc

SEQ ID NO: 1372502 - RNA, 17 nt, Human
gcucagcacugccugcu

SEQ ID NO: 1372503 - RNA, 15 nt, Human
gcucagauagaauga

SEQ ID NO: 1372504 - RNA, 19 nt, Human
gcucagauagaaugacagu

SEQ ID NO: 1372505 - RNA, 19 nt, Human
gcucauauggggcugggag

SEQ ID NO: 1372506 - RNA, 17 nt, Human
gcucaguggggcagagg

SEQ ID NO: 1372507 - RNA, 19 nt, Human
gcucagugaaguugcugcu

SEQ ID NO: 1372508 - RNA, 18 nt, Human
gcucauaacggaucagaa

SEQ ID NO: 1372509 - RNA, 20 nt, Human
gcucagugaaguugcugcuu

SEQ ID NO: 1372510 - RNA, 17 nt, Human
gcucagugaaguugcug

SEQ ID NO: 1372511 - RNA, 21 nt, Human
gcucaguaauuugaggacaac

SEQ ID NO: 1372512 - RNA, 16 nt, Human
gcucaguaauuugagg

SEQ ID NO: 1372513 - RNA, 23 nt, Human
gcuccaguguccugagcucagcg

SEQ ID NO: 1372514 - RNA, 22 nt, Human
gcuccaguguccugagcucagc

SEQ ID NO: 1372515 - RNA, 16 nt, Human
gcuccagcugccccgg

SEQ ID NO: 1372516 - RNA, 21 nt, Human
gcuccagcugcucugucuucu

SEQ ID NO: 1372517 - RNA, 18 nt, Human
gcucccugacugggaguu

SEQ ID NO: 1372518 - RNA, 16 nt, Human
gcucccugacugggag

SEQ ID NO: 1372519 - RNA, 19 nt, Human
gcucccuccgcccccaggu

SEQ ID NO: 1372520 - RNA, 18 nt, Human
gcucccuccgcccccagg

SEQ ID NO: 1372521 - RNA, 16 nt, Human
gcucccuccgccccca

SEQ ID NO: 1372522 - RNA, 12 nt, Human
gcucccucagac

SEQ ID NO: 1372523 - RNA, 22 nt, Human
gcucccucagacuggggcaaug

SEQ ID NO: 1372524 - RNA, 11 nt, Human
gcucccucaga

SEQ ID NO: 1372525 - RNA, 10 nt, Human
gcucccucag

SEQ ID NO: 1372526 - RNA, 20 nt, Human
gcuccaguguccugagcuca

SEQ ID NO: 1372527 - RNA, 20 nt, Human
gcuccauuuuuagugaaaua

SEQ ID NO: 1372528 - RNA, 21 nt, Human
gcuccagcugccccggccccu

SEQ ID NO: 1372529 - RNA, 20 nt, Human
gcuccagcugcucugucuuc

SEQ ID NO: 1372530 - RNA, 13 nt, Human
gcuccagcugccc

SEQ ID NO: 1372531 - RNA, 12 nt, Human
gcuccagcugcc

SEQ ID NO: 1372532 - RNA, 18 nt, Human
gcuccaagauucuagaug

SEQ ID NO: 1372533 - RNA, 23 nt, Human
gcuccaaggggaaucagaacuca

SEQ ID NO: 1372534 - RNA, 21 nt, Human
gcuccaaggggaaucagaacu

SEQ ID NO: 1372535 - RNA, 20 nt, Human
gcuccaaggggaaucagaac

SEQ ID NO: 1372536 - RNA, 19 nt, Human
gcuccaagccccaucuucu

SEQ ID NO: 1372537 - RNA, 16 nt, Human
gcuccaagccccaucu

SEQ ID NO: 1372538 - RNA, 17 nt, Human
gcuccaagauucuagau

SEQ ID NO: 1372539 - RNA, 16 nt, Human
gcuccaagauucuaga

SEQ ID NO: 1372540 - RNA, 15 nt, Human
gcuccaagauucuag

SEQ ID NO: 1372541 - RNA, 14 nt, Human
gcuccaagauucua

SEQ ID NO: 1372542 - RNA, 20 nt, Human
gcuccaaagucauaauugca

SEQ ID NO: 1372543 - RNA, 19 nt, Human
gcuccaaagucauaauugc

SEQ ID NO: 1372544 - RNA, 17 nt, Human
gcuccaaagucauaauu

SEQ ID NO: 1372545 - RNA, 21 nt, Human
gcuccaaccugcaaagaucug

SEQ ID NO: 1372546 - RNA, 18 nt, Human
gcuccaaccugcaaagau

SEQ ID NO: 1372547 - RNA, 15 nt, Human
gcuccaaccugcaaa

SEQ ID NO: 1372548 - RNA, 14 nt, Human
gcuccaagaauuuc

SEQ ID NO: 1372549 - RNA, 14 nt, Human
gcuucucccaggca

SEQ ID NO: 1372550 - RNA, 13 nt, Human
gcuucucccaggc

SEQ ID NO: 1372551 - RNA, 11 nt, Human
gcuucucccag

SEQ ID NO: 1372552 - RNA, 22 nt, Human
gcuucucauccugcaggcagcu

SEQ ID NO: 1372553 - RNA, 23 nt, Human
gcuucugagcagcgagccugcua

SEQ ID NO: 1372554 - RNA, 21 nt, Human
gcuucugagcagcgagccugc

SEQ ID NO: 1372555 - RNA, 18 nt, Human
gcuucugagcagcgagcc

SEQ ID NO: 1372556 - RNA, 22 nt, Human
gcuucucccaggcaaggcugug

SEQ ID NO: 1372557 - RNA, 20 nt, Human
gcuucucccaggcaaggcug

SEQ ID NO: 1372558 - RNA, 23 nt, Human
gcuucucccaggcaaggcugugg

SEQ ID NO: 1372559 - RNA, 18 nt, Human
gcuucucccaggcaaggc

SEQ ID NO: 1372560 - RNA, 17 nt, Human
gcuucucccaggcaagg

SEQ ID NO: 1372561 - RNA, 16 nt, Human
gcuucucccaggcaag

SEQ ID NO: 1372562 - RNA, 15 nt, Human
gcuucucccaggcaa

SEQ ID NO: 1372563 - RNA, 22 nt, Human
gcuucugagcagcgagccugcu

SEQ ID NO: 1372564 - RNA, 17 nt, Human
gcuucugcccccugcag

SEQ ID NO: 1372565 - RNA, 16 nt, Human
gcuucugcccccugca

SEQ ID NO: 1372566 - RNA, 19 nt, Human
gcuucugcccccugcagaa

SEQ ID NO: 1372567 - RNA, 15 nt, Human
gcuuaugguaccaga

SEQ ID NO: 1372568 - RNA, 15 nt, Human
gcuuaugcucuuaau

SEQ ID NO: 1372569 - RNA, 21 nt, Human
gcuuaguuuguguguugucuc

SEQ ID NO: 1372570 - RNA, 20 nt, Human
gcuuaguuuguguguugucu

SEQ ID NO: 1372571 - RNA, 23 nt, Human
gcuuaugauagcaaauggccuca

SEQ ID NO: 1372572 - RNA, 18 nt, Human
gcuuaugcuuaaauucaa

SEQ ID NO: 1372573 - RNA, 23 nt, Human
gcuuaugacaucacuuguacaaa

SEQ ID NO: 1372574 - RNA, 22 nt, Human
gcuuaugacaucacuuguacaa

SEQ ID NO: 1372575 - RNA, 18 nt, Human
gcuuaugacaucacuugu

SEQ ID NO: 1372576 - RNA, 15 nt, Human
gcuuaugaaaagaau

SEQ ID NO: 1372577 - RNA, 16 nt, Human
gcuuauaauucuuuca

SEQ ID NO: 1372578 - RNA, 17 nt, Human
gcuuauaauaaaggacu

SEQ ID NO: 1372579 - RNA, 20 nt, Human
gcuuagcucaauuagugugg

SEQ ID NO: 1372580 - RNA, 23 nt, Human
gcuuagcuuuagaaacagugcaa

SEQ ID NO: 1372581 - RNA, 19 nt, Human
gcuuagcaguccccuuccc

SEQ ID NO: 1372582 - RNA, 13 nt, Human
gcuuagauuucau

SEQ ID NO: 1372583 - RNA, 15 nt, Human
gcuuagauuucauag

SEQ ID NO: 1372584 - RNA, 16 nt, Human
gcuuagaguuggccau

SEQ ID NO: 1372585 - RNA, 12 nt, Human
gcuguugcugaa

SEQ ID NO: 1372586 - RNA, 13 nt, Human
gcuguugcugaau

SEQ ID NO: 1372587 - RNA, 16 nt, Human
gcuuaguuuguguguu

SEQ ID NO: 1372588 - RNA, 14 nt, Human
gcuuaguuugugug

SEQ ID NO: 1372589 - RNA, 12 nt, Human
gcuuaguuugug

SEQ ID NO: 1372590 - RNA, 19 nt, Human
gcuguccuuuuuccucucc

SEQ ID NO: 1372591 - RNA, 14 nt, Human
gcuguccuuuuucc

SEQ ID NO: 1372592 - RNA, 14 nt, Human
gcuguccuuucuag

SEQ ID NO: 1372593 - RNA, 20 nt, Human
gcugucuacacuaagagaga

SEQ ID NO: 1372594 - RNA, 19 nt, Human
gcuguggugagggaagacg

SEQ ID NO: 1372595 - RNA, 23 nt, Human
gcuguggugugucccccucuguc

SEQ ID NO: 1372596 - RNA, 12 nt, Human
gcuguucaugaa

SEQ ID NO: 1372597 - RNA, 21 nt, Human
gcuguucaugaaagauucaau

SEQ ID NO: 1372598 - RNA, 22 nt, Human
ggaaagggcccuccuuccuaaa

SEQ ID NO: 1372599 - RNA, 21 nt, Human
ggaaagggcccuccuuccuaa

SEQ ID NO: 1372600 - RNA, 20 nt, Human
ggaaagggcccuccuuccua

SEQ ID NO: 1372601 - RNA, 21 nt, Human
ggaaaggggcaggccagagcu

SEQ ID NO: 1372602 - RNA, 23 nt, Human
ggaaagggauuuucagcccucag

SEQ ID NO: 1372603 - RNA, 15 nt, Human
ggaaaauucauuuuu

SEQ ID NO: 1372604 - RNA, 14 nt, Human
ggaaaauucauuuu

SEQ ID NO: 1372605 - RNA, 12 nt, Human
ggaaaauuauuu

SEQ ID NO: 1372606 - RNA, 23 nt, Human
ggaaauauauauuauacuuguaa

SEQ ID NO: 1372607 - RNA, 16 nt, Human
ggaaauauauauuaua

SEQ ID NO: 1372608 - RNA, 18 nt, Human
ggaaauacaguucugcuc

SEQ ID NO: 1372609 - RNA, 19 nt, Human
ggaaauacaguucugcucu

SEQ ID NO: 1372610 - RNA, 16 nt, Human
ggaaaucaacuugcuu

SEQ ID NO: 1372611 - RNA, 21 nt, Human
ggaaccccggggugcccacag

SEQ ID NO: 1372612 - RNA, 15 nt, Human
ggaacccagacucag

SEQ ID NO: 1372613 - RNA, 14 nt, Human
ggaacccagacuca

SEQ ID NO: 1372614 - RNA, 13 nt, Human
ggaacccagacuc

SEQ ID NO: 1372615 - RNA, 11 nt, Human
ggaacccagac

SEQ ID NO: 1372616 - RNA, 13 nt, Human
ggaaccagacucu

SEQ ID NO: 1372617 - RNA, 19 nt, Human
ggaaccagacucuugccug

SEQ ID NO: 1372618 - RNA, 12 nt, Human
ggaaccagacuc

SEQ ID NO: 1372619 - RNA, 11 nt, Human
ggaaccagacu

SEQ ID NO: 1372620 - RNA, 14 nt, Human
ggaacauggggagg

SEQ ID NO: 1372621 - RNA, 13 nt, Human
ggaacauggggag

SEQ ID NO: 1372622 - RNA, 19 nt, Human
ggaacagugugcaaggcag

SEQ ID NO: 1372623 - RNA, 18 nt, Human
ggaacagugugcaaggca

SEQ ID NO: 1372624 - RNA, 13 nt, Human
ggaacauaaaaag

SEQ ID NO: 1372625 - RNA, 17 nt, Human
ggaacauggggaggagg

SEQ ID NO: 1372626 - RNA, 18 nt, Human
ggaacauaaaaaggacau

SEQ ID NO: 1372627 - RNA, 23 nt, Human
gcuuuguuuugcacacuuugcca

SEQ ID NO: 1372628 - RNA, 14 nt, Human
gcuuuguuuugcac

SEQ ID NO: 1372629 - RNA, 15 nt, Human
ggaaaaauguaggag

SEQ ID NO: 1372630 - RNA, 18 nt, Human
ggaaaacaugcuacacac

SEQ ID NO: 1372631 - RNA, 18 nt, Human
gcuuuucaugcaaacucu

SEQ ID NO: 1372632 - RNA, 16 nt, Human
gcuuuucccaaaagcc

SEQ ID NO: 1372633 - RNA, 17 nt, Human
ggaaaaggccuggggug

SEQ ID NO: 1372634 - RNA, 22 nt, Human
ggaaaaggccuggggugacccg

SEQ ID NO: 1372635 - RNA, 16 nt, Human
ggaaaaggccuggggu

SEQ ID NO: 1372636 - RNA, 14 nt, Human
ggaaaaggccuggg

SEQ ID NO: 1372637 - RNA, 13 nt, Human
ggaaaaggccugg

SEQ ID NO: 1372638 - RNA, 12 nt, Human
ggaaaaggccug

SEQ ID NO: 1372639 - RNA, 10 nt, Human
ggaaaagcuu

SEQ ID NO: 1372640 - RNA, 15 nt, Human
ggaaaacagaacacu

SEQ ID NO: 1372641 - RNA, 15 nt, Human
ggaaaacauuccauc

SEQ ID NO: 1372642 - RNA, 16 nt, Human
gcuuuagaaucccagc

SEQ ID NO: 1372643 - RNA, 21 nt, Human
gcuuuagaaucccagcccccu

SEQ ID NO: 1372644 - RNA, 20 nt, Human
gcuuuagaaacagugcaaca

SEQ ID NO: 1372645 - RNA, 12 nt, Human
gcuuuagaaaca

SEQ ID NO: 1372646 - RNA, 18 nt, Human
gcuucugcccccugcaga

SEQ ID NO: 1372647 - RNA, 22 nt, Human
gcuuuguggcacuggggcaggg

SEQ ID NO: 1372648 - RNA, 18 nt, Human
gcuuugucuacuucaaaa

SEQ ID NO: 1372649 - RNA, 14 nt, Human
gcuuuguggcacug

SEQ ID NO: 1372650 - RNA, 15 nt, Human
gcuuugugauuuuug

SEQ ID NO: 1372651 - RNA, 13 nt, Human
gcuuucagggagg

SEQ ID NO: 1372652 - RNA, 13 nt, Human
gcuuucagagccu

SEQ ID NO: 1372653 - RNA, 15 nt, Human
gcuuucagaauaugu

SEQ ID NO: 1372654 - RNA, 19 nt, Human
ggaaugcccuucacuguca

SEQ ID NO: 1372655 - RNA, 16 nt, Human
ggaauggcagcagggg

SEQ ID NO: 1372656 - RNA, 14 nt, Human
ggaauggcagcagg

SEQ ID NO: 1372657 - RNA, 12 nt, Human
ggaauggcagca

SEQ ID NO: 1372658 - RNA, 22 nt, Human
ggaauggauuuuucuuuaacug

SEQ ID NO: 1372659 - RNA, 20 nt, Human
ggaauggauuuuucuuuaac

SEQ ID NO: 1372660 - RNA, 14 nt, Human
ggaauggaggggca

SEQ ID NO: 1372661 - RNA, 16 nt, Human
ggaauggaggggcaga

SEQ ID NO: 1372662 - RNA, 17 nt, Human
ggaauggaggggcagag

SEQ ID NO: 1372663 - RNA, 19 nt, Human
ggaauggauuuuucuuuaa

SEQ ID NO: 1372664 - RNA, 21 nt, Human
ggaauggaggggcagagccag

SEQ ID NO: 1372665 - RNA, 19 nt, Human
ggaauuacgugcucugugg

SEQ ID NO: 1372666 - RNA, 19 nt, Human
ggaauugauuugcauugaa

SEQ ID NO: 1372667 - RNA, 18 nt, Human
ggaauugauuugcauuga

SEQ ID NO: 1372668 - RNA, 17 nt, Human
ggaauugauuugcauug

SEQ ID NO: 1372669 - RNA, 15 nt, Human
ggaauugauuugcau

SEQ ID NO: 1372670 - RNA, 13 nt, Human
ggacaaaggagcc

SEQ ID NO: 1372671 - RNA, 13 nt, Human
ggacaaagaaccu

SEQ ID NO: 1372672 - RNA, 14 nt, Human
ggacaaagaaccuu

SEQ ID NO: 1372673 - RNA, 17 nt, Human
ggacaaaauggaauacu

SEQ ID NO: 1372674 - RNA, 16 nt, Human
ggacaaaauggaauac

SEQ ID NO: 1372675 - RNA, 20 nt, Human
ggacaaaaccccccagauau

SEQ ID NO: 1372676 - RNA, 19 nt, Human
ggaauuuucaucuaggauu

SEQ ID NO: 1372677 - RNA, 18 nt, Human
ggacaaaucacauauuuu

SEQ ID NO: 1372678 - RNA, 21 nt, Human
ggacaaaucacauauuuuaaa

SEQ ID NO: 1372679 - RNA, 18 nt, Human
ggacaaaggagccuguga

SEQ ID NO: 1372680 - RNA, 17 nt, Human
ggacaaaggagccugug

SEQ ID NO: 1372681 - RNA, 16 nt, Human
ggacaaaggagccugu

SEQ ID NO: 1372682 - RNA, 15 nt, Human
ggacaaaggagccug

SEQ ID NO: 1372683 - RNA, 14 nt, Human
ggacaaaggagccu

SEQ ID NO: 1372684 - RNA, 15 nt, Human
ggacacuacacccag

SEQ ID NO: 1372685 - RNA, 16 nt, Human
ggacacuacacccagc

SEQ ID NO: 1372686 - RNA, 17 nt, Human
ggacacuacacccagca

SEQ ID NO: 1372687 - RNA, 18 nt, Human
ggacacuacacccagcaa

SEQ ID NO: 1372688 - RNA, 19 nt, Human
ggacacuacacccagcaau

SEQ ID NO: 1372689 - RNA, 20 nt, Human
ggacacuacacccagcaaua

SEQ ID NO: 1372690 - RNA, 21 nt, Human
ggacacuacacccagcaauag

SEQ ID NO: 1372691 - RNA, 16 nt, Human
ggaauuugccugcugg

SEQ ID NO: 1372692 - RNA, 22 nt, Human
ggaauuucuuaacuucuugcuu

SEQ ID NO: 1372693 - RNA, 18 nt, Human
ggaauuucuuaacuucuu

SEQ ID NO: 1372694 - RNA, 19 nt, Human
ggaauuucccaggacccug

SEQ ID NO: 1372695 - RNA, 18 nt, Human
ggaauuucccaggacccu

SEQ ID NO: 1372696 - RNA, 17 nt, Human
ggaauuucccaggaccc

SEQ ID NO: 1372697 - RNA, 16 nt, Human
ggaauuucccaggacc

SEQ ID NO: 1372698 - RNA, 15 nt, Human
ggaauuucccaggac

SEQ ID NO: 1372699 - RNA, 14 nt, Human
ggaauuucccagga

SEQ ID NO: 1372700 - RNA, 12 nt, Human
ggaauuguguuu

SEQ ID NO: 1372701 - RNA, 22 nt, Human
ggaauuggagcucgugggacag

SEQ ID NO: 1372702 - RNA, 16 nt, Human
ggaauuggagcucgug

SEQ ID NO: 1372703 - RNA, 14 nt, Human
ggaaggggacccuc

SEQ ID NO: 1372704 - RNA, 17 nt, Human
ggaaggggccagaggcu

SEQ ID NO: 1372705 - RNA, 15 nt, Human
ggaaggggccagagg

SEQ ID NO: 1372706 - RNA, 14 nt, Human
ggaaggguaaacaa

SEQ ID NO: 1372707 - RNA, 15 nt, Human
ggaaggguaaacaau

SEQ ID NO: 1372708 - RNA, 16 nt, Human
ggaaguaggaaguaaa

SEQ ID NO: 1372709 - RNA, 14 nt, Human
ggaaguagaaacaa

SEQ ID NO: 1372710 - RNA, 20 nt, Human
ggaagugaagacuggaagcu

SEQ ID NO: 1372711 - RNA, 23 nt, Human
ggaagucguccuuacuccugugg

SEQ ID NO: 1372712 - RNA, 22 nt, Human
ggaagucguccuuacuccugug

SEQ ID NO: 1372713 - RNA, 21 nt, Human
ggaagucguccuuacuccugu

SEQ ID NO: 1372714 - RNA, 16 nt, Human
ggaaguccggccccag

SEQ ID NO: 1372715 - RNA, 17 nt, Human
ggaaguccaauguggca

SEQ ID NO: 1372716 - RNA, 16 nt, Human
ggaaguccaauguggc

SEQ ID NO: 1372717 - RNA, 15 nt, Human
ggaaguccaaugugg

SEQ ID NO: 1372718 - RNA, 13 nt, Human
ggaagucaaagca

SEQ ID NO: 1372719 - RNA, 22 nt, Human
ggaaguggcugagucaggacuu

SEQ ID NO: 1372720 - RNA, 18 nt, Human
ggaagugcuaauuuugaa

SEQ ID NO: 1372721 - RNA, 21 nt, Human
ggaagggagccaagggaugga

SEQ ID NO: 1372722 - RNA, 17 nt, Human
ggaagggagccaaggga

SEQ ID NO: 1372723 - RNA, 15 nt, Human
ggaagggagccaagg

SEQ ID NO: 1372724 - RNA, 13 nt, Human
ggaagggagccaa

SEQ ID NO: 1372725 - RNA, 11 nt, Human
ggaagggagcc

SEQ ID NO: 1372726 - RNA, 21 nt, Human
ggaaggcuuguugugcuuuua

SEQ ID NO: 1372727 - RNA, 19 nt, Human
ggaaggcuuguugugcuuu

SEQ ID NO: 1372728 - RNA, 22 nt, Human
ggaaggcuacuucggggcuggg

SEQ ID NO: 1372729 - RNA, 23 nt, Human
ggaaggcuacuucggggcuggga

SEQ ID NO: 1372730 - RNA, 20 nt, Human
ggaaggcuacuucggggcug

SEQ ID NO: 1372731 - RNA, 19 nt, Human
ggaaggcuacuucggggcu

SEQ ID NO: 1372732 - RNA, 17 nt, Human
ggaaggcagggaggagg

SEQ ID NO: 1372733 - RNA, 21 nt, Human
ggaaggcagggaggaggcaga

SEQ ID NO: 1372734 - RNA, 17 nt, Human
ggaaggcaggcagggcu

SEQ ID NO: 1372735 - RNA, 16 nt, Human
ggaaggcaggcagggc

SEQ ID NO: 1372736 - RNA, 15 nt, Human
ggaaggcaggcaggg

SEQ ID NO: 1372737 - RNA, 14 nt, Human
ggaaggcaggcagg

SEQ ID NO: 1372738 - RNA, 12 nt, Human
ggaaggcaggca

SEQ ID NO: 1372739 - RNA, 11 nt, Human
ggaaggcaggc

SEQ ID NO: 1372740 - RNA, 22 nt, Human
ggaaggcaggcagggcucuccu

SEQ ID NO: 1372741 - RNA, 21 nt, Human
ggaaggcaggcagggcucucc

SEQ ID NO: 1372742 - RNA, 19 nt, Human
ggaaggcaggcagggcucu

SEQ ID NO: 1372743 - RNA, 18 nt, Human
ggaaggcaggcagggcuc

SEQ ID NO: 1372744 - RNA, 22 nt, Human
ggaaggauucugcuggccucug

SEQ ID NO: 1372745 - RNA, 20 nt, Human
ggaaggauucugcuggccuc

SEQ ID NO: 1372746 - RNA, 19 nt, Human
ggaaggauucugcuggccu

SEQ ID NO: 1372747 - RNA, 22 nt, Human
ggaaggaucccaugagcuccuu

SEQ ID NO: 1372748 - RNA, 16 nt, Human
ggaaggauucugcugg

SEQ ID NO: 1372749 - RNA, 19 nt, Human
ggacgccugggggugccag

SEQ ID NO: 1372750 - RNA, 14 nt, Human
ggacgccugggggu

SEQ ID NO: 1372751 - RNA, 17 nt, Human
ggacgcccaggacccca

SEQ ID NO: 1372752 - RNA, 20 nt, Human
ggaccuucgggcugugcccg

SEQ ID NO: 1372753 - RNA, 19 nt, Human
ggaccuucgggcugugccc

SEQ ID NO: 1372754 - RNA, 18 nt, Human
ggaccuucgggcugugcc

SEQ ID NO: 1372755 - RNA, 21 nt, Human
ggaccagaagcucccccagca

SEQ ID NO: 1372756 - RNA, 18 nt, Human
ggaccagaagcuccccca

SEQ ID NO: 1372757 - RNA, 15 nt, Human
ggaccagaagcuccc

SEQ ID NO: 1372758 - RNA, 14 nt, Human
ggaccacaggcuca

SEQ ID NO: 1372759 - RNA, 15 nt, Human
ggaccacaggcucag

SEQ ID NO: 1372760 - RNA, 20 nt, Human
ggaccacaacuauuuucaga

SEQ ID NO: 1372761 - RNA, 18 nt, Human
ggaccacccugagccggc

SEQ ID NO: 1372762 - RNA, 16 nt, Human
ggaccacccugagccg

SEQ ID NO: 1372763 - RNA, 15 nt, Human
ggaccacccugagcc

SEQ ID NO: 1372764 - RNA, 22 nt, Human
ggaccacccucacuggcucucc

SEQ ID NO: 1372765 - RNA, 21 nt, Human
ggacagaugccuccuuccucu

SEQ ID NO: 1372766 - RNA, 15 nt, Human
ggacagaugccuccu

SEQ ID NO: 1372767 - RNA, 22 nt, Human
ggacacuacacccagcaauaga

SEQ ID NO: 1372768 - RNA, 20 nt, Human
ggacagaugccuccuuccuc

SEQ ID NO: 1372769 - RNA, 19 nt, Human
ggacagcaacuaucagacu

SEQ ID NO: 1372770 - RNA, 16 nt, Human
ggaccaagcaucuugg

SEQ ID NO: 1372771 - RNA, 22 nt, Human
ggaccaaagggagucugccagg

SEQ ID NO: 1372772 - RNA, 12 nt, Human
ggaccaaagcaa

SEQ ID NO: 1372773 - RNA, 14 nt, Human
ggacauuucucuaa

SEQ ID NO: 1372774 - RNA, 16 nt, Human
ggacauuugcucaugg

SEQ ID NO: 1372775 - RNA, 15 nt, Human
ggagaagccaggaau

SEQ ID NO: 1372776 - RNA, 13 nt, Human
ggagaagccagga

SEQ ID NO: 1372777 - RNA, 12 nt, Human
ggagaagccagg

SEQ ID NO: 1372778 - RNA, 17 nt, Human
ggacugugugcucagga

SEQ ID NO: 1372779 - RNA, 16 nt, Human
ggacugcucaggaaac

SEQ ID NO: 1372780 - RNA, 20 nt, Human
ggacgccugggggugccagg

SEQ ID NO: 1372781 - RNA, 20 nt, Human
ggacugggagcccccagccu

SEQ ID NO: 1372782 - RNA, 19 nt, Human
ggacugggagcccccagcc

SEQ ID NO: 1372783 - RNA, 18 nt, Human
ggacugggagcccccagc

SEQ ID NO: 1372784 - RNA, 21 nt, Human
ggacugggagcccccagccug

SEQ ID NO: 1372785 - RNA, 18 nt, Human
ggagacagcaucaggguu

SEQ ID NO: 1372786 - RNA, 17 nt, Human
ggagacagcaucagggu

SEQ ID NO: 1372787 - RNA, 14 nt, Human
ggagacagcaucag

SEQ ID NO: 1372788 - RNA, 20 nt, Human
ggagacacuggccccucaaa

SEQ ID NO: 1372789 - RNA, 17 nt, Human
ggagacacuggccccuc

SEQ ID NO: 1372790 - RNA, 18 nt, Human
ggagaagcccgugugaga

SEQ ID NO: 1372791 - RNA, 15 nt, Human
ggagaaucaucagga

SEQ ID NO: 1372792 - RNA, 17 nt, Human
ggagaaucaucaggacc

SEQ ID NO: 1372793 - RNA, 22 nt, Human
ggagaaucaucaggacccugga

SEQ ID NO: 1372794 - RNA, 19 nt, Human
ggagaaucgcuccugcagc

SEQ ID NO: 1372795 - RNA, 18 nt, Human
ggagaguuuccugaaaca

SEQ ID NO: 1372796 - RNA, 13 nt, Human
ggagagugggggu

SEQ ID NO: 1372797 - RNA, 17 nt, Human
ggagagucucccaggga

SEQ ID NO: 1372798 - RNA, 16 nt, Human
ggagagguugucugug

SEQ ID NO: 1372799 - RNA, 17 nt, Human
ggagaggccccagccgc

SEQ ID NO: 1372800 - RNA, 15 nt, Human
ggagauccuccugca

SEQ ID NO: 1372801 - RNA, 13 nt, Human
ggagauccuccug

SEQ ID NO: 1372802 - RNA, 14 nt, Human
ggagaugaggccag

SEQ ID NO: 1372803 - RNA, 15 nt, Human
ggagaugaggccaga

SEQ ID NO: 1372804 - RNA, 16 nt, Human
ggagaugaggccagac

SEQ ID NO: 1372805 - RNA, 14 nt, Human
ggccaggccucucc

SEQ ID NO: 1372806 - RNA, 18 nt, Human
ggccagcugugguuuucu

SEQ ID NO: 1372807 - RNA, 23 nt, Human
ggccauguccaaagaggcugccc

SEQ ID NO: 1372808 - RNA, 22 nt, Human
ggccauguccaaagaggcugcc

SEQ ID NO: 1372809 - RNA, 16 nt, Human
ggccauguccaaagag

SEQ ID NO: 1372810 - RNA, 15 nt, Human
ggccauguccaaaga

SEQ ID NO: 1372811 - RNA, 13 nt, Human
ggccauguccaaa

SEQ ID NO: 1372812 - RNA, 20 nt, Human
ggccauucuccacagcaacc

SEQ ID NO: 1372813 - RNA, 20 nt, Human
ggccauucuuucccaacacc

SEQ ID NO: 1372814 - RNA, 15 nt, Human
ggccagcuuuucaaa

SEQ ID NO: 1372815 - RNA, 18 nt, Human
ggccagcuggaggcaggg

SEQ ID NO: 1372816 - RNA, 15 nt, Human
ggccagcuggaggca

SEQ ID NO: 1372817 - RNA, 13 nt, Human
ggccagcuggagg

SEQ ID NO: 1372818 - RNA, 22 nt, Human
ggccagcgagcgcccagcuccu

SEQ ID NO: 1372819 - RNA, 21 nt, Human
ggccagccuggccuccugccu

SEQ ID NO: 1372820 - RNA, 22 nt, Human
ggccagccuggccuccugccuc

SEQ ID NO: 1372821 - RNA, 20 nt, Human
ggccagccuggccuccugcc

SEQ ID NO: 1372822 - RNA, 19 nt, Human
ggccagccuggccuccugc

SEQ ID NO: 1372823 - RNA, 18 nt, Human
ggccagccuggccuccug

SEQ ID NO: 1372824 - RNA, 17 nt, Human
ggccagccuggccuccu

SEQ ID NO: 1372825 - RNA, 18 nt, Human
ggccacgcuccagcugcc

SEQ ID NO: 1372826 - RNA, 16 nt, Human
ggccagccuggccucc

SEQ ID NO: 1372827 - RNA, 15 nt, Human
ggccagccuggccuc

SEQ ID NO: 1372828 - RNA, 14 nt, Human
ggccagccuggccu

SEQ ID NO: 1372829 - RNA, 13 nt, Human
ggccagccuggcc

SEQ ID NO: 1372830 - RNA, 12 nt, Human
ggccagccuggc

SEQ ID NO: 1372831 - RNA, 11 nt, Human
ggccagccucu

SEQ ID NO: 1372832 - RNA, 11 nt, Human
ggccagccugg

SEQ ID NO: 1372833 - RNA, 20 nt, Human
ggccacuccuuccugcccca

SEQ ID NO: 1372834 - RNA, 19 nt, Human
ggccacuccuuccugcccc

SEQ ID NO: 1372835 - RNA, 17 nt, Human
ggccacuccuuccugcc

SEQ ID NO: 1372836 - RNA, 16 nt, Human
ggccacuccuuccugc

SEQ ID NO: 1372837 - RNA, 15 nt, Human
ggccacuccuuccug

SEQ ID NO: 1372838 - RNA, 14 nt, Human
ggccacuccuuccu

SEQ ID NO: 1372839 - RNA, 13 nt, Human
ggccacuccgaga

SEQ ID NO: 1372840 - RNA, 19 nt, Human
ggccacaugggaggcucac

SEQ ID NO: 1372841 - RNA, 18 nt, Human
ggccacaugggaggcuca

SEQ ID NO: 1372842 - RNA, 15 nt, Human
ggcagcucuggacag

SEQ ID NO: 1372843 - RNA, 18 nt, Human
ggcagcuccucugucucg

SEQ ID NO: 1372844 - RNA, 21 nt, Human
ggcagcuccucugucucgagc

SEQ ID NO: 1372845 - RNA, 16 nt, Human
ggcagcuccucugucu

SEQ ID NO: 1372846 - RNA, 13 nt, Human
ggcagcuccucug

SEQ ID NO: 1372847 - RNA, 20 nt, Human
ggcagcucuggacagcccca

SEQ ID NO: 1372848 - RNA, 16 nt, Human
ggcagcuucugccccc

SEQ ID NO: 1372849 - RNA, 23 nt, Human
ggcacuaacguugagccccugga

SEQ ID NO: 1372850 - RNA, 22 nt, Human
ggcaccugguggccaugcuccu

SEQ ID NO: 1372851 - RNA, 23 nt, Human
ggcaccugggcccuggggccugu

SEQ ID NO: 1372852 - RNA, 16 nt, Human
ggcaccuaauccaggc

SEQ ID NO: 1372853 - RNA, 15 nt, Human
ggcaccuaauccagg

SEQ ID NO: 1372854 - RNA, 22 nt, Human
ggcaccgaagcccagagggucu

SEQ ID NO: 1372855 - RNA, 22 nt, Human
ggcagcgccaggcugaccacag

SEQ ID NO: 1372856 - RNA, 14 nt, Human
ggcagggugacccu

SEQ ID NO: 1372857 - RNA, 23 nt, Human
ggcagcuucugcccccugcagaa

SEQ ID NO: 1372858 - RNA, 22 nt, Human
ggcagcuucugcccccugcaga

SEQ ID NO: 1372859 - RNA, 21 nt, Human
ggcagcuucugcccccugcag

SEQ ID NO: 1372860 - RNA, 20 nt, Human
ggcagcuucugcccccugca

SEQ ID NO: 1372861 - RNA, 17 nt, Human
ggcagcuucugcccccu

SEQ ID NO: 1372862 - RNA, 12 nt, Human
ggcauggaaauu

SEQ ID NO: 1372863 - RNA, 17 nt, Human
ggcaucuuuuguauuaa

SEQ ID NO: 1372864 - RNA, 21 nt, Human
ggcaucuuuuguauuaagaaa

SEQ ID NO: 1372865 - RNA, 16 nt, Human
ggcaucuuuuguauua

SEQ ID NO: 1372866 - RNA, 14 nt, Human
ggcaucuuuuguau

SEQ ID NO: 1372867 - RNA, 11 nt, Human
ggcaucuuuug

SEQ ID NO: 1372868 - RNA, 16 nt, Human
ggcacccccagccugg

SEQ ID NO: 1372869 - RNA, 15 nt, Human
ggcacccccagccug

SEQ ID NO: 1372870 - RNA, 14 nt, Human
ggcacccccagccu

SEQ ID NO: 1372871 - RNA, 13 nt, Human
ggcacccccagcc

SEQ ID NO: 1372872 - RNA, 18 nt, Human
ggcaaugccacagcccug

SEQ ID NO: 1372873 - RNA, 21 nt, Human
ggcaaugggagcugaggccac

SEQ ID NO: 1372874 - RNA, 20 nt, Human
ggcaaugggagcugaggcca

SEQ ID NO: 1372875 - RNA, 15 nt, Human
ggcacccccugcagc

SEQ ID NO: 1372876 - RNA, 23 nt, Human
ggcaccgaagcccagagggucug

SEQ ID NO: 1372877 - RNA, 16 nt, Human
ggcaccgaagcccaga

SEQ ID NO: 1372878 - RNA, 15 nt, Human
ggcaccgaagcccag

SEQ ID NO: 1372879 - RNA, 14 nt, Human
ggcacccccugcag

SEQ ID NO: 1372880 - RNA, 13 nt, Human
ggcacccccugca

SEQ ID NO: 1372881 - RNA, 17 nt, Human
ggcacccccgucaagag

SEQ ID NO: 1372882 - RNA, 21 nt, Human
ggcacccccagccugggccua

SEQ ID NO: 1372883 - RNA, 20 nt, Human
ggcacccccagccugggccu

SEQ ID NO: 1372884 - RNA, 19 nt, Human
ggcacccccagccugggcc

SEQ ID NO: 1372885 - RNA, 18 nt, Human
ggcacccccagccugggc

SEQ ID NO: 1372886 - RNA, 17 nt, Human
ggcacccccagccuggg

SEQ ID NO: 1372887 - RNA, 17 nt, Human
ggcaaugccacagcccu

SEQ ID NO: 1372888 - RNA, 15 nt, Human
ggcaaugauggcaau

SEQ ID NO: 1372889 - RNA, 19 nt, Human
ggcaaucauggugcucaga

SEQ ID NO: 1372890 - RNA, 19 nt, Human
ggauugcgagagaugugug

SEQ ID NO: 1372891 - RNA, 18 nt, Human
ggauugcgagagaugugu

SEQ ID NO: 1372892 - RNA, 17 nt, Human
ggauugcgagagaugug

SEQ ID NO: 1372893 - RNA, 13 nt, Human
ggauggacaucuu

SEQ ID NO: 1372894 - RNA, 16 nt, Human
ggauugcgagagaugu

SEQ ID NO: 1372895 - RNA, 19 nt, Human
ggauugcaauaucugaagc

SEQ ID NO: 1372896 - RNA, 18 nt, Human
ggauugcacguggccucu

SEQ ID NO: 1372897 - RNA, 17 nt, Human
ggauugcacguggccuc

SEQ ID NO: 1372898 - RNA, 15 nt, Human
ggauugcacguggcc

SEQ ID NO: 1372899 - RNA, 16 nt, Human
ggauucuuccaucuga

SEQ ID NO: 1372900 - RNA, 14 nt, Human
ggauggacaucuug

SEQ ID NO: 1372901 - RNA, 16 nt, Human
ggaugcuaacaucuaa

SEQ ID NO: 1372902 - RNA, 16 nt, Human
ggaugcggauggccgg

SEQ ID NO: 1372903 - RNA, 15 nt, Human
ggaugcuuguacaua

SEQ ID NO: 1372904 - RNA, 22 nt, Human
ggaugccaauauuaaaucugcu

SEQ ID NO: 1372905 - RNA, 14 nt, Human
ggaugcagugcucg

SEQ ID NO: 1372906 - RNA, 22 nt, Human
ggaugcagugcucgcuguugcu

SEQ ID NO: 1372907 - RNA, 21 nt, Human
ggauccgacugcuuuggaccu

SEQ ID NO: 1372908 - RNA, 19 nt, Human
ggauccgacugcuuuggac

SEQ ID NO: 1372909 - RNA, 17 nt, Human
ggauccgacugcuuugg

SEQ ID NO: 1372910 - RNA, 23 nt, Human
ggaugcacagaguuguuacauuu

SEQ ID NO: 1372911 - RNA, 20 nt, Human
ggauauaguuuuacuuuuaa

SEQ ID NO: 1372912 - RNA, 16 nt, Human
ggauauaguuuuacuu

SEQ ID NO: 1372913 - RNA, 21 nt, Human
ggauaggccuucauuaacaaa

SEQ ID NO: 1372914 - RNA, 15 nt, Human
ggauaggccagccgc

SEQ ID NO: 1372915 - RNA, 14 nt, Human
ggauaggccagccg

SEQ ID NO: 1372916 - RNA, 16 nt, Human
ggauauguaaaacauu

SEQ ID NO: 1372917 - RNA, 18 nt, Human
ggaucacaagauggaauu

SEQ ID NO: 1372918 - RNA, 14 nt, Human
ggaucacaagaugg

SEQ ID NO: 1372919 - RNA, 17 nt, Human
ggaucccucccccccau

SEQ ID NO: 1372920 - RNA, 22 nt, Human
ggaucccucaucugucccuccg

SEQ ID NO: 1372921 - RNA, 18 nt, Human
ggaucccucaucuguccc

SEQ ID NO: 1372922 - RNA, 13 nt, Human
ggaucccucaucu

SEQ ID NO: 1372923 - RNA, 18 nt, Human
ggauagaugcuggcccag

SEQ ID NO: 1372924 - RNA, 14 nt, Human
ggauagaugcuggc

SEQ ID NO: 1372925 - RNA, 13 nt, Human
ggauagaugcugg

SEQ ID NO: 1372926 - RNA, 12 nt, Human
ggauagaggggu

SEQ ID NO: 1372927 - RNA, 18 nt, Human
ggauacuuauauggaaau

SEQ ID NO: 1372928 - RNA, 18 nt, Human
ggauacaaaagcauguga

SEQ ID NO: 1372929 - RNA, 21 nt, Human
ggauacgcaucagacagaugg

SEQ ID NO: 1372930 - RNA, 18 nt, Human
ggagaugaggccagacca

SEQ ID NO: 1372931 - RNA, 15 nt, Human
ggccuaggauucuaa

SEQ ID NO: 1372932 - RNA, 13 nt, Human
ggccuaggauucu

SEQ ID NO: 1372933 - RNA, 23 nt, Human
ggccuaggaggguccucugagac

SEQ ID NO: 1372934 - RNA, 21 nt, Human
ggccuaggaggguccucugag

SEQ ID NO: 1372935 - RNA, 19 nt, Human
ggccuaggaggguccucug

SEQ ID NO: 1372936 - RNA, 17 nt, Human
ggccuaggaggguccuc

SEQ ID NO: 1372937 - RNA, 24 nt, Human
ggccuacuagagucugaacagcug

SEQ ID NO: 1372938 - RNA, 23 nt, Human
ggccuaccccgcagacaccuugg

SEQ ID NO: 1372939 - RNA, 20 nt, Human
ggccuaccccgcagacaccu

SEQ ID NO: 1372940 - RNA, 16 nt, Human
ggccuaccccgcagac

SEQ ID NO: 1372941 - RNA, 20 nt, Human
ggccuaagaggcugcccucc

SEQ ID NO: 1372942 - RNA, 18 nt, Human
ggccuaagaggcugcccu

SEQ ID NO: 1372943 - RNA, 22 nt, Human
ggccuaagaggcugcccuccug

SEQ ID NO: 1372944 - RNA, 15 nt, Human
ggccuaagaggcugc

SEQ ID NO: 1372945 - RNA, 20 nt, Human
ggccgugacgucuggguggc

SEQ ID NO: 1372946 - RNA, 16 nt, Human
ggccgugacgucuggg

SEQ ID NO: 1372947 - RNA, 21 nt, Human
ggccgugaaugggugcccaca

SEQ ID NO: 1372948 - RNA, 21 nt, Human
ggccgugacgucuggguggcc

SEQ ID NO: 1372949 - RNA, 22 nt, Human
ggccuaaccugccgagagucca

SEQ ID NO: 1372950 - RNA, 19 nt, Human
ggcccugucauccagcuca

SEQ ID NO: 1372951 - RNA, 23 nt, Human
ggcccuggggccuguacugccug

SEQ ID NO: 1372952 - RNA, 18 nt, Human
ggcccuggggccuguacu

SEQ ID NO: 1372953 - RNA, 17 nt, Human
ggcccuggggccuguac

SEQ ID NO: 1372954 - RNA, 16 nt, Human
ggcccuggggccugua

SEQ ID NO: 1372955 - RNA, 15 nt, Human
ggcccuggggccugu

SEQ ID NO: 1372956 - RNA, 14 nt, Human
ggcccuggggccug

SEQ ID NO: 1372957 - RNA, 13 nt, Human
ggcccuggggccu

SEQ ID NO: 1372958 - RNA, 15 nt, Human
ggcccugggcuggaa

SEQ ID NO: 1372959 - RNA, 14 nt, Human
ggcccugggcugga

SEQ ID NO: 1372960 - RNA, 13 nt, Human
ggcccugggcugg

SEQ ID NO: 1372961 - RNA, 12 nt, Human
ggcccugggcug

SEQ ID NO: 1372962 - RNA, 18 nt, Human
ggcccugggccugccuca

SEQ ID NO: 1372963 - RNA, 23 nt, Human
ggcccugggccugccucaccacg

SEQ ID NO: 1372964 - RNA, 19 nt, Human
ggccucaaaggcccgcucu

SEQ ID NO: 1372965 - RNA, 18 nt, Human
ggccucaaaggcccgcuc

SEQ ID NO: 1372966 - RNA, 23 nt, Human
ggccucaaagcaagcauucagaa

SEQ ID NO: 1372967 - RNA, 22 nt, Human
ggccuauggagagcccugggac

SEQ ID NO: 1372968 - RNA, 21 nt, Human
ggccuauggagagcccuggga

SEQ ID NO: 1372969 - RNA, 19 nt, Human
ggccuauggagagcccugg

SEQ ID NO: 1372970 - RNA, 18 nt, Human
ggccuauggagagcccug

SEQ ID NO: 1372971 - RNA, 17 nt, Human
ggccuauggagagcccu

SEQ ID NO: 1372972 - RNA, 16 nt, Human
ggccuauggagagccc

SEQ ID NO: 1372973 - RNA, 15 nt, Human
ggccuauggagagcc

SEQ ID NO: 1372974 - RNA, 18 nt, Human
ggccuaugacuugggcac

SEQ ID NO: 1372975 - RNA, 13 nt, Human
ggccuaggcugca

SEQ ID NO: 1372976 - RNA, 14 nt, Human
ggccuaggcugcau

SEQ ID NO: 1372977 - RNA, 12 nt, Human
ggccuaggcugc

SEQ ID NO: 1372978 - RNA, 19 nt, Human
ggccucaaaugcaccaugu

SEQ ID NO: 1372979 - RNA, 20 nt, Human
ggccucaaaggcccgcucua

SEQ ID NO: 1372980 - RNA, 19 nt, Human
ggccucuuccgugacguca

SEQ ID NO: 1372981 - RNA, 21 nt, Human
ggcccucucugcucugcgugu

SEQ ID NO: 1372982 - RNA, 21 nt, Human
ggcccaauccaagguggggug

SEQ ID NO: 1372983 - RNA, 23 nt, Human
ggcccaacacaauucuucuucca

SEQ ID NO: 1372984 - RNA, 15 nt, Human
ggcccucucugcucu

SEQ ID NO: 1372985 - RNA, 14 nt, Human
ggcccucucugcuc

SEQ ID NO: 1372986 - RNA, 23 nt, Human
ggcccucuccccugcccccugca

SEQ ID NO: 1372987 - RNA, 16 nt, Human
ggcccucuccccugcc

SEQ ID NO: 1372988 - RNA, 15 nt, Human
ggcccucuccccugc

SEQ ID NO: 1372989 - RNA, 12 nt, Human
ggcccucucccc

SEQ ID NO: 1372990 - RNA, 23 nt, Human
ggcccacugugccucagagacca

SEQ ID NO: 1372991 - RNA, 15 nt, Human
ggcccagagaagcca

SEQ ID NO: 1372992 - RNA, 21 nt, Human
ggcccacugugccucagagac

SEQ ID NO: 1372993 - RNA, 18 nt, Human
ggcccacugugccucaga

SEQ ID NO: 1372994 - RNA, 17 nt, Human
ggcccacugugccucag

SEQ ID NO: 1372995 - RNA, 13 nt, Human
ggcccacugugcc

SEQ ID NO: 1372996 - RNA, 17 nt, Human
ggcccuggccuccccug

SEQ ID NO: 1372997 - RNA, 14 nt, Human
ggcccuggccuccc

SEQ ID NO: 1372998 - RNA, 13 nt, Human
ggcccuggccucc

SEQ ID NO: 1372999 - RNA, 23 nt, Human
ggcccuggaucagcguggccuug

SEQ ID NO: 1373000 - RNA, 22 nt, Human
ggcccuggaucagcguggccuu

SEQ ID NO: 1373001 - RNA, 20 nt, Human
ggcccuggaucagcguggcc

SEQ ID NO: 1373002 - RNA, 18 nt, Human
ggcccuggaucagcgugg

SEQ ID NO: 1373003 - RNA, 17 nt, Human
ggcccuggaucagcgug

SEQ ID NO: 1373004 - RNA, 18 nt, Human
ggcccugcuuccugcuug

SEQ ID NO: 1373005 - RNA, 16 nt, Human
ggcccuggagcagcca

SEQ ID NO: 1373006 - RNA, 21 nt, Human
ggcccuggagcagccacccca

SEQ ID NO: 1373007 - RNA, 16 nt, Human
ggcccugcuuccugcu

SEQ ID NO: 1373008 - RNA, 15 nt, Human
ggcccugcuuccugc

SEQ ID NO: 1373009 - RNA, 14 nt, Human
ggcccugcuuccug

SEQ ID NO: 1373010 - RNA, 22 nt, Human
ggcccugcaaaaggacucucag

SEQ ID NO: 1373011 - RNA, 19 nt, Human
ggcccugcaaaaggacucu

SEQ ID NO: 1373012 - RNA, 11 nt, Human
ggcccugagcg

SEQ ID NO: 1373013 - RNA, 23 nt, Human
ggcccugagcgaguggagucugc

SEQ ID NO: 1373014 - RNA, 19 nt, Human
ggcucaagcgauucuccug

SEQ ID NO: 1373015 - RNA, 21 nt, Human
ggcuauuuuguuugcuucaug

SEQ ID NO: 1373016 - RNA, 16 nt, Human
ggcuauuuguaaaucu

SEQ ID NO: 1373017 - RNA, 18 nt, Human
ggcuauagaugucuuuuc

SEQ ID NO: 1373018 - RNA, 15 nt, Human
ggcuaugcauuugaa

SEQ ID NO: 1373019 - RNA, 19 nt, Human
ggcuauagaugucuuuucc

SEQ ID NO: 1373020 - RNA, 17 nt, Human
ggcuauagaugucuuuu

SEQ ID NO: 1373021 - RNA, 14 nt, Human
ggcuagggggagcc

SEQ ID NO: 1373022 - RNA, 16 nt, Human
ggcuaggguggggaga

SEQ ID NO: 1373023 - RNA, 20 nt, Human
ggcuagagugcgguggcgcg

SEQ ID NO: 1373024 - RNA, 18 nt, Human
ggcggcuggggucccagc

SEQ ID NO: 1373025 - RNA, 18 nt, Human
ggcggcucggaggaagcc

SEQ ID NO: 1373026 - RNA, 17 nt, Human
ggcuagagguucaaaga

SEQ ID NO: 1373027 - RNA, 22 nt, Human
ggcuagagguucaaagauauuu

SEQ ID NO: 1373028 - RNA, 23 nt, Human
ggcuccagccccucuuggagaag

SEQ ID NO: 1373029 - RNA, 22 nt, Human
ggcuccagccccucuuggagaa

SEQ ID NO: 1373030 - RNA, 19 nt, Human
ggcuccagaugcagggcag

SEQ ID NO: 1373031 - RNA, 18 nt, Human
ggcuccagaugcagggca

SEQ ID NO: 1373032 - RNA, 17 nt, Human
ggcuccagaugcagggc

SEQ ID NO: 1373033 - RNA, 16 nt, Human
ggcuccagaugcaggg

SEQ ID NO: 1373034 - RNA, 18 nt, Human
ggcucacacaccuguagc

SEQ ID NO: 1373035 - RNA, 21 nt, Human
ggcuccagccccucuuggaga

SEQ ID NO: 1373036 - RNA, 15 nt, Human
ggcuccagccccucu

SEQ ID NO: 1373037 - RNA, 23 nt, Human
ggccugaaagaggcugaggccug

SEQ ID NO: 1373038 - RNA, 17 nt, Human
ggccugaaagaggcuga

SEQ ID NO: 1373039 - RNA, 22 nt, Human
ggccucuugagcaguggcuggu

SEQ ID NO: 1373040 - RNA, 18 nt, Human
ggccucuugagcaguggc

SEQ ID NO: 1373041 - RNA, 16 nt, Human
ggccucuugagcagug

SEQ ID NO: 1373042 - RNA, 13 nt, Human
ggccucuugagca

SEQ ID NO: 1373043 - RNA, 17 nt, Human
ggccuggcuggcugagg

SEQ ID NO: 1373044 - RNA, 15 nt, Human
ggccuggcuggcuga

SEQ ID NO: 1373045 - RNA, 14 nt, Human
ggccuggcuggcug

SEQ ID NO: 1373046 - RNA, 12 nt, Human
ggccuggcuggc

SEQ ID NO: 1373047 - RNA, 11 nt, Human
ggccuggcugg

SEQ ID NO: 1373048 - RNA, 21 nt, Human
ggccugggacaacugcuccca

SEQ ID NO: 1373049 - RNA, 19 nt, Human
ggccuggcuggcugagggc

SEQ ID NO: 1373050 - RNA, 13 nt, Human
ggccugggcagga

SEQ ID NO: 1373051 - RNA, 18 nt, Human
ggccugggcuccuggacc

SEQ ID NO: 1373052 - RNA, 17 nt, Human
ggccugggcuccuggac

SEQ ID NO: 1373053 - RNA, 11 nt, Human
ggccugggagg

SEQ ID NO: 1373054 - RNA, 14 nt, Human
ggccugggcaggag

SEQ ID NO: 1373055 - RNA, 14 nt, Human
ggccuguccuccaa

SEQ ID NO: 1373056 - RNA, 22 nt, Human
ggccuguccacaggcuucugag

SEQ ID NO: 1373057 - RNA, 15 nt, Human
ggccuguccacaggc

SEQ ID NO: 1373058 - RNA, 18 nt, Human
ggccuguacugccugcuu

SEQ ID NO: 1373059 - RNA, 18 nt, Human
ggccuguccaacacaucu

SEQ ID NO: 1373060 - RNA, 17 nt, Human
ggccuguagaguugcug

SEQ ID NO: 1373061 - RNA, 17 nt, Human
ggccuguacugccugcu

SEQ ID NO: 1373062 - RNA, 22 nt, Human
ggccugucucaagcucuuccuu

SEQ ID NO: 1373063 - RNA, 11 nt, Human
ggccugugagc

SEQ ID NO: 1373064 - RNA, 22 nt, Human
ggcggccuaugacuugggcacc

SEQ ID NO: 1373065 - RNA, 18 nt, Human
ggcggcaggggccuggag

SEQ ID NO: 1373066 - RNA, 17 nt, Human
ggcggcaggggccugga

SEQ ID NO: 1373067 - RNA, 20 nt, Human
ggcggauguugaagugagcu

SEQ ID NO: 1373068 - RNA, 16 nt, Human
ggcgcggcugggagga

SEQ ID NO: 1373069 - RNA, 16 nt, Human
ggcgccugugguucug

SEQ ID NO: 1373070 - RNA, 15 nt, Human
ggcgccugugguucu

SEQ ID NO: 1373071 - RNA, 22 nt, Human
ggcgcgaucucggcucacugca

SEQ ID NO: 1373072 - RNA, 21 nt, Human
ggcgccgucuccaggggcugc

SEQ ID NO: 1373073 - RNA, 20 nt, Human
ggcgccgucuccaggggcug

SEQ ID NO: 1373074 - RNA, 20 nt, Human
ggccuguggaucaaauccag

SEQ ID NO: 1373075 - RNA, 13 nt, Human
guacuaaagccaa

SEQ ID NO: 1373076 - RNA, 17 nt, Human
guacggauuuucaguua

SEQ ID NO: 1373077 - RNA, 15 nt, Human
guacgaugacagugu

SEQ ID NO: 1373078 - RNA, 17 nt, Human
guacguugugcauuugg

SEQ ID NO: 1373079 - RNA, 23 nt, Human
guacgaaccuacaguuuuaacug

SEQ ID NO: 1373080 - RNA, 23 nt, Human
guaccuuuugaggagccccagcu

SEQ ID NO: 1373081 - RNA, 21 nt, Human
guaccuuuugaggagccccag

SEQ ID NO: 1373082 - RNA, 14 nt, Human
guacguugugcauu

SEQ ID NO: 1373083 - RNA, 15 nt, Human
guacguugugcauuu

SEQ ID NO: 1373084 - RNA, 16 nt, Human
guacguugugcauuug

SEQ ID NO: 1373085 - RNA, 15 nt, Human
guaccuggggccaaa

SEQ ID NO: 1373086 - RNA, 16 nt, Human
guaccugggcaagcug

SEQ ID NO: 1373087 - RNA, 15 nt, Human
guaccugggcaagcu

SEQ ID NO: 1373088 - RNA, 15 nt, Human
guaccugagggucug

SEQ ID NO: 1373089 - RNA, 17 nt, Human
guaccugcccccaaucc

SEQ ID NO: 1373090 - RNA, 14 nt, Human
guaccugagggucu

SEQ ID NO: 1373091 - RNA, 12 nt, Human
guaccugagggu

SEQ ID NO: 1373092 - RNA, 20 nt, Human
guaccgcgucuacccuggga

SEQ ID NO: 1373093 - RNA, 13 nt, Human
guaccucuugagc

SEQ ID NO: 1373094 - RNA, 21 nt, Human
guaccucuugagccuugaacu

SEQ ID NO: 1373095 - RNA, 22 nt, Human
guaccucuugagccuugaacuu

SEQ ID NO: 1373096 - RNA, 19 nt, Human
guacccucucagcuccagg

SEQ ID NO: 1373097 - RNA, 18 nt, Human
guacccucucagcuccag

SEQ ID NO: 1373098 - RNA, 17 nt, Human
guacccucucagcucca

SEQ ID NO: 1373099 - RNA, 17 nt, Human
guacccuccuggcucuu

SEQ ID NO: 1373100 - RNA, 18 nt, Human
guaccgcgucuacccugg

SEQ ID NO: 1373101 - RNA, 15 nt, Human
guacccucuggaggg

SEQ ID NO: 1373102 - RNA, 16 nt, Human
guacccucugaaauac

SEQ ID NO: 1373103 - RNA, 15 nt, Human
guacccccaggacca

SEQ ID NO: 1373104 - RNA, 16 nt, Human
guacccccaggaccag

SEQ ID NO: 1373105 - RNA, 14 nt, Human
guacccccaggacc

SEQ ID NO: 1373106 - RNA, 13 nt, Human
guacccccaggac

SEQ ID NO: 1373107 - RNA, 22 nt, Human
guacuuucauauuuuaaacaga

SEQ ID NO: 1373108 - RNA, 23 nt, Human
guacuuuauuuucuauaauuuaa

SEQ ID NO: 1373109 - RNA, 14 nt, Human
guagaaaggccuuu

SEQ ID NO: 1373110 - RNA, 16 nt, Human
guagaaaggccuuuaa

SEQ ID NO: 1373111 - RNA, 17 nt, Human
guagaaaggccuuuaaa

SEQ ID NO: 1373112 - RNA, 19 nt, Human
guagaaacugcagggaaaa

SEQ ID NO: 1373113 - RNA, 15 nt, Human
guagaaacugcaggg

SEQ ID NO: 1373114 - RNA, 13 nt, Human
guagaaaagcuau

SEQ ID NO: 1373115 - RNA, 20 nt, Human
guagaaaaaaaaauucacau

SEQ ID NO: 1373116 - RNA, 22 nt, Human
guacuugccuuauuagaguguc

SEQ ID NO: 1373117 - RNA, 14 nt, Human
guacuugcucuuga

SEQ ID NO: 1373118 - RNA, 12 nt, Human
guacuuguaguu

SEQ ID NO: 1373119 - RNA, 21 nt, Human
guacuuggaguauuggggucu

SEQ ID NO: 1373120 - RNA, 22 nt, Human
guacuugcucuugaugccuggc

SEQ ID NO: 1373121 - RNA, 15 nt, Human
guacuugcucuugau

SEQ ID NO: 1373122 - RNA, 16 nt, Human
guacuugcucuugaug

SEQ ID NO: 1373123 - RNA, 18 nt, Human
guacuugcucuugaugcc

SEQ ID NO: 1373124 - RNA, 19 nt, Human
guacuugcucuugaugccu

SEQ ID NO: 1373125 - RNA, 20 nt, Human
guacaguuaucuaaguuaau

SEQ ID NO: 1373126 - RNA, 14 nt, Human
guacaguuaucuaa

SEQ ID NO: 1373127 - RNA, 21 nt, Human
guacaguuauuuaugccucug

SEQ ID NO: 1373128 - RNA, 12 nt, Human
guacaguguuac

SEQ ID NO: 1373129 - RNA, 22 nt, Human
guacagugucuuuuuuuguaua

SEQ ID NO: 1373130 - RNA, 21 nt, Human
guacagugucuuuuuuuguau

SEQ ID NO: 1373131 - RNA, 20 nt, Human
guacagugucuuuuuuugua

SEQ ID NO: 1373132 - RNA, 15 nt, Human
guacagugucuuuuu

SEQ ID NO: 1373133 - RNA, 14 nt, Human
guacagugucuuuu

SEQ ID NO: 1373134 - RNA, 13 nt, Human
guacagugucuuu

SEQ ID NO: 1373135 - RNA, 24 nt, Human
guacaguauggggguuguaaauug

SEQ ID NO: 1373136 - RNA, 23 nt, Human
guacaguauggggguuguaaauu

SEQ ID NO: 1373137 - RNA, 22 nt, Human
guacaguauggggguuguaaau

SEQ ID NO: 1373138 - RNA, 21 nt, Human
guacaguauggggguuguaaa

SEQ ID NO: 1373139 - RNA, 16 nt, Human
guacaggguuaucugc

SEQ ID NO: 1373140 - RNA, 14 nt, Human
guacauaacugaaa

SEQ ID NO: 1373141 - RNA, 22 nt, Human
guacauacccuggccgcccccu

SEQ ID NO: 1373142 - RNA, 19 nt, Human
guacauacccuggccgccc

SEQ ID NO: 1373143 - RNA, 20 nt, Human
guacauaaugcgugcauacc

SEQ ID NO: 1373144 - RNA, 18 nt, Human
guacauaguuauuuauuu

SEQ ID NO: 1373145 - RNA, 17 nt, Human
guacauaguuauuuauu

SEQ ID NO: 1373146 - RNA, 14 nt, Human
guacauaugugcug

SEQ ID NO: 1373147 - RNA, 16 nt, Human
guacauaugugcugga

SEQ ID NO: 1373148 - RNA, 15 nt, Human
guacagcuggcucua

SEQ ID NO: 1373149 - RNA, 14 nt, Human
guacagcuggcucu

SEQ ID NO: 1373150 - RNA, 12 nt, Human
guacagcuggcu

SEQ ID NO: 1373151 - RNA, 21 nt, Human
guacagaguguggacucuggu

SEQ ID NO: 1373152 - RNA, 17 nt, Human
guacagagaagccauca

SEQ ID NO: 1373153 - RNA, 18 nt, Human
guacagagaagccaucac

SEQ ID NO: 1373154 - RNA, 16 nt, Human
guacagagaagccauc

SEQ ID NO: 1373155 - RNA, 15 nt, Human
guacagagaagccau

SEQ ID NO: 1373156 - RNA, 23 nt, Human
guacagagaagccagcuuguuua

SEQ ID NO: 1373157 - RNA, 21 nt, Human
guacagagaagccagcuuguu

SEQ ID NO: 1373158 - RNA, 20 nt, Human
guacagcaaggagauuuaca

SEQ ID NO: 1373159 - RNA, 19 nt, Human
guacagagaagccagcuug

SEQ ID NO: 1373160 - RNA, 18 nt, Human
guacagagaagccagcuu

SEQ ID NO: 1373161 - RNA, 16 nt, Human
guacagagaagccagc

SEQ ID NO: 1373162 - RNA, 15 nt, Human
guacagagaagccag

SEQ ID NO: 1373163 - RNA, 14 nt, Human
guacagagaagcca

SEQ ID NO: 1373164 - RNA, 13 nt, Human
guacagagaagcc

SEQ ID NO: 1373165 - RNA, 12 nt, Human
guacagagaagc

SEQ ID NO: 1373166 - RNA, 11 nt, Human
guacagagaag

SEQ ID NO: 1373167 - RNA, 18 nt, Human
guaauuguacuaaagcca

SEQ ID NO: 1373168 - RNA, 21 nt, Human
guacacuguuucaaacuuuac

SEQ ID NO: 1373169 - RNA, 19 nt, Human
guacacuguuucaaacuuu

SEQ ID NO: 1373170 - RNA, 20 nt, Human
guacacuguuucaaacuuua

SEQ ID NO: 1373171 - RNA, 13 nt, Human
guacagaaagcug

SEQ ID NO: 1373172 - RNA, 14 nt, Human
guacagaaagcugc

SEQ ID NO: 1373173 - RNA, 15 nt, Human
guacagacagaaaaa

SEQ ID NO: 1373174 - RNA, 15 nt, Human
guaauuaguaacaug

SEQ ID NO: 1373175 - RNA, 21 nt, Human
guaauuaaaagcaaaucauuu

SEQ ID NO: 1373176 - RNA, 20 nt, Human
guaauuaaaagcaaaucauu

SEQ ID NO: 1373177 - RNA, 19 nt, Human
guaauuaaaagcaaaucau

SEQ ID NO: 1373178 - RNA, 18 nt, Human
guaauuaaaagcaaauca

SEQ ID NO: 1373179 - RNA, 13 nt, Human
guaauuauggagu

SEQ ID NO: 1373180 - RNA, 21 nt, Human
guaauuagugccacuuaaugu

SEQ ID NO: 1373181 - RNA, 20 nt, Human
guaauuagugccacuuaaug

SEQ ID NO: 1373182 - RNA, 23 nt, Human
guaauuaguaacauguguuaagu

SEQ ID NO: 1373183 - RNA, 23 nt, Human
guaauuguacuaaagccaaacau

SEQ ID NO: 1373184 - RNA, 18 nt, Human
guacacuguuucaaacuu

SEQ ID NO: 1373185 - RNA, 15 nt, Human
guaauugacaugugc

SEQ ID NO: 1373186 - RNA, 15 nt, Human
guaauuggaaaggca

SEQ ID NO: 1373187 - RNA, 19 nt, Human
guaauuauuuauguauggu

SEQ ID NO: 1373188 - RNA, 23 nt, Human
guaauuauuuauguauggugcaa

SEQ ID NO: 1373189 - RNA, 15 nt, Human
guaauucuaaaugaa

SEQ ID NO: 1373190 - RNA, 14 nt, Human
guaauucuaaauga

SEQ ID NO: 1373191 - RNA, 12 nt, Human
guaauucuaaau

SEQ ID NO: 1373192 - RNA, 17 nt, Human
guaauucagguuuuucc

SEQ ID NO: 1373193 - RNA, 22 nt, Human
guaauucuaaaugaauguuuac

SEQ ID NO: 1373194 - RNA, 18 nt, Human
guaauucuaaaugaaugu

SEQ ID NO: 1373195 - RNA, 23 nt, Human
guaauucuaccaaggucuucuua

SEQ ID NO: 1373196 - RNA, 22 nt, Human
guaaucugaauaaaguguaaca

SEQ ID NO: 1373197 - RNA, 22 nt, Human
guaaucuaugaauucuaaguga

SEQ ID NO: 1373198 - RNA, 11 nt, Human
guaaugaaaac

SEQ ID NO: 1373199 - RNA, 13 nt, Human
guaaugaaaacca

SEQ ID NO: 1373200 - RNA, 18 nt, Human
guaauguuaauauugauu

SEQ ID NO: 1373201 - RNA, 22 nt, Human
guaauguuaauauugauuuauu

SEQ ID NO: 1373202 - RNA, 17 nt, Human
guaauguuaauauugau

SEQ ID NO: 1373203 - RNA, 17 nt, Human
guaaugucuugagcucu

SEQ ID NO: 1373204 - RNA, 19 nt, Human
guaaugucuugagcucuau

SEQ ID NO: 1373205 - RNA, 19 nt, Human
guaauguaucaaauacauu

SEQ ID NO: 1373206 - RNA, 17 nt, Human
guaaugguguagaacac

SEQ ID NO: 1373207 - RNA, 16 nt, Human
guaaugguguagaaca

SEQ ID NO: 1373208 - RNA, 15 nt, Human
guaaugguguagaac

SEQ ID NO: 1373209 - RNA, 14 nt, Human
guaaugguguagaa

SEQ ID NO: 1373210 - RNA, 23 nt, Human
guaaugguacugacuuugcuugc

SEQ ID NO: 1373211 - RNA, 19 nt, Human
guaaugguacugacuuugc

SEQ ID NO: 1373212 - RNA, 23 nt, Human
guaauggcaguuauauuuugcag

SEQ ID NO: 1373213 - RNA, 16 nt, Human
guaauggcaguuauau

SEQ ID NO: 1373214 - RNA, 19 nt, Human
guaaugauaacuggaaacu

SEQ ID NO: 1373215 - RNA, 22 nt, Human
gguuuaaaugaacaagagaagc

SEQ ID NO: 1373216 - RNA, 12 nt, Human
gguuuaaaugaa

SEQ ID NO: 1373217 - RNA, 22 nt, Human
gguuuaaagagucuagauucaa

SEQ ID NO: 1373218 - RNA, 20 nt, Human
gguuuaaagagucuagauuc

SEQ ID NO: 1373219 - RNA, 15 nt, Human
gguuuaaagagucua

SEQ ID NO: 1373220 - RNA, 18 nt, Human
gguuuaaagaaaguguau

SEQ ID NO: 1373221 - RNA, 14 nt, Human
gguuguuucuguuc

SEQ ID NO: 1373222 - RNA, 19 nt, Human
gguuguuucuguuccaaau

SEQ ID NO: 1373223 - RNA, 12 nt, Human
gguuguuucugu

SEQ ID NO: 1373224 - RNA, 13 nt, Human
gguuguuauguga

SEQ ID NO: 1373225 - RNA, 17 nt, Human
gguuuaagaaauagaau

SEQ ID NO: 1373226 - RNA, 17 nt, Human
gguuuaaaugaacaaga

SEQ ID NO: 1373227 - RNA, 18 nt, Human
gguuguauuagauguucu

SEQ ID NO: 1373228 - RNA, 19 nt, Human
gguuguauuagauguucuc

SEQ ID NO: 1373229 - RNA, 16 nt, Human
gguugcuccgccuggc

SEQ ID NO: 1373230 - RNA, 18 nt, Human
gguugcuccgccuggccu

SEQ ID NO: 1373231 - RNA, 16 nt, Human
gguugaccccagagga

SEQ ID NO: 1373232 - RNA, 15 nt, Human
gguugaccccagagg

SEQ ID NO: 1373233 - RNA, 16 nt, Human
gguugaacucuggugg

SEQ ID NO: 1373234 - RNA, 22 nt, Human
gguugaacucugguggcacagg

SEQ ID NO: 1373235 - RNA, 16 nt, Human
gguugguaggguggga

SEQ ID NO: 1373236 - RNA, 13 nt, Human
gguugguagggug

SEQ ID NO: 1373237 - RNA, 18 nt, Human
gguucagaauuaaacuuu

SEQ ID NO: 1373238 - RNA, 14 nt, Human
gguucaacuuauua

SEQ ID NO: 1373239 - RNA, 23 nt, Human
gguucaacaaagaaacaaagaug

SEQ ID NO: 1373240 - RNA, 19 nt, Human
gguucagaauuaaacuuuu

SEQ ID NO: 1373241 - RNA, 21 nt, Human
gguggcccucuccccugcccc

SEQ ID NO: 1373242 - RNA, 22 nt, Human
gguggcccucuccccugccccc

SEQ ID NO: 1373243 - RNA, 20 nt, Human
gguggcccucuccccugccc

SEQ ID NO: 1373244 - RNA, 19 nt, Human
gguggcccucuccccugcc

SEQ ID NO: 1373245 - RNA, 18 nt, Human
gguggcccucuccccugc

SEQ ID NO: 1373246 - RNA, 15 nt, Human
gguggcccucucccc

SEQ ID NO: 1373247 - RNA, 21 nt, Human
gguggccgcugaguggcaggg

SEQ ID NO: 1373248 - RNA, 20 nt, Human
gguggccgcugaguggcagg

SEQ ID NO: 1373249 - RNA, 23 nt, Human
gguggcccuuaugacugccaaga

SEQ ID NO: 1373250 - RNA, 20 nt, Human
gguggcccuuaugacugcca

SEQ ID NO: 1373251 - RNA, 23 nt, Human
guaaaaaaaaaaaaaauguucuu

SEQ ID NO: 1373252 - RNA, 13 nt, Human
gguuuuuuuccuu

SEQ ID NO: 1373253 - RNA, 14 nt, Human
gguuuuuuaguuga

SEQ ID NO: 1373254 - RNA, 20 nt, Human
gguuuuuggacuucuggggu

SEQ ID NO: 1373255 - RNA, 23 nt, Human
gguuuuuguuuguuuccuuuguu

SEQ ID NO: 1373256 - RNA, 12 nt, Human
gguuuuucccug

SEQ ID NO: 1373257 - RNA, 19 nt, Human
gguuuuuacugcucugaga

SEQ ID NO: 1373258 - RNA, 20 nt, Human
gguuuuuacugcucugagaa

SEQ ID NO: 1373259 - RNA, 16 nt, Human
gguuuuuaaaacccag

SEQ ID NO: 1373260 - RNA, 19 nt, Human
gguuuuguauucucugagc

SEQ ID NO: 1373261 - RNA, 18 nt, Human
gguuuuguauucucugag

SEQ ID NO: 1373262 - RNA, 17 nt, Human
gguuuuguauucucuga

SEQ ID NO: 1373263 - RNA, 18 nt, Human
gguuuacucacugcugca

SEQ ID NO: 1373264 - RNA, 13 nt, Human
gguuuaauguuuu

SEQ ID NO: 1373265 - RNA, 19 nt, Human
gguuuaauguuuuggccaa

SEQ ID NO: 1373266 - RNA, 19 nt, Human
gguuuaauccccaguaaaa

SEQ ID NO: 1373267 - RNA, 22 nt, Human
gguuuaauccccaguaaaauug

SEQ ID NO: 1373268 - RNA, 13 nt, Human
gguuuucgagauu

SEQ ID NO: 1373269 - RNA, 20 nt, Human
gguuuucacauuggaaacaa

SEQ ID NO: 1373270 - RNA, 12 nt, Human
gguuuucuguuc

SEQ ID NO: 1373271 - RNA, 13 nt, Human
gguuuucuguucu

SEQ ID NO: 1373272 - RNA, 15 nt, Human
gguuuucuguucuuu

SEQ ID NO: 1373273 - RNA, 20 nt, Human
guaaaacauuuauuuugaca

SEQ ID NO: 1373274 - RNA, 18 nt, Human
guaaaagcaaaaaagaaa

SEQ ID NO: 1373275 - RNA, 12 nt, Human
guaaaagcaaaa

SEQ ID NO: 1373276 - RNA, 18 nt, Human
guaaaacauuuauuuuga

SEQ ID NO: 1373277 - RNA, 11 nt, Human
guaaaacauuu

SEQ ID NO: 1373278 - RNA, 15 nt, Human
guaaaaaugauuuca

SEQ ID NO: 1373279 - RNA, 17 nt, Human
guaaaaauggaaacuau

SEQ ID NO: 1373280 - RNA, 22 nt, Human
gguuuuuuuucaguuguucuuu

SEQ ID NO: 1373281 - RNA, 18 nt, Human
guaaaaacaaagaaauua

SEQ ID NO: 1373282 - RNA, 13 nt, Human
guaaaaaauuuau

SEQ ID NO: 1373283 - RNA, 20 nt, Human
guaaaaacaaagaaauuaug

SEQ ID NO: 1373284 - RNA, 16 nt, Human
guaagauuuguuuuua

SEQ ID NO: 1373285 - RNA, 18 nt, Human
guaagauuuccuucuuuu

SEQ ID NO: 1373286 - RNA, 13 nt, Human
guaagauuuccuu

SEQ ID NO: 1373287 - RNA, 23 nt, Human
guaagauuauagauucuaaagau

SEQ ID NO: 1373288 - RNA, 22 nt, Human
guaagauuauagauucuaaaga

SEQ ID NO: 1373289 - RNA, 21 nt, Human
guaagauuauagauucuaaag

SEQ ID NO: 1373290 - RNA, 20 nt, Human
guaagauuauagauucuaaa

SEQ ID NO: 1373291 - RNA, 18 nt, Human
guaagauuauagauucua

SEQ ID NO: 1373292 - RNA, 15 nt, Human
guaagagcaaaagaa

SEQ ID NO: 1373293 - RNA, 15 nt, Human
guaagacaaagguuu

SEQ ID NO: 1373294 - RNA, 16 nt, Human
guaagaaauacagacu

SEQ ID NO: 1373295 - RNA, 13 nt, Human
guaagaaauacag

SEQ ID NO: 1373296 - RNA, 20 nt, Human
guaagaaaccuacugcccag

SEQ ID NO: 1373297 - RNA, 14 nt, Human
guaacuuuugugaa

SEQ ID NO: 1373298 - RNA, 17 nt, Human
guaacuuuuguaagaca

SEQ ID NO: 1373299 - RNA, 15 nt, Human
guaacuuuuguaaga

SEQ ID NO: 1373300 - RNA, 14 nt, Human
guaacuuuuguaag

SEQ ID NO: 1373301 - RNA, 22 nt, Human
guaacuugauccauuucuaauu

SEQ ID NO: 1373302 - RNA, 23 nt, Human
guaacuugauccauuucuaauua

SEQ ID NO: 1373303 - RNA, 21 nt, Human
guaacuugauccauuucuaau

SEQ ID NO: 1373304 - RNA, 21 nt, Human
guaacuucuuauggaauugau

SEQ ID NO: 1373305 - RNA, 20 nt, Human
guaacuucuuauggaauuga

SEQ ID NO: 1373306 - RNA, 18 nt, Human
guaacuucuuauggaauu

SEQ ID NO: 1373307 - RNA, 16 nt, Human
guaacuguuuuuuaag

SEQ ID NO: 1373308 - RNA, 13 nt, Human
guaacuguucuug

SEQ ID NO: 1373309 - RNA, 23 nt, Human
guaaauuaacuuuuauaaacuuu

SEQ ID NO: 1373310 - RNA, 19 nt, Human
guaaggcuguguaagauuu

SEQ ID NO: 1373311 - RNA, 14 nt, Human
guaaggcuguguaa

SEQ ID NO: 1373312 - RNA, 13 nt, Human
guaaggcugugua

SEQ ID NO: 1373313 - RNA, 16 nt, Human
guaaggcucuagauca

SEQ ID NO: 1373314 - RNA, 14 nt, Human
guaaggcucuagau

SEQ ID NO: 1373315 - RNA, 13 nt, Human
guaaggcucuaga

SEQ ID NO: 1373316 - RNA, 19 nt, Human
guaaggauccggaaagaag

SEQ ID NO: 1373317 - RNA, 18 nt, Human
guaaggauccggaaagaa

SEQ ID NO: 1373318 - RNA, 18 nt, Human
guaaguacagagaagcca

SEQ ID NO: 1373319 - RNA, 17 nt, Human
guaaguacagagaagcc

SEQ ID NO: 1373320 - RNA, 16 nt, Human
guaaguacagagaagc

SEQ ID NO: 1373321 - RNA, 15 nt, Human
guaaguacagagaag

SEQ ID NO: 1373322 - RNA, 14 nt, Human
guaaguacagagaa

SEQ ID NO: 1373323 - RNA, 13 nt, Human
guaaguacagaga

SEQ ID NO: 1373324 - RNA, 19 nt, Human
guaaguacagagaagccau

SEQ ID NO: 1373325 - RNA, 16 nt, Human
guaagcacugacuggg

SEQ ID NO: 1373326 - RNA, 17 nt, Human
guaagauuuguuuuuaa

SEQ ID NO: 1373327 - RNA, 21 nt, Human
guaagauuuguuuuuaaacug

SEQ ID NO: 1373328 - RNA, 20 nt, Human
guaagcacugacugggacca

SEQ ID NO: 1373329 - RNA, 23 nt, Human
guaagcauaagcuuaugcuuaaa

SEQ ID NO: 1373330 - RNA, 16 nt, Human
guaaaugguaugucau

SEQ ID NO: 1373331 - RNA, 15 nt, Human
guaaaucugccacaa

SEQ ID NO: 1373332 - RNA, 15 nt, Human
guaaauuaacuuuua

SEQ ID NO: 1373333 - RNA, 16 nt, Human
guaaauuaacuuuuau

SEQ ID NO: 1373334 - RNA, 17 nt, Human
guaaauuaacuuuuaua

SEQ ID NO: 1373335 - RNA, 21 nt, Human
guaaauuaacuuuuauaaacu

SEQ ID NO: 1373336 - RNA, 22 nt, Human
guaaauuaacuuuuauaaacuu

SEQ ID NO: 1373337 - RNA, 14 nt, Human
guaaaucuuuuaca

SEQ ID NO: 1373338 - RNA, 14 nt, Human
guaaaucugccaca

SEQ ID NO: 1373339 - RNA, 13 nt, Human
guaaaucugccac

SEQ ID NO: 1373340 - RNA, 12 nt, Human
guaaaucugcca

SEQ ID NO: 1373341 - RNA, 13 nt, Human
guaaaucuacaca

SEQ ID NO: 1373342 - RNA, 18 nt, Human
guaaaugggggugcauuu

SEQ ID NO: 1373343 - RNA, 19 nt, Human
guaaaugggggugcauuug

SEQ ID NO: 1373344 - RNA, 20 nt, Human
guaaaugggggugcauuuga

SEQ ID NO: 1373345 - RNA, 21 nt, Human
guaaaucaguaagagguguua

SEQ ID NO: 1373346 - RNA, 17 nt, Human
guaaaucaguaagaggu

SEQ ID NO: 1373347 - RNA, 14 nt, Human
guaaauaaaaagaa

SEQ ID NO: 1373348 - RNA, 15 nt, Human
guaaauaaaaagaaa

SEQ ID NO: 1373349 - RNA, 16 nt, Human
guaaauaaugcuuuga

SEQ ID NO: 1373350 - RNA, 12 nt, Human
guaaauaaugcu

SEQ ID NO: 1373351 - RNA, 16 nt, Human
guaaauaauacauuau

SEQ ID NO: 1373352 - RNA, 14 nt, Human
guaaauaauacauu

SEQ ID NO: 1373353 - RNA, 20 nt, Human
guaaauaacuggaaaacaga

SEQ ID NO: 1373354 - RNA, 21 nt, Human
guaaauaacuggaaaacagaa

SEQ ID NO: 1373355 - RNA, 13 nt, Human
guaaauacaauuu

SEQ ID NO: 1373356 - RNA, 13 nt, Human
guaaauaaaaaga

SEQ ID NO: 1373357 - RNA, 17 nt, Human
guaaaagguauuaaauu

SEQ ID NO: 1373358 - RNA, 16 nt, Human
guaaaagcauuuugua

SEQ ID NO: 1373359 - RNA, 19 nt, Human
guaaaagcaaaaaagaaaa

SEQ ID NO: 1373360 - RNA, 16 nt, Human
guaaaauaaaaggucg

SEQ ID NO: 1373361 - RNA, 14 nt, Human
guaaauaggaauug

SEQ ID NO: 1373362 - RNA, 16 nt, Human
guaaauacccauaugu

SEQ ID NO: 1373363 - RNA, 19 nt, Human
guaaauacaauuuuuuuua

SEQ ID NO: 1373364 - RNA, 21 nt, Human
guaaauacaauuuuuuuuauu

SEQ ID NO: 1373365 - RNA, 23 nt, Human
guaaauauaaagacguuuuauaa

SEQ ID NO: 1373366 - RNA, 19 nt, Human
guaaauauaaagacguuuu

SEQ ID NO: 1373367 - RNA, 15 nt, Human
guaaauauaaagacg

SEQ ID NO: 1373368 - RNA, 14 nt, Human
guaaauauaaagac

SEQ ID NO: 1373369 - RNA, 13 nt, Human
guaaauauaaaga

SEQ ID NO: 1373370 - RNA, 12 nt, Human
guaaauauaaag

SEQ ID NO: 1373371 - RNA, 11 nt, Human
guaaauauaaa

SEQ ID NO: 1373372 - RNA, 23 nt, Human
guaaauauuuuaaagaauugugu

SEQ ID NO: 1373373 - RNA, 13 nt, Human
guaaauauuuuaa

SEQ ID NO: 1373374 - RNA, 14 nt, Human
guaaaucaguaaga

SEQ ID NO: 1373375 - RNA, 14 nt, Human
guaaauauuuuaaa

SEQ ID NO: 1373376 - RNA, 21 nt, Human
guaaaucacgcuuuuugaaaa

SEQ ID NO: 1373377 - RNA, 22 nt, Human
ggugaagaggaggggaagaggc

SEQ ID NO: 1373378 - RNA, 16 nt, Human
ggucugagcuccagcu

SEQ ID NO: 1373379 - RNA, 15 nt, Human
ggucugagcuccagc

SEQ ID NO: 1373380 - RNA, 21 nt, Human
ggugaagcucacuucugggcu

SEQ ID NO: 1373381 - RNA, 18 nt, Human
ggugaagugaagacaaug

SEQ ID NO: 1373382 - RNA, 17 nt, Human
ggucccuccccuucucu

SEQ ID NO: 1373383 - RNA, 14 nt, Human
ggucccucugugua

SEQ ID NO: 1373384 - RNA, 12 nt, Human
gguccccuccuu

SEQ ID NO: 1373385 - RNA, 21 nt, Human
ggucccccacucuaaagcaaa

SEQ ID NO: 1373386 - RNA, 13 nt, Human
gguccccuccuuc

SEQ ID NO: 1373387 - RNA, 18 nt, Human
ggucccuaauaaagcugu

SEQ ID NO: 1373388 - RNA, 12 nt, Human
ggucccuaauaa

SEQ ID NO: 1373389 - RNA, 13 nt, Human
ggucccuaauaaa

SEQ ID NO: 1373390 - RNA, 16 nt, Human
ggucccuaauaaagcu

SEQ ID NO: 1373391 - RNA, 17 nt, Human
ggucccuaauaaagcug

SEQ ID NO: 1373392 - RNA, 20 nt, Human
ggucccuggguagcggggga

SEQ ID NO: 1373393 - RNA, 11 nt, Human
ggucccugggu

SEQ ID NO: 1373394 - RNA, 19 nt, Human
ggucccuuguauccccugc

SEQ ID NO: 1373395 - RNA, 17 nt, Human
gguccgguguucuaaga

SEQ ID NO: 1373396 - RNA, 16 nt, Human
gguccgguguucuaag

SEQ ID NO: 1373397 - RNA, 18 nt, Human
gguccggcagcuucugcc

SEQ ID NO: 1373398 - RNA, 21 nt, Human
gguccgguguucuaagaugug

SEQ ID NO: 1373399 - RNA, 13 nt, Human
gguccgugggacg

SEQ ID NO: 1373400 - RNA, 16 nt, Human
ggugcucucuuucugu

SEQ ID NO: 1373401 - RNA, 14 nt, Human
ggugcucagggggc

SEQ ID NO: 1373402 - RNA, 17 nt, Human
ggugcggcuggccaugg

SEQ ID NO: 1373403 - RNA, 23 nt, Human
ggugaguuggcuuaccuggccca

SEQ ID NO: 1373404 - RNA, 23 nt, Human
ggugaggucuguuccuuuuauau

SEQ ID NO: 1373405 - RNA, 16 nt, Human
ggugaggucagcacau

SEQ ID NO: 1373406 - RNA, 23 nt, Human
ggugacccggcacccccugcagc

SEQ ID NO: 1373407 - RNA, 22 nt, Human
ggugacccggcacccccugcag

SEQ ID NO: 1373408 - RNA, 21 nt, Human
ggugacccggcacccccugca

SEQ ID NO: 1373409 - RNA, 20 nt, Human
ggugacccggcacccccugc

SEQ ID NO: 1373410 - RNA, 22 nt, Human
ggugaccccagggcacaggagc

SEQ ID NO: 1373411 - RNA, 23 nt, Human
ggugaccccagggcacaggagcu

SEQ ID NO: 1373412 - RNA, 21 nt, Human
ggugaccccagggcacaggag

SEQ ID NO: 1373413 - RNA, 20 nt, Human
ggugaccccagggcacagga

SEQ ID NO: 1373414 - RNA, 17 nt, Human
ggugaccccagggcaca

SEQ ID NO: 1373415 - RNA, 22 nt, Human
ggugccccaggaccagcucagg

SEQ ID NO: 1373416 - RNA, 21 nt, Human
ggugccccaggaccagcucag

SEQ ID NO: 1373417 - RNA, 20 nt, Human
ggugccccaggaccagcuca

SEQ ID NO: 1373418 - RNA, 17 nt, Human
ggugccccaggaccagc

SEQ ID NO: 1373419 - RNA, 16 nt, Human
ggugccccaggaccag

SEQ ID NO: 1373420 - RNA, 15 nt, Human
ggugccccaggacca

SEQ ID NO: 1373421 - RNA, 14 nt, Human
ggugccccaggacc

SEQ ID NO: 1373422 - RNA, 13 nt, Human
ggugccccaggac

SEQ ID NO: 1373423 - RNA, 14 nt, Human
ggugcccaggagaa

SEQ ID NO: 1373424 - RNA, 13 nt, Human
ggugcccaggaga

SEQ ID NO: 1373425 - RNA, 12 nt, Human
ggugcccaggag

SEQ ID NO: 1373426 - RNA, 16 nt, Human
ggugccuaggccuggg

SEQ ID NO: 1373427 - RNA, 23 nt, Human
ggugccccaggaccagcucagga

SEQ ID NO: 1373428 - RNA, 21 nt, Human
ggucagcaugucuauucagcu

SEQ ID NO: 1373429 - RNA, 18 nt, Human
ggucagcacaucucaaca

SEQ ID NO: 1373430 - RNA, 15 nt, Human
ggucccagcagcugc

SEQ ID NO: 1373431 - RNA, 12 nt, Human
ggucccagcagc

SEQ ID NO: 1373432 - RNA, 14 nt, Human
ggucccagcagcug

SEQ ID NO: 1373433 - RNA, 22 nt, Human
ggucccccacucuaaagcaaau

SEQ ID NO: 1373434 - RNA, 15 nt, Human
ggucacagcggaggu

SEQ ID NO: 1373435 - RNA, 14 nt, Human
ggucacacacugau

SEQ ID NO: 1373436 - RNA, 18 nt, Human
ggucaaguuauuaauuuc

SEQ ID NO: 1373437 - RNA, 15 nt, Human
gguagaauguaaagc

SEQ ID NO: 1373438 - RNA, 22 nt, Human
gguagacacacaugaaguccaa

SEQ ID NO: 1373439 - RNA, 19 nt, Human
gguagaauguaaagcuugu

SEQ ID NO: 1373440 - RNA, 20 nt, Human
gguagaaagagauacagagg

SEQ ID NO: 1373441 - RNA, 15 nt, Human
gguagacacacauga

SEQ ID NO: 1373442 - RNA, 15 nt, Human
ggguugugugucugu

SEQ ID NO: 1373443 - RNA, 19 nt, Human
ggguuuaauccccaguaaa

SEQ ID NO: 1373444 - RNA, 22 nt, Human
ggguuuaauccccaguaaaauu

SEQ ID NO: 1373445 - RNA, 23 nt, Human
ggguuuaauccccaguaaaauug

SEQ ID NO: 1373446 - RNA, 23 nt, Human
ggguuguaaauuggcauggaaau

SEQ ID NO: 1373447 - RNA, 20 nt, Human
ggguuucaccauguuagcca

SEQ ID NO: 1373448 - RNA, 15 nt, Human
ggguuuauucacuga

SEQ ID NO: 1373449 - RNA, 20 nt, Human
ggguuucaccauguuggcca

SEQ ID NO: 1373450 - RNA, 13 nt, Human
gguacccucugga

SEQ ID NO: 1373451 - RNA, 14 nt, Human
gguacccuccuggc

SEQ ID NO: 1373452 - RNA, 15 nt, Human
gguacuguacagcug

SEQ ID NO: 1373453 - RNA, 18 nt, Human
gguacugacuuugcuugc

SEQ ID NO: 1373454 - RNA, 20 nt, Human
gguacuguacagcuggcucu

SEQ ID NO: 1373455 - RNA, 18 nt, Human
gguacuguacagcuggcu

SEQ ID NO: 1373456 - RNA, 21 nt, Human
gguacuguacagcuggcucua

SEQ ID NO: 1373457 - RNA, 22 nt, Human
gguacuucaaauccuugaagau

SEQ ID NO: 1373458 - RNA, 19 nt, Human
ggguuccuccccuccagcu

SEQ ID NO: 1373459 - RNA, 18 nt, Human
ggguuccuccccuccagc

SEQ ID NO: 1373460 - RNA, 15 nt, Human
ggguucucacagugg

SEQ ID NO: 1373461 - RNA, 17 nt, Human
ggguuccuccccuccag

SEQ ID NO: 1373462 - RNA, 21 nt, Human
ggguuccguguccacccccau

SEQ ID NO: 1373463 - RNA, 21 nt, Human
ggguucugccugccagcugca

SEQ ID NO: 1373464 - RNA, 20 nt, Human
ggguucugccugccagcugc

SEQ ID NO: 1373465 - RNA, 12 nt, Human
ggguggaagcuu

SEQ ID NO: 1373466 - RNA, 13 nt, Human
ggguucauuugug

SEQ ID NO: 1373467 - RNA, 14 nt, Human
ggguucauuugugu

SEQ ID NO: 1373468 - RNA, 16 nt, Human
ggguagcgggggaggg

SEQ ID NO: 1373469 - RNA, 19 nt, Human
gggugcugggccccugccu

SEQ ID NO: 1373470 - RNA, 21 nt, Human
ggguagccacuggacugacga

SEQ ID NO: 1373471 - RNA, 23 nt, Human
gggcucugcaauuccccucugcu

SEQ ID NO: 1373472 - RNA, 21 nt, Human
gggcucugcaauuccccucug

SEQ ID NO: 1373473 - RNA, 20 nt, Human
gggcucugcaauuccccucu

SEQ ID NO: 1373474 - RNA, 10 nt, Human
gggcucugau

SEQ ID NO: 1373475 - RNA, 16 nt, Human
gggcucugaguacccc

SEQ ID NO: 1373476 - RNA, 11 nt, Human
gggcucugagu

SEQ ID NO: 1373477 - RNA, 15 nt, Human
gggcucugaggcgcc

SEQ ID NO: 1373478 - RNA, 12 nt, Human
gggcucugaggc

SEQ ID NO: 1373479 - RNA, 11 nt, Human
gggcucugagg

SEQ ID NO: 1373480 - RNA, 22 nt, Human
gggcucuccuggcuucccaucc

SEQ ID NO: 1373481 - RNA, 13 nt, Human
gggcucuccuggc

SEQ ID NO: 1373482 - RNA, 12 nt, Human
gggcucuccugg

SEQ ID NO: 1373483 - RNA, 22 nt, Human
gggcucuaacgccugagcccag

SEQ ID NO: 1373484 - RNA, 23 nt, Human
gggcucuaacgccugagcccagg

SEQ ID NO: 1373485 - RNA, 21 nt, Human
gggcucuaacgccugagccca

SEQ ID NO: 1373486 - RNA, 20 nt, Human
gggcucuaacgccugagccc

SEQ ID NO: 1373487 - RNA, 19 nt, Human
gggcucuaacgccugagcc

SEQ ID NO: 1373488 - RNA, 18 nt, Human
gggcucuaacgccugagc

SEQ ID NO: 1373489 - RNA, 17 nt, Human
gggcucuaacgccugag

SEQ ID NO: 1373490 - RNA, 16 nt, Human
gggcucuaacgccuga

SEQ ID NO: 1373491 - RNA, 15 nt, Human
gggcucuaacgccug

SEQ ID NO: 1373492 - RNA, 20 nt, Human
gggcucgaggggugggcugg

SEQ ID NO: 1373493 - RNA, 18 nt, Human
gggcucgaggggugggcu

SEQ ID NO: 1373494 - RNA, 12 nt, Human
gggcuccuuucc

SEQ ID NO: 1373495 - RNA, 23 nt, Human
gggcuccuugugggccugggcuc

SEQ ID NO: 1373496 - RNA, 22 nt, Human
gggcuccuugugggccugggcu

SEQ ID NO: 1373497 - RNA, 20 nt, Human
gggcuccuugugggccuggg

SEQ ID NO: 1373498 - RNA, 19 nt, Human
gggcuccuugugggccugg

SEQ ID NO: 1373499 - RNA, 18 nt, Human
gggcuccuugugggccug

SEQ ID NO: 1373500 - RNA, 13 nt, Human
gggcuccuggacc

SEQ ID NO: 1373501 - RNA, 22 nt, Human
gggcuccugcacuuacuugcuu

SEQ ID NO: 1373502 - RNA, 18 nt, Human
gggcuccugcacuuacuu

SEQ ID NO: 1373503 - RNA, 11 nt, Human
gggcuccugca

SEQ ID NO: 1373504 - RNA, 18 nt, Human
gggcuccgugugggagac

SEQ ID NO: 1373505 - RNA, 17 nt, Human
gggcuccgugugggaga

SEQ ID NO: 1373506 - RNA, 22 nt, Human
gggcuccuccaggguggcagca

SEQ ID NO: 1373507 - RNA, 23 nt, Human
gggcuccuccaggguggcagcaa

SEQ ID NO: 1373508 - RNA, 13 nt, Human
gggcugagggagc

SEQ ID NO: 1373509 - RNA, 12 nt, Human
gggcugagggag

SEQ ID NO: 1373510 - RNA, 23 nt, Human
gggcugagcuggggaccugguac

SEQ ID NO: 1373511 - RNA, 16 nt, Human
gggcugucaucugugc

SEQ ID NO: 1373512 - RNA, 19 nt, Human
gggcuguaacugccaggcu

SEQ ID NO: 1373513 - RNA, 18 nt, Human
gggcuguaacugccaggc

SEQ ID NO: 1373514 - RNA, 17 nt, Human
gggcuguaacugccagg

SEQ ID NO: 1373515 - RNA, 16 nt, Human
gggcuguaacugccag

SEQ ID NO: 1373516 - RNA, 18 nt, Human
gggcugaggagcagcagg

SEQ ID NO: 1373517 - RNA, 14 nt, Human
gggcugagggagcc

SEQ ID NO: 1373518 - RNA, 23 nt, Human
gggcugguucuguaauugugugu

SEQ ID NO: 1373519 - RNA, 22 nt, Human
gggcuguccugccacccagccc

SEQ ID NO: 1373520 - RNA, 22 nt, Human
gggcuguaacugccaggcucuc

SEQ ID NO: 1373521 - RNA, 17 nt, Human
gggcugucaucugugca

SEQ ID NO: 1373522 - RNA, 19 nt, Human
gggcuuauaucuggccucu

SEQ ID NO: 1373523 - RNA, 14 nt, Human
gggcuuauaucugg

SEQ ID NO: 1373524 - RNA, 20 nt, Human
gggcuuauaauaaaggacug

SEQ ID NO: 1373525 - RNA, 21 nt, Human
gggccuggagauccuccugca

SEQ ID NO: 1373526 - RNA, 12 nt, Human
gggccuggagau

SEQ ID NO: 1373527 - RNA, 13 nt, Human
gggcccuccuucc

SEQ ID NO: 1373528 - RNA, 22 nt, Human
gggccugcugcugagaaccugg

SEQ ID NO: 1373529 - RNA, 23 nt, Human
gggccugcugcugagaaccuggc

SEQ ID NO: 1373530 - RNA, 16 nt, Human
gggcccucucugcucu

SEQ ID NO: 1373531 - RNA, 12 nt, Human
gggcccggacgc

SEQ ID NO: 1373532 - RNA, 11 nt, Human
gggcccggacg

SEQ ID NO: 1373533 - RNA, 23 nt, Human
gggccuggucucacccuggaggc

SEQ ID NO: 1373534 - RNA, 21 nt, Human
gggccuggucucacccuggag

SEQ ID NO: 1373535 - RNA, 20 nt, Human
gggccuggucucacccugga

SEQ ID NO: 1373536 - RNA, 19 nt, Human
gggccuggucucacccugg

SEQ ID NO: 1373537 - RNA, 14 nt, Human
gggcgcggcuggga

SEQ ID NO: 1373538 - RNA, 21 nt, Human
gggcucccuguaaccucuuca

SEQ ID NO: 1373539 - RNA, 18 nt, Human
gggcucccugacugggag

SEQ ID NO: 1373540 - RNA, 14 nt, Human
gggcucccugacug

SEQ ID NO: 1373541 - RNA, 17 nt, Human
gggccuuggccuggagc

SEQ ID NO: 1373542 - RNA, 16 nt, Human
gggccuuggccuggag

SEQ ID NO: 1373543 - RNA, 15 nt, Human
gggccuuggccugga

SEQ ID NO: 1373544 - RNA, 14 nt, Human
gggccuuggccugg

SEQ ID NO: 1373545 - RNA, 18 nt, Human
gggccuuaggaagagccu

SEQ ID NO: 1373546 - RNA, 20 nt, Human
gggccuuaggaagagccuuc

SEQ ID NO: 1373547 - RNA, 23 nt, Human
gggccuguccacaggcuucugag

SEQ ID NO: 1373548 - RNA, 16 nt, Human
gggccuguccacaggc

SEQ ID NO: 1373549 - RNA, 20 nt, Human
gggccuguacugccugcuug

SEQ ID NO: 1373550 - RNA, 18 nt, Human
gggccuguacugccugcu

SEQ ID NO: 1373551 - RNA, 17 nt, Human
gggccuguacugccugc

SEQ ID NO: 1373552 - RNA, 16 nt, Human
gggccuguacugccug

SEQ ID NO: 1373553 - RNA, 15 nt, Human
gggccuguacugccu

SEQ ID NO: 1373554 - RNA, 23 nt, Human
gggccugguuaaauaaggcaggg

SEQ ID NO: 1373555 - RNA, 22 nt, Human
gggccugguuaaauaaggcagg

SEQ ID NO: 1373556 - RNA, 13 nt, Human
gggcgccuguggu

SEQ ID NO: 1373557 - RNA, 12 nt, Human
gggcgcaggccg

SEQ ID NO: 1373558 - RNA, 24 nt, Human
gggccuugggcuccgugugggaga

SEQ ID NO: 1373559 - RNA, 14 nt, Human
gggccuugggcucc

SEQ ID NO: 1373560 - RNA, 13 nt, Human
gggccuugggcuc

SEQ ID NO: 1373561 - RNA, 18 nt, Human
gggccuuggccuggagca

SEQ ID NO: 1373562 - RNA, 16 nt, Human
gggccuuuggcaggug

SEQ ID NO: 1373563 - RNA, 17 nt, Human
ggguacauggugcuggg

SEQ ID NO: 1373564 - RNA, 18 nt, Human
ggggugcagggauguggg

SEQ ID NO: 1373565 - RNA, 16 nt, Human
ggggugcccacaggcc

SEQ ID NO: 1373566 - RNA, 13 nt, Human
ggggugcagggau

SEQ ID NO: 1373567 - RNA, 16 nt, Human
ggggugcacaggaggg

SEQ ID NO: 1373568 - RNA, 15 nt, Human
ggggugcacaggagg

SEQ ID NO: 1373569 - RNA, 14 nt, Human
ggggugcacaggag

SEQ ID NO: 1373570 - RNA, 13 nt, Human
ggggugcacagga

SEQ ID NO: 1373571 - RNA, 17 nt, Human
ggggugaugagggcagc

SEQ ID NO: 1373572 - RNA, 23 nt, Human
ggggugaugagggcagcagccag

SEQ ID NO: 1373573 - RNA, 15 nt, Human
ggggugaggagcugg

SEQ ID NO: 1373574 - RNA, 14 nt, Human
ggggugaggagcug

SEQ ID NO: 1373575 - RNA, 23 nt, Human
ggggugacccggcacccccugca

SEQ ID NO: 1373576 - RNA, 21 nt, Human
gggguuccguguccaccccca

SEQ ID NO: 1373577 - RNA, 14 nt, Human
gggguucaggcccg

SEQ ID NO: 1373578 - RNA, 16 nt, Human
gggguuauuuucuggu

SEQ ID NO: 1373579 - RNA, 16 nt, Human
ggggcaggcugggcca

SEQ ID NO: 1373580 - RNA, 15 nt, Human
ggggcaggcugggcc

SEQ ID NO: 1373581 - RNA, 14 nt, Human
ggggcaggcugggc

SEQ ID NO: 1373582 - RNA, 13 nt, Human
ggggcaggcuggg

SEQ ID NO: 1373583 - RNA, 21 nt, Human
ggggcaggaguagcugagcuc

SEQ ID NO: 1373584 - RNA, 20 nt, Human
ggggcaggaguagcugagcu

SEQ ID NO: 1373585 - RNA, 19 nt, Human
ggggcaggaguagcugagc

SEQ ID NO: 1373586 - RNA, 17 nt, Human
ggggcaggaguagcuga

SEQ ID NO: 1373587 - RNA, 11 nt, Human
ggggcaggagu

SEQ ID NO: 1373588 - RNA, 13 nt, Human
ggggcuggaggag

SEQ ID NO: 1373589 - RNA, 12 nt, Human
ggggcugcugcu

SEQ ID NO: 1373590 - RNA, 19 nt, Human
ggggcugcuuccuccugga

SEQ ID NO: 1373591 - RNA, 18 nt, Human
ggggcugcuuccuccugg

SEQ ID NO: 1373592 - RNA, 16 nt, Human
ggggcugcuuccuccu

SEQ ID NO: 1373593 - RNA, 22 nt, Human
ggggcugcugcugggcucagug

SEQ ID NO: 1373594 - RNA, 21 nt, Human
ggggcuggaggagcccaggcc

SEQ ID NO: 1373595 - RNA, 17 nt, Human
ggggcuggaggagccca

SEQ ID NO: 1373596 - RNA, 16 nt, Human
ggggcuggaggagccc

SEQ ID NO: 1373597 - RNA, 23 nt, Human
ggggcuggaggagcccaggccag

SEQ ID NO: 1373598 - RNA, 17 nt, Human
gggggaacucagaucca

SEQ ID NO: 1373599 - RNA, 14 nt, Human
ggggcuugccuucu

SEQ ID NO: 1373600 - RNA, 21 nt, Human
ggggcuuccuggugcuggagg

SEQ ID NO: 1373601 - RNA, 13 nt, Human
ggggcuuccuggu

SEQ ID NO: 1373602 - RNA, 11 nt, Human
ggggcuuccug

SEQ ID NO: 1373603 - RNA, 23 nt, Human
ggggcuguccugccacccagccc

SEQ ID NO: 1373604 - RNA, 20 nt, Human
ggggcuuauaauaaaggacu

SEQ ID NO: 1373605 - RNA, 17 nt, Human
gggcuucagcugccagu

SEQ ID NO: 1373606 - RNA, 15 nt, Human
gggcuuccuggugcu

SEQ ID NO: 1373607 - RNA, 21 nt, Human
gggcuuccuggagcagaagca

SEQ ID NO: 1373608 - RNA, 16 nt, Human
gggcuuccuggagcag

SEQ ID NO: 1373609 - RNA, 15 nt, Human
gggcuuccuggagca

SEQ ID NO: 1373610 - RNA, 14 nt, Human
gggcuuccuggagc

SEQ ID NO: 1373611 - RNA, 13 nt, Human
gggcuuccuggag

SEQ ID NO: 1373612 - RNA, 12 nt, Human
gggcuuccugga

SEQ ID NO: 1373613 - RNA, 13 nt, Human
gggcuucccaagg

SEQ ID NO: 1373614 - RNA, 16 nt, Human
gggcuucccaagggcu

SEQ ID NO: 1373615 - RNA, 17 nt, Human
gggcuucagguccaggc

SEQ ID NO: 1373616 - RNA, 13 nt, Human
gggcuugccuucu

SEQ ID NO: 1373617 - RNA, 15 nt, Human
gggcuugggccuagg

SEQ ID NO: 1373618 - RNA, 11 nt, Human
gggcuugggcc

SEQ ID NO: 1373619 - RNA, 14 nt, Human
gggcuugccuucug

SEQ ID NO: 1373620 - RNA, 21 nt, Human
gggcuugcuauucugucccua

SEQ ID NO: 1373621 - RNA, 22 nt, Human
ggggaguaaagaauuauuuugu

SEQ ID NO: 1373622 - RNA, 13 nt, Human
ggggaggaggagg

SEQ ID NO: 1373623 - RNA, 15 nt, Human
ggggagcugggccug

SEQ ID NO: 1373624 - RNA, 19 nt, Human
ggggagcgggucugcuccc

SEQ ID NO: 1373625 - RNA, 22 nt, Human
ggggagccccuucugcucagcu

SEQ ID NO: 1373626 - RNA, 21 nt, Human
ggggaguuaagaccuggcagc

SEQ ID NO: 1373627 - RNA, 17 nt, Human
ggggaguuaagaccugg

SEQ ID NO: 1373628 - RNA, 19 nt, Human
ggggagcccacuguccugg

SEQ ID NO: 1373629 - RNA, 11 nt, Human
ggggagcccac

SEQ ID NO: 1373630 - RNA, 14 nt, Human
ggggagcaggcagc

SEQ ID NO: 1373631 - RNA, 18 nt, Human
ggggagacugggcugagg

SEQ ID NO: 1373632 - RNA, 17 nt, Human
ggggagacugggcugag

SEQ ID NO: 1373633 - RNA, 20 nt, Human
gggcuugggccuaggcugca

SEQ ID NO: 1373634 - RNA, 23 nt, Human
ggggaucccucccccccaugcac

SEQ ID NO: 1373635 - RNA, 21 nt, Human
ggggaucccucccccccaugc

SEQ ID NO: 1373636 - RNA, 18 nt, Human
ggggaguuuagggugggg

SEQ ID NO: 1373637 - RNA, 12 nt, Human
ggggcagccccc

SEQ ID NO: 1373638 - RNA, 13 nt, Human
ggggcagagccag

SEQ ID NO: 1373639 - RNA, 14 nt, Human
ggggcagagccagg

SEQ ID NO: 1373640 - RNA, 23 nt, Human
ggggcagaggcaguaccugggca

SEQ ID NO: 1373641 - RNA, 17 nt, Human
ggggcagaggcaguacc

SEQ ID NO: 1373642 - RNA, 15 nt, Human
ggggcagagccagga

SEQ ID NO: 1373643 - RNA, 16 nt, Human
ggggcagagccaggaa

SEQ ID NO: 1373644 - RNA, 22 nt, Human
gucaagcugaguauuaaaaugu

SEQ ID NO: 1373645 - RNA, 21 nt, Human
gucaagaauagcauuguaaaa

SEQ ID NO: 1373646 - RNA, 17 nt, Human
gucaacuugagcauguu

SEQ ID NO: 1373647 - RNA, 20 nt, Human
gucaagagugaauucccuca

SEQ ID NO: 1373648 - RNA, 19 nt, Human
gucaagagugaauucccuc

SEQ ID NO: 1373649 - RNA, 17 nt, Human
gucaagugcguccacga

SEQ ID NO: 1373650 - RNA, 20 nt, Human
gucaacuugagcauguuacu

SEQ ID NO: 1373651 - RNA, 22 nt, Human
guauuuguuaauuuagaaaacu

SEQ ID NO: 1373652 - RNA, 16 nt, Human
guauuuguucccaaga

SEQ ID NO: 1373653 - RNA, 18 nt, Human
guauuuuaaaagaaugau

SEQ ID NO: 1373654 - RNA, 23 nt, Human
guauuuguuaauuuagaaaacuu

SEQ ID NO: 1373655 - RNA, 18 nt, Human
guauuuguuaauuuagaa

SEQ ID NO: 1373656 - RNA, 17 nt, Human
guauuuguuaauuuaga

SEQ ID NO: 1373657 - RNA, 13 nt, Human
guauuuguaauua

SEQ ID NO: 1373658 - RNA, 20 nt, Human
guauuugggaagugaagacu

SEQ ID NO: 1373659 - RNA, 17 nt, Human
guauuuuaaaagaauga

SEQ ID NO: 1373660 - RNA, 16 nt, Human
guauuuuaaaagaaug

SEQ ID NO: 1373661 - RNA, 18 nt, Human
gucaaguuauuaauuucu

SEQ ID NO: 1373662 - RNA, 22 nt, Human
gucaaugcaguugucucuguuu

SEQ ID NO: 1373663 - RNA, 16 nt, Human
gucaaugcaguugucu

SEQ ID NO: 1373664 - RNA, 14 nt, Human
gucaaugcaguugu

SEQ ID NO: 1373665 - RNA, 21 nt, Human
gucaauaaaauccauacauuu

SEQ ID NO: 1373666 - RNA, 20 nt, Human
gucaaguuauuaauuucuuc

SEQ ID NO: 1373667 - RNA, 11 nt, Human
gucaaguuauu

SEQ ID NO: 1373668 - RNA, 15 nt, Human
gucaauaaaauccau

SEQ ID NO: 1373669 - RNA, 20 nt, Human
gucacccaggcuggacugca

SEQ ID NO: 1373670 - RNA, 20 nt, Human
gucacccaggcuggagugca

SEQ ID NO: 1373671 - RNA, 20 nt, Human
gucacccagguuggagugca

SEQ ID NO: 1373672 - RNA, 16 nt, Human
gucaccucagagacau

SEQ ID NO: 1373673 - RNA, 21 nt, Human
gucaccuaggaagccucagau

SEQ ID NO: 1373674 - RNA, 20 nt, Human
gucaccuaggaagccucaga

SEQ ID NO: 1373675 - RNA, 19 nt, Human
gucaccuaggaagccucag

SEQ ID NO: 1373676 - RNA, 14 nt, Human
gucaccucauggaa

SEQ ID NO: 1373677 - RNA, 13 nt, Human
guauuauauguac

SEQ ID NO: 1373678 - RNA, 18 nt, Human
guauuauaccaaaauguu

SEQ ID NO: 1373679 - RNA, 15 nt, Human
guauuauguguguuu

SEQ ID NO: 1373680 - RNA, 16 nt, Human
guauuaugucucuucu

SEQ ID NO: 1373681 - RNA, 16 nt, Human
guauuauuuacauuua

SEQ ID NO: 1373682 - RNA, 19 nt, Human
guauucaaaaauuaucuau

SEQ ID NO: 1373683 - RNA, 14 nt, Human
guauuauaccuuuu

SEQ ID NO: 1373684 - RNA, 12 nt, Human
guauuagauguu

SEQ ID NO: 1373685 - RNA, 13 nt, Human
guauuagauguuc

SEQ ID NO: 1373686 - RNA, 14 nt, Human
guauuagauguucu

SEQ ID NO: 1373687 - RNA, 15 nt, Human
guauuagauguucuc

SEQ ID NO: 1373688 - RNA, 17 nt, Human
guauuagauguucucua

SEQ ID NO: 1373689 - RNA, 18 nt, Human
guauuagauguucucuau

SEQ ID NO: 1373690 - RNA, 21 nt, Human
guauuagauguucucuaucau

SEQ ID NO: 1373691 - RNA, 22 nt, Human
guauuagauguucucuaucauu

SEQ ID NO: 1373692 - RNA, 22 nt, Human
guauuacaguggggaaugaaga

SEQ ID NO: 1373693 - RNA, 20 nt, Human
guauuacaguggggaaugaa

SEQ ID NO: 1373694 - RNA, 21 nt, Human
guauuuggaaauaaagucaga

SEQ ID NO: 1373695 - RNA, 20 nt, Human
guauuuggaaauaaagucag

SEQ ID NO: 1373696 - RNA, 19 nt, Human
guauuuggaaauaaaguca

SEQ ID NO: 1373697 - RNA, 22 nt, Human
guauuugcuuuuuuguuuuggc

SEQ ID NO: 1373698 - RNA, 12 nt, Human
guauuugcuuuu

SEQ ID NO: 1373699 - RNA, 12 nt, Human
guauuugcuaau

SEQ ID NO: 1373700 - RNA, 11 nt, Human
guauuugcuaa

SEQ ID NO: 1373701 - RNA, 15 nt, Human
guauuugaaucagcc

SEQ ID NO: 1373702 - RNA, 22 nt, Human
guauuucuaugaaauauuaugu

SEQ ID NO: 1373703 - RNA, 19 nt, Human
guauuuauuuuuucuuuuc

SEQ ID NO: 1373704 - RNA, 13 nt, Human
guauuucaaauug

SEQ ID NO: 1373705 - RNA, 17 nt, Human
guauuucuaugaaauau

SEQ ID NO: 1373706 - RNA, 17 nt, Human
guauuuauucaauaaag

SEQ ID NO: 1373707 - RNA, 19 nt, Human
guauuuauucaauaaagua

SEQ ID NO: 1373708 - RNA, 20 nt, Human
guauuuauucaauaaaguau

SEQ ID NO: 1373709 - RNA, 22 nt, Human
guauuuauucaauaaaguauuu

SEQ ID NO: 1373710 - RNA, 23 nt, Human
guauuuauucaauaaaguauuua

SEQ ID NO: 1373711 - RNA, 21 nt, Human
guauucccaaaaauuacuuug

SEQ ID NO: 1373712 - RNA, 19 nt, Human
guauuccagaccugaagaa

SEQ ID NO: 1373713 - RNA, 22 nt, Human
guauucauccaaguuaaaugua

SEQ ID NO: 1373714 - RNA, 21 nt, Human
guauucauccaaguuaaaugu

SEQ ID NO: 1373715 - RNA, 16 nt, Human
guauucguuaucuaau

SEQ ID NO: 1373716 - RNA, 19 nt, Human
guauucccauuagaccaag

SEQ ID NO: 1373717 - RNA, 13 nt, Human
guauuuauucaau

SEQ ID NO: 1373718 - RNA, 14 nt, Human
guauuuauucaaua

SEQ ID NO: 1373719 - RNA, 16 nt, Human
guauuuauucaauaaa

SEQ ID NO: 1373720 - RNA, 22 nt, Human
gucccagcagcugccaggagca

SEQ ID NO: 1373721 - RNA, 15 nt, Human
gucccagcagcugcc

SEQ ID NO: 1373722 - RNA, 14 nt, Human
gucccagcagcugc

SEQ ID NO: 1373723 - RNA, 12 nt, Human
gucccagcagcu

SEQ ID NO: 1373724 - RNA, 11 nt, Human
gucccagcagc

SEQ ID NO: 1373725 - RNA, 22 nt, Human
gucccagaaaaagcaucauggc

SEQ ID NO: 1373726 - RNA, 12 nt, Human
gucccagagcag

SEQ ID NO: 1373727 - RNA, 21 nt, Human
gucccagaagaugacugaggg

SEQ ID NO: 1373728 - RNA, 20 nt, Human
guccaggcugccguggggcc

SEQ ID NO: 1373729 - RNA, 16 nt, Human
guccaggcugccgugg

SEQ ID NO: 1373730 - RNA, 14 nt, Human
guccaggcugccgu

SEQ ID NO: 1373731 - RNA, 13 nt, Human
guccaggcugccg

SEQ ID NO: 1373732 - RNA, 15 nt, Human
guccaggcacugaga

SEQ ID NO: 1373733 - RNA, 21 nt, Human
guccaggaugcuaacaucuaa

SEQ ID NO: 1373734 - RNA, 13 nt, Human
guccaggagccug

SEQ ID NO: 1373735 - RNA, 17 nt, Human
guccagcugagcgccag

SEQ ID NO: 1373736 - RNA, 21 nt, Human
guccagcucuggaggggaggg

SEQ ID NO: 1373737 - RNA, 16 nt, Human
guccagcucuggaggg

SEQ ID NO: 1373738 - RNA, 14 nt, Human
guccagcucuggag

SEQ ID NO: 1373739 - RNA, 13 nt, Human
guccagcucugga

SEQ ID NO: 1373740 - RNA, 12 nt, Human
guccagcucugg

SEQ ID NO: 1373741 - RNA, 19 nt, Human
guccacuucugacagccuc

SEQ ID NO: 1373742 - RNA, 18 nt, Human
guccacuucugacagccu

SEQ ID NO: 1373743 - RNA, 17 nt, Human
guccacuucugacagcc

SEQ ID NO: 1373744 - RNA, 16 nt, Human
guccacuucugacagc

SEQ ID NO: 1373745 - RNA, 13 nt, Human
gucauguguauaa

SEQ ID NO: 1373746 - RNA, 12 nt, Human
gucauguguaua

SEQ ID NO: 1373747 - RNA, 15 nt, Human
gucaugugacaggua

SEQ ID NO: 1373748 - RNA, 11 nt, Human
gucaugugacc

SEQ ID NO: 1373749 - RNA, 23 nt, Human
gucaugggccacugcuuuucccu

SEQ ID NO: 1373750 - RNA, 14 nt, Human
gucaugcugccuua

SEQ ID NO: 1373751 - RNA, 13 nt, Human
gucaugcugccuu

SEQ ID NO: 1373752 - RNA, 14 nt, Human
gucauguguauaaa

SEQ ID NO: 1373753 - RNA, 24 nt, Human
gucaugcacaguauuuguaauuaa

SEQ ID NO: 1373754 - RNA, 19 nt, Human
gucaugcacaguauuugua

SEQ ID NO: 1373755 - RNA, 21 nt, Human
gucaugaggagauucugccuu

SEQ ID NO: 1373756 - RNA, 22 nt, Human
gucaugaggagauucugccuuu

SEQ ID NO: 1373757 - RNA, 20 nt, Human
gucaugaggagauucugccu

SEQ ID NO: 1373758 - RNA, 22 nt, Human
gucaucuugcuaccaguauuua

SEQ ID NO: 1373759 - RNA, 18 nt, Human
gucaucuugcuaccagua

SEQ ID NO: 1373760 - RNA, 15 nt, Human
gucaucuugcuacca

SEQ ID NO: 1373761 - RNA, 14 nt, Human
gucaucuugcuacc

SEQ ID NO: 1373762 - RNA, 12 nt, Human
gucaucuugcua

SEQ ID NO: 1373763 - RNA, 22 nt, Human
gucauccucaaagaaaguguau

SEQ ID NO: 1373764 - RNA, 19 nt, Human
gucauccucaaagaaagug

SEQ ID NO: 1373765 - RNA, 21 nt, Human
gucaucaucauggccagcugg

SEQ ID NO: 1373766 - RNA, 20 nt, Human
gucaucaucauggccagcug

SEQ ID NO: 1373767 - RNA, 18 nt, Human
gucaucaucauggccagc

SEQ ID NO: 1373768 - RNA, 17 nt, Human
gucaucaucauggccag

SEQ ID NO: 1373769 - RNA, 18 nt, Human
gucauccucacagugaac

SEQ ID NO: 1373770 - RNA, 23 nt, Human
gucaucaauuaaaggcaaaggca

SEQ ID NO: 1373771 - RNA, 15 nt, Human
gucauagguuaauau

SEQ ID NO: 1373772 - RNA, 22 nt, Human
gucauagaaauuacacccaaag

SEQ ID NO: 1373773 - RNA, 13 nt, Human
gucauagaaauua

SEQ ID NO: 1373774 - RNA, 16 nt, Human
gucauaccaaugaaaa

SEQ ID NO: 1373775 - RNA, 15 nt, Human
gucauaccaaugaaa

SEQ ID NO: 1373776 - RNA, 16 nt, Human
gucauacagagaaguc

SEQ ID NO: 1373777 - RNA, 15 nt, Human
gucauacagagaagu

SEQ ID NO: 1373778 - RNA, 14 nt, Human
gucauacagagaag

SEQ ID NO: 1373779 - RNA, 13 nt, Human
gucauacagagaa

SEQ ID NO: 1373780 - RNA, 12 nt, Human
gucauacagaga

SEQ ID NO: 1373781 - RNA, 18 nt, Human
gucauaauugcauugacu

SEQ ID NO: 1373782 - RNA, 16 nt, Human
gucauaauugcauuga

SEQ ID NO: 1373783 - RNA, 14 nt, Human
gucauaauugcauu

SEQ ID NO: 1373784 - RNA, 12 nt, Human
gucauaauugca

SEQ ID NO: 1373785 - RNA, 15 nt, Human
gucagcaugaauuug

SEQ ID NO: 1373786 - RNA, 13 nt, Human
gucagccacuguu

SEQ ID NO: 1373787 - RNA, 20 nt, Human
gucagcaugaauuuguaaug

SEQ ID NO: 1373788 - RNA, 14 nt, Human
gucagcaugaauuu

SEQ ID NO: 1373789 - RNA, 23 nt, Human
gucagcagccucccugaagacca

SEQ ID NO: 1373790 - RNA, 22 nt, Human
gucagcccuaggguggagagcc

SEQ ID NO: 1373791 - RNA, 13 nt, Human
gucagcccuaggg

SEQ ID NO: 1373792 - RNA, 13 nt, Human
gucaccugugcuu

SEQ ID NO: 1373793 - RNA, 21 nt, Human
gucaccucagagacauacacc

SEQ ID NO: 1373794 - RNA, 18 nt, Human
gucacggauuugugucug

SEQ ID NO: 1373795 - RNA, 20 nt, Human
gucacggcugcgcacugugu

SEQ ID NO: 1373796 - RNA, 14 nt, Human
gucacgccagacuu

SEQ ID NO: 1373797 - RNA, 20 nt, Human
gucagcagccucccugaaga

SEQ ID NO: 1373798 - RNA, 21 nt, Human
gucagcaaguccuaagccugu

SEQ ID NO: 1373799 - RNA, 19 nt, Human
gucacguuuggugcuucuc

SEQ ID NO: 1373800 - RNA, 14 nt, Human
guccuauggccuca

SEQ ID NO: 1373801 - RNA, 22 nt, Human
guccuaucugggcuuccuggag

SEQ ID NO: 1373802 - RNA, 21 nt, Human
guccuaucugggcuuccugga

SEQ ID NO: 1373803 - RNA, 20 nt, Human
guccuaucugggcuuccugg

SEQ ID NO: 1373804 - RNA, 24 nt, Human
guccuaucugggcuuccuggagca

SEQ ID NO: 1373805 - RNA, 19 nt, Human
guccuaucugggcuuccug

SEQ ID NO: 1373806 - RNA, 18 nt, Human
guccuaucugggcuuccu

SEQ ID NO: 1373807 - RNA, 17 nt, Human
guccuaucugggcuucc

SEQ ID NO: 1373808 - RNA, 15 nt, Human
guccuaucugggcuu

SEQ ID NO: 1373809 - RNA, 14 nt, Human
guccuaucugggcu

SEQ ID NO: 1373810 - RNA, 20 nt, Human
guccuaucuccagcggcccu

SEQ ID NO: 1373811 - RNA, 16 nt, Human
guccuaguuguucagc

SEQ ID NO: 1373812 - RNA, 17 nt, Human
guccuagcacagauggc

SEQ ID NO: 1373813 - RNA, 21 nt, Human
guccuagcacagauggccagc

SEQ ID NO: 1373814 - RNA, 15 nt, Human
guccuagcacagaug

SEQ ID NO: 1373815 - RNA, 16 nt, Human
guccuauggccucaug

SEQ ID NO: 1373816 - RNA, 15 nt, Human
guccuauggccucau

SEQ ID NO: 1373817 - RNA, 22 nt, Human
guccuccaacaccaagcacagc

SEQ ID NO: 1373818 - RNA, 21 nt, Human
guccuccaacaccaagcacag

SEQ ID NO: 1373819 - RNA, 21 nt, Human
guccucagccuugccagagau

SEQ ID NO: 1373820 - RNA, 20 nt, Human
guccucagccuugccagaga

SEQ ID NO: 1373821 - RNA, 16 nt, Human
guccucagccuugcca

SEQ ID NO: 1373822 - RNA, 20 nt, Human
guccucagagaauuucuacc

SEQ ID NO: 1373823 - RNA, 14 nt, Human
guccucagccuugc

SEQ ID NO: 1373824 - RNA, 12 nt, Human
guccucagccuu

SEQ ID NO: 1373825 - RNA, 12 nt, Human
guccucagcccc

SEQ ID NO: 1373826 - RNA, 15 nt, Human
gucccuggggcuagg

SEQ ID NO: 1373827 - RNA, 19 nt, Human
gucccugggagggacaugc

SEQ ID NO: 1373828 - RNA, 23 nt, Human
gucccugccuggaccagccucuc

SEQ ID NO: 1373829 - RNA, 22 nt, Human
gucccugccuggaccagccucu

SEQ ID NO: 1373830 - RNA, 14 nt, Human
gucccugccuggac

SEQ ID NO: 1373831 - RNA, 21 nt, Human
gucccugccuggaccagccuc

SEQ ID NO: 1373832 - RNA, 20 nt, Human
gucccugccuggaccagccu

SEQ ID NO: 1373833 - RNA, 21 nt, Human
gucccagguuggcucugccag

SEQ ID NO: 1373834 - RNA, 22 nt, Human
gucccagguuggcucugccagu

SEQ ID NO: 1373835 - RNA, 19 nt, Human
gucccagguuggcucugcc

SEQ ID NO: 1373836 - RNA, 18 nt, Human
gucccagguuggcucugc

SEQ ID NO: 1373837 - RNA, 17 nt, Human
gucccagguuggcucug

SEQ ID NO: 1373838 - RNA, 16 nt, Human
gucccagguuggcucu

SEQ ID NO: 1373839 - RNA, 17 nt, Human
gucccagcagcugccag

SEQ ID NO: 1373840 - RNA, 19 nt, Human
gucccaggaaucaguuuaa

SEQ ID NO: 1373841 - RNA, 20 nt, Human
gucccuggguagcgggggag

SEQ ID NO: 1373842 - RNA, 22 nt, Human
gucccuggggcuagggggagcc

SEQ ID NO: 1373843 - RNA, 22 nt, Human
guccucccgagcuccucuucca

SEQ ID NO: 1373844 - RNA, 21 nt, Human
guccucccgagcuccucuucc

SEQ ID NO: 1373845 - RNA, 16 nt, Human
guccucccgagcuccu

SEQ ID NO: 1373846 - RNA, 22 nt, Human
guccuggcgccuggcaguccgu

SEQ ID NO: 1373847 - RNA, 21 nt, Human
guccucccaauuucagacucc

SEQ ID NO: 1373848 - RNA, 19 nt, Human
guccugugaaugccacugc

SEQ ID NO: 1373849 - RNA, 18 nt, Human
guccugugaaugccacug

SEQ ID NO: 1373850 - RNA, 20 nt, Human
guccugucggagcccugucu

SEQ ID NO: 1373851 - RNA, 21 nt, Human
guccugucggagcccugucuc

SEQ ID NO: 1373852 - RNA, 23 nt, Human
guccugucaucaucauggccagc

SEQ ID NO: 1373853 - RNA, 21 nt, Human
guccugucaucaucauggcca

SEQ ID NO: 1373854 - RNA, 20 nt, Human
guccugucaucaucauggcc

SEQ ID NO: 1373855 - RNA, 18 nt, Human
guccugucggagcccugu

SEQ ID NO: 1373856 - RNA, 19 nt, Human
guccugucaucaucauggc

SEQ ID NO: 1373857 - RNA, 16 nt, Human
guccugucaucaucau

SEQ ID NO: 1373858 - RNA, 15 nt, Human
guccuguacauugug

SEQ ID NO: 1373859 - RNA, 20 nt, Human
guccuggugguauuuucaau

SEQ ID NO: 1373860 - RNA, 23 nt, Human
guccuggugguauuuucaauagc

SEQ ID NO: 1373861 - RNA, 22 nt, Human
guccugguggggcagcuccucu

SEQ ID NO: 1373862 - RNA, 20 nt, Human
guccugguggggcagcuccu

SEQ ID NO: 1373863 - RNA, 18 nt, Human
guccugguggggcagcuc

SEQ ID NO: 1373864 - RNA, 17 nt, Human
guccugguggggcagcu

SEQ ID NO: 1373865 - RNA, 16 nt, Human
guccugguggggcagc

SEQ ID NO: 1373866 - RNA, 17 nt, Human
guccugggccugcagaa

SEQ ID NO: 1373867 - RNA, 14 nt, Human
guccugggccugca

SEQ ID NO: 1373868 - RNA, 13 nt, Human
guccugggccugc

SEQ ID NO: 1373869 - RNA, 16 nt, Human
guccugggaggagaga

SEQ ID NO: 1373870 - RNA, 15 nt, Human
guccugggaggagag

SEQ ID NO: 1373871 - RNA, 21 nt, Human
gucucuuccaguuugcuuugc

SEQ ID NO: 1373872 - RNA, 23 nt, Human
gucucuuauggauguccccagca

SEQ ID NO: 1373873 - RNA, 22 nt, Human
gucucuuauggauguccccagc

SEQ ID NO: 1373874 - RNA, 15 nt, Human
gucucuuauggaugu

SEQ ID NO: 1373875 - RNA, 22 nt, Human
gucucuguuuuacaaguuggag

SEQ ID NO: 1373876 - RNA, 18 nt, Human
gucucucuaugccucucu

SEQ ID NO: 1373877 - RNA, 22 nt, Human
gucucucuaugccucucuacag

SEQ ID NO: 1373878 - RNA, 17 nt, Human
gucucucuaugccucuc

SEQ ID NO: 1373879 - RNA, 22 nt, Human
gucucucguaguguuaaguuau

SEQ ID NO: 1373880 - RNA, 15 nt, Human
gucucucaugaaccu

SEQ ID NO: 1373881 - RNA, 18 nt, Human
gucucucagggccaggcc

SEQ ID NO: 1373882 - RNA, 17 nt, Human
gucucucagggccaggc

SEQ ID NO: 1373883 - RNA, 16 nt, Human
gucucucaugaaccuc

SEQ ID NO: 1373884 - RNA, 15 nt, Human
gucucggccuucaca

SEQ ID NO: 1373885 - RNA, 14 nt, Human
gucucgucucuuuu

SEQ ID NO: 1373886 - RNA, 21 nt, Human
gucucuauaccaauaaaguga

SEQ ID NO: 1373887 - RNA, 14 nt, Human
gucugccacccagg

SEQ ID NO: 1373888 - RNA, 21 nt, Human
gucugccaaccuaaaacucuu

SEQ ID NO: 1373889 - RNA, 19 nt, Human
gucugccaaccuaaaacuc

SEQ ID NO: 1373890 - RNA, 21 nt, Human
gucugagguccugagcacugc

SEQ ID NO: 1373891 - RNA, 19 nt, Human
gucugagguccugagcacu

SEQ ID NO: 1373892 - RNA, 18 nt, Human
gucugagguccugagcac

SEQ ID NO: 1373893 - RNA, 17 nt, Human
gucugagguccugagca

SEQ ID NO: 1373894 - RNA, 16 nt, Human
gucugagguccugagc

SEQ ID NO: 1373895 - RNA, 15 nt, Human
gucugagguccugag

SEQ ID NO: 1373896 - RNA, 14 nt, Human
gucugagguccuga

SEQ ID NO: 1373897 - RNA, 13 nt, Human
gucugacuguuuc

SEQ ID NO: 1373898 - RNA, 11 nt, Human
gucuaaaacuc

SEQ ID NO: 1373899 - RNA, 16 nt, Human
gucguuuuuuuuuugu

SEQ ID NO: 1373900 - RNA, 21 nt, Human
gucguuuuuuuuuuguuuguu

SEQ ID NO: 1373901 - RNA, 15 nt, Human
gucguucccagugug

SEQ ID NO: 1373902 - RNA, 23 nt, Human
gucguuaaaaacagauuuggaaa

SEQ ID NO: 1373903 - RNA, 21 nt, Human
gucguggggugugcugggagc

SEQ ID NO: 1373904 - RNA, 19 nt, Human
gucguggggugugcuggga

SEQ ID NO: 1373905 - RNA, 14 nt, Human
gucuacccugggau

SEQ ID NO: 1373906 - RNA, 13 nt, Human
gucuacccuggga

SEQ ID NO: 1373907 - RNA, 23 nt, Human
gucuacacuaagagagaaugaga

SEQ ID NO: 1373908 - RNA, 18 nt, Human
gucuaagauucuagauca

SEQ ID NO: 1373909 - RNA, 16 nt, Human
gucuaagauucuagau

SEQ ID NO: 1373910 - RNA, 15 nt, Human
gucuaagauucuaga

SEQ ID NO: 1373911 - RNA, 14 nt, Human
gucuaagauucuag

SEQ ID NO: 1373912 - RNA, 13 nt, Human
gucuaagauucua

SEQ ID NO: 1373913 - RNA, 12 nt, Human
gucuaagauucu

SEQ ID NO: 1373914 - RNA, 21 nt, Human
gucuaaagauggaguuucuaa

SEQ ID NO: 1373915 - RNA, 20 nt, Human
gucuaaagauggaguuucua

SEQ ID NO: 1373916 - RNA, 22 nt, Human
gucuaaagauggaguuucuaag

SEQ ID NO: 1373917 - RNA, 17 nt, Human
gucuacacacccugcau

SEQ ID NO: 1373918 - RNA, 21 nt, Human
gucuaaucuagauaucgacuu

SEQ ID NO: 1373919 - RNA, 17 nt, Human
gucuacacuaagagaga

SEQ ID NO: 1373920 - RNA, 21 nt, Human
gucucgagcgcccugcagacc

SEQ ID NO: 1373921 - RNA, 23 nt, Human
gucucgagcgcccugcagacccu

SEQ ID NO: 1373922 - RNA, 20 nt, Human
gucucgagcgcccugcagac

SEQ ID NO: 1373923 - RNA, 19 nt, Human
gucucgagcgcccugcaga

SEQ ID NO: 1373924 - RNA, 18 nt, Human
gucucgagcgcccugcag

SEQ ID NO: 1373925 - RNA, 17 nt, Human
gucucgagcgcccugca

SEQ ID NO: 1373926 - RNA, 15 nt, Human
gucucgagcgcccug

SEQ ID NO: 1373927 - RNA, 14 nt, Human
gucucgagcgcccu

SEQ ID NO: 1373928 - RNA, 22 nt, Human
gucucacuugugcaguguugac

SEQ ID NO: 1373929 - RNA, 22 nt, Human
gucuacccugggauucaggaaa

SEQ ID NO: 1373930 - RNA, 13 nt, Human
gucucgagcgccc

SEQ ID NO: 1373931 - RNA, 17 nt, Human
gugaaaaugguccagga

SEQ ID NO: 1373932 - RNA, 15 nt, Human
gugaaaaugguccag

SEQ ID NO: 1373933 - RNA, 12 nt, Human
gugaaaagaaua

SEQ ID NO: 1373934 - RNA, 17 nt, Human
gucugccacccaggauc

SEQ ID NO: 1373935 - RNA, 20 nt, Human
gugaaacucguuaauuugua

SEQ ID NO: 1373936 - RNA, 12 nt, Human
gugaaacuggau

SEQ ID NO: 1373937 - RNA, 19 nt, Human
gugaaagaaaauaacaaua

SEQ ID NO: 1373938 - RNA, 14 nt, Human
gugaaacuuucauu

SEQ ID NO: 1373939 - RNA, 13 nt, Human
gugaaagaaguaa

SEQ ID NO: 1373940 - RNA, 22 nt, Human
gugaaauaccaaccugaagaca

SEQ ID NO: 1373941 - RNA, 13 nt, Human
gugaaaucauuca

SEQ ID NO: 1373942 - RNA, 19 nt, Human
gugaauacugcuacagcaa

SEQ ID NO: 1373943 - RNA, 15 nt, Human
gugaauaccugcuca

SEQ ID NO: 1373944 - RNA, 20 nt, Human
gugaaauuuacaucauuucu

SEQ ID NO: 1373945 - RNA, 22 nt, Human
gugaaauuuacaucauuucuuu

SEQ ID NO: 1373946 - RNA, 18 nt, Human
gugaaauuauucauaauu

SEQ ID NO: 1373947 - RNA, 20 nt, Human
gugaaauuauucauaauuau

SEQ ID NO: 1373948 - RNA, 21 nt, Human
gugaaucaagggucaggccuu

SEQ ID NO: 1373949 - RNA, 17 nt, Human
gugaaucaagggucagg

SEQ ID NO: 1373950 - RNA, 15 nt, Human
gugaaucaaggguca

SEQ ID NO: 1373951 - RNA, 13 nt, Human
gugaaucaagggu

SEQ ID NO: 1373952 - RNA, 23 nt, Human
gugaauagccauauuuguaaaau

SEQ ID NO: 1373953 - RNA, 19 nt, Human
gugaauagccauauuugua

SEQ ID NO: 1373954 - RNA, 18 nt, Human
gugaauagccauauuugu

SEQ ID NO: 1373955 - RNA, 21 nt, Human
gugaauacugcuacagcaauu

SEQ ID NO: 1373956 - RNA, 22 nt, Human
gugaauuaggcuguaacuacuu

SEQ ID NO: 1373957 - RNA, 21 nt, Human
gugaauuaggcuguaacuacu

SEQ ID NO: 1373958 - RNA, 18 nt, Human
gugaauuaggcuguaacu

SEQ ID NO: 1373959 - RNA, 12 nt, Human
gugaaugggugc

SEQ ID NO: 1373960 - RNA, 17 nt, Human
gugagcugagcaggcca

SEQ ID NO: 1373961 - RNA, 16 nt, Human
gugagcugagcaggcc

SEQ ID NO: 1373962 - RNA, 14 nt, Human
gugagcugagcagg

SEQ ID NO: 1373963 - RNA, 13 nt, Human
gugagcugagcag

SEQ ID NO: 1373964 - RNA, 19 nt, Human
gugagcauguuuggaaggg

SEQ ID NO: 1373965 - RNA, 16 nt, Human
gugagcuccuaagcca

SEQ ID NO: 1373966 - RNA, 15 nt, Human
gugaggaaagucauu

SEQ ID NO: 1373967 - RNA, 13 nt, Human
gugagcauguuug

SEQ ID NO: 1373968 - RNA, 20 nt, Human
gugagcauggaacacuucga

SEQ ID NO: 1373969 - RNA, 16 nt, Human
gugagcagucaggaaa

SEQ ID NO: 1373970 - RNA, 21 nt, Human
gugaccugcugagcucugaga

SEQ ID NO: 1373971 - RNA, 20 nt, Human
gugaccugcugagcucugag

SEQ ID NO: 1373972 - RNA, 19 nt, Human
gugaccugcugagcucuga

SEQ ID NO: 1373973 - RNA, 18 nt, Human
gugaccugcugagcucug

SEQ ID NO: 1373974 - RNA, 16 nt, Human
gugaccugcugagcuc

SEQ ID NO: 1373975 - RNA, 15 nt, Human
gugaccugcugagcu

SEQ ID NO: 1373976 - RNA, 14 nt, Human
gugaccugcugagc

SEQ ID NO: 1373977 - RNA, 13 nt, Human
gugaccugcugag

SEQ ID NO: 1373978 - RNA, 12 nt, Human
gugaccugcuga

SEQ ID NO: 1373979 - RNA, 18 nt, Human
gugaccugcuaggccaga

SEQ ID NO: 1373980 - RNA, 13 nt, Human
gugaccugcuagg

SEQ ID NO: 1373981 - RNA, 12 nt, Human
gugacucuuucc

SEQ ID NO: 1373982 - RNA, 15 nt, Human
gugacugaauuucuu

SEQ ID NO: 1373983 - RNA, 16 nt, Human
gugacugaauuucuuu

SEQ ID NO: 1373984 - RNA, 18 nt, Human
gugacugaauuucuuuug

SEQ ID NO: 1373985 - RNA, 19 nt, Human
gugaccggacuuuucugca

SEQ ID NO: 1373986 - RNA, 15 nt, Human
gugaccggacuuuuc

SEQ ID NO: 1373987 - RNA, 16 nt, Human
gugacccuggcuccuu

SEQ ID NO: 1373988 - RNA, 18 nt, Human
gugaccuauaccuguguu

SEQ ID NO: 1373989 - RNA, 21 nt, Human
gugaccggacuuuucugcaaa

SEQ ID NO: 1373990 - RNA, 20 nt, Human
gugacaaaaaauuaaagcau

SEQ ID NO: 1373991 - RNA, 23 nt, Human
gugacccggcacccccugcagcu

SEQ ID NO: 1373992 - RNA, 22 nt, Human
gugacccggcacccccugcagc

SEQ ID NO: 1373993 - RNA, 21 nt, Human
gugacccggcacccccugcag

SEQ ID NO: 1373994 - RNA, 18 nt, Human
gugacccggcacccccug

SEQ ID NO: 1373995 - RNA, 17 nt, Human
gugacccggcacccccu

SEQ ID NO: 1373996 - RNA, 13 nt, Human
gugacaaaaaauu

SEQ ID NO: 1373997 - RNA, 17 nt, Human
gugaauuuuuuuuuccu

SEQ ID NO: 1373998 - RNA, 16 nt, Human
gugacaagcucacaga

SEQ ID NO: 1373999 - RNA, 20 nt, Human
gugauuuuuaugccaccuga

SEQ ID NO: 1374000 - RNA, 19 nt, Human
gugauuuuuaugccaccug

SEQ ID NO: 1374001 - RNA, 17 nt, Human
gugauuuuuaugccacc

SEQ ID NO: 1374002 - RNA, 22 nt, Human
gugauuuaagggcccaggucag

SEQ ID NO: 1374003 - RNA, 17 nt, Human
gugauuuaagggcccag

SEQ ID NO: 1374004 - RNA, 16 nt, Human
gugauuuuuaugccac

SEQ ID NO: 1374005 - RNA, 23 nt, Human
gugauuguggaauggagauucag

SEQ ID NO: 1374006 - RNA, 19 nt, Human
gugauuguggaauggagau

SEQ ID NO: 1374007 - RNA, 14 nt, Human
gugauuguggaaug

SEQ ID NO: 1374008 - RNA, 24 nt, Human
gugauuggccuguagaguugcuga

SEQ ID NO: 1374009 - RNA, 13 nt, Human
gugauucugccuu

SEQ ID NO: 1374010 - RNA, 21 nt, Human
gugauucagaaaauguucugu

SEQ ID NO: 1374011 - RNA, 22 nt, Human
gugaucccuagcugugaccucu

SEQ ID NO: 1374012 - RNA, 21 nt, Human
gugaucccuagcugugaccuc

SEQ ID NO: 1374013 - RNA, 16 nt, Human
gugauccauguaacug

SEQ ID NO: 1374014 - RNA, 23 nt, Human
gugaggcaaugggagcugaggcc

SEQ ID NO: 1374015 - RNA, 15 nt, Human
gugcccucugggcuc

SEQ ID NO: 1374016 - RNA, 14 nt, Human
gugcccucugggcu

SEQ ID NO: 1374017 - RNA, 13 nt, Human
gugcccucugggc

SEQ ID NO: 1374018 - RNA, 22 nt, Human
gugcccucucccacccucuucc

SEQ ID NO: 1374019 - RNA, 21 nt, Human
gugcccucucccacccucuuc

SEQ ID NO: 1374020 - RNA, 20 nt, Human
gugcccucucccacccucuu

SEQ ID NO: 1374021 - RNA, 19 nt, Human
gugcccucucccacccucu

SEQ ID NO: 1374022 - RNA, 18 nt, Human
gugcccucucccacccuc

SEQ ID NO: 1374023 - RNA, 17 nt, Human
gugcccucucccacccu

SEQ ID NO: 1374024 - RNA, 15 nt, Human
gugcccucucccacc

SEQ ID NO: 1374025 - RNA, 13 nt, Human
gugcccucuccca

SEQ ID NO: 1374026 - RNA, 16 nt, Human
gugcccccaggguccu

SEQ ID NO: 1374027 - RNA, 22 nt, Human
gugcccccaggguccugggagg

SEQ ID NO: 1374028 - RNA, 14 nt, Human
gugcccccaggguc

SEQ ID NO: 1374029 - RNA, 22 nt, Human
gugcccccaaccauuuccucag

SEQ ID NO: 1374030 - RNA, 19 nt, Human
gugcccccacugaccagaa

SEQ ID NO: 1374031 - RNA, 18 nt, Human
gugcccccacugaccaga

SEQ ID NO: 1374032 - RNA, 15 nt, Human
gugcccccacugacc

SEQ ID NO: 1374033 - RNA, 13 nt, Human
gugcccccacuga

SEQ ID NO: 1374034 - RNA, 21 nt, Human
gugccccaggaccagcucagg

SEQ ID NO: 1374035 - RNA, 19 nt, Human
gugccccaggaccagcuca

SEQ ID NO: 1374036 - RNA, 15 nt, Human
gugccccaggaccag

SEQ ID NO: 1374037 - RNA, 14 nt, Human
gugccccaggacca

SEQ ID NO: 1374038 - RNA, 12 nt, Human
gugccccaggac

SEQ ID NO: 1374039 - RNA, 17 nt, Human
gugcccaguuaaucuug

SEQ ID NO: 1374040 - RNA, 16 nt, Human
gugcccaguuaaucuu

SEQ ID NO: 1374041 - RNA, 12 nt, Human
gugcccaggaga

SEQ ID NO: 1374042 - RNA, 13 nt, Human
gugcccaggagaa

SEQ ID NO: 1374043 - RNA, 20 nt, Human
gugcccaagccagaggcugg

SEQ ID NO: 1374044 - RNA, 19 nt, Human
gugcccaagccagaggcug

SEQ ID NO: 1374045 - RNA, 12 nt, Human
gugcccaagcca

SEQ ID NO: 1374046 - RNA, 18 nt, Human
gugccaguauuuuaaaau

SEQ ID NO: 1374047 - RNA, 16 nt, Human
gugccaguauuuuaaa

SEQ ID NO: 1374048 - RNA, 16 nt, Human
gugcccagaauaaguu

SEQ ID NO: 1374049 - RNA, 22 nt, Human
gugcccacagugucaggcacug

SEQ ID NO: 1374050 - RNA, 21 nt, Human
gugcccacaggccgcccugcg

SEQ ID NO: 1374051 - RNA, 13 nt, Human
gugcccacaggcc

SEQ ID NO: 1374052 - RNA, 16 nt, Human
gugcaguccugaucag

SEQ ID NO: 1374053 - RNA, 24 nt, Human
gugcaguggcaucaucucagcuca

SEQ ID NO: 1374054 - RNA, 22 nt, Human
gugcaguaucaugcccugugca

SEQ ID NO: 1374055 - RNA, 15 nt, Human
gugcaguacuuugug

SEQ ID NO: 1374056 - RNA, 15 nt, Human
gugcagguggggaga

SEQ ID NO: 1374057 - RNA, 15 nt, Human
gugcagggauguggg

SEQ ID NO: 1374058 - RNA, 14 nt, Human
gugcagggaugugg

SEQ ID NO: 1374059 - RNA, 23 nt, Human
gugcagggccuguaaucccagca

SEQ ID NO: 1374060 - RNA, 24 nt, Human
gugcaacaggguauggacuaucug

SEQ ID NO: 1374061 - RNA, 14 nt, Human
gugcaacaggguau

SEQ ID NO: 1374062 - RNA, 13 nt, Human
gugcaacacuggu

SEQ ID NO: 1374063 - RNA, 22 nt, Human
gugcaacaagguccucugucag

SEQ ID NO: 1374064 - RNA, 18 nt, Human
gugcaaauugucacagga

SEQ ID NO: 1374065 - RNA, 24 nt, Human
gugcaguggcgcgaucucagcuca

SEQ ID NO: 1374066 - RNA, 21 nt, Human
gugcauaccacuuuuguucuu

SEQ ID NO: 1374067 - RNA, 13 nt, Human
gugcauaccacuu

SEQ ID NO: 1374068 - RNA, 14 nt, Human
gugcauaccacuuu

SEQ ID NO: 1374069 - RNA, 24 nt, Human
gugcaguggcgugaucucagcuca

SEQ ID NO: 1374070 - RNA, 16 nt, Human
gugcuuaugguaccag

SEQ ID NO: 1374071 - RNA, 21 nt, Human
gugcuuaugcucuuaauugcc

SEQ ID NO: 1374072 - RNA, 22 nt, Human
gugcuucuaguucugccaggag

SEQ ID NO: 1374073 - RNA, 21 nt, Human
gugcuucuaguucugccagga

SEQ ID NO: 1374074 - RNA, 14 nt, Human
gugcuucgggcccu

SEQ ID NO: 1374075 - RNA, 20 nt, Human
gugcuucuaguucugccagg

SEQ ID NO: 1374076 - RNA, 17 nt, Human
gugcuucgggcccuucc

SEQ ID NO: 1374077 - RNA, 13 nt, Human
gugcuucuuucuu

SEQ ID NO: 1374078 - RNA, 11 nt, Human
gugcugugugu

SEQ ID NO: 1374079 - RNA, 16 nt, Human
gugcuguuuuguuaua

SEQ ID NO: 1374080 - RNA, 19 nt, Human
gugcuguuuauuaaucuua

SEQ ID NO: 1374081 - RNA, 15 nt, Human
gugcuguuuauuaau

SEQ ID NO: 1374082 - RNA, 21 nt, Human
gugcuuaucccauagccagga

SEQ ID NO: 1374083 - RNA, 21 nt, Human
gugcuguuuuguuauauaauu

SEQ ID NO: 1374084 - RNA, 19 nt, Human
gugcuguuuuguuauauaa

SEQ ID NO: 1374085 - RNA, 20 nt, Human
gugcuuuccauucgugaaaa

SEQ ID NO: 1374086 - RNA, 18 nt, Human
gugcuugauagaaaugcc

SEQ ID NO: 1374087 - RNA, 14 nt, Human
gugcuucuuucuuu

SEQ ID NO: 1374088 - RNA, 21 nt, Human
guggaaaacuuaugcugauuu

SEQ ID NO: 1374089 - RNA, 16 nt, Human
guggaaaacuuaugcu

SEQ ID NO: 1374090 - RNA, 16 nt, Human
gugcuuuuuuugugug

SEQ ID NO: 1374091 - RNA, 23 nt, Human
gugcuuuuggcggggaggaggaa

SEQ ID NO: 1374092 - RNA, 15 nt, Human
gugcuuuuaaaugca

SEQ ID NO: 1374093 - RNA, 17 nt, Human
gugcuuugagagagaaa

SEQ ID NO: 1374094 - RNA, 15 nt, Human
gugcuuugagagaga

SEQ ID NO: 1374095 - RNA, 23 nt, Human
gugcuuucuucucccaauucauc

SEQ ID NO: 1374096 - RNA, 18 nt, Human
gugccuuuauuuccacug

SEQ ID NO: 1374097 - RNA, 16 nt, Human
gugccuuucaggaucu

SEQ ID NO: 1374098 - RNA, 20 nt, Human
gugccuuuauuuccacugug

SEQ ID NO: 1374099 - RNA, 16 nt, Human
gugccuuuauuuccac

SEQ ID NO: 1374100 - RNA, 13 nt, Human
gugccuuguuuuu

SEQ ID NO: 1374101 - RNA, 19 nt, Human
gugccuugucacgccagac

SEQ ID NO: 1374102 - RNA, 13 nt, Human
gugcccugauccc

SEQ ID NO: 1374103 - RNA, 17 nt, Human
gugcccugagccagggu

SEQ ID NO: 1374104 - RNA, 15 nt, Human
gugcccugagccagg

SEQ ID NO: 1374105 - RNA, 12 nt, Human
gugcccugagcc

SEQ ID NO: 1374106 - RNA, 19 nt, Human
gugcccucugggcucugag

SEQ ID NO: 1374107 - RNA, 17 nt, Human
gugcccucugggcucug

SEQ ID NO: 1374108 - RNA, 16 nt, Human
gugcccucugggcucu

SEQ ID NO: 1374109 - RNA, 19 nt, Human
gugcugaauguugggacug

SEQ ID NO: 1374110 - RNA, 23 nt, Human
gugcucuuuguuuugugucucuu

SEQ ID NO: 1374111 - RNA, 21 nt, Human
gugcugaacaguggaggaaga

SEQ ID NO: 1374112 - RNA, 20 nt, Human
gugcucuuuucuccucacug

SEQ ID NO: 1374113 - RNA, 16 nt, Human
gugcucuuuucuccuc

SEQ ID NO: 1374114 - RNA, 14 nt, Human
gugcucuuuucucc

SEQ ID NO: 1374115 - RNA, 22 nt, Human
gugcucuuuguuuugugucucu

SEQ ID NO: 1374116 - RNA, 16 nt, Human
gugcucuuuguuuugu

SEQ ID NO: 1374117 - RNA, 15 nt, Human
gugcucuuuguuuug

SEQ ID NO: 1374118 - RNA, 18 nt, Human
gugcugacggccagggag

SEQ ID NO: 1374119 - RNA, 16 nt, Human
gugcugacggccaggg

SEQ ID NO: 1374120 - RNA, 15 nt, Human
gugcugacggccagg

SEQ ID NO: 1374121 - RNA, 22 nt, Human
gugcugacgggacccacaugcu

SEQ ID NO: 1374122 - RNA, 23 nt, Human
gugcugacggccagggagaagcu

SEQ ID NO: 1374123 - RNA, 21 nt, Human
gugcugacggccagggagaag

SEQ ID NO: 1374124 - RNA, 14 nt, Human
gugcugagauuaca

SEQ ID NO: 1374125 - RNA, 12 nt, Human
gugcugcauuua

SEQ ID NO: 1374126 - RNA, 19 nt, Human
gugcugcauuuaaaagaua

SEQ ID NO: 1374127 - RNA, 20 nt, Human
gugcugcauuuaaaagauac

SEQ ID NO: 1374128 - RNA, 19 nt, Human
guggagggguaggggcugg

SEQ ID NO: 1374129 - RNA, 22 nt, Human
guggagggguaggggcugggaa

SEQ ID NO: 1374130 - RNA, 12 nt, Human
guggagggccac

SEQ ID NO: 1374131 - RNA, 23 nt, Human
guggagggacaaguggacucagg

SEQ ID NO: 1374132 - RNA, 14 nt, Human
guggaggcugcucg

SEQ ID NO: 1374133 - RNA, 13 nt, Human
guggaggcugcuc

SEQ ID NO: 1374134 - RNA, 12 nt, Human
guggaggcugcu

SEQ ID NO: 1374135 - RNA, 19 nt, Human
guggaucuauuucauguuu

SEQ ID NO: 1374136 - RNA, 19 nt, Human
guggauccaaacugaucca

SEQ ID NO: 1374137 - RNA, 21 nt, Human
guggaucagagaugcaccacc

SEQ ID NO: 1374138 - RNA, 23 nt, Human
guggaucacaaaguggaacgaaa

SEQ ID NO: 1374139 - RNA, 16 nt, Human
guggauauuuguauaa

SEQ ID NO: 1374140 - RNA, 14 nt, Human
guggauauuguuac

SEQ ID NO: 1374141 - RNA, 17 nt, Human
guggagucugccaccca

SEQ ID NO: 1374142 - RNA, 16 nt, Human
guggagucugccaccc

SEQ ID NO: 1374143 - RNA, 18 nt, Human
guggagagggaaugugaa

SEQ ID NO: 1374144 - RNA, 15 nt, Human
guggagagggaaugu

SEQ ID NO: 1374145 - RNA, 14 nt, Human
guggagagggaaug

SEQ ID NO: 1374146 - RNA, 12 nt, Human
guggagagggaa

SEQ ID NO: 1374147 - RNA, 15 nt, Human
guggaacugcugcca

SEQ ID NO: 1374148 - RNA, 14 nt, Human
guggaacugcugcc

SEQ ID NO: 1374149 - RNA, 16 nt, Human
guggaacgaaaaugaa

SEQ ID NO: 1374150 - RNA, 23 nt, Human
guggaacuacauuaguacacagc

SEQ ID NO: 1374151 - RNA, 20 nt, Human
guggaaauuaagacuuuaug

SEQ ID NO: 1374152 - RNA, 19 nt, Human
guggaacauaaaaaggaca

SEQ ID NO: 1374153 - RNA, 20 nt, Human
guggaacauaaaaaggacau

SEQ ID NO: 1374154 - RNA, 21 nt, Human
guggaacauaaaaaggacauc

SEQ ID NO: 1374155 - RNA, 20 nt, Human
guggcaggggacaggagucc

SEQ ID NO: 1374156 - RNA, 18 nt, Human
guggcaggggacaggagu

SEQ ID NO: 1374157 - RNA, 16 nt, Human
guggcaggggacagga

SEQ ID NO: 1374158 - RNA, 23 nt, Human
guggcaggcagaggcccaggcug

SEQ ID NO: 1374159 - RNA, 24 nt, Human
guggcaggcagaggcccaggcugc

SEQ ID NO: 1374160 - RNA, 22 nt, Human
guggcaggcagaggcccaggcu

SEQ ID NO: 1374161 - RNA, 15 nt, Human
guggcaggcagaggc

SEQ ID NO: 1374162 - RNA, 13 nt, Human
guggcaggcagag

SEQ ID NO: 1374163 - RNA, 12 nt, Human
guggcaggcaga

SEQ ID NO: 1374164 - RNA, 11 nt, Human
guggcagucug

SEQ ID NO: 1374165 - RNA, 23 nt, Human
guggccaggccgggaaaaagccc

SEQ ID NO: 1374166 - RNA, 10 nt, Human
guggccaggc

SEQ ID NO: 1374167 - RNA, 13 nt, Human
guggccaggaggu

SEQ ID NO: 1374168 - RNA, 12 nt, Human
guggccaggagg

SEQ ID NO: 1374169 - RNA, 21 nt, Human
guggccagcgagggcgugucu

SEQ ID NO: 1374170 - RNA, 13 nt, Human
guggccaccagua

SEQ ID NO: 1374171 - RNA, 15 nt, Human
guggccccacccugg

SEQ ID NO: 1374172 - RNA, 19 nt, Human
guggccaugcuccucuucc

SEQ ID NO: 1374173 - RNA, 18 nt, Human
guggccaugcuccucuuc

SEQ ID NO: 1374174 - RNA, 13 nt, Human
guggccaugcucc

SEQ ID NO: 1374175 - RNA, 21 nt, Human
guggccaugacccugccucuc

SEQ ID NO: 1374176 - RNA, 20 nt, Human
guggccaugacccugccucu

SEQ ID NO: 1374177 - RNA, 18 nt, Human
guggccaugacccugccu

SEQ ID NO: 1374178 - RNA, 19 nt, Human
guggccccacccugggccc

SEQ ID NO: 1374179 - RNA, 18 nt, Human
guggccccacccugggcc

SEQ ID NO: 1374180 - RNA, 20 nt, Human
guggccccacccugggcccu

SEQ ID NO: 1374181 - RNA, 18 nt, Human
guggcucgggaggcgaag

SEQ ID NO: 1374182 - RNA, 14 nt, Human
guggcauccagagu

SEQ ID NO: 1374183 - RNA, 23 nt, Human
guggccaagaagcaguggccuua

SEQ ID NO: 1374184 - RNA, 22 nt, Human
guggccaagaagcaguggccuu

SEQ ID NO: 1374185 - RNA, 17 nt, Human
guggccaagaagcagug

SEQ ID NO: 1374186 - RNA, 15 nt, Human
guggccaagaagcag

SEQ ID NO: 1374187 - RNA, 19 nt, Human
guggcaucaucucagcuca

SEQ ID NO: 1374188 - RNA, 15 nt, Human
ucacccugccuuauc

SEQ ID NO: 1374189 - RNA, 13 nt, Human
ucacccugccuua

SEQ ID NO: 1374190 - RNA, 23 nt, Human
ucacccugauuuaggagaagcca

SEQ ID NO: 1374191 - RNA, 17 nt, Human
ucacccuaccugugccu

SEQ ID NO: 1374192 - RNA, 15 nt, Human
ucacccuaccugugc

SEQ ID NO: 1374193 - RNA, 18 nt, Human
ucacccuggaggcaccug

SEQ ID NO: 1374194 - RNA, 17 nt, Human
ucacccuggaggcaccu

SEQ ID NO: 1374195 - RNA, 13 nt, Human
ucacccuguccaa

SEQ ID NO: 1374196 - RNA, 21 nt, Human
ucacccuguccaaacugccua

SEQ ID NO: 1374197 - RNA, 22 nt, Human
ucacccuuugcugugaggcugu

SEQ ID NO: 1374198 - RNA, 15 nt, Human
ucacccuuugcugug

SEQ ID NO: 1374199 - RNA, 13 nt, Human
ucacccuuugcug

SEQ ID NO: 1374200 - RNA, 16 nt, Human
ucaccgagugggggca

SEQ ID NO: 1374201 - RNA, 22 nt, Human
ucaccgacugaaaauauuguuu

SEQ ID NO: 1374202 - RNA, 16 nt, Human
ucaccacugcccccug

SEQ ID NO: 1374203 - RNA, 18 nt, Human
ucaccacgacuggccagg

SEQ ID NO: 1374204 - RNA, 20 nt, Human
ucaccacgacuggccagggc

SEQ ID NO: 1374205 - RNA, 15 nt, Human
ucaccccuguuucug

SEQ ID NO: 1374206 - RNA, 14 nt, Human
ucaccagagacuuu

SEQ ID NO: 1374207 - RNA, 15 nt, Human
ucaccagagacuuua

SEQ ID NO: 1374208 - RNA, 19 nt, Human
ucaccagagacuuuagggg

SEQ ID NO: 1374209 - RNA, 17 nt, Human
ucacauuggaaacaagu

SEQ ID NO: 1374210 - RNA, 22 nt, Human
ucacauuguauucagaguugau

SEQ ID NO: 1374211 - RNA, 12 nt, Human
ucacauuuaaau

SEQ ID NO: 1374212 - RNA, 22 nt, Human
ucacaccaggcuugccugcagg

SEQ ID NO: 1374213 - RNA, 21 nt, Human
ucacaccaggcuugccugcag

SEQ ID NO: 1374214 - RNA, 20 nt, Human
ucacaccacuagccucaggg

SEQ ID NO: 1374215 - RNA, 12 nt, Human
ucacacaggcau

SEQ ID NO: 1374216 - RNA, 23 nt, Human
ucacaccaggcuugccugcaggc

SEQ ID NO: 1374217 - RNA, 15 nt, Human
ucacaccacuagccu

SEQ ID NO: 1374218 - RNA, 12 nt, Human
ucacacacugau

SEQ ID NO: 1374219 - RNA, 23 nt, Human
ucacagguagacaguauauaacu

SEQ ID NO: 1374220 - RNA, 12 nt, Human
ucacaggcagcc

SEQ ID NO: 1374221 - RNA, 14 nt, Human
ucacaguauugcuc

SEQ ID NO: 1374222 - RNA, 15 nt, Human
ucacaggucccaaau

SEQ ID NO: 1374223 - RNA, 15 nt, Human
ucacaguauugcuca

SEQ ID NO: 1374224 - RNA, 14 nt, Human
ucacauuggaaaca

SEQ ID NO: 1374225 - RNA, 12 nt, Human
ucacacaccugu

SEQ ID NO: 1374226 - RNA, 20 nt, Human
ucacaaguggguacccccag

SEQ ID NO: 1374227 - RNA, 22 nt, Human
ucacaaguggguacccccagga

SEQ ID NO: 1374228 - RNA, 22 nt, Human
ucacaaggcagcaaggcccgag

SEQ ID NO: 1374229 - RNA, 23 nt, Human
ucacaaggcagcaaggcccgagc

SEQ ID NO: 1374230 - RNA, 18 nt, Human
ucacaaggcagcaaggcc

SEQ ID NO: 1374231 - RNA, 16 nt, Human
ucacaaggcagcaagg

SEQ ID NO: 1374232 - RNA, 12 nt, Human
ucacaaggcagc

SEQ ID NO: 1374233 - RNA, 23 nt, Human
ucacaagauggaauuuaucaaac

SEQ ID NO: 1374234 - RNA, 14 nt, Human
ucaauuccaccugc

SEQ ID NO: 1374235 - RNA, 20 nt, Human
ucaauuccaacaguuuaaug

SEQ ID NO: 1374236 - RNA, 19 nt, Human
ucaauuccaacaguuuaau

SEQ ID NO: 1374237 - RNA, 18 nt, Human
ucaauuccaacaguuuaa

SEQ ID NO: 1374238 - RNA, 15 nt, Human
ucaauuccaacaguu

SEQ ID NO: 1374239 - RNA, 22 nt, Human
ucaauucaaagcuguguguuug

SEQ ID NO: 1374240 - RNA, 17 nt, Human
ucaauucaaagcugugu

SEQ ID NO: 1374241 - RNA, 15 nt, Human
ucaauucaaagcugu

SEQ ID NO: 1374242 - RNA, 18 nt, Human
ucaauuauaguuucugag

SEQ ID NO: 1374243 - RNA, 21 nt, Human
ucaauuccaacaguuuaauga

SEQ ID NO: 1374244 - RNA, 18 nt, Human
ucaauguuucuucuaggu

SEQ ID NO: 1374245 - RNA, 14 nt, Human
ucaauaaaauccau

SEQ ID NO: 1374246 - RNA, 19 nt, Human
ucaauuauaguuucugagg

SEQ ID NO: 1374247 - RNA, 17 nt, Human
ucaauuauaguuucuga

SEQ ID NO: 1374248 - RNA, 16 nt, Human
ucaauuauaguuucug

SEQ ID NO: 1374249 - RNA, 15 nt, Human
ucaauuauaguuucu

SEQ ID NO: 1374250 - RNA, 14 nt, Human
ucaauuauaguuuc

SEQ ID NO: 1374251 - RNA, 23 nt, Human
ucaauuaaaauagucucuuuaaa

SEQ ID NO: 1374252 - RNA, 23 nt, Human
ucaaccccuccccuccaucccug

SEQ ID NO: 1374253 - RNA, 21 nt, Human
ucaaccccuccccuccauccc

SEQ ID NO: 1374254 - RNA, 19 nt, Human
ucaaccccuccccuccauc

SEQ ID NO: 1374255 - RNA, 22 nt, Human
ucaaauguucuaaguuucuaag

SEQ ID NO: 1374256 - RNA, 21 nt, Human
ucaaauguucuaaguuucuaa

SEQ ID NO: 1374257 - RNA, 20 nt, Human
ucaaauguucuaaguuucua

SEQ ID NO: 1374258 - RNA, 19 nt, Human
ucaaauguucuaaguuucu

SEQ ID NO: 1374259 - RNA, 15 nt, Human
ucaaauguucuaagu

SEQ ID NO: 1374260 - RNA, 14 nt, Human
ucaaauguucuaag

SEQ ID NO: 1374261 - RNA, 13 nt, Human
ucaaauguucuaa

SEQ ID NO: 1374262 - RNA, 23 nt, Human
ucaaauguucuaaguuucuaaga

SEQ ID NO: 1374263 - RNA, 16 nt, Human
ucaaccccuccccucc

SEQ ID NO: 1374264 - RNA, 16 nt, Human
ucaacucuuuguuauu

SEQ ID NO: 1374265 - RNA, 22 nt, Human
ucaacucuuuguuauuugaaaa

SEQ ID NO: 1374266 - RNA, 14 nt, Human
ucaacucuuuguua

SEQ ID NO: 1374267 - RNA, 24 nt, Human
ucaacucucuuauugccucacuuc

SEQ ID NO: 1374268 - RNA, 23 nt, Human
ucaacucucuuauugccucacuu

SEQ ID NO: 1374269 - RNA, 21 nt, Human
ucaacucucuuauugccucac

SEQ ID NO: 1374270 - RNA, 20 nt, Human
ucaacucucuuauugccuca

SEQ ID NO: 1374271 - RNA, 17 nt, Human
ucaaccugggcaaagcc

SEQ ID NO: 1374272 - RNA, 13 nt, Human
ucaaccugccuga

SEQ ID NO: 1374273 - RNA, 22 nt, Human
ucaacuccaaacugacucuuaa

SEQ ID NO: 1374274 - RNA, 20 nt, Human
ucaaggaaguagaaacaaaa

SEQ ID NO: 1374275 - RNA, 21 nt, Human
ucaaggacacgggccugucca

SEQ ID NO: 1374276 - RNA, 23 nt, Human
ucaaggaauuucuuaacuucuug

SEQ ID NO: 1374277 - RNA, 21 nt, Human
ucaaggaauuucuuaacuucu

SEQ ID NO: 1374278 - RNA, 19 nt, Human
ucaaggaauuucuuaacuu

SEQ ID NO: 1374279 - RNA, 16 nt, Human
ucaaggaauuucuuaa

SEQ ID NO: 1374280 - RNA, 12 nt, Human
ucaaacuuggau

SEQ ID NO: 1374281 - RNA, 19 nt, Human
ucaaacuggggccucccug

SEQ ID NO: 1374282 - RNA, 21 nt, Human
ucaaagaggcugaggcuggca

SEQ ID NO: 1374283 - RNA, 22 nt, Human
ucaaacuuggauacuuggauuu

SEQ ID NO: 1374284 - RNA, 16 nt, Human
ucaaaugguaucuuuu

SEQ ID NO: 1374285 - RNA, 21 nt, Human
ucaaaugguaggcauuuccua

SEQ ID NO: 1374286 - RNA, 20 nt, Human
ucaaaugguaggcauuuccu

SEQ ID NO: 1374287 - RNA, 20 nt, Human
ucaaauggggccagauccag

SEQ ID NO: 1374288 - RNA, 23 nt, Human
ucaaaugaauggaggaacuuucc

SEQ ID NO: 1374289 - RNA, 15 nt, Human
ucaaaucuaccacug

SEQ ID NO: 1374290 - RNA, 20 nt, Human
ucaaaucuaccacuguauga

SEQ ID NO: 1374291 - RNA, 16 nt, Human
ucaaauccuugaagau

SEQ ID NO: 1374292 - RNA, 21 nt, Human
uauuugacaacguuucagcga

SEQ ID NO: 1374293 - RNA, 21 nt, Human
uauuugaaugauuuuucuuua

SEQ ID NO: 1374294 - RNA, 22 nt, Human
uauuugcauaacaauuccucua

SEQ ID NO: 1374295 - RNA, 21 nt, Human
uauuugcauaacaauuccucu

SEQ ID NO: 1374296 - RNA, 17 nt, Human
ucaaacauauauaacaa

SEQ ID NO: 1374297 - RNA, 19 nt, Human
ucaaacugaggaauuucac

SEQ ID NO: 1374298 - RNA, 21 nt, Human
ucaaacccuagccuugcuugu

SEQ ID NO: 1374299 - RNA, 20 nt, Human
ucaaacccuagccuugcuug

SEQ ID NO: 1374300 - RNA, 19 nt, Human
ucaaacccuagccuugcuu

SEQ ID NO: 1374301 - RNA, 18 nt, Human
ucaaacccuagccuugcu

SEQ ID NO: 1374302 - RNA, 17 nt, Human
ucaaacccuagccuugc

SEQ ID NO: 1374303 - RNA, 16 nt, Human
ucaaacccuagccuug

SEQ ID NO: 1374304 - RNA, 15 nt, Human
ucaaacccuagccuu

SEQ ID NO: 1374305 - RNA, 12 nt, Human
ucaaacauuuug

SEQ ID NO: 1374306 - RNA, 15 nt, Human
ucaaacauuuucugg

SEQ ID NO: 1374307 - RNA, 13 nt, Human
ucaaacauuuucu

SEQ ID NO: 1374308 - RNA, 18 nt, Human
ucaaacauuuugaaaguc

SEQ ID NO: 1374309 - RNA, 17 nt, Human
ucaaacauuuugaaagu

SEQ ID NO: 1374310 - RNA, 15 nt, Human
ucaaacauuuugaaa

SEQ ID NO: 1374311 - RNA, 20 nt, Human
ucaaaccaaaucacugaacu

SEQ ID NO: 1374312 - RNA, 15 nt, Human
uauuaacgaugucca

SEQ ID NO: 1374313 - RNA, 17 nt, Human
uauuaacuuuaauguuu

SEQ ID NO: 1374314 - RNA, 13 nt, Human
uauuaacauaccu

SEQ ID NO: 1374315 - RNA, 22 nt, Human
uauguuguaauauuucuucaaa

SEQ ID NO: 1374316 - RNA, 18 nt, Human
uauguugaauacuuuuua

SEQ ID NO: 1374317 - RNA, 18 nt, Human
uauguugguagauucuaa

SEQ ID NO: 1374318 - RNA, 15 nt, Human
uauguugaauacuuu

SEQ ID NO: 1374319 - RNA, 12 nt, Human
uauguugaauac

SEQ ID NO: 1374320 - RNA, 18 nt, Human
uauguucuaaccuuuaca

SEQ ID NO: 1374321 - RNA, 20 nt, Human
uauguuccauuaaacgauuu

SEQ ID NO: 1374322 - RNA, 16 nt, Human
uauguuccauuaaacg

SEQ ID NO: 1374323 - RNA, 15 nt, Human
uauguuccauuaaac

SEQ ID NO: 1374324 - RNA, 14 nt, Human
uauguuccauuaaa

SEQ ID NO: 1374325 - RNA, 21 nt, Human
uauguucaacuaggaucagaa

SEQ ID NO: 1374326 - RNA, 16 nt, Human
uauguucaaagucaaa

SEQ ID NO: 1374327 - RNA, 20 nt, Human
uauguuauauauaaauauau

SEQ ID NO: 1374328 - RNA, 16 nt, Human
uauguucagauuauug

SEQ ID NO: 1374329 - RNA, 18 nt, Human
uauguuacuacaugcacu

SEQ ID NO: 1374330 - RNA, 19 nt, Human
uauguuaagggaagaauuc

SEQ ID NO: 1374331 - RNA, 21 nt, Human
uauguuauauauaaauauauu

SEQ ID NO: 1374332 - RNA, 19 nt, Human
uauguuauauauaaauaua

SEQ ID NO: 1374333 - RNA, 15 nt, Human
uauguuauauauaaa

SEQ ID NO: 1374334 - RNA, 19 nt, Human
uauguuagugcaaauuguc

SEQ ID NO: 1374335 - RNA, 12 nt, Human
uauguuaaaacu

SEQ ID NO: 1374336 - RNA, 20 nt, Human
uauguuaaacuagcauaucu

SEQ ID NO: 1374337 - RNA, 21 nt, Human
uauguuaaacuagcauaucug

SEQ ID NO: 1374338 - RNA, 21 nt, Human
uauggacuaucugucuggugg

SEQ ID NO: 1374339 - RNA, 18 nt, Human
uauggacuaucugucugg

SEQ ID NO: 1374340 - RNA, 17 nt, Human
uauggacuaucugucug

SEQ ID NO: 1374341 - RNA, 13 nt, Human
uauggacuaucug

SEQ ID NO: 1374342 - RNA, 16 nt, Human
uauggagagcccuggg

SEQ ID NO: 1374343 - RNA, 15 nt, Human
uauggagagcccugg

SEQ ID NO: 1374344 - RNA, 14 nt, Human
uauggagagcccug

SEQ ID NO: 1374345 - RNA, 14 nt, Human
uauggaggcaggag

SEQ ID NO: 1374346 - RNA, 22 nt, Human
uauggagucauuuuuacaaugu

SEQ ID NO: 1374347 - RNA, 16 nt, Human
uauggagucauuuuua

SEQ ID NO: 1374348 - RNA, 13 nt, Human
uauguguguuuua

SEQ ID NO: 1374349 - RNA, 13 nt, Human
uauuauauggaaa

SEQ ID NO: 1374350 - RNA, 12 nt, Human
uauuauauggaa

SEQ ID NO: 1374351 - RNA, 17 nt, Human
uauuauacuuguaauua

SEQ ID NO: 1374352 - RNA, 18 nt, Human
uauuauacuuguaauuau

SEQ ID NO: 1374353 - RNA, 14 nt, Human
uauuauaccuuuuu

SEQ ID NO: 1374354 - RNA, 17 nt, Human
uauuauauguacccucu

SEQ ID NO: 1374355 - RNA, 21 nt, Human
uauuauauguacccucugaaa

SEQ ID NO: 1374356 - RNA, 17 nt, Human
uauuauauuuacaaaug

SEQ ID NO: 1374357 - RNA, 19 nt, Human
uauuauaaucuuauaauug

SEQ ID NO: 1374358 - RNA, 14 nt, Human
uauuauaaucuuau

SEQ ID NO: 1374359 - RNA, 12 nt, Human
uauuauaccuuu

SEQ ID NO: 1374360 - RNA, 13 nt, Human
uauuauaccuuuu

SEQ ID NO: 1374361 - RNA, 16 nt, Human
uauuaagguguggcuu

SEQ ID NO: 1374362 - RNA, 18 nt, Human
uauuaacuuuaauguuuu

SEQ ID NO: 1374363 - RNA, 15 nt, Human
uauuaagcaucagaa

SEQ ID NO: 1374364 - RNA, 14 nt, Human
uauuauuuguguuu

SEQ ID NO: 1374365 - RNA, 13 nt, Human
uauuauuuauaua

SEQ ID NO: 1374366 - RNA, 21 nt, Human
uauuaugucucuucugagcua

SEQ ID NO: 1374367 - RNA, 16 nt, Human
uauuauguuaaaacug

SEQ ID NO: 1374368 - RNA, 17 nt, Human
uauuaugucucuucuga

SEQ ID NO: 1374369 - RNA, 20 nt, Human
uauuauggaggcaggaguuu

SEQ ID NO: 1374370 - RNA, 19 nt, Human
uauuaugcauuauaucaaa

SEQ ID NO: 1374371 - RNA, 17 nt, Human
uauuaugagaugcuggc

SEQ ID NO: 1374372 - RNA, 15 nt, Human
uauuaugagaugcug

SEQ ID NO: 1374373 - RNA, 14 nt, Human
uauuaugagaugcu

SEQ ID NO: 1374374 - RNA, 22 nt, Human
uauuaugaaugugaagccuucc

SEQ ID NO: 1374375 - RNA, 21 nt, Human
uauuaugaaugugaagccuuc

SEQ ID NO: 1374376 - RNA, 20 nt, Human
uauuaugaaugugaagccuu

SEQ ID NO: 1374377 - RNA, 14 nt, Human
uauuaugaauguga

SEQ ID NO: 1374378 - RNA, 13 nt, Human
uauuaugaaugug

SEQ ID NO: 1374379 - RNA, 19 nt, Human
uauuaucuuuucauacauu

SEQ ID NO: 1374380 - RNA, 14 nt, Human
uauuaucuuuucau

SEQ ID NO: 1374381 - RNA, 15 nt, Human
uauuaucaacaauag

SEQ ID NO: 1374382 - RNA, 13 nt, Human
uauuaucugucag

SEQ ID NO: 1374383 - RNA, 14 nt, Human
uauuaucugggcuu

SEQ ID NO: 1374384 - RNA, 15 nt, Human
uauuaucccagcugc

SEQ ID NO: 1374385 - RNA, 16 nt, Human
uauuauccccauuucu

SEQ ID NO: 1374386 - RNA, 12 nt, Human
uauuaucuuuuc

SEQ ID NO: 1374387 - RNA, 14 nt, Human
uauuaucugucagc

SEQ ID NO: 1374388 - RNA, 16 nt, Human
uauucauuuucucuaa

SEQ ID NO: 1374389 - RNA, 14 nt, Human
uauucauuuucucu

SEQ ID NO: 1374390 - RNA, 18 nt, Human
uauucauuguggucauag

SEQ ID NO: 1374391 - RNA, 23 nt, Human
uauucauccaaguuaaauguaga

SEQ ID NO: 1374392 - RNA, 23 nt, Human
uauugauaagaucuuuuauuuug

SEQ ID NO: 1374393 - RNA, 19 nt, Human
uauugauaagaucuuuuau

SEQ ID NO: 1374394 - RNA, 18 nt, Human
uauugauaagaucuuuua

SEQ ID NO: 1374395 - RNA, 17 nt, Human
uauugauaagaucuuuu

SEQ ID NO: 1374396 - RNA, 15 nt, Human
uauucauuuucucua

SEQ ID NO: 1374397 - RNA, 17 nt, Human
uauuccaagacaugucu

SEQ ID NO: 1374398 - RNA, 15 nt, Human
uauugcaguuuauca

SEQ ID NO: 1374399 - RNA, 13 nt, Human
uauugcaguuuau

SEQ ID NO: 1374400 - RNA, 11 nt, Human
uauugcaguuu

SEQ ID NO: 1374401 - RNA, 17 nt, Human
uauugcacauuguaaaa

SEQ ID NO: 1374402 - RNA, 13 nt, Human
uauugcacauugu

SEQ ID NO: 1374403 - RNA, 23 nt, Human
uauugcacaugucuuaaugaagu

SEQ ID NO: 1374404 - RNA, 22 nt, Human
uauugcagcgauuaauaacagg

SEQ ID NO: 1374405 - RNA, 12 nt, Human
uauugcacaugu

SEQ ID NO: 1374406 - RNA, 14 nt, Human
uauugcacaugucu

SEQ ID NO: 1374407 - RNA, 16 nt, Human
uauugcacaugucuua

SEQ ID NO: 1374408 - RNA, 17 nt, Human
uauugcacaugucuuaa

SEQ ID NO: 1374409 - RNA, 20 nt, Human
uauugcacaugucuuaauga

SEQ ID NO: 1374410 - RNA, 22 nt, Human
uauugcacaugucuuaaugaag

SEQ ID NO: 1374411 - RNA, 19 nt, Human
uauugcaguuuaucauuca

SEQ ID NO: 1374412 - RNA, 20 nt, Human
uauugcaguuuaucauucaa

SEQ ID NO: 1374413 - RNA, 15 nt, Human
uauugcauuaauuuu

SEQ ID NO: 1374414 - RNA, 13 nt, Human
uauugcauuuaua

SEQ ID NO: 1374415 - RNA, 17 nt, Human
uauugcauuuauaugua

SEQ ID NO: 1374416 - RNA, 18 nt, Human
uauugugcaauguguaua

SEQ ID NO: 1374417 - RNA, 16 nt, Human
uauugugcaaugugua

SEQ ID NO: 1374418 - RNA, 14 nt, Human
uauugugcaaugug

SEQ ID NO: 1374419 - RNA, 19 nt, Human
uauugugcaauguaaauau

SEQ ID NO: 1374420 - RNA, 21 nt, Human
uauugcuugcacaaaccaauu

SEQ ID NO: 1374421 - RNA, 15 nt, Human
uauugcuugcacaaa

SEQ ID NO: 1374422 - RNA, 17 nt, Human
uauuguugcauugcuuu

SEQ ID NO: 1374423 - RNA, 17 nt, Human
uauuguugaaaaaguuu

SEQ ID NO: 1374424 - RNA, 14 nt, Human
uauuguugaaaaag

SEQ ID NO: 1374425 - RNA, 15 nt, Human
uauuguucucacacu

SEQ ID NO: 1374426 - RNA, 23 nt, Human
uauugugcaauguguauaaacaa

SEQ ID NO: 1374427 - RNA, 14 nt, Human
uauuuaacagaaau

SEQ ID NO: 1374428 - RNA, 13 nt, Human
uauuuaacagaaa

SEQ ID NO: 1374429 - RNA, 12 nt, Human
uauuuaacagaa

SEQ ID NO: 1374430 - RNA, 15 nt, Human
uauuuaacaagaucu

SEQ ID NO: 1374431 - RNA, 18 nt, Human
uauuuaaauguaaagaca

SEQ ID NO: 1374432 - RNA, 18 nt, Human
uauuguuucaauugcauc

SEQ ID NO: 1374433 - RNA, 12 nt, Human
uauuguuucaau

SEQ ID NO: 1374434 - RNA, 22 nt, Human
uauuguuguccuuuucauaggu

SEQ ID NO: 1374435 - RNA, 18 nt, Human
uauuguuguccuuuucau

SEQ ID NO: 1374436 - RNA, 16 nt, Human
uauuguuguccuuuuc

SEQ ID NO: 1374437 - RNA, 14 nt, Human
uauuguuguccuuu

SEQ ID NO: 1374438 - RNA, 13 nt, Human
uauuguuguccuu

SEQ ID NO: 1374439 - RNA, 17 nt, Human
uauuuauauguacauga

SEQ ID NO: 1374440 - RNA, 15 nt, Human
uauuuauauguacau

SEQ ID NO: 1374441 - RNA, 12 nt, Human
uauuuaucuuua

SEQ ID NO: 1374442 - RNA, 20 nt, Human
uauuuaugccucuguauuua

SEQ ID NO: 1374443 - RNA, 20 nt, Human
uauuuauguauugugcaaug

SEQ ID NO: 1374444 - RNA, 13 nt, Human
uauuuauguauug

SEQ ID NO: 1374445 - RNA, 12 nt, Human
uauuuauguauu

SEQ ID NO: 1374446 - RNA, 13 nt, Human
uauuuauguaugg

SEQ ID NO: 1374447 - RNA, 14 nt, Human
uauuuauuacugua

SEQ ID NO: 1374448 - RNA, 13 nt, Human
uauuucuaugaaa

SEQ ID NO: 1374449 - RNA, 16 nt, Human
uauuuauucaauaaag

SEQ ID NO: 1374450 - RNA, 18 nt, Human
uauuuauucaauaaagua

SEQ ID NO: 1374451 - RNA, 19 nt, Human
uauuuauucaauaaaguau

SEQ ID NO: 1374452 - RNA, 20 nt, Human
uauuuauucaauaaaguauu

SEQ ID NO: 1374453 - RNA, 12 nt, Human
uauuuauucaau

SEQ ID NO: 1374454 - RNA, 13 nt, Human
uauuuauucaaua

SEQ ID NO: 1374455 - RNA, 14 nt, Human
uauuuauucaauaa

SEQ ID NO: 1374456 - RNA, 20 nt, Human
uauuugaaaacauguuuauu

SEQ ID NO: 1374457 - RNA, 14 nt, Human
uauuugaacuuuuu

SEQ ID NO: 1374458 - RNA, 16 nt, Human
uauuugaaccaauaaa

SEQ ID NO: 1374459 - RNA, 19 nt, Human
uauuugaaucuugucucaa

SEQ ID NO: 1374460 - RNA, 20 nt, Human
uauuugaaucuugucucaau

SEQ ID NO: 1374461 - RNA, 12 nt, Human
uauuugaaucuu

SEQ ID NO: 1374462 - RNA, 14 nt, Human
uauuugaaucuugu

SEQ ID NO: 1374463 - RNA, 16 nt, Human
uauuugaaucuugucu

SEQ ID NO: 1374464 - RNA, 18 nt, Human
uauuugaaucuugucuca

SEQ ID NO: 1374465 - RNA, 22 nt, Human
uauuucuuccuaccaagucaaa

SEQ ID NO: 1374466 - RNA, 15 nt, Human
uauuucuaugaaaua

SEQ ID NO: 1374467 - RNA, 14 nt, Human
uauuucuaugaaau

SEQ ID NO: 1374468 - RNA, 14 nt, Human
uauaugcuuacuga

SEQ ID NO: 1374469 - RNA, 17 nt, Human
uauaugcuuacugauau

SEQ ID NO: 1374470 - RNA, 16 nt, Human
uauaugcuuacugaua

SEQ ID NO: 1374471 - RNA, 21 nt, Human
uauaugcuuacugauauauuu

SEQ ID NO: 1374472 - RNA, 13 nt, Human
uauaugcuucugu

SEQ ID NO: 1374473 - RNA, 14 nt, Human
uauauguguaugca

SEQ ID NO: 1374474 - RNA, 19 nt, Human
uauauaaauauauuauuac

SEQ ID NO: 1374475 - RNA, 17 nt, Human
uauaguuuuacuuuuaa

SEQ ID NO: 1374476 - RNA, 16 nt, Human
uauaguuuuacuuuua

SEQ ID NO: 1374477 - RNA, 22 nt, Human
uauauaaauauauuauuacuug

SEQ ID NO: 1374478 - RNA, 13 nt, Human
uauauaacaaugc

SEQ ID NO: 1374479 - RNA, 15 nt, Human
uauaguuuuacuuuu

SEQ ID NO: 1374480 - RNA, 22 nt, Human
uauaguuucugaggcuuuauga

SEQ ID NO: 1374481 - RNA, 14 nt, Human
uauaguuucugagg

SEQ ID NO: 1374482 - RNA, 13 nt, Human
uauaguucuaggc

SEQ ID NO: 1374483 - RNA, 12 nt, Human
uauaguucuagg

SEQ ID NO: 1374484 - RNA, 15 nt, Human
uauaguucuagacau

SEQ ID NO: 1374485 - RNA, 13 nt, Human
uauaguucuagac

SEQ ID NO: 1374486 - RNA, 12 nt, Human
uauaguucuaga

SEQ ID NO: 1374487 - RNA, 21 nt, Human
uauaguucaugucugcuauca

SEQ ID NO: 1374488 - RNA, 22 nt, Human
uauaguuauuaaguucuuuaaa

SEQ ID NO: 1374489 - RNA, 17 nt, Human
uauaguuaacacacuac

SEQ ID NO: 1374490 - RNA, 22 nt, Human
uauaguuacuguguaauuagug

SEQ ID NO: 1374491 - RNA, 20 nt, Human
uauaguuacuguguaauuag

SEQ ID NO: 1374492 - RNA, 18 nt, Human
uauaguuacuguguaauu

SEQ ID NO: 1374493 - RNA, 16 nt, Human
uauaguuacuguguaa

SEQ ID NO: 1374494 - RNA, 15 nt, Human
uauaguuacugugua

SEQ ID NO: 1374495 - RNA, 13 nt, Human
uauaguuacugug

SEQ ID NO: 1374496 - RNA, 18 nt, Human
uauaguuaacacacuacc

SEQ ID NO: 1374497 - RNA, 16 nt, Human
uauaguuaacacacua

SEQ ID NO: 1374498 - RNA, 15 nt, Human
uauaguuaacacacu

SEQ ID NO: 1374499 - RNA, 13 nt, Human
uauaguuaacaca

SEQ ID NO: 1374500 - RNA, 16 nt, Human
uauacugcauacuuuu

SEQ ID NO: 1374501 - RNA, 12 nt, Human
uauacugcauac

SEQ ID NO: 1374502 - RNA, 23 nt, Human
uauacugcuuggagcugagcaaa

SEQ ID NO: 1374503 - RNA, 17 nt, Human
uauacugcauacuuuuu

SEQ ID NO: 1374504 - RNA, 17 nt, Human
uauacgaaauaauuguu

SEQ ID NO: 1374505 - RNA, 16 nt, Human
uauacgaaauaauugu

SEQ ID NO: 1374506 - RNA, 22 nt, Human
uauaccuguguuucuugccuca

SEQ ID NO: 1374507 - RNA, 20 nt, Human
uauacgcagcgugcuuuaaa

SEQ ID NO: 1374508 - RNA, 20 nt, Human
uauacuagggagccauuuga

SEQ ID NO: 1374509 - RNA, 22 nt, Human
uauacuagggagccauuugaga

SEQ ID NO: 1374510 - RNA, 18 nt, Human
uauaaaugcaaauaacaa

SEQ ID NO: 1374511 - RNA, 17 nt, Human
uauaaaugcaaauaaca

SEQ ID NO: 1374512 - RNA, 16 nt, Human
uauaaaugcaaauaac

SEQ ID NO: 1374513 - RNA, 15 nt, Human
uauaaaugcaaauaa

SEQ ID NO: 1374514 - RNA, 12 nt, Human
uauaaagcagua

SEQ ID NO: 1374515 - RNA, 12 nt, Human
uauaaagcauuu

SEQ ID NO: 1374516 - RNA, 17 nt, Human
uauaaagacguuuuaua

SEQ ID NO: 1374517 - RNA, 14 nt, Human
uauaaagaauugug

SEQ ID NO: 1374518 - RNA, 21 nt, Human
uauaaagacguuuuauaagca

SEQ ID NO: 1374519 - RNA, 17 nt, Human
uaguugccuuaaaauaa

SEQ ID NO: 1374520 - RNA, 20 nt, Human
uauaauauacuauauuuaug

SEQ ID NO: 1374521 - RNA, 17 nt, Human
uauaauauacuauauuu

SEQ ID NO: 1374522 - RNA, 16 nt, Human
uauaauaaauguacau

SEQ ID NO: 1374523 - RNA, 19 nt, Human
uauaaaugucuuuaaugca

SEQ ID NO: 1374524 - RNA, 23 nt, Human
uauaaaugucuuuaaugcaauau

SEQ ID NO: 1374525 - RNA, 17 nt, Human
uauaaaugucuuuaaug

SEQ ID NO: 1374526 - RNA, 11 nt, Human
uauaaaugucu

SEQ ID NO: 1374527 - RNA, 14 nt, Human
uauaauaaaggacu

SEQ ID NO: 1374528 - RNA, 19 nt, Human
uauaauaaaggacuguaau

SEQ ID NO: 1374529 - RNA, 22 nt, Human
uauaauaaaggacuguaaucuu

SEQ ID NO: 1374530 - RNA, 19 nt, Human
uauaauguuguuauuuaaa

SEQ ID NO: 1374531 - RNA, 17 nt, Human
uauaauguuguuauuua

SEQ ID NO: 1374532 - RNA, 17 nt, Human
uauaaucuuauaauugu

SEQ ID NO: 1374533 - RNA, 16 nt, Human
uauaaucuuauaauug

SEQ ID NO: 1374534 - RNA, 17 nt, Human
uauaaucauuauuacuu

SEQ ID NO: 1374535 - RNA, 23 nt, Human
uauaaucauuauuacuuuugcug

SEQ ID NO: 1374536 - RNA, 22 nt, Human
uauaaucaucaaguaauacaaa

SEQ ID NO: 1374537 - RNA, 17 nt, Human
uauaaucaucaaguaau

SEQ ID NO: 1374538 - RNA, 16 nt, Human
uauaaucaucaaguaa

SEQ ID NO: 1374539 - RNA, 18 nt, Human
uauaauguuguuauuuaa

SEQ ID NO: 1374540 - RNA, 23 nt, Human
uauaccuguguuucuugccucau

SEQ ID NO: 1374541 - RNA, 12 nt, Human
uauaccuguguu

SEQ ID NO: 1374542 - RNA, 21 nt, Human
uauaauuguucucagaauccc

SEQ ID NO: 1374543 - RNA, 22 nt, Human
uauaauuggauuuccuaauacu

SEQ ID NO: 1374544 - RNA, 20 nt, Human
uauaauuggauuuccuaaua

SEQ ID NO: 1374545 - RNA, 19 nt, Human
uauaauuggauuuccuaau

SEQ ID NO: 1374546 - RNA, 18 nt, Human
uauaauuggauuuccuaa

SEQ ID NO: 1374547 - RNA, 17 nt, Human
uauaauuggauuuccua

SEQ ID NO: 1374548 - RNA, 17 nt, Human
uauaauugccaaaaagu

SEQ ID NO: 1374549 - RNA, 16 nt, Human
uauaauucuuucaaua

SEQ ID NO: 1374550 - RNA, 13 nt, Human
uauaauucuuuca

SEQ ID NO: 1374551 - RNA, 19 nt, Human
uauaauuauauguuguaag

SEQ ID NO: 1374552 - RNA, 13 nt, Human
uauaauuauaugu

SEQ ID NO: 1374553 - RNA, 15 nt, Human
uauaauucacauugu

SEQ ID NO: 1374554 - RNA, 17 nt, Human
uauaauuauauguugua

SEQ ID NO: 1374555 - RNA, 20 nt, Human
uauaauucacauuguauuca

SEQ ID NO: 1374556 - RNA, 18 nt, Human
uaguaucaucagauagca

SEQ ID NO: 1374557 - RNA, 22 nt, Human
uaggugcaauuucaagguucua

SEQ ID NO: 1374558 - RNA, 21 nt, Human
uaggugauccauguaacugcc

SEQ ID NO: 1374559 - RNA, 22 nt, Human
uaggugauccauguaacugccu

SEQ ID NO: 1374560 - RNA, 19 nt, Human
uaggugauccauguaacug

SEQ ID NO: 1374561 - RNA, 16 nt, Human
uaggugauccauguaa

SEQ ID NO: 1374562 - RNA, 15 nt, Human
uaggugauccaugua

SEQ ID NO: 1374563 - RNA, 18 nt, Human
uaguauuuuuuguauaau

SEQ ID NO: 1374564 - RNA, 15 nt, Human
uaguaugaggcauuu

SEQ ID NO: 1374565 - RNA, 19 nt, Human
uaguauuucuaugaaauau

SEQ ID NO: 1374566 - RNA, 18 nt, Human
uaguauuucuaugaaaua

SEQ ID NO: 1374567 - RNA, 19 nt, Human
uaguauuuuuuguauaauu

SEQ ID NO: 1374568 - RNA, 15 nt, Human
uagugcaaauuguca

SEQ ID NO: 1374569 - RNA, 14 nt, Human
uagugcaaauuguc

SEQ ID NO: 1374570 - RNA, 14 nt, Human
uagucaaauugugu

SEQ ID NO: 1374571 - RNA, 13 nt, Human
uagucaaauugug

SEQ ID NO: 1374572 - RNA, 22 nt, Human
uagugccacuuaauguauguua

SEQ ID NO: 1374573 - RNA, 13 nt, Human
uagugcuaagugu

SEQ ID NO: 1374574 - RNA, 13 nt, Human
uaguguucauaaa

SEQ ID NO: 1374575 - RNA, 20 nt, Human
uaguugcaacuuuguauaaa

SEQ ID NO: 1374576 - RNA, 23 nt, Human
uaggaauagcaugucacuaaagc

SEQ ID NO: 1374577 - RNA, 15 nt, Human
guggcugcagccuca

SEQ ID NO: 1374578 - RNA, 15 nt, Human
uaggaauagcauguc

SEQ ID NO: 1374579 - RNA, 17 nt, Human
guggcugcagccucagg

SEQ ID NO: 1374580 - RNA, 14 nt, Human
guggcugcagccuc

SEQ ID NO: 1374581 - RNA, 13 nt, Human
guggcugcagccu

SEQ ID NO: 1374582 - RNA, 17 nt, Human
guggcugaggccaccca

SEQ ID NO: 1374583 - RNA, 21 nt, Human
guggcucugaggugccugucc

SEQ ID NO: 1374584 - RNA, 16 nt, Human
uaggaauggaaaggau

SEQ ID NO: 1374585 - RNA, 17 nt, Human
uaggaccaagcaucuug

SEQ ID NO: 1374586 - RNA, 23 nt, Human
uaggaccaugguuaagaguccaa

SEQ ID NO: 1374587 - RNA, 19 nt, Human
uaggaccaugguuaagagu

SEQ ID NO: 1374588 - RNA, 18 nt, Human
uaggaccaagcaucuugg

SEQ ID NO: 1374589 - RNA, 22 nt, Human
uaggaccaagcaucuugggggg

SEQ ID NO: 1374590 - RNA, 13 nt, Human
uaggacccuuccc

SEQ ID NO: 1374591 - RNA, 21 nt, Human
uaggcccccacuugccucuuc

SEQ ID NO: 1374592 - RNA, 19 nt, Human
uaggcccccacuugccucu

SEQ ID NO: 1374593 - RNA, 14 nt, Human
uaggcccccacuug

SEQ ID NO: 1374594 - RNA, 20 nt, Human
uaggcuauuuguaaaucugc

SEQ ID NO: 1374595 - RNA, 18 nt, Human
uaggcuauuuguaaaucu

SEQ ID NO: 1374596 - RNA, 16 nt, Human
uaggcuauuuguaaau

SEQ ID NO: 1374597 - RNA, 20 nt, Human
uaggccuugcggcuccucag

SEQ ID NO: 1374598 - RNA, 16 nt, Human
uaggcuagggugggga

SEQ ID NO: 1374599 - RNA, 14 nt, Human
uagguacacagcuc

SEQ ID NO: 1374600 - RNA, 14 nt, Human
uagguaggguuuaa

SEQ ID NO: 1374601 - RNA, 16 nt, Human
uagguaguaccaaaau

SEQ ID NO: 1374602 - RNA, 14 nt, Human
uagguaggaaaugu

SEQ ID NO: 1374603 - RNA, 16 nt, Human
uaggucagugcaaaua

SEQ ID NO: 1374604 - RNA, 15 nt, Human
uaggucucaauaccu

SEQ ID NO: 1374605 - RNA, 20 nt, Human
uaucuaaguuaauuuaaagu

SEQ ID NO: 1374606 - RNA, 19 nt, Human
uaucuaaguuaauuuaaag

SEQ ID NO: 1374607 - RNA, 23 nt, Human
uaucuaaguuaauuuaaaguugu

SEQ ID NO: 1374608 - RNA, 16 nt, Human
uaucgucacugcuuaa

SEQ ID NO: 1374609 - RNA, 13 nt, Human
uaucuaauuuaua

SEQ ID NO: 1374610 - RNA, 13 nt, Human
uaucuaaucauga

SEQ ID NO: 1374611 - RNA, 22 nt, Human
uaucuaaguuaauuuaaaguug

SEQ ID NO: 1374612 - RNA, 22 nt, Human
uaucuaccccagacuagaugua

SEQ ID NO: 1374613 - RNA, 23 nt, Human
uaucugggaagcuauuuuuuuca

SEQ ID NO: 1374614 - RNA, 15 nt, Human
uaucuggccucugcu

SEQ ID NO: 1374615 - RNA, 13 nt, Human
uaucugccuuuau

SEQ ID NO: 1374616 - RNA, 14 nt, Human
uaucugccuuuauu

SEQ ID NO: 1374617 - RNA, 18 nt, Human
uaucugccuuuauugugu

SEQ ID NO: 1374618 - RNA, 20 nt, Human
uaucugccuuuauuguguuu

SEQ ID NO: 1374619 - RNA, 22 nt, Human
uaucugcaagugagguguguca

SEQ ID NO: 1374620 - RNA, 13 nt, Human
uaucugaucagaa

SEQ ID NO: 1374621 - RNA, 13 nt, Human
uaucugaggucac

SEQ ID NO: 1374622 - RNA, 23 nt, Human
uaucugaguuacagaaaugauua

SEQ ID NO: 1374623 - RNA, 21 nt, Human
uaucugaggcacaugucagca

SEQ ID NO: 1374624 - RNA, 17 nt, Human
uauccugaaauuucaga

SEQ ID NO: 1374625 - RNA, 16 nt, Human
uauccugaaauuucag

SEQ ID NO: 1374626 - RNA, 14 nt, Human
uauccugaaauuuc

SEQ ID NO: 1374627 - RNA, 23 nt, Human
uauccucuuuagaguuagacugu

SEQ ID NO: 1374628 - RNA, 14 nt, Human
uauccucuuuagag

SEQ ID NO: 1374629 - RNA, 16 nt, Human
uauccucuuuagaguu

SEQ ID NO: 1374630 - RNA, 17 nt, Human
uauccucuuuagaguua

SEQ ID NO: 1374631 - RNA, 22 nt, Human
uauccucuuuagaguuagacug

SEQ ID NO: 1374632 - RNA, 12 nt, Human
uauccucuguaa

SEQ ID NO: 1374633 - RNA, 18 nt, Human
uauccucucuuccucuuc

SEQ ID NO: 1374634 - RNA, 15 nt, Human
uauccucucuuccuc

SEQ ID NO: 1374635 - RNA, 14 nt, Human
uauccucucuuccu

SEQ ID NO: 1374636 - RNA, 17 nt, Human
uauccucccuguaacuu

SEQ ID NO: 1374637 - RNA, 16 nt, Human
uauccucccuguaacu

SEQ ID NO: 1374638 - RNA, 15 nt, Human
uauccucccuguaac

SEQ ID NO: 1374639 - RNA, 14 nt, Human
uauccucccuguaa

SEQ ID NO: 1374640 - RNA, 12 nt, Human
uauccucccugu

SEQ ID NO: 1374641 - RNA, 11 nt, Human
uauccucccug

SEQ ID NO: 1374642 - RNA, 18 nt, Human
uauccuuucauauaguua

SEQ ID NO: 1374643 - RNA, 15 nt, Human
uaucguaaaauuaag

SEQ ID NO: 1374644 - RNA, 18 nt, Human
uaucguaaaauuaagaaa

SEQ ID NO: 1374645 - RNA, 19 nt, Human
uaugacaucacuuguacaa

SEQ ID NO: 1374646 - RNA, 24 nt, Human
uaugacaucacuuguacaaaauaa

SEQ ID NO: 1374647 - RNA, 23 nt, Human
uaugacaucacuuguacaaaaua

SEQ ID NO: 1374648 - RNA, 20 nt, Human
uaugacaucacuuguacaaa

SEQ ID NO: 1374649 - RNA, 22 nt, Human
uaugacacaugcaaggucauuu

SEQ ID NO: 1374650 - RNA, 12 nt, Human
uaugacacaugc

SEQ ID NO: 1374651 - RNA, 15 nt, Human
uaugaauacuuugca

SEQ ID NO: 1374652 - RNA, 13 nt, Human
uaugaauacuuug

SEQ ID NO: 1374653 - RNA, 22 nt, Human
uaucuucucaaguucuaagauu

SEQ ID NO: 1374654 - RNA, 12 nt, Human
uaugaauaacau

SEQ ID NO: 1374655 - RNA, 18 nt, Human
uaugaauugaauuaucuu

SEQ ID NO: 1374656 - RNA, 19 nt, Human
uaugaauuauucaauuuau

SEQ ID NO: 1374657 - RNA, 18 nt, Human
uaugaauuauucaauuua

SEQ ID NO: 1374658 - RNA, 14 nt, Human
uaugaauuauucaa

SEQ ID NO: 1374659 - RNA, 19 nt, Human
uaugaaugugaagccuucc

SEQ ID NO: 1374660 - RNA, 23 nt, Human
uaugaauuacauuuguauaaaau

SEQ ID NO: 1374661 - RNA, 18 nt, Human
uaugaaugugaagccuuc

SEQ ID NO: 1374662 - RNA, 17 nt, Human
uaugaaugugaagccuu

SEQ ID NO: 1374663 - RNA, 16 nt, Human
uaugaaugugaagccu

SEQ ID NO: 1374664 - RNA, 15 nt, Human
uaugaaugugaagcc

SEQ ID NO: 1374665 - RNA, 17 nt, Human
uaugaauuacauuugua

SEQ ID NO: 1374666 - RNA, 15 nt, Human
uaucugucagcugca

SEQ ID NO: 1374667 - RNA, 13 nt, Human
uaucuguaauggu

SEQ ID NO: 1374668 - RNA, 20 nt, Human
uaucugggcuuccuggagca

SEQ ID NO: 1374669 - RNA, 18 nt, Human
uaucugggcuuccuggag

SEQ ID NO: 1374670 - RNA, 16 nt, Human
uaucugggcuuccugg

SEQ ID NO: 1374671 - RNA, 15 nt, Human
uaucugggcuuccug

SEQ ID NO: 1374672 - RNA, 14 nt, Human
uaucugggcuuccu

SEQ ID NO: 1374673 - RNA, 11 nt, Human
uaucugggcuu

SEQ ID NO: 1374674 - RNA, 22 nt, Human
uaucuguaaugguacugacuuu

SEQ ID NO: 1374675 - RNA, 21 nt, Human
uaucuguagacggcucaguau

SEQ ID NO: 1374676 - RNA, 17 nt, Human
uaucuuacuauuucaca

SEQ ID NO: 1374677 - RNA, 18 nt, Human
uaucuuacuauuucacaa

SEQ ID NO: 1374678 - RNA, 21 nt, Human
uaucuucucaaguucuaagau

SEQ ID NO: 1374679 - RNA, 20 nt, Human
uaucuucucaaguucuaaga

SEQ ID NO: 1374680 - RNA, 18 nt, Human
uaucuucucaaguucuaa

SEQ ID NO: 1374681 - RNA, 17 nt, Human
uaucuucucaaguucua

SEQ ID NO: 1374682 - RNA, 15 nt, Human
uaucuucucaaguuc

SEQ ID NO: 1374683 - RNA, 14 nt, Human
uaucuucacuuguc

SEQ ID NO: 1374684 - RNA, 20 nt, Human
uaugaaguuuuuuuuauaca

SEQ ID NO: 1374685 - RNA, 16 nt, Human
uauggaaauaaaugua

SEQ ID NO: 1374686 - RNA, 15 nt, Human
uaugcuuugaaacag

SEQ ID NO: 1374687 - RNA, 20 nt, Human
uaugcuuguaacuaaaauaa

SEQ ID NO: 1374688 - RNA, 18 nt, Human
uaugcuuguaacuaaaau

SEQ ID NO: 1374689 - RNA, 16 nt, Human
uaugcuugcaaaaacu

SEQ ID NO: 1374690 - RNA, 19 nt, Human
uauggaauugauuugcauu

SEQ ID NO: 1374691 - RNA, 11 nt, Human
uauggaauuga

SEQ ID NO: 1374692 - RNA, 16 nt, Human
uauggacaaaacaaga

SEQ ID NO: 1374693 - RNA, 15 nt, Human
uauggaauuuugcaa

SEQ ID NO: 1374694 - RNA, 18 nt, Human
uauggaauugauuugcau

SEQ ID NO: 1374695 - RNA, 14 nt, Human
uauggaaauauaua

SEQ ID NO: 1374696 - RNA, 15 nt, Human
uauggaaauauauau

SEQ ID NO: 1374697 - RNA, 13 nt, Human
uauggaaauauau

SEQ ID NO: 1374698 - RNA, 17 nt, Human
uauggaaauaaauguau

SEQ ID NO: 1374699 - RNA, 14 nt, Human
uaugcauauuuguu

SEQ ID NO: 1374700 - RNA, 13 nt, Human
uaugcaugaagua

SEQ ID NO: 1374701 - RNA, 18 nt, Human
uaugcaugaaguaauaug

SEQ ID NO: 1374702 - RNA, 16 nt, Human
uaugcuucuguuuuau

SEQ ID NO: 1374703 - RNA, 15 nt, Human
uaugcuucuguuuua

SEQ ID NO: 1374704 - RNA, 20 nt, Human
uaugcacuuauaauuuuccu

SEQ ID NO: 1374705 - RNA, 22 nt, Human
uaugcacuuauaauuuuccuaa

SEQ ID NO: 1374706 - RNA, 19 nt, Human
uaugcacuuauaauuuucc

SEQ ID NO: 1374707 - RNA, 16 nt, Human
uaugcacaugaacuua

SEQ ID NO: 1374708 - RNA, 19 nt, Human
uaugcacaugaacuuagau

SEQ ID NO: 1374709 - RNA, 15 nt, Human
uaugcacaugaacuu

SEQ ID NO: 1374710 - RNA, 15 nt, Human
uaugcauauuuguuu

SEQ ID NO: 1374711 - RNA, 20 nt, Human
uaugcauauuauuuuauguu

SEQ ID NO: 1374712 - RNA, 17 nt, Human
uaugauuuuuuuuucau

SEQ ID NO: 1374713 - RNA, 13 nt, Human
uaugauuuacauu

SEQ ID NO: 1374714 - RNA, 18 nt, Human
uaugauuuaauuugaaau

SEQ ID NO: 1374715 - RNA, 17 nt, Human
uaugauuuaauuugaaa

SEQ ID NO: 1374716 - RNA, 19 nt, Human
uaugauuuuuuuuucauac

SEQ ID NO: 1374717 - RNA, 14 nt, Human
uaugcaaaagcaag

SEQ ID NO: 1374718 - RNA, 16 nt, Human
uaugcaauuuccuuuu

SEQ ID NO: 1374719 - RNA, 13 nt, Human
uaugcacacauuu

SEQ ID NO: 1374720 - RNA, 14 nt, Human
uaugcacaguaaaa

SEQ ID NO: 1374721 - RNA, 14 nt, Human
uaugcacacauuuu

SEQ ID NO: 1374722 - RNA, 16 nt, Human
uaugacuauguaaacu

SEQ ID NO: 1374723 - RNA, 17 nt, Human
uaugacuauguaaacua

SEQ ID NO: 1374724 - RNA, 23 nt, Human
uaugacuugggcacccccagccu

SEQ ID NO: 1374725 - RNA, 22 nt, Human
uaugacuugggcacccccagcc

SEQ ID NO: 1374726 - RNA, 21 nt, Human
uaugacuugggcacccccagc

SEQ ID NO: 1374727 - RNA, 18 nt, Human
uaugacuauguaaacuac

SEQ ID NO: 1374728 - RNA, 16 nt, Human
uaugagcucuucaugu

SEQ ID NO: 1374729 - RNA, 15 nt, Human
uaugagcucuucaug

SEQ ID NO: 1374730 - RNA, 14 nt, Human
uaugagcucuucau

SEQ ID NO: 1374731 - RNA, 15 nt, Human
uaugauuacuggccu

SEQ ID NO: 1374732 - RNA, 21 nt, Human
uaugauuauuaacgaugucca

SEQ ID NO: 1374733 - RNA, 12 nt, Human
uaugauuauuaa

SEQ ID NO: 1374734 - RNA, 22 nt, Human
uaugauuacuggccuuuuucau

SEQ ID NO: 1374735 - RNA, 21 nt, Human
uaugauucaaaugucuauaaa

SEQ ID NO: 1374736 - RNA, 16 nt, Human
uaugauucaaaugucu

SEQ ID NO: 1374737 - RNA, 16 nt, Human
uaugauucccagccag

SEQ ID NO: 1374738 - RNA, 22 nt, Human
ucagcucuucuccauccuacca

SEQ ID NO: 1374739 - RNA, 19 nt, Human
ucagcucugggccauucuc

SEQ ID NO: 1374740 - RNA, 22 nt, Human
ucagcucugacauucugauucg

SEQ ID NO: 1374741 - RNA, 16 nt, Human
ucagcucugacauucu

SEQ ID NO: 1374742 - RNA, 21 nt, Human
ucagcucugaaagagaaacac

SEQ ID NO: 1374743 - RNA, 18 nt, Human
ucagcucugaaagagaaa

SEQ ID NO: 1374744 - RNA, 16 nt, Human
ucagcucugaaagaga

SEQ ID NO: 1374745 - RNA, 14 nt, Human
ucagcucugaaaga

SEQ ID NO: 1374746 - RNA, 18 nt, Human
ucagcucccacaagccuc

SEQ ID NO: 1374747 - RNA, 19 nt, Human
ucagcugucuuuuggagga

SEQ ID NO: 1374748 - RNA, 15 nt, Human
ucagcugucuuuugg

SEQ ID NO: 1374749 - RNA, 14 nt, Human
ucagcugucuuuug

SEQ ID NO: 1374750 - RNA, 13 nt, Human
ucagcugucuuuu

SEQ ID NO: 1374751 - RNA, 19 nt, Human
ucaccgugggcucccugac

SEQ ID NO: 1374752 - RNA, 18 nt, Human
ucaccgugggcucccuga

SEQ ID NO: 1374753 - RNA, 17 nt, Human
ucaccgugggcucccug

SEQ ID NO: 1374754 - RNA, 16 nt, Human
ucaccgugggcucccu

SEQ ID NO: 1374755 - RNA, 15 nt, Human
ucaccgugggcuccc

SEQ ID NO: 1374756 - RNA, 13 nt, Human
ucaccgugggcuc

SEQ ID NO: 1374757 - RNA, 22 nt, Human
ucaccggcucucaccuggcccu

SEQ ID NO: 1374758 - RNA, 18 nt, Human
ucaccggggugguuuagu

SEQ ID NO: 1374759 - RNA, 15 nt, Human
ucaccggcucucacc

SEQ ID NO: 1374760 - RNA, 16 nt, Human
ucagcucccacaagcc

SEQ ID NO: 1374761 - RNA, 13 nt, Human
ucagcucccacaa

SEQ ID NO: 1374762 - RNA, 19 nt, Human
ucagcuccagguggcucug

SEQ ID NO: 1374763 - RNA, 14 nt, Human
ucagcuccaggugg

SEQ ID NO: 1374764 - RNA, 13 nt, Human
ucagcuccagcug

SEQ ID NO: 1374765 - RNA, 18 nt, Human
ucaggccuuugagcucag

SEQ ID NO: 1374766 - RNA, 19 nt, Human
ucaggaugagggaaaagaa

SEQ ID NO: 1374767 - RNA, 18 nt, Human
ucaggaugagggaaaaga

SEQ ID NO: 1374768 - RNA, 14 nt, Human
ucaggaucuauuuu

SEQ ID NO: 1374769 - RNA, 22 nt, Human
ucaggauccaagcuaagcacug

SEQ ID NO: 1374770 - RNA, 20 nt, Human
ucaggauccaagcuaagcac

SEQ ID NO: 1374771 - RNA, 16 nt, Human
ucaggaguguguguga

SEQ ID NO: 1374772 - RNA, 19 nt, Human
ucaggacacaggccugugu

SEQ ID NO: 1374773 - RNA, 18 nt, Human
ucaggacacaggccugug

SEQ ID NO: 1374774 - RNA, 17 nt, Human
ucaggacacaggccugu

SEQ ID NO: 1374775 - RNA, 23 nt, Human
ucaggacacaggccuguguagcu

SEQ ID NO: 1374776 - RNA, 16 nt, Human
ucaggacacaggccug

SEQ ID NO: 1374777 - RNA, 15 nt, Human
ucaggacacaggccu

SEQ ID NO: 1374778 - RNA, 18 nt, Human
ucaggaauucuuggagaa

SEQ ID NO: 1374779 - RNA, 18 nt, Human
ucaggaauauuuuccaaa

SEQ ID NO: 1374780 - RNA, 17 nt, Human
ucaggaauauuuuccaa

SEQ ID NO: 1374781 - RNA, 19 nt, Human
ucaggaaucggaauccugu

SEQ ID NO: 1374782 - RNA, 16 nt, Human
ucaggaauucuuggag

SEQ ID NO: 1374783 - RNA, 11 nt, Human
ucaggagcccu

SEQ ID NO: 1374784 - RNA, 12 nt, Human
ucaggagcccug

SEQ ID NO: 1374785 - RNA, 14 nt, Human
ucaggagcccuggg

SEQ ID NO: 1374786 - RNA, 15 nt, Human
ucaggagcccuggga

SEQ ID NO: 1374787 - RNA, 16 nt, Human
ucaggugaaaggaaau

SEQ ID NO: 1374788 - RNA, 21 nt, Human
ucaggugaaacuccagaugcc

SEQ ID NO: 1374789 - RNA, 16 nt, Human
ucagguccucagagaa

SEQ ID NO: 1374790 - RNA, 23 nt, Human
ucaggucacauaaaacuuuguau

SEQ ID NO: 1374791 - RNA, 18 nt, Human
ucaggucacauaaaacuu

SEQ ID NO: 1374792 - RNA, 22 nt, Human
ucagggaaggaggagccugucc

SEQ ID NO: 1374793 - RNA, 23 nt, Human
ucagggaaggaggagccuguccu

SEQ ID NO: 1374794 - RNA, 21 nt, Human
ucagggaaggaggagccuguc

SEQ ID NO: 1374795 - RNA, 20 nt, Human
ucagggaaggaggagccugu

SEQ ID NO: 1374796 - RNA, 19 nt, Human
ucagggaaggaggagccug

SEQ ID NO: 1374797 - RNA, 17 nt, Human
ucagggaaggaggagcc

SEQ ID NO: 1374798 - RNA, 15 nt, Human
ucaggcugccugagu

SEQ ID NO: 1374799 - RNA, 13 nt, Human
ucaggcugccuga

SEQ ID NO: 1374800 - RNA, 12 nt, Human
ucaggcugccug

SEQ ID NO: 1374801 - RNA, 13 nt, Human
ucaggcuagaugu

SEQ ID NO: 1374802 - RNA, 15 nt, Human
ucagucacagccacc

SEQ ID NO: 1374803 - RNA, 14 nt, Human
ucagucacagccac

SEQ ID NO: 1374804 - RNA, 13 nt, Human
ucagucacagcca

SEQ ID NO: 1374805 - RNA, 16 nt, Human
ucagucaauauuuuua

SEQ ID NO: 1374806 - RNA, 19 nt, Human
ucagucucagaaugucauu

SEQ ID NO: 1374807 - RNA, 18 nt, Human
ucagucucagaaugucau

SEQ ID NO: 1374808 - RNA, 15 nt, Human
ucaguauuuaacuaa

SEQ ID NO: 1374809 - RNA, 20 nt, Human
ucaguauuuaacuaauuaua

SEQ ID NO: 1374810 - RNA, 14 nt, Human
ucaguauuuaacua

SEQ ID NO: 1374811 - RNA, 13 nt, Human
ucaguauuuaacu

SEQ ID NO: 1374812 - RNA, 15 nt, Human
ucagucucuauacca

SEQ ID NO: 1374813 - RNA, 18 nt, Human
ucagucucuauaccaaua

SEQ ID NO: 1374814 - RNA, 21 nt, Human
ucagucucuauaccaauaaag

SEQ ID NO: 1374815 - RNA, 18 nt, Human
ucagugacccuggcuccu

SEQ ID NO: 1374816 - RNA, 20 nt, Human
ucagugaaguugcugcuucu

SEQ ID NO: 1374817 - RNA, 18 nt, Human
ucagugaaguugcugcuu

SEQ ID NO: 1374818 - RNA, 17 nt, Human
ucagugaaguugcugcu

SEQ ID NO: 1374819 - RNA, 16 nt, Human
ucagugaaguugcugc

SEQ ID NO: 1374820 - RNA, 14 nt, Human
ucagugaaguugcu

SEQ ID NO: 1374821 - RNA, 13 nt, Human
ucagugaagacua

SEQ ID NO: 1374822 - RNA, 20 nt, Human
ucagucucuauaccaauaaa

SEQ ID NO: 1374823 - RNA, 22 nt, Human
uccaaaaccgccagcucuguuc

SEQ ID NO: 1374824 - RNA, 20 nt, Human
uccaaaaccgccagcucugu

SEQ ID NO: 1374825 - RNA, 19 nt, Human
uccaaaaccgccagcucug

SEQ ID NO: 1374826 - RNA, 18 nt, Human
uccaaaaccgccagcucu

SEQ ID NO: 1374827 - RNA, 21 nt, Human
ucauuuaucuauaauuuaccu

SEQ ID NO: 1374828 - RNA, 18 nt, Human
ucauuuaucuauaauuua

SEQ ID NO: 1374829 - RNA, 16 nt, Human
ucauuuaucuauaauu

SEQ ID NO: 1374830 - RNA, 12 nt, Human
ucauuuaucuau

SEQ ID NO: 1374831 - RNA, 18 nt, Human
uccaaaagaagcccccag

SEQ ID NO: 1374832 - RNA, 15 nt, Human
uccaaaagaagcccc

SEQ ID NO: 1374833 - RNA, 14 nt, Human
uccaaaagaagccc

SEQ ID NO: 1374834 - RNA, 21 nt, Human
uccaaaaccgccagcucuguu

SEQ ID NO: 1374835 - RNA, 13 nt, Human
uccaaaacugccu

SEQ ID NO: 1374836 - RNA, 12 nt, Human
uccaaaacugcc

SEQ ID NO: 1374837 - RNA, 21 nt, Human
uccaaaagaagcccccagcua

SEQ ID NO: 1374838 - RNA, 14 nt, Human
uccaaacaggcuca

SEQ ID NO: 1374839 - RNA, 18 nt, Human
uccaaagaggcugccccu

SEQ ID NO: 1374840 - RNA, 16 nt, Human
uccaaagaggcugccc

SEQ ID NO: 1374841 - RNA, 15 nt, Human
uccaaagaggcugcc

SEQ ID NO: 1374842 - RNA, 14 nt, Human
uccaaagaggcugc

SEQ ID NO: 1374843 - RNA, 13 nt, Human
uccaaagaggcug

SEQ ID NO: 1374844 - RNA, 16 nt, Human
uccaaacuaauuuuua

SEQ ID NO: 1374845 - RNA, 12 nt, Human
uccaaacuaauu

SEQ ID NO: 1374846 - RNA, 20 nt, Human
uccaaagaguagaauugcau

SEQ ID NO: 1374847 - RNA, 19 nt, Human
uccaaagaggcugccccuc

SEQ ID NO: 1374848 - RNA, 13 nt, Human
uccaaaguacacu

SEQ ID NO: 1374849 - RNA, 22 nt, Human
uccaaaccacuuuuugcagcuu

SEQ ID NO: 1374850 - RNA, 12 nt, Human
uccaaaccacuu

SEQ ID NO: 1374851 - RNA, 19 nt, Human
ucauuuaguuugauuauuc

SEQ ID NO: 1374852 - RNA, 18 nt, Human
ucauuuagucaugugacc

SEQ ID NO: 1374853 - RNA, 17 nt, Human
ucauuuagccuguccug

SEQ ID NO: 1374854 - RNA, 16 nt, Human
ucauuuagccuguccu

SEQ ID NO: 1374855 - RNA, 15 nt, Human
ucauuuagccugucc

SEQ ID NO: 1374856 - RNA, 23 nt, Human
ucauuuagcauguuguugaaagg

SEQ ID NO: 1374857 - RNA, 17 nt, Human
ucauuuagcauguuguu

SEQ ID NO: 1374858 - RNA, 22 nt, Human
ucauuuaauccucccuuccucc

SEQ ID NO: 1374859 - RNA, 21 nt, Human
ucauuuaauaauauacuugug

SEQ ID NO: 1374860 - RNA, 18 nt, Human
ucauuuaauaauauacuu

SEQ ID NO: 1374861 - RNA, 20 nt, Human
ucauuuaauaauauacuugu

SEQ ID NO: 1374862 - RNA, 18 nt, Human
ucauugucuguguagagu

SEQ ID NO: 1374863 - RNA, 14 nt, Human
ucauuguauguggu

SEQ ID NO: 1374864 - RNA, 11 nt, Human
ucauuuaauaa

SEQ ID NO: 1374865 - RNA, 14 nt, Human
ucauuuaauaauau

SEQ ID NO: 1374866 - RNA, 14 nt, Human
ucauuguagaaaag

SEQ ID NO: 1374867 - RNA, 20 nt, Human
ucauuagccugaguagaaag

SEQ ID NO: 1374868 - RNA, 18 nt, Human
ucauuagccugaguagaa

SEQ ID NO: 1374869 - RNA, 19 nt, Human
ucauuagccugaguagaaa

SEQ ID NO: 1374870 - RNA, 20 nt, Human
ucauuagacuggaacuugaa

SEQ ID NO: 1374871 - RNA, 15 nt, Human
ucauuagaaauauuu

SEQ ID NO: 1374872 - RNA, 14 nt, Human
ucauggugcucaga

SEQ ID NO: 1374873 - RNA, 20 nt, Human
ucauccaccccaucccuccc

SEQ ID NO: 1374874 - RNA, 19 nt, Human
ucaucauucucugucucau

SEQ ID NO: 1374875 - RNA, 18 nt, Human
ucaucauucucugucuca

SEQ ID NO: 1374876 - RNA, 14 nt, Human
ucaucauucucugu

SEQ ID NO: 1374877 - RNA, 13 nt, Human
ucaucauucucug

SEQ ID NO: 1374878 - RNA, 22 nt, Human
ucaucauggccagcuggaggca

SEQ ID NO: 1374879 - RNA, 18 nt, Human
ucaucauggccagcugga

SEQ ID NO: 1374880 - RNA, 17 nt, Human
ucaucauggccagcugg

SEQ ID NO: 1374881 - RNA, 14 nt, Human
ucaucauggccagc

SEQ ID NO: 1374882 - RNA, 19 nt, Human
ucaucaauggggccaguca

SEQ ID NO: 1374883 - RNA, 13 nt, Human
ucaucaauuaaag

SEQ ID NO: 1374884 - RNA, 22 nt, Human
ucaguguaccgcgucuacccug

SEQ ID NO: 1374885 - RNA, 22 nt, Human
ucaguguauggaaauaaaugua

SEQ ID NO: 1374886 - RNA, 21 nt, Human
ucaguguauggaaauaaaugu

SEQ ID NO: 1374887 - RNA, 22 nt, Human
ucaguguagaaccuaauucaau

SEQ ID NO: 1374888 - RNA, 19 nt, Human
ucaguguaccauuugccuc

SEQ ID NO: 1374889 - RNA, 18 nt, Human
ucaguguaccauuugccu

SEQ ID NO: 1374890 - RNA, 22 nt, Human
ucaucucagugaagaauacuuc

SEQ ID NO: 1374891 - RNA, 19 nt, Human
ucaucucagcucacugcaa

SEQ ID NO: 1374892 - RNA, 18 nt, Human
ucaucuccugccuuccuc

SEQ ID NO: 1374893 - RNA, 15 nt, Human
ucaucuccugccuuc

SEQ ID NO: 1374894 - RNA, 22 nt, Human
ucaucucccaccuagcagcacc

SEQ ID NO: 1374895 - RNA, 12 nt, Human
ucaucucccacc

SEQ ID NO: 1374896 - RNA, 21 nt, Human
ucaucucauuuaauccucccu

SEQ ID NO: 1374897 - RNA, 20 nt, Human
ucaucucauuuaauccuccc

SEQ ID NO: 1374898 - RNA, 16 nt, Human
ucaucuccccaucauu

SEQ ID NO: 1374899 - RNA, 22 nt, Human
ucaucuugcuaccaguauuuag

SEQ ID NO: 1374900 - RNA, 21 nt, Human
ucaucuugcuaccaguauuua

SEQ ID NO: 1374901 - RNA, 18 nt, Human
ucaucuugcuaccaguau

SEQ ID NO: 1374902 - RNA, 17 nt, Human
ucaucuugcuaccagua

SEQ ID NO: 1374903 - RNA, 11 nt, Human
ucaucuugcua

SEQ ID NO: 1374904 - RNA, 12 nt, Human
ucaucuuucuuc

SEQ ID NO: 1374905 - RNA, 20 nt, Human
ucaugcugggauuuccaacu

SEQ ID NO: 1374906 - RNA, 17 nt, Human
ucaugcuguucaugaaa

SEQ ID NO: 1374907 - RNA, 19 nt, Human
ucaugggccacugcuuuuc

SEQ ID NO: 1374908 - RNA, 19 nt, Human
ucccaccugacacaccagg

SEQ ID NO: 1374909 - RNA, 13 nt, Human
ucccaccugacac

SEQ ID NO: 1374910 - RNA, 22 nt, Human
uccauucacaguucuuugggcc

SEQ ID NO: 1374911 - RNA, 23 nt, Human
ucccaccugacacaccaggcgcu

SEQ ID NO: 1374912 - RNA, 19 nt, Human
uccauuaaacgauuuuuaa

SEQ ID NO: 1374913 - RNA, 23 nt, Human
uccaugggcagagcccaagggaa

SEQ ID NO: 1374914 - RNA, 11 nt, Human
ucccaggaccc

SEQ ID NO: 1374915 - RNA, 24 nt, Human
ucccaggaccacaggcucaggcag

SEQ ID NO: 1374916 - RNA, 23 nt, Human
ucccaggaccacaggcucaggca

SEQ ID NO: 1374917 - RNA, 19 nt, Human
ucccaggaccacaggcuca

SEQ ID NO: 1374918 - RNA, 18 nt, Human
ucccaggaccacaggcuc

SEQ ID NO: 1374919 - RNA, 17 nt, Human
ucccaggaccacaggcu

SEQ ID NO: 1374920 - RNA, 12 nt, Human
ucccaggacccu

SEQ ID NO: 1374921 - RNA, 16 nt, Human
ucccaggaacugggcc

SEQ ID NO: 1374922 - RNA, 11 nt, Human
ucccaggaacu

SEQ ID NO: 1374923 - RNA, 22 nt, Human
ucccaggccccaugaccuccag

SEQ ID NO: 1374924 - RNA, 21 nt, Human
ucccaggccccaugaccucca

SEQ ID NO: 1374925 - RNA, 18 nt, Human
ucccaggccccaugaccu

SEQ ID NO: 1374926 - RNA, 11 nt, Human
ucccaggcccc

SEQ ID NO: 1374927 - RNA, 20 nt, Human
ucccaggcccacugugccuc

SEQ ID NO: 1374928 - RNA, 19 nt, Human
ucccaggcccacugugccu

SEQ ID NO: 1374929 - RNA, 12 nt, Human
ucccaggcccac

SEQ ID NO: 1374930 - RNA, 23 nt, Human
ucccaggccccaugaccuccagc

SEQ ID NO: 1374931 - RNA, 18 nt, Human
uccccccacucccucaca

SEQ ID NO: 1374932 - RNA, 22 nt, Human
uccccccacaagugcccuccag

SEQ ID NO: 1374933 - RNA, 17 nt, Human
uccccccacaagugccc

SEQ ID NO: 1374934 - RNA, 22 nt, Human
uccccccaagggaggcugcugc

SEQ ID NO: 1374935 - RNA, 19 nt, Human
ucccccauguucugucccu

SEQ ID NO: 1374936 - RNA, 17 nt, Human
uccccagcccagagaca

SEQ ID NO: 1374937 - RNA, 16 nt, Human
uccccagcccagagac

SEQ ID NO: 1374938 - RNA, 15 nt, Human
uccccagcccagaga

SEQ ID NO: 1374939 - RNA, 14 nt, Human
uccccagcccagag

SEQ ID NO: 1374940 - RNA, 13 nt, Human
uccccagcccaga

SEQ ID NO: 1374941 - RNA, 12 nt, Human
uccccagcccag

SEQ ID NO: 1374942 - RNA, 20 nt, Human
uccccagcauuccagccccu

SEQ ID NO: 1374943 - RNA, 10 nt, Human
ucccaugugg

SEQ ID NO: 1374944 - RNA, 14 nt, Human
ucccauguucaagc

SEQ ID NO: 1374945 - RNA, 23 nt, Human
uccccagagaaaggggagcccac

SEQ ID NO: 1374946 - RNA, 22 nt, Human
uccccagagaaaggggagccca

SEQ ID NO: 1374947 - RNA, 19 nt, Human
uccagguagagggugugua

SEQ ID NO: 1374948 - RNA, 22 nt, Human
uccagguccugguggggcagcu

SEQ ID NO: 1374949 - RNA, 21 nt, Human
uccagguauucguuaucuaau

SEQ ID NO: 1374950 - RNA, 17 nt, Human
uccagggugugugcucg

SEQ ID NO: 1374951 - RNA, 21 nt, Human
uccagguccugguggggcagc

SEQ ID NO: 1374952 - RNA, 15 nt, Human
uccagguccuggugg

SEQ ID NO: 1374953 - RNA, 14 nt, Human
uccaguaaaauaau

SEQ ID NO: 1374954 - RNA, 14 nt, Human
uccauaacugaaca

SEQ ID NO: 1374955 - RNA, 13 nt, Human
uccauaaagaccc

SEQ ID NO: 1374956 - RNA, 17 nt, Human
uccauaaauccuugaug

SEQ ID NO: 1374957 - RNA, 19 nt, Human
uccaguucaugagaaucua

SEQ ID NO: 1374958 - RNA, 16 nt, Human
uccaguucaugagaau

SEQ ID NO: 1374959 - RNA, 22 nt, Human
uccaguuaaaaaaaauuuuaau

SEQ ID NO: 1374960 - RNA, 23 nt, Human
uccaguuggaguuuuuuguacca

SEQ ID NO: 1374961 - RNA, 19 nt, Human
uccaucacguuagcugucc

SEQ ID NO: 1374962 - RNA, 13 nt, Human
uccaucaucaugu

SEQ ID NO: 1374963 - RNA, 15 nt, Human
uccauacauuugugu

SEQ ID NO: 1374964 - RNA, 22 nt, Human
uccaugcguguuucugacucug

SEQ ID NO: 1374965 - RNA, 21 nt, Human
uccaugcguguuucugacucu

SEQ ID NO: 1374966 - RNA, 22 nt, Human
uccaugcugugcgcccagggcu

SEQ ID NO: 1374967 - RNA, 21 nt, Human
uccaugcugugcgcccagggc

SEQ ID NO: 1374968 - RNA, 20 nt, Human
uccaugcugugcgcccaggg

SEQ ID NO: 1374969 - RNA, 22 nt, Human
uccaugggcagagcccaaggga

SEQ ID NO: 1374970 - RNA, 18 nt, Human
uccaugggcagagcccaa

SEQ ID NO: 1374971 - RNA, 17 nt, Human
uccaugggcagagccca

SEQ ID NO: 1374972 - RNA, 16 nt, Human
uccaugggcagagccc

SEQ ID NO: 1374973 - RNA, 15 nt, Human
uccaugggcagagcc

SEQ ID NO: 1374974 - RNA, 18 nt, Human
uccaugggagaaaauaga

SEQ ID NO: 1374975 - RNA, 20 nt, Human
uccaugggccauaugaaaag

SEQ ID NO: 1374976 - RNA, 23 nt, Human
uccaggggcugcuuccuccugga

SEQ ID NO: 1374977 - RNA, 22 nt, Human
uccaggggcugcuuccuccugg

SEQ ID NO: 1374978 - RNA, 21 nt, Human
uccaggggcugcuuccuccug

SEQ ID NO: 1374979 - RNA, 13 nt, Human
uccagcugccccg

SEQ ID NO: 1374980 - RNA, 12 nt, Human
uccagcugcccc

SEQ ID NO: 1374981 - RNA, 22 nt, Human
uccagcugccccggccccuccc

SEQ ID NO: 1374982 - RNA, 16 nt, Human
uccagcugagcgccag

SEQ ID NO: 1374983 - RNA, 21 nt, Human
uccagcugacuaaacuuuuuu

SEQ ID NO: 1374984 - RNA, 14 nt, Human
uccagcugacuaaa

SEQ ID NO: 1374985 - RNA, 16 nt, Human
uccagcuccuuugggc

SEQ ID NO: 1374986 - RNA, 20 nt, Human
uccagcucuggaggggaggg

SEQ ID NO: 1374987 - RNA, 15 nt, Human
uccagcucuggaggg

SEQ ID NO: 1374988 - RNA, 13 nt, Human
uccagcucuggag

SEQ ID NO: 1374989 - RNA, 12 nt, Human
uccagcucugga

SEQ ID NO: 1374990 - RNA, 19 nt, Human
uccagcuccuuugggcuuc

SEQ ID NO: 1374991 - RNA, 15 nt, Human
uccagcuccuuuggg

SEQ ID NO: 1374992 - RNA, 14 nt, Human
uccagcuccuuugg

SEQ ID NO: 1374993 - RNA, 13 nt, Human
uccagcuccugua

SEQ ID NO: 1374994 - RNA, 17 nt, Human
uccaaagucauaauugc

SEQ ID NO: 1374995 - RNA, 15 nt, Human
uccaaagucauaauu

SEQ ID NO: 1374996 - RNA, 18 nt, Human
uccaaagucauaauugca

SEQ ID NO: 1374997 - RNA, 14 nt, Human
uccaaaguacacug

SEQ ID NO: 1374998 - RNA, 16 nt, Human
uccaaaguacacuguu

SEQ ID NO: 1374999 - RNA, 22 nt, Human
uccagauaguguagcugaggag

SEQ ID NO: 1375000 - RNA, 15 nt, Human
uccagauaguguagc

SEQ ID NO: 1375001 - RNA, 20 nt, Human
uccagaaagccccacccagg

SEQ ID NO: 1375002 - RNA, 21 nt, Human
uccagagucccugccuggacc

SEQ ID NO: 1375003 - RNA, 20 nt, Human
uccagagucccugccuggac

SEQ ID NO: 1375004 - RNA, 19 nt, Human
uccagagucccugccugga

SEQ ID NO: 1375005 - RNA, 23 nt, Human
uccagaaagccccacccaggcca

SEQ ID NO: 1375006 - RNA, 18 nt, Human
uccagagucccugccugg

SEQ ID NO: 1375007 - RNA, 16 nt, Human
uccagaaagccccacc

SEQ ID NO: 1375008 - RNA, 14 nt, Human
uccagaaagcccca

SEQ ID NO: 1375009 - RNA, 23 nt, Human
uccacuuuguuucguggggaggu

SEQ ID NO: 1375010 - RNA, 22 nt, Human
uccacuuuguuucguggggagg

SEQ ID NO: 1375011 - RNA, 19 nt, Human
uccacuuuguuucgugggg

SEQ ID NO: 1375012 - RNA, 18 nt, Human
uccacuuuguuucguggg

SEQ ID NO: 1375013 - RNA, 15 nt, Human
uccacuuuguuucgu

SEQ ID NO: 1375014 - RNA, 14 nt, Human
uccagaaaacaaaa

SEQ ID NO: 1375015 - RNA, 13 nt, Human
uccagaaaacaaa

SEQ ID NO: 1375016 - RNA, 23 nt, Human
uccagaaagaaaacuuguauuau

SEQ ID NO: 1375017 - RNA, 18 nt, Human
ucccccccaugcacugug

SEQ ID NO: 1375018 - RNA, 17 nt, Human
ucccccccaugcacugu

SEQ ID NO: 1375019 - RNA, 13 nt, Human
ucccccccaugca

SEQ ID NO: 1375020 - RNA, 22 nt, Human
uccccccaucuugcuucccuaa

SEQ ID NO: 1375021 - RNA, 15 nt, Human
uccccccaucuugcu

SEQ ID NO: 1375022 - RNA, 12 nt, Human
uccccccaucuu

SEQ ID NO: 1375023 - RNA, 21 nt, Human
ucccccuguuucagaggcuca

SEQ ID NO: 1375024 - RNA, 20 nt, Human
ucccuucacaaacccagugu

SEQ ID NO: 1375025 - RNA, 12 nt, Human
ucccuugccuca

SEQ ID NO: 1375026 - RNA, 18 nt, Human
ucccuugccccccuggcc

SEQ ID NO: 1375027 - RNA, 14 nt, Human
ucccuugccccccu

SEQ ID NO: 1375028 - RNA, 15 nt, Human
ucccuuccugccagc

SEQ ID NO: 1375029 - RNA, 10 nt, Human
ucccuucaua

SEQ ID NO: 1375030 - RNA, 23 nt, Human
ucccuucaguacccucucagcuc

SEQ ID NO: 1375031 - RNA, 21 nt, Human
ucccuucaguacccucucagc

SEQ ID NO: 1375032 - RNA, 20 nt, Human
ucccuucaguacccucucag

SEQ ID NO: 1375033 - RNA, 19 nt, Human
ucccuucaguacccucuca

SEQ ID NO: 1375034 - RNA, 18 nt, Human
ucccuucaguacccucuc

SEQ ID NO: 1375035 - RNA, 16 nt, Human
ucccuucaguacccuc

SEQ ID NO: 1375036 - RNA, 14 nt, Human
ucccuucauacuug

SEQ ID NO: 1375037 - RNA, 16 nt, Human
ucccuucauacuugaa

SEQ ID NO: 1375038 - RNA, 15 nt, Human
uccgcaggugcuggu

SEQ ID NO: 1375039 - RNA, 23 nt, Human
uccgcagcccccacccccaaggu

SEQ ID NO: 1375040 - RNA, 20 nt, Human
ucccuugccucaaugccagu

SEQ ID NO: 1375041 - RNA, 19 nt, Human
uccgccacuggggcucaga

SEQ ID NO: 1375042 - RNA, 21 nt, Human
uccgccacuggggcucagagc

SEQ ID NO: 1375043 - RNA, 15 nt, Human
uccgccacuggggcu

SEQ ID NO: 1375044 - RNA, 14 nt, Human
uccgccacuggggc

SEQ ID NO: 1375045 - RNA, 18 nt, Human
uccgcaggugcugguccc

SEQ ID NO: 1375046 - RNA, 16 nt, Human
uccgcaggugcugguc

SEQ ID NO: 1375047 - RNA, 20 nt, Human
uccgcuuggagcuauuuucc

SEQ ID NO: 1375048 - RNA, 16 nt, Human
uccgccuggccuggcc

SEQ ID NO: 1375049 - RNA, 15 nt, Human
uccgcuauccaccaa

SEQ ID NO: 1375050 - RNA, 19 nt, Human
uccucauuguaaacaaacu

SEQ ID NO: 1375051 - RNA, 22 nt, Human
uccucauuuuuauaaugucccu

SEQ ID NO: 1375052 - RNA, 22 nt, Human
uccuccaacaccaagcacagca

SEQ ID NO: 1375053 - RNA, 17 nt, Human
uccuccaacaccaagca

SEQ ID NO: 1375054 - RNA, 19 nt, Human
uccuccacguucugcucau

SEQ ID NO: 1375055 - RNA, 17 nt, Human
uccuccaccucaacucc

SEQ ID NO: 1375056 - RNA, 16 nt, Human
uccuccagggacagca

SEQ ID NO: 1375057 - RNA, 14 nt, Human
uccuccagggacag

SEQ ID NO: 1375058 - RNA, 15 nt, Human
uccuccaggaagccu

SEQ ID NO: 1375059 - RNA, 17 nt, Human
uccuccagccccuguag

SEQ ID NO: 1375060 - RNA, 13 nt, Human
uccuccagccccu

SEQ ID NO: 1375061 - RNA, 12 nt, Human
uccuccagcccc

SEQ ID NO: 1375062 - RNA, 12 nt, Human
uccuccacgccu

SEQ ID NO: 1375063 - RNA, 20 nt, Human
uccuccaggguggcagcaac

SEQ ID NO: 1375064 - RNA, 21 nt, Human
uccucccaauuucagacuccc

SEQ ID NO: 1375065 - RNA, 20 nt, Human
uccucccaauuucagacucc

SEQ ID NO: 1375066 - RNA, 12 nt, Human
uccuccauggga

SEQ ID NO: 1375067 - RNA, 21 nt, Human
uccuccaggguggcagcaaca

SEQ ID NO: 1375068 - RNA, 19 nt, Human
uccuaucaccuauuuccau

SEQ ID NO: 1375069 - RNA, 19 nt, Human
uccuacagaaaaaccuugg

SEQ ID NO: 1375070 - RNA, 17 nt, Human
uccuacagaaaaaccuu

SEQ ID NO: 1375071 - RNA, 20 nt, Human
uccuacagaaaaaccuuggg

SEQ ID NO: 1375072 - RNA, 15 nt, Human
uccuacagaaaaacc

SEQ ID NO: 1375073 - RNA, 14 nt, Human
uccuacagaaaaac

SEQ ID NO: 1375074 - RNA, 13 nt, Human
uccuacagaaaaa

SEQ ID NO: 1375075 - RNA, 17 nt, Human
uccuacccccugugccu

SEQ ID NO: 1375076 - RNA, 16 nt, Human
uccuacccccugugcc

SEQ ID NO: 1375077 - RNA, 15 nt, Human
uccuacccccugugc

SEQ ID NO: 1375078 - RNA, 13 nt, Human
uccuacccccugu

SEQ ID NO: 1375079 - RNA, 23 nt, Human
uccuaagggucgaaagcucuaga

SEQ ID NO: 1375080 - RNA, 21 nt, Human
uccuaagggucgaaagcucua

SEQ ID NO: 1375081 - RNA, 20 nt, Human
uccuaagggucgaaagcucu

SEQ ID NO: 1375082 - RNA, 18 nt, Human
uccuaagggucgaaagcu

SEQ ID NO: 1375083 - RNA, 16 nt, Human
uccuaagggucgaaag

SEQ ID NO: 1375084 - RNA, 22 nt, Human
uccgcuuggagcuauuuuccag

SEQ ID NO: 1375085 - RNA, 22 nt, Human
uccuaagcuggagugcaguggc

SEQ ID NO: 1375086 - RNA, 19 nt, Human
uccugagcucagcguggag

SEQ ID NO: 1375087 - RNA, 18 nt, Human
uccugagcucagcgugga

SEQ ID NO: 1375088 - RNA, 14 nt, Human
uccugagcucagcg

SEQ ID NO: 1375089 - RNA, 13 nt, Human
uccugagcucagc

SEQ ID NO: 1375090 - RNA, 12 nt, Human
uccugagcucag

SEQ ID NO: 1375091 - RNA, 17 nt, Human
uccugagccccagggag

SEQ ID NO: 1375092 - RNA, 16 nt, Human
uccugagccccaggga

SEQ ID NO: 1375093 - RNA, 14 nt, Human
uccugagccccagg

SEQ ID NO: 1375094 - RNA, 23 nt, Human
uccugagccagugucaggaggaa

SEQ ID NO: 1375095 - RNA, 18 nt, Human
uccugagaaagcucaaag

SEQ ID NO: 1375096 - RNA, 16 nt, Human
uccugagaaagcucaa

SEQ ID NO: 1375097 - RNA, 15 nt, Human
uccugagaaagcuca

SEQ ID NO: 1375098 - RNA, 24 nt, Human
uccugagaaaaaagguuccgcuug

SEQ ID NO: 1375099 - RNA, 19 nt, Human
uccugagaaaaaagguucc

SEQ ID NO: 1375100 - RNA, 23 nt, Human
uccucuguucaaagcugccuguc

SEQ ID NO: 1375101 - RNA, 19 nt, Human
uccucuguucaaagcugcc

SEQ ID NO: 1375102 - RNA, 20 nt, Human
uccucugugaccaaugucuu

SEQ ID NO: 1375103 - RNA, 21 nt, Human
uccucugugaccaaugucuug

SEQ ID NO: 1375104 - RNA, 19 nt, Human
uccucugugaccaaugucu

SEQ ID NO: 1375105 - RNA, 15 nt, Human
uccucugucucgagc

SEQ ID NO: 1375106 - RNA, 23 nt, Human
uccucugucucgagcgcccugca

SEQ ID NO: 1375107 - RNA, 12 nt, Human
uccuccucugug

SEQ ID NO: 1375108 - RNA, 13 nt, Human
uccuccucuguga

SEQ ID NO: 1375109 - RNA, 11 nt, Human
uccuccucugu

SEQ ID NO: 1375110 - RNA, 20 nt, Human
uccuccucccacccggcugc

SEQ ID NO: 1375111 - RNA, 14 nt, Human
uccuccucccaccc

SEQ ID NO: 1375112 - RNA, 17 nt, Human
uccuccuccagggacag

SEQ ID NO: 1375113 - RNA, 16 nt, Human
uccuccuccagggaca

SEQ ID NO: 1375114 - RNA, 15 nt, Human
uccuccuccagggac

SEQ ID NO: 1375115 - RNA, 14 nt, Human
uccuccuccaggga

SEQ ID NO: 1375116 - RNA, 13 nt, Human
uccuccuccaggg

SEQ ID NO: 1375117 - RNA, 12 nt, Human
uccuccuccagg

SEQ ID NO: 1375118 - RNA, 21 nt, Human
uccucccacccggcugcagag

SEQ ID NO: 1375119 - RNA, 20 nt, Human
uccucccacccggcugcaga

SEQ ID NO: 1375120 - RNA, 15 nt, Human
uccugccccaggccu

SEQ ID NO: 1375121 - RNA, 14 nt, Human
uccugccccaggcc

SEQ ID NO: 1375122 - RNA, 14 nt, Human
uccugccagccccu

SEQ ID NO: 1375123 - RNA, 13 nt, Human
uccugccagcccc

SEQ ID NO: 1375124 - RNA, 21 nt, Human
uccugccccaacuccuuccag

SEQ ID NO: 1375125 - RNA, 22 nt, Human
uccugccacccagccccagcca

SEQ ID NO: 1375126 - RNA, 20 nt, Human
uccugccacccagccccagc

SEQ ID NO: 1375127 - RNA, 16 nt, Human
uccugccacccagccc

SEQ ID NO: 1375128 - RNA, 19 nt, Human
uccuggagcagaagcagca

SEQ ID NO: 1375129 - RNA, 18 nt, Human
uccuggagcagaagcagc

SEQ ID NO: 1375130 - RNA, 16 nt, Human
uccuggagcagaagca

SEQ ID NO: 1375131 - RNA, 14 nt, Human
uccuggagcagaag

SEQ ID NO: 1375132 - RNA, 13 nt, Human
uccuggagcagaa

SEQ ID NO: 1375133 - RNA, 22 nt, Human
uccuggacaugaagauucuuuc

SEQ ID NO: 1375134 - RNA, 21 nt, Human
uccuggacaugaagauucuuu

SEQ ID NO: 1375135 - RNA, 22 nt, Human
uccuggacagcugugccucgcu

SEQ ID NO: 1375136 - RNA, 19 nt, Human
uccuggacagcugugccuc

SEQ ID NO: 1375137 - RNA, 18 nt, Human
uccuggacagcugugccu

SEQ ID NO: 1375138 - RNA, 14 nt, Human
uccuggaggcccag

SEQ ID NO: 1375139 - RNA, 13 nt, Human
uccuggaggccca

SEQ ID NO: 1375140 - RNA, 19 nt, Human
uccuggagcagaccacccc

SEQ ID NO: 1375141 - RNA, 18 nt, Human
uccuggagcagaccaccc

SEQ ID NO: 1375142 - RNA, 20 nt, Human
uccuggagcagaagcagcaa

SEQ ID NO: 1375143 - RNA, 18 nt, Human
uccuggaggcccaguuca

SEQ ID NO: 1375144 - RNA, 15 nt, Human
uccuggaggcccagu

SEQ ID NO: 1375145 - RNA, 17 nt, Human
uccugccggcuccuugg

SEQ ID NO: 1375146 - RNA, 14 nt, Human
uccugccggcuccu

SEQ ID NO: 1375147 - RNA, 23 nt, Human
uccugucucccuccucugcccgg

SEQ ID NO: 1375148 - RNA, 15 nt, Human
uccugucucccuccu

SEQ ID NO: 1375149 - RNA, 12 nt, Human
uccuggcgccug

SEQ ID NO: 1375150 - RNA, 14 nt, Human
uccuggccgccugg

SEQ ID NO: 1375151 - RNA, 22 nt, Human
uccuggaugauacuaauaaacu

SEQ ID NO: 1375152 - RNA, 17 nt, Human
uccuggcccagccuuug

SEQ ID NO: 1375153 - RNA, 17 nt, Human
uccuggcaauagucaaa

SEQ ID NO: 1375154 - RNA, 23 nt, Human
uccuuagccuggaccucugacag

SEQ ID NO: 1375155 - RNA, 22 nt, Human
uccuuagccuggaccucugaca

SEQ ID NO: 1375156 - RNA, 21 nt, Human
uccuuagccuggaccucugac

SEQ ID NO: 1375157 - RNA, 15 nt, Human
uccuuagccuggacc

SEQ ID NO: 1375158 - RNA, 14 nt, Human
uccuuagccuggac

SEQ ID NO: 1375159 - RNA, 13 nt, Human
uccuuagccugga

SEQ ID NO: 1375160 - RNA, 17 nt, Human
uccuuagaucuggcaug

SEQ ID NO: 1375161 - RNA, 18 nt, Human
uccuuagaucuggcaugu

SEQ ID NO: 1375162 - RNA, 18 nt, Human
uccuuagacucuuuuccu

SEQ ID NO: 1375163 - RNA, 19 nt, Human
uccuuagaaaaaaaauuau

SEQ ID NO: 1375164 - RNA, 18 nt, Human
ucggauccagggaggcug

SEQ ID NO: 1375165 - RNA, 14 nt, Human
ucggauuuuuucca

SEQ ID NO: 1375166 - RNA, 13 nt, Human
ucggauuuuuucc

SEQ ID NO: 1375167 - RNA, 10 nt, Human
ucggauuaga

SEQ ID NO: 1375168 - RNA, 17 nt, Human
ucggauuuuuuccaaaa

SEQ ID NO: 1375169 - RNA, 16 nt, Human
ucggauuuuuuccaaa

SEQ ID NO: 1375170 - RNA, 16 nt, Human
ucgugaaaacacauuu

SEQ ID NO: 1375171 - RNA, 20 nt, Human
ucgucuuucccauggggagg

SEQ ID NO: 1375172 - RNA, 18 nt, Human
ucgucuuucccaugggga

SEQ ID NO: 1375173 - RNA, 15 nt, Human
ucgucuuucccaugg

SEQ ID NO: 1375174 - RNA, 21 nt, Human
ucuaaaguucuaagauucuga

SEQ ID NO: 1375175 - RNA, 20 nt, Human
ucuaaaguucuaagauucug

SEQ ID NO: 1375176 - RNA, 19 nt, Human
ucuaaaguucuaagauucu

SEQ ID NO: 1375177 - RNA, 18 nt, Human
ucuaaaguucuaagauuc

SEQ ID NO: 1375178 - RNA, 17 nt, Human
ucuaaaguucuaagauu

SEQ ID NO: 1375179 - RNA, 16 nt, Human
ucuaaaguucuaagau

SEQ ID NO: 1375180 - RNA, 15 nt, Human
ucuaaaguucuaaga

SEQ ID NO: 1375181 - RNA, 14 nt, Human
ucuaaaguucuaag

SEQ ID NO: 1375182 - RNA, 13 nt, Human
ucuaaaguucuaa

SEQ ID NO: 1375183 - RNA, 12 nt, Human
ucuaaaguucua

SEQ ID NO: 1375184 - RNA, 11 nt, Human
ucuaaaguucu

SEQ ID NO: 1375185 - RNA, 23 nt, Human
ucuaaagguccacaggucuagac

SEQ ID NO: 1375186 - RNA, 22 nt, Human
ucuaaagguccacaggucuaga

SEQ ID NO: 1375187 - RNA, 17 nt, Human
ucuaaagguccacaggu

SEQ ID NO: 1375188 - RNA, 15 nt, Human
ucuaaagguccacag

SEQ ID NO: 1375189 - RNA, 14 nt, Human
ucuaaagguccaca

SEQ ID NO: 1375190 - RNA, 18 nt, Human
ucuaaaggcuaccuuugu

SEQ ID NO: 1375191 - RNA, 17 nt, Human
ucuaaaggcuaccuuug

SEQ ID NO: 1375192 - RNA, 19 nt, Human
ucuaaaggcuaccuuugua

SEQ ID NO: 1375193 - RNA, 20 nt, Human
ucuaaaggcuaccuuuguau

SEQ ID NO: 1375194 - RNA, 24 nt, Human
ucguggagagcuaggagcaaagcc

SEQ ID NO: 1375195 - RNA, 17 nt, Human
ucgugaccugcuaggcc

SEQ ID NO: 1375196 - RNA, 21 nt, Human
ucgugaccugcuaggccagag

SEQ ID NO: 1375197 - RNA, 18 nt, Human
ucguggacacacacagac

SEQ ID NO: 1375198 - RNA, 12 nt, Human
ucguggacaccu

SEQ ID NO: 1375199 - RNA, 13 nt, Human
ucguggacaccug

SEQ ID NO: 1375200 - RNA, 14 nt, Human
ucguggacaccugc

SEQ ID NO: 1375201 - RNA, 15 nt, Human
ucguggacaccugcc

SEQ ID NO: 1375202 - RNA, 16 nt, Human
ucguggacaccugccc

SEQ ID NO: 1375203 - RNA, 18 nt, Human
ucguggagagcuaggagc

SEQ ID NO: 1375204 - RNA, 16 nt, Human
ucguggagagcuagga

SEQ ID NO: 1375205 - RNA, 12 nt, Human
ucguggagagcu

SEQ ID NO: 1375206 - RNA, 10 nt, Human
ucguggagag

SEQ ID NO: 1375207 - RNA, 22 nt, Human
ucguggacugagugggaagccc

SEQ ID NO: 1375208 - RNA, 20 nt, Human
ucguggacugagugggaagc

SEQ ID NO: 1375209 - RNA, 22 nt, Human
ucguggacacacacagacuauu

SEQ ID NO: 1375210 - RNA, 17 nt, Human
ucguggacaccugcccu

SEQ ID NO: 1375211 - RNA, 18 nt, Human
ucguggacaccugcccug

SEQ ID NO: 1375212 - RNA, 19 nt, Human
ucguggacaccugcccugc

SEQ ID NO: 1375213 - RNA, 20 nt, Human
ucguggacaccugcccugcc

SEQ ID NO: 1375214 - RNA, 12 nt, Human
ucuaucauuuaa

SEQ ID NO: 1375215 - RNA, 13 nt, Human
ucuaucauuuaau

SEQ ID NO: 1375216 - RNA, 14 nt, Human
ucuaucauuuaaua

SEQ ID NO: 1375217 - RNA, 15 nt, Human
ucuaucauuuaauaa

SEQ ID NO: 1375218 - RNA, 16 nt, Human
ucuaucauuuaauaau

SEQ ID NO: 1375219 - RNA, 17 nt, Human
ucuaucauuuaauaaua

SEQ ID NO: 1375220 - RNA, 18 nt, Human
ucuaucauuuaauaauau

SEQ ID NO: 1375221 - RNA, 22 nt, Human
ucuaucauuuaauaauauacuu

SEQ ID NO: 1375222 - RNA, 17 nt, Human
ucuaugacacaugcaag

SEQ ID NO: 1375223 - RNA, 14 nt, Human
ucuaugacacaugc

SEQ ID NO: 1375224 - RNA, 19 nt, Human
ucuacuuccaaacuaauuu

SEQ ID NO: 1375225 - RNA, 14 nt, Human
ucuacuuccccaug

SEQ ID NO: 1375226 - RNA, 22 nt, Human
ucuacuuccaaacuaauuuuua

SEQ ID NO: 1375227 - RNA, 21 nt, Human
ucuacuuaauccaauggguuu

SEQ ID NO: 1375228 - RNA, 23 nt, Human
ucuacuggucuuguggaauuggg

SEQ ID NO: 1375229 - RNA, 20 nt, Human
ucuacuggucuuguggaauu

SEQ ID NO: 1375230 - RNA, 16 nt, Human
ucuacuggucuugugg

SEQ ID NO: 1375231 - RNA, 20 nt, Human
ucuacugggaaggcuacuuc

SEQ ID NO: 1375232 - RNA, 20 nt, Human
ucuaccuucuccccagcucc

SEQ ID NO: 1375233 - RNA, 23 nt, Human
ucuaccuucuccccagcucccag

SEQ ID NO: 1375234 - RNA, 18 nt, Human
ucuaccuucuccccagcu

SEQ ID NO: 1375235 - RNA, 16 nt, Human
ucuaccuucuccccag

SEQ ID NO: 1375236 - RNA, 15 nt, Human
ucuaccuucucccca

SEQ ID NO: 1375237 - RNA, 19 nt, Human
ucuacagagcuucccugac

SEQ ID NO: 1375238 - RNA, 18 nt, Human
ucuacagagcuucccuga

SEQ ID NO: 1375239 - RNA, 17 nt, Human
ucuacagagcuucccug

SEQ ID NO: 1375240 - RNA, 16 nt, Human
ucuacagagcuucccu

SEQ ID NO: 1375241 - RNA, 16 nt, Human
ucuacacauacaugua

SEQ ID NO: 1375242 - RNA, 21 nt, Human
ucuacaacucauacacucgua

SEQ ID NO: 1375243 - RNA, 17 nt, Human
ucuacaacucauacacu

SEQ ID NO: 1375244 - RNA, 17 nt, Human
ucuacacuaagagagaa

SEQ ID NO: 1375245 - RNA, 20 nt, Human
ucucaugccaguaacaggcu

SEQ ID NO: 1375246 - RNA, 12 nt, Human
ucucaugccagu

SEQ ID NO: 1375247 - RNA, 22 nt, Human
ucucaugaaccucaagcugcau

SEQ ID NO: 1375248 - RNA, 21 nt, Human
ucucaugccccuggcugggac

SEQ ID NO: 1375249 - RNA, 18 nt, Human
ucucaugccccuggcugg

SEQ ID NO: 1375250 - RNA, 14 nt, Human
ucucaugaaccuca

SEQ ID NO: 1375251 - RNA, 13 nt, Human
ucucaugaaccuc

SEQ ID NO: 1375252 - RNA, 11 nt, Human
ucucaucuggg

SEQ ID NO: 1375253 - RNA, 22 nt, Human
ucucaucuggggagcaggcagc

SEQ ID NO: 1375254 - RNA, 18 nt, Human
ucucaucucuucuuuuaa

SEQ ID NO: 1375255 - RNA, 20 nt, Human
ucucaucucagugaagaaua

SEQ ID NO: 1375256 - RNA, 19 nt, Human
ucucaucucagugaagaau

SEQ ID NO: 1375257 - RNA, 15 nt, Human
ucucauccugcaggc

SEQ ID NO: 1375258 - RNA, 13 nt, Human
ucucauccugcag

SEQ ID NO: 1375259 - RNA, 16 nt, Human
ucuaugagucuagaug

SEQ ID NO: 1375260 - RNA, 15 nt, Human
ucuaugagucuagau

SEQ ID NO: 1375261 - RNA, 14 nt, Human
ucuaugagucuaga

SEQ ID NO: 1375262 - RNA, 13 nt, Human
ucucagucucuga

SEQ ID NO: 1375263 - RNA, 11 nt, Human
ucucagucucu

SEQ ID NO: 1375264 - RNA, 17 nt, Human
ucucagucucugagcag

SEQ ID NO: 1375265 - RNA, 15 nt, Human
ucucagucucugagc

SEQ ID NO: 1375266 - RNA, 18 nt, Human
ucucagucucugagcagu

SEQ ID NO: 1375267 - RNA, 15 nt, Human
ucucagucugucacc

SEQ ID NO: 1375268 - RNA, 16 nt, Human
ucucagugaagaauac

SEQ ID NO: 1375269 - RNA, 16 nt, Human
ucucauacccucccuc

SEQ ID NO: 1375270 - RNA, 20 nt, Human
ucucccuggaaugaguugag

SEQ ID NO: 1375271 - RNA, 15 nt, Human
ucucccugccuccug

SEQ ID NO: 1375272 - RNA, 19 nt, Human
ucucccugcauggcauccu

SEQ ID NO: 1375273 - RNA, 15 nt, Human
ucucccugcauggca

SEQ ID NO: 1375274 - RNA, 21 nt, Human
ucucccuccuccaggaagccu

SEQ ID NO: 1375275 - RNA, 18 nt, Human
ucucccuccucugcccgg

SEQ ID NO: 1375276 - RNA, 14 nt, Human
ucuccccugccccc

SEQ ID NO: 1375277 - RNA, 12 nt, Human
ucuccccugccc

SEQ ID NO: 1375278 - RNA, 21 nt, Human
ucuccccugcacuguaaaaug

SEQ ID NO: 1375279 - RNA, 17 nt, Human
ucuccccugcacuguaa

SEQ ID NO: 1375280 - RNA, 16 nt, Human
ucuccccugcacugua

SEQ ID NO: 1375281 - RNA, 15 nt, Human
ucuccccugcacugu

SEQ ID NO: 1375282 - RNA, 14 nt, Human
ucuccccugcacug

SEQ ID NO: 1375283 - RNA, 13 nt, Human
ucuccccugcacu

SEQ ID NO: 1375284 - RNA, 12 nt, Human
ucuccccugcac

SEQ ID NO: 1375285 - RNA, 21 nt, Human
ucucccccaacagcuggaccc

SEQ ID NO: 1375286 - RNA, 17 nt, Human
ucucccccaacagcugg

SEQ ID NO: 1375287 - RNA, 12 nt, Human
ucucccccaaca

SEQ ID NO: 1375288 - RNA, 22 nt, Human
ucuccccagguccagcucugga

SEQ ID NO: 1375289 - RNA, 20 nt, Human
ucuccccagguccagcucug

SEQ ID NO: 1375290 - RNA, 19 nt, Human
ucuccccagguccagcucu

SEQ ID NO: 1375291 - RNA, 15 nt, Human
ucuccaggcaggucu

SEQ ID NO: 1375292 - RNA, 21 nt, Human
ucuccagcugggcucugcaau

SEQ ID NO: 1375293 - RNA, 17 nt, Human
ucuccagaggccaagga

SEQ ID NO: 1375294 - RNA, 18 nt, Human
ucuccagaaagccccacc

SEQ ID NO: 1375295 - RNA, 19 nt, Human
ucuccacuuucagcugucu

SEQ ID NO: 1375296 - RNA, 18 nt, Human
ucuccacuuucagcuguc

SEQ ID NO: 1375297 - RNA, 17 nt, Human
ucuccacuuucagcugu

SEQ ID NO: 1375298 - RNA, 16 nt, Human
ucuccacuuucagcug

SEQ ID NO: 1375299 - RNA, 15 nt, Human
ucuccacuuucagcu

SEQ ID NO: 1375300 - RNA, 14 nt, Human
ucuccacuuucagc

SEQ ID NO: 1375301 - RNA, 16 nt, Human
ucuccagccucagccu

SEQ ID NO: 1375302 - RNA, 19 nt, Human
ucuccagcugggcucugca

SEQ ID NO: 1375303 - RNA, 17 nt, Human
ucuccagcugggcucug

SEQ ID NO: 1375304 - RNA, 11 nt, Human
ucuccagcugg

SEQ ID NO: 1375305 - RNA, 15 nt, Human
ucuccagcugacuaa

SEQ ID NO: 1375306 - RNA, 14 nt, Human
ucuccagcugacua

SEQ ID NO: 1375307 - RNA, 12 nt, Human
ucuccagcugac

SEQ ID NO: 1375308 - RNA, 20 nt, Human
ucuccagcggcccugucauc

SEQ ID NO: 1375309 - RNA, 18 nt, Human
ucuccagcggcccuguca

SEQ ID NO: 1375310 - RNA, 16 nt, Human
ucuccagcggcccugu

SEQ ID NO: 1375311 - RNA, 19 nt, Human
ucuccagccucagccuccc

SEQ ID NO: 1375312 - RNA, 18 nt, Human
ucuccagccucagcucuc

SEQ ID NO: 1375313 - RNA, 15 nt, Human
ugaucuccguggcuu

SEQ ID NO: 1375314 - RNA, 18 nt, Human
ugaucuccguggcuuugg

SEQ ID NO: 1375315 - RNA, 19 nt, Human
ugaucuggaacccagacuc

SEQ ID NO: 1375316 - RNA, 18 nt, Human
ugaucuggaacccagacu

SEQ ID NO: 1375317 - RNA, 17 nt, Human
ugaucuggaacccagac

SEQ ID NO: 1375318 - RNA, 15 nt, Human
ugaucuggaacccag

SEQ ID NO: 1375319 - RNA, 17 nt, Human
ugaucugucuguggcaa

SEQ ID NO: 1375320 - RNA, 14 nt, Human
ugaucugucugugg

SEQ ID NO: 1375321 - RNA, 19 nt, Human
ugaucugucuguggcaaaa

SEQ ID NO: 1375322 - RNA, 14 nt, Human
ugauccaacuaaug

SEQ ID NO: 1375323 - RNA, 13 nt, Human
ugauccaacuaau

SEQ ID NO: 1375324 - RNA, 22 nt, Human
ugaucauguguggaaguuauua

SEQ ID NO: 1375325 - RNA, 14 nt, Human
ugauagauuuucug

SEQ ID NO: 1375326 - RNA, 13 nt, Human
ugauagcaaagcg

SEQ ID NO: 1375327 - RNA, 24 nt, Human
ugaucagcuuauugucuagugaaa

SEQ ID NO: 1375328 - RNA, 18 nt, Human
ugauagcaaauggccuca

SEQ ID NO: 1375329 - RNA, 16 nt, Human
ugaucagccccacccu

SEQ ID NO: 1375330 - RNA, 17 nt, Human
ugaucagcuuauugucu

SEQ ID NO: 1375331 - RNA, 14 nt, Human
ugaugccucugucu

SEQ ID NO: 1375332 - RNA, 23 nt, Human
ugaugcaugcacuguucccccug

SEQ ID NO: 1375333 - RNA, 18 nt, Human
ugaugcaugcacuguucc

SEQ ID NO: 1375334 - RNA, 17 nt, Human
ugaugcaugcacuguuc

SEQ ID NO: 1375335 - RNA, 22 nt, Human
ugaugcaucagaaagggagggc

SEQ ID NO: 1375336 - RNA, 21 nt, Human
ugaugcaucagaaagggaggg

SEQ ID NO: 1375337 - RNA, 21 nt, Human
ugaugcagcuuauacgaaaua

SEQ ID NO: 1375338 - RNA, 20 nt, Human
ugaugauuuagagugcuguc

SEQ ID NO: 1375339 - RNA, 21 nt, Human
ugaugccucugucuucuggac

SEQ ID NO: 1375340 - RNA, 23 nt, Human
ugaugcuacaggauuugaaauug

SEQ ID NO: 1375341 - RNA, 20 nt, Human
ugaugcuacaggauuugaaa

SEQ ID NO: 1375342 - RNA, 11 nt, Human
ugaugccuggc

SEQ ID NO: 1375343 - RNA, 19 nt, Human
ugaugucauacagagaagu

SEQ ID NO: 1375344 - RNA, 18 nt, Human
ugaugucauacagagaag

SEQ ID NO: 1375345 - RNA, 17 nt, Human
ugaugucauacagagaa

SEQ ID NO: 1375346 - RNA, 16 nt, Human
ugaugucauacagaga

SEQ ID NO: 1375347 - RNA, 15 nt, Human
ugaugucauacagag

SEQ ID NO: 1375348 - RNA, 14 nt, Human
ugaugucauacaga

SEQ ID NO: 1375349 - RNA, 23 nt, Human
ugaugucaauuucuguguugcca

SEQ ID NO: 1375350 - RNA, 19 nt, Human
ugaugucaauuucuguguu

SEQ ID NO: 1375351 - RNA, 18 nt, Human
ugaugucaauuucugugu

SEQ ID NO: 1375352 - RNA, 21 nt, Human
ugaugucauacagagaaguca

SEQ ID NO: 1375353 - RNA, 20 nt, Human
ugaugucauacagagaaguc

SEQ ID NO: 1375354 - RNA, 22 nt, Human
ugaugucauacagagaagucac

SEQ ID NO: 1375355 - RNA, 23 nt, Human
ugauguuaaaaaaauaagaagaa

SEQ ID NO: 1375356 - RNA, 14 nt, Human
ugauguuaaaaaaa

SEQ ID NO: 1375357 - RNA, 13 nt, Human
ugauguuaaaaaa

SEQ ID NO: 1375358 - RNA, 12 nt, Human
ugauguuaaaaa

SEQ ID NO: 1375359 - RNA, 13 nt, Human
ugaugguuguaca

SEQ ID NO: 1375360 - RNA, 14 nt, Human
ugaugguuguacau

SEQ ID NO: 1375361 - RNA, 17 nt, Human
ugaugucaauuucugug

SEQ ID NO: 1375362 - RNA, 21 nt, Human
ugaugguuguacauauaagug

SEQ ID NO: 1375363 - RNA, 22 nt, Human
ugauucagaaaauguucuguuu

SEQ ID NO: 1375364 - RNA, 21 nt, Human
ugauucagaaaauguucuguu

SEQ ID NO: 1375365 - RNA, 20 nt, Human
ugauucagaaaauguucugu

SEQ ID NO: 1375366 - RNA, 19 nt, Human
ugauucagaaaauguucug

SEQ ID NO: 1375367 - RNA, 18 nt, Human
ugauucagaaaauguucu

SEQ ID NO: 1375368 - RNA, 16 nt, Human
ugauucaccucuucuu

SEQ ID NO: 1375369 - RNA, 16 nt, Human
ugauucacaucucauu

SEQ ID NO: 1375370 - RNA, 23 nt, Human
ugauucaaucuguaaacugugua

SEQ ID NO: 1375371 - RNA, 22 nt, Human
ugauucaaucuguaaacugugu

SEQ ID NO: 1375372 - RNA, 21 nt, Human
ugauucaaucuguaaacugug

SEQ ID NO: 1375373 - RNA, 17 nt, Human
ugauucaaucuguaaac

SEQ ID NO: 1375374 - RNA, 16 nt, Human
ugauucaaucuguaaa

SEQ ID NO: 1375375 - RNA, 16 nt, Human
ugauuauucaguguca

SEQ ID NO: 1375376 - RNA, 14 nt, Human
ugauuauucagugu

SEQ ID NO: 1375377 - RNA, 20 nt, Human
ugauuauuaacgauguccaa

SEQ ID NO: 1375378 - RNA, 22 nt, Human
ugauuaugaauuacauuuguau

SEQ ID NO: 1375379 - RNA, 21 nt, Human
ugauuaugaauuacauuugua

SEQ ID NO: 1375380 - RNA, 17 nt, Human
ugauguucuaaggcucu

SEQ ID NO: 1375381 - RNA, 15 nt, Human
ugauguucuaaggcu

SEQ ID NO: 1375382 - RNA, 14 nt, Human
ugauguucuaaggc

SEQ ID NO: 1375383 - RNA, 12 nt, Human
ugauguucuaag

SEQ ID NO: 1375384 - RNA, 13 nt, Human
ugauguuccuucc

SEQ ID NO: 1375385 - RNA, 22 nt, Human
ugauguucuaaggcucugagag

SEQ ID NO: 1375386 - RNA, 21 nt, Human
ugauguucuaaggcucugaga

SEQ ID NO: 1375387 - RNA, 20 nt, Human
ugauguucuaaggcucugag

SEQ ID NO: 1375388 - RNA, 19 nt, Human
ugauguucuaaggcucuga

SEQ ID NO: 1375389 - RNA, 18 nt, Human
ugauguucuaaggcucug

SEQ ID NO: 1375390 - RNA, 22 nt, Human
ugauguuuagaaacacaacuau

SEQ ID NO: 1375391 - RNA, 16 nt, Human
ugauuagacagaacac

SEQ ID NO: 1375392 - RNA, 15 nt, Human
ugauuagacagaaca

SEQ ID NO: 1375393 - RNA, 13 nt, Human
ugauuagacagaa

SEQ ID NO: 1375394 - RNA, 23 nt, Human
ugauuagaaauuaccuguggaua

SEQ ID NO: 1375395 - RNA, 23 nt, Human
ugauuacuggccuuuuucauuua

SEQ ID NO: 1375396 - RNA, 21 nt, Human
ugauuacuggccuuuuucauu

SEQ ID NO: 1375397 - RNA, 20 nt, Human
ugauuacuggccuuuuucau

SEQ ID NO: 1375398 - RNA, 17 nt, Human
ugauuagacagaacacc

SEQ ID NO: 1375399 - RNA, 19 nt, Human
ugauuaugaauuacauuug

SEQ ID NO: 1375400 - RNA, 17 nt, Human
ugauuaugaauuacauu

SEQ ID NO: 1375401 - RNA, 13 nt, Human
ugauuauauguca

SEQ ID NO: 1375402 - RNA, 18 nt, Human
ugauuguggaauggagau

SEQ ID NO: 1375403 - RNA, 14 nt, Human
ugauuguggaaugg

SEQ ID NO: 1375404 - RNA, 14 nt, Human
ugauugucuuaaua

SEQ ID NO: 1375405 - RNA, 13 nt, Human
ugauugucuuaau

SEQ ID NO: 1375406 - RNA, 16 nt, Human
ugauuguauuguugaa

SEQ ID NO: 1375407 - RNA, 20 nt, Human
ugauuguaguaaucugcauu

SEQ ID NO: 1375408 - RNA, 18 nt, Human
ugauugucuuaauauugu

SEQ ID NO: 1375409 - RNA, 21 nt, Human
ugauuguggaauggagauuca

SEQ ID NO: 1375410 - RNA, 21 nt, Human
ugauuggccuguagaguugcu

SEQ ID NO: 1375411 - RNA, 15 nt, Human
ugauugaugacccuu

SEQ ID NO: 1375412 - RNA, 14 nt, Human
ugauugauuugaag

SEQ ID NO: 1375413 - RNA, 12 nt, Human
ugauugauuuga

SEQ ID NO: 1375414 - RNA, 13 nt, Human
ugauucugccuuu

SEQ ID NO: 1375415 - RNA, 12 nt, Human
ugauucugccuu

SEQ ID NO: 1375416 - RNA, 22 nt, Human
ugauucugcaguaaaucuuuua

SEQ ID NO: 1375417 - RNA, 16 nt, Human
ugauucugcaguaaau

SEQ ID NO: 1375418 - RNA, 18 nt, Human
ugagcuggaccucaccaa

SEQ ID NO: 1375419 - RNA, 20 nt, Human
ugagcucuauuaugaaugug

SEQ ID NO: 1375420 - RNA, 22 nt, Human
ugagcuccuguccccugcuaca

SEQ ID NO: 1375421 - RNA, 21 nt, Human
ugagcuccuguccccugcuac

SEQ ID NO: 1375422 - RNA, 21 nt, Human
ugagcuccuuaaggcucuuuu

SEQ ID NO: 1375423 - RNA, 19 nt, Human
ugagcuccuuaaggcucuu

SEQ ID NO: 1375424 - RNA, 20 nt, Human
ugagcuccuguccccugcua

SEQ ID NO: 1375425 - RNA, 18 nt, Human
ugagcuccuguccccugc

SEQ ID NO: 1375426 - RNA, 13 nt, Human
ugagccugccgag

SEQ ID NO: 1375427 - RNA, 15 nt, Human
ugagccccuggaggc

SEQ ID NO: 1375428 - RNA, 14 nt, Human
ugagccccagggag

SEQ ID NO: 1375429 - RNA, 15 nt, Human
ugagcaucacagaau

SEQ ID NO: 1375430 - RNA, 14 nt, Human
ugagcaucacagaa

SEQ ID NO: 1375431 - RNA, 13 nt, Human
ugagcaucacaga

SEQ ID NO: 1375432 - RNA, 18 nt, Human
ugagcaucacagaaugug

SEQ ID NO: 1375433 - RNA, 12 nt, Human
ugagcaucacag

SEQ ID NO: 1375434 - RNA, 23 nt, Human
ugagcauaggugauccauguaac

SEQ ID NO: 1375435 - RNA, 21 nt, Human
ugagcauaggugauccaugua

SEQ ID NO: 1375436 - RNA, 13 nt, Human
ugagcauagguga

SEQ ID NO: 1375437 - RNA, 15 nt, Human
ugagcaguggcuggu

SEQ ID NO: 1375438 - RNA, 14 nt, Human
ugagcaguggcugg

SEQ ID NO: 1375439 - RNA, 13 nt, Human
ugagcaguggcug

SEQ ID NO: 1375440 - RNA, 12 nt, Human
ugagcaguggcu

SEQ ID NO: 1375441 - RNA, 22 nt, Human
ugagcaguggcugguccagggc

SEQ ID NO: 1375442 - RNA, 18 nt, Human
ugagcaguggcuggucca

SEQ ID NO: 1375443 - RNA, 20 nt, Human
ugagcaguccuuggccugcu

SEQ ID NO: 1375444 - RNA, 19 nt, Human
ugagauauuaaugcccaga

SEQ ID NO: 1375445 - RNA, 20 nt, Human
ugagauauuaaugcccagac

SEQ ID NO: 1375446 - RNA, 13 nt, Human
ugagauauuaaug

SEQ ID NO: 1375447 - RNA, 12 nt, Human
ugagauauuaau

SEQ ID NO: 1375448 - RNA, 21 nt, Human
ugagauaguuuucauccauaa

SEQ ID NO: 1375449 - RNA, 18 nt, Human
ugagauaguuuucaucca

SEQ ID NO: 1375450 - RNA, 17 nt, Human
ugagauaguuuucaucc

SEQ ID NO: 1375451 - RNA, 16 nt, Human
ugagauaguuuucauc

SEQ ID NO: 1375452 - RNA, 13 nt, Human
ugagagugugacc

SEQ ID NO: 1375453 - RNA, 19 nt, Human
ugagaguuuuggaugcagu

SEQ ID NO: 1375454 - RNA, 17 nt, Human
ugagaguuuuggaugca

SEQ ID NO: 1375455 - RNA, 14 nt, Human
ugagagugugacca

SEQ ID NO: 1375456 - RNA, 15 nt, Human
ugagaguuuuggaug

SEQ ID NO: 1375457 - RNA, 12 nt, Human
ugagagugugac

SEQ ID NO: 1375458 - RNA, 16 nt, Human
ugagagucuagauucu

SEQ ID NO: 1375459 - RNA, 17 nt, Human
ugagagucuagauucuc

SEQ ID NO: 1375460 - RNA, 15 nt, Human
ugagagucuagauuc

SEQ ID NO: 1375461 - RNA, 14 nt, Human
ugagagucuagauu

SEQ ID NO: 1375462 - RNA, 13 nt, Human
ugagagucuagau

SEQ ID NO: 1375463 - RNA, 21 nt, Human
ugagacuaaucuuauucauuu

SEQ ID NO: 1375464 - RNA, 19 nt, Human
ugaccggacuuuucugcaa

SEQ ID NO: 1375465 - RNA, 16 nt, Human
ugaccggacuuuucug

SEQ ID NO: 1375466 - RNA, 19 nt, Human
ugaccgcgacuaauuucaa

SEQ ID NO: 1375467 - RNA, 21 nt, Human
ugaccucaggcaaucugcccg

SEQ ID NO: 1375468 - RNA, 16 nt, Human
ugagaaccuggccuuc

SEQ ID NO: 1375469 - RNA, 15 nt, Human
ugagaaccuggccuu

SEQ ID NO: 1375470 - RNA, 14 nt, Human
ugagaaccuggccu

SEQ ID NO: 1375471 - RNA, 12 nt, Human
ugagaaccuggc

SEQ ID NO: 1375472 - RNA, 20 nt, Human
ugagaaccguagaugauuuc

SEQ ID NO: 1375473 - RNA, 20 nt, Human
ugaccucaggcaaucugccc

SEQ ID NO: 1375474 - RNA, 18 nt, Human
ugagaaauuuaaacuaua

SEQ ID NO: 1375475 - RNA, 17 nt, Human
ugagaaauuuauaaacu

SEQ ID NO: 1375476 - RNA, 22 nt, Human
ugagacuaaucuuauucauuuu

SEQ ID NO: 1375477 - RNA, 17 nt, Human
ugagacuccagaccuga

SEQ ID NO: 1375478 - RNA, 22 nt, Human
ugagaaccuggguugcagacag

SEQ ID NO: 1375479 - RNA, 23 nt, Human
ugagaaccuggguugcagacagg

SEQ ID NO: 1375480 - RNA, 21 nt, Human
ugagaaccuggguugcagaca

SEQ ID NO: 1375481 - RNA, 12 nt, Human
ugagaaccuggg

SEQ ID NO: 1375482 - RNA, 14 nt, Human
ugagaccacuguua

SEQ ID NO: 1375483 - RNA, 12 nt, Human
ugagaccaccuc

SEQ ID NO: 1375484 - RNA, 15 nt, Human
ugagaccaccucuca

SEQ ID NO: 1375485 - RNA, 20 nt, Human
ugagacccagcccucauccc

SEQ ID NO: 1375486 - RNA, 18 nt, Human
ugagacccagcccucauc

SEQ ID NO: 1375487 - RNA, 19 nt, Human
ugagaccaccucucaauau

SEQ ID NO: 1375488 - RNA, 15 nt, Human
ugagugaauaaaugu

SEQ ID NO: 1375489 - RNA, 21 nt, Human
ugagucuuugguucuaaggac

SEQ ID NO: 1375490 - RNA, 20 nt, Human
ugagucuuugguucuaagga

SEQ ID NO: 1375491 - RNA, 18 nt, Human
ugagucuuugguucuaag

SEQ ID NO: 1375492 - RNA, 17 nt, Human
ugagucuuugguucuaa

SEQ ID NO: 1375493 - RNA, 16 nt, Human
ugagucuuugguucua

SEQ ID NO: 1375494 - RNA, 15 nt, Human
ugagucucucugggc

SEQ ID NO: 1375495 - RNA, 15 nt, Human
ugagucuagauguuu

SEQ ID NO: 1375496 - RNA, 17 nt, Human
ugagucgugaccugcua

SEQ ID NO: 1375497 - RNA, 19 nt, Human
ugagucguacagaaagcug

SEQ ID NO: 1375498 - RNA, 17 nt, Human
ugagucguacagaaagc

SEQ ID NO: 1375499 - RNA, 15 nt, Human
ugaguucucccugua

SEQ ID NO: 1375500 - RNA, 14 nt, Human
ugagugagcaugcc

SEQ ID NO: 1375501 - RNA, 18 nt, Human
ugaguuuuguguuuguug

SEQ ID NO: 1375502 - RNA, 21 nt, Human
ugaguuuuguguuuguuguag

SEQ ID NO: 1375503 - RNA, 17 nt, Human
ugaguuuuguguuuguu

SEQ ID NO: 1375504 - RNA, 13 nt, Human
ugaguuuuccaug

SEQ ID NO: 1375505 - RNA, 19 nt, Human
ugaguuuuccauggcagga

SEQ ID NO: 1375506 - RNA, 20 nt, Human
ugaguuugucgcucaugugu

SEQ ID NO: 1375507 - RNA, 19 nt, Human
ugaguuugucgcucaugug

SEQ ID NO: 1375508 - RNA, 16 nt, Human
ugauaacuggaaacuu

SEQ ID NO: 1375509 - RNA, 17 nt, Human
ugaggucucagccccuu

SEQ ID NO: 1375510 - RNA, 15 nt, Human
ugaggucucagcccc

SEQ ID NO: 1375511 - RNA, 14 nt, Human
ugaggucucagccc

SEQ ID NO: 1375512 - RNA, 13 nt, Human
ugaggucucagcc

SEQ ID NO: 1375513 - RNA, 22 nt, Human
ugagguccugagcacugccagg

SEQ ID NO: 1375514 - RNA, 21 nt, Human
ugagguccugagcacugccag

SEQ ID NO: 1375515 - RNA, 20 nt, Human
ugagguccugagcacugcca

SEQ ID NO: 1375516 - RNA, 23 nt, Human
ugagguccugagcacugccagga

SEQ ID NO: 1375517 - RNA, 19 nt, Human
ugagguccugagcacugcc

SEQ ID NO: 1375518 - RNA, 18 nt, Human
ugagguccugagcacugc

SEQ ID NO: 1375519 - RNA, 17 nt, Human
ugagguccugagcacug

SEQ ID NO: 1375520 - RNA, 16 nt, Human
ugagguccugagcacu

SEQ ID NO: 1375521 - RNA, 15 nt, Human
ugagguccugagcac

SEQ ID NO: 1375522 - RNA, 14 nt, Human
ugagguccugagca

SEQ ID NO: 1375523 - RNA, 13 nt, Human
ugagguccugagc

SEQ ID NO: 1375524 - RNA, 16 nt, Human
ugaggucucagccccu

SEQ ID NO: 1375525 - RNA, 14 nt, Human
ugagggagccuggc

SEQ ID NO: 1375526 - RNA, 17 nt, Human
ugagggagaacaagacc

SEQ ID NO: 1375527 - RNA, 12 nt, Human
ugaggcauuugu

SEQ ID NO: 1375528 - RNA, 19 nt, Human
ugaggcauuuguuugaacu

SEQ ID NO: 1375529 - RNA, 20 nt, Human
ugaggcauuuguuugaacug

SEQ ID NO: 1375530 - RNA, 21 nt, Human
ugaggcauuuguuugaacuga

SEQ ID NO: 1375531 - RNA, 23 nt, Human
ugaggcauuuguuugaacugaua

SEQ ID NO: 1375532 - RNA, 20 nt, Human
ugaggagcuggggaucccuc

SEQ ID NO: 1375533 - RNA, 13 nt, Human
ugaggagcugggg

SEQ ID NO: 1375534 - RNA, 12 nt, Human
ugaggagcuggg

SEQ ID NO: 1375535 - RNA, 22 nt, Human
ugagcuggggaccugguacccu

SEQ ID NO: 1375536 - RNA, 16 nt, Human
ugaggagcuugaaacc

SEQ ID NO: 1375537 - RNA, 23 nt, Human
ugaaagccaaggagucacugaga

SEQ ID NO: 1375538 - RNA, 13 nt, Human
ugaaagccaugga

SEQ ID NO: 1375539 - RNA, 16 nt, Human
ugaaagccauggagau

SEQ ID NO: 1375540 - RNA, 20 nt, Human
ugaaaccccuguaggccuca

SEQ ID NO: 1375541 - RNA, 21 nt, Human
ugaaagaggcugaggccugga

SEQ ID NO: 1375542 - RNA, 19 nt, Human
ugaaagaggcugaggccug

SEQ ID NO: 1375543 - RNA, 16 nt, Human
ugaaagaugaucauuu

SEQ ID NO: 1375544 - RNA, 15 nt, Human
ugaaagcuacucaua

SEQ ID NO: 1375545 - RNA, 15 nt, Human
ugaaagguacuucaa

SEQ ID NO: 1375546 - RNA, 16 nt, Human
ugaaagguaauuugag

SEQ ID NO: 1375547 - RNA, 16 nt, Human
ugaaagguacuucaaa

SEQ ID NO: 1375548 - RNA, 17 nt, Human
ugaaacaagaagccaca

SEQ ID NO: 1375549 - RNA, 16 nt, Human
ugaaacaacuuggaaa

SEQ ID NO: 1375550 - RNA, 15 nt, Human
ugaaacaacuuggaa

SEQ ID NO: 1375551 - RNA, 14 nt, Human
ugaaacaaagaguu

SEQ ID NO: 1375552 - RNA, 23 nt, Human
ugaaacaaagaguucaagaaaua

SEQ ID NO: 1375553 - RNA, 20 nt, Human
ugaaaccaguguuagggaag

SEQ ID NO: 1375554 - RNA, 20 nt, Human
ugaaaagcuccauuuuuagu

SEQ ID NO: 1375555 - RNA, 13 nt, Human
ugaaaauuuugau

SEQ ID NO: 1375556 - RNA, 19 nt, Human
ugaaaauuuugauguuuua

SEQ ID NO: 1375557 - RNA, 21 nt, Human
ugaaaauuuugauguuuuaag

SEQ ID NO: 1375558 - RNA, 18 nt, Human
ucuuuuauacucagcuuu

SEQ ID NO: 1375559 - RNA, 22 nt, Human
ucuuuuauaauucucauuaaaa

SEQ ID NO: 1375560 - RNA, 17 nt, Human
ugaaaagcuagaauuga

SEQ ID NO: 1375561 - RNA, 16 nt, Human
ugaaaagcagacauuu

SEQ ID NO: 1375562 - RNA, 20 nt, Human
ugaacauugguucuuucauu

SEQ ID NO: 1375563 - RNA, 12 nt, Human
ugaacaguggag

SEQ ID NO: 1375564 - RNA, 18 nt, Human
ugaacacaaacuguaaau

SEQ ID NO: 1375565 - RNA, 23 nt, Human
ugaacaagagaagcauucucauu

SEQ ID NO: 1375566 - RNA, 18 nt, Human
ugaacaagagaagcauuc

SEQ ID NO: 1375567 - RNA, 17 nt, Human
ugaacaagagaagcauu

SEQ ID NO: 1375568 - RNA, 16 nt, Human
ugaacaagagaagcau

SEQ ID NO: 1375569 - RNA, 14 nt, Human
ugaacaagagaagc

SEQ ID NO: 1375570 - RNA, 18 nt, Human
ugaacaagaauuggaagc

SEQ ID NO: 1375571 - RNA, 14 nt, Human
ugaacaagaauugg

SEQ ID NO: 1375572 - RNA, 12 nt, Human
ugaacaagaauu

SEQ ID NO: 1375573 - RNA, 11 nt, Human
ugaacaagaau

SEQ ID NO: 1375574 - RNA, 22 nt, Human
ugaacaggaaacuccugugacc

SEQ ID NO: 1375575 - RNA, 23 nt, Human
ugaacagcugguguagcuacaga

SEQ ID NO: 1375576 - RNA, 19 nt, Human
ugaacagcugguguagcua

SEQ ID NO: 1375577 - RNA, 18 nt, Human
ugaacagcugguguagcu

SEQ ID NO: 1375578 - RNA, 15 nt, Human
ugaacagcuggugua

SEQ ID NO: 1375579 - RNA, 14 nt, Human
ugaacagcuggugu

SEQ ID NO: 1375580 - RNA, 13 nt, Human
ugaacagcuggug

SEQ ID NO: 1375581 - RNA, 17 nt, Human
ugaacaggaaacuccug

SEQ ID NO: 1375582 - RNA, 19 nt, Human
ugaacaguuguguuugaag

SEQ ID NO: 1375583 - RNA, 19 nt, Human
ugaaauguaaggcugugua

SEQ ID NO: 1375584 - RNA, 15 nt, Human
ugaaauguaaggcug

SEQ ID NO: 1375585 - RNA, 20 nt, Human
ugaaauguaaggcuguguaa

SEQ ID NO: 1375586 - RNA, 12 nt, Human
ugaaauguaagg

SEQ ID NO: 1375587 - RNA, 17 nt, Human
ugaaauggauacuuaua

SEQ ID NO: 1375588 - RNA, 19 nt, Human
ugaaagguuagagaauaaa

SEQ ID NO: 1375589 - RNA, 16 nt, Human
ugaaauauugacuuuu

SEQ ID NO: 1375590 - RNA, 15 nt, Human
ugaaaucauucauuu

SEQ ID NO: 1375591 - RNA, 13 nt, Human
ugaaauuauguaa

SEQ ID NO: 1375592 - RNA, 15 nt, Human
ugaaauuauguaaau

SEQ ID NO: 1375593 - RNA, 23 nt, Human
ugaaauuaagaaggcaaaaaugu

SEQ ID NO: 1375594 - RNA, 21 nt, Human
ugaaauuaagaaggcaaaaau

SEQ ID NO: 1375595 - RNA, 19 nt, Human
ugaaauuaagaaggcaaaa

SEQ ID NO: 1375596 - RNA, 22 nt, Human
ugaaauuaacuggguaaugaaa

SEQ ID NO: 1375597 - RNA, 17 nt, Human
ugaaauuaaccucucac

SEQ ID NO: 1375598 - RNA, 14 nt, Human
ugaaauuaaccucu

SEQ ID NO: 1375599 - RNA, 15 nt, Human
ugaaauuccaaaguc

SEQ ID NO: 1375600 - RNA, 14 nt, Human
ugaaauuccaaagu

SEQ ID NO: 1375601 - RNA, 12 nt, Human
ugaaauuccaaa

SEQ ID NO: 1375602 - RNA, 17 nt, Human
ugaaauuccaaagucuc

SEQ ID NO: 1375603 - RNA, 16 nt, Human
ugaaauuccaaagucu

SEQ ID NO: 1375604 - RNA, 19 nt, Human
ugaaauuccaaagucucua

SEQ ID NO: 1375605 - RNA, 16 nt, Human
ugaaauucuccuggag

SEQ ID NO: 1375606 - RNA, 15 nt, Human
ugaaauucuccugga

SEQ ID NO: 1375607 - RNA, 14 nt, Human
ugaaauucuccugg

SEQ ID NO: 1375608 - RNA, 12 nt, Human
ugaaauuauuca

SEQ ID NO: 1375609 - RNA, 20 nt, Human
ugaaauuaugugacauuuua

SEQ ID NO: 1375610 - RNA, 22 nt, Human
ugaaauuaugugacauuuuaca

SEQ ID NO: 1375611 - RNA, 23 nt, Human
ucuuucaaaaccuuuugaaauua

SEQ ID NO: 1375612 - RNA, 21 nt, Human
ucuuucaaaaccuuuugaaau

SEQ ID NO: 1375613 - RNA, 20 nt, Human
ucuuucaaaaccuuuugaaa

SEQ ID NO: 1375614 - RNA, 11 nt, Human
ucuuucaaaac

SEQ ID NO: 1375615 - RNA, 21 nt, Human
ucuuucaagcagucgugccug

SEQ ID NO: 1375616 - RNA, 20 nt, Human
ucuuucaagcagucgugccu

SEQ ID NO: 1375617 - RNA, 16 nt, Human
ucuuguuggugcacag

SEQ ID NO: 1375618 - RNA, 14 nt, Human
ucuuguuucaauuc

SEQ ID NO: 1375619 - RNA, 17 nt, Human
ucuuguuggugcacagc

SEQ ID NO: 1375620 - RNA, 13 nt, Human
ucuuguugagccg

SEQ ID NO: 1375621 - RNA, 22 nt, Human
ucuuguguuuccacagccugca

SEQ ID NO: 1375622 - RNA, 13 nt, Human
ucuuguguuggcu

SEQ ID NO: 1375623 - RNA, 20 nt, Human
ucuugcuuggggaacuugug

SEQ ID NO: 1375624 - RNA, 18 nt, Human
ucuugcuucuuucuagaa

SEQ ID NO: 1375625 - RNA, 17 nt, Human
ucuugcuucuuucuaga

SEQ ID NO: 1375626 - RNA, 16 nt, Human
ucuugcuucuuucuag

SEQ ID NO: 1375627 - RNA, 19 nt, Human
ucuugcacagucacugcuc

SEQ ID NO: 1375628 - RNA, 23 nt, Human
ucuugcaccccaaagcuuuccug

SEQ ID NO: 1375629 - RNA, 22 nt, Human
ucuugcaccccaaagcuuuccu

SEQ ID NO: 1375630 - RNA, 23 nt, Human
ucuugcaggaaggacuaugaaaa

SEQ ID NO: 1375631 - RNA, 14 nt, Human
ucucccugcauggc

SEQ ID NO: 1375632 - RNA, 20 nt, Human
ucuugcacagucacugcucu

SEQ ID NO: 1375633 - RNA, 18 nt, Human
ucucccuguacaguguua

SEQ ID NO: 1375634 - RNA, 14 nt, Human
ucucccuguacagu

SEQ ID NO: 1375635 - RNA, 16 nt, Human
ucucccuggugcuuau

SEQ ID NO: 1375636 - RNA, 13 nt, Human
ucucccuggugcu

SEQ ID NO: 1375637 - RNA, 11 nt, Human
ucuugcuucuu

SEQ ID NO: 1375638 - RNA, 23 nt, Human
ucuugcuucccuaaucuaugguc

SEQ ID NO: 1375639 - RNA, 22 nt, Human
ucuugcuucccuaaucuauggu

SEQ ID NO: 1375640 - RNA, 18 nt, Human
ucuugcuucccuaaucua

SEQ ID NO: 1375641 - RNA, 22 nt, Human
ucuugcuggucuagucacgcau

SEQ ID NO: 1375642 - RNA, 20 nt, Human
ucuugcuaccaguauuuaga

SEQ ID NO: 1375643 - RNA, 14 nt, Human
ucuugcuaccagua

SEQ ID NO: 1375644 - RNA, 13 nt, Human
ucuugcuaccagu

SEQ ID NO: 1375645 - RNA, 14 nt, Human
ucuuuuauaggauu

SEQ ID NO: 1375646 - RNA, 13 nt, Human
ucuuuuauaauuc

SEQ ID NO: 1375647 - RNA, 16 nt, Human
ucuuuggaaaguacac

SEQ ID NO: 1375648 - RNA, 19 nt, Human
ucuuuggaaaguacacucu

SEQ ID NO: 1375649 - RNA, 14 nt, Human
ucuuugccacccuc

SEQ ID NO: 1375650 - RNA, 16 nt, Human
ucuuugccacccucau

SEQ ID NO: 1375651 - RNA, 17 nt, Human
ucuuugccacccucaug

SEQ ID NO: 1375652 - RNA, 18 nt, Human
ucuuugccacccucaugc

SEQ ID NO: 1375653 - RNA, 20 nt, Human
ucuuugccacccucaugcug

SEQ ID NO: 1375654 - RNA, 13 nt, Human
ucuuugaauaaau

SEQ ID NO: 1375655 - RNA, 12 nt, Human
ucuuugaauaaa

SEQ ID NO: 1375656 - RNA, 16 nt, Human
ucuuugaaauuaugua

SEQ ID NO: 1375657 - RNA, 15 nt, Human
ucuuugaaauuaugu

SEQ ID NO: 1375658 - RNA, 12 nt, Human
ucuuugaaauua

SEQ ID NO: 1375659 - RNA, 12 nt, Human
ucuuugccaagu

SEQ ID NO: 1375660 - RNA, 15 nt, Human
ucuuucagcuccuga

SEQ ID NO: 1375661 - RNA, 14 nt, Human
ucuuucagcuccug

SEQ ID NO: 1375662 - RNA, 13 nt, Human
ucuuucagcuccu

SEQ ID NO: 1375663 - RNA, 11 nt, Human
ucuuucagcuc

SEQ ID NO: 1375664 - RNA, 13 nt, Human
ucuuuccaaagua

SEQ ID NO: 1375665 - RNA, 14 nt, Human
ucuuuccaaaguac

SEQ ID NO: 1375666 - RNA, 23 nt, Human
ucuuuccacggagccacuccucu

SEQ ID NO: 1375667 - RNA, 22 nt, Human
ucuuuccacggagccacuccuc

SEQ ID NO: 1375668 - RNA, 19 nt, Human
ucuuuccacggagccacuc

SEQ ID NO: 1375669 - RNA, 21 nt, Human
ucuuucauuugcuuuggaagu

SEQ ID NO: 1375670 - RNA, 17 nt, Human
ucuuuccaaaguacacu

SEQ ID NO: 1375671 - RNA, 20 nt, Human
ucuuuccauuggaucucauu

SEQ ID NO: 1375672 - RNA, 16 nt, Human
ucuuucauuucuucua

SEQ ID NO: 1375673 - RNA, 13 nt, Human
ucuuucuuuauuu

SEQ ID NO: 1375674 - RNA, 16 nt, Human
ucuuucuuucaauaaa

SEQ ID NO: 1375675 - RNA, 15 nt, Human
ucuuucuuucuuaga

SEQ ID NO: 1375676 - RNA, 22 nt, Human
ucuuucuuugggaauauuugaa

SEQ ID NO: 1375677 - RNA, 23 nt, Human
ucuuucuuugggaauauuugaau

SEQ ID NO: 1375678 - RNA, 22 nt, Human
ugaaugaggucagcaugucuau

SEQ ID NO: 1375679 - RNA, 14 nt, Human
ugaaugagaaucua

SEQ ID NO: 1375680 - RNA, 11 nt, Human
ugaaugaacac

SEQ ID NO: 1375681 - RNA, 17 nt, Human
ugaaugaaaauguccau

SEQ ID NO: 1375682 - RNA, 23 nt, Human
ugaauguguuucacaguuugaaa

SEQ ID NO: 1375683 - RNA, 11 nt, Human
ugaauguuaaa

SEQ ID NO: 1375684 - RNA, 22 nt, Human
ugaauguguuucacaguuugaa

SEQ ID NO: 1375685 - RNA, 21 nt, Human
ugaauguguuucacaguuuga

SEQ ID NO: 1375686 - RNA, 13 nt, Human
ugaauguuaaaua

SEQ ID NO: 1375687 - RNA, 15 nt, Human
ugaauguuaaauaaa

SEQ ID NO: 1375688 - RNA, 16 nt, Human
ugaauguuaaauaaau

SEQ ID NO: 1375689 - RNA, 18 nt, Human
ugaauguuaaauaaauug

SEQ ID NO: 1375690 - RNA, 20 nt, Human
ugaauguuaaauaaauugua

SEQ ID NO: 1375691 - RNA, 21 nt, Human
ugaauguuaaauaaauuguau

SEQ ID NO: 1375692 - RNA, 16 nt, Human
ugaauccaaacuaauc

SEQ ID NO: 1375693 - RNA, 15 nt, Human
ugaauccaaacuaau

SEQ ID NO: 1375694 - RNA, 21 nt, Human
ugaaucauuguauguggucau

SEQ ID NO: 1375695 - RNA, 18 nt, Human
ugaaucauuguauguggu

SEQ ID NO: 1375696 - RNA, 22 nt, Human
ugaaucauuuuaccuuugacaa

SEQ ID NO: 1375697 - RNA, 23 nt, Human
ugaaucauuuuaccuuugacaaa

SEQ ID NO: 1375698 - RNA, 21 nt, Human
ugaauucuugguugaggaaac

SEQ ID NO: 1375699 - RNA, 22 nt, Human
ugaauucuugguugaggaaaca

SEQ ID NO: 1375700 - RNA, 20 nt, Human
ugaauucuugguugaggaaa

SEQ ID NO: 1375701 - RNA, 22 nt, Human
ugaauucccucacucgucuccc

SEQ ID NO: 1375702 - RNA, 14 nt, Human
ugaauucccucacu

SEQ ID NO: 1375703 - RNA, 13 nt, Human
ugaauucccucac

SEQ ID NO: 1375704 - RNA, 12 nt, Human
ugaauucccuca

SEQ ID NO: 1375705 - RNA, 13 nt, Human
ugaauuauucaau

SEQ ID NO: 1375706 - RNA, 17 nt, Human
ugaauuaugaaacuuuu

SEQ ID NO: 1375707 - RNA, 15 nt, Human
ugaauuaugaaacuu

SEQ ID NO: 1375708 - RNA, 21 nt, Human
ugaauuaucuugguugaaaau

SEQ ID NO: 1375709 - RNA, 13 nt, Human
ugaauuaugaaac

SEQ ID NO: 1375710 - RNA, 15 nt, Human
ugaauuauucaauuu

SEQ ID NO: 1375711 - RNA, 18 nt, Human
ugaauuauuacaguguuu

SEQ ID NO: 1375712 - RNA, 17 nt, Human
ugaauuauuacaguguu

SEQ ID NO: 1375713 - RNA, 16 nt, Human
ugaauuauuacagugu

SEQ ID NO: 1375714 - RNA, 14 nt, Human
ugaauuauuacagu

SEQ ID NO: 1375715 - RNA, 16 nt, Human
ugaauuauuuucucuc

SEQ ID NO: 1375716 - RNA, 18 nt, Human
ugaauuacauuuguauaa

SEQ ID NO: 1375717 - RNA, 16 nt, Human
ugaauuacauuuguau

SEQ ID NO: 1375718 - RNA, 15 nt, Human
ugaauuacauuugua

SEQ ID NO: 1375719 - RNA, 22 nt, Human
ugaauuaggcuguaacuacuuu

SEQ ID NO: 1375720 - RNA, 21 nt, Human
ugaauuaggcuguaacuacuu

SEQ ID NO: 1375721 - RNA, 20 nt, Human
ugaauuaggcuguaacuacu

SEQ ID NO: 1375722 - RNA, 17 nt, Human
ugaauuaggcuguaacu

SEQ ID NO: 1375723 - RNA, 15 nt, Human
ugaauuauauguuca

SEQ ID NO: 1375724 - RNA, 16 nt, Human
ugaauaaaaacucaag

SEQ ID NO: 1375725 - RNA, 18 nt, Human
ugaauaaaaacucaagga

SEQ ID NO: 1375726 - RNA, 15 nt, Human
ugaaguugcugcuuc

SEQ ID NO: 1375727 - RNA, 22 nt, Human
ugaaguugcugcuucucccagg

SEQ ID NO: 1375728 - RNA, 14 nt, Human
ugaaguugcugcuu

SEQ ID NO: 1375729 - RNA, 13 nt, Human
ugaaguugcugcu

SEQ ID NO: 1375730 - RNA, 18 nt, Human
ugaaguuagcuuuaacuu

SEQ ID NO: 1375731 - RNA, 23 nt, Human
ugaaguuagcuuuaacuuaaaua

SEQ ID NO: 1375732 - RNA, 11 nt, Human
ugaaguccaag

SEQ ID NO: 1375733 - RNA, 22 nt, Human
ugaagugcuguuuauuaaucuu

SEQ ID NO: 1375734 - RNA, 18 nt, Human
ugaagugcuguuuauuaa

SEQ ID NO: 1375735 - RNA, 23 nt, Human
ugaagugagcugagauugcacca

SEQ ID NO: 1375736 - RNA, 18 nt, Human
ugaagugagcacagccua

SEQ ID NO: 1375737 - RNA, 17 nt, Human
ugaagugagcacagccu

SEQ ID NO: 1375738 - RNA, 13 nt, Human
ugaaguccaagca

SEQ ID NO: 1375739 - RNA, 20 nt, Human
ugaaggacuaauagaaaagu

SEQ ID NO: 1375740 - RNA, 17 nt, Human
ugaaggacuaauagaaa

SEQ ID NO: 1375741 - RNA, 12 nt, Human
ugaaggacccuu

SEQ ID NO: 1375742 - RNA, 18 nt, Human
ugaaggcaaaauugcaaa

SEQ ID NO: 1375743 - RNA, 22 nt, Human
ugaaggacuaauagaaaaguau

SEQ ID NO: 1375744 - RNA, 14 nt, Human
ugaacucuuaauca

SEQ ID NO: 1375745 - RNA, 15 nt, Human
ugaacucuuaaucaa

SEQ ID NO: 1375746 - RNA, 14 nt, Human
ugaagauacugaaa

SEQ ID NO: 1375747 - RNA, 18 nt, Human
ugaagauacugaaauaaa

SEQ ID NO: 1375748 - RNA, 16 nt, Human
ugaagauacugaaaua

SEQ ID NO: 1375749 - RNA, 15 nt, Human
ugaagauacugaaau

SEQ ID NO: 1375750 - RNA, 15 nt, Human
ugacccuugcuguga

SEQ ID NO: 1375751 - RNA, 13 nt, Human
ugacccuuuucau

SEQ ID NO: 1375752 - RNA, 13 nt, Human
ugacccuggcucc

SEQ ID NO: 1375753 - RNA, 18 nt, Human
ugaccaguugcagucacu

SEQ ID NO: 1375754 - RNA, 17 nt, Human
ugaccaguugcagucac

SEQ ID NO: 1375755 - RNA, 16 nt, Human
ugaccaggcugccucc

SEQ ID NO: 1375756 - RNA, 16 nt, Human
ugaccaggcauccucc

SEQ ID NO: 1375757 - RNA, 22 nt, Human
ugaccagcucccccucccuccc

SEQ ID NO: 1375758 - RNA, 20 nt, Human
ugaccagcucccccucccuc

SEQ ID NO: 1375759 - RNA, 19 nt, Human
ugaccagcucccccucccu

SEQ ID NO: 1375760 - RNA, 18 nt, Human
ugaccagcucccccuccc

SEQ ID NO: 1375761 - RNA, 17 nt, Human
ugaccagcucccccucc

SEQ ID NO: 1375762 - RNA, 16 nt, Human
ugaccagcucccccuc

SEQ ID NO: 1375763 - RNA, 13 nt, Human
ugaccagcucccc

SEQ ID NO: 1375764 - RNA, 12 nt, Human
ugaccagcuccc

SEQ ID NO: 1375765 - RNA, 23 nt, Human
ugaccacuuuuuagaaagauaau

SEQ ID NO: 1375766 - RNA, 16 nt, Human
ugaccacucugucuug

SEQ ID NO: 1375767 - RNA, 15 nt, Human
ugaccacucugucuu

SEQ ID NO: 1375768 - RNA, 20 nt, Human
ugaccacucagagacaugca

SEQ ID NO: 1375769 - RNA, 18 nt, Human
ugaccacucagagacaug

SEQ ID NO: 1375770 - RNA, 16 nt, Human
ugaccacucagagaca

SEQ ID NO: 1375771 - RNA, 14 nt, Human
ugaccacucagaga

SEQ ID NO: 1375772 - RNA, 19 nt, Human
ugaccacagcacagccaac

SEQ ID NO: 1375773 - RNA, 17 nt, Human
ugaccacagcacagcca

SEQ ID NO: 1375774 - RNA, 16 nt, Human
ugaccacagcacagcc

SEQ ID NO: 1375775 - RNA, 15 nt, Human
ugaccacagcacagc

SEQ ID NO: 1375776 - RNA, 17 nt, Human
ugacauguccuucugag

SEQ ID NO: 1375777 - RNA, 14 nt, Human
ugacauguccuucu

SEQ ID NO: 1375778 - RNA, 18 nt, Human
ugacaugggacauuugcu

SEQ ID NO: 1375779 - RNA, 17 nt, Human
ugacaugggacauuugc

SEQ ID NO: 1375780 - RNA, 20 nt, Human
ugacauacccccucccccac

SEQ ID NO: 1375781 - RNA, 16 nt, Human
ugacauacccccuccc

SEQ ID NO: 1375782 - RNA, 15 nt, Human
ugacauacccccucc

SEQ ID NO: 1375783 - RNA, 22 nt, Human
ugacacuuuaauuaccaaccug

SEQ ID NO: 1375784 - RNA, 13 nt, Human
ugacacaaacaca

SEQ ID NO: 1375785 - RNA, 17 nt, Human
ugacacaaacacacaca

SEQ ID NO: 1375786 - RNA, 12 nt, Human
ugacacaaacac

SEQ ID NO: 1375787 - RNA, 17 nt, Human
ugacaaucauguguguu

SEQ ID NO: 1375788 - RNA, 18 nt, Human
ugacaaucauguguguua

SEQ ID NO: 1375789 - RNA, 16 nt, Human
ugacaaucaugugugu

SEQ ID NO: 1375790 - RNA, 15 nt, Human
ugacaaucaugugug

SEQ ID NO: 1375791 - RNA, 13 nt, Human
ugacaaucaugug

SEQ ID NO: 1375792 - RNA, 17 nt, Human
ugacaauaaaacauuaa

SEQ ID NO: 1375793 - RNA, 20 nt, Human
ugacaagcucacagaccuuu

SEQ ID NO: 1375794 - RNA, 15 nt, Human
ugacaagcucacaga

SEQ ID NO: 1375795 - RNA, 15 nt, Human
ugacaacuucuaauu

SEQ ID NO: 1375796 - RNA, 14 nt, Human
ugacaacuucuaau

SEQ ID NO: 1375797 - RNA, 18 nt, Human
ugaauuguaacuguucuu

SEQ ID NO: 1375798 - RNA, 22 nt, Human
ugacaacuucuaauugccaugu

SEQ ID NO: 1375799 - RNA, 19 nt, Human
ugacaacuucuaauugcca

SEQ ID NO: 1375800 - RNA, 12 nt, Human
ugacaagcucac

SEQ ID NO: 1375801 - RNA, 15 nt, Human
ugacagacaggcucu

SEQ ID NO: 1375802 - RNA, 14 nt, Human
ugacagacaggcuc

SEQ ID NO: 1375803 - RNA, 19 nt, Human
ugacagacaggcucuuagc

SEQ ID NO: 1375804 - RNA, 23 nt, Human
ugacauaaguauuuaauucaugu

SEQ ID NO: 1375805 - RNA, 15 nt, Human
ugauuuaauuugaaa

SEQ ID NO: 1375806 - RNA, 16 nt, Human
ugauuuaauguuuuca

SEQ ID NO: 1375807 - RNA, 13 nt, Human
ugauuuaauguuu

SEQ ID NO: 1375808 - RNA, 22 nt, Human
ugcagggaaaauuauuugcaua

SEQ ID NO: 1375809 - RNA, 21 nt, Human
ugcagggaaaauuauuugcau

SEQ ID NO: 1375810 - RNA, 20 nt, Human
ugcagggaaaauuauuugca

SEQ ID NO: 1375811 - RNA, 15 nt, Human
ugcagggaaaauuau

SEQ ID NO: 1375812 - RNA, 14 nt, Human
ugcagggcagucau

SEQ ID NO: 1375813 - RNA, 13 nt, Human
ugcagggcaguca

SEQ ID NO: 1375814 - RNA, 23 nt, Human
ugcagggauguggguuccacaga

SEQ ID NO: 1375815 - RNA, 22 nt, Human
ugcagggauguggguuccacag

SEQ ID NO: 1375816 - RNA, 18 nt, Human
ugcagggauguggguucc

SEQ ID NO: 1375817 - RNA, 16 nt, Human
ugcagggauguggguu

SEQ ID NO: 1375818 - RNA, 15 nt, Human
ugcagggaugugggu

SEQ ID NO: 1375819 - RNA, 14 nt, Human
ugcagggauguggg

SEQ ID NO: 1375820 - RNA, 23 nt, Human
ugcagggagcugggcuuccagaa

SEQ ID NO: 1375821 - RNA, 21 nt, Human
ugcagggcagucauuggcugu

SEQ ID NO: 1375822 - RNA, 21 nt, Human
ugcaguucccacauuaaagaa

SEQ ID NO: 1375823 - RNA, 21 nt, Human
ugcauaguaccaaucauuuua

SEQ ID NO: 1375824 - RNA, 20 nt, Human
ugcauaguaccaaucauuuu

SEQ ID NO: 1375825 - RNA, 19 nt, Human
ugcaguuuaucauucaagu

SEQ ID NO: 1375826 - RNA, 20 nt, Human
ugcauaggaguuuggaggaa

SEQ ID NO: 1375827 - RNA, 17 nt, Human
ugcaguuuaucauucaa

SEQ ID NO: 1375828 - RNA, 16 nt, Human
ugcaguuuaucauuca

SEQ ID NO: 1375829 - RNA, 12 nt, Human
ugcaguuuauca

SEQ ID NO: 1375830 - RNA, 10 nt, Human
ugcaguuuau

SEQ ID NO: 1375831 - RNA, 17 nt, Human
ugcaguugucucuguuu

SEQ ID NO: 1375832 - RNA, 15 nt, Human
ugcaguugucucugu

SEQ ID NO: 1375833 - RNA, 14 nt, Human
ugcaguugucucug

SEQ ID NO: 1375834 - RNA, 13 nt, Human
ugcaguugucucu

SEQ ID NO: 1375835 - RNA, 14 nt, Human
ugcaguucugaaga

SEQ ID NO: 1375836 - RNA, 12 nt, Human
ugcaguucugaa

SEQ ID NO: 1375837 - RNA, 22 nt, Human
ugcauaguaccaaucauuuuaa

SEQ ID NO: 1375838 - RNA, 19 nt, Human
ugcauauguugaauacuuu

SEQ ID NO: 1375839 - RNA, 18 nt, Human
ugcauauuauuuuauguu

SEQ ID NO: 1375840 - RNA, 19 nt, Human
ugccaaauuaaaaaagaua

SEQ ID NO: 1375841 - RNA, 18 nt, Human
ugccaaauuaaaaaagau

SEQ ID NO: 1375842 - RNA, 17 nt, Human
ugccaaauuaaaaaaga

SEQ ID NO: 1375843 - RNA, 13 nt, Human
ugccaaauuaaaa

SEQ ID NO: 1375844 - RNA, 18 nt, Human
ugccaaauauguccuggg

SEQ ID NO: 1375845 - RNA, 17 nt, Human
ugccaaauauguccugg

SEQ ID NO: 1375846 - RNA, 19 nt, Human
ugccaaaggaugugauaua

SEQ ID NO: 1375847 - RNA, 17 nt, Human
ugccaaaggaugugaua

SEQ ID NO: 1375848 - RNA, 16 nt, Human
ugccaaaggaugugau

SEQ ID NO: 1375849 - RNA, 15 nt, Human
ugccaaaggauguga

SEQ ID NO: 1375850 - RNA, 23 nt, Human
ugccaaacaaaaagguucucagg

SEQ ID NO: 1375851 - RNA, 17 nt, Human
ugccaaacaaaaagguu

SEQ ID NO: 1375852 - RNA, 19 nt, Human
ugcauuuggguccaggagg

SEQ ID NO: 1375853 - RNA, 20 nt, Human
ugcauuuggguccaggagga

SEQ ID NO: 1375854 - RNA, 18 nt, Human
ugcauuuggguccaggag

SEQ ID NO: 1375855 - RNA, 17 nt, Human
ugcauuuggguccagga

SEQ ID NO: 1375856 - RNA, 16 nt, Human
ugcauuuggguccagg

SEQ ID NO: 1375857 - RNA, 14 nt, Human
ugcauuugggucca

SEQ ID NO: 1375858 - RNA, 23 nt, Human
ugcauuuggugguuucagaaaug

SEQ ID NO: 1375859 - RNA, 23 nt, Human
ugcaucagaaagggagggcucug

SEQ ID NO: 1375860 - RNA, 22 nt, Human
ugcaucagaaagggagggcucu

SEQ ID NO: 1375861 - RNA, 21 nt, Human
ugcaucagaaagggagggcuc

SEQ ID NO: 1375862 - RNA, 20 nt, Human
ugcaucagaaagggagggcu

SEQ ID NO: 1375863 - RNA, 18 nt, Human
ugcaucagaaagggaggg

SEQ ID NO: 1375864 - RNA, 17 nt, Human
ugcaucagaaagggagg

SEQ ID NO: 1375865 - RNA, 20 nt, Human
ugcauggugccccaggacca

SEQ ID NO: 1375866 - RNA, 19 nt, Human
ugcauggugccccaggacc

SEQ ID NO: 1375867 - RNA, 18 nt, Human
ugcauggugccccaggac

SEQ ID NO: 1375868 - RNA, 17 nt, Human
ugcauggugccccagga

SEQ ID NO: 1375869 - RNA, 22 nt, Human
ugcauggugccccaggaccagc

SEQ ID NO: 1375870 - RNA, 21 nt, Human
ugcauggugccccaggaccag

SEQ ID NO: 1375871 - RNA, 20 nt, Human
ugcauuuggagggagugagu

SEQ ID NO: 1375872 - RNA, 16 nt, Human
ugcauuugauacauuu

SEQ ID NO: 1375873 - RNA, 21 nt, Human
ugcauuuggugguuucagaaa

SEQ ID NO: 1375874 - RNA, 15 nt, Human
ugccaggagcacggc

SEQ ID NO: 1375875 - RNA, 20 nt, Human
ugccaggaccagucaaccug

SEQ ID NO: 1375876 - RNA, 22 nt, Human
ugccacguuggagaagcccgug

SEQ ID NO: 1375877 - RNA, 17 nt, Human
ugccaggaggacccagg

SEQ ID NO: 1375878 - RNA, 13 nt, Human
ugccaggaggacc

SEQ ID NO: 1375879 - RNA, 20 nt, Human
ugccaggagcacggcucugu

SEQ ID NO: 1375880 - RNA, 19 nt, Human
ugccaggagcacggcucug

SEQ ID NO: 1375881 - RNA, 14 nt, Human
ugccaccugucugu

SEQ ID NO: 1375882 - RNA, 15 nt, Human
ugccaccugucuguc

SEQ ID NO: 1375883 - RNA, 16 nt, Human
ugccaccugucugucu

SEQ ID NO: 1375884 - RNA, 17 nt, Human
ugccaccuccccccaca

SEQ ID NO: 1375885 - RNA, 15 nt, Human
ugccaccucccccca

SEQ ID NO: 1375886 - RNA, 18 nt, Human
ugccaaccuaaaacucuu

SEQ ID NO: 1375887 - RNA, 16 nt, Human
ugccaaccuaaaacuc

SEQ ID NO: 1375888 - RNA, 12 nt, Human
ugccaaccuaaa

SEQ ID NO: 1375889 - RNA, 22 nt, Human
ugccaaauuaaaaaagauaaac

SEQ ID NO: 1375890 - RNA, 22 nt, Human
ugccaaauuauucuccuauguu

SEQ ID NO: 1375891 - RNA, 13 nt, Human
ugccaccuggacc

SEQ ID NO: 1375892 - RNA, 19 nt, Human
ugccaccucuaacagcacc

SEQ ID NO: 1375893 - RNA, 20 nt, Human
ugccaccucuaacagcacca

SEQ ID NO: 1375894 - RNA, 18 nt, Human
ugccaccucuaacagcac

SEQ ID NO: 1375895 - RNA, 14 nt, Human
ugccaccuccugcc

SEQ ID NO: 1375896 - RNA, 20 nt, Human
ugccaccuggaccccugcau

SEQ ID NO: 1375897 - RNA, 19 nt, Human
ugccaccuggaccccugca

SEQ ID NO: 1375898 - RNA, 18 nt, Human
ugccaccuggaccccugc

SEQ ID NO: 1375899 - RNA, 15 nt, Human
ugccaccuggacccc

SEQ ID NO: 1375900 - RNA, 14 nt, Human
ugccaccuggaccc

SEQ ID NO: 1375901 - RNA, 10 nt, Human
ugccaccugu

SEQ ID NO: 1375902 - RNA, 11 nt, Human
ugccaccuguc

SEQ ID NO: 1375903 - RNA, 12 nt, Human
ugccaccugucu

SEQ ID NO: 1375904 - RNA, 13 nt, Human
ugccaccugucug

SEQ ID NO: 1375905 - RNA, 20 nt, Human
ugcccgccugggucuccuaa

SEQ ID NO: 1375906 - RNA, 11 nt, Human
ugccccuuucu

SEQ ID NO: 1375907 - RNA, 14 nt, Human
ugccccuuucugga

SEQ ID NO: 1375908 - RNA, 19 nt, Human
ugccccuuuauaaauccaa

SEQ ID NO: 1375909 - RNA, 20 nt, Human
ugccccuuggacacgcucag

SEQ ID NO: 1375910 - RNA, 21 nt, Human
ugccccuugacaacuggcagg

SEQ ID NO: 1375911 - RNA, 20 nt, Human
ugccccuugacaacuggcag

SEQ ID NO: 1375912 - RNA, 15 nt, Human
ugccccucucaccaa

SEQ ID NO: 1375913 - RNA, 14 nt, Human
ugccccucucacca

SEQ ID NO: 1375914 - RNA, 12 nt, Human
ugccccucucac

SEQ ID NO: 1375915 - RNA, 20 nt, Human
ugccccucuccuucuuagcu

SEQ ID NO: 1375916 - RNA, 15 nt, Human
ugccccucuccuucu

SEQ ID NO: 1375917 - RNA, 19 nt, Human
ugccccacuuguccuuagc

SEQ ID NO: 1375918 - RNA, 18 nt, Human
ugccccacuuguccuuag

SEQ ID NO: 1375919 - RNA, 14 nt, Human
ugccccacuugucc

SEQ ID NO: 1375920 - RNA, 20 nt, Human
ugccccaacuccuuccagcu

SEQ ID NO: 1375921 - RNA, 22 nt, Human
ugccccaacuccuuccagcuag

SEQ ID NO: 1375922 - RNA, 19 nt, Human
ugccccaacuccuuccagc

SEQ ID NO: 1375923 - RNA, 18 nt, Human
ugccccaacuccuuccag

SEQ ID NO: 1375924 - RNA, 16 nt, Human
ugccccaacuccuucc

SEQ ID NO: 1375925 - RNA, 14 nt, Human
ugcccauuuugaau

SEQ ID NO: 1375926 - RNA, 15 nt, Human
ugcccauguuucaaa

SEQ ID NO: 1375927 - RNA, 13 nt, Human
ugcccauguuuca

SEQ ID NO: 1375928 - RNA, 20 nt, Human
ugcccagagacccagcggac

SEQ ID NO: 1375929 - RNA, 23 nt, Human
ugcccagagacccagcggacaca

SEQ ID NO: 1375930 - RNA, 17 nt, Human
ugccaggcuaauuuuuu

SEQ ID NO: 1375931 - RNA, 12 nt, Human
ugccaggcucuc

SEQ ID NO: 1375932 - RNA, 16 nt, Human
ugccaggcuaauuuuu

SEQ ID NO: 1375933 - RNA, 17 nt, Human
ugccaggcuggagugca

SEQ ID NO: 1375934 - RNA, 18 nt, Human
ugcccagagacccagcgg

SEQ ID NO: 1375935 - RNA, 17 nt, Human
ugcccagagacccagcg

SEQ ID NO: 1375936 - RNA, 16 nt, Human
ugcccagagacccagc

SEQ ID NO: 1375937 - RNA, 15 nt, Human
ugcccagagacccag

SEQ ID NO: 1375938 - RNA, 14 nt, Human
ugccaggcucucuu

SEQ ID NO: 1375939 - RNA, 10 nt, Human
ugcccagaca

SEQ ID NO: 1375940 - RNA, 19 nt, Human
ugccaggcuggagugcagu

SEQ ID NO: 1375941 - RNA, 14 nt, Human
ugccucaaccuccc

SEQ ID NO: 1375942 - RNA, 22 nt, Human
ugccucaaauaaaaagugcuuu

SEQ ID NO: 1375943 - RNA, 21 nt, Human
ugccucaaauaaaaagugcuu

SEQ ID NO: 1375944 - RNA, 12 nt, Human
ugccucaaauaa

SEQ ID NO: 1375945 - RNA, 20 nt, Human
ugccuauugcuagagcuccu

SEQ ID NO: 1375946 - RNA, 18 nt, Human
ugccuauugcuagagcuc

SEQ ID NO: 1375947 - RNA, 17 nt, Human
ugccuauugcuagagcu

SEQ ID NO: 1375948 - RNA, 21 nt, Human
ugccuauuaucugucagcugc

SEQ ID NO: 1375949 - RNA, 20 nt, Human
ugccucggccucccaaagug

SEQ ID NO: 1375950 - RNA, 21 nt, Human
ugccucgcuccccacucugcu

SEQ ID NO: 1375951 - RNA, 20 nt, Human
ugccuccugccggcuccuug

SEQ ID NO: 1375952 - RNA, 21 nt, Human
ugccuccugccggcuccuugg

SEQ ID NO: 1375953 - RNA, 14 nt, Human
ugccuccugccggc

SEQ ID NO: 1375954 - RNA, 15 nt, Human
ugccuccucccuccc

SEQ ID NO: 1375955 - RNA, 16 nt, Human
ugccucaaugccagua

SEQ ID NO: 1375956 - RNA, 15 nt, Human
ugccucaaugccagu

SEQ ID NO: 1375957 - RNA, 13 nt, Human
ugccucaaugcca

SEQ ID NO: 1375958 - RNA, 19 nt, Human
ugccuccucccucccucuc

SEQ ID NO: 1375959 - RNA, 13 nt, Human
ugccuccucccuc

SEQ ID NO: 1375960 - RNA, 12 nt, Human
ugccuccucccu

SEQ ID NO: 1375961 - RNA, 11 nt, Human
ugccuccuccc

SEQ ID NO: 1375962 - RNA, 20 nt, Human
ugcccggcuaauuuuuguaa

SEQ ID NO: 1375963 - RNA, 22 nt, Human
ugcugcugagaaccuggccuuc

SEQ ID NO: 1375964 - RNA, 20 nt, Human
ugcugcugagaaccuggccu

SEQ ID NO: 1375965 - RNA, 19 nt, Human
ugcugcugagaaccuggcc

SEQ ID NO: 1375966 - RNA, 21 nt, Human
ugcugcugagaaccuggccuu

SEQ ID NO: 1375967 - RNA, 13 nt, Human
ugcugcugccugc

SEQ ID NO: 1375968 - RNA, 14 nt, Human
ugcugcugccugcc

SEQ ID NO: 1375969 - RNA, 14 nt, Human
ugcugggauuucca

SEQ ID NO: 1375970 - RNA, 23 nt, Human
ugcugcuucucccaggcaaggcu

SEQ ID NO: 1375971 - RNA, 20 nt, Human
ugcugcuucucccaggcaag

SEQ ID NO: 1375972 - RNA, 19 nt, Human
ugcugcuucucccaggcaa

SEQ ID NO: 1375973 - RNA, 18 nt, Human
ugcugcuucucccaggca

SEQ ID NO: 1375974 - RNA, 15 nt, Human
ugcugcuucucccag

SEQ ID NO: 1375975 - RNA, 14 nt, Human
ugcugggccccugc

SEQ ID NO: 1375976 - RNA, 16 nt, Human
ugcugggccccugccu

SEQ ID NO: 1375977 - RNA, 17 nt, Human
ugcugggccccugccuc

SEQ ID NO: 1375978 - RNA, 18 nt, Human
ugcugggccccugccucu

SEQ ID NO: 1375979 - RNA, 19 nt, Human
ugcugggccccugccucuc

SEQ ID NO: 1375980 - RNA, 21 nt, Human
ugcugggccccugccucucug

SEQ ID NO: 1375981 - RNA, 22 nt, Human
ugcugggccccugccucucugc

SEQ ID NO: 1375982 - RNA, 23 nt, Human
ugcugggccccugccucucugca

SEQ ID NO: 1375983 - RNA, 24 nt, Human
ugcugggccccugccucucugcag

SEQ ID NO: 1375984 - RNA, 14 nt, Human
ugcucuuucucugc

SEQ ID NO: 1375985 - RNA, 13 nt, Human
ugcucuuucucug

SEQ ID NO: 1375986 - RNA, 12 nt, Human
ugcucuuucucu

SEQ ID NO: 1375987 - RNA, 17 nt, Human
ugcugcauuuaaaagau

SEQ ID NO: 1375988 - RNA, 18 nt, Human
ugcugcauuuaaaagaua

SEQ ID NO: 1375989 - RNA, 19 nt, Human
ugcugcauuuaaaagauac

SEQ ID NO: 1375990 - RNA, 23 nt, Human
ugcugcauuuaaaagauacaguu

SEQ ID NO: 1375991 - RNA, 18 nt, Human
ugcugcugagaaccuggc

SEQ ID NO: 1375992 - RNA, 17 nt, Human
ugcugcugagaaccugg

SEQ ID NO: 1375993 - RNA, 16 nt, Human
ugcugcugagaaccug

SEQ ID NO: 1375994 - RNA, 15 nt, Human
ugcugcugagaaccu

SEQ ID NO: 1375995 - RNA, 13 nt, Human
ugcugcugagaac

SEQ ID NO: 1375996 - RNA, 11 nt, Human
ugcugcugaga

SEQ ID NO: 1375997 - RNA, 23 nt, Human
ugcugcucuuggcuggacccagc

SEQ ID NO: 1375998 - RNA, 21 nt, Human
ugcugcucuuggcuggaccca

SEQ ID NO: 1375999 - RNA, 19 nt, Human
ugcugcucuuggcuggacc

SEQ ID NO: 1376000 - RNA, 18 nt, Human
ugcugcucuuggcuggac

SEQ ID NO: 1376001 - RNA, 17 nt, Human
ugcugcucuuggcugga

SEQ ID NO: 1376002 - RNA, 16 nt, Human
ugcugcucccucagac

SEQ ID NO: 1376003 - RNA, 17 nt, Human
ugcugcucccucagacu

SEQ ID NO: 1376004 - RNA, 15 nt, Human
ugcugcucccucaga

SEQ ID NO: 1376005 - RNA, 14 nt, Human
ugcugcucccucag

SEQ ID NO: 1376006 - RNA, 13 nt, Human
ugcugcucccuca

SEQ ID NO: 1376007 - RNA, 20 nt, Human
ugcugccuuauucagggaag

SEQ ID NO: 1376008 - RNA, 19 nt, Human
ugcugccuuauucagggaa

SEQ ID NO: 1376009 - RNA, 18 nt, Human
ugcugccuuauucaggga

SEQ ID NO: 1376010 - RNA, 16 nt, Human
ugcugccucccucugc

SEQ ID NO: 1376011 - RNA, 15 nt, Human
ugcucuuucucugcc

SEQ ID NO: 1376012 - RNA, 15 nt, Human
ugcugccugcuuuuu

SEQ ID NO: 1376013 - RNA, 17 nt, Human
ugcugccugcuuuuuau

SEQ ID NO: 1376014 - RNA, 17 nt, Human
ugcuggggccugggaca

SEQ ID NO: 1376015 - RNA, 14 nt, Human
ugcuggggccuggg

SEQ ID NO: 1376016 - RNA, 22 nt, Human
ugcuggggaagacaguggcccc

SEQ ID NO: 1376017 - RNA, 17 nt, Human
ugcuggggaagacagug

SEQ ID NO: 1376018 - RNA, 16 nt, Human
ugcuggggaagacagu

SEQ ID NO: 1376019 - RNA, 23 nt, Human
ugcuggggccugggacaacugcu

SEQ ID NO: 1376020 - RNA, 18 nt, Human
ugcuggggccugguuccc

SEQ ID NO: 1376021 - RNA, 17 nt, Human
ugcugggcucagugaag

SEQ ID NO: 1376022 - RNA, 15 nt, Human
ugcugggcucaguga

SEQ ID NO: 1376023 - RNA, 14 nt, Human
ugcugggcucagug

SEQ ID NO: 1376024 - RNA, 13 nt, Human
ugcugggcucagu

SEQ ID NO: 1376025 - RNA, 12 nt, Human
ugcugggcucag

SEQ ID NO: 1376026 - RNA, 16 nt, Human
ugcugggauuuccaac

SEQ ID NO: 1376027 - RNA, 22 nt, Human
ugcuggguccauaucacacaca

SEQ ID NO: 1376028 - RNA, 16 nt, Human
ugcugguccgugggac

SEQ ID NO: 1376029 - RNA, 13 nt, Human
ugcugguccgugg

SEQ ID NO: 1376030 - RNA, 19 nt, Human
ugcuggucccggggccagc

SEQ ID NO: 1376031 - RNA, 18 nt, Human
ugcuggugagccaagcag

SEQ ID NO: 1376032 - RNA, 20 nt, Human
ugcuguaaagaguugcuuuu

SEQ ID NO: 1376033 - RNA, 16 nt, Human
ugcugugguguguccc

SEQ ID NO: 1376034 - RNA, 15 nt, Human
ugcuguggugugucc

SEQ ID NO: 1376035 - RNA, 22 nt, Human
ugcugguuuguaguugaauauu

SEQ ID NO: 1376036 - RNA, 13 nt, Human
ugcugguuuguag

SEQ ID NO: 1376037 - RNA, 13 nt, Human
ugcugguuuuagu

SEQ ID NO: 1376038 - RNA, 21 nt, Human
ugcugugugcuuuuuuugugu

SEQ ID NO: 1376039 - RNA, 12 nt, Human
ugcuguguaaaa

SEQ ID NO: 1376040 - RNA, 23 nt, Human
ugcuguggugugucccccucugu

SEQ ID NO: 1376041 - RNA, 17 nt, Human
ugcuguggugugucccc

SEQ ID NO: 1376042 - RNA, 15 nt, Human
ugcugugugcuuuuu

SEQ ID NO: 1376043 - RNA, 22 nt, Human
ugcuguucucuugggaacugaa

SEQ ID NO: 1376044 - RNA, 17 nt, Human
ugcuguucaugaaagau

SEQ ID NO: 1376045 - RNA, 16 nt, Human
ugcuguucaugaaaga

SEQ ID NO: 1376046 - RNA, 21 nt, Human
ugcucauauugugauucugcc

SEQ ID NO: 1376047 - RNA, 16 nt, Human
ugcucauaacggauca

SEQ ID NO: 1376048 - RNA, 14 nt, Human
ugcucauaacggau

SEQ ID NO: 1376049 - RNA, 23 nt, Human
ugcucauauugugauucugccuu

SEQ ID NO: 1376050 - RNA, 22 nt, Human
ugcucauauugugauucugccu

SEQ ID NO: 1376051 - RNA, 16 nt, Human
ugcucuaacagcccuc

SEQ ID NO: 1376052 - RNA, 15 nt, Human
ugcucuaacagcccu

SEQ ID NO: 1376053 - RNA, 21 nt, Human
ugcucggggugcacaggaggg

SEQ ID NO: 1376054 - RNA, 22 nt, Human
ugcucggggugcacaggagggg

SEQ ID NO: 1376055 - RNA, 20 nt, Human
ugcucggggugcacaggagg

SEQ ID NO: 1376056 - RNA, 19 nt, Human
ugcucggggugcacaggag

SEQ ID NO: 1376057 - RNA, 18 nt, Human
ugcucggggugcacagga

SEQ ID NO: 1376058 - RNA, 17 nt, Human
ugcucggggugcacagg

SEQ ID NO: 1376059 - RNA, 16 nt, Human
ugcucggggugcacag

SEQ ID NO: 1376060 - RNA, 15 nt, Human
ugcucggggugcaca

SEQ ID NO: 1376061 - RNA, 19 nt, Human
ugcucgcuguugcugaaua

SEQ ID NO: 1376062 - RNA, 21 nt, Human
ugcucuuggcuggacccagcc

SEQ ID NO: 1376063 - RNA, 20 nt, Human
ugcucuuggcuggacccagc

SEQ ID NO: 1376064 - RNA, 19 nt, Human
ugcucuuggcuggacccag

SEQ ID NO: 1376065 - RNA, 15 nt, Human
ugcucuuggcuggac

SEQ ID NO: 1376066 - RNA, 14 nt, Human
ugcucuuggcugga

SEQ ID NO: 1376067 - RNA, 15 nt, Human
ugcucuccucuucua

SEQ ID NO: 1376068 - RNA, 14 nt, Human
ugcucuccucuucu

SEQ ID NO: 1376069 - RNA, 13 nt, Human
ugcucuccucuuc

SEQ ID NO: 1376070 - RNA, 11 nt, Human
ugcucuccucu

SEQ ID NO: 1376071 - RNA, 12 nt, Human
ugcucuccucuu

SEQ ID NO: 1376072 - RNA, 10 nt, Human
ugcucuccuc

SEQ ID NO: 1376073 - RNA, 13 nt, Human
ugcucuccuccac

SEQ ID NO: 1376074 - RNA, 18 nt, Human
ugcuaggccagagcccac

SEQ ID NO: 1376075 - RNA, 19 nt, Human
ugcuaggccagagcccacu

SEQ ID NO: 1376076 - RNA, 17 nt, Human
ugcuaggccagagccca

SEQ ID NO: 1376077 - RNA, 14 nt, Human
ugcuaggccagagc

SEQ ID NO: 1376078 - RNA, 18 nt, Human
ugcuaggaagaggagugg

SEQ ID NO: 1376079 - RNA, 12 nt, Human
ugcuaggaagag

SEQ ID NO: 1376080 - RNA, 13 nt, Human
ugcucagacagaa

SEQ ID NO: 1376081 - RNA, 17 nt, Human
ugcucacgucaaaugca

SEQ ID NO: 1376082 - RNA, 19 nt, Human
ugcucacccagugcccucu

SEQ ID NO: 1376083 - RNA, 14 nt, Human
ugcucacccagugc

SEQ ID NO: 1376084 - RNA, 18 nt, Human
ugcucaggagcccuggga

SEQ ID NO: 1376085 - RNA, 19 nt, Human
ugcucaggagcccugggag

SEQ ID NO: 1376086 - RNA, 20 nt, Human
ugcucaggagcccugggagg

SEQ ID NO: 1376087 - RNA, 18 nt, Human
ugcuacuggggaaacugg

SEQ ID NO: 1376088 - RNA, 13 nt, Human
ugcuacuggggaa

SEQ ID NO: 1376089 - RNA, 15 nt, Human
ugcuagaacaugguu

SEQ ID NO: 1376090 - RNA, 16 nt, Human
ugcuacuuauauaauu

SEQ ID NO: 1376091 - RNA, 19 nt, Human
ugcuacuggggaaacuggc

SEQ ID NO: 1376092 - RNA, 22 nt, Human
ugcuacuggggaaacuggccau

SEQ ID NO: 1376093 - RNA, 19 nt, Human
ugcuaacggugcucagggg

SEQ ID NO: 1376094 - RNA, 18 nt, Human
ugcuaacggugcucaggg

SEQ ID NO: 1376095 - RNA, 22 nt, Human
ugcguguuuggguuuuuuuccu

SEQ ID NO: 1376096 - RNA, 17 nt, Human
ugccuuggccucccaag

SEQ ID NO: 1376097 - RNA, 17 nt, Human
ugccucuaccugacacu

SEQ ID NO: 1376098 - RNA, 15 nt, Human
ugccucuaccugaca

SEQ ID NO: 1376099 - RNA, 19 nt, Human
ugccucuacugggaaggcu

SEQ ID NO: 1376100 - RNA, 16 nt, Human
ugccucuacugggaag

SEQ ID NO: 1376101 - RNA, 23 nt, Human
ugccucuaccugacacucccuug

SEQ ID NO: 1376102 - RNA, 20 nt, Human
ugccuugcauaauggucaga

SEQ ID NO: 1376103 - RNA, 17 nt, Human
ugcgccaccgcccagag

SEQ ID NO: 1376104 - RNA, 18 nt, Human
ugcgcuccuggcccagcc

SEQ ID NO: 1376105 - RNA, 20 nt, Human
ugcgcuccuggcccagccuu

SEQ ID NO: 1376106 - RNA, 17 nt, Human
ugcgcuccuggcccagc

SEQ ID NO: 1376107 - RNA, 14 nt, Human
ugcgcuccuggccc

SEQ ID NO: 1376108 - RNA, 13 nt, Human
ugcgcuccuggcc

SEQ ID NO: 1376109 - RNA, 23 nt, Human
ugcgcucagggccaugcugaggc

SEQ ID NO: 1376110 - RNA, 22 nt, Human
ugcgcucagggccaugcugagg

SEQ ID NO: 1376111 - RNA, 21 nt, Human
ugcgcucagggccaugcugag

SEQ ID NO: 1376112 - RNA, 19 nt, Human
ugcgcucagggccaugcug

SEQ ID NO: 1376113 - RNA, 15 nt, Human
ugcgcucagggccau

SEQ ID NO: 1376114 - RNA, 14 nt, Human
ugcgcucagggcca

SEQ ID NO: 1376115 - RNA, 13 nt, Human
ugcgcucagggcc

SEQ ID NO: 1376116 - RNA, 15 nt, Human
uggccucaaagcaag

SEQ ID NO: 1376117 - RNA, 21 nt, Human
uggccccucaaaucguccagc

SEQ ID NO: 1376118 - RNA, 16 nt, Human
uggccccguuucuggu

SEQ ID NO: 1376119 - RNA, 15 nt, Human
uggccccguuucugg

SEQ ID NO: 1376120 - RNA, 11 nt, Human
uggcccccucc

SEQ ID NO: 1376121 - RNA, 15 nt, Human
uggccccccuggucc

SEQ ID NO: 1376122 - RNA, 21 nt, Human
uggccccccugguccccuccu

SEQ ID NO: 1376123 - RNA, 22 nt, Human
uggcccaucaggguaggcugga

SEQ ID NO: 1376124 - RNA, 12 nt, Human
uggcccaucagg

SEQ ID NO: 1376125 - RNA, 23 nt, Human
uggcccagggcccagagcccagc

SEQ ID NO: 1376126 - RNA, 22 nt, Human
uggcccagggcccagagcccag

SEQ ID NO: 1376127 - RNA, 21 nt, Human
uggcccagggcccagagccca

SEQ ID NO: 1376128 - RNA, 20 nt, Human
uggcccagggcccagagccc

SEQ ID NO: 1376129 - RNA, 18 nt, Human
uggcccagggcccagagc

SEQ ID NO: 1376130 - RNA, 17 nt, Human
uggcccagggcccagag

SEQ ID NO: 1376131 - RNA, 13 nt, Human
uggccaggaagcu

SEQ ID NO: 1376132 - RNA, 21 nt, Human
uggccaggaagcuuuggugag

SEQ ID NO: 1376133 - RNA, 21 nt, Human
uggccagcuggaggcaggggc

SEQ ID NO: 1376134 - RNA, 23 nt, Human
uggccagcgagcgcccagcuccu

SEQ ID NO: 1376135 - RNA, 22 nt, Human
uggccagccccuuagacagagg

SEQ ID NO: 1376136 - RNA, 21 nt, Human
uggccagccccuuagacagag

SEQ ID NO: 1376137 - RNA, 20 nt, Human
uggccagccccuuagacaga

SEQ ID NO: 1376138 - RNA, 16 nt, Human
uggccagccccuuaga

SEQ ID NO: 1376139 - RNA, 12 nt, Human
uggccagccccu

SEQ ID NO: 1376140 - RNA, 20 nt, Human
uggcagaguuacaguucugu

SEQ ID NO: 1376141 - RNA, 19 nt, Human
uggcagaguuacaguucug

SEQ ID NO: 1376142 - RNA, 18 nt, Human
uggcagagaugccucccu

SEQ ID NO: 1376143 - RNA, 19 nt, Human
uggcagagaugccucccug

SEQ ID NO: 1376144 - RNA, 17 nt, Human
uggcagagaugccuccc

SEQ ID NO: 1376145 - RNA, 13 nt, Human
uggcagagaugcc

SEQ ID NO: 1376146 - RNA, 17 nt, Human
uggcagaguuacaguuc

SEQ ID NO: 1376147 - RNA, 12 nt, Human
uggcagaguuac

SEQ ID NO: 1376148 - RNA, 17 nt, Human
uggccuccccugccacc

SEQ ID NO: 1376149 - RNA, 15 nt, Human
uggccuccccugcca

SEQ ID NO: 1376150 - RNA, 14 nt, Human
uggccuccccugcc

SEQ ID NO: 1376151 - RNA, 15 nt, Human
uggccucccccacuu

SEQ ID NO: 1376152 - RNA, 21 nt, Human
uggccucauguggcuggaaga

SEQ ID NO: 1376153 - RNA, 20 nt, Human
uggccucauguggcuggaag

SEQ ID NO: 1376154 - RNA, 19 nt, Human
uggccucauguggcuggaa

SEQ ID NO: 1376155 - RNA, 18 nt, Human
uggccucauguggcugga

SEQ ID NO: 1376156 - RNA, 17 nt, Human
uggccucauguggcugg

SEQ ID NO: 1376157 - RNA, 15 nt, Human
uggccucauguggcu

SEQ ID NO: 1376158 - RNA, 13 nt, Human
uggccucaugugg

SEQ ID NO: 1376159 - RNA, 19 nt, Human
uggccucagcucccacaag

SEQ ID NO: 1376160 - RNA, 16 nt, Human
uggcgaugccagccaa

SEQ ID NO: 1376161 - RNA, 19 nt, Human
uggcgaugccagccaagcu

SEQ ID NO: 1376162 - RNA, 14 nt, Human
uggcgaugccagcc

SEQ ID NO: 1376163 - RNA, 13 nt, Human
uggcgaugccagc

SEQ ID NO: 1376164 - RNA, 23 nt, Human
uggccuccccugccaccaggcca

SEQ ID NO: 1376165 - RNA, 21 nt, Human
uggccuccccugccaccaggc

SEQ ID NO: 1376166 - RNA, 20 nt, Human
uggccuccccugccaccagg

SEQ ID NO: 1376167 - RNA, 19 nt, Human
uggccuccccugccaccag

SEQ ID NO: 1376168 - RNA, 21 nt, Human
uggcucccaggggcucccucc

SEQ ID NO: 1376169 - RNA, 19 nt, Human
uggcucccaggggcucccu

SEQ ID NO: 1376170 - RNA, 14 nt, Human
uggcucccaggggc

SEQ ID NO: 1376171 - RNA, 20 nt, Human
uggcugcugaucgccuuccc

SEQ ID NO: 1376172 - RNA, 17 nt, Human
uggcguaggcuacagag

SEQ ID NO: 1376173 - RNA, 16 nt, Human
uggcguaggcuacaga

SEQ ID NO: 1376174 - RNA, 23 nt, Human
uggcguaaguacagagaagccau

SEQ ID NO: 1376175 - RNA, 22 nt, Human
uggcguaaguacagagaagcca

SEQ ID NO: 1376176 - RNA, 21 nt, Human
uggcguaaguacagagaagcc

SEQ ID NO: 1376177 - RNA, 20 nt, Human
uggcguaaguacagagaagc

SEQ ID NO: 1376178 - RNA, 19 nt, Human
uggcguaaguacagagaag

SEQ ID NO: 1376179 - RNA, 18 nt, Human
uggcguaaguacagagaa

SEQ ID NO: 1376180 - RNA, 17 nt, Human
uggcguaaguacagaga

SEQ ID NO: 1376181 - RNA, 20 nt, Human
uggcggcuggggucccagca

SEQ ID NO: 1376182 - RNA, 21 nt, Human
uggcggcuggggucccagcag

SEQ ID NO: 1376183 - RNA, 16 nt, Human
uggcguaaguacagag

SEQ ID NO: 1376184 - RNA, 15 nt, Human
uggcguaaguacaga

SEQ ID NO: 1376185 - RNA, 18 nt, Human
uggcggggggcccauugg

SEQ ID NO: 1376186 - RNA, 19 nt, Human
uggcggggaggaggaaauc

SEQ ID NO: 1376187 - RNA, 17 nt, Human
uggcggggaggaggaaa

SEQ ID NO: 1376188 - RNA, 15 nt, Human
uggcgggguggggug

SEQ ID NO: 1376189 - RNA, 17 nt, Human
uggcaaaggaaggugga

SEQ ID NO: 1376190 - RNA, 21 nt, Human
uggcaaagccuucauugccuu

SEQ ID NO: 1376191 - RNA, 20 nt, Human
uggcaaaacucuacuuaauc

SEQ ID NO: 1376192 - RNA, 23 nt, Human
uggauuuuuuccuucaaaguuua

SEQ ID NO: 1376193 - RNA, 18 nt, Human
uggauuuuucuuuaacug

SEQ ID NO: 1376194 - RNA, 22 nt, Human
uggcacuaacguugagccccug

SEQ ID NO: 1376195 - RNA, 15 nt, Human
uggcacuaguauuuc

SEQ ID NO: 1376196 - RNA, 14 nt, Human
uggcaagugaauuu

SEQ ID NO: 1376197 - RNA, 17 nt, Human
uggcaaggguucaccug

SEQ ID NO: 1376198 - RNA, 20 nt, Human
uggcaauagucaaauugugu

SEQ ID NO: 1376199 - RNA, 14 nt, Human
uggaggaccugagc

SEQ ID NO: 1376200 - RNA, 15 nt, Human
uggaggaccugagcc

SEQ ID NO: 1376201 - RNA, 13 nt, Human
uggaggaccugag

SEQ ID NO: 1376202 - RNA, 18 nt, Human
uggaguuuuuuguaccaa

SEQ ID NO: 1376203 - RNA, 17 nt, Human
uggaguuuuuuguacca

SEQ ID NO: 1376204 - RNA, 16 nt, Human
uggaguuuuguuuccu

SEQ ID NO: 1376205 - RNA, 20 nt, Human
uggaguuuuguuuccucugu

SEQ ID NO: 1376206 - RNA, 17 nt, Human
uggaguuucuaaggucc

SEQ ID NO: 1376207 - RNA, 16 nt, Human
uggaguuucuaagguc

SEQ ID NO: 1376208 - RNA, 14 nt, Human
uggaguuucuaagg

SEQ ID NO: 1376209 - RNA, 13 nt, Human
uggaguuucuaag

SEQ ID NO: 1376210 - RNA, 21 nt, Human
uggaguuucauguacaagaug

SEQ ID NO: 1376211 - RNA, 21 nt, Human
uggauaacuuccacagggucc

SEQ ID NO: 1376212 - RNA, 22 nt, Human
uggaucucccugagaugggcuu

SEQ ID NO: 1376213 - RNA, 16 nt, Human
uggauaacuuccacag

SEQ ID NO: 1376214 - RNA, 15 nt, Human
uggauaacuuccaca

SEQ ID NO: 1376215 - RNA, 20 nt, Human
uggacucagggcagcgccag

SEQ ID NO: 1376216 - RNA, 18 nt, Human
uggacucagggcagcgcc

SEQ ID NO: 1376217 - RNA, 15 nt, Human
uggacucagggcagc

SEQ ID NO: 1376218 - RNA, 14 nt, Human
uggacucagggcag

SEQ ID NO: 1376219 - RNA, 19 nt, Human
uggaccacugggcaaugau

SEQ ID NO: 1376220 - RNA, 15 nt, Human
uggaccacugggcaa

SEQ ID NO: 1376221 - RNA, 15 nt, Human
uggaccagccucucc

SEQ ID NO: 1376222 - RNA, 19 nt, Human
uggacugagugggaagccc

SEQ ID NO: 1376223 - RNA, 17 nt, Human
uggacugagugggaagc

SEQ ID NO: 1376224 - RNA, 14 nt, Human
uggacuggaagggg

SEQ ID NO: 1376225 - RNA, 11 nt, Human
uggagaaggaa

SEQ ID NO: 1376226 - RNA, 12 nt, Human
uggagaaggaag

SEQ ID NO: 1376227 - RNA, 13 nt, Human
uggagaaggaagg

SEQ ID NO: 1376228 - RNA, 23 nt, Human
uggagaagucucagcuaagcuca

SEQ ID NO: 1376229 - RNA, 17 nt, Human
uggagaagucucagcua

SEQ ID NO: 1376230 - RNA, 16 nt, Human
uggagaagucucagcu

SEQ ID NO: 1376231 - RNA, 15 nt, Human
uggagaagucucagc

SEQ ID NO: 1376232 - RNA, 14 nt, Human
uggagaaggaaggc

SEQ ID NO: 1376233 - RNA, 14 nt, Human
ugcuguuccagugg

SEQ ID NO: 1376234 - RNA, 17 nt, Human
ugcuguuugacaccucu

SEQ ID NO: 1376235 - RNA, 23 nt, Human
ugcuguuuauuaaucuuagugua

SEQ ID NO: 1376236 - RNA, 17 nt, Human
ugcuguuuauuaaucuu

SEQ ID NO: 1376237 - RNA, 14 nt, Human
ugcuguuuauuaau

SEQ ID NO: 1376238 - RNA, 22 nt, Human
uggacacgcucaguggggcaga

SEQ ID NO: 1376239 - RNA, 15 nt, Human
uggacacgcucagug

SEQ ID NO: 1376240 - RNA, 18 nt, Human
uggacaccuuuagguucu

SEQ ID NO: 1376241 - RNA, 16 nt, Human
uggacacuacacccag

SEQ ID NO: 1376242 - RNA, 17 nt, Human
uggacacuacacccagc

SEQ ID NO: 1376243 - RNA, 18 nt, Human
uggacacuacacccagca

SEQ ID NO: 1376244 - RNA, 19 nt, Human
uggacacuacacccagcaa

SEQ ID NO: 1376245 - RNA, 15 nt, Human
uggacacucagaccu

SEQ ID NO: 1376246 - RNA, 20 nt, Human
uggacacuacacccagcaau

SEQ ID NO: 1376247 - RNA, 14 nt, Human
uggacaggcuggcu

SEQ ID NO: 1376248 - RNA, 23 nt, Human
uggacacuuaauacuaccuugaa

SEQ ID NO: 1376249 - RNA, 16 nt, Human
uggacacucagaccug

SEQ ID NO: 1376250 - RNA, 14 nt, Human
uggacauccuccuc

SEQ ID NO: 1376251 - RNA, 23 nt, Human
uggacaguuuaccaguugccuuu

SEQ ID NO: 1376252 - RNA, 21 nt, Human
uggaccaauagggcugagcuc

SEQ ID NO: 1376253 - RNA, 20 nt, Human
uggaccaauagggcugagcu

SEQ ID NO: 1376254 - RNA, 18 nt, Human
uggacauccuccucccac

SEQ ID NO: 1376255 - RNA, 18 nt, Human
uggugacaucagguuuuu

SEQ ID NO: 1376256 - RNA, 20 nt, Human
uggucgaggaguaacaauac

SEQ ID NO: 1376257 - RNA, 16 nt, Human
uggucgaggaguaaca

SEQ ID NO: 1376258 - RNA, 23 nt, Human
uggucgagaaagaggcaccagga

SEQ ID NO: 1376259 - RNA, 15 nt, Human
ugguccuuucuuccg

SEQ ID NO: 1376260 - RNA, 12 nt, Human
ugguccuuuggg

SEQ ID NO: 1376261 - RNA, 18 nt, Human
uggucuaaguccagucca

SEQ ID NO: 1376262 - RNA, 22 nt, Human
uggucguuuuuuuuuuguuugu

SEQ ID NO: 1376263 - RNA, 12 nt, Human
uggucuaaaacu

SEQ ID NO: 1376264 - RNA, 13 nt, Human
uggucguuuuuuu

SEQ ID NO: 1376265 - RNA, 17 nt, Human
uggucggaaaacaugcu

SEQ ID NO: 1376266 - RNA, 15 nt, Human
uggucgcuccugccc

SEQ ID NO: 1376267 - RNA, 13 nt, Human
uggucgcuccugc

SEQ ID NO: 1376268 - RNA, 17 nt, Human
uggucgaggaguaacaa

SEQ ID NO: 1376269 - RNA, 14 nt, Human
uggucggaaaacau

SEQ ID NO: 1376270 - RNA, 15 nt, Human
uggugccaauuucaa

SEQ ID NO: 1376271 - RNA, 23 nt, Human
uggugcacagcacaaauuaguua

SEQ ID NO: 1376272 - RNA, 22 nt, Human
uggugcaauguguguauaugga

SEQ ID NO: 1376273 - RNA, 17 nt, Human
uggugagggaagacgcc

SEQ ID NO: 1376274 - RNA, 16 nt, Human
uggugauuuagcagga

SEQ ID NO: 1376275 - RNA, 22 nt, Human
uggugauuuagcaggaagcugu

SEQ ID NO: 1376276 - RNA, 22 nt, Human
uggugacaucagguuuuucccg

SEQ ID NO: 1376277 - RNA, 18 nt, Human
uggucaacuugagcaugu

SEQ ID NO: 1376278 - RNA, 12 nt, Human
ugggucacagga

SEQ ID NO: 1376279 - RNA, 21 nt, Human
uggguaucaccacuggagauc

SEQ ID NO: 1376280 - RNA, 13 nt, Human
ugggucacaggaa

SEQ ID NO: 1376281 - RNA, 22 nt, Human
uggguaucaccacuggagauca

SEQ ID NO: 1376282 - RNA, 22 nt, Human
ugguauuuucaauagccacuaa

SEQ ID NO: 1376283 - RNA, 20 nt, Human
ugguauuuucaauagccacu

SEQ ID NO: 1376284 - RNA, 17 nt, Human
ugguauuuucaauagcc

SEQ ID NO: 1376285 - RNA, 13 nt, Human
ugguauuuucaau

SEQ ID NO: 1376286 - RNA, 23 nt, Human
ugguauuguauuuauucaauaaa

SEQ ID NO: 1376287 - RNA, 21 nt, Human
ugguauguuuucaggcuagau

SEQ ID NO: 1376288 - RNA, 13 nt, Human
ugguauguuuuca

SEQ ID NO: 1376289 - RNA, 20 nt, Human
ugguccgugggacggugccc

SEQ ID NO: 1376290 - RNA, 19 nt, Human
ugguccuauggccucaugu

SEQ ID NO: 1376291 - RNA, 16 nt, Human
ugguccuauggccuca

SEQ ID NO: 1376292 - RNA, 22 nt, Human
uggucccuuguauccccugcag

SEQ ID NO: 1376293 - RNA, 23 nt, Human
uggucccuuguauccccugcagg

SEQ ID NO: 1376294 - RNA, 22 nt, Human
uggucccuguuuucccacgagg

SEQ ID NO: 1376295 - RNA, 12 nt, Human
uggucccugggu

SEQ ID NO: 1376296 - RNA, 22 nt, Human
ugguccccuccuucccaaguga

SEQ ID NO: 1376297 - RNA, 18 nt, Human
ugguccccuccuucccaa

SEQ ID NO: 1376298 - RNA, 19 nt, Human
ugggaucagggguaggaau

SEQ ID NO: 1376299 - RNA, 16 nt, Human
uggcugcugugggaaa

SEQ ID NO: 1376300 - RNA, 14 nt, Human
uggcugcuguggga

SEQ ID NO: 1376301 - RNA, 20 nt, Human
ugggaucagggguaggaaug

SEQ ID NO: 1376302 - RNA, 22 nt, Human
ugggauguucagcacugucccu

SEQ ID NO: 1376303 - RNA, 21 nt, Human
ugggauguucagcacuguccc

SEQ ID NO: 1376304 - RNA, 20 nt, Human
ugggauguucagcacugucc

SEQ ID NO: 1376305 - RNA, 16 nt, Human
ugggauguucagcacu

SEQ ID NO: 1376306 - RNA, 13 nt, Human
ugggcagggagcg

SEQ ID NO: 1376307 - RNA, 18 nt, Human
ugggcaggagggaggugc

SEQ ID NO: 1376308 - RNA, 16 nt, Human
ugggcaggagggaggu

SEQ ID NO: 1376309 - RNA, 15 nt, Human
ugggcaggagggagg

SEQ ID NO: 1376310 - RNA, 14 nt, Human
ugggcagagcuggc

SEQ ID NO: 1376311 - RNA, 13 nt, Human
ugggcaggaggga

SEQ ID NO: 1376312 - RNA, 16 nt, Human
ugggcagagcuggcuc

SEQ ID NO: 1376313 - RNA, 12 nt, Human
ugggcagagcug

SEQ ID NO: 1376314 - RNA, 14 nt, Human
ugggcagagcccaa

SEQ ID NO: 1376315 - RNA, 13 nt, Human
ugggcagagccca

SEQ ID NO: 1376316 - RNA, 19 nt, Human
ugggccugggcuccuggac

SEQ ID NO: 1376317 - RNA, 18 nt, Human
ugggccugggcuccugga

SEQ ID NO: 1376318 - RNA, 17 nt, Human
ugggccugggcuccugg

SEQ ID NO: 1376319 - RNA, 16 nt, Human
ugggccugggcuccug

SEQ ID NO: 1376320 - RNA, 15 nt, Human
ugggccugggcuccu

SEQ ID NO: 1376321 - RNA, 13 nt, Human
ugggccugggcuc

SEQ ID NO: 1376322 - RNA, 23 nt, Human
ugggccugguuaaauaaggcagg

SEQ ID NO: 1376323 - RNA, 22 nt, Human
ugggccuggucucacccuggag

SEQ ID NO: 1376324 - RNA, 21 nt, Human
ugggccuggucucacccugga

SEQ ID NO: 1376325 - RNA, 20 nt, Human
ugggccugggcuccuggacc

SEQ ID NO: 1376326 - RNA, 18 nt, Human
ugggcccucucugcucug

SEQ ID NO: 1376327 - RNA, 16 nt, Human
ugggcccucucugcuc

SEQ ID NO: 1376328 - RNA, 13 nt, Human
ugggcccucucug

SEQ ID NO: 1376329 - RNA, 21 nt, Human
ugggccccugccucucugcag

SEQ ID NO: 1376330 - RNA, 23 nt, Human
ugggccccugccucucugcaggu

SEQ ID NO: 1376331 - RNA, 24 nt, Human
uggggggugaugagggcagcagcc

SEQ ID NO: 1376332 - RNA, 16 nt, Human
ugggggguggccaggc

SEQ ID NO: 1376333 - RNA, 20 nt, Human
uggggggugaugagggcagc

SEQ ID NO: 1376334 - RNA, 19 nt, Human
uggggggugaugagggcag

SEQ ID NO: 1376335 - RNA, 18 nt, Human
uggggggugaugagggca

SEQ ID NO: 1376336 - RNA, 23 nt, Human
uggggggguggccgcugaguggc

SEQ ID NO: 1376337 - RNA, 14 nt, Human
uggggggguggccg

SEQ ID NO: 1376338 - RNA, 13 nt, Human
uggggggguggcc

SEQ ID NO: 1376339 - RNA, 21 nt, Human
uggggguagggggcuggagga

SEQ ID NO: 1376340 - RNA, 21 nt, Human
uggggguccuccuccagggac

SEQ ID NO: 1376341 - RNA, 19 nt, Human
uggggguagggggcuggag

SEQ ID NO: 1376342 - RNA, 21 nt, Human
ugggggacuuacaugauucau

SEQ ID NO: 1376343 - RNA, 14 nt, Human
ugggggacuuacau

SEQ ID NO: 1376344 - RNA, 16 nt, Human
ugggggacuguaaguu

SEQ ID NO: 1376345 - RNA, 21 nt, Human
ugggggaguagaucuuucuag

SEQ ID NO: 1376346 - RNA, 15 nt, Human
uggguacccccagga

SEQ ID NO: 1376347 - RNA, 18 nt, Human
uggguaaugaaacaaaga

SEQ ID NO: 1376348 - RNA, 16 nt, Human
uggggguucaggcccg

SEQ ID NO: 1376349 - RNA, 16 nt, Human
uggggguggggguagg

SEQ ID NO: 1376350 - RNA, 10 nt, Human
uggggguggg

SEQ ID NO: 1376351 - RNA, 20 nt, Human
uggguauaguucaugucugc

SEQ ID NO: 1376352 - RNA, 17 nt, Human
uggguauaaaagauggg

SEQ ID NO: 1376353 - RNA, 19 nt, Human
uggguacuucuugaaggug

SEQ ID NO: 1376354 - RNA, 16 nt, Human
uggguacuucuugaag

SEQ ID NO: 1376355 - RNA, 15 nt, Human
uggguauaaaagaug

SEQ ID NO: 1376356 - RNA, 20 nt, Human
ugggcuuccuggagcagaag

SEQ ID NO: 1376357 - RNA, 17 nt, Human
ugggcuuccuggagcag

SEQ ID NO: 1376358 - RNA, 16 nt, Human
ugggcuuccuggagca

SEQ ID NO: 1376359 - RNA, 15 nt, Human
ugggcuuccuggagc

SEQ ID NO: 1376360 - RNA, 14 nt, Human
ugggcuuccuggag

SEQ ID NO: 1376361 - RNA, 13 nt, Human
ugggcuuccugga

SEQ ID NO: 1376362 - RNA, 13 nt, Human
ugggcuucccaag

SEQ ID NO: 1376363 - RNA, 14 nt, Human
ugggcuucccaagg

SEQ ID NO: 1376364 - RNA, 13 nt, Human
ugggcuucaucug

SEQ ID NO: 1376365 - RNA, 15 nt, Human
ugggccuuaggaaga

SEQ ID NO: 1376366 - RNA, 17 nt, Human
ugggcuugcuauucugu

SEQ ID NO: 1376367 - RNA, 14 nt, Human
ugggcuugcuauuc

SEQ ID NO: 1376368 - RNA, 14 nt, Human
ugggcuugauucug

SEQ ID NO: 1376369 - RNA, 13 nt, Human
ugggcuugauucu

SEQ ID NO: 1376370 - RNA, 21 nt, Human
ugggcuugcuauucugucccu

SEQ ID NO: 1376371 - RNA, 20 nt, Human
uggggaguuuaggguggggg

SEQ ID NO: 1376372 - RNA, 20 nt, Human
uggggaucccucccccccau

SEQ ID NO: 1376373 - RNA, 17 nt, Human
uggggauaggccagccg

SEQ ID NO: 1376374 - RNA, 18 nt, Human
uggggauaggccagccgc

SEQ ID NO: 1376375 - RNA, 15 nt, Human
uggggccaggucacc

SEQ ID NO: 1376376 - RNA, 22 nt, Human
uggggaugguaguuuuuucauc

SEQ ID NO: 1376377 - RNA, 21 nt, Human
uggggccaggcugggucgccc

SEQ ID NO: 1376378 - RNA, 22 nt, Human
uggggccaggcugggucgcccu

SEQ ID NO: 1376379 - RNA, 20 nt, Human
uuugugggggacuguaaguu

SEQ ID NO: 1376380 - RNA, 18 nt, Human
uuugugggggacuguaag

SEQ ID NO: 1376381 - RNA, 17 nt, Human
uuugugggggacuguaa

SEQ ID NO: 1376382 - RNA, 13 nt, Human
uucgggcugugcc

SEQ ID NO: 1376383 - RNA, 12 nt, Human
uucgggcugugc

SEQ ID NO: 1376384 - RNA, 20 nt, Human
uucgggccaaggaccugaga

SEQ ID NO: 1376385 - RNA, 18 nt, Human
uucgggccaaggaccuga

SEQ ID NO: 1376386 - RNA, 18 nt, Human
uucuaaaaauugugauca

SEQ ID NO: 1376387 - RNA, 12 nt, Human
uucguucugugg

SEQ ID NO: 1376388 - RNA, 14 nt, Human
uucgggcugugccc

SEQ ID NO: 1376389 - RNA, 15 nt, Human
uucguuuauuuucaa

SEQ ID NO: 1376390 - RNA, 23 nt, Human
uucuaaagauucuauaguucuag

SEQ ID NO: 1376391 - RNA, 22 nt, Human
uucuaaagauucuauaguucua

SEQ ID NO: 1376392 - RNA, 16 nt, Human
uucuaaagauucuaua

SEQ ID NO: 1376393 - RNA, 14 nt, Human
uucuaaagauucua

SEQ ID NO: 1376394 - RNA, 13 nt, Human
uucuaaagauucu

SEQ ID NO: 1376395 - RNA, 12 nt, Human
uucuaaagauuc

SEQ ID NO: 1376396 - RNA, 24 nt, Human
uuccuggacagcugugccucgcuc

SEQ ID NO: 1376397 - RNA, 21 nt, Human
uuccuggacagcugugccucg

SEQ ID NO: 1376398 - RNA, 20 nt, Human
uuccuggacagcugugccuc

SEQ ID NO: 1376399 - RNA, 19 nt, Human
uuccuggacagcugugccu

SEQ ID NO: 1376400 - RNA, 17 nt, Human
uuccuggacagcugugc

SEQ ID NO: 1376401 - RNA, 15 nt, Human
uuccuggacagcugu

SEQ ID NO: 1376402 - RNA, 16 nt, Human
uuccugccccaggccu

SEQ ID NO: 1376403 - RNA, 13 nt, Human
uuccugccccagg

SEQ ID NO: 1376404 - RNA, 23 nt, Human
uuccugccccaacuccuuccagc

SEQ ID NO: 1376405 - RNA, 20 nt, Human
uuccugccagccccugccau

SEQ ID NO: 1376406 - RNA, 22 nt, Human
uuccuggagcagaagcagcaac

SEQ ID NO: 1376407 - RNA, 15 nt, Human
uuccugccagccccu

SEQ ID NO: 1376408 - RNA, 16 nt, Human
uuccuaugcuuugaaa

SEQ ID NO: 1376409 - RNA, 11 nt, Human
uuccucagcca

SEQ ID NO: 1376410 - RNA, 22 nt, Human
uuccucaugaauguaaauuugu

SEQ ID NO: 1376411 - RNA, 18 nt, Human
uuccucagacucuaagaa

SEQ ID NO: 1376412 - RNA, 14 nt, Human
uuccucagacucua

SEQ ID NO: 1376413 - RNA, 21 nt, Human
uuccucacaccaggcuugccu

SEQ ID NO: 1376414 - RNA, 19 nt, Human
uuccuauacgcagcgugcu

SEQ ID NO: 1376415 - RNA, 13 nt, Human
uuccuauacgcag

SEQ ID NO: 1376416 - RNA, 12 nt, Human
uucccuuuguga

SEQ ID NO: 1376417 - RNA, 22 nt, Human
uucccuuugugagucaauacau

SEQ ID NO: 1376418 - RNA, 14 nt, Human
uuccuaugcuuuga

SEQ ID NO: 1376419 - RNA, 18 nt, Human
uucccuugaugaagaagu

SEQ ID NO: 1376420 - RNA, 14 nt, Human
uucccuugagcccu

SEQ ID NO: 1376421 - RNA, 15 nt, Human
uucccuugagcccuc

SEQ ID NO: 1376422 - RNA, 20 nt, Human
uucccucuuuggcuccccug

SEQ ID NO: 1376423 - RNA, 16 nt, Human
uucccucuuuggcucc

SEQ ID NO: 1376424 - RNA, 14 nt, Human
uucccucuuuggcu

SEQ ID NO: 1376425 - RNA, 13 nt, Human
uucccugaagcuc

SEQ ID NO: 1376426 - RNA, 16 nt, Human
uucccugacucauucu

SEQ ID NO: 1376427 - RNA, 13 nt, Human
uucccugacucau

SEQ ID NO: 1376428 - RNA, 15 nt, Human
uucccucucccaggc

SEQ ID NO: 1376429 - RNA, 14 nt, Human
uucccucucccagg

SEQ ID NO: 1376430 - RNA, 15 nt, Human
uucccucucuggaga

SEQ ID NO: 1376431 - RNA, 14 nt, Human
uucccucucucacu

SEQ ID NO: 1376432 - RNA, 16 nt, Human
uucccucucccaggcc

SEQ ID NO: 1376433 - RNA, 17 nt, Human
uucccucucccaggccc

SEQ ID NO: 1376434 - RNA, 13 nt, Human
uucccucucugga

SEQ ID NO: 1376435 - RNA, 21 nt, Human
uucccucucucauacccuccc

SEQ ID NO: 1376436 - RNA, 14 nt, Human
uucccuuccugcca

SEQ ID NO: 1376437 - RNA, 15 nt, Human
uucccuuccugccag

SEQ ID NO: 1376438 - RNA, 17 nt, Human
uucccuugaugaagaag

SEQ ID NO: 1376439 - RNA, 23 nt, Human
uucccugccucucaucaacugaa

SEQ ID NO: 1376440 - RNA, 14 nt, Human
uucccugccucuca

SEQ ID NO: 1376441 - RNA, 22 nt, Human
uucccugcugugaaagaaguaa

SEQ ID NO: 1376442 - RNA, 20 nt, Human
uucccuggaaaccuuccacc

SEQ ID NO: 1376443 - RNA, 23 nt, Human
uucccuggaaaccuuccacccag

SEQ ID NO: 1376444 - RNA, 22 nt, Human
uucccuggaaaccuuccaccca

SEQ ID NO: 1376445 - RNA, 13 nt, Human
uuccccccaaggg

SEQ ID NO: 1376446 - RNA, 15 nt, Human
uucccccacugauca

SEQ ID NO: 1376447 - RNA, 12 nt, Human
uucccccaccac

SEQ ID NO: 1376448 - RNA, 23 nt, Human
uucccccaccaccaaaacugcuc

SEQ ID NO: 1376449 - RNA, 19 nt, Human
uuccccauggcccugagcg

SEQ ID NO: 1376450 - RNA, 18 nt, Human
uuccccaucuucuaaacc

SEQ ID NO: 1376451 - RNA, 17 nt, Human
uuccccaucuucuaaac

SEQ ID NO: 1376452 - RNA, 19 nt, Human
uuccccaucucaggccaga

SEQ ID NO: 1376453 - RNA, 20 nt, Human
uuccccaucguugcccccau

SEQ ID NO: 1376454 - RNA, 15 nt, Human
uucccauuuaucuaa

SEQ ID NO: 1376455 - RNA, 15 nt, Human
uucccaucgcuguca

SEQ ID NO: 1376456 - RNA, 23 nt, Human
uucccauggggagggauucuggu

SEQ ID NO: 1376457 - RNA, 15 nt, Human
uucccauggggaggg

SEQ ID NO: 1376458 - RNA, 14 nt, Human
uucccauggggagg

SEQ ID NO: 1376459 - RNA, 15 nt, Human
uucccauuucagcug

SEQ ID NO: 1376460 - RNA, 14 nt, Human
uucccauuucagcu

SEQ ID NO: 1376461 - RNA, 13 nt, Human
uuccauuacaagu

SEQ ID NO: 1376462 - RNA, 23 nt, Human
uuccauuacaaguauuuuuaauu

SEQ ID NO: 1376463 - RNA, 23 nt, Human
uuccauuaaacgauuuuuaaaau

SEQ ID NO: 1376464 - RNA, 13 nt, Human
uuccauuaaacga

SEQ ID NO: 1376465 - RNA, 16 nt, Human
uuccaugugcccaguu

SEQ ID NO: 1376466 - RNA, 17 nt, Human
uuccaugugcccaguua

SEQ ID NO: 1376467 - RNA, 15 nt, Human
uuccaugugcccagu

SEQ ID NO: 1376468 - RNA, 14 nt, Human
uucccaucgcuguc

SEQ ID NO: 1376469 - RNA, 15 nt, Human
uucccauccccagcg

SEQ ID NO: 1376470 - RNA, 17 nt, Human
uucccauccccagcgau

SEQ ID NO: 1376471 - RNA, 14 nt, Human
uucccauccccagc

SEQ ID NO: 1376472 - RNA, 13 nt, Human
uucccauccccag

SEQ ID NO: 1376473 - RNA, 19 nt, Human
uuccauugguccaagauuc

SEQ ID NO: 1376474 - RNA, 17 nt, Human
uuccauugguccaagau

SEQ ID NO: 1376475 - RNA, 16 nt, Human
uuccauugguccaaga

SEQ ID NO: 1376476 - RNA, 17 nt, Human
uuccauuggaucucauu

SEQ ID NO: 1376477 - RNA, 16 nt, Human
uuccauuggaucucau

SEQ ID NO: 1376478 - RNA, 13 nt, Human
uuccauucuggaa

SEQ ID NO: 1376479 - RNA, 15 nt, Human
uuccauucuggaagu

SEQ ID NO: 1376480 - RNA, 12 nt, Human
uucauuugcuuu

SEQ ID NO: 1376481 - RNA, 18 nt, Human
uucauuugagaaguaaac

SEQ ID NO: 1376482 - RNA, 20 nt, Human
uucaugcaaacucuuugguc

SEQ ID NO: 1376483 - RNA, 16 nt, Human
uucaugcaaacucuuu

SEQ ID NO: 1376484 - RNA, 15 nt, Human
uucaugcaaacucuu

SEQ ID NO: 1376485 - RNA, 17 nt, Human
uucaugcaaacuuuauu

SEQ ID NO: 1376486 - RNA, 15 nt, Human
uucaugcagcugugg

SEQ ID NO: 1376487 - RNA, 14 nt, Human
uucaugcagcugug

SEQ ID NO: 1376488 - RNA, 13 nt, Human
uucaugcagcugu

SEQ ID NO: 1376489 - RNA, 13 nt, Human
uucaugcauggaa

SEQ ID NO: 1376490 - RNA, 18 nt, Human
uucaggaaaauugaaugc

SEQ ID NO: 1376491 - RNA, 19 nt, Human
uucaggaaaaggccugggg

SEQ ID NO: 1376492 - RNA, 18 nt, Human
uucaggaaaaggccuggg

SEQ ID NO: 1376493 - RNA, 17 nt, Human
uucaggaaaaggccugg

SEQ ID NO: 1376494 - RNA, 16 nt, Human
uucaggaaaaggccug

SEQ ID NO: 1376495 - RNA, 13 nt, Human
uucaggaaaauug

SEQ ID NO: 1376496 - RNA, 17 nt, Human
uucaugaaagauucaau

SEQ ID NO: 1376497 - RNA, 15 nt, Human
uucaugaaagauuca

SEQ ID NO: 1376498 - RNA, 15 nt, Human
uuccaaauacuaaug

SEQ ID NO: 1376499 - RNA, 14 nt, Human
uuccaaacuaauuu

SEQ ID NO: 1376500 - RNA, 21 nt, Human
uuccaaagaguagaauugcau

SEQ ID NO: 1376501 - RNA, 20 nt, Human
uuccaaacucuucccucucu

SEQ ID NO: 1376502 - RNA, 18 nt, Human
uuccaaaaucucccauuu

SEQ ID NO: 1376503 - RNA, 19 nt, Human
uuccaaaaucucccauuuu

SEQ ID NO: 1376504 - RNA, 16 nt, Human
uuccaaaaucucccau

SEQ ID NO: 1376505 - RNA, 16 nt, Human
uucauuugcuuuggaa

SEQ ID NO: 1376506 - RNA, 20 nt, Human
uuccaaauucaguuucauaa

SEQ ID NO: 1376507 - RNA, 19 nt, Human
uuccaaauucaguuucaua

SEQ ID NO: 1376508 - RNA, 18 nt, Human
uuccaaauucaguuucau

SEQ ID NO: 1376509 - RNA, 15 nt, Human
uuccaaauucaguuu

SEQ ID NO: 1376510 - RNA, 14 nt, Human
uuccaaauucaguu

SEQ ID NO: 1376511 - RNA, 21 nt, Human
uuccaaauguaauaaacuuua

SEQ ID NO: 1376512 - RNA, 13 nt, Human
uuccacugagacc

SEQ ID NO: 1376513 - RNA, 19 nt, Human
uuccacucguguguuucua

SEQ ID NO: 1376514 - RNA, 12 nt, Human
uuauuguacuug

SEQ ID NO: 1376515 - RNA, 15 nt, Human
uuauugucuagugaa

SEQ ID NO: 1376516 - RNA, 14 nt, Human
uuauuguauucugg

SEQ ID NO: 1376517 - RNA, 13 nt, Human
uuauuguauucug

SEQ ID NO: 1376518 - RNA, 15 nt, Human
uuauuguguuuguca

SEQ ID NO: 1376519 - RNA, 16 nt, Human
uuauuguguuugucau

SEQ ID NO: 1376520 - RNA, 17 nt, Human
uuauuguguuugucauu

SEQ ID NO: 1376521 - RNA, 18 nt, Human
uuauuguguuugucauua

SEQ ID NO: 1376522 - RNA, 16 nt, Human
uuauuuuaauaauguu

SEQ ID NO: 1376523 - RNA, 15 nt, Human
uuauuuuaauaaugu

SEQ ID NO: 1376524 - RNA, 14 nt, Human
uuauuggcugagau

SEQ ID NO: 1376525 - RNA, 16 nt, Human
uuauuggcugagauau

SEQ ID NO: 1376526 - RNA, 15 nt, Human
uuauuggcugagaua

SEQ ID NO: 1376527 - RNA, 18 nt, Human
uuauugguuuugcagaag

SEQ ID NO: 1376528 - RNA, 15 nt, Human
uuauugguuuugcag

SEQ ID NO: 1376529 - RNA, 22 nt, Human
uuauuggcugagauaugaacau

SEQ ID NO: 1376530 - RNA, 17 nt, Human
uuauuuuaauaauguuu

SEQ ID NO: 1376531 - RNA, 20 nt, Human
uuauuuuauguugcauagaa

SEQ ID NO: 1376532 - RNA, 21 nt, Human
uucaaagguucuagguuucaa

SEQ ID NO: 1376533 - RNA, 16 nt, Human
uucaaagguucuaggu

SEQ ID NO: 1376534 - RNA, 12 nt, Human
uucaaagguucu

SEQ ID NO: 1376535 - RNA, 22 nt, Human
uucaaagcuuuuuccagaggcu

SEQ ID NO: 1376536 - RNA, 23 nt, Human
uucaaagcuguguguuuggaaga

SEQ ID NO: 1376537 - RNA, 20 nt, Human
uucaaagcuguguguuugga

SEQ ID NO: 1376538 - RNA, 23 nt, Human
uucaaagccagcguccuccucug

SEQ ID NO: 1376539 - RNA, 16 nt, Human
uucaacggaaagugcu

SEQ ID NO: 1376540 - RNA, 17 nt, Human
uucaaauccuugaagau

SEQ ID NO: 1376541 - RNA, 19 nt, Human
uucaaaguuuaauaaauuu

SEQ ID NO: 1376542 - RNA, 14 nt, Human
uucaaaguuuaaua

SEQ ID NO: 1376543 - RNA, 13 nt, Human
uucaaaguguuau

SEQ ID NO: 1376544 - RNA, 19 nt, Human
uucaaauagggucuaacuc

SEQ ID NO: 1376545 - RNA, 18 nt, Human
uucaaauagggucuaacu

SEQ ID NO: 1376546 - RNA, 22 nt, Human
uucaaaucaaucuguaaaacua

SEQ ID NO: 1376547 - RNA, 23 nt, Human
uucaaaucaaucuguaaaacuaa

SEQ ID NO: 1376548 - RNA, 17 nt, Human
uucaauugcaucuccca

SEQ ID NO: 1376549 - RNA, 15 nt, Human
uucaauugcaucucc

SEQ ID NO: 1376550 - RNA, 19 nt, Human
uucaauugcaucucccaga

SEQ ID NO: 1376551 - RNA, 23 nt, Human
uucaauagccacuaaccuugccu

SEQ ID NO: 1376552 - RNA, 18 nt, Human
uucaccuguaaaccugag

SEQ ID NO: 1376553 - RNA, 17 nt, Human
uucaccuguaaaccuga

SEQ ID NO: 1376554 - RNA, 16 nt, Human
uucaccuguaaaccug

SEQ ID NO: 1376555 - RNA, 13 nt, Human
uucaccuguaaac

SEQ ID NO: 1376556 - RNA, 21 nt, Human
uucaccuggaagcauuuguuu

SEQ ID NO: 1376557 - RNA, 18 nt, Human
uucaccugccccaacucu

SEQ ID NO: 1376558 - RNA, 15 nt, Human
uucacaaacuuuuau

SEQ ID NO: 1376559 - RNA, 20 nt, Human
uucagauaaucacaauacau

SEQ ID NO: 1376560 - RNA, 21 nt, Human
uucagaguugaugguuguaca

SEQ ID NO: 1376561 - RNA, 22 nt, Human
uucagaguugaugguuguacau

SEQ ID NO: 1376562 - RNA, 23 nt, Human
uucagaguucuuuuugaaguauu

SEQ ID NO: 1376563 - RNA, 22 nt, Human
uucagaguucuuuuugaaguau

SEQ ID NO: 1376564 - RNA, 21 nt, Human
uucagaguucuuuuugaagua

SEQ ID NO: 1376565 - RNA, 22 nt, Human
uucagagccuccuuucuggcuu

SEQ ID NO: 1376566 - RNA, 15 nt, Human
uucagagaggccuuu

SEQ ID NO: 1376567 - RNA, 21 nt, Human
uucagagagcagugcuuuugg

SEQ ID NO: 1376568 - RNA, 22 nt, Human
uucagagagcagugcuuuuggc

SEQ ID NO: 1376569 - RNA, 19 nt, Human
uucagagagcagugcuuuu

SEQ ID NO: 1376570 - RNA, 18 nt, Human
uucagagagcagugcuuu

SEQ ID NO: 1376571 - RNA, 13 nt, Human
uucagagagcagu

SEQ ID NO: 1376572 - RNA, 20 nt, Human
uucagacaucugagguuuua

SEQ ID NO: 1376573 - RNA, 16 nt, Human
uuauugcaguuuauca

SEQ ID NO: 1376574 - RNA, 14 nt, Human
uuauugcaguuuau

SEQ ID NO: 1376575 - RNA, 19 nt, Human
uuauugcagcgauuaauaa

SEQ ID NO: 1376576 - RNA, 22 nt, Human
uuauugcaguuuaucauucaag

SEQ ID NO: 1376577 - RNA, 21 nt, Human
uuauugcaguuuaucauucaa

SEQ ID NO: 1376578 - RNA, 18 nt, Human
uuauugcaguuuaucauu

SEQ ID NO: 1376579 - RNA, 23 nt, Human
uuauugacacagaaaauguugag

SEQ ID NO: 1376580 - RNA, 19 nt, Human
uuauugacacagaaaaugu

SEQ ID NO: 1376581 - RNA, 14 nt, Human
uuauugacacagaa

SEQ ID NO: 1376582 - RNA, 12 nt, Human
uuauucuugguu

SEQ ID NO: 1376583 - RNA, 14 nt, Human
uuauucuucuagag

SEQ ID NO: 1376584 - RNA, 13 nt, Human
uuauucuucuaga

SEQ ID NO: 1376585 - RNA, 19 nt, Human
uuauucguagauauuggac

SEQ ID NO: 1376586 - RNA, 18 nt, Human
uuauuacuguaagaaaau

SEQ ID NO: 1376587 - RNA, 17 nt, Human
uuauuacuguaagaaaa

SEQ ID NO: 1376588 - RNA, 18 nt, Human
uuauuaaugcacuuucua

SEQ ID NO: 1376589 - RNA, 17 nt, Human
uuauuaaugcacuuucu

SEQ ID NO: 1376590 - RNA, 13 nt, Human
uuauuaaugcacu

SEQ ID NO: 1376591 - RNA, 20 nt, Human
uuauuaauuuuaguuuuuca

SEQ ID NO: 1376592 - RNA, 12 nt, Human
uuauuaauuuga

SEQ ID NO: 1376593 - RNA, 16 nt, Human
uuauuacuguaagaaa

SEQ ID NO: 1376594 - RNA, 11 nt, Human
uuauuaaugca

SEQ ID NO: 1376595 - RNA, 17 nt, Human
uuauuaaucuuagugua

SEQ ID NO: 1376596 - RNA, 23 nt, Human
uuauuaaagaaaaaaauguauuu

SEQ ID NO: 1376597 - RNA, 22 nt, Human
uuauuaaagaaaaaaauguauu

SEQ ID NO: 1376598 - RNA, 21 nt, Human
uuauuaaagaaaaaaauguau

SEQ ID NO: 1376599 - RNA, 20 nt, Human
uuauuaaagaaaaaaaugua

SEQ ID NO: 1376600 - RNA, 14 nt, Human
uuauuaaagaaaaa

SEQ ID NO: 1376601 - RNA, 13 nt, Human
uuauuaaagaaaa

SEQ ID NO: 1376602 - RNA, 12 nt, Human
uuauuaaagaaa

SEQ ID NO: 1376603 - RNA, 14 nt, Human
uuauuaaaccccuu

SEQ ID NO: 1376604 - RNA, 16 nt, Human
uuauuaaacaaauaau

SEQ ID NO: 1376605 - RNA, 20 nt, Human
uuaucuugaauaauguaaga

SEQ ID NO: 1376606 - RNA, 16 nt, Human
uuaucugucagcugca

SEQ ID NO: 1376607 - RNA, 14 nt, Human
uuaucugaucagaa

SEQ ID NO: 1376608 - RNA, 20 nt, Human
uuaucugaauuuuuaaacaa

SEQ ID NO: 1376609 - RNA, 18 nt, Human
uuaucugagucaacuccu

SEQ ID NO: 1376610 - RNA, 21 nt, Human
uuaucugaauuuuuaaacaag

SEQ ID NO: 1376611 - RNA, 18 nt, Human
uuaucugaauuuuuaaac

SEQ ID NO: 1376612 - RNA, 17 nt, Human
uuaucugaauuuuuaaa

SEQ ID NO: 1376613 - RNA, 12 nt, Human
uuaucugggcuu

SEQ ID NO: 1376614 - RNA, 18 nt, Human
uuaucugcaagugaggug

SEQ ID NO: 1376615 - RNA, 14 nt, Human
uuaucuauaauuua

SEQ ID NO: 1376616 - RNA, 17 nt, Human
uuaucuagauacuguau

SEQ ID NO: 1376617 - RNA, 22 nt, Human
uuaucuauaauuuaccuaagau

SEQ ID NO: 1376618 - RNA, 17 nt, Human
uuaucuauaauuuaccu

SEQ ID NO: 1376619 - RNA, 15 nt, Human
uuaucuauaauuuac

SEQ ID NO: 1376620 - RNA, 12 nt, Human
uuaucucugugu

SEQ ID NO: 1376621 - RNA, 13 nt, Human
uuaguugcaacuu

SEQ ID NO: 1376622 - RNA, 20 nt, Human
uuaguugcaacuuuguauaa

SEQ ID NO: 1376623 - RNA, 16 nt, Human
uuaucuagauacugua

SEQ ID NO: 1376624 - RNA, 17 nt, Human
uuaugaaaaagaagaau

SEQ ID NO: 1376625 - RNA, 15 nt, Human
uuaucuuuuuaccuu

SEQ ID NO: 1376626 - RNA, 12 nt, Human
uuaucuuuauau

SEQ ID NO: 1376627 - RNA, 16 nt, Human
uuaucuuuacuuuuaa

SEQ ID NO: 1376628 - RNA, 17 nt, Human
uuaucuugguugaaaau

SEQ ID NO: 1376629 - RNA, 13 nt, Human
uuaugccaccuga

SEQ ID NO: 1376630 - RNA, 22 nt, Human
uuaugcaugaaguaauaugcac

SEQ ID NO: 1376631 - RNA, 14 nt, Human
uuaugaaaaagaag

SEQ ID NO: 1376632 - RNA, 16 nt, Human
uuaugcaugaaguaau

SEQ ID NO: 1376633 - RNA, 18 nt, Human
uuaugcucuuaauugcca

SEQ ID NO: 1376634 - RNA, 21 nt, Human
uuaugcucuuaauugccaccu

SEQ ID NO: 1376635 - RNA, 17 nt, Human
uuaugcucuuaauugcc

SEQ ID NO: 1376636 - RNA, 19 nt, Human
uuaugcgguuaauuuugaa

SEQ ID NO: 1376637 - RNA, 16 nt, Human
uuaugcgguuaauuuu

SEQ ID NO: 1376638 - RNA, 17 nt, Human
uuaugccuuuuuugauc

SEQ ID NO: 1376639 - RNA, 16 nt, Human
uuaugccaccugaaua

SEQ ID NO: 1376640 - RNA, 21 nt, Human
uuauggcacuaguauuucuau

SEQ ID NO: 1376641 - RNA, 15 nt, Human
uuaugcugauuuauu

SEQ ID NO: 1376642 - RNA, 17 nt, Human
uuaugcugugacacaug

SEQ ID NO: 1376643 - RNA, 16 nt, Human
uuaugcuuaaauucaa

SEQ ID NO: 1376644 - RNA, 17 nt, Human
uuagagugucuuuccac

SEQ ID NO: 1376645 - RNA, 16 nt, Human
uuagagugucuuucca

SEQ ID NO: 1376646 - RNA, 12 nt, Human
uuagaguuagac

SEQ ID NO: 1376647 - RNA, 13 nt, Human
uuagaguuagacu

SEQ ID NO: 1376648 - RNA, 14 nt, Human
uuagaguugauacu

SEQ ID NO: 1376649 - RNA, 14 nt, Human
uuagaguuagacug

SEQ ID NO: 1376650 - RNA, 17 nt, Human
uuagaguuagacuguug

SEQ ID NO: 1376651 - RNA, 18 nt, Human
uuagaguuagacuguugg

SEQ ID NO: 1376652 - RNA, 18 nt, Human
uuagagggaggagaauga

SEQ ID NO: 1376653 - RNA, 15 nt, Human
uuagagauaagaguu

SEQ ID NO: 1376654 - RNA, 20 nt, Human
uuagauagcccuguccuggu

SEQ ID NO: 1376655 - RNA, 18 nt, Human
uuagauagcccuguccug

SEQ ID NO: 1376656 - RNA, 17 nt, Human
uuagauagcccuguccu

SEQ ID NO: 1376657 - RNA, 16 nt, Human
uuagauagcccugucc

SEQ ID NO: 1376658 - RNA, 15 nt, Human
uuagauaaauauuga

SEQ ID NO: 1376659 - RNA, 22 nt, Human
uuagauaauacaccacuacauu

SEQ ID NO: 1376660 - RNA, 22 nt, Human
uuagcuaauaaaaagcuuuugu

SEQ ID NO: 1376661 - RNA, 15 nt, Human
uuagcuaauaaaaag

SEQ ID NO: 1376662 - RNA, 21 nt, Human
uuagcuaaacggauuccaaag

SEQ ID NO: 1376663 - RNA, 15 nt, Human
uuagaucuggcaugu

SEQ ID NO: 1376664 - RNA, 21 nt, Human
uuagaugcaguucugaagaag

SEQ ID NO: 1376665 - RNA, 20 nt, Human
uuagaugcaguucugaagaa

SEQ ID NO: 1376666 - RNA, 13 nt, Human
uuagcuuuaacuu

SEQ ID NO: 1376667 - RNA, 23 nt, Human
uuaggaaauguuuuuaauaaaag

SEQ ID NO: 1376668 - RNA, 13 nt, Human
uuagcuccugugg

SEQ ID NO: 1376669 - RNA, 17 nt, Human
uuagcucaaugagcaug

SEQ ID NO: 1376670 - RNA, 18 nt, Human
uuagcucaaugagcaugu

SEQ ID NO: 1376671 - RNA, 14 nt, Human
uuagcucaaugagc

SEQ ID NO: 1376672 - RNA, 13 nt, Human
uuagcucaaugag

SEQ ID NO: 1376673 - RNA, 23 nt, Human
uuagcuaauaaaaagcuuuuguc

SEQ ID NO: 1376674 - RNA, 13 nt, Human
uuagcucugagaa

SEQ ID NO: 1376675 - RNA, 12 nt, Human
uuagcucugaga

SEQ ID NO: 1376676 - RNA, 11 nt, Human
uuagcucugag

SEQ ID NO: 1376677 - RNA, 14 nt, Human
uuagcuccuguggc

SEQ ID NO: 1376678 - RNA, 17 nt, Human
uuagcugucugcucaga

SEQ ID NO: 1376679 - RNA, 15 nt, Human
uuagcugucugcuca

SEQ ID NO: 1376680 - RNA, 16 nt, Human
uuagcuggcauuacag

SEQ ID NO: 1376681 - RNA, 13 nt, Human
uuagcuggaaaag

SEQ ID NO: 1376682 - RNA, 12 nt, Human
uuagcuggaaaa

SEQ ID NO: 1376683 - RNA, 22 nt, Human
uuaguccuguuauagacgagaa

SEQ ID NO: 1376684 - RNA, 13 nt, Human
uuagucgugagcu

SEQ ID NO: 1376685 - RNA, 17 nt, Human
uuagucccucaugcaaa

SEQ ID NO: 1376686 - RNA, 19 nt, Human
uuagucauguuuaucugcu

SEQ ID NO: 1376687 - RNA, 16 nt, Human
uuagucgugagcucuu

SEQ ID NO: 1376688 - RNA, 19 nt, Human
uuagucgugagcucuugug

SEQ ID NO: 1376689 - RNA, 21 nt, Human
uuagucgugagcucuugugag

SEQ ID NO: 1376690 - RNA, 24 nt, Human
uuagucgugagcucuugugaggaa

SEQ ID NO: 1376691 - RNA, 14 nt, Human
uuagucaugugacc

SEQ ID NO: 1376692 - RNA, 13 nt, Human
uuagucaugugac

SEQ ID NO: 1376693 - RNA, 22 nt, Human
uuaguauuguuguccuuuucau

SEQ ID NO: 1376694 - RNA, 23 nt, Human
uuaguauuguuguccuuuucaua

SEQ ID NO: 1376695 - RNA, 20 nt, Human
uuaguauuguuguccuuuuc

SEQ ID NO: 1376696 - RNA, 18 nt, Human
uuaguauuguuguccuuu

SEQ ID NO: 1376697 - RNA, 13 nt, Human
uuaguaucuuuug

SEQ ID NO: 1376698 - RNA, 16 nt, Human
uuaguaugaggcauuu

SEQ ID NO: 1376699 - RNA, 17 nt, Human
uuaguauuguuguccuu

SEQ ID NO: 1376700 - RNA, 16 nt, Human
uuaguauuguuguccu

SEQ ID NO: 1376701 - RNA, 12 nt, Human
uuaguauuguug

SEQ ID NO: 1376702 - RNA, 18 nt, Human
uuaguaugaggcauuugu

SEQ ID NO: 1376703 - RNA, 16 nt, Human
uuaguuccacugagac

SEQ ID NO: 1376704 - RNA, 15 nt, Human
uuaguuccacugaga

SEQ ID NO: 1376705 - RNA, 22 nt, Human
uuaguuaccuuauaguuacugu

SEQ ID NO: 1376706 - RNA, 21 nt, Human
uuaguuaccuuauaguuacug

SEQ ID NO: 1376707 - RNA, 20 nt, Human
uuaguuaccuuauaguuacu

SEQ ID NO: 1376708 - RNA, 19 nt, Human
uuaguuaccuuauaguuac

SEQ ID NO: 1376709 - RNA, 18 nt, Human
uuaguuaccuuauaguua

SEQ ID NO: 1376710 - RNA, 16 nt, Human
uuaguuaccuuauagu

SEQ ID NO: 1376711 - RNA, 13 nt, Human
uuaguuaccuuau

SEQ ID NO: 1376712 - RNA, 23 nt, Human
uuagucucaguuugugugucuua

SEQ ID NO: 1376713 - RNA, 22 nt, Human
uuagucucaguuugugugucuu

SEQ ID NO: 1376714 - RNA, 21 nt, Human
uuagucucaguuugugugucu

SEQ ID NO: 1376715 - RNA, 12 nt, Human
uuagucucaguu

SEQ ID NO: 1376716 - RNA, 14 nt, Human
uuaguguucauaaa

SEQ ID NO: 1376717 - RNA, 15 nt, Human
uuaggcagacucuuu

SEQ ID NO: 1376718 - RNA, 16 nt, Human
uuaggcagacucuuua

SEQ ID NO: 1376719 - RNA, 16 nt, Human
uuaggagcuaaggcuc

SEQ ID NO: 1376720 - RNA, 17 nt, Human
uuaggagcuaaggcucu

SEQ ID NO: 1376721 - RNA, 15 nt, Human
uuaggagcuaaggcu

SEQ ID NO: 1376722 - RNA, 15 nt, Human
uuaggacuugcccuc

SEQ ID NO: 1376723 - RNA, 21 nt, Human
uuaggagagaagguagggguu

SEQ ID NO: 1376724 - RNA, 17 nt, Human
uuaggagaagccaggaa

SEQ ID NO: 1376725 - RNA, 16 nt, Human
uuaggagaagccagga

SEQ ID NO: 1376726 - RNA, 13 nt, Human
uuaggagaagcca

SEQ ID NO: 1376727 - RNA, 12 nt, Human
uuaggagaagcc

SEQ ID NO: 1376728 - RNA, 18 nt, Human
uuaggaagcaagcuuaau

SEQ ID NO: 1376729 - RNA, 22 nt, Human
uuaggaagagccuuccacccag

SEQ ID NO: 1376730 - RNA, 11 nt, Human
uuaggaagagc

SEQ ID NO: 1376731 - RNA, 22 nt, Human
uuaggaaguugacuuauaguac

SEQ ID NO: 1376732 - RNA, 23 nt, Human
uuaggaaguugacuuauaguaca

SEQ ID NO: 1376733 - RNA, 22 nt, Human
uuaggcuauuuguaaaucugcc

SEQ ID NO: 1376734 - RNA, 20 nt, Human
uuaggcuauuuguaaaucug

SEQ ID NO: 1376735 - RNA, 19 nt, Human
uuaggcuauuuguaaaucu

SEQ ID NO: 1376736 - RNA, 16 nt, Human
uuaggcuauuuguaaa

SEQ ID NO: 1376737 - RNA, 19 nt, Human
uuaggcccccaucauccuc

SEQ ID NO: 1376738 - RNA, 14 nt, Human
uuaggcuguaacua

SEQ ID NO: 1376739 - RNA, 23 nt, Human
uuaggcuauuuguaaaucugcca

SEQ ID NO: 1376740 - RNA, 20 nt, Human
uuaggcuguaacuacuuuau

SEQ ID NO: 1376741 - RNA, 17 nt, Human
uuaggcuguaacuacuu

SEQ ID NO: 1376742 - RNA, 14 nt, Human
uuagggaaaacauu

SEQ ID NO: 1376743 - RNA, 21 nt, Human
uuacuuuggggcuaauuuaac

SEQ ID NO: 1376744 - RNA, 16 nt, Human
uuacuuuauguuacua

SEQ ID NO: 1376745 - RNA, 18 nt, Human
uuacuuuagaagccugca

SEQ ID NO: 1376746 - RNA, 23 nt, Human
uuacuuguaaauauaaagacguu

SEQ ID NO: 1376747 - RNA, 22 nt, Human
uuacuuguaaauauaaagacgu

SEQ ID NO: 1376748 - RNA, 21 nt, Human
uuacuuguaaauauaaagacg

SEQ ID NO: 1376749 - RNA, 19 nt, Human
uuacuuguaaauauaaaga

SEQ ID NO: 1376750 - RNA, 17 nt, Human
uuacuuguaaauauaaa

SEQ ID NO: 1376751 - RNA, 16 nt, Human
uuacuuguaaauauaa

SEQ ID NO: 1376752 - RNA, 13 nt, Human
uuacuuguaaaua

SEQ ID NO: 1376753 - RNA, 14 nt, Human
uuacuugaccuccu

SEQ ID NO: 1376754 - RNA, 14 nt, Human
uuacuuuugcugua

SEQ ID NO: 1376755 - RNA, 19 nt, Human
uuacuuuuaaacuguguac

SEQ ID NO: 1376756 - RNA, 16 nt, Human
uuacuuuuaaacugug

SEQ ID NO: 1376757 - RNA, 15 nt, Human
uuacuuuuaaacugu

SEQ ID NO: 1376758 - RNA, 14 nt, Human
uuacuuuuaaacug

SEQ ID NO: 1376759 - RNA, 17 nt, Human
uuacuuuuaaacaguga

SEQ ID NO: 1376760 - RNA, 13 nt, Human
uuacuuugugaau

SEQ ID NO: 1376761 - RNA, 14 nt, Human
uuagaaaacuuuaa

SEQ ID NO: 1376762 - RNA, 16 nt, Human
uuagaaaacuuuaaag

SEQ ID NO: 1376763 - RNA, 23 nt, Human
uuagaaaaccagcucagcacugc

SEQ ID NO: 1376764 - RNA, 21 nt, Human
uuagaaaacauaaucuucugc

SEQ ID NO: 1376765 - RNA, 19 nt, Human
uuagaaacacaacuauauu

SEQ ID NO: 1376766 - RNA, 18 nt, Human
uuagacuaaggccauuau

SEQ ID NO: 1376767 - RNA, 23 nt, Human
uuagaccuacagggggucuggcu

SEQ ID NO: 1376768 - RNA, 13 nt, Human
uuagaccuacagg

SEQ ID NO: 1376769 - RNA, 18 nt, Human
uuagacugugauucagaa

SEQ ID NO: 1376770 - RNA, 20 nt, Human
uuagacuguuggggugggua

SEQ ID NO: 1376771 - RNA, 19 nt, Human
uuagacuggacagcuugug

SEQ ID NO: 1376772 - RNA, 17 nt, Human
uuagacuggacagcuug

SEQ ID NO: 1376773 - RNA, 16 nt, Human
uuagacuggacagcuu

SEQ ID NO: 1376774 - RNA, 15 nt, Human
uuagacuggacagcu

SEQ ID NO: 1376775 - RNA, 22 nt, Human
uuagacuggaacuugaacugau

SEQ ID NO: 1376776 - RNA, 21 nt, Human
uuagacuggaacuugaacuga

SEQ ID NO: 1376777 - RNA, 17 nt, Human
uuagacuggaacuugaa

SEQ ID NO: 1376778 - RNA, 16 nt, Human
uuagacuggaacuuga

SEQ ID NO: 1376779 - RNA, 15 nt, Human
uuagacuggaacuug

SEQ ID NO: 1376780 - RNA, 17 nt, Human
uuagacucuuuuccuuc

SEQ ID NO: 1376781 - RNA, 16 nt, Human
uuagaccuguguuacu

SEQ ID NO: 1376782 - RNA, 12 nt, Human
uuagagaauaaa

SEQ ID NO: 1376783 - RNA, 21 nt, Human
uuagagaaguauacauaaguu

SEQ ID NO: 1376784 - RNA, 22 nt, Human
uuagacuuuaacauaagcuauu

SEQ ID NO: 1376785 - RNA, 21 nt, Human
uuagacuuuaacauaagcuau

SEQ ID NO: 1376786 - RNA, 16 nt, Human
uuagacuuuaacauaa

SEQ ID NO: 1376787 - RNA, 15 nt, Human
uuagacuuuaacaua

SEQ ID NO: 1376788 - RNA, 23 nt, Human
uuacuagggaucccucaucuguc

SEQ ID NO: 1376789 - RNA, 20 nt, Human
uuacuagggaucccucaucu

SEQ ID NO: 1376790 - RNA, 16 nt, Human
uuacuagggaucccuc

SEQ ID NO: 1376791 - RNA, 14 nt, Human
uuacuacaugcacu

SEQ ID NO: 1376792 - RNA, 13 nt, Human
uuacuacaugcac

SEQ ID NO: 1376793 - RNA, 20 nt, Human
uuacuaaggaagauuacuca

SEQ ID NO: 1376794 - RNA, 23 nt, Human
uuacuauaagaacuuugagcuac

SEQ ID NO: 1376795 - RNA, 20 nt, Human
uuacuauaagaacuuugagc

SEQ ID NO: 1376796 - RNA, 15 nt, Human
uuacuauaagaacuu

SEQ ID NO: 1376797 - RNA, 20 nt, Human
uuacaauuuuuuaucaugca

SEQ ID NO: 1376798 - RNA, 18 nt, Human
uuacaauuuuuuaucaug

SEQ ID NO: 1376799 - RNA, 17 nt, Human
uuacaauuuuuuaucau

SEQ ID NO: 1376800 - RNA, 15 nt, Human
uuacaauuuuuuauc

SEQ ID NO: 1376801 - RNA, 13 nt, Human
uuacuaaguuuuu

SEQ ID NO: 1376802 - RNA, 14 nt, Human
uuacuaaguuuuua

SEQ ID NO: 1376803 - RNA, 16 nt, Human
uuacuaauagacaauu

SEQ ID NO: 1376804 - RNA, 22 nt, Human
uuacuucguguccgacucuucu

SEQ ID NO: 1376805 - RNA, 11 nt, Human
uuacuucauau

SEQ ID NO: 1376806 - RNA, 16 nt, Human
uuacuuaaucaaaacu

SEQ ID NO: 1376807 - RNA, 18 nt, Human
uuacuuauuaucuucagg

SEQ ID NO: 1376808 - RNA, 18 nt, Human
uuacuguuagucauuugc

SEQ ID NO: 1376809 - RNA, 20 nt, Human
uuacuguguaauuagugcca

SEQ ID NO: 1376810 - RNA, 16 nt, Human
uuacuguguaauuagu

SEQ ID NO: 1376811 - RNA, 13 nt, Human
uuacuguguaauu

SEQ ID NO: 1376812 - RNA, 19 nt, Human
uuacugucuuuuuucuaaa

SEQ ID NO: 1376813 - RNA, 19 nt, Human
uuacuauggcccuggccua

SEQ ID NO: 1376814 - RNA, 17 nt, Human
uuaauauaaaugcaaau

SEQ ID NO: 1376815 - RNA, 14 nt, Human
uuaauauaaaugca

SEQ ID NO: 1376816 - RNA, 23 nt, Human
uuaauauaaaguuuuauauauua

SEQ ID NO: 1376817 - RNA, 22 nt, Human
uuaauauaaaguuuuauauauu

SEQ ID NO: 1376818 - RNA, 21 nt, Human
uuaauauaaaguuuuauauau

SEQ ID NO: 1376819 - RNA, 18 nt, Human
uuaagcucugagcuguca

SEQ ID NO: 1376820 - RNA, 17 nt, Human
uuaagcucugagcuguc

SEQ ID NO: 1376821 - RNA, 16 nt, Human
uuaagcucugagcugu

SEQ ID NO: 1376822 - RNA, 15 nt, Human
uuaagcucugagcug

SEQ ID NO: 1376823 - RNA, 14 nt, Human
uuaagcucugagcu

SEQ ID NO: 1376824 - RNA, 16 nt, Human
uuaaugcaauauacug

SEQ ID NO: 1376825 - RNA, 21 nt, Human
uuaaugauaugcuuguaacua

SEQ ID NO: 1376826 - RNA, 20 nt, Human
uuaauauauauuaucuuuuc

SEQ ID NO: 1376827 - RNA, 15 nt, Human
uuaauauaaaugcaa

SEQ ID NO: 1376828 - RNA, 19 nt, Human
uuacaaguaacaaaaauaa

SEQ ID NO: 1376829 - RNA, 20 nt, Human
uuacaaguaacaaaaauaaa

SEQ ID NO: 1376830 - RNA, 17 nt, Human
uuacaaguaacaaaaau

SEQ ID NO: 1376831 - RNA, 15 nt, Human
uuaauguuuaaaaca

SEQ ID NO: 1376832 - RNA, 18 nt, Human
uuaauguuuuuugccaca

SEQ ID NO: 1376833 - RNA, 15 nt, Human
uuaaugcacuuucua

SEQ ID NO: 1376834 - RNA, 14 nt, Human
uuaaugcacuuucu

SEQ ID NO: 1376835 - RNA, 13 nt, Human
uuaaugcacuuuc

SEQ ID NO: 1376836 - RNA, 12 nt, Human
uuaaugcacuuu

SEQ ID NO: 1376837 - RNA, 11 nt, Human
uuaaugcacuu

SEQ ID NO: 1376838 - RNA, 13 nt, Human
uuaaugcccagac

SEQ ID NO: 1376839 - RNA, 23 nt, Human
uuaaugccgauauacucuagaug

SEQ ID NO: 1376840 - RNA, 19 nt, Human
uuaauggugccuucauuug

SEQ ID NO: 1376841 - RNA, 17 nt, Human
uuaauggugccuucauu

SEQ ID NO: 1376842 - RNA, 20 nt, Human
uuaauggugccuucauuugg

SEQ ID NO: 1376843 - RNA, 18 nt, Human
uuaauguauguuaccaaa

SEQ ID NO: 1376844 - RNA, 17 nt, Human
uuaauguauguuaccaa

SEQ ID NO: 1376845 - RNA, 15 nt, Human
uuaauguauguuacc

SEQ ID NO: 1376846 - RNA, 13 nt, Human
uuaauguauguua

SEQ ID NO: 1376847 - RNA, 19 nt, Human
uuaauguauaguaaaucac

SEQ ID NO: 1376848 - RNA, 22 nt, Human
uuaaugucaauucuugccaaau

SEQ ID NO: 1376849 - RNA, 12 nt, Human
uuaaccuuugau

SEQ ID NO: 1376850 - RNA, 14 nt, Human
uuaacgauguccaa

SEQ ID NO: 1376851 - RNA, 15 nt, Human
uuaaccucugcacua

SEQ ID NO: 1376852 - RNA, 12 nt, Human
uuaaccucugca

SEQ ID NO: 1376853 - RNA, 21 nt, Human
uuaaccuaugauauuuucugu

SEQ ID NO: 1376854 - RNA, 20 nt, Human
uuaaccuaugauauuuucug

SEQ ID NO: 1376855 - RNA, 18 nt, Human
uuaaccccccuguacaca

SEQ ID NO: 1376856 - RNA, 20 nt, Human
uuaaccccccuguacacaac

SEQ ID NO: 1376857 - RNA, 17 nt, Human
uuaaccccccuguacac

SEQ ID NO: 1376858 - RNA, 14 nt, Human
uuaaccccccugua

SEQ ID NO: 1376859 - RNA, 22 nt, Human
uuaaccagaucuagucaaucaa

SEQ ID NO: 1376860 - RNA, 13 nt, Human
uuaaccagaucua

SEQ ID NO: 1376861 - RNA, 18 nt, Human
uuaaagaauaugaaacau

SEQ ID NO: 1376862 - RNA, 16 nt, Human
uuaaagaauaugaaac

SEQ ID NO: 1376863 - RNA, 14 nt, Human
uuaaagacuuuuau

SEQ ID NO: 1376864 - RNA, 13 nt, Human
uuaaauuacagaa

SEQ ID NO: 1376865 - RNA, 21 nt, Human
uuaaauguuuuuuuuuaaaga

SEQ ID NO: 1376866 - RNA, 23 nt, Human
uuaaauguuuuuuuuuaaagacu

SEQ ID NO: 1376867 - RNA, 21 nt, Human
uuaacuucuugcuucuuucua

SEQ ID NO: 1376868 - RNA, 18 nt, Human
uuaacuuuuauaaacuuu

SEQ ID NO: 1376869 - RNA, 16 nt, Human
uuaacuuuuauaaacu

SEQ ID NO: 1376870 - RNA, 17 nt, Human
uuaacuuuuauaaacuu

SEQ ID NO: 1376871 - RNA, 17 nt, Human
uuaacuucuugcuucuu

SEQ ID NO: 1376872 - RNA, 14 nt, Human
uuaacuucuugcuu

SEQ ID NO: 1376873 - RNA, 15 nt, Human
uuaacuuuuauaaac

SEQ ID NO: 1376874 - RNA, 13 nt, Human
uuaacuuaaauag

SEQ ID NO: 1376875 - RNA, 16 nt, Human
uuaacuucacauauug

SEQ ID NO: 1376876 - RNA, 15 nt, Human
uuaacuuaaauagua

SEQ ID NO: 1376877 - RNA, 15 nt, Human
uuaacuguggauauu

SEQ ID NO: 1376878 - RNA, 13 nt, Human
uuaacuguggaua

SEQ ID NO: 1376879 - RNA, 12 nt, Human
uuaacuguggau

SEQ ID NO: 1376880 - RNA, 17 nt, Human
uuaacuggguaaugaaa

SEQ ID NO: 1376881 - RNA, 21 nt, Human
uuaacuggguaaugaaacaaa

SEQ ID NO: 1376882 - RNA, 19 nt, Human
uuaacugccguaauuuaac

SEQ ID NO: 1376883 - RNA, 17 nt, Human
uuaacucucuuuauguc

SEQ ID NO: 1376884 - RNA, 19 nt, Human
uuaacucucuuuaugucug

SEQ ID NO: 1376885 - RNA, 15 nt, Human
uuaacucucuuuaug

SEQ ID NO: 1376886 - RNA, 22 nt, Human
uuaacucccauuaccauguaau

SEQ ID NO: 1376887 - RNA, 23 nt, Human
uuaacucccauuaccauguaaug

SEQ ID NO: 1376888 - RNA, 20 nt, Human
uuaacugaauaccacucugu

SEQ ID NO: 1376889 - RNA, 16 nt, Human
uuaacugaauaccacu

SEQ ID NO: 1376890 - RNA, 22 nt, Human
uuaacugaauaccacucuguaa

SEQ ID NO: 1376891 - RNA, 21 nt, Human
uuaacugaauaccacucugua

SEQ ID NO: 1376892 - RNA, 21 nt, Human
uuaacugacaagccaucuuga

SEQ ID NO: 1376893 - RNA, 17 nt, Human
uuaacucauuagacugg

SEQ ID NO: 1376894 - RNA, 16 nt, Human
uuaacucauuagacug

SEQ ID NO: 1376895 - RNA, 15 nt, Human
uuaacucauuagacu

SEQ ID NO: 1376896 - RNA, 14 nt, Human
uuaacuauugcauu

SEQ ID NO: 1376897 - RNA, 21 nt, Human
uuaacuauugcauuuauaugu

SEQ ID NO: 1376898 - RNA, 22 nt, Human
uuaacuauugcauuuauaugua

SEQ ID NO: 1376899 - RNA, 23 nt, Human
uguuuuuugccacagcuuuugca

SEQ ID NO: 1376900 - RNA, 19 nt, Human
uguuuuuugccacagcuuu

SEQ ID NO: 1376901 - RNA, 18 nt, Human
uguuuuuugccacagcuu

SEQ ID NO: 1376902 - RNA, 15 nt, Human
uguuuuuugccacag

SEQ ID NO: 1376903 - RNA, 16 nt, Human
uguuuuguuuuuacaa

SEQ ID NO: 1376904 - RNA, 15 nt, Human
uguuuuguuuuuaca

SEQ ID NO: 1376905 - RNA, 20 nt, Human
uguuuuguugacauucugaa

SEQ ID NO: 1376906 - RNA, 19 nt, Human
uguuuuguugacauucuga

SEQ ID NO: 1376907 - RNA, 15 nt, Human
uguuuuguugacauu

SEQ ID NO: 1376908 - RNA, 14 nt, Human
uguuuuguugacau

SEQ ID NO: 1376909 - RNA, 13 nt, Human
uguuuuguugaca

SEQ ID NO: 1376910 - RNA, 12 nt, Human
uguuuuguugac

SEQ ID NO: 1376911 - RNA, 21 nt, Human
uguuuuguugacauucugaau

SEQ ID NO: 1376912 - RNA, 22 nt, Human
uguuuuguucaccauuauaaug

SEQ ID NO: 1376913 - RNA, 19 nt, Human
uguuuuaaggaugcuugua

SEQ ID NO: 1376914 - RNA, 18 nt, Human
uguuuuaaggaugcuugu

SEQ ID NO: 1376915 - RNA, 23 nt, Human
uuaaaagaauaucuggcaaauua

SEQ ID NO: 1376916 - RNA, 14 nt, Human
uuaaaagauacagu

SEQ ID NO: 1376917 - RNA, 17 nt, Human
uuaaaagauacaguuac

SEQ ID NO: 1376918 - RNA, 15 nt, Human
uguuuuuuucuaaua

SEQ ID NO: 1376919 - RNA, 16 nt, Human
uguuuuuuuguuauua

SEQ ID NO: 1376920 - RNA, 15 nt, Human
uguuuuuuuguuugu

SEQ ID NO: 1376921 - RNA, 18 nt, Human
uguuuuuuuguuauuaaa

SEQ ID NO: 1376922 - RNA, 18 nt, Human
uguuuuuuuuuaaagacu

SEQ ID NO: 1376923 - RNA, 12 nt, Human
uuaaagaagacc

SEQ ID NO: 1376924 - RNA, 17 nt, Human
uuaaagaaaguguauuu

SEQ ID NO: 1376925 - RNA, 12 nt, Human
uuaaagaaagug

SEQ ID NO: 1376926 - RNA, 19 nt, Human
uuaaacuguguacauaacu

SEQ ID NO: 1376927 - RNA, 12 nt, Human
uuaaacugugua

SEQ ID NO: 1376928 - RNA, 21 nt, Human
uuaaacuguacagugucuuuu

SEQ ID NO: 1376929 - RNA, 20 nt, Human
uuaaacuguacagugucuuu

SEQ ID NO: 1376930 - RNA, 18 nt, Human
uuaaacuguacagugucu

SEQ ID NO: 1376931 - RNA, 17 nt, Human
uuaaacuguacaguguc

SEQ ID NO: 1376932 - RNA, 16 nt, Human
uuaaacuguacagugu

SEQ ID NO: 1376933 - RNA, 15 nt, Human
uuaaacuguacagug

SEQ ID NO: 1376934 - RNA, 14 nt, Human
uuaaacuguacagu

SEQ ID NO: 1376935 - RNA, 13 nt, Human
uuaaacuguacag

SEQ ID NO: 1376936 - RNA, 12 nt, Human
uuaaacuguaca

SEQ ID NO: 1376937 - RNA, 22 nt, Human
uuaaacucuguugcaagugcaa

SEQ ID NO: 1376938 - RNA, 21 nt, Human
uuaaaauagcguucuuguaau

SEQ ID NO: 1376939 - RNA, 22 nt, Human
uuaaaauagcguucuuguaauu

SEQ ID NO: 1376940 - RNA, 20 nt, Human
uuaaaauagcguucuuguaa

SEQ ID NO: 1376941 - RNA, 22 nt, Human
uuaaaauagcaaaagaagaagu

SEQ ID NO: 1376942 - RNA, 23 nt, Human
uuaaaauagcaaaagaagaaguu

SEQ ID NO: 1376943 - RNA, 21 nt, Human
uuaaaauagcaaaagaagaag

SEQ ID NO: 1376944 - RNA, 19 nt, Human
uuaaaauagcaaaagaaga

SEQ ID NO: 1376945 - RNA, 16 nt, Human
uuaaaagugucaagcu

SEQ ID NO: 1376946 - RNA, 18 nt, Human
uuaaaaguguauuuguua

SEQ ID NO: 1376947 - RNA, 13 nt, Human
uuaaaagccugcu

SEQ ID NO: 1376948 - RNA, 18 nt, Human
uuaaaagcaaaucauuug

SEQ ID NO: 1376949 - RNA, 21 nt, Human
uuaaaagcaaaucauuuguuu

SEQ ID NO: 1376950 - RNA, 14 nt, Human
uuaaaagcaaauca

SEQ ID NO: 1376951 - RNA, 13 nt, Human
uuaaaagauuuuu

SEQ ID NO: 1376952 - RNA, 21 nt, Human
uuaaaauaccagccaguaaau

SEQ ID NO: 1376953 - RNA, 22 nt, Human
uuaaaagaugcuuuuaacagag

SEQ ID NO: 1376954 - RNA, 20 nt, Human
uuaaaagaugcuuuuaacag

SEQ ID NO: 1376955 - RNA, 12 nt, Human
uuaaaagaauau

SEQ ID NO: 1376956 - RNA, 13 nt, Human
uuaaaagaaugau

SEQ ID NO: 1376957 - RNA, 18 nt, Human
uguuuggguuuuuuuccu

SEQ ID NO: 1376958 - RNA, 23 nt, Human
uguuuggggcaggaguagcugag

SEQ ID NO: 1376959 - RNA, 15 nt, Human
uguuuggggcaggag

SEQ ID NO: 1376960 - RNA, 17 nt, Human
uguuucuacuuugauau

SEQ ID NO: 1376961 - RNA, 15 nt, Human
uguuucguggggagg

SEQ ID NO: 1376962 - RNA, 16 nt, Human
uguuuccuuuuucaga

SEQ ID NO: 1376963 - RNA, 14 nt, Human
uguuucgcucuuug

SEQ ID NO: 1376964 - RNA, 18 nt, Human
uguuuccuuuuucagaua

SEQ ID NO: 1376965 - RNA, 14 nt, Human
uguuuccagcauuc

SEQ ID NO: 1376966 - RNA, 13 nt, Human
uguuuccagcauu

SEQ ID NO: 1376967 - RNA, 15 nt, Human
uguuugucauuagcc

SEQ ID NO: 1376968 - RNA, 17 nt, Human
uguuugucauuagccug

SEQ ID NO: 1376969 - RNA, 16 nt, Human
uguuugguauuguauu

SEQ ID NO: 1376970 - RNA, 17 nt, Human
uguuugguauuguauuu

SEQ ID NO: 1376971 - RNA, 22 nt, Human
uguuugguauuguauuuauuca

SEQ ID NO: 1376972 - RNA, 14 nt, Human
uguuugugcugugg

SEQ ID NO: 1376973 - RNA, 13 nt, Human
uguuugugcugug

SEQ ID NO: 1376974 - RNA, 13 nt, Human
uguuugugauuga

SEQ ID NO: 1376975 - RNA, 12 nt, Human
uguuucacaguu

SEQ ID NO: 1376976 - RNA, 13 nt, Human
uguuucacaaggu

SEQ ID NO: 1376977 - RNA, 16 nt, Human
uguuucacaaggucuu

SEQ ID NO: 1376978 - RNA, 16 nt, Human
uguuucaauugcaucu

SEQ ID NO: 1376979 - RNA, 21 nt, Human
uguuucaaggcacucuagauu

SEQ ID NO: 1376980 - RNA, 20 nt, Human
uguuucaaggcacucuagau

SEQ ID NO: 1376981 - RNA, 19 nt, Human
uguuucaaggcacucuaga

SEQ ID NO: 1376982 - RNA, 15 nt, Human
uguuucaaggcacuc

SEQ ID NO: 1376983 - RNA, 22 nt, Human
uguuucaagaggagcccccacc

SEQ ID NO: 1376984 - RNA, 19 nt, Human
uguuucaagaggagccccc

SEQ ID NO: 1376985 - RNA, 21 nt, Human
uguuucagaggcucagauugu

SEQ ID NO: 1376986 - RNA, 20 nt, Human
uguuucacaguuugaaauaa

SEQ ID NO: 1376987 - RNA, 19 nt, Human
uguuucacaguuugaaaua

SEQ ID NO: 1376988 - RNA, 17 nt, Human
uguuucacaguuugaaa

SEQ ID NO: 1376989 - RNA, 12 nt, Human
uguuucaagagg

SEQ ID NO: 1376990 - RNA, 19 nt, Human
uguuuagacuuuaacauaa

SEQ ID NO: 1376991 - RNA, 20 nt, Human
uguuuagauaauacaccacu

SEQ ID NO: 1376992 - RNA, 15 nt, Human
uguuucaaacuuuac

SEQ ID NO: 1376993 - RNA, 22 nt, Human
uguuucaaacauauauaacaau

SEQ ID NO: 1376994 - RNA, 21 nt, Human
uguuucaaacauauauaacaa

SEQ ID NO: 1376995 - RNA, 23 nt, Human
uguuuagacuuuaacauaagcua

SEQ ID NO: 1376996 - RNA, 18 nt, Human
uguuuagacuuuaacaua

SEQ ID NO: 1376997 - RNA, 13 nt, Human
uguuuagacuuua

SEQ ID NO: 1376998 - RNA, 23 nt, Human
uggugccccaggaccagcucagg

SEQ ID NO: 1376999 - RNA, 16 nt, Human
uguuuagauaauacac

SEQ ID NO: 1377000 - RNA, 14 nt, Human
uggugccccaggac

SEQ ID NO: 1377001 - RNA, 13 nt, Human
uggugccccagga

SEQ ID NO: 1377002 - RNA, 10 nt, Human
uggugccacc

SEQ ID NO: 1377003 - RNA, 19 nt, Human
uggugccccaggaccagcu

SEQ ID NO: 1377004 - RNA, 18 nt, Human
uggugccccaggaccagc

SEQ ID NO: 1377005 - RNA, 17 nt, Human
uggugccccaggaccag

SEQ ID NO: 1377006 - RNA, 16 nt, Human
uggugccccaggacca

SEQ ID NO: 1377007 - RNA, 21 nt, Human
uggugccccaggaccagcuca

SEQ ID NO: 1377008 - RNA, 20 nt, Human
uggugccccaggaccagcuc

SEQ ID NO: 1377009 - RNA, 15 nt, Human
uuugaggcaaaagaa

SEQ ID NO: 1377010 - RNA, 14 nt, Human
uuugaggcaaaaga

SEQ ID NO: 1377011 - RNA, 22 nt, Human
uuugagauauuaaugcccagac

SEQ ID NO: 1377012 - RNA, 17 nt, Human
uuugaggucuguucuuu

SEQ ID NO: 1377013 - RNA, 16 nt, Human
uuugaaguuagcuuua

SEQ ID NO: 1377014 - RNA, 23 nt, Human
uuugaaguuagcuuuaacuuaaa

SEQ ID NO: 1377015 - RNA, 13 nt, Human
uuugaaguguaau

SEQ ID NO: 1377016 - RNA, 20 nt, Human
uuugaagugcuguuuauuaa

SEQ ID NO: 1377017 - RNA, 16 nt, Human
uuugaagugcuguuua

SEQ ID NO: 1377018 - RNA, 15 nt, Human
uuugaagugcuguuu

SEQ ID NO: 1377019 - RNA, 22 nt, Human
uuugaagucauaccaaugaaaa

SEQ ID NO: 1377020 - RNA, 13 nt, Human
uuugaaguauuua

SEQ ID NO: 1377021 - RNA, 20 nt, Human
uuugaauaaaugucacuuuu

SEQ ID NO: 1377022 - RNA, 15 nt, Human
uuugaauaaauguca

SEQ ID NO: 1377023 - RNA, 17 nt, Human
uuugaaguuagcuuuaa

SEQ ID NO: 1377024 - RNA, 14 nt, Human
uuucuuaacuucuu

SEQ ID NO: 1377025 - RNA, 13 nt, Human
uuucuuaacuucu

SEQ ID NO: 1377026 - RNA, 20 nt, Human
uuucuuaaauaagaaacuuu

SEQ ID NO: 1377027 - RNA, 13 nt, Human
uuucuuaaauaag

SEQ ID NO: 1377028 - RNA, 21 nt, Human
uuucuuaaagugccaguauuu

SEQ ID NO: 1377029 - RNA, 17 nt, Human
uuucuuaaagugccagu

SEQ ID NO: 1377030 - RNA, 13 nt, Human
uuucuuaaagugc

SEQ ID NO: 1377031 - RNA, 12 nt, Human
uuucuuaaauaa

SEQ ID NO: 1377032 - RNA, 17 nt, Human
uuucugaucaaggccuu

SEQ ID NO: 1377033 - RNA, 15 nt, Human
uuucugaucaaggcc

SEQ ID NO: 1377034 - RNA, 19 nt, Human
uuucuuaaauaagaaacuu

SEQ ID NO: 1377035 - RNA, 18 nt, Human
uuucuuaaauaagaaacu

SEQ ID NO: 1377036 - RNA, 21 nt, Human
uuucuuaaauaagaaacuuuu

SEQ ID NO: 1377037 - RNA, 18 nt, Human
uuucuuaaccagaucauu

SEQ ID NO: 1377038 - RNA, 21 nt, Human
uuugaaauugaaccuuugugc

SEQ ID NO: 1377039 - RNA, 20 nt, Human
uuucuugugcacuggcacca

SEQ ID NO: 1377040 - RNA, 19 nt, Human
uuucuugugcacuggcacc

SEQ ID NO: 1377041 - RNA, 20 nt, Human
uuucuugucuauaaagcauu

SEQ ID NO: 1377042 - RNA, 18 nt, Human
uuucuugucuauaaagca

SEQ ID NO: 1377043 - RNA, 13 nt, Human
uuucuugucuaua

SEQ ID NO: 1377044 - RNA, 21 nt, Human
uuugaaauuguauuacaaauc

SEQ ID NO: 1377045 - RNA, 13 nt, Human
uuugaaggcaaaa

SEQ ID NO: 1377046 - RNA, 12 nt, Human
uuugaaggcaaa

SEQ ID NO: 1377047 - RNA, 18 nt, Human
uuugaagcuacugugugu

SEQ ID NO: 1377048 - RNA, 16 nt, Human
uuugaagcuacugugu

SEQ ID NO: 1377049 - RNA, 20 nt, Human
uuugaaccugaugaaaauaa

SEQ ID NO: 1377050 - RNA, 18 nt, Human
uuugaaccugaugaaaau

SEQ ID NO: 1377051 - RNA, 13 nt, Human
uuugaaccaauaa

SEQ ID NO: 1377052 - RNA, 17 nt, Human
uuuguaaaucugccaca

SEQ ID NO: 1377053 - RNA, 15 nt, Human
uuuguaaaucugcca

SEQ ID NO: 1377054 - RNA, 22 nt, Human
uuuguaaacucaaaauauuugu

SEQ ID NO: 1377055 - RNA, 17 nt, Human
uuuguaaacucaaaaua

SEQ ID NO: 1377056 - RNA, 16 nt, Human
uuuguaaacucaaaau

SEQ ID NO: 1377057 - RNA, 14 nt, Human
uuuguaaaaugaca

SEQ ID NO: 1377058 - RNA, 16 nt, Human
uuuguauuaagaaagg

SEQ ID NO: 1377059 - RNA, 13 nt, Human
uuuguauucaaaa

SEQ ID NO: 1377060 - RNA, 15 nt, Human
uuuguauucucuccu

SEQ ID NO: 1377061 - RNA, 23 nt, Human
uuuguaaaaugacaaucaugugu

SEQ ID NO: 1377062 - RNA, 19 nt, Human
uuugguuucccaagagcua

SEQ ID NO: 1377063 - RNA, 13 nt, Human
uuugguucuaagg

SEQ ID NO: 1377064 - RNA, 11 nt, Human
uuugguucuaa

SEQ ID NO: 1377065 - RNA, 16 nt, Human
uuugguaccagauaac

SEQ ID NO: 1377066 - RNA, 20 nt, Human
uuugguucauuaauucuaua

SEQ ID NO: 1377067 - RNA, 16 nt, Human
uuuggguuuuuuuccu

SEQ ID NO: 1377068 - RNA, 16 nt, Human
uuuggguuucugcccu

SEQ ID NO: 1377069 - RNA, 11 nt, Human
uuuggguuucu

SEQ ID NO: 1377070 - RNA, 16 nt, Human
uuuggguucugccugc

SEQ ID NO: 1377071 - RNA, 15 nt, Human
uuuggguucugccug

SEQ ID NO: 1377072 - RNA, 14 nt, Human
uuuggguucugccu

SEQ ID NO: 1377073 - RNA, 18 nt, Human
uuuggguuuuuuuccuuu

SEQ ID NO: 1377074 - RNA, 20 nt, Human
uuugguaaaauacuucuuga

SEQ ID NO: 1377075 - RNA, 18 nt, Human
uuugguaaggggaauuga

SEQ ID NO: 1377076 - RNA, 16 nt, Human
uuuggacuucuggggu

SEQ ID NO: 1377077 - RNA, 16 nt, Human
uuuggaccuaauccaa

SEQ ID NO: 1377078 - RNA, 19 nt, Human
uuuggaccuaaauggccuc

SEQ ID NO: 1377079 - RNA, 23 nt, Human
uuugcuuuaauauaaaugcaaau

SEQ ID NO: 1377080 - RNA, 18 nt, Human
uuugcuuuaauauaaaug

SEQ ID NO: 1377081 - RNA, 23 nt, Human
uuugcuugcuuugaaguagcucu

SEQ ID NO: 1377082 - RNA, 20 nt, Human
uuugcuucaugugucccaga

SEQ ID NO: 1377083 - RNA, 19 nt, Human
uuugcuucaugugucccag

SEQ ID NO: 1377084 - RNA, 17 nt, Human
uuugauaugugaacagu

SEQ ID NO: 1377085 - RNA, 15 nt, Human
uuugauaugugaaca

SEQ ID NO: 1377086 - RNA, 20 nt, Human
uuugauaugcauauuuguuu

SEQ ID NO: 1377087 - RNA, 14 nt, Human
uuugauaugugaac

SEQ ID NO: 1377088 - RNA, 22 nt, Human
uuugccaagggcauaaauuauu

SEQ ID NO: 1377089 - RNA, 23 nt, Human
uuugccaagggcauaaauuauug

SEQ ID NO: 1377090 - RNA, 21 nt, Human
uuugcauuuguuuauguaauu

SEQ ID NO: 1377091 - RNA, 23 nt, Human
uuugcauuuguuuauguaauuuc

SEQ ID NO: 1377092 - RNA, 20 nt, Human
uuugcauuuguuuauguaau

SEQ ID NO: 1377093 - RNA, 12 nt, Human
uuugcauuuguu

SEQ ID NO: 1377094 - RNA, 18 nt, Human
uuugccacagcuuuugca

SEQ ID NO: 1377095 - RNA, 16 nt, Human
uuugccacagcuuuug

SEQ ID NO: 1377096 - RNA, 15 nt, Human
uuugccacagcuuuu

SEQ ID NO: 1377097 - RNA, 13 nt, Human
uuugccacagcuu

SEQ ID NO: 1377098 - RNA, 19 nt, Human
uuugccacccucaugcugu

SEQ ID NO: 1377099 - RNA, 18 nt, Human
uuugccacccucaugcug

SEQ ID NO: 1377100 - RNA, 22 nt, Human
uuuccuccugaggcuuuggauu

SEQ ID NO: 1377101 - RNA, 21 nt, Human
uuuccuccugaggcuuuggau

SEQ ID NO: 1377102 - RNA, 18 nt, Human
uuuccuccucaggcacac

SEQ ID NO: 1377103 - RNA, 22 nt, Human
uuuccuccgucaccucagagac

SEQ ID NO: 1377104 - RNA, 12 nt, Human
uuuccuaauacu

SEQ ID NO: 1377105 - RNA, 24 nt, Human
uuuccuaauaaaguucuguacuca

SEQ ID NO: 1377106 - RNA, 23 nt, Human
uuuccuaauaaaguucuguacuc

SEQ ID NO: 1377107 - RNA, 21 nt, Human
uuuccuaauaaaguucuguac

SEQ ID NO: 1377108 - RNA, 12 nt, Human
uuuccucuccac

SEQ ID NO: 1377109 - RNA, 14 nt, Human
uuuccucuccacac

SEQ ID NO: 1377110 - RNA, 23 nt, Human
uuuccucuguucaaagcugccug

SEQ ID NO: 1377111 - RNA, 16 nt, Human
uuucuaauugcuuauu

SEQ ID NO: 1377112 - RNA, 23 nt, Human
uuucuaauugcuuauuuauugua

SEQ ID NO: 1377113 - RNA, 14 nt, Human
uuucuaauugcuua

SEQ ID NO: 1377114 - RNA, 13 nt, Human
uuucuaauugcuu

SEQ ID NO: 1377115 - RNA, 19 nt, Human
uuucuaauuauguagcucu

SEQ ID NO: 1377116 - RNA, 18 nt, Human
uuucuaauuauguagcuc

SEQ ID NO: 1377117 - RNA, 17 nt, Human
uuucuaauuauguagcu

SEQ ID NO: 1377118 - RNA, 14 nt, Human
uuucuaauuaugua

SEQ ID NO: 1377119 - RNA, 12 nt, Human
uuuccuguccuc

SEQ ID NO: 1377120 - RNA, 23 nt, Human
uuuccuguauuuguucccaagag

SEQ ID NO: 1377121 - RNA, 22 nt, Human
uuuccuggguggcuacucugug

SEQ ID NO: 1377122 - RNA, 22 nt, Human
uuucuaaaguaaaaacaaagaa

SEQ ID NO: 1377123 - RNA, 19 nt, Human
uuucuaaaucuccaaaaua

SEQ ID NO: 1377124 - RNA, 22 nt, Human
uuuccuggugccaauuucaagu

SEQ ID NO: 1377125 - RNA, 19 nt, Human
uuuccuggugccaauuuca

SEQ ID NO: 1377126 - RNA, 16 nt, Human
uuuccuggugccaauu

SEQ ID NO: 1377127 - RNA, 14 nt, Human
uuuccuggugccaa

SEQ ID NO: 1377128 - RNA, 17 nt, Human
uuucuaaaguaaaaaca

SEQ ID NO: 1377129 - RNA, 16 nt, Human
uuucuaccauuucaga

SEQ ID NO: 1377130 - RNA, 22 nt, Human
uuucucgcuguccuuucuagag

SEQ ID NO: 1377131 - RNA, 16 nt, Human
uuucucucaacaccau

SEQ ID NO: 1377132 - RNA, 14 nt, Human
uuucucucaacacc

SEQ ID NO: 1377133 - RNA, 12 nt, Human
uuucucuaggaa

SEQ ID NO: 1377134 - RNA, 15 nt, Human
uuucucugaacacau

SEQ ID NO: 1377135 - RNA, 21 nt, Human
uuucucucuuuauacagcugu

SEQ ID NO: 1377136 - RNA, 20 nt, Human
uuucucucuuuauacagcug

SEQ ID NO: 1377137 - RNA, 16 nt, Human
uuucugaaaauauaac

SEQ ID NO: 1377138 - RNA, 19 nt, Human
uuucugaaauuuccuggga

SEQ ID NO: 1377139 - RNA, 12 nt, Human
uuucugaaauuu

SEQ ID NO: 1377140 - RNA, 16 nt, Human
uuucauuuucucucag

SEQ ID NO: 1377141 - RNA, 19 nt, Human
uuucauuugguucauuaau

SEQ ID NO: 1377142 - RNA, 23 nt, Human
uuucauuucuucuacaacucaua

SEQ ID NO: 1377143 - RNA, 16 nt, Human
uuucauuucuucuaca

SEQ ID NO: 1377144 - RNA, 14 nt, Human
uuucauuucaacug

SEQ ID NO: 1377145 - RNA, 20 nt, Human
uuucauuuaucuauaauuua

SEQ ID NO: 1377146 - RNA, 18 nt, Human
uuucaguccccacagaua

SEQ ID NO: 1377147 - RNA, 14 nt, Human
uuucaguauuauau

SEQ ID NO: 1377148 - RNA, 16 nt, Human
uuucaguauuauaugu

SEQ ID NO: 1377149 - RNA, 16 nt, Human
uuucagcugucuuuug

SEQ ID NO: 1377150 - RNA, 15 nt, Human
uuucagcugucuuuu

SEQ ID NO: 1377151 - RNA, 20 nt, Human
uuucagcuccugaccaguug

SEQ ID NO: 1377152 - RNA, 21 nt, Human
uuucagcuccugaccaguugc

SEQ ID NO: 1377153 - RNA, 16 nt, Human
uuucagcuccugacca

SEQ ID NO: 1377154 - RNA, 12 nt, Human
uuucagcuccug

SEQ ID NO: 1377155 - RNA, 23 nt, Human
uuuccacggagccacuccucuga

SEQ ID NO: 1377156 - RNA, 23 nt, Human
uuuccaccacagccagcaccugg

SEQ ID NO: 1377157 - RNA, 17 nt, Human
uuucauuuucucucagg

SEQ ID NO: 1377158 - RNA, 18 nt, Human
uuucauuuucucucaggu

SEQ ID NO: 1377159 - RNA, 17 nt, Human
uuucacaguuugaaaua

SEQ ID NO: 1377160 - RNA, 18 nt, Human
uuucacaguuugaaauaa

SEQ ID NO: 1377161 - RNA, 16 nt, Human
uuucacaguuugaaau

SEQ ID NO: 1377162 - RNA, 17 nt, Human
uuucacagaaaauaagg

SEQ ID NO: 1377163 - RNA, 13 nt, Human
uuucacagcuccu

SEQ ID NO: 1377164 - RNA, 14 nt, Human
uuucacagaaaaua

SEQ ID NO: 1377165 - RNA, 17 nt, Human
uuucacaaggucuuuaa

SEQ ID NO: 1377166 - RNA, 20 nt, Human
uuucaauugcaucucccaga

SEQ ID NO: 1377167 - RNA, 18 nt, Human
uuucaauugcaucuccca

SEQ ID NO: 1377168 - RNA, 22 nt, Human
uuucaauuccaccugcaaucaa

SEQ ID NO: 1377169 - RNA, 21 nt, Human
uuucacauagcccacuuacau

SEQ ID NO: 1377170 - RNA, 22 nt, Human
uuucacauagcccacuuacauu

SEQ ID NO: 1377171 - RNA, 23 nt, Human
uuucagcgacuccguuggccacu

SEQ ID NO: 1377172 - RNA, 18 nt, Human
uuucagcgacuccguugg

SEQ ID NO: 1377173 - RNA, 13 nt, Human
uuuaugcuugcaa

SEQ ID NO: 1377174 - RNA, 14 nt, Human
uuuaugccaccuga

SEQ ID NO: 1377175 - RNA, 17 nt, Human
uuuaugagaaagccuuc

SEQ ID NO: 1377176 - RNA, 19 nt, Human
uuuaugauaauagauucuc

SEQ ID NO: 1377177 - RNA, 18 nt, Human
uuuaugauaauagauucu

SEQ ID NO: 1377178 - RNA, 17 nt, Human
uuuaugauaauagauuc

SEQ ID NO: 1377179 - RNA, 22 nt, Human
uuuaugauacuugaaaauuaac

SEQ ID NO: 1377180 - RNA, 17 nt, Human
uuuauggcacuaguauu

SEQ ID NO: 1377181 - RNA, 21 nt, Human
uuuaucccaaaguuguuguaa

SEQ ID NO: 1377182 - RNA, 16 nt, Human
uuuaucccucaccugu

SEQ ID NO: 1377183 - RNA, 18 nt, Human
uuuaucccaaaguuguug

SEQ ID NO: 1377184 - RNA, 16 nt, Human
uuuaucccaaaguugu

SEQ ID NO: 1377185 - RNA, 20 nt, Human
uuuauacuuucccuacccuc

SEQ ID NO: 1377186 - RNA, 20 nt, Human
uuuauacucuuucuguauau

SEQ ID NO: 1377187 - RNA, 18 nt, Human
uuuauacucuuucuguau

SEQ ID NO: 1377188 - RNA, 16 nt, Human
uuuauacucuuucugu

SEQ ID NO: 1377189 - RNA, 12 nt, Human
uuuauacauaaa

SEQ ID NO: 1377190 - RNA, 20 nt, Human
uuuauacauaaacaagacca

SEQ ID NO: 1377191 - RNA, 12 nt, Human
uuuaucuuuaua

SEQ ID NO: 1377192 - RNA, 14 nt, Human
uuuaugaaugggug

SEQ ID NO: 1377193 - RNA, 14 nt, Human
uuuaugagaaacuu

SEQ ID NO: 1377194 - RNA, 16 nt, Human
uuuaucugaauuuuua

SEQ ID NO: 1377195 - RNA, 20 nt, Human
uuuaucgcugggaaaugaga

SEQ ID NO: 1377196 - RNA, 19 nt, Human
uuuaucgcugggaaaugag

SEQ ID NO: 1377197 - RNA, 15 nt, Human
uuuaucgcugggaaa

SEQ ID NO: 1377198 - RNA, 18 nt, Human
uuuauccugaaauuucag

SEQ ID NO: 1377199 - RNA, 18 nt, Human
uuuauccucuuuagaguu

SEQ ID NO: 1377200 - RNA, 16 nt, Human
uuuauccuaucucucc

SEQ ID NO: 1377201 - RNA, 16 nt, Human
uuuaucgcagaccuuu

SEQ ID NO: 1377202 - RNA, 19 nt, Human
uuuauccugaaauuucaga

SEQ ID NO: 1377203 - RNA, 16 nt, Human
uuuaucgucacugcuu

SEQ ID NO: 1377204 - RNA, 22 nt, Human
uuuauacagcuguauugucuga

SEQ ID NO: 1377205 - RNA, 21 nt, Human
uuuauacagcuguauugucug

SEQ ID NO: 1377206 - RNA, 18 nt, Human
uuuauacagcuguauugu

SEQ ID NO: 1377207 - RNA, 14 nt, Human
uuuauacagcugua

SEQ ID NO: 1377208 - RNA, 13 nt, Human
uuuauacagcugu

SEQ ID NO: 1377209 - RNA, 12 nt, Human
uuuauacagcug

SEQ ID NO: 1377210 - RNA, 14 nt, Human
uuuauaacuaacau

SEQ ID NO: 1377211 - RNA, 13 nt, Human
uuuauaaauccaa

SEQ ID NO: 1377212 - RNA, 20 nt, Human
uuuauaaauacugcaaauca

SEQ ID NO: 1377213 - RNA, 17 nt, Human
uuuauaaauacugcaaa

SEQ ID NO: 1377214 - RNA, 23 nt, Human
uuuaguugaauuuuuuuuaacau

SEQ ID NO: 1377215 - RNA, 14 nt, Human
uuuaguugaauuuu

SEQ ID NO: 1377216 - RNA, 11 nt, Human
uuuaguugaau

SEQ ID NO: 1377217 - RNA, 19 nt, Human
uuuacccuggccccucucc

SEQ ID NO: 1377218 - RNA, 17 nt, Human
uuuacccuggccccucu

SEQ ID NO: 1377219 - RNA, 14 nt, Human
uuuacccuggcccc

SEQ ID NO: 1377220 - RNA, 20 nt, Human
uuuagacagucucacuuugu

SEQ ID NO: 1377221 - RNA, 16 nt, Human
uuuagacagucucacu

SEQ ID NO: 1377222 - RNA, 17 nt, Human
uuuaguugcaacuuugu

SEQ ID NO: 1377223 - RNA, 18 nt, Human
uuuaguugcaacuuugua

SEQ ID NO: 1377224 - RNA, 22 nt, Human
uuuaacauuccucaugaaugua

SEQ ID NO: 1377225 - RNA, 23 nt, Human
uuuaacauuccucaugaauguaa

SEQ ID NO: 1377226 - RNA, 12 nt, Human
uuuaacagaaau

SEQ ID NO: 1377227 - RNA, 13 nt, Human
uuuaacauuccuc

SEQ ID NO: 1377228 - RNA, 14 nt, Human
uuuaacagaaaugu

SEQ ID NO: 1377229 - RNA, 15 nt, Human
uuuaacagaaaugua

SEQ ID NO: 1377230 - RNA, 18 nt, Human
uuuaaccccccuguacac

SEQ ID NO: 1377231 - RNA, 17 nt, Human
uuuaaccccccuguaca

SEQ ID NO: 1377232 - RNA, 19 nt, Human
uuuaaccccccuguacaca

SEQ ID NO: 1377233 - RNA, 14 nt, Human
uuuaaccucuaaau

SEQ ID NO: 1377234 - RNA, 14 nt, Human
uuuaauaaacacuc

SEQ ID NO: 1377235 - RNA, 15 nt, Human
uuuaauaaacacucu

SEQ ID NO: 1377236 - RNA, 13 nt, Human
uuuaauauaaaug

SEQ ID NO: 1377237 - RNA, 23 nt, Human
uuuaauauaaaguuuuauauauu

SEQ ID NO: 1377238 - RNA, 22 nt, Human
uuuaauauaaaguuuuauauau

SEQ ID NO: 1377239 - RNA, 18 nt, Human
uuuaauauaaaguuuuau

SEQ ID NO: 1377240 - RNA, 16 nt, Human
uuuaauauaaaguuuu

SEQ ID NO: 1377241 - RNA, 13 nt, Human
uuuaauauaaagu

SEQ ID NO: 1377242 - RNA, 23 nt, Human
uuuaauauaaaguaguccuguga

SEQ ID NO: 1377243 - RNA, 19 nt, Human
uuuaauaauguuucaaaca

SEQ ID NO: 1377244 - RNA, 16 nt, Human
uuuaaccuaugauauu

SEQ ID NO: 1377245 - RNA, 15 nt, Human
uuuaauaauguuuca

SEQ ID NO: 1377246 - RNA, 22 nt, Human
uuuaauaaacacucuugaaaaa

SEQ ID NO: 1377247 - RNA, 17 nt, Human
uuuaaucaaauuuguag

SEQ ID NO: 1377248 - RNA, 13 nt, Human
uuuaaucaaauuu

SEQ ID NO: 1377249 - RNA, 20 nt, Human
uuuaauauaaaugcaaauaa

SEQ ID NO: 1377250 - RNA, 18 nt, Human
uuuaauauaaaugcaaau

SEQ ID NO: 1377251 - RNA, 15 nt, Human
uuuaauauaaaugca

SEQ ID NO: 1377252 - RNA, 21 nt, Human
uuuacaugaaguauuuuuuca

SEQ ID NO: 1377253 - RNA, 18 nt, Human
uuuacaugaauugcauuu

SEQ ID NO: 1377254 - RNA, 15 nt, Human
uuuacaugaaguauu

SEQ ID NO: 1377255 - RNA, 14 nt, Human
uuuacaugaaguau

SEQ ID NO: 1377256 - RNA, 13 nt, Human
uuuacaugaagua

SEQ ID NO: 1377257 - RNA, 17 nt, Human
uuuaccaguugccuuuu

SEQ ID NO: 1377258 - RNA, 20 nt, Human
uuuacaugcuuauuccauga

SEQ ID NO: 1377259 - RNA, 18 nt, Human
uuuacaugcuuauuccau

SEQ ID NO: 1377260 - RNA, 17 nt, Human
uuuacaugcuuauucca

SEQ ID NO: 1377261 - RNA, 16 nt, Human
uuuacaugcuuauucc

SEQ ID NO: 1377262 - RNA, 14 nt, Human
uuuacaugcuuauu

SEQ ID NO: 1377263 - RNA, 13 nt, Human
uuuacaugcuuau

SEQ ID NO: 1377264 - RNA, 12 nt, Human
uuuacaugcuua

SEQ ID NO: 1377265 - RNA, 16 nt, Human
uuuacaugaaguauuu

SEQ ID NO: 1377266 - RNA, 16 nt, Human
uuuacaugaggacucu

SEQ ID NO: 1377267 - RNA, 16 nt, Human
uuuacauggcuggagc

SEQ ID NO: 1377268 - RNA, 19 nt, Human
uuuaaaagcacgacagugg

SEQ ID NO: 1377269 - RNA, 13 nt, Human
uuuaaaagcacga

SEQ ID NO: 1377270 - RNA, 12 nt, Human
uuuaaaagauuu

SEQ ID NO: 1377271 - RNA, 13 nt, Human
uuuaaaagaugcu

SEQ ID NO: 1377272 - RNA, 17 nt, Human
uuuaaaagaugcuuuua

SEQ ID NO: 1377273 - RNA, 12 nt, Human
uuuaaaagacac

SEQ ID NO: 1377274 - RNA, 19 nt, Human
uuuaaaagacacacuuguc

SEQ ID NO: 1377275 - RNA, 13 nt, Human
uuuaaaagauaca

SEQ ID NO: 1377276 - RNA, 11 nt, Human
uuuaaaacuug

SEQ ID NO: 1377277 - RNA, 17 nt, Human
uuuaaaagaaugauuau

SEQ ID NO: 1377278 - RNA, 22 nt, Human
uuuaaaacuguuggaauggauu

SEQ ID NO: 1377279 - RNA, 15 nt, Human
uuuaaaacuguugga

SEQ ID NO: 1377280 - RNA, 21 nt, Human
uuuaaaacccauuuaaauuuu

SEQ ID NO: 1377281 - RNA, 14 nt, Human
uuuaaaacccauuu

SEQ ID NO: 1377282 - RNA, 14 nt, Human
uuuaaaagaaugau

SEQ ID NO: 1377283 - RNA, 15 nt, Human
uuuaaaaucugucac

SEQ ID NO: 1377284 - RNA, 19 nt, Human
uuuaaaaucaucagaaagg

SEQ ID NO: 1377285 - RNA, 22 nt, Human
uuuaaaaucagcuauuuuguga

SEQ ID NO: 1377286 - RNA, 18 nt, Human
uuuaaaaucagcuauuuu

SEQ ID NO: 1377287 - RNA, 16 nt, Human
uuuaaaauaucuacau

SEQ ID NO: 1377288 - RNA, 23 nt, Human
uuuaaaauagcguucuuguaauu

SEQ ID NO: 1377289 - RNA, 20 nt, Human
uuuaaaauagcguucuugua

SEQ ID NO: 1377290 - RNA, 17 nt, Human
uuuaaaauagcguucuu

SEQ ID NO: 1377291 - RNA, 12 nt, Human
uuuaaaauagca

SEQ ID NO: 1377292 - RNA, 23 nt, Human
uuuaaaagugccauuaacaaaug

SEQ ID NO: 1377293 - RNA, 18 nt, Human
uuuaaaagugucaagcug

SEQ ID NO: 1377294 - RNA, 14 nt, Human
uuuaaaagccugcu

SEQ ID NO: 1377295 - RNA, 13 nt, Human
uuuaaaagccugc

SEQ ID NO: 1377296 - RNA, 17 nt, Human
uuuaaaaggaaagaaaa

SEQ ID NO: 1377297 - RNA, 23 nt, Human
uuuaaaccgcuaaaagaaacuuu

SEQ ID NO: 1377298 - RNA, 22 nt, Human
uuuaaaccgcuaaaagaaacuu

SEQ ID NO: 1377299 - RNA, 21 nt, Human
uuuaaaccgcuaaaagaaacu

SEQ ID NO: 1377300 - RNA, 20 nt, Human
uuuaaaccgcuaaaagaaac

SEQ ID NO: 1377301 - RNA, 17 nt, Human
uuuaaaccgcuaaaaga

SEQ ID NO: 1377302 - RNA, 19 nt, Human
uuuaaacauuaauagcagc

SEQ ID NO: 1377303 - RNA, 19 nt, Human
uuuaaaccaauugcugcua

SEQ ID NO: 1377304 - RNA, 15 nt, Human
uuuaaacauuaauag

SEQ ID NO: 1377305 - RNA, 15 nt, Human
uuuaaacaaguauuu

SEQ ID NO: 1377306 - RNA, 14 nt, Human
uuuaaacaccuccu

SEQ ID NO: 1377307 - RNA, 18 nt, Human
uuuaaacuguacaguguc

SEQ ID NO: 1377308 - RNA, 15 nt, Human
uuuaaacuguacagu

SEQ ID NO: 1377309 - RNA, 13 nt, Human
uuuaaacuguaca

SEQ ID NO: 1377310 - RNA, 15 nt, Human
uuuaaacuauaagca

SEQ ID NO: 1377311 - RNA, 11 nt, Human
uuuaaaccuuu

SEQ ID NO: 1377312 - RNA, 18 nt, Human
uuuaaaccuauacucacu

SEQ ID NO: 1377313 - RNA, 16 nt, Human
uuuaaacuguacagug

SEQ ID NO: 1377314 - RNA, 14 nt, Human
uuuaaacuguguac

SEQ ID NO: 1377315 - RNA, 13 nt, Human
uuuaacagaaaug

SEQ ID NO: 1377316 - RNA, 16 nt, Human
uuuaaaauuuguucuu

SEQ ID NO: 1377317 - RNA, 12 nt, Human
uuuaaaauuugu

SEQ ID NO: 1377318 - RNA, 20 nt, Human
uuuaaaauuuauauuguaaa

SEQ ID NO: 1377319 - RNA, 18 nt, Human
uuuaaaauuuuuuuagaa

SEQ ID NO: 1377320 - RNA, 19 nt, Human
uuuaaaauuuuuuuagaaa

SEQ ID NO: 1377321 - RNA, 17 nt, Human
uuuaaaauuuauauugu

SEQ ID NO: 1377322 - RNA, 12 nt, Human
uuuaaaauguac

SEQ ID NO: 1377323 - RNA, 16 nt, Human
uuuaaaauuacaacua

SEQ ID NO: 1377324 - RNA, 12 nt, Human
uuuaaaaugucu

SEQ ID NO: 1377325 - RNA, 20 nt, Human
uuuaaaauguaaagccaugc

SEQ ID NO: 1377326 - RNA, 18 nt, Human
uuuaaaauguaaagccau

SEQ ID NO: 1377327 - RNA, 17 nt, Human
uuuaaaauguaaagcca

SEQ ID NO: 1377328 - RNA, 11 nt, Human
uuuaaaaugua

SEQ ID NO: 1377329 - RNA, 16 nt, Human
uuuaaaaugagaaauc

SEQ ID NO: 1377330 - RNA, 19 nt, Human
uuguuucuuucucugagga

SEQ ID NO: 1377331 - RNA, 16 nt, Human
uuguuucuuucucuga

SEQ ID NO: 1377332 - RNA, 15 nt, Human
uuguuucuuaaauaa

SEQ ID NO: 1377333 - RNA, 23 nt, Human
uuguuucuuaaauaagaaacuuu

SEQ ID NO: 1377334 - RNA, 14 nt, Human
uuguuucuuaaaua

SEQ ID NO: 1377335 - RNA, 12 nt, Human
uuguuucuuaaa

SEQ ID NO: 1377336 - RNA, 17 nt, Human
uuguuucuguuccaaau

SEQ ID NO: 1377337 - RNA, 17 nt, Human
uuguuuggggcaggagu

SEQ ID NO: 1377338 - RNA, 15 nt, Human
uuguuugguauugua

SEQ ID NO: 1377339 - RNA, 20 nt, Human
uuguuucuuucucugaggac

SEQ ID NO: 1377340 - RNA, 15 nt, Human
uuguuuauguaauuu

SEQ ID NO: 1377341 - RNA, 21 nt, Human
uuguuuagaaagaauauucau

SEQ ID NO: 1377342 - RNA, 16 nt, Human
uuguuucuguuccaaa

SEQ ID NO: 1377343 - RNA, 15 nt, Human
uuguuucuguuccaa

SEQ ID NO: 1377344 - RNA, 15 nt, Human
uuuaaaacagacacu

SEQ ID NO: 1377345 - RNA, 12 nt, Human
uuguuuuacaau

SEQ ID NO: 1377346 - RNA, 13 nt, Human
uuguuuuacaaua

SEQ ID NO: 1377347 - RNA, 16 nt, Human
uuguuugguauuguau

SEQ ID NO: 1377348 - RNA, 19 nt, Human
uuguuugguauuguauuua

SEQ ID NO: 1377349 - RNA, 21 nt, Human
uuguuugguauuguauuuauu

SEQ ID NO: 1377350 - RNA, 22 nt, Human
uuguuauuuugcaaccucgcug

SEQ ID NO: 1377351 - RNA, 15 nt, Human
uuguuauuuugcaac

SEQ ID NO: 1377352 - RNA, 23 nt, Human
uuguuauuugaaaacauguuuau

SEQ ID NO: 1377353 - RNA, 22 nt, Human
uuguuuaauuuuuauuucuucc

SEQ ID NO: 1377354 - RNA, 22 nt, Human
uuguuuacaugcuuauuccaug

SEQ ID NO: 1377355 - RNA, 23 nt, Human
uuguuuacaugcuuauuccauga

SEQ ID NO: 1377356 - RNA, 17 nt, Human
uuguuuacaugcuuauu

SEQ ID NO: 1377357 - RNA, 16 nt, Human
uuguuuacaugcuuau

SEQ ID NO: 1377358 - RNA, 15 nt, Human
uuguuuacaugcuua

SEQ ID NO: 1377359 - RNA, 14 nt, Human
uugucuuauucccu

SEQ ID NO: 1377360 - RNA, 12 nt, Human
uugucuuuauuu

SEQ ID NO: 1377361 - RNA, 15 nt, Human
uuguuauuaaacaaa

SEQ ID NO: 1377362 - RNA, 19 nt, Human
uugcagaaaauucugugcc

SEQ ID NO: 1377363 - RNA, 23 nt, Human
uugauucgguauccccccaucuu

SEQ ID NO: 1377364 - RNA, 19 nt, Human
uugauucauaguaacuucu

SEQ ID NO: 1377365 - RNA, 14 nt, Human
uugaucuggaaccc

SEQ ID NO: 1377366 - RNA, 18 nt, Human
uugcaguuuaucauucaa

SEQ ID NO: 1377367 - RNA, 13 nt, Human
uugcaguuuauca

SEQ ID NO: 1377368 - RNA, 21 nt, Human
uugcaguucccacauuaaaga

SEQ ID NO: 1377369 - RNA, 13 nt, Human
uugcagcuguuuu

SEQ ID NO: 1377370 - RNA, 12 nt, Human
uugcagcuguuu

SEQ ID NO: 1377371 - RNA, 9 nt, Human
uugcagcug

SEQ ID NO: 1377372 - RNA, 15 nt, Human
uugcagcgacuggca

SEQ ID NO: 1377373 - RNA, 18 nt, Human
uugcagcgauuaauaaca

SEQ ID NO: 1377374 - RNA, 20 nt, Human
uugcagccggcacagggucu

SEQ ID NO: 1377375 - RNA, 18 nt, Human
uugcagccggcacagggu

SEQ ID NO: 1377376 - RNA, 19 nt, Human
uugcagcgauuaauaacag

SEQ ID NO: 1377377 - RNA, 23 nt, Human
uugcagcucuccccuucucugua

SEQ ID NO: 1377378 - RNA, 17 nt, Human
uugcagaaaauucugug

SEQ ID NO: 1377379 - RNA, 16 nt, Human
uugcagaaaauucugu

SEQ ID NO: 1377380 - RNA, 17 nt, Human
uugcagcacagcugaga

SEQ ID NO: 1377381 - RNA, 22 nt, Human
uugcagcccugcugcugccugc

SEQ ID NO: 1377382 - RNA, 23 nt, Human
uugccaugacaacuucuaauugc

SEQ ID NO: 1377383 - RNA, 23 nt, Human
uugccaucugcgugacaauaaaa

SEQ ID NO: 1377384 - RNA, 19 nt, Human
uugccauauuuucaccauu

SEQ ID NO: 1377385 - RNA, 20 nt, Human
uugccaggugacugucuggg

SEQ ID NO: 1377386 - RNA, 19 nt, Human
uugccaggcuggagugcag

SEQ ID NO: 1377387 - RNA, 23 nt, Human
uugccaggcuggagugcaguggc

SEQ ID NO: 1377388 - RNA, 19 nt, Human
uugccagagauccaaaaga

SEQ ID NO: 1377389 - RNA, 19 nt, Human
uugcauaacaauuccucua

SEQ ID NO: 1377390 - RNA, 23 nt, Human
uugcaguuuaucauucaagugua

SEQ ID NO: 1377391 - RNA, 20 nt, Human
uugcaguuuaucauucaagu

SEQ ID NO: 1377392 - RNA, 19 nt, Human
uugcaguuuaucauucaag

SEQ ID NO: 1377393 - RNA, 16 nt, Human
uugcauaacguauaaa

SEQ ID NO: 1377394 - RNA, 15 nt, Human
uugaauuguaacugu

SEQ ID NO: 1377395 - RNA, 21 nt, Human
uugaauucuugguugaggaaa

SEQ ID NO: 1377396 - RNA, 22 nt, Human
uugaauuaucuugguugaaaau

SEQ ID NO: 1377397 - RNA, 20 nt, Human
uugaauuaucuugguugaaa

SEQ ID NO: 1377398 - RNA, 18 nt, Human
uugaauuaucuugguuga

SEQ ID NO: 1377399 - RNA, 13 nt, Human
uugaauuaucuug

SEQ ID NO: 1377400 - RNA, 23 nt, Human
uugaauuaauaucccuacaugua

SEQ ID NO: 1377401 - RNA, 20 nt, Human
uugaauguuaaauaaauugu

SEQ ID NO: 1377402 - RNA, 14 nt, Human
uugagccuugaacu

SEQ ID NO: 1377403 - RNA, 15 nt, Human
uugagccuugaacuu

SEQ ID NO: 1377404 - RNA, 16 nt, Human
uugagccuugaacuuu

SEQ ID NO: 1377405 - RNA, 16 nt, Human
uugaggcaaaagaagg

SEQ ID NO: 1377406 - RNA, 13 nt, Human
uugaggacuucuu

SEQ ID NO: 1377407 - RNA, 16 nt, Human
uugaggagccccagcu

SEQ ID NO: 1377408 - RNA, 12 nt, Human
uugaggagcccc

SEQ ID NO: 1377409 - RNA, 15 nt, Human
uugaggacuucuugc

SEQ ID NO: 1377410 - RNA, 15 nt, Human
uugagcucucugccc

SEQ ID NO: 1377411 - RNA, 18 nt, Human
uugagcucucucauuguc

SEQ ID NO: 1377412 - RNA, 15 nt, Human
uugagcuauugcugu

SEQ ID NO: 1377413 - RNA, 18 nt, Human
uugaauuguaacuguucu

SEQ ID NO: 1377414 - RNA, 19 nt, Human
uugagccuugaacuuugac

SEQ ID NO: 1377415 - RNA, 16 nt, Human
uugaucuccguggcuu

SEQ ID NO: 1377416 - RNA, 19 nt, Human
uugaucgccuuucccaggu

SEQ ID NO: 1377417 - RNA, 18 nt, Human
uugauccauuucuaauua

SEQ ID NO: 1377418 - RNA, 17 nt, Human
uugauccauuucuaauu

SEQ ID NO: 1377419 - RNA, 16 nt, Human
uugauccauuucuaau

SEQ ID NO: 1377420 - RNA, 15 nt, Human
uugauccauuucuaa

SEQ ID NO: 1377421 - RNA, 17 nt, Human
uugauccagaaagaaaa

SEQ ID NO: 1377422 - RNA, 18 nt, Human
uugaucaguuaagaaauu

SEQ ID NO: 1377423 - RNA, 12 nt, Human
uugaucaguuaa

SEQ ID NO: 1377424 - RNA, 21 nt, Human
uugaucagccccacccuggcc

SEQ ID NO: 1377425 - RNA, 20 nt, Human
uugaucagccccacccuggc

SEQ ID NO: 1377426 - RNA, 15 nt, Human
uugauauuucuagcu

SEQ ID NO: 1377427 - RNA, 15 nt, Human
uugauaugacuguuu

SEQ ID NO: 1377428 - RNA, 16 nt, Human
uugauaugugaacagu

SEQ ID NO: 1377429 - RNA, 22 nt, Human
uugaggcuugguuccuucccaa

SEQ ID NO: 1377430 - RNA, 20 nt, Human
uugauaugccuuuucccaac

SEQ ID NO: 1377431 - RNA, 12 nt, Human
uucuuguauuua

SEQ ID NO: 1377432 - RNA, 21 nt, Human
uucuucauaacaauuuuagga

SEQ ID NO: 1377433 - RNA, 18 nt, Human
uucuucauaacaauuuua

SEQ ID NO: 1377434 - RNA, 14 nt, Human
uucuugucuuuauu

SEQ ID NO: 1377435 - RNA, 21 nt, Human
uucuugucuauaaagcauuua

SEQ ID NO: 1377436 - RNA, 22 nt, Human
uucuugucuauaaagcauuuaa

SEQ ID NO: 1377437 - RNA, 18 nt, Human
uucuugucuauaaagcau

SEQ ID NO: 1377438 - RNA, 17 nt, Human
uucuugucuauaaagca

SEQ ID NO: 1377439 - RNA, 16 nt, Human
uucuugucuauaaagc

SEQ ID NO: 1377440 - RNA, 14 nt, Human
uucuugucuauaaa

SEQ ID NO: 1377441 - RNA, 13 nt, Human
uucuugucuauaa

SEQ ID NO: 1377442 - RNA, 11 nt, Human
uucuugucuau

SEQ ID NO: 1377443 - RNA, 12 nt, Human
uucuuuaacugc

SEQ ID NO: 1377444 - RNA, 20 nt, Human
uucuuuaaaguucuucuaag

SEQ ID NO: 1377445 - RNA, 22 nt, Human
uucuuguguguaugcacaugaa

SEQ ID NO: 1377446 - RNA, 18 nt, Human
uucuuguguguaugcaca

SEQ ID NO: 1377447 - RNA, 22 nt, Human
uucuuauggaauugauuugcau

SEQ ID NO: 1377448 - RNA, 18 nt, Human
uucuuauggaauugauuu

SEQ ID NO: 1377449 - RNA, 17 nt, Human
uucuuauggaauugauu

SEQ ID NO: 1377450 - RNA, 15 nt, Human
uucuuauggaauuga

SEQ ID NO: 1377451 - RNA, 18 nt, Human
uucuuaugccauauaauu

SEQ ID NO: 1377452 - RNA, 13 nt, Human
uucuuagugacuu

SEQ ID NO: 1377453 - RNA, 16 nt, Human
uucuuagcucaaugag

SEQ ID NO: 1377454 - RNA, 23 nt, Human
uucuuagcucaaugagcauguuu

SEQ ID NO: 1377455 - RNA, 19 nt, Human
uucuuaggguuaugauuaa

SEQ ID NO: 1377456 - RNA, 17 nt, Human
uucuuagggaaggauac

SEQ ID NO: 1377457 - RNA, 16 nt, Human
uucuaaguuucuaaga

SEQ ID NO: 1377458 - RNA, 14 nt, Human
uucuaaguuucuaa

SEQ ID NO: 1377459 - RNA, 13 nt, Human
uucuaaguuucua

SEQ ID NO: 1377460 - RNA, 12 nt, Human
uucuaaguuucu

SEQ ID NO: 1377461 - RNA, 20 nt, Human
uucuaaguaaauacaauuuu

SEQ ID NO: 1377462 - RNA, 17 nt, Human
uucuaagucuuuccauu

SEQ ID NO: 1377463 - RNA, 15 nt, Human
uucuaagucuuucca

SEQ ID NO: 1377464 - RNA, 12 nt, Human
uucuaagucuuu

SEQ ID NO: 1377465 - RNA, 21 nt, Human
uucuaaguaaauacaauuuuu

SEQ ID NO: 1377466 - RNA, 18 nt, Human
uucuaaguaaauacaauu

SEQ ID NO: 1377467 - RNA, 17 nt, Human
uucuaaguaaauacaau

SEQ ID NO: 1377468 - RNA, 16 nt, Human
uucuaaguaaauacaa

SEQ ID NO: 1377469 - RNA, 15 nt, Human
uucuaaguaaauaca

SEQ ID NO: 1377470 - RNA, 17 nt, Human
uucuaaagcucugacau

SEQ ID NO: 1377471 - RNA, 16 nt, Human
uucuaaagcucugaca

SEQ ID NO: 1377472 - RNA, 15 nt, Human
uucuaaagcucugac

SEQ ID NO: 1377473 - RNA, 22 nt, Human
uucuggccaguguuuaaaacuu

SEQ ID NO: 1377474 - RNA, 18 nt, Human
uucuggccaguguuuaaa

SEQ ID NO: 1377475 - RNA, 17 nt, Human
uucuggccaguguuuaa

SEQ ID NO: 1377476 - RNA, 16 nt, Human
uucuggccaguguuua

SEQ ID NO: 1377477 - RNA, 15 nt, Human
uucuggccaggaagc

SEQ ID NO: 1377478 - RNA, 21 nt, Human
uucuggccaguguuuaaaacu

SEQ ID NO: 1377479 - RNA, 16 nt, Human
uucuggcuaugcauuu

SEQ ID NO: 1377480 - RNA, 14 nt, Human
uucuggccaggaag

SEQ ID NO: 1377481 - RNA, 18 nt, Human
uucuaaguuucuaagauu

SEQ ID NO: 1377482 - RNA, 17 nt, Human
uucuaaguuucuaagau

SEQ ID NO: 1377483 - RNA, 15 nt, Human
uucuuagcucaauga

SEQ ID NO: 1377484 - RNA, 17 nt, Human
uucugugccugaauauu

SEQ ID NO: 1377485 - RNA, 16 nt, Human
uucugugccugaauau

SEQ ID NO: 1377486 - RNA, 15 nt, Human
uucugugccugaaua

SEQ ID NO: 1377487 - RNA, 13 nt, Human
uucugugccugaa

SEQ ID NO: 1377488 - RNA, 17 nt, Human
uucuguauauacuuuuu

SEQ ID NO: 1377489 - RNA, 16 nt, Human
uucuguauauacuuuu

SEQ ID NO: 1377490 - RNA, 15 nt, Human
uucuguauauacuuu

SEQ ID NO: 1377491 - RNA, 16 nt, Human
uucuuucccagucugu

SEQ ID NO: 1377492 - RNA, 15 nt, Human
uucuuuccauuugca

SEQ ID NO: 1377493 - RNA, 21 nt, Human
uugaaaaucuuauaauuuaaa

SEQ ID NO: 1377494 - RNA, 11 nt, Human
uucuuuagaac

SEQ ID NO: 1377495 - RNA, 22 nt, Human
uucuuuacaaaacaaacucauu

SEQ ID NO: 1377496 - RNA, 20 nt, Human
uucuuuacaaaacaaacuca

SEQ ID NO: 1377497 - RNA, 19 nt, Human
uucuuuaacugccguaauu

SEQ ID NO: 1377498 - RNA, 15 nt, Human
uugaaacagaaaaau

SEQ ID NO: 1377499 - RNA, 15 nt, Human
uugaacuuugaccuc

SEQ ID NO: 1377500 - RNA, 16 nt, Human
uugaaaauguccagga

SEQ ID NO: 1377501 - RNA, 21 nt, Human
uugaaaauaagaauagaaaua

SEQ ID NO: 1377502 - RNA, 13 nt, Human
uucuuucuagaaa

SEQ ID NO: 1377503 - RNA, 12 nt, Human
uucuuucuagaa

SEQ ID NO: 1377504 - RNA, 18 nt, Human
uugaaaauuaacaugaau

SEQ ID NO: 1377505 - RNA, 20 nt, Human
uugaauguguuucacaguuu

SEQ ID NO: 1377506 - RNA, 13 nt, Human
uugaauguuaaau

SEQ ID NO: 1377507 - RNA, 15 nt, Human
uugaauguuaaauaa

SEQ ID NO: 1377508 - RNA, 18 nt, Human
uugaauguuaaauaaauu

SEQ ID NO: 1377509 - RNA, 22 nt, Human
uugaauguggcuugagaaauau

SEQ ID NO: 1377510 - RNA, 21 nt, Human
uugaauguggcuugagaaaua

SEQ ID NO: 1377511 - RNA, 19 nt, Human
uugaauguggcuugagaaa

SEQ ID NO: 1377512 - RNA, 21 nt, Human
uugaaugauuuuucuuuacaa

SEQ ID NO: 1377513 - RNA, 20 nt, Human
uugaaugauuuuucuuuaca

SEQ ID NO: 1377514 - RNA, 16 nt, Human
uugaagagguuuuaaa

SEQ ID NO: 1377515 - RNA, 20 nt, Human
uugaacuuugaccucugcag

SEQ ID NO: 1377516 - RNA, 17 nt, Human
uugaacuuugaccucug

SEQ ID NO: 1377517 - RNA, 18 nt, Human
uugaacuuugaccucugc

SEQ ID NO: 1377518 - RNA, 18 nt, Human
uugaagcacguacauuuu

SEQ ID NO: 1377519 - RNA, 14 nt, Human
uugaagcacguaca

SEQ ID NO: 1377520 - RNA, 20 nt, Human
uugaagcaaaucgaaugaaa

SEQ ID NO: 1377521 - RNA, 20 nt, Human
uugaagcacagugaucaagu

SEQ ID NO: 1377522 - RNA, 21 nt, Human
uugaagagguuuuaaagcuuc

SEQ ID NO: 1377523 - RNA, 17 nt, Human
uuguaaaaugacaauca

SEQ ID NO: 1377524 - RNA, 15 nt, Human
uuguaaaaugacaau

SEQ ID NO: 1377525 - RNA, 13 nt, Human
uuguaaaaugaca

SEQ ID NO: 1377526 - RNA, 14 nt, Human
uugguaccagauaa

SEQ ID NO: 1377527 - RNA, 12 nt, Human
uugguaccagau

SEQ ID NO: 1377528 - RNA, 13 nt, Human
uuggucguuuuuu

SEQ ID NO: 1377529 - RNA, 15 nt, Human
uugggauaucuccug

SEQ ID NO: 1377530 - RNA, 13 nt, Human
uugggaguuuuua

SEQ ID NO: 1377531 - RNA, 19 nt, Human
uugggagcuugggaaugga

SEQ ID NO: 1377532 - RNA, 17 nt, Human
uugggagcuugggaaug

SEQ ID NO: 1377533 - RNA, 15 nt, Human
uugggagagggcgca

SEQ ID NO: 1377534 - RNA, 17 nt, Human
uugggcacccccagccu

SEQ ID NO: 1377535 - RNA, 14 nt, Human
uugggauuugcugu

SEQ ID NO: 1377536 - RNA, 13 nt, Human
uugggauuugcug

SEQ ID NO: 1377537 - RNA, 15 nt, Human
uugguaacuuuugug

SEQ ID NO: 1377538 - RNA, 14 nt, Human
uugguaacuuuugu

SEQ ID NO: 1377539 - RNA, 12 nt, Human
uugguaacuuuu

SEQ ID NO: 1377540 - RNA, 20 nt, Human
uugguaaggggaauugagga

SEQ ID NO: 1377541 - RNA, 14 nt, Human
uugggaauuuuauu

SEQ ID NO: 1377542 - RNA, 18 nt, Human
uugggaauggauccugga

SEQ ID NO: 1377543 - RNA, 17 nt, Human
uugggaauauuugaauc

SEQ ID NO: 1377544 - RNA, 19 nt, Human
uugggaauauuugaaucuu

SEQ ID NO: 1377545 - RNA, 21 nt, Human
uuggcuuuauccucuuuagag

SEQ ID NO: 1377546 - RNA, 22 nt, Human
uuggcuuuauccucuuuagagu

SEQ ID NO: 1377547 - RNA, 15 nt, Human
uugggaauauuugaa

SEQ ID NO: 1377548 - RNA, 16 nt, Human
uugggaauauuugaau

SEQ ID NO: 1377549 - RNA, 16 nt, Human
uugggagagggcgcag

SEQ ID NO: 1377550 - RNA, 23 nt, Human
uugggagagacuuguuuuggaug

SEQ ID NO: 1377551 - RNA, 13 nt, Human
uugggagagacuu

SEQ ID NO: 1377552 - RNA, 17 nt, Human
uugggagacaugugaca

SEQ ID NO: 1377553 - RNA, 14 nt, Human
uugggagacaugug

SEQ ID NO: 1377554 - RNA, 22 nt, Human
uugggacugcuaaauaaaauuu

SEQ ID NO: 1377555 - RNA, 19 nt, Human
uuggcuuauaauucuuuca

SEQ ID NO: 1377556 - RNA, 18 nt, Human
uuggcuuauaauucuuuc

SEQ ID NO: 1377557 - RNA, 17 nt, Human
uuggcuuauaauucuuu

SEQ ID NO: 1377558 - RNA, 14 nt, Human
uuggcuuauaauuc

SEQ ID NO: 1377559 - RNA, 16 nt, Human
uuggcauagcucuggg

SEQ ID NO: 1377560 - RNA, 14 nt, Human
uuggcuuuauccuc

SEQ ID NO: 1377561 - RNA, 20 nt, Human
uuggcuuuauccucuuuaga

SEQ ID NO: 1377562 - RNA, 14 nt, Human
uuggcagucugaau

SEQ ID NO: 1377563 - RNA, 14 nt, Human
uuggcaggcuggcc

SEQ ID NO: 1377564 - RNA, 13 nt, Human
uuggcaggcuggc

SEQ ID NO: 1377565 - RNA, 17 nt, Human
uugucuuaauauugugg

SEQ ID NO: 1377566 - RNA, 12 nt, Human
uugucuuaauau

SEQ ID NO: 1377567 - RNA, 23 nt, Human
uugucucuguuuuacaaguugga

SEQ ID NO: 1377568 - RNA, 21 nt, Human
uugucucugaugcagcuuaua

SEQ ID NO: 1377569 - RNA, 17 nt, Human
uugucucugaugcagcu

SEQ ID NO: 1377570 - RNA, 15 nt, Human
uugucucugaugcag

SEQ ID NO: 1377571 - RNA, 15 nt, Human
uugucugaacuugca

SEQ ID NO: 1377572 - RNA, 12 nt, Human
uugucucuguuu

SEQ ID NO: 1377573 - RNA, 22 nt, Human
uugucugaaaagugaagacaga

SEQ ID NO: 1377574 - RNA, 14 nt, Human
uugucucugaugca

SEQ ID NO: 1377575 - RNA, 13 nt, Human
uugucucugaugc

SEQ ID NO: 1377576 - RNA, 18 nt, Human
uugucuauaaagcauuua

SEQ ID NO: 1377577 - RNA, 18 nt, Human
uugucuauuaccuguuag

SEQ ID NO: 1377578 - RNA, 16 nt, Human
uugucuauaaagcauu

SEQ ID NO: 1377579 - RNA, 15 nt, Human
uugucuauaaagcau

SEQ ID NO: 1377580 - RNA, 22 nt, Human
uugucaagaauagcauuguaaa

SEQ ID NO: 1377581 - RNA, 16 nt, Human
uuguaugaaacuaaag

SEQ ID NO: 1377582 - RNA, 22 nt, Human
uuguaaacucaaaauauuugua

SEQ ID NO: 1377583 - RNA, 16 nt, Human
uuguaaacucaaaaua

SEQ ID NO: 1377584 - RNA, 23 nt, Human
uuguaaacaaacuguguaacugc

SEQ ID NO: 1377585 - RNA, 22 nt, Human
uuguaaacaaacuguguaacug

SEQ ID NO: 1377586 - RNA, 17 nt, Human
uuguaaaauuauuucau

SEQ ID NO: 1377587 - RNA, 22 nt, Human
uuguaaaaugacaaucaugugu

SEQ ID NO: 1377588 - RNA, 20 nt, Human
uuguaaaaugacaaucaugu

SEQ ID NO: 1377589 - RNA, 19 nt, Human
uuguaaaaugacaaucaug

SEQ ID NO: 1377590 - RNA, 15 nt, Human
uuguaccaacuuuua

SEQ ID NO: 1377591 - RNA, 20 nt, Human
uuguacauuugggaguuuuu

SEQ ID NO: 1377592 - RNA, 15 nt, Human
uuguagcauccugga

SEQ ID NO: 1377593 - RNA, 17 nt, Human
uuguagcauccucuuua

SEQ ID NO: 1377594 - RNA, 22 nt, Human
uuguagaagucacauuccugaa

SEQ ID NO: 1377595 - RNA, 17 nt, Human
uuguagaagucacauuc

SEQ ID NO: 1377596 - RNA, 18 nt, Human
uuguacuuuagggaagua

SEQ ID NO: 1377597 - RNA, 20 nt, Human
uugccaugacaacuucuaau

SEQ ID NO: 1377598 - RNA, 17 nt, Human
uugccuucuacuuuuaa

SEQ ID NO: 1377599 - RNA, 22 nt, Human
uugccuuccagaaaacaaaacu

SEQ ID NO: 1377600 - RNA, 19 nt, Human
uugccuguaacaagccaga

SEQ ID NO: 1377601 - RNA, 14 nt, Human
uugccuguaacaag

SEQ ID NO: 1377602 - RNA, 13 nt, Human
uugccuuaaaaua

SEQ ID NO: 1377603 - RNA, 16 nt, Human
uugccuuaacuggagc

SEQ ID NO: 1377604 - RNA, 19 nt, Human
uugccuuuugcaaccagga

SEQ ID NO: 1377605 - RNA, 15 nt, Human
uugcgcuccuggccc

SEQ ID NO: 1377606 - RNA, 19 nt, Human
uugcgauagagucucacug

SEQ ID NO: 1377607 - RNA, 19 nt, Human
uugcgagagauguguguug

SEQ ID NO: 1377608 - RNA, 17 nt, Human
uugcgagagaugugugu

SEQ ID NO: 1377609 - RNA, 16 nt, Human
uugcgagagaugugug

SEQ ID NO: 1377610 - RNA, 15 nt, Human
uugcgagagaugugu

SEQ ID NO: 1377611 - RNA, 14 nt, Human
uugcgagagaugug

SEQ ID NO: 1377612 - RNA, 12 nt, Human
uugcgagagaug

SEQ ID NO: 1377613 - RNA, 19 nt, Human
uugcugugaggcuguccug

SEQ ID NO: 1377614 - RNA, 18 nt, Human
uugcugugaggcuguccu

SEQ ID NO: 1377615 - RNA, 17 nt, Human
uugcugugaggcugucc

SEQ ID NO: 1377616 - RNA, 15 nt, Human
uugcugugaggcugu

SEQ ID NO: 1377617 - RNA, 14 nt, Human
uugcugugaggcug

SEQ ID NO: 1377618 - RNA, 23 nt, Human
uugcuggacugucauagaaauua

SEQ ID NO: 1377619 - RNA, 21 nt, Human
uugcuggaauaaguucaaauu

SEQ ID NO: 1377620 - RNA, 21 nt, Human
uugcuggaagacgcaagggcc

SEQ ID NO: 1377621 - RNA, 21 nt, Human
uugcugcuucucccaggcaag

SEQ ID NO: 1377622 - RNA, 17 nt, Human
uugcugcuucucccagg

SEQ ID NO: 1377623 - RNA, 16 nt, Human
uugcugcuucucccag

SEQ ID NO: 1377624 - RNA, 15 nt, Human
uugcugcuucuccca

SEQ ID NO: 1377625 - RNA, 15 nt, Human
uugcuggaguacuua

SEQ ID NO: 1377626 - RNA, 13 nt, Human
uugcugcuucucc

SEQ ID NO: 1377627 - RNA, 20 nt, Human
uugcugcuaauauuuuccuc

SEQ ID NO: 1377628 - RNA, 16 nt, Human
uugcugcuaauauuuu

SEQ ID NO: 1377629 - RNA, 21 nt, Human
uugcuaagccccagcaagcaa

SEQ ID NO: 1377630 - RNA, 18 nt, Human
uugcuaagcauuccaacu

SEQ ID NO: 1377631 - RNA, 21 nt, Human
uugcgcuccuggcccagccuu

SEQ ID NO: 1377632 - RNA, 20 nt, Human
uugcgcuccuggcccagccu

SEQ ID NO: 1377633 - RNA, 19 nt, Human
uugcgcuccuggcccagcc

SEQ ID NO: 1377634 - RNA, 16 nt, Human
uugcuaagcauuccaa

SEQ ID NO: 1377635 - RNA, 19 nt, Human
uuggcaccuaauccaggca

SEQ ID NO: 1377636 - RNA, 18 nt, Human
uuggcaccgaagcccaga

SEQ ID NO: 1377637 - RNA, 17 nt, Human
uuggcaccgaagcccag

SEQ ID NO: 1377638 - RNA, 23 nt, Human
uuggcaccagacacccaggacuu

SEQ ID NO: 1377639 - RNA, 21 nt, Human
uuggcaccagacacccaggac

SEQ ID NO: 1377640 - RNA, 20 nt, Human
uuggcaccagacacccagga

SEQ ID NO: 1377641 - RNA, 17 nt, Human
uuggcaccagacaccca

SEQ ID NO: 1377642 - RNA, 13 nt, Human
uuggcaccagaca

SEQ ID NO: 1377643 - RNA, 13 nt, Human
uuggcaauuuugu

SEQ ID NO: 1377644 - RNA, 14 nt, Human
uuggcaauuuugug

SEQ ID NO: 1377645 - RNA, 12 nt, Human
uuggcaauuuug

SEQ ID NO: 1377646 - RNA, 17 nt, Human
uuggcaaugccaucauc

SEQ ID NO: 1377647 - RNA, 20 nt, Human
uuggauuuugcaaggugcau

SEQ ID NO: 1377648 - RNA, 21 nt, Human
uuggcaccuaauccaggcaga

SEQ ID NO: 1377649 - RNA, 13 nt, Human
uuggcagccuugu

SEQ ID NO: 1377650 - RNA, 12 nt, Human
uuggcagccuug

SEQ ID NO: 1377651 - RNA, 12 nt, Human
uuggcaggcugg

SEQ ID NO: 1377652 - RNA, 16 nt, Human
uuggcagccuugugau

SEQ ID NO: 1377653 - RNA, 14 nt, Human
uuggcagccuugug

SEQ ID NO: 1377654 - RNA, 22 nt, Human
uuggauuugacauugcguuuga

SEQ ID NO: 1377655 - RNA, 14 nt, Human
uuggauuugacauu

SEQ ID NO: 1377656 - RNA, 21 nt, Human
uuggauuuccuaauacuguca

SEQ ID NO: 1377657 - RNA, 14 nt, Human
uuggauuuccuaau

SEQ ID NO: 1377658 - RNA, 12 nt, Human
uuggauuuccua

SEQ ID NO: 1377659 - RNA, 16 nt, Human
uuggauuuaguuucag

SEQ ID NO: 1377660 - RNA, 21 nt, Human
uuggauuuaaaagccugcuca

SEQ ID NO: 1377661 - RNA, 19 nt, Human
uuggauuuaaaagccugcu

SEQ ID NO: 1377662 - RNA, 20 nt, Human
uugcugugaggcuguccugu

SEQ ID NO: 1377663 - RNA, 21 nt, Human
uuggaagagcagcaccuccuc

SEQ ID NO: 1377664 - RNA, 22 nt, Human
uuggaagauggcauaaccuguc

SEQ ID NO: 1377665 - RNA, 22 nt, Human
uuggaagagcagcaccuccuca

SEQ ID NO: 1377666 - RNA, 20 nt, Human
uuggaagagcagcaccuccu

SEQ ID NO: 1377667 - RNA, 17 nt, Human
uuggaagagcagcaccu

SEQ ID NO: 1377668 - RNA, 16 nt, Human
uuggaagagcagcacc

SEQ ID NO: 1377669 - RNA, 15 nt, Human
uuggaagagcagcac

SEQ ID NO: 1377670 - RNA, 24 nt, Human
uuggaagacuaucuuacuauuuca

SEQ ID NO: 1377671 - RNA, 14 nt, Human
uuggacacgcucag

SEQ ID NO: 1377672 - RNA, 19 nt, Human
uuggacaccuuuagguucu

SEQ ID NO: 1377673 - RNA, 19 nt, Human
uuggacaagcuucugagac

SEQ ID NO: 1377674 - RNA, 17 nt, Human
uuggacaagcuucugag

SEQ ID NO: 1377675 - RNA, 15 nt, Human
uuggacaagcuucug

SEQ ID NO: 1377676 - RNA, 19 nt, Human
uuggacaaaucacauauuu

SEQ ID NO: 1377677 - RNA, 20 nt, Human
uuggacaaaucacauauuuu

SEQ ID NO: 1377678 - RNA, 14 nt, Human
uuggacaaaucaca

SEQ ID NO: 1377679 - RNA, 14 nt, Human
uuggacauccuccu

SEQ ID NO: 1377680 - RNA, 15 nt, Human
uuggacaguuuacca

SEQ ID NO: 1377681 - RNA, 17 nt, Human
uuggaauguucucagau

SEQ ID NO: 1377682 - RNA, 23 nt, Human
uuggaauauuguccauuguccaa

SEQ ID NO: 1377683 - RNA, 15 nt, Human
uuggaauauaauugu

SEQ ID NO: 1377684 - RNA, 13 nt, Human
uuggaauacuuuu

SEQ ID NO: 1377685 - RNA, 17 nt, Human
uuggaauucgcuuucua

SEQ ID NO: 1377686 - RNA, 18 nt, Human
uuggacaaaauggaauac

SEQ ID NO: 1377687 - RNA, 23 nt, Human
ggcaucggggagccgggagccug

SEQ ID NO: 1377688 - RNA, 11 nt, Human
ggcauuuccua

SEQ ID NO: 1377689 - RNA, 21 nt, Human
ggcauuugcaggguccucuuc

SEQ ID NO: 1377690 - RNA, 20 nt, Human
ggcauuugcaggguccucuu

SEQ ID NO: 1377691 - RNA, 16 nt, Human
ggcauuuccugggugg

SEQ ID NO: 1377692 - RNA, 18 nt, Human
ggcauuuccuggguggcu

SEQ ID NO: 1377693 - RNA, 15 nt, Human
ggcauuuccugggug

SEQ ID NO: 1377694 - RNA, 12 nt, Human
ggcauuuccugg

SEQ ID NO: 1377695 - RNA, 21 nt, Human
ggcaucgcaccauucugacuc

SEQ ID NO: 1377696 - RNA, 18 nt, Human
ggcaucgcaccauucuga

SEQ ID NO: 1377697 - RNA, 22 nt, Human
ggcaucggggagccgggagccu

SEQ ID NO: 1377698 - RNA, 18 nt, Human
ggcauccagagucccugc

SEQ ID NO: 1377699 - RNA, 16 nt, Human
ggcauccagagucccu

SEQ ID NO: 1377700 - RNA, 20 nt, Human
ggcaucaguguccuuggcag

SEQ ID NO: 1377701 - RNA, 17 nt, Human
ggcaucaucucagcuca

SEQ ID NO: 1377702 - RNA, 23 nt, Human
ggcaucaucucagcucacugcaa

SEQ ID NO: 1377703 - RNA, 15 nt, Human
ggccaagaagcagug

SEQ ID NO: 1377704 - RNA, 13 nt, Human
ggccaagaggcug

SEQ ID NO: 1377705 - RNA, 23 nt, Human
ggcauuuguuucuuucucugagg

SEQ ID NO: 1377706 - RNA, 17 nt, Human
ggcauuuguuucuuucu

SEQ ID NO: 1377707 - RNA, 18 nt, Human
ggcauuuuacuguacaga

SEQ ID NO: 1377708 - RNA, 17 nt, Human
ggcauuuguuugaacug

SEQ ID NO: 1377709 - RNA, 21 nt, Human
ggccagaggcccccagcccag

SEQ ID NO: 1377710 - RNA, 16 nt, Human
ggccaaggaccugaga

SEQ ID NO: 1377711 - RNA, 19 nt, Human
ggccaaggaccugagaccu

SEQ ID NO: 1377712 - RNA, 15 nt, Human
ggccaaggaccugag

SEQ ID NO: 1377713 - RNA, 23 nt, Human
ggccaagcugaggugcccaggag

SEQ ID NO: 1377714 - RNA, 22 nt, Human
ggccaagcugaggugcccagga

SEQ ID NO: 1377715 - RNA, 20 nt, Human
ggccaagcugaggugcccag

SEQ ID NO: 1377716 - RNA, 15 nt, Human
ggccaagcugaggug

SEQ ID NO: 1377717 - RNA, 16 nt, Human
ggccagaccauggaca

SEQ ID NO: 1377718 - RNA, 22 nt, Human
ggcagggggcugcugcugggcu

SEQ ID NO: 1377719 - RNA, 18 nt, Human
ggcagggggcugcugcug

SEQ ID NO: 1377720 - RNA, 17 nt, Human
ggcagggggcugcugcu

SEQ ID NO: 1377721 - RNA, 16 nt, Human
ggcagggggcugcugc

SEQ ID NO: 1377722 - RNA, 15 nt, Human
ggcagggggcugcug

SEQ ID NO: 1377723 - RNA, 14 nt, Human
ggcagggggcugcu

SEQ ID NO: 1377724 - RNA, 13 nt, Human
ggcagggggcugc

SEQ ID NO: 1377725 - RNA, 12 nt, Human
ggcagggggcug

SEQ ID NO: 1377726 - RNA, 15 nt, Human
ggcaggggcuuccug

SEQ ID NO: 1377727 - RNA, 14 nt, Human
ggcaggggcuuccu

SEQ ID NO: 1377728 - RNA, 13 nt, Human
ggcaggggcuucc

SEQ ID NO: 1377729 - RNA, 12 nt, Human
ggcaaaacucua

SEQ ID NO: 1377730 - RNA, 12 nt, Human
ggauuuuuucca

SEQ ID NO: 1377731 - RNA, 23 nt, Human
ggauuuuuguuuuguuuuuacaa

SEQ ID NO: 1377732 - RNA, 11 nt, Human
ggcaaaagcuu

SEQ ID NO: 1377733 - RNA, 23 nt, Human
ggauuuccugcuuugggaagccg

SEQ ID NO: 1377734 - RNA, 20 nt, Human
ggauuucaugauuucauuuc

SEQ ID NO: 1377735 - RNA, 19 nt, Human
ggauuuauuuaaaauagca

SEQ ID NO: 1377736 - RNA, 14 nt, Human
ggauuuauuuaaaa

SEQ ID NO: 1377737 - RNA, 14 nt, Human
ggcacacagcuacu

SEQ ID NO: 1377738 - RNA, 14 nt, Human
ggcacugcuaggcu

SEQ ID NO: 1377739 - RNA, 18 nt, Human
ggcacaucagcacgauuu

SEQ ID NO: 1377740 - RNA, 22 nt, Human
ggcagggagcggccggccagcc

SEQ ID NO: 1377741 - RNA, 16 nt, Human
ggcagggccccaggca

SEQ ID NO: 1377742 - RNA, 17 nt, Human
ggcaggggccuggagau

SEQ ID NO: 1377743 - RNA, 16 nt, Human
ggcaggggccuggaga

SEQ ID NO: 1377744 - RNA, 14 nt, Human
ggcaggggccugga

SEQ ID NO: 1377745 - RNA, 21 nt, Human
ggcaggggccuccaugggccc

SEQ ID NO: 1377746 - RNA, 12 nt, Human
ggcaggggccgg

SEQ ID NO: 1377747 - RNA, 14 nt, Human
ggcagggaccacac

SEQ ID NO: 1377748 - RNA, 20 nt, Human
ggcagggaacauggggagga

SEQ ID NO: 1377749 - RNA, 18 nt, Human
ggcagggaacauggggag

SEQ ID NO: 1377750 - RNA, 17 nt, Human
ggcagggaacaugggga

SEQ ID NO: 1377751 - RNA, 22 nt, Human
ggcaggcugggccauguccaaa

SEQ ID NO: 1377752 - RNA, 16 nt, Human
ggcaggcugggccaug

SEQ ID NO: 1377753 - RNA, 15 nt, Human
ggcaggcugggccau

SEQ ID NO: 1377754 - RNA, 14 nt, Human
ggcaggcugggcca

SEQ ID NO: 1377755 - RNA, 17 nt, Human
ggcaggauuggggaaga

SEQ ID NO: 1377756 - RNA, 22 nt, Human
ggcaggauuggggaagagagcc

SEQ ID NO: 1377757 - RNA, 15 nt, Human
ggcaggauuggggaa

SEQ ID NO: 1377758 - RNA, 19 nt, Human
ggcaggaguagcugagcuc

SEQ ID NO: 1377759 - RNA, 18 nt, Human
ggcaggaguagcugagcu

SEQ ID NO: 1377760 - RNA, 17 nt, Human
ggcaggaguagcugagc

SEQ ID NO: 1377761 - RNA, 14 nt, Human
ggcaggaguagcug

SEQ ID NO: 1377762 - RNA, 21 nt, Human
ggcagcgccaggcugaccaca

SEQ ID NO: 1377763 - RNA, 14 nt, Human
ggcagcgccaggcu

SEQ ID NO: 1377764 - RNA, 14 nt, Human
ggcaggagggaggu

SEQ ID NO: 1377765 - RNA, 14 nt, Human
ggcagccuugugau

SEQ ID NO: 1377766 - RNA, 14 nt, Human
ggcagcccagccag

SEQ ID NO: 1377767 - RNA, 13 nt, Human
ggcagcccagcca

SEQ ID NO: 1377768 - RNA, 12 nt, Human
ggcagcccagcc

SEQ ID NO: 1377769 - RNA, 11 nt, Human
ggcagcccagc

SEQ ID NO: 1377770 - RNA, 23 nt, Human
ggcagccagugcccugagccagg

SEQ ID NO: 1377771 - RNA, 22 nt, Human
ggcagccagugcccugagccag

SEQ ID NO: 1377772 - RNA, 20 nt, Human
ggcagccagugcccugagcc

SEQ ID NO: 1377773 - RNA, 19 nt, Human
ggcagccagugcccugagc

SEQ ID NO: 1377774 - RNA, 17 nt, Human
ggcagccagugcccuga

SEQ ID NO: 1377775 - RNA, 15 nt, Human
ggcagccagugcccu

SEQ ID NO: 1377776 - RNA, 20 nt, Human
ggcagccagcaucugggccu

SEQ ID NO: 1377777 - RNA, 21 nt, Human
ggcagccagggagagcccagg

SEQ ID NO: 1377778 - RNA, 19 nt, Human
ggcagccagcaucugggcc

SEQ ID NO: 1377779 - RNA, 16 nt, Human
ggcagccagcaucugg

SEQ ID NO: 1377780 - RNA, 21 nt, Human
ggcagccacacuucucaggac

SEQ ID NO: 1377781 - RNA, 20 nt, Human
ggcagccacacuucucagga

SEQ ID NO: 1377782 - RNA, 17 nt, Human
ggcagcauccccuugaa

SEQ ID NO: 1377783 - RNA, 22 nt, Human
ggcagcagugugaggccagggc

SEQ ID NO: 1377784 - RNA, 18 nt, Human
ggcagcccagccagcguc

SEQ ID NO: 1377785 - RNA, 16 nt, Human
ggcagcccagccagcg

SEQ ID NO: 1377786 - RNA, 15 nt, Human
ggcagcccagccagc

SEQ ID NO: 1377787 - RNA, 23 nt, Human
ggcagccucugggggguggccag

SEQ ID NO: 1377788 - RNA, 20 nt, Human
ggcagccucugggggguggc

SEQ ID NO: 1377789 - RNA, 19 nt, Human
ggcagccucuggggggugg

SEQ ID NO: 1377790 - RNA, 16 nt, Human
ggcagccucugggggg

SEQ ID NO: 1377791 - RNA, 18 nt, Human
ggcagccccaggccaaag

SEQ ID NO: 1377792 - RNA, 14 nt, Human
ggcagccccaggcc

SEQ ID NO: 1377793 - RNA, 13 nt, Human
ggcagccucuggg

SEQ ID NO: 1377794 - RNA, 24 nt, Human
ggaucucauuggacccuuccaugg

SEQ ID NO: 1377795 - RNA, 17 nt, Human
ggaucucauuggacccu

SEQ ID NO: 1377796 - RNA, 22 nt, Human
ggaucucaccaggcagccucug

SEQ ID NO: 1377797 - RNA, 17 nt, Human
ggaucucaccaggcagc

SEQ ID NO: 1377798 - RNA, 16 nt, Human
ggaucucaccaggcag

SEQ ID NO: 1377799 - RNA, 15 nt, Human
ggaucucaccaggca

SEQ ID NO: 1377800 - RNA, 21 nt, Human
ggaucuauuucauguuuuuga

SEQ ID NO: 1377801 - RNA, 14 nt, Human
ggaucuauuucaug

SEQ ID NO: 1377802 - RNA, 16 nt, Human
ggauccuguguggaga

SEQ ID NO: 1377803 - RNA, 21 nt, Human
ggaucucccugagaugggcuu

SEQ ID NO: 1377804 - RNA, 19 nt, Human
ggauggucuuacagcaggc

SEQ ID NO: 1377805 - RNA, 12 nt, Human
ggauuuaacaga

SEQ ID NO: 1377806 - RNA, 19 nt, Human
ggauuuaaaagccugcuca

SEQ ID NO: 1377807 - RNA, 18 nt, Human
ggauuuaaaagccugcuc

SEQ ID NO: 1377808 - RNA, 17 nt, Human
ggauuuaaaagccugcu

SEQ ID NO: 1377809 - RNA, 16 nt, Human
ggauuuaaaagccugc

SEQ ID NO: 1377810 - RNA, 22 nt, Human
ggauuuaacagaaauguacagc

SEQ ID NO: 1377811 - RNA, 16 nt, Human
ggauuuaacagaaaug

SEQ ID NO: 1377812 - RNA, 17 nt, Human
ggauuuaacagaaaugu

SEQ ID NO: 1377813 - RNA, 23 nt, Human
ggaugggggaacucagauccagg

SEQ ID NO: 1377814 - RNA, 22 nt, Human
ggaugggggaacucagauccag

SEQ ID NO: 1377815 - RNA, 21 nt, Human
ggaugggggaacucagaucca

SEQ ID NO: 1377816 - RNA, 17 nt, Human
ggaugggggaacucaga

SEQ ID NO: 1377817 - RNA, 15 nt, Human
ggaugggggaacuca

SEQ ID NO: 1377818 - RNA, 12 nt, Human
ggauggugucuc

SEQ ID NO: 1377819 - RNA, 21 nt, Human
ggauggucuuacagcaggcag

SEQ ID NO: 1377820 - RNA, 20 nt, Human
ggaugguaguuuuuucaucu

SEQ ID NO: 1377821 - RNA, 16 nt, Human
ggaugguaguuuuuuc

SEQ ID NO: 1377822 - RNA, 21 nt, Human
ggaugggguauggauucuaaa

SEQ ID NO: 1377823 - RNA, 14 nt, Human
ggauuguaguccca

SEQ ID NO: 1377824 - RNA, 19 nt, Human
ggaguuagggacugaccag

SEQ ID NO: 1377825 - RNA, 13 nt, Human
ggaguuagggacu

SEQ ID NO: 1377826 - RNA, 22 nt, Human
ggaguuagggacugaccagcag

SEQ ID NO: 1377827 - RNA, 23 nt, Human
ggaguuaagaccuggcagcucug

SEQ ID NO: 1377828 - RNA, 18 nt, Human
ggaguuaagaccuggcag

SEQ ID NO: 1377829 - RNA, 16 nt, Human
ggaguuaagaccuggc

SEQ ID NO: 1377830 - RNA, 15 nt, Human
ggaguuaagaccugg

SEQ ID NO: 1377831 - RNA, 20 nt, Human
ggaguguuccccuuccacug

SEQ ID NO: 1377832 - RNA, 12 nt, Human
ggaguguucccc

SEQ ID NO: 1377833 - RNA, 17 nt, Human
ggagugugugugagugu

SEQ ID NO: 1377834 - RNA, 20 nt, Human
ggaguguccucuucccucuc

SEQ ID NO: 1377835 - RNA, 13 nt, Human
ggaguguccucuu

SEQ ID NO: 1377836 - RNA, 20 nt, Human
ggaguguaugacugcacaug

SEQ ID NO: 1377837 - RNA, 20 nt, Human
ggagugguuuaggcuauuug

SEQ ID NO: 1377838 - RNA, 15 nt, Human
ggaguggguggggag

SEQ ID NO: 1377839 - RNA, 14 nt, Human
ggagugggugggga

SEQ ID NO: 1377840 - RNA, 23 nt, Human
ggagugggguggugucagacccu

SEQ ID NO: 1377841 - RNA, 24 nt, Human
ggaguguccucuucccucucugca

SEQ ID NO: 1377842 - RNA, 16 nt, Human
ggagugugcguggugg

SEQ ID NO: 1377843 - RNA, 15 nt, Human
ggaggugggccgugg

SEQ ID NO: 1377844 - RNA, 19 nt, Human
ggaggugggccguggcccu

SEQ ID NO: 1377845 - RNA, 13 nt, Human
ggagguggcuggg

SEQ ID NO: 1377846 - RNA, 14 nt, Human
ggagggugggaagg

SEQ ID NO: 1377847 - RNA, 13 nt, Human
ggagggugggaag

SEQ ID NO: 1377848 - RNA, 16 nt, Human
ggagggaagggagcca

SEQ ID NO: 1377849 - RNA, 15 nt, Human
ggagggaagggagcc

SEQ ID NO: 1377850 - RNA, 16 nt, Human
ggagggaagcucuugg

SEQ ID NO: 1377851 - RNA, 13 nt, Human
ggaggcugguccu

SEQ ID NO: 1377852 - RNA, 18 nt, Human
ggaggcugcugcugcucu

SEQ ID NO: 1377853 - RNA, 23 nt, Human
ggaggcugcucggggugcacagg

SEQ ID NO: 1377854 - RNA, 22 nt, Human
ggaggcugcucggggugcacag

SEQ ID NO: 1377855 - RNA, 14 nt, Human
ggaggcugcucggg

SEQ ID NO: 1377856 - RNA, 12 nt, Human
ggaggcugcucg

SEQ ID NO: 1377857 - RNA, 11 nt, Human
ggaggcugcuc

SEQ ID NO: 1377858 - RNA, 14 nt, Human
ggagggggauccga

SEQ ID NO: 1377859 - RNA, 14 nt, Human
ggagggggagaggg

SEQ ID NO: 1377860 - RNA, 16 nt, Human
ggaggggggagggaag

SEQ ID NO: 1377861 - RNA, 15 nt, Human
ggaggggggagggaa

SEQ ID NO: 1377862 - RNA, 21 nt, Human
ggaggcucacccccuucucca

SEQ ID NO: 1377863 - RNA, 16 nt, Human
ggaggcggugggccug

SEQ ID NO: 1377864 - RNA, 22 nt, Human
ggaggcuaugcucaggggcccu

SEQ ID NO: 1377865 - RNA, 20 nt, Human
ggaggcuaaagcccagagac

SEQ ID NO: 1377866 - RNA, 20 nt, Human
ggaggcggauguugaaguga

SEQ ID NO: 1377867 - RNA, 18 nt, Human
ggaggcuccagagggcac

SEQ ID NO: 1377868 - RNA, 16 nt, Human
ggaggcuccagagggc

SEQ ID NO: 1377869 - RNA, 15 nt, Human
ggaggcuccagaggg

SEQ ID NO: 1377870 - RNA, 15 nt, Human
ggaggcucagguccc

SEQ ID NO: 1377871 - RNA, 15 nt, Human
ggaggcucuggagcc

SEQ ID NO: 1377872 - RNA, 13 nt, Human
aaaaauacucaga

SEQ ID NO: 1377873 - RNA, 14 nt, Human
aaaaauacucagau

SEQ ID NO: 1377874 - RNA, 17 nt, Human
aaaaauaauuuuuauau

SEQ ID NO: 1377875 - RNA, 18 nt, Human
aaaaauaaucaaaagcua

SEQ ID NO: 1377876 - RNA, 12 nt, Human
aaaaauaaagaa

SEQ ID NO: 1377877 - RNA, 18 nt, Human
ggcugguaucucagaaag

SEQ ID NO: 1377878 - RNA, 16 nt, Human
ggcugguaucucagaa

SEQ ID NO: 1377879 - RNA, 17 nt, Human
aaaaagcccaccauuug

SEQ ID NO: 1377880 - RNA, 17 nt, Human
aaaaagccaguuugggu

SEQ ID NO: 1377881 - RNA, 21 nt, Human
aaaaaggaugcacagaguugu

SEQ ID NO: 1377882 - RNA, 13 nt, Human
aaaaaggcaguua

SEQ ID NO: 1377883 - RNA, 23 nt, Human
aaaaagccaguuuggguaaaaua

SEQ ID NO: 1377884 - RNA, 23 nt, Human
aaaaaguugcagcuguuuuguug

SEQ ID NO: 1377885 - RNA, 16 nt, Human
aaaaaguuuuaguuuu

SEQ ID NO: 1377886 - RNA, 13 nt, Human
aaaaaguuuguuu

SEQ ID NO: 1377887 - RNA, 14 nt, Human
aaaaauaaaaaaca

SEQ ID NO: 1377888 - RNA, 12 nt, Human
aaaaaaagauga

SEQ ID NO: 1377889 - RNA, 19 nt, Human
aaaaaaauugaaauguaag

SEQ ID NO: 1377890 - RNA, 13 nt, Human
aaaaaaauguauu

SEQ ID NO: 1377891 - RNA, 10 nt, Human
aaaaaacuac

SEQ ID NO: 1377892 - RNA, 14 nt, Human
aaaaaaagaucugu

SEQ ID NO: 1377893 - RNA, 19 nt, Human
aaaaaaaccugagauuuau

SEQ ID NO: 1377894 - RNA, 18 nt, Human
aaaaaaacaguggaucac

SEQ ID NO: 1377895 - RNA, 20 nt, Human
ggcuggccucccaaaugagc

SEQ ID NO: 1377896 - RNA, 23 nt, Human
ggcuggccucacccaccccugca

SEQ ID NO: 1377897 - RNA, 19 nt, Human
ggcuggccauggagaaagc

SEQ ID NO: 1377898 - RNA, 18 nt, Human
ggcuggccauggagaaag

SEQ ID NO: 1377899 - RNA, 13 nt, Human
ggcuggccaugga

SEQ ID NO: 1377900 - RNA, 22 nt, Human
ggcuggccaguccaggcugccg

SEQ ID NO: 1377901 - RNA, 23 nt, Human
ggcugcccuccugugcucagccc

SEQ ID NO: 1377902 - RNA, 22 nt, Human
ggcugcccuccugugcucagcc

SEQ ID NO: 1377903 - RNA, 20 nt, Human
ggcugcccuccugugcucag

SEQ ID NO: 1377904 - RNA, 18 nt, Human
ggcugcccuccugugcuc

SEQ ID NO: 1377905 - RNA, 14 nt, Human
ggcugcccuccugu

SEQ ID NO: 1377906 - RNA, 13 nt, Human
ggcugcccuccug

SEQ ID NO: 1377907 - RNA, 15 nt, Human
ggcugccccucucac

SEQ ID NO: 1377908 - RNA, 15 nt, Human
ggcugaccaugcuca

SEQ ID NO: 1377909 - RNA, 13 nt, Human
ggcugaaagacag

SEQ ID NO: 1377910 - RNA, 21 nt, Human
ggcuggccaguccaggcugcc

SEQ ID NO: 1377911 - RNA, 20 nt, Human
ggcuggccaguccaggcugc

SEQ ID NO: 1377912 - RNA, 16 nt, Human
ggcuggccaguccagg

SEQ ID NO: 1377913 - RNA, 15 nt, Human
ggcugccguccccua

SEQ ID NO: 1377914 - RNA, 23 nt, Human
ggcugccguggggccgccgccuc

SEQ ID NO: 1377915 - RNA, 16 nt, Human
ggcugccguggggccg

SEQ ID NO: 1377916 - RNA, 15 nt, Human
ggcugccggggcagc

SEQ ID NO: 1377917 - RNA, 21 nt, Human
ggcucuugauaccccccucug

SEQ ID NO: 1377918 - RNA, 20 nt, Human
ggcucuugauaccccccucu

SEQ ID NO: 1377919 - RNA, 19 nt, Human
ggcucuugauaccccccuc

SEQ ID NO: 1377920 - RNA, 19 nt, Human
ggcucuaauucacagugcu

SEQ ID NO: 1377921 - RNA, 17 nt, Human
ggcucuaauucacagug

SEQ ID NO: 1377922 - RNA, 23 nt, Human
ggcucuaacgccugagcccaggg

SEQ ID NO: 1377923 - RNA, 22 nt, Human
ggcucuaacgccugagcccagg

SEQ ID NO: 1377924 - RNA, 19 nt, Human
ggcucuaacgccugagccc

SEQ ID NO: 1377925 - RNA, 18 nt, Human
ggcucuaacgccugagcc

SEQ ID NO: 1377926 - RNA, 17 nt, Human
ggcucuaacgccugagc

SEQ ID NO: 1377927 - RNA, 16 nt, Human
ggcucuaacgccugag

SEQ ID NO: 1377928 - RNA, 15 nt, Human
ggcucuaacgccuga

SEQ ID NO: 1377929 - RNA, 14 nt, Human
ggcucuaacgccug

SEQ ID NO: 1377930 - RNA, 18 nt, Human
ggcucguugacuggcugu

SEQ ID NO: 1377931 - RNA, 23 nt, Human
ggcucguggacugagugggaagc

SEQ ID NO: 1377932 - RNA, 19 nt, Human
ggcucguggacugaguggg

SEQ ID NO: 1377933 - RNA, 13 nt, Human
ggcucguggacug

SEQ ID NO: 1377934 - RNA, 15 nt, Human
ggcucggccugcccc

SEQ ID NO: 1377935 - RNA, 18 nt, Human
ggcucggccugcccccac

SEQ ID NO: 1377936 - RNA, 14 nt, Human
ggcucggccugccc

SEQ ID NO: 1377937 - RNA, 16 nt, Human
ggcucccuggggggag

SEQ ID NO: 1377938 - RNA, 21 nt, Human
ggcucccuguaaccucuucag

SEQ ID NO: 1377939 - RNA, 17 nt, Human
ggcucccuccgccccca

SEQ ID NO: 1377940 - RNA, 15 nt, Human
ggcucccggaauucc

SEQ ID NO: 1377941 - RNA, 20 nt, Human
ggcucccuguaaccucuuca

SEQ ID NO: 1377942 - RNA, 13 nt, Human
ggcucccuccgcc

SEQ ID NO: 1377943 - RNA, 18 nt, Human
ggcucccugacugggagu

SEQ ID NO: 1377944 - RNA, 17 nt, Human
ggcucccugacugggag

SEQ ID NO: 1377945 - RNA, 23 nt, Human
ggcucacugcaaccuccaccucc

SEQ ID NO: 1377946 - RNA, 14 nt, Human
ggcucacucagcca

SEQ ID NO: 1377947 - RNA, 22 nt, Human
ggcucacucagcacuuggcccu

SEQ ID NO: 1377948 - RNA, 16 nt, Human
ggcucacucagcacuu

SEQ ID NO: 1377949 - RNA, 22 nt, Human
ggccuucccuguuuucccccca

SEQ ID NO: 1377950 - RNA, 18 nt, Human
ggcgaucacaacgugcau

SEQ ID NO: 1377951 - RNA, 20 nt, Human
ggcgaucacaacgugcauug

SEQ ID NO: 1377952 - RNA, 13 nt, Human
ggcguuuguaaug

SEQ ID NO: 1377953 - RNA, 20 nt, Human
ggcuaagcuucacuguaaaa

SEQ ID NO: 1377954 - RNA, 18 nt, Human
ggcgaugccagccaagcu

SEQ ID NO: 1377955 - RNA, 17 nt, Human
ggcgaugccagccaagc

SEQ ID NO: 1377956 - RNA, 17 nt, Human
ggcgugagccaccucgc

SEQ ID NO: 1377957 - RNA, 23 nt, Human
ggcgugaucucagcucacugcaa

SEQ ID NO: 1377958 - RNA, 13 nt, Human
ggcuaauuuaaca

SEQ ID NO: 1377959 - RNA, 12 nt, Human
ggcuaauuuaac

SEQ ID NO: 1377960 - RNA, 13 nt, Human
ggcuacagagaag

SEQ ID NO: 1377961 - RNA, 12 nt, Human
ggcuacagagaa

SEQ ID NO: 1377962 - RNA, 11 nt, Human
ggcuacagaga

SEQ ID NO: 1377963 - RNA, 13 nt, Human
ggcuaauuuuugu

SEQ ID NO: 1377964 - RNA, 17 nt, Human
ggcuacagagaagccuu

SEQ ID NO: 1377965 - RNA, 16 nt, Human
ggcuacagagaagccu

SEQ ID NO: 1377966 - RNA, 15 nt, Human
ggcuacagagaagcc

SEQ ID NO: 1377967 - RNA, 14 nt, Human
ggcuacagagaagc

SEQ ID NO: 1377968 - RNA, 19 nt, Human
ggcuacagagaagccuuca

SEQ ID NO: 1377969 - RNA, 18 nt, Human
ggcuacagagaagccuuc

SEQ ID NO: 1377970 - RNA, 14 nt, Human
ggcuaccaggaaag

SEQ ID NO: 1377971 - RNA, 13 nt, Human
ggcuaccuuugua

SEQ ID NO: 1377972 - RNA, 24 nt, Human
ggcuacucugugccagagccuggg

SEQ ID NO: 1377973 - RNA, 23 nt, Human
ggcuacucugugccagagccugg

SEQ ID NO: 1377974 - RNA, 22 nt, Human
ggcuacucugugccagagccug

SEQ ID NO: 1377975 - RNA, 21 nt, Human
ggcuacucugugccagagccu

SEQ ID NO: 1377976 - RNA, 20 nt, Human
ggcuacucugugccagagcc

SEQ ID NO: 1377977 - RNA, 19 nt, Human
ggcuacucugugccagagc

SEQ ID NO: 1377978 - RNA, 18 nt, Human
ggcuacucugugccagag

SEQ ID NO: 1377979 - RNA, 16 nt, Human
ggcuacucugugccag

SEQ ID NO: 1377980 - RNA, 15 nt, Human
ggcuacucugugcca

SEQ ID NO: 1377981 - RNA, 13 nt, Human
ggcuacucugugc

SEQ ID NO: 1377982 - RNA, 19 nt, Human
ggcuacccugagcugaggc

SEQ ID NO: 1377983 - RNA, 14 nt, Human
ggcuaccuuuguau

SEQ ID NO: 1377984 - RNA, 18 nt, Human
ggcuacuucggggcuggg

SEQ ID NO: 1377985 - RNA, 23 nt, Human
ggcuacuucggggcugggaaguc

SEQ ID NO: 1377986 - RNA, 17 nt, Human
ggcuagacuagucucaa

SEQ ID NO: 1377987 - RNA, 16 nt, Human
ggcuagagguucaaag

SEQ ID NO: 1377988 - RNA, 22 nt, Human
ggccuggagcacaaagacccug

SEQ ID NO: 1377989 - RNA, 20 nt, Human
ggccuggagauccuccugca

SEQ ID NO: 1377990 - RNA, 22 nt, Human
ggccugcugcugagaaccuggc

SEQ ID NO: 1377991 - RNA, 20 nt, Human
ggccugcugcugagaaccug

SEQ ID NO: 1377992 - RNA, 23 nt, Human
ggccugcugcugagaaccuggcc

SEQ ID NO: 1377993 - RNA, 19 nt, Human
ggccugcugcugagaaccu

SEQ ID NO: 1377994 - RNA, 18 nt, Human
ggccugcugcugagaacc

SEQ ID NO: 1377995 - RNA, 16 nt, Human
ggccugcugcugagaa

SEQ ID NO: 1377996 - RNA, 15 nt, Human
ggccugcugcugaga

SEQ ID NO: 1377997 - RNA, 14 nt, Human
ggccugcugcugag

SEQ ID NO: 1377998 - RNA, 13 nt, Human
ggccugcugcuga

SEQ ID NO: 1377999 - RNA, 11 nt, Human
ggccugcugcu

SEQ ID NO: 1378000 - RNA, 10 nt, Human
ggccugcugc

SEQ ID NO: 1378001 - RNA, 18 nt, Human
ggccugcuccagaccuga

SEQ ID NO: 1378002 - RNA, 17 nt, Human
ggccugcuccagaccug

SEQ ID NO: 1378003 - RNA, 16 nt, Human
ggccugcuccagaccu

SEQ ID NO: 1378004 - RNA, 15 nt, Human
ggccugcuccagacc

SEQ ID NO: 1378005 - RNA, 14 nt, Human
ggccugcuccagac

SEQ ID NO: 1378006 - RNA, 13 nt, Human
ggccugcuccaga

SEQ ID NO: 1378007 - RNA, 15 nt, Human
ggccugcuaaggucu

SEQ ID NO: 1378008 - RNA, 17 nt, Human
ggccuuauugcauccca

SEQ ID NO: 1378009 - RNA, 15 nt, Human
ggccuuaggaagagc

SEQ ID NO: 1378010 - RNA, 19 nt, Human
ggccuuacuuaaacccagc

SEQ ID NO: 1378011 - RNA, 20 nt, Human
ggccuucacaaucugucagu

SEQ ID NO: 1378012 - RNA, 12 nt, Human
ggccuucacaau

SEQ ID NO: 1378013 - RNA, 18 nt, Human
ggccuguuuggccucucu

SEQ ID NO: 1378014 - RNA, 17 nt, Human
ggccuguuuggccucuc

SEQ ID NO: 1378015 - RNA, 12 nt, Human
ggccugccccca

SEQ ID NO: 1378016 - RNA, 13 nt, Human
ggccugcccccac

SEQ ID NO: 1378017 - RNA, 15 nt, Human
ggccugcccaguugc

SEQ ID NO: 1378018 - RNA, 17 nt, Human
ggccugcccagugcacu

SEQ ID NO: 1378019 - RNA, 14 nt, Human
ggccugccaggagg

SEQ ID NO: 1378020 - RNA, 13 nt, Human
ggccugccaggag

SEQ ID NO: 1378021 - RNA, 12 nt, Human
ggccugccagga

SEQ ID NO: 1378022 - RNA, 22 nt, Human
ggccugccaccuggaccccugc

SEQ ID NO: 1378023 - RNA, 23 nt, Human
ggccugccaccuggaccccugca

SEQ ID NO: 1378024 - RNA, 19 nt, Human
ggccugccaccuggacccc

SEQ ID NO: 1378025 - RNA, 18 nt, Human
ggccugccaccuggaccc

SEQ ID NO: 1378026 - RNA, 17 nt, Human
ggccugccaccuggacc

SEQ ID NO: 1378027 - RNA, 14 nt, Human
ggccugccaccugg

SEQ ID NO: 1378028 - RNA, 18 nt, Human
ggccugcaaacugggaac

SEQ ID NO: 1378029 - RNA, 16 nt, Human
ggccugcaaacuggga

SEQ ID NO: 1378030 - RNA, 15 nt, Human
ggccugcaaacuggg

SEQ ID NO: 1378031 - RNA, 14 nt, Human
ggccugcaaacugg

SEQ ID NO: 1378032 - RNA, 19 nt, Human
ggccugaugggguggaagg

SEQ ID NO: 1378033 - RNA, 17 nt, Human
ggccucagggcuccuug

SEQ ID NO: 1378034 - RNA, 16 nt, Human
ggccucagggcuccuu

SEQ ID NO: 1378035 - RNA, 18 nt, Human
ggccucagggcuccuugu

SEQ ID NO: 1378036 - RNA, 15 nt, Human
ggccucagggcuccu

SEQ ID NO: 1378037 - RNA, 14 nt, Human
ggccucagggcucc

SEQ ID NO: 1378038 - RNA, 13 nt, Human
ggccucagggcuc

SEQ ID NO: 1378039 - RNA, 11 nt, Human
ggccucagggc

SEQ ID NO: 1378040 - RNA, 13 nt, Human
ggccgccuggguc

SEQ ID NO: 1378041 - RNA, 15 nt, Human
ggccgccugggucca

SEQ ID NO: 1378042 - RNA, 14 nt, Human
ggccgccgccucuu

SEQ ID NO: 1378043 - RNA, 22 nt, Human
ggccgcccccugccccccagcc

SEQ ID NO: 1378044 - RNA, 19 nt, Human
ggccgcccccugcccccca

SEQ ID NO: 1378045 - RNA, 18 nt, Human
ggccgcccccugcccccc

SEQ ID NO: 1378046 - RNA, 16 nt, Human
ggccgcccccugcccc

SEQ ID NO: 1378047 - RNA, 19 nt, Human
ggcccucaagucuuucucu

SEQ ID NO: 1378048 - RNA, 14 nt, Human
ggccucauguggcu

SEQ ID NO: 1378049 - RNA, 13 nt, Human
ggccccagccucc

SEQ ID NO: 1378050 - RNA, 18 nt, Human
ggccccagcacagcuuga

SEQ ID NO: 1378051 - RNA, 23 nt, Human
ggccagaugcacaucccuggaag

SEQ ID NO: 1378052 - RNA, 21 nt, Human
ggccagaugcacaucccugga

SEQ ID NO: 1378053 - RNA, 20 nt, Human
ggccagaugcacaucccugg

SEQ ID NO: 1378054 - RNA, 18 nt, Human
ggccagauccagccuggg

SEQ ID NO: 1378055 - RNA, 17 nt, Human
ggccagauccagccugg

SEQ ID NO: 1378056 - RNA, 11 nt, Human
ggccagaggcu

SEQ ID NO: 1378057 - RNA, 22 nt, Human
ggccagaggcccccagcccagg

SEQ ID NO: 1378058 - RNA, 17 nt, Human
ggccccugccucucugc

SEQ ID NO: 1378059 - RNA, 18 nt, Human
ggccccugccucucugca

SEQ ID NO: 1378060 - RNA, 19 nt, Human
ggccccugccucucugcag

SEQ ID NO: 1378061 - RNA, 21 nt, Human
ggccccugccucucugcaggu

SEQ ID NO: 1378062 - RNA, 13 nt, Human
gggccugccaccu

SEQ ID NO: 1378063 - RNA, 11 nt, Human
gggccugccac

SEQ ID NO: 1378064 - RNA, 20 nt, Human
gggccucaccgagugggggc

SEQ ID NO: 1378065 - RNA, 19 nt, Human
gggccugcugcugagaacc

SEQ ID NO: 1378066 - RNA, 18 nt, Human
gggccugcugcugagaac

SEQ ID NO: 1378067 - RNA, 17 nt, Human
gggccugcugcugagaa

SEQ ID NO: 1378068 - RNA, 16 nt, Human
gggccugcugcugaga

SEQ ID NO: 1378069 - RNA, 15 nt, Human
gggccugcugcugag

SEQ ID NO: 1378070 - RNA, 13 nt, Human
gggccugcugcug

SEQ ID NO: 1378071 - RNA, 12 nt, Human
gggccugcugcu

SEQ ID NO: 1378072 - RNA, 11 nt, Human
gggccugcugc

SEQ ID NO: 1378073 - RNA, 18 nt, Human
gggccugcuccagaccug

SEQ ID NO: 1378074 - RNA, 17 nt, Human
gggccugcuccagaccu

SEQ ID NO: 1378075 - RNA, 15 nt, Human
gggccugcuccagac

SEQ ID NO: 1378076 - RNA, 14 nt, Human
gggccugcuccaga

SEQ ID NO: 1378077 - RNA, 13 nt, Human
gggccugcuccag

SEQ ID NO: 1378078 - RNA, 15 nt, Human
gggccugccucacca

SEQ ID NO: 1378079 - RNA, 14 nt, Human
gggccugccucacc

SEQ ID NO: 1378080 - RNA, 12 nt, Human
gggccugccuca

SEQ ID NO: 1378081 - RNA, 14 nt, Human
gggccugcccagug

SEQ ID NO: 1378082 - RNA, 23 nt, Human
gggccugccaccuggaccccugc

SEQ ID NO: 1378083 - RNA, 19 nt, Human
gggccugccaccuggaccc

SEQ ID NO: 1378084 - RNA, 18 nt, Human
gggccugccaccuggacc

SEQ ID NO: 1378085 - RNA, 16 nt, Human
gggccugccaccugga

SEQ ID NO: 1378086 - RNA, 20 nt, Human
gggccugcugcugagaaccu

SEQ ID NO: 1378087 - RNA, 22 nt, Human
gggcuacccugagcugaggcag

SEQ ID NO: 1378088 - RNA, 23 nt, Human
gggccggggaacuggccaagcug

SEQ ID NO: 1378089 - RNA, 20 nt, Human
gggccggggaacuggccaag

SEQ ID NO: 1378090 - RNA, 19 nt, Human
gggccggggaacuggccaa

SEQ ID NO: 1378091 - RNA, 17 nt, Human
gggccggggaacuggcc

SEQ ID NO: 1378092 - RNA, 16 nt, Human
gggccggggaacuggc

SEQ ID NO: 1378093 - RNA, 12 nt, Human
gggccgcugcca

SEQ ID NO: 1378094 - RNA, 17 nt, Human
gggccgccgccucuuuc

SEQ ID NO: 1378095 - RNA, 18 nt, Human
gggccauucuccacagca

SEQ ID NO: 1378096 - RNA, 16 nt, Human
gggccauucuccacag

SEQ ID NO: 1378097 - RNA, 23 nt, Human
gggccauguccaaagaggcugcc

SEQ ID NO: 1378098 - RNA, 22 nt, Human
gggccauguccaaagaggcugc

SEQ ID NO: 1378099 - RNA, 21 nt, Human
gggccauguccaaagaggcug

SEQ ID NO: 1378100 - RNA, 17 nt, Human
gggccauguccaaagag

SEQ ID NO: 1378101 - RNA, 16 nt, Human
gggccauguccaaaga

SEQ ID NO: 1378102 - RNA, 15 nt, Human
gggccauguccaaag

SEQ ID NO: 1378103 - RNA, 14 nt, Human
gggccauguccaaa

SEQ ID NO: 1378104 - RNA, 21 nt, Human
gggccaugcugaggccugggc

SEQ ID NO: 1378105 - RNA, 23 nt, Human
gggccaugcugaggccugggccg

SEQ ID NO: 1378106 - RNA, 17 nt, Human
gggccagauccagccug

SEQ ID NO: 1378107 - RNA, 16 nt, Human
gggccagauccagccu

SEQ ID NO: 1378108 - RNA, 14 nt, Human
gggccagauccagc

SEQ ID NO: 1378109 - RNA, 13 nt, Human
gggccagauccag

SEQ ID NO: 1378110 - RNA, 12 nt, Human
gggccagaggcu

SEQ ID NO: 1378111 - RNA, 15 nt, Human
gggccagagccaggg

SEQ ID NO: 1378112 - RNA, 14 nt, Human
gggccagagccagg

SEQ ID NO: 1378113 - RNA, 13 nt, Human
gggccagagccag

SEQ ID NO: 1378114 - RNA, 12 nt, Human
gggccagagcca

SEQ ID NO: 1378115 - RNA, 11 nt, Human
gggccagagcc

SEQ ID NO: 1378116 - RNA, 18 nt, Human
gggccagauccagccugg

SEQ ID NO: 1378117 - RNA, 20 nt, Human
gggccaugcugaggccuggg

SEQ ID NO: 1378118 - RNA, 19 nt, Human
gggccaugcugaggccugg

SEQ ID NO: 1378119 - RNA, 10 nt, Human
gggccaggcc

SEQ ID NO: 1378120 - RNA, 13 nt, Human
gggccaggcuggg

SEQ ID NO: 1378121 - RNA, 23 nt, Human
gggcuccagccccucuuggagaa

SEQ ID NO: 1378122 - RNA, 22 nt, Human
gggcucaggucacauaaaacuu

SEQ ID NO: 1378123 - RNA, 14 nt, Human
gggcucccuccgcc

SEQ ID NO: 1378124 - RNA, 21 nt, Human
gggcugcugcugggcucagug

SEQ ID NO: 1378125 - RNA, 17 nt, Human
gggcugcugcugggcuc

SEQ ID NO: 1378126 - RNA, 17 nt, Human
gggcugcuuccuccugg

SEQ ID NO: 1378127 - RNA, 12 nt, Human
gggcugcuuccu

SEQ ID NO: 1378128 - RNA, 23 nt, Human
gggcucccuccgcccccagguag

SEQ ID NO: 1378129 - RNA, 20 nt, Human
gggcugccggggcagccccc

SEQ ID NO: 1378130 - RNA, 12 nt, Human
gggcucccugac

SEQ ID NO: 1378131 - RNA, 16 nt, Human
aaaaugggcacuuaaa

SEQ ID NO: 1378132 - RNA, 23 nt, Human
aaaauggccauuugcuuuuucac

SEQ ID NO: 1378133 - RNA, 15 nt, Human
aaaauggucucuaac

SEQ ID NO: 1378134 - RNA, 19 nt, Human
aaaagguucuuacugcuug

SEQ ID NO: 1378135 - RNA, 15 nt, Human
aaaagguauuaaauu

SEQ ID NO: 1378136 - RNA, 11 nt, Human
aaaaggccugg

SEQ ID NO: 1378137 - RNA, 12 nt, Human
aaaaggccuggg

SEQ ID NO: 1378138 - RNA, 13 nt, Human
aaaaggcaguuac

SEQ ID NO: 1378139 - RNA, 14 nt, Human
aaaaggauaaguga

SEQ ID NO: 1378140 - RNA, 13 nt, Human
ggcuggucucaaa

SEQ ID NO: 1378141 - RNA, 23 nt, Human
ggcugguccagggcuagugacuu

SEQ ID NO: 1378142 - RNA, 13 nt, Human
ggcugguccaggg

SEQ ID NO: 1378143 - RNA, 21 nt, Human
ggcugguccuauggccucaug

SEQ ID NO: 1378144 - RNA, 17 nt, Human
aaaaggacaucagcaaa

SEQ ID NO: 1378145 - RNA, 19 nt, Human
aaaaggacaucagcaaaca

SEQ ID NO: 1378146 - RNA, 13 nt, Human
aaaaggaugcaca

SEQ ID NO: 1378147 - RNA, 14 nt, Human
aaaaggaugcacag

SEQ ID NO: 1378148 - RNA, 15 nt, Human
aaaaggaugcacaga

SEQ ID NO: 1378149 - RNA, 19 nt, Human
aaaaggaugcacagaguug

SEQ ID NO: 1378150 - RNA, 22 nt, Human
aaaaggaugcacagaguuguua

SEQ ID NO: 1378151 - RNA, 10 nt, Human
aaaauacaug

SEQ ID NO: 1378152 - RNA, 17 nt, Human
aaaauacaagacugcca

SEQ ID NO: 1378153 - RNA, 15 nt, Human
aaaauacaagacugc

SEQ ID NO: 1378154 - RNA, 12 nt, Human
aaaauacauugu

SEQ ID NO: 1378155 - RNA, 14 nt, Human
aaaauaauuuugua

SEQ ID NO: 1378156 - RNA, 13 nt, Human
aaaauaauuuugu

SEQ ID NO: 1378157 - RNA, 20 nt, Human
aaaauaauuuuuauauuuga

SEQ ID NO: 1378158 - RNA, 17 nt, Human
aaaauaauuuuuauauu

SEQ ID NO: 1378159 - RNA, 16 nt, Human
aaaauaauuuuuauau

SEQ ID NO: 1378160 - RNA, 16 nt, Human
aaaauaagucaacagu

SEQ ID NO: 1378161 - RNA, 18 nt, Human
aaaauaagucaacaguaa

SEQ ID NO: 1378162 - RNA, 14 nt, Human
aaaauaagucaaca

SEQ ID NO: 1378163 - RNA, 19 nt, Human
aaaauaagcagguggaucu

SEQ ID NO: 1378164 - RNA, 14 nt, Human
aaaauaagcaggug

SEQ ID NO: 1378165 - RNA, 13 nt, Human
aaaauaagcaggu

SEQ ID NO: 1378166 - RNA, 16 nt, Human
aaaauaagaauagaaa

SEQ ID NO: 1378167 - RNA, 20 nt, Human
aaaauaauuauauaacugua

SEQ ID NO: 1378168 - RNA, 23 nt, Human
aaaauaauacugcugagauacau

SEQ ID NO: 1378169 - RNA, 23 nt, Human
aaaauaaucaaaagcuauuuaaa

SEQ ID NO: 1378170 - RNA, 16 nt, Human
aaaauaauacugcuga

SEQ ID NO: 1378171 - RNA, 20 nt, Human
aaaauaauuuuaaacaaagg

SEQ ID NO: 1378172 - RNA, 19 nt, Human
aaaauaauuuuaaacaaag

SEQ ID NO: 1378173 - RNA, 11 nt, Human
aaaauaauuuu

SEQ ID NO: 1378174 - RNA, 23 nt, Human
aaaaugccaugaugccucugucu

SEQ ID NO: 1378175 - RNA, 19 nt, Human
aaaaugcuuuuuauuucug

SEQ ID NO: 1378176 - RNA, 18 nt, Human
aaaaugcuuuuuauuucu

SEQ ID NO: 1378177 - RNA, 13 nt, Human
aaaaugcuuuuua

SEQ ID NO: 1378178 - RNA, 22 nt, Human
aaaaugcuuuuuauuucugcau

SEQ ID NO: 1378179 - RNA, 16 nt, Human
gggccagacaugccac

SEQ ID NO: 1378180 - RNA, 20 nt, Human
aaaaucugucacguagaacu

SEQ ID NO: 1378181 - RNA, 21 nt, Human
aaaaucucuccacuuucagcu

SEQ ID NO: 1378182 - RNA, 22 nt, Human
aaaaucucuccacuuucagcug

SEQ ID NO: 1378183 - RNA, 20 nt, Human
aaaaucucuccacuuucagc

SEQ ID NO: 1378184 - RNA, 19 nt, Human
aaaaucucuccacuuucag

SEQ ID NO: 1378185 - RNA, 18 nt, Human
aaaaucucuccacuuuca

SEQ ID NO: 1378186 - RNA, 16 nt, Human
aaaaucucuccacuuu

SEQ ID NO: 1378187 - RNA, 15 nt, Human
aaaaucucuccacuu

SEQ ID NO: 1378188 - RNA, 21 nt, Human
aaaaucucccauuuuggaauu

SEQ ID NO: 1378189 - RNA, 19 nt, Human
aaaaucucccauuuuggaa

SEQ ID NO: 1378190 - RNA, 13 nt, Human
aaaauauuuugaa

SEQ ID NO: 1378191 - RNA, 18 nt, Human
aaaaugacaaucaugugu

SEQ ID NO: 1378192 - RNA, 20 nt, Human
aaaaugacaaucaugugugu

SEQ ID NO: 1378193 - RNA, 17 nt, Human
aaaaugacaaucaugug

SEQ ID NO: 1378194 - RNA, 14 nt, Human
aaaaugacaaucau

SEQ ID NO: 1378195 - RNA, 11 nt, Human
aaaaugagaaa

SEQ ID NO: 1378196 - RNA, 12 nt, Human
aaaaugagaaau

SEQ ID NO: 1378197 - RNA, 22 nt, Human
aaaauagauaagaguagaaacu

SEQ ID NO: 1378198 - RNA, 13 nt, Human
aaaauagacacuc

SEQ ID NO: 1378199 - RNA, 15 nt, Human
aaaauagacaaauag

SEQ ID NO: 1378200 - RNA, 21 nt, Human
aaaauacuuuuacucugccua

SEQ ID NO: 1378201 - RNA, 22 nt, Human
aaaauacuuuuacucugccuac

SEQ ID NO: 1378202 - RNA, 16 nt, Human
aaaauacuuuuacucu

SEQ ID NO: 1378203 - RNA, 11 nt, Human
aaaauacuuuu

SEQ ID NO: 1378204 - RNA, 13 nt, Human
aaaauaucuacau

SEQ ID NO: 1378205 - RNA, 22 nt, Human
aaaauaucuacauuaauauacu

SEQ ID NO: 1378206 - RNA, 19 nt, Human
aaaauagacaaauagaaaa

SEQ ID NO: 1378207 - RNA, 12 nt, Human
aaaauauuuuga

SEQ ID NO: 1378208 - RNA, 20 nt, Human
aaaauauuguuuuacaauag

SEQ ID NO: 1378209 - RNA, 19 nt, Human
aaaauauuguuuuacaaua

SEQ ID NO: 1378210 - RNA, 15 nt, Human
aaaauauuuguacau

SEQ ID NO: 1378211 - RNA, 21 nt, Human
gggggcagcacaggagggcgg

SEQ ID NO: 1378212 - RNA, 22 nt, Human
gggggcagucugagagaggcca

SEQ ID NO: 1378213 - RNA, 16 nt, Human
gggggcuggaggagcc

SEQ ID NO: 1378214 - RNA, 16 nt, Human
gggggcugaggagcag

SEQ ID NO: 1378215 - RNA, 23 nt, Human
ggggcccggacgcccaggacccc

SEQ ID NO: 1378216 - RNA, 12 nt, Human
gggggcagaagu

SEQ ID NO: 1378217 - RNA, 16 nt, Human
gggggcacaagacuga

SEQ ID NO: 1378218 - RNA, 15 nt, Human
gggggcacaagacug

SEQ ID NO: 1378219 - RNA, 23 nt, Human
ggggguggccgcugaguggcagg

SEQ ID NO: 1378220 - RNA, 19 nt, Human
ggggguuccguguccaccc

SEQ ID NO: 1378221 - RNA, 14 nt, Human
ggggucccagcagc

SEQ ID NO: 1378222 - RNA, 12 nt, Human
ggggucccagca

SEQ ID NO: 1378223 - RNA, 13 nt, Human
gggguagggggcu

SEQ ID NO: 1378224 - RNA, 21 nt, Human
ggggcccgcgauguggaacug

SEQ ID NO: 1378225 - RNA, 18 nt, Human
ggggccccucucagcccu

SEQ ID NO: 1378226 - RNA, 19 nt, Human
ggggccccucucagcccuc

SEQ ID NO: 1378227 - RNA, 17 nt, Human
ggggccccucucagccc

SEQ ID NO: 1378228 - RNA, 15 nt, Human
ggggccccucucagc

SEQ ID NO: 1378229 - RNA, 17 nt, Human
ggggcccaugaaagagg

SEQ ID NO: 1378230 - RNA, 15 nt, Human
ggggacagguccuca

SEQ ID NO: 1378231 - RNA, 14 nt, Human
aaaauguccuugug

SEQ ID NO: 1378232 - RNA, 22 nt, Human
aaaauguauuuuauguuauaua

SEQ ID NO: 1378233 - RNA, 16 nt, Human
aaaauguaugcauguu

SEQ ID NO: 1378234 - RNA, 15 nt, Human
aaaauguaugcaugu

SEQ ID NO: 1378235 - RNA, 22 nt, Human
aaaauguaagauuauagauucu

SEQ ID NO: 1378236 - RNA, 19 nt, Human
aaaauguaaaggagucaaa

SEQ ID NO: 1378237 - RNA, 14 nt, Human
aaaauguaaagcca

SEQ ID NO: 1378238 - RNA, 22 nt, Human
aaaaugguccaauuaguuuccu

SEQ ID NO: 1378239 - RNA, 18 nt, Human
aaaauguauuuuauguua

SEQ ID NO: 1378240 - RNA, 17 nt, Human
aaaauguauuuuauguu

SEQ ID NO: 1378241 - RNA, 16 nt, Human
aaaauguauuuuaugu

SEQ ID NO: 1378242 - RNA, 15 nt, Human
aaaauguauuuuaug

SEQ ID NO: 1378243 - RNA, 13 nt, Human
aaaauguauuuua

SEQ ID NO: 1378244 - RNA, 11 nt, Human
aaaauguauuu

SEQ ID NO: 1378245 - RNA, 15 nt, Human
aaaauguaugucugg

SEQ ID NO: 1378246 - RNA, 20 nt, Human
aaaauguaugcauguugucu

SEQ ID NO: 1378247 - RNA, 21 nt, Human
gggucaggccuuugagcucag

SEQ ID NO: 1378248 - RNA, 23 nt, Human
gggucaaguuauuaauuucuuca

SEQ ID NO: 1378249 - RNA, 12 nt, Human
gggucacaggaa

SEQ ID NO: 1378250 - RNA, 13 nt, Human
gggucaaguuauu

SEQ ID NO: 1378251 - RNA, 13 nt, Human
ggguauggcguaa

SEQ ID NO: 1378252 - RNA, 22 nt, Human
ggguauggcguaaguacagaga

SEQ ID NO: 1378253 - RNA, 19 nt, Human
gggguccuggagcagacca

SEQ ID NO: 1378254 - RNA, 23 nt, Human
gggguccuccuccagggacagca

SEQ ID NO: 1378255 - RNA, 18 nt, Human
ggggucccagcagcugcc

SEQ ID NO: 1378256 - RNA, 19 nt, Human
ggguccucuucugggccug

SEQ ID NO: 1378257 - RNA, 13 nt, Human
ggguccucuucug

SEQ ID NO: 1378258 - RNA, 19 nt, Human
ggguccucugagacuccag

SEQ ID NO: 1378259 - RNA, 15 nt, Human
ggguccucugagacu

SEQ ID NO: 1378260 - RNA, 20 nt, Human
ggguccuccuccagggacag

SEQ ID NO: 1378261 - RNA, 18 nt, Human
ggguccuccuccagggac

SEQ ID NO: 1378262 - RNA, 16 nt, Human
ggguccuccuccaggg

SEQ ID NO: 1378263 - RNA, 15 nt, Human
ggguccuccuccagg

SEQ ID NO: 1378264 - RNA, 16 nt, Human
ggguccggcagcuucu

SEQ ID NO: 1378265 - RNA, 15 nt, Human
ggguccggcagcuuc

SEQ ID NO: 1378266 - RNA, 14 nt, Human
aaacauuugcugaa

SEQ ID NO: 1378267 - RNA, 20 nt, Human
aaacgauuuuuaaaauguac

SEQ ID NO: 1378268 - RNA, 17 nt, Human
aaacgagacuuuccauu

SEQ ID NO: 1378269 - RNA, 16 nt, Human
aaaccuuccacccagu

SEQ ID NO: 1378270 - RNA, 23 nt, Human
aaaccuuccacccagugcugaau

SEQ ID NO: 1378271 - RNA, 16 nt, Human
aaacauuuucuggcca

SEQ ID NO: 1378272 - RNA, 12 nt, Human
aaacauuuucug

SEQ ID NO: 1378273 - RNA, 18 nt, Human
aaaccacugaaaaaauau

SEQ ID NO: 1378274 - RNA, 17 nt, Human
aaaccacugaaaaaaua

SEQ ID NO: 1378275 - RNA, 16 nt, Human
aaaccacugaaaaaau

SEQ ID NO: 1378276 - RNA, 12 nt, Human
aaaccacugaaa

SEQ ID NO: 1378277 - RNA, 20 nt, Human
aaaccacuuuuugcagcuuu

SEQ ID NO: 1378278 - RNA, 20 nt, Human
aaaccagcuuccuucagaga

SEQ ID NO: 1378279 - RNA, 23 nt, Human
aaaccugagauuuauuaaagaaa

SEQ ID NO: 1378280 - RNA, 19 nt, Human
aaaccagcuuccuucagag

SEQ ID NO: 1378281 - RNA, 18 nt, Human
aaaccagcuuccuucaga

SEQ ID NO: 1378282 - RNA, 17 nt, Human
aaaccagcuuccuucag

SEQ ID NO: 1378283 - RNA, 16 nt, Human
aaaccagcuuccuuca

SEQ ID NO: 1378284 - RNA, 13 nt, Human
aaaccagcuuccu

SEQ ID NO: 1378285 - RNA, 12 nt, Human
aaaccagcuucc

SEQ ID NO: 1378286 - RNA, 13 nt, Human
aaaccagcucagc

SEQ ID NO: 1378287 - RNA, 10 nt, Human
aaaccacuuu

SEQ ID NO: 1378288 - RNA, 13 nt, Human
ggguggcugcagc

SEQ ID NO: 1378289 - RNA, 23 nt, Human
ggguggcuacucugugccagagc

SEQ ID NO: 1378290 - RNA, 20 nt, Human
ggguggcuacucugugccag

SEQ ID NO: 1378291 - RNA, 19 nt, Human
ggguggcuacucugugcca

SEQ ID NO: 1378292 - RNA, 18 nt, Human
ggguggcuacucugugcc

SEQ ID NO: 1378293 - RNA, 20 nt, Human
aaacuuaugcugauuuauuu

SEQ ID NO: 1378294 - RNA, 14 nt, Human
aaacuuaaucuaaa

SEQ ID NO: 1378295 - RNA, 21 nt, Human
aaacuuaaauguuauuaucug

SEQ ID NO: 1378296 - RNA, 17 nt, Human
aaacuuaaauguuauua

SEQ ID NO: 1378297 - RNA, 16 nt, Human
aaacuuaaauguuauu

SEQ ID NO: 1378298 - RNA, 19 nt, Human
aaacuguuggaauggauuu

SEQ ID NO: 1378299 - RNA, 14 nt, Human
aaacuaaaaacuag

SEQ ID NO: 1378300 - RNA, 17 nt, Human
aaacuaaaaaauuaaac

SEQ ID NO: 1378301 - RNA, 13 nt, Human
ggguggugucaga

SEQ ID NO: 1378302 - RNA, 21 nt, Human
ggguguccugcaccggggccu

SEQ ID NO: 1378303 - RNA, 17 nt, Human
ggguguccugcaccggg

SEQ ID NO: 1378304 - RNA, 15 nt, Human
gggugguggccuggu

SEQ ID NO: 1378305 - RNA, 17 nt, Human
ggguggcugcagccuca

SEQ ID NO: 1378306 - RNA, 15 nt, Human
ggguggcugcagccu

SEQ ID NO: 1378307 - RNA, 20 nt, Human
ggguguccccaacagcgccc

SEQ ID NO: 1378308 - RNA, 18 nt, Human
ggguuuuguauucucuga

SEQ ID NO: 1378309 - RNA, 19 nt, Human
gguaaauaaaaagaaaggc

SEQ ID NO: 1378310 - RNA, 15 nt, Human
gguaaauaaaaagaa

SEQ ID NO: 1378311 - RNA, 20 nt, Human
gguaaaguuaaguugagaua

SEQ ID NO: 1378312 - RNA, 16 nt, Human
gguaaagacuggcuuu

SEQ ID NO: 1378313 - RNA, 15 nt, Human
gguaaagacuggcuu

SEQ ID NO: 1378314 - RNA, 13 nt, Human
gguaaaaugccau

SEQ ID NO: 1378315 - RNA, 23 nt, Human
gguaaaauacuuuuacucugccu

SEQ ID NO: 1378316 - RNA, 13 nt, Human
gguaaaauacuuc

SEQ ID NO: 1378317 - RNA, 14 nt, Human
gguaaaaaauuuau

SEQ ID NO: 1378318 - RNA, 13 nt, Human
gguaaaacacuug

SEQ ID NO: 1378319 - RNA, 16 nt, Human
gguaaaaaauuuauaa

SEQ ID NO: 1378320 - RNA, 22 nt, Human
gguaaaaaaaaauuacuguuua

SEQ ID NO: 1378321 - RNA, 22 nt, Human
ggguuuuuuaguugaauuuuuu

SEQ ID NO: 1378322 - RNA, 15 nt, Human
gguaaaucaguaaga

SEQ ID NO: 1378323 - RNA, 22 nt, Human
gguaaaucagacuaugaaguuu

SEQ ID NO: 1378324 - RNA, 11 nt, Human
gguccaggaga

SEQ ID NO: 1378325 - RNA, 22 nt, Human
gguccagcucuggaggggaggg

SEQ ID NO: 1378326 - RNA, 16 nt, Human
gguccagcucuggagg

SEQ ID NO: 1378327 - RNA, 15 nt, Human
gguccagcucuggag

SEQ ID NO: 1378328 - RNA, 14 nt, Human
gguccagcucugga

SEQ ID NO: 1378329 - RNA, 13 nt, Human
gguccagcucugg

SEQ ID NO: 1378330 - RNA, 12 nt, Human
gguccagcucug

SEQ ID NO: 1378331 - RNA, 11 nt, Human
gguccagcucu

SEQ ID NO: 1378332 - RNA, 17 nt, Human
aaacuuccccaucuucu

SEQ ID NO: 1378333 - RNA, 15 nt, Human
aaacuuuaucacuua

SEQ ID NO: 1378334 - RNA, 19 nt, Human
gguaucucagaaagugccu

SEQ ID NO: 1378335 - RNA, 15 nt, Human
gguaucucagaaagu

SEQ ID NO: 1378336 - RNA, 18 nt, Human
gguauccccccaucuugc

SEQ ID NO: 1378337 - RNA, 20 nt, Human
gguaucucagaaagugccug

SEQ ID NO: 1378338 - RNA, 16 nt, Human
gguaugaacuugagga

SEQ ID NO: 1378339 - RNA, 19 nt, Human
gguaugaacuugaggacac

SEQ ID NO: 1378340 - RNA, 20 nt, Human
gguaugaacuugaggacaca

SEQ ID NO: 1378341 - RNA, 14 nt, Human
ggucagugcaaaua

SEQ ID NO: 1378342 - RNA, 16 nt, Human
gguauauccaaaagcu

SEQ ID NO: 1378343 - RNA, 13 nt, Human
gguauauacuuug

SEQ ID NO: 1378344 - RNA, 23 nt, Human
gguauaguucaugucugcuauca

SEQ ID NO: 1378345 - RNA, 19 nt, Human
gguagguucagccaagguu

SEQ ID NO: 1378346 - RNA, 18 nt, Human
gguagguucagccaaggu

SEQ ID NO: 1378347 - RNA, 12 nt, Human
gguauauuuucc

SEQ ID NO: 1378348 - RNA, 14 nt, Human
gguauaccucacuu

SEQ ID NO: 1378349 - RNA, 17 nt, Human
gguagguucagccaagg

SEQ ID NO: 1378350 - RNA, 16 nt, Human
gguagguucagccaag

SEQ ID NO: 1378351 - RNA, 15 nt, Human
gguagguucagccaa

SEQ ID NO: 1378352 - RNA, 16 nt, Human
gguaggguaaaucagu

SEQ ID NO: 1378353 - RNA, 15 nt, Human
gguaggguaaaucag

SEQ ID NO: 1378354 - RNA, 14 nt, Human
gguaggguaaauca

SEQ ID NO: 1378355 - RNA, 13 nt, Human
gguagggguuggg

SEQ ID NO: 1378356 - RNA, 23 nt, Human
gguagggggcuggaggagcccag

SEQ ID NO: 1378357 - RNA, 17 nt, Human
gguagggggcuggagga

SEQ ID NO: 1378358 - RNA, 13 nt, Human
gguagggggcugg

SEQ ID NO: 1378359 - RNA, 16 nt, Human
gguaggggcugggaac

SEQ ID NO: 1378360 - RNA, 14 nt, Human
gguaggggcuggga

SEQ ID NO: 1378361 - RNA, 13 nt, Human
gguaggggcuggg

SEQ ID NO: 1378362 - RNA, 11 nt, Human
gguaggggcug

SEQ ID NO: 1378363 - RNA, 21 nt, Human
gguaggggccccucucagccc

SEQ ID NO: 1378364 - RNA, 19 nt, Human
gguaggggccccucucagc

SEQ ID NO: 1378365 - RNA, 18 nt, Human
gguaggggccccucucag

SEQ ID NO: 1378366 - RNA, 14 nt, Human
gguaggggccccuc

SEQ ID NO: 1378367 - RNA, 24 nt, Human
gguaggccaagguguccuacagaa

SEQ ID NO: 1378368 - RNA, 23 nt, Human
gguaggccaagguguccuacaga

SEQ ID NO: 1378369 - RNA, 21 nt, Human
gguaggccaagguguccuaca

SEQ ID NO: 1378370 - RNA, 18 nt, Human
gguaggccaagguguccu

SEQ ID NO: 1378371 - RNA, 17 nt, Human
gguaggagggugggaag

SEQ ID NO: 1378372 - RNA, 21 nt, Human
gguaggaauagcaugucacua

SEQ ID NO: 1378373 - RNA, 17 nt, Human
gguaagcaacauggcuu

SEQ ID NO: 1378374 - RNA, 16 nt, Human
gguaagcaacauggcu

SEQ ID NO: 1378375 - RNA, 23 nt, Human
gguaagaaguuuuaaaaagccag

SEQ ID NO: 1378376 - RNA, 24 nt, Human
gguaacuuuugugaauuaggcugu

SEQ ID NO: 1378377 - RNA, 18 nt, Human
gguaacugcuuucuguuc

SEQ ID NO: 1378378 - RNA, 19 nt, Human
gguaagcaacauggcuuug

SEQ ID NO: 1378379 - RNA, 18 nt, Human
gguaaguuuuuugaaauu

SEQ ID NO: 1378380 - RNA, 15 nt, Human
guaauuugugauaca

SEQ ID NO: 1378381 - RNA, 17 nt, Human
guaauuugugauacaau

SEQ ID NO: 1378382 - RNA, 20 nt, Human
guaauuugugauacaaugcu

SEQ ID NO: 1378383 - RNA, 13 nt, Human
guaaucccugcuu

SEQ ID NO: 1378384 - RNA, 14 nt, Human
guaaucaauguuuc

SEQ ID NO: 1378385 - RNA, 22 nt, Human
guaauccucaagaaauaaaagg

SEQ ID NO: 1378386 - RNA, 18 nt, Human
guaaucccugcuuuuugu

SEQ ID NO: 1378387 - RNA, 21 nt, Human
guacaagaagcauuuuguaag

SEQ ID NO: 1378388 - RNA, 15 nt, Human
guacaagaagcauuu

SEQ ID NO: 1378389 - RNA, 23 nt, Human
guacaaccacacccacacucaga

SEQ ID NO: 1378390 - RNA, 15 nt, Human
guaauuuuuuucacc

SEQ ID NO: 1378391 - RNA, 22 nt, Human
guaauuugugauacaaugcugu

SEQ ID NO: 1378392 - RNA, 16 nt, Human
guacaaaauaaacaaa

SEQ ID NO: 1378393 - RNA, 14 nt, Human
guacaaaauaaaca

SEQ ID NO: 1378394 - RNA, 12 nt, Human
guacaaaauaaa

SEQ ID NO: 1378395 - RNA, 22 nt, Human
guaaucaaucuacucaaagcau

SEQ ID NO: 1378396 - RNA, 20 nt, Human
guaauauugacuuguauauu

SEQ ID NO: 1378397 - RNA, 19 nt, Human
guaauauugacuuguauau

SEQ ID NO: 1378398 - RNA, 16 nt, Human
guaauauugacuugua

SEQ ID NO: 1378399 - RNA, 23 nt, Human
guaauacuucuuguguguaugca

SEQ ID NO: 1378400 - RNA, 21 nt, Human
guaauaagguuuuaauuuagu

SEQ ID NO: 1378401 - RNA, 15 nt, Human
guaauaagguuuuaa

SEQ ID NO: 1378402 - RNA, 20 nt, Human
guaauaaaauucaacaaaca

SEQ ID NO: 1378403 - RNA, 21 nt, Human
guaauaaaauucaacaaacau

SEQ ID NO: 1378404 - RNA, 13 nt, Human
guaauaaacucau

SEQ ID NO: 1378405 - RNA, 16 nt, Human
guaauaauaaagaaua

SEQ ID NO: 1378406 - RNA, 12 nt, Human
guaauaauaaag

SEQ ID NO: 1378407 - RNA, 22 nt, Human
guaauacaaacuaauuuaguaa

SEQ ID NO: 1378408 - RNA, 18 nt, Human
guaauacuucuugugugu

SEQ ID NO: 1378409 - RNA, 17 nt, Human
guaauacuucuugugug

SEQ ID NO: 1378410 - RNA, 22 nt, Human
guaacuaaaauaauuuuguaau

SEQ ID NO: 1378411 - RNA, 20 nt, Human
guaacuaaaauaauuuugua

SEQ ID NO: 1378412 - RNA, 15 nt, Human
guaacuaaaauaauu

SEQ ID NO: 1378413 - RNA, 13 nt, Human
guaacuaaaauaa

SEQ ID NO: 1378414 - RNA, 17 nt, Human
guaacgcgucuuccuga

SEQ ID NO: 1378415 - RNA, 16 nt, Human
guaacgcgucuuccug

SEQ ID NO: 1378416 - RNA, 20 nt, Human
guaaccucuucagaggcccu

SEQ ID NO: 1378417 - RNA, 18 nt, Human
guaaccucuucagaggcc

SEQ ID NO: 1378418 - RNA, 13 nt, Human
guaacucaucugu

SEQ ID NO: 1378419 - RNA, 14 nt, Human
guaacuacuuuaua

SEQ ID NO: 1378420 - RNA, 12 nt, Human
guaacuacuuua

SEQ ID NO: 1378421 - RNA, 19 nt, Human
guaacuaacugcauacacu

SEQ ID NO: 1378422 - RNA, 23 nt, Human
guaaguugggcuugcuauucugu

SEQ ID NO: 1378423 - RNA, 18 nt, Human
guaaguugggcuugcuau

SEQ ID NO: 1378424 - RNA, 17 nt, Human
guaaguugggcuugcua

SEQ ID NO: 1378425 - RNA, 19 nt, Human
guaaguugggcuugcuauu

SEQ ID NO: 1378426 - RNA, 13 nt, Human
guaaguuuuuuga

SEQ ID NO: 1378427 - RNA, 19 nt, Human
guaaacagauggcacuuug

SEQ ID NO: 1378428 - RNA, 13 nt, Human
guaaaccuuuuau

SEQ ID NO: 1378429 - RNA, 11 nt, Human
guaaacaauau

SEQ ID NO: 1378430 - RNA, 20 nt, Human
guaaacaaacuguguaacug

SEQ ID NO: 1378431 - RNA, 19 nt, Human
guaaaauugccauauugca

SEQ ID NO: 1378432 - RNA, 20 nt, Human
guaaaauugccauauugcac

SEQ ID NO: 1378433 - RNA, 21 nt, Human
guaaaauugccauauugcaca

SEQ ID NO: 1378434 - RNA, 23 nt, Human
guaaaaugugggauuauggguca

SEQ ID NO: 1378435 - RNA, 14 nt, Human
guaaaauugccaua

SEQ ID NO: 1378436 - RNA, 15 nt, Human
guaaaauugccauau

SEQ ID NO: 1378437 - RNA, 16 nt, Human
guaaaauugccauauu

SEQ ID NO: 1378438 - RNA, 18 nt, Human
guaaaauugccauauugc

SEQ ID NO: 1378439 - RNA, 23 nt, Human
aaauaauuauauaacuguauuug

SEQ ID NO: 1378440 - RNA, 22 nt, Human
aaauaauuauauaacuguauuu

SEQ ID NO: 1378441 - RNA, 21 nt, Human
aaauaauuauauaacuguauu

SEQ ID NO: 1378442 - RNA, 21 nt, Human
aaauaauguguaguucaugua

SEQ ID NO: 1378443 - RNA, 13 nt, Human
aaaguuaaguuga

SEQ ID NO: 1378444 - RNA, 21 nt, Human
aaaguguuuucucugaacaca

SEQ ID NO: 1378445 - RNA, 17 nt, Human
aaaguguuuucucugaa

SEQ ID NO: 1378446 - RNA, 23 nt, Human
aaaguguuuucucugaacacauu

SEQ ID NO: 1378447 - RNA, 20 nt, Human
aaauaauguguaguucaugu

SEQ ID NO: 1378448 - RNA, 22 nt, Human
aaauaaugugaaacuggauuaa

SEQ ID NO: 1378449 - RNA, 14 nt, Human
aaaguguuuucucu

SEQ ID NO: 1378450 - RNA, 21 nt, Human
aaaguggguuuuuuaguugaa

SEQ ID NO: 1378451 - RNA, 18 nt, Human
aaagugucaacucuuugu

SEQ ID NO: 1378452 - RNA, 15 nt, Human
aaaguguauuuguua

SEQ ID NO: 1378453 - RNA, 22 nt, Human
aaaguguauuuuuuuacuaaua

SEQ ID NO: 1378454 - RNA, 22 nt, Human
guaacauuugcuguuuuaaaca

SEQ ID NO: 1378455 - RNA, 19 nt, Human
guaacauuugcuguuuuaa

SEQ ID NO: 1378456 - RNA, 14 nt, Human
guaacauuugcugu

SEQ ID NO: 1378457 - RNA, 23 nt, Human
guaacauguguuaaguauuuuca

SEQ ID NO: 1378458 - RNA, 23 nt, Human
guaacaagccagauuuuuuaaaa

SEQ ID NO: 1378459 - RNA, 16 nt, Human
guaacaagccagauuu

SEQ ID NO: 1378460 - RNA, 15 nt, Human
guaacaagccagauu

SEQ ID NO: 1378461 - RNA, 14 nt, Human
guaacaagccagau

SEQ ID NO: 1378462 - RNA, 13 nt, Human
guaacaagccaga

SEQ ID NO: 1378463 - RNA, 13 nt, Human
guaacaaaaauaa

SEQ ID NO: 1378464 - RNA, 22 nt, Human
guaaauuuguacuauuuaacug

SEQ ID NO: 1378465 - RNA, 20 nt, Human
guaaauuuguacuauuuaac

SEQ ID NO: 1378466 - RNA, 15 nt, Human
guaaauuuguacuau

SEQ ID NO: 1378467 - RNA, 13 nt, Human
guaaauuuguacu

SEQ ID NO: 1378468 - RNA, 15 nt, Human
guaaagucaaggaga

SEQ ID NO: 1378469 - RNA, 23 nt, Human
guaaaguauguauuauuuacauu

SEQ ID NO: 1378470 - RNA, 22 nt, Human
guaaaguauguauuauuuacau

SEQ ID NO: 1378471 - RNA, 17 nt, Human
guaaaguauguauuauu

SEQ ID NO: 1378472 - RNA, 15 nt, Human
guaaaguauguauua

SEQ ID NO: 1378473 - RNA, 17 nt, Human
guaaaguacuuguaguu

SEQ ID NO: 1378474 - RNA, 16 nt, Human
guaaaguacuuguagu

SEQ ID NO: 1378475 - RNA, 15 nt, Human
guaaaguacuuguag

SEQ ID NO: 1378476 - RNA, 14 nt, Human
guaaaguacuugua

SEQ ID NO: 1378477 - RNA, 15 nt, Human
guaaagcuaaaauaa

SEQ ID NO: 1378478 - RNA, 23 nt, Human
guaaacucaaaauauuuguacau

SEQ ID NO: 1378479 - RNA, 16 nt, Human
guaaacucaaaauauu

SEQ ID NO: 1378480 - RNA, 22 nt, Human
guaaacuaucuuggugaauuuu

SEQ ID NO: 1378481 - RNA, 16 nt, Human
guaaagcuugucugau

SEQ ID NO: 1378482 - RNA, 20 nt, Human
guaaagcuaaaauaaagaaa

SEQ ID NO: 1378483 - RNA, 24 nt, Human
guaaacugugcaccaagcaggaaa

SEQ ID NO: 1378484 - RNA, 21 nt, Human
guaaagcccauuuuuaaaaua

SEQ ID NO: 1378485 - RNA, 21 nt, Human
aaauaugauguuaaaaaaaua

SEQ ID NO: 1378486 - RNA, 15 nt, Human
aaauaugauguuaaa

SEQ ID NO: 1378487 - RNA, 20 nt, Human
aaauaugaagacauaaaccc

SEQ ID NO: 1378488 - RNA, 17 nt, Human
aaauaugaagaacugag

SEQ ID NO: 1378489 - RNA, 15 nt, Human
aaauaucuugaaagg

SEQ ID NO: 1378490 - RNA, 16 nt, Human
aaauauguccuggggu

SEQ ID NO: 1378491 - RNA, 13 nt, Human
aaauauguaccaa

SEQ ID NO: 1378492 - RNA, 19 nt, Human
aaauauggucuuuugguua

SEQ ID NO: 1378493 - RNA, 18 nt, Human
aaauauggacugcucagg

SEQ ID NO: 1378494 - RNA, 20 nt, Human
aaauauggacacuuaauacu

SEQ ID NO: 1378495 - RNA, 16 nt, Human
aaauauggacacuuaa

SEQ ID NO: 1378496 - RNA, 15 nt, Human
aaauauggacacuua

SEQ ID NO: 1378497 - RNA, 16 nt, Human
aaauaugccuuuuuga

SEQ ID NO: 1378498 - RNA, 18 nt, Human
aaaucagcuauuuuguga

SEQ ID NO: 1378499 - RNA, 16 nt, Human
guacacagcaccagaa

SEQ ID NO: 1378500 - RNA, 20 nt, Human
aaauaccagccaguaaaugg

SEQ ID NO: 1378501 - RNA, 21 nt, Human
aaauaccagccaguaaauggg

SEQ ID NO: 1378502 - RNA, 18 nt, Human
guacacaauaagcaaaaa

SEQ ID NO: 1378503 - RNA, 20 nt, Human
guacacaauaagcaaaaaca

SEQ ID NO: 1378504 - RNA, 19 nt, Human
aaauaccagccaguaaaug

SEQ ID NO: 1378505 - RNA, 16 nt, Human
aaauauauacuaaaca

SEQ ID NO: 1378506 - RNA, 12 nt, Human
aaauauauacua

SEQ ID NO: 1378507 - RNA, 15 nt, Human
aaauauaggaacuua

SEQ ID NO: 1378508 - RNA, 22 nt, Human
aaauauacuuuuacaaguaaca

SEQ ID NO: 1378509 - RNA, 18 nt, Human
aaauauagaucaguuaua

SEQ ID NO: 1378510 - RNA, 23 nt, Human
aaauauacuuuuacaaguaacaa

SEQ ID NO: 1378511 - RNA, 15 nt, Human
aaauacggugggggu

SEQ ID NO: 1378512 - RNA, 13 nt, Human
aaauauacuuuua

SEQ ID NO: 1378513 - RNA, 22 nt, Human
aaauacgugggcauucaaaugu

SEQ ID NO: 1378514 - RNA, 21 nt, Human
aaauacgugggcauucaaaug

SEQ ID NO: 1378515 - RNA, 20 nt, Human
aaauacgugggcauucaaau

SEQ ID NO: 1378516 - RNA, 23 nt, Human
aaauaucccuccuguugggagag

SEQ ID NO: 1378517 - RNA, 20 nt, Human
aaauaucccuccuguuggga

SEQ ID NO: 1378518 - RNA, 22 nt, Human
aaauaucacuugucaauaaaau

SEQ ID NO: 1378519 - RNA, 21 nt, Human
aaauauauuauuacuuguaaa

SEQ ID NO: 1378520 - RNA, 22 nt, Human
aaauauauuuaagauaauuaua

SEQ ID NO: 1378521 - RNA, 16 nt, Human
aaauauauuuuaagac

SEQ ID NO: 1378522 - RNA, 22 nt, Human
aaauauauuuuaagacgaaaca

SEQ ID NO: 1378523 - RNA, 21 nt, Human
aaauauauuuaagauaauuau

SEQ ID NO: 1378524 - RNA, 20 nt, Human
aaauauauuuaagauaauua

SEQ ID NO: 1378525 - RNA, 12 nt, Human
aaauauauuuaa

SEQ ID NO: 1378526 - RNA, 23 nt, Human
aaauauauuauuacuuguaaaua

SEQ ID NO: 1378527 - RNA, 19 nt, Human
aaauauauuauuacuugua

SEQ ID NO: 1378528 - RNA, 16 nt, Human
aaauauauuauuacuu

SEQ ID NO: 1378529 - RNA, 13 nt, Human
aaauauauuauua

SEQ ID NO: 1378530 - RNA, 12 nt, Human
aaauauauuauu

SEQ ID NO: 1378531 - RNA, 22 nt, Human
aaauauauauuauacuuguaau

SEQ ID NO: 1378532 - RNA, 17 nt, Human
aaauauauauuauacuu

SEQ ID NO: 1378533 - RNA, 14 nt, Human
aaauauauauuaua

SEQ ID NO: 1378534 - RNA, 13 nt, Human
aaauauauauuau

SEQ ID NO: 1378535 - RNA, 12 nt, Human
aaauauauauua

SEQ ID NO: 1378536 - RNA, 18 nt, Human
aaauauaugcuaagucuu

SEQ ID NO: 1378537 - RNA, 14 nt, Human
aaauauauaucaaa

SEQ ID NO: 1378538 - RNA, 16 nt, Human
aaagcagguucuuguu

SEQ ID NO: 1378539 - RNA, 15 nt, Human
aaagcagguucuugu

SEQ ID NO: 1378540 - RNA, 14 nt, Human
aaagcagguucuug

SEQ ID NO: 1378541 - RNA, 17 nt, Human
aaagcagguuucaagga

SEQ ID NO: 1378542 - RNA, 19 nt, Human
aaagcagguucuuguuggu

SEQ ID NO: 1378543 - RNA, 17 nt, Human
aaagcagguucuuguug

SEQ ID NO: 1378544 - RNA, 22 nt, Human
aaagcagguucuuguuggugca

SEQ ID NO: 1378545 - RNA, 15 nt, Human
aaagcagccacgagg

SEQ ID NO: 1378546 - RNA, 12 nt, Human
aaagcagccacg

SEQ ID NO: 1378547 - RNA, 19 nt, Human
aaagcagaauaguauuuuu

SEQ ID NO: 1378548 - RNA, 17 nt, Human
aaagcagccuggccaac

SEQ ID NO: 1378549 - RNA, 15 nt, Human
aaagcagcguuucua

SEQ ID NO: 1378550 - RNA, 18 nt, Human
aaagcugacuuggcuggu

SEQ ID NO: 1378551 - RNA, 20 nt, Human
aaagcuagaauugaguguuu

SEQ ID NO: 1378552 - RNA, 14 nt, Human
aaagcuagaauuga

SEQ ID NO: 1378553 - RNA, 13 nt, Human
aaagcuagaauug

SEQ ID NO: 1378554 - RNA, 16 nt, Human
aaagcaguauuuuucu

SEQ ID NO: 1378555 - RNA, 15 nt, Human
aaagcaguauuuuuc

SEQ ID NO: 1378556 - RNA, 18 nt, Human
aaagcugguuuaauguuu

SEQ ID NO: 1378557 - RNA, 16 nt, Human
aaagcugguuuaaugu

SEQ ID NO: 1378558 - RNA, 14 nt, Human
aaagcugauuuuuu

SEQ ID NO: 1378559 - RNA, 18 nt, Human
aaagcuguguguuuggaa

SEQ ID NO: 1378560 - RNA, 17 nt, Human
aaagcuguucugucuuc

SEQ ID NO: 1378561 - RNA, 14 nt, Human
aaagcuguguggca

SEQ ID NO: 1378562 - RNA, 19 nt, Human
ggugcugggagaggcagcc

SEQ ID NO: 1378563 - RNA, 18 nt, Human
ggugcugggagaggcagc

SEQ ID NO: 1378564 - RNA, 12 nt, Human
ggugcugggaga

SEQ ID NO: 1378565 - RNA, 23 nt, Human
ggugcuggagguuggaucuugau

SEQ ID NO: 1378566 - RNA, 17 nt, Human
ggugcugccucuaccug

SEQ ID NO: 1378567 - RNA, 15 nt, Human
gguggacucgccugu

SEQ ID NO: 1378568 - RNA, 14 nt, Human
aaagcagaggccaa

SEQ ID NO: 1378569 - RNA, 14 nt, Human
gguggcagcaacaa

SEQ ID NO: 1378570 - RNA, 13 nt, Human
gguggcagcaaca

SEQ ID NO: 1378571 - RNA, 19 nt, Human
aaagcuuaaaacuuugaag

SEQ ID NO: 1378572 - RNA, 15 nt, Human
aaagcuuaaaacuuu

SEQ ID NO: 1378573 - RNA, 14 nt, Human
aaagcuuaaaacuu

SEQ ID NO: 1378574 - RNA, 19 nt, Human
aaagggcccuccuuccuaa

SEQ ID NO: 1378575 - RNA, 16 nt, Human
aaagcuuaaaacuuug

SEQ ID NO: 1378576 - RNA, 11 nt, Human
aaaggggagac

SEQ ID NO: 1378577 - RNA, 17 nt, Human
aaagggcccuccuuccu

SEQ ID NO: 1378578 - RNA, 22 nt, Human
aaagggcuguuauaaucuuuca

SEQ ID NO: 1378579 - RNA, 20 nt, Human
aaagggcuguuauaaucuuu

SEQ ID NO: 1378580 - RNA, 23 nt, Human
aaaggugacaucggaaaaauaau

SEQ ID NO: 1378581 - RNA, 24 nt, Human
aaaggggucggcugaccaugcuca

SEQ ID NO: 1378582 - RNA, 23 nt, Human
aaaggggucggcugaccaugcuc

SEQ ID NO: 1378583 - RNA, 21 nt, Human
aaagguuuaaaugaacaagag

SEQ ID NO: 1378584 - RNA, 20 nt, Human
aaagguuuaaaugaacaaga

SEQ ID NO: 1378585 - RNA, 18 nt, Human
aaagguuuaaaugaacaa

SEQ ID NO: 1378586 - RNA, 16 nt, Human
aaagguuuaaaugaac

SEQ ID NO: 1378587 - RNA, 14 nt, Human
aaagguuuaaauga

SEQ ID NO: 1378588 - RNA, 13 nt, Human
aaagguuuaaaug

SEQ ID NO: 1378589 - RNA, 21 nt, Human
aaagguucuagguuucaaaga

SEQ ID NO: 1378590 - RNA, 20 nt, Human
aaagguucuagguuucaaag

SEQ ID NO: 1378591 - RNA, 13 nt, Human
aaagguucuaggu

SEQ ID NO: 1378592 - RNA, 19 nt, Human
aaagguuagagaauaaauu

SEQ ID NO: 1378593 - RNA, 17 nt, Human
aaaggugugagacuggg

SEQ ID NO: 1378594 - RNA, 19 nt, Human
aaaggugugagacugggaa

SEQ ID NO: 1378595 - RNA, 18 nt, Human
aaagguucaugcaaacuu

SEQ ID NO: 1378596 - RNA, 12 nt, Human
ggugggccuggu

SEQ ID NO: 1378597 - RNA, 16 nt, Human
ggugggcugguaucuc

SEQ ID NO: 1378598 - RNA, 14 nt, Human
gguggcuuuugcgg

SEQ ID NO: 1378599 - RNA, 23 nt, Human
gguggcuuuugcgguucaggaaa

SEQ ID NO: 1378600 - RNA, 14 nt, Human
aaagguuuuccucu

SEQ ID NO: 1378601 - RNA, 19 nt, Human
aaagguuuaugaaaaagaa

SEQ ID NO: 1378602 - RNA, 21 nt, Human
aaagguuuggaaggagcagaa

SEQ ID NO: 1378603 - RNA, 22 nt, Human
aaagguuuaugaaaaagaagaa

SEQ ID NO: 1378604 - RNA, 18 nt, Human
aaagguuuaugaaaaaga

SEQ ID NO: 1378605 - RNA, 16 nt, Human
aaagguuuaugaaaaa

SEQ ID NO: 1378606 - RNA, 16 nt, Human
aaagguuuacagaauu

SEQ ID NO: 1378607 - RNA, 15 nt, Human
aaagguuuacagaau

SEQ ID NO: 1378608 - RNA, 20 nt, Human
aaagguuuaagaaauagaau

SEQ ID NO: 1378609 - RNA, 22 nt, Human
aaagguuuaaaugaacaagaga

SEQ ID NO: 1378610 - RNA, 18 nt, Human
aaagguuuuuuuucaguu

SEQ ID NO: 1378611 - RNA, 12 nt, Human
aaagguuuuuuu

SEQ ID NO: 1378612 - RNA, 21 nt, Human
aaaguaaaaacaaagaaauua

SEQ ID NO: 1378613 - RNA, 15 nt, Human
gguucuagguuucaa

SEQ ID NO: 1378614 - RNA, 23 nt, Human
gguucuaaggccuaggauucuaa

SEQ ID NO: 1378615 - RNA, 12 nt, Human
gguucuaaggcc

SEQ ID NO: 1378616 - RNA, 11 nt, Human
gguucuaaggc

SEQ ID NO: 1378617 - RNA, 22 nt, Human
gguucuaaaguucuaagauucu

SEQ ID NO: 1378618 - RNA, 17 nt, Human
gguucuaaaguucuaag

SEQ ID NO: 1378619 - RNA, 15 nt, Human
gguucuaaaguucua

SEQ ID NO: 1378620 - RNA, 14 nt, Human
gguucuaaaguucu

SEQ ID NO: 1378621 - RNA, 13 nt, Human
gguucuaaaguuc

SEQ ID NO: 1378622 - RNA, 12 nt, Human
gguucuaaaguu

SEQ ID NO: 1378623 - RNA, 11 nt, Human
gguucuaaagu

SEQ ID NO: 1378624 - RNA, 14 nt, Human
gguucuaaaaggug

SEQ ID NO: 1378625 - RNA, 15 nt, Human
gguuccuuuuauuag

SEQ ID NO: 1378626 - RNA, 23 nt, Human
gguuccgcuuggagcagaggggc

SEQ ID NO: 1378627 - RNA, 22 nt, Human
gguuccgcuuggagcagagggg

SEQ ID NO: 1378628 - RNA, 21 nt, Human
gguuccgcuuggagcagaggg

SEQ ID NO: 1378629 - RNA, 15 nt, Human
gguuccgcuuggagc

SEQ ID NO: 1378630 - RNA, 16 nt, Human
gguucccaagcucaga

SEQ ID NO: 1378631 - RNA, 13 nt, Human
gguucccaagcuc

SEQ ID NO: 1378632 - RNA, 13 nt, Human
gguguucuaagau

SEQ ID NO: 1378633 - RNA, 22 nt, Human
gguguugccaaauauguccugg

SEQ ID NO: 1378634 - RNA, 21 nt, Human
gguguugccaaauauguccug

SEQ ID NO: 1378635 - RNA, 11 nt, Human
gguguucuaag

SEQ ID NO: 1378636 - RNA, 12 nt, Human
gguguuauuugg

SEQ ID NO: 1378637 - RNA, 22 nt, Human
gguguuauuuggaaccuuguuu

SEQ ID NO: 1378638 - RNA, 21 nt, Human
gguguuaucaccgugggcucc

SEQ ID NO: 1378639 - RNA, 14 nt, Human
gguguuaauuuuug

SEQ ID NO: 1378640 - RNA, 15 nt, Human
gguguuaacagaagg

SEQ ID NO: 1378641 - RNA, 13 nt, Human
gguguuaacagaa

SEQ ID NO: 1378642 - RNA, 12 nt, Human
ggugugucugcu

SEQ ID NO: 1378643 - RNA, 23 nt, Human
ggugugucccccucuguccaggc

SEQ ID NO: 1378644 - RNA, 21 nt, Human
ggugugguacagagaagccag

SEQ ID NO: 1378645 - RNA, 23 nt, Human
ggugugguacagagaagccagcu

SEQ ID NO: 1378646 - RNA, 20 nt, Human
ggugugguacagagaagcca

SEQ ID NO: 1378647 - RNA, 19 nt, Human
ggugugguacagagaagcc

SEQ ID NO: 1378648 - RNA, 17 nt, Human
ggugugguacagagaag

SEQ ID NO: 1378649 - RNA, 16 nt, Human
ggugugguacagagaa

SEQ ID NO: 1378650 - RNA, 15 nt, Human
ggugugguacagaga

SEQ ID NO: 1378651 - RNA, 14 nt, Human
ggugugguacagag

SEQ ID NO: 1378652 - RNA, 12 nt, Human
gguguggcuccu

SEQ ID NO: 1378653 - RNA, 16 nt, Human
gguguggagccgaggc

SEQ ID NO: 1378654 - RNA, 21 nt, Human
gguggggagagacgggcccug

SEQ ID NO: 1378655 - RNA, 22 nt, Human
gguggggggggggcgcggcugg

SEQ ID NO: 1378656 - RNA, 16 nt, Human
aaaguacuuguaguuc

SEQ ID NO: 1378657 - RNA, 15 nt, Human
aaaguacuuguaguu

SEQ ID NO: 1378658 - RNA, 14 nt, Human
aaaguacuuguagu

SEQ ID NO: 1378659 - RNA, 17 nt, Human
aaaguacacucugcugu

SEQ ID NO: 1378660 - RNA, 15 nt, Human
aaaguacacucugcu

SEQ ID NO: 1378661 - RNA, 19 nt, Human
aaaguacacuguuucaaac

SEQ ID NO: 1378662 - RNA, 19 nt, Human
aaaguacaaccauagagga

SEQ ID NO: 1378663 - RNA, 18 nt, Human
aaaguacacuguuucaaa

SEQ ID NO: 1378664 - RNA, 21 nt, Human
aaaguaucccuacuguaauuu

SEQ ID NO: 1378665 - RNA, 17 nt, Human
aaaguggguuuuuuagu

SEQ ID NO: 1378666 - RNA, 14 nt, Human
aaaguguauuuuuu

SEQ ID NO: 1378667 - RNA, 21 nt, Human
aaaguguauuuuuuuacuaau

SEQ ID NO: 1378668 - RNA, 19 nt, Human
aaaguauguauuauuuaca

SEQ ID NO: 1378669 - RNA, 17 nt, Human
aaaguauguauuauuua

SEQ ID NO: 1378670 - RNA, 16 nt, Human
aaaguauguauuauuu

SEQ ID NO: 1378671 - RNA, 22 nt, Human
aaaguggguuuuuuaguugaau

SEQ ID NO: 1378672 - RNA, 17 nt, Human
aaagugggcuugauucu

SEQ ID NO: 1378673 - RNA, 17 nt, Human
aaaguauguuagugcaa

SEQ ID NO: 1378674 - RNA, 16 nt, Human
gguuucauguuaguua

SEQ ID NO: 1378675 - RNA, 17 nt, Human
gguuucagcacuagcca

SEQ ID NO: 1378676 - RNA, 19 nt, Human
gguuucagcacuagccaaa

SEQ ID NO: 1378677 - RNA, 13 nt, Human
gguuucagcacua

SEQ ID NO: 1378678 - RNA, 21 nt, Human
gguucucaauuccaacaguuu

SEQ ID NO: 1378679 - RNA, 21 nt, Human
gguuucuaagcauaaaagaug

SEQ ID NO: 1378680 - RNA, 12 nt, Human
gguuucuagcau

SEQ ID NO: 1378681 - RNA, 19 nt, Human
gguuucccuacugaagccc

SEQ ID NO: 1378682 - RNA, 21 nt, Human
gguuuuaauuuaguaaaccaa

SEQ ID NO: 1378683 - RNA, 15 nt, Human
gguuuuaacuuuguu

SEQ ID NO: 1378684 - RNA, 14 nt, Human
gguuuuaacuuugu

SEQ ID NO: 1378685 - RNA, 22 nt, Human
gguuugguuugcagcgacuggc

SEQ ID NO: 1378686 - RNA, 15 nt, Human
gguuugguguauggu

SEQ ID NO: 1378687 - RNA, 20 nt, Human
gguuuguaaauuaacuuuua

SEQ ID NO: 1378688 - RNA, 17 nt, Human
gguuuuauaaggcugau

SEQ ID NO: 1378689 - RNA, 16 nt, Human
gguuuuagguucuaaa

SEQ ID NO: 1378690 - RNA, 15 nt, Human
gguuuuagguucuaa

SEQ ID NO: 1378691 - RNA, 17 nt, Human
gguuuuaauuuaguaaa

SEQ ID NO: 1378692 - RNA, 17 nt, Human
gguuuucacauuggaaa

SEQ ID NO: 1378693 - RNA, 16 nt, Human
gcuuugcuaccaaagc

SEQ ID NO: 1378694 - RNA, 17 nt, Human
gcuuugcccuucuuucu

SEQ ID NO: 1378695 - RNA, 14 nt, Human
gcuuuggaaguuuu

SEQ ID NO: 1378696 - RNA, 23 nt, Human
gcuuuggaaguuuagcucugaga

SEQ ID NO: 1378697 - RNA, 21 nt, Human
gcuuuggaaguuuagcucuga

SEQ ID NO: 1378698 - RNA, 14 nt, Human
gcuuuggaagccau

SEQ ID NO: 1378699 - RNA, 20 nt, Human
gcuuugauucauaguaacuu

SEQ ID NO: 1378700 - RNA, 15 nt, Human
gcuuugauucauagu

SEQ ID NO: 1378701 - RNA, 12 nt, Human
gcuuugauucau

SEQ ID NO: 1378702 - RNA, 21 nt, Human
gcuuugauguuccuuccagug

SEQ ID NO: 1378703 - RNA, 16 nt, Human
gcuuucgaacugcuag

SEQ ID NO: 1378704 - RNA, 19 nt, Human
gcuuuccugccccaggccu

SEQ ID NO: 1378705 - RNA, 17 nt, Human
gcuuuccugccccaggc

SEQ ID NO: 1378706 - RNA, 14 nt, Human
gcuuuccugcccca

SEQ ID NO: 1378707 - RNA, 12 nt, Human
gcuuuccugccc

SEQ ID NO: 1378708 - RNA, 11 nt, Human
gcuuuccugcc

SEQ ID NO: 1378709 - RNA, 22 nt, Human
gcuuuccugaauccaaacuaau

SEQ ID NO: 1378710 - RNA, 12 nt, Human
gcuuuccugaau

SEQ ID NO: 1378711 - RNA, 11 nt, Human
gcuuuccugaa

SEQ ID NO: 1378712 - RNA, 15 nt, Human
gcuuaaucuuugaaa

SEQ ID NO: 1378713 - RNA, 17 nt, Human
gcuuaaucagauagaua

SEQ ID NO: 1378714 - RNA, 19 nt, Human
gcuguuugagauucucaaa

SEQ ID NO: 1378715 - RNA, 17 nt, Human
gcuuaacuucacauauu

SEQ ID NO: 1378716 - RNA, 16 nt, Human
gcuguuuauuaaucuu

SEQ ID NO: 1378717 - RNA, 15 nt, Human
gcuguuuacuaggga

SEQ ID NO: 1378718 - RNA, 16 nt, Human
gcuuaacuucacauau

SEQ ID NO: 1378719 - RNA, 17 nt, Human
ggaaacuggccauggcc

SEQ ID NO: 1378720 - RNA, 17 nt, Human
ggaaacuccugugacca

SEQ ID NO: 1378721 - RNA, 16 nt, Human
ggaaacuccugugacc

SEQ ID NO: 1378722 - RNA, 17 nt, Human
ggaaacaguugcaugua

SEQ ID NO: 1378723 - RNA, 18 nt, Human
ggaaacaguugcauguag

SEQ ID NO: 1378724 - RNA, 21 nt, Human
ggaaacagcaucuccaagcag

SEQ ID NO: 1378725 - RNA, 23 nt, Human
gcuuuuguuuccuuuuucagaua

SEQ ID NO: 1378726 - RNA, 23 nt, Human
gcuuuugugggggacuguaaguu

SEQ ID NO: 1378727 - RNA, 11 nt, Human
gcuuuuggcaa

SEQ ID NO: 1378728 - RNA, 21 nt, Human
gcuuuugugggggacuguaag

SEQ ID NO: 1378729 - RNA, 13 nt, Human
gcuuuugugcauu

SEQ ID NO: 1378730 - RNA, 19 nt, Human
gcuuuugugcauuaucuag

SEQ ID NO: 1378731 - RNA, 15 nt, Human
gcuuuuuuuuccuuc

SEQ ID NO: 1378732 - RNA, 22 nt, Human
gcuuuuuuuguguguauuugcu

SEQ ID NO: 1378733 - RNA, 21 nt, Human
gcuuuuuuuguguguauuugc

SEQ ID NO: 1378734 - RNA, 17 nt, Human
gcuuuuuuuguguguau

SEQ ID NO: 1378735 - RNA, 21 nt, Human
gcuuuuguuuccuuuuucaga

SEQ ID NO: 1378736 - RNA, 16 nt, Human
ggaaaaaauaacaaug

SEQ ID NO: 1378737 - RNA, 21 nt, Human
ggaaagcaagaaucagagaag

SEQ ID NO: 1378738 - RNA, 21 nt, Human
ggaaagcaaagcacagagagu

SEQ ID NO: 1378739 - RNA, 20 nt, Human
ggaaagcaaagcacagagag

SEQ ID NO: 1378740 - RNA, 17 nt, Human
ggaaagcaaagcacaga

SEQ ID NO: 1378741 - RNA, 16 nt, Human
ggaaagcaaagcacag

SEQ ID NO: 1378742 - RNA, 13 nt, Human
ggaaagcaaagca

SEQ ID NO: 1378743 - RNA, 20 nt, Human
ggaaagcccauaugcuacca

SEQ ID NO: 1378744 - RNA, 11 nt, Human
ggaaagcaggu

SEQ ID NO: 1378745 - RNA, 16 nt, Human
ggaaagcaagaaucag

SEQ ID NO: 1378746 - RNA, 19 nt, Human
ggaaagcagccuggccaac

SEQ ID NO: 1378747 - RNA, 12 nt, Human
ggaaaggccagc

SEQ ID NO: 1378748 - RNA, 16 nt, Human
ggaaaggccagcacuc

SEQ ID NO: 1378749 - RNA, 23 nt, Human
ggaaagcgccuccaacccuagca

SEQ ID NO: 1378750 - RNA, 21 nt, Human
ggaaagcuuuucuauuuuaau

SEQ ID NO: 1378751 - RNA, 16 nt, Human
ggaaagccccugcccc

SEQ ID NO: 1378752 - RNA, 19 nt, Human
ggaaagcgccuccaacccu

SEQ ID NO: 1378753 - RNA, 21 nt, Human
gcuuuugcccauuuugaauca

SEQ ID NO: 1378754 - RNA, 20 nt, Human
gcuuuugcccauuuugaauc

SEQ ID NO: 1378755 - RNA, 23 nt, Human
gcuuuugcgguucaggaaaauug

SEQ ID NO: 1378756 - RNA, 16 nt, Human
gcuuuucccuuuguga

SEQ ID NO: 1378757 - RNA, 21 nt, Human
gcuuuucccuuuuuuuaagua

SEQ ID NO: 1378758 - RNA, 20 nt, Human
gcuuuucccuuuuuuuaagu

SEQ ID NO: 1378759 - RNA, 13 nt, Human
ggacaugcuuagc

SEQ ID NO: 1378760 - RNA, 21 nt, Human
ggacaugcgguagccagcaca

SEQ ID NO: 1378761 - RNA, 19 nt, Human
ggacaugcgguagccagca

SEQ ID NO: 1378762 - RNA, 16 nt, Human
ggacaugcgguagcca

SEQ ID NO: 1378763 - RNA, 16 nt, Human
ggacauccuccuccca

SEQ ID NO: 1378764 - RNA, 14 nt, Human
ggacaugcuuagca

SEQ ID NO: 1378765 - RNA, 23 nt, Human
ggacaguuuaccaguugccuuuu

SEQ ID NO: 1378766 - RNA, 20 nt, Human
ggacaguuuaccaguugccu

SEQ ID NO: 1378767 - RNA, 22 nt, Human
ggacaguuccagaagugugacu

SEQ ID NO: 1378768 - RNA, 13 nt, Human
ggacauccuccuc

SEQ ID NO: 1378769 - RNA, 12 nt, Human
ggacaucagcaa

SEQ ID NO: 1378770 - RNA, 14 nt, Human
ggacaucagcaaac

SEQ ID NO: 1378771 - RNA, 15 nt, Human
ggacaucagcaaaca

SEQ ID NO: 1378772 - RNA, 13 nt, Human
ggacaggcuggcu

SEQ ID NO: 1378773 - RNA, 14 nt, Human
ggacaccugcccug

SEQ ID NO: 1378774 - RNA, 15 nt, Human
ggacaccugcccugc

SEQ ID NO: 1378775 - RNA, 16 nt, Human
ggacaccugcccugcc

SEQ ID NO: 1378776 - RNA, 13 nt, Human
ggacaccugcccu

SEQ ID NO: 1378777 - RNA, 16 nt, Human
ggacaccuaggcuagg

SEQ ID NO: 1378778 - RNA, 10 nt, Human
ggacaccugc

SEQ ID NO: 1378779 - RNA, 11 nt, Human
ggacaccugcc

SEQ ID NO: 1378780 - RNA, 12 nt, Human
ggacaccugccc

SEQ ID NO: 1378781 - RNA, 23 nt, Human
ggacaggcuggcuccagaugcag

SEQ ID NO: 1378782 - RNA, 15 nt, Human
ggacaggcuggcucc

SEQ ID NO: 1378783 - RNA, 20 nt, Human
ggacagguccucaguguccu

SEQ ID NO: 1378784 - RNA, 21 nt, Human
ggacagucaccucauggaauu

SEQ ID NO: 1378785 - RNA, 18 nt, Human
ggacagucaccucaugga

SEQ ID NO: 1378786 - RNA, 17 nt, Human
ggacagucaccucaugg

SEQ ID NO: 1378787 - RNA, 20 nt, Human
ggaagcgcgagggccucaaa

SEQ ID NO: 1378788 - RNA, 22 nt, Human
ggaagccucagauuccuuccca

SEQ ID NO: 1378789 - RNA, 13 nt, Human
ggaagccucagau

SEQ ID NO: 1378790 - RNA, 20 nt, Human
ggaagccgugcucgccccag

SEQ ID NO: 1378791 - RNA, 15 nt, Human
ggaagccguccuggc

SEQ ID NO: 1378792 - RNA, 14 nt, Human
ggaagccugcaguc

SEQ ID NO: 1378793 - RNA, 15 nt, Human
ggaauauaauuguuu

SEQ ID NO: 1378794 - RNA, 11 nt, Human
ggaauauuuga

SEQ ID NO: 1378795 - RNA, 13 nt, Human
ggaauauuugaau

SEQ ID NO: 1378796 - RNA, 14 nt, Human
ggaauauuugaauc

SEQ ID NO: 1378797 - RNA, 16 nt, Human
ggaauauauaaccagu

SEQ ID NO: 1378798 - RNA, 17 nt, Human
ggaauagcaugucacua

SEQ ID NO: 1378799 - RNA, 14 nt, Human
ggaauagcauguca

SEQ ID NO: 1378800 - RNA, 19 nt, Human
ggaauacugaacaucugag

SEQ ID NO: 1378801 - RNA, 17 nt, Human
ggaauacuuuuuguuau

SEQ ID NO: 1378802 - RNA, 12 nt, Human
ggaauacuuuuu

SEQ ID NO: 1378803 - RNA, 19 nt, Human
ggaauacucuuauaucuau

SEQ ID NO: 1378804 - RNA, 23 nt, Human
ggacaauggaccggagagugggg

SEQ ID NO: 1378805 - RNA, 15 nt, Human
ggaauauuugaaucu

SEQ ID NO: 1378806 - RNA, 20 nt, Human
ggaauauuugaaucuugucu

SEQ ID NO: 1378807 - RNA, 12 nt, Human
ggacacaggccu

SEQ ID NO: 1378808 - RNA, 11 nt, Human
ggacacaggcc

SEQ ID NO: 1378809 - RNA, 23 nt, Human
ggacacaggccuguguagcugug

SEQ ID NO: 1378810 - RNA, 16 nt, Human
ggacacaggccugugu

SEQ ID NO: 1378811 - RNA, 14 nt, Human
ggacacaggccugu

SEQ ID NO: 1378812 - RNA, 13 nt, Human
ggacacaggccug

SEQ ID NO: 1378813 - RNA, 12 nt, Human
ggacacaugucc

SEQ ID NO: 1378814 - RNA, 13 nt, Human
ggacacaugucca

SEQ ID NO: 1378815 - RNA, 16 nt, Human
ggacaccccgacuuuu

SEQ ID NO: 1378816 - RNA, 19 nt, Human
ggacacauguccaguggga

SEQ ID NO: 1378817 - RNA, 14 nt, Human
ggaagcccauccug

SEQ ID NO: 1378818 - RNA, 17 nt, Human
ggaagcccauccugacc

SEQ ID NO: 1378819 - RNA, 16 nt, Human
ggaagccagcuuuccc

SEQ ID NO: 1378820 - RNA, 13 nt, Human
ggaaaucuuaaac

SEQ ID NO: 1378821 - RNA, 19 nt, Human
ggaaaucaggguuaguauu

SEQ ID NO: 1378822 - RNA, 15 nt, Human
ggaaaucccuucaua

SEQ ID NO: 1378823 - RNA, 22 nt, Human
gcugccugagucgugaccugcu

SEQ ID NO: 1378824 - RNA, 21 nt, Human
gcugccugagucgugaccugc

SEQ ID NO: 1378825 - RNA, 11 nt, Human
gcugccugagu

SEQ ID NO: 1378826 - RNA, 18 nt, Human
gcugccucccucugcugu

SEQ ID NO: 1378827 - RNA, 21 nt, Human
gcugccuccccucuccuuccu

SEQ ID NO: 1378828 - RNA, 21 nt, Human
gcugccucuaccugacacucc

SEQ ID NO: 1378829 - RNA, 21 nt, Human
gcugccucccuuguggcagca

SEQ ID NO: 1378830 - RNA, 18 nt, Human
gcugccucuucccucuuc

SEQ ID NO: 1378831 - RNA, 14 nt, Human
gcugccucuucccu

SEQ ID NO: 1378832 - RNA, 18 nt, Human
gcugccccucucaccaaa

SEQ ID NO: 1378833 - RNA, 16 nt, Human
gcugccccucucacca

SEQ ID NO: 1378834 - RNA, 15 nt, Human
gcugccccucucacc

SEQ ID NO: 1378835 - RNA, 14 nt, Human
gcugccccucucac

SEQ ID NO: 1378836 - RNA, 13 nt, Human
gcugccccucuca

SEQ ID NO: 1378837 - RNA, 22 nt, Human
gcugccccucaucucucugccc

SEQ ID NO: 1378838 - RNA, 23 nt, Human
gcugccccggccccucccccuga

SEQ ID NO: 1378839 - RNA, 22 nt, Human
gcugccccggccccucccccug

SEQ ID NO: 1378840 - RNA, 16 nt, Human
gcugccccggccccuc

SEQ ID NO: 1378841 - RNA, 15 nt, Human
gcugccccggccccu

SEQ ID NO: 1378842 - RNA, 13 nt, Human
gcugccccggccc

SEQ ID NO: 1378843 - RNA, 15 nt, Human
gcugcccccaccucu

SEQ ID NO: 1378844 - RNA, 16 nt, Human
gcugcagccugcgcca

SEQ ID NO: 1378845 - RNA, 23 nt, Human
gcugcagccucaggacugggagc

SEQ ID NO: 1378846 - RNA, 22 nt, Human
gcugcagccucaggacugggag

SEQ ID NO: 1378847 - RNA, 21 nt, Human
gcugcagccucaggacuggga

SEQ ID NO: 1378848 - RNA, 19 nt, Human
gcugcagccucaggacugg

SEQ ID NO: 1378849 - RNA, 18 nt, Human
gcugcagccucaggacug

SEQ ID NO: 1378850 - RNA, 16 nt, Human
gcugcagccucaggac

SEQ ID NO: 1378851 - RNA, 15 nt, Human
gcugcagccucagga

SEQ ID NO: 1378852 - RNA, 14 nt, Human
gcugcagccucagg

SEQ ID NO: 1378853 - RNA, 21 nt, Human
gcugcccuccugugcucagcc

SEQ ID NO: 1378854 - RNA, 12 nt, Human
gcugcccuccug

SEQ ID NO: 1378855 - RNA, 21 nt, Human
gcugcccuacagcacccugug

SEQ ID NO: 1378856 - RNA, 20 nt, Human
gcugccccuggugcacuggc

SEQ ID NO: 1378857 - RNA, 18 nt, Human
gcugcaagcacagcccuu

SEQ ID NO: 1378858 - RNA, 20 nt, Human
gcugcaagguacucugguga

SEQ ID NO: 1378859 - RNA, 12 nt, Human
gcugcaagguac

SEQ ID NO: 1378860 - RNA, 20 nt, Human
gcugaggugcccaggagaag

SEQ ID NO: 1378861 - RNA, 16 nt, Human
gcugagcagggccggg

SEQ ID NO: 1378862 - RNA, 14 nt, Human
gcugagcagggccg

SEQ ID NO: 1378863 - RNA, 13 nt, Human
gcugagcagggcc

SEQ ID NO: 1378864 - RNA, 14 nt, Human
gcugagcaggccac

SEQ ID NO: 1378865 - RNA, 12 nt, Human
gcugagcaggcc

SEQ ID NO: 1378866 - RNA, 18 nt, Human
gcugagcaaaucaccaca

SEQ ID NO: 1378867 - RNA, 23 nt, Human
gcugaggcagcagugugaggcca

SEQ ID NO: 1378868 - RNA, 13 nt, Human
gcugaggcagcag

SEQ ID NO: 1378869 - RNA, 18 nt, Human
gcugaggugcccaggaga

SEQ ID NO: 1378870 - RNA, 17 nt, Human
gcugaggugcccaggag

SEQ ID NO: 1378871 - RNA, 16 nt, Human
gcugaggugcccagga

SEQ ID NO: 1378872 - RNA, 15 nt, Human
gcugaggugcccagg

SEQ ID NO: 1378873 - RNA, 21 nt, Human
gcugaggccacacucagcaca

SEQ ID NO: 1378874 - RNA, 19 nt, Human
gcugaggccacacucagca

SEQ ID NO: 1378875 - RNA, 20 nt, Human
gcuggagagcauagggucug

SEQ ID NO: 1378876 - RNA, 16 nt, Human
gcuggcucugagcgcc

SEQ ID NO: 1378877 - RNA, 13 nt, Human
gcuggcucugagc

SEQ ID NO: 1378878 - RNA, 16 nt, Human
gcuggcugagggcagu

SEQ ID NO: 1378879 - RNA, 23 nt, Human
gcugcucuuggcuggacccagcc

SEQ ID NO: 1378880 - RNA, 22 nt, Human
gcugcucuuggcuggacccagc

SEQ ID NO: 1378881 - RNA, 21 nt, Human
gcugcucuuggcuggacccag

SEQ ID NO: 1378882 - RNA, 18 nt, Human
gcugcucuuggcuggacc

SEQ ID NO: 1378883 - RNA, 15 nt, Human
gcugcucuuggcugg

SEQ ID NO: 1378884 - RNA, 15 nt, Human
gcugguaucucagaa

SEQ ID NO: 1378885 - RNA, 14 nt, Human
gcugguagagcagg

SEQ ID NO: 1378886 - RNA, 18 nt, Human
gcugggccccugccucuc

SEQ ID NO: 1378887 - RNA, 20 nt, Human
gcugggccccugccucucug

SEQ ID NO: 1378888 - RNA, 12 nt, Human
gcugggccccug

SEQ ID NO: 1378889 - RNA, 13 nt, Human
gcugggccccugc

SEQ ID NO: 1378890 - RNA, 14 nt, Human
gcugggccccugcc

SEQ ID NO: 1378891 - RNA, 22 nt, Human
gcugggaacagugugcaaggca

SEQ ID NO: 1378892 - RNA, 15 nt, Human
gcuggcugagggcag

SEQ ID NO: 1378893 - RNA, 15 nt, Human
gcuggcuugggcagc

SEQ ID NO: 1378894 - RNA, 20 nt, Human
gcugggccauguccaaagag

SEQ ID NO: 1378895 - RNA, 19 nt, Human
gcugggccauguccaaaga

SEQ ID NO: 1378896 - RNA, 17 nt, Human
gcugggccauguccaaa

SEQ ID NO: 1378897 - RNA, 21 nt, Human
gcugggaauggaggggcagag

SEQ ID NO: 1378898 - RNA, 17 nt, Human
gcugugcuauggugcuc

SEQ ID NO: 1378899 - RNA, 16 nt, Human
gcugugcuauggugcu

SEQ ID NO: 1378900 - RNA, 18 nt, Human
gcugugcgcccagggcug

SEQ ID NO: 1378901 - RNA, 16 nt, Human
gcugugcgcccagggc

SEQ ID NO: 1378902 - RNA, 17 nt, Human
gcugugcgcccagggcu

SEQ ID NO: 1378903 - RNA, 23 nt, Human
gcuguaguaggcauuuuuaccau

SEQ ID NO: 1378904 - RNA, 16 nt, Human
gcuguaguaggcauuu

SEQ ID NO: 1378905 - RNA, 14 nt, Human
gcuguauaaaauca

SEQ ID NO: 1378906 - RNA, 18 nt, Human
gcuguauaaaaucagcca

SEQ ID NO: 1378907 - RNA, 20 nt, Human
gcugugauacgaugcuucaa

SEQ ID NO: 1378908 - RNA, 19 nt, Human
gcugugaguucucccugua

SEQ ID NO: 1378909 - RNA, 18 nt, Human
gcugugaguucucccugu

SEQ ID NO: 1378910 - RNA, 22 nt, Human
gcugugagucuuugguucuaag

SEQ ID NO: 1378911 - RNA, 20 nt, Human
gcugugagucuuugguucua

SEQ ID NO: 1378912 - RNA, 18 nt, Human
gcugugaggcuguccugu

SEQ ID NO: 1378913 - RNA, 17 nt, Human
gcugugaggcuguccug

SEQ ID NO: 1378914 - RNA, 16 nt, Human
gcugugaggcuguccu

SEQ ID NO: 1378915 - RNA, 15 nt, Human
gcugugaggcugucc

SEQ ID NO: 1378916 - RNA, 14 nt, Human
gcugugaggcuguc

SEQ ID NO: 1378917 - RNA, 13 nt, Human
gcugugaggcugu

SEQ ID NO: 1378918 - RNA, 12 nt, Human
gcugugaggcug

SEQ ID NO: 1378919 - RNA, 15 nt, Human
gcuguauagcugcuu

SEQ ID NO: 1378920 - RNA, 20 nt, Human
gcuguauaaaaucagccaau

SEQ ID NO: 1378921 - RNA, 22 nt, Human
gcuguauaaaaucagccaauua

SEQ ID NO: 1378922 - RNA, 21 nt, Human
gcuguauuuuaaaagaaugau

SEQ ID NO: 1378923 - RNA, 20 nt, Human
gcuguauuuuaaaagaauga

SEQ ID NO: 1378924 - RNA, 13 nt, Human
gcggcaucaggcu

SEQ ID NO: 1378925 - RNA, 19 nt, Human
gcggcaggggccuggagau

SEQ ID NO: 1378926 - RNA, 16 nt, Human
gcggcaggggccugga

SEQ ID NO: 1378927 - RNA, 15 nt, Human
gcggcaggggccugg

SEQ ID NO: 1378928 - RNA, 14 nt, Human
gcggcuccucaggg

SEQ ID NO: 1378929 - RNA, 12 nt, Human
gcggcuccucag

SEQ ID NO: 1378930 - RNA, 16 nt, Human
gcggcagauggggaga

SEQ ID NO: 1378931 - RNA, 13 nt, Human
gcggauggccgga

SEQ ID NO: 1378932 - RNA, 21 nt, Human
gcguggaacucgugucuggca

SEQ ID NO: 1378933 - RNA, 21 nt, Human
gcgggagccaugcgcccccuc

SEQ ID NO: 1378934 - RNA, 12 nt, Human
gcggcugugugu

SEQ ID NO: 1378935 - RNA, 22 nt, Human
gcggcuggggucccagcagcug

SEQ ID NO: 1378936 - RNA, 21 nt, Human
gcggcuggggucccagcagcu

SEQ ID NO: 1378937 - RNA, 20 nt, Human
gcggcuggggucccagcagc

SEQ ID NO: 1378938 - RNA, 19 nt, Human
gcggcuggggucccagcag

SEQ ID NO: 1378939 - RNA, 18 nt, Human
gcggcuggggucccagca

SEQ ID NO: 1378940 - RNA, 17 nt, Human
gcggcuggggucccagc

SEQ ID NO: 1378941 - RNA, 20 nt, Human
gcggcuggccauggagaaag

SEQ ID NO: 1378942 - RNA, 19 nt, Human
gcggcuggccauggagaaa

SEQ ID NO: 1378943 - RNA, 18 nt, Human
gcggcuggccauggagaa

SEQ ID NO: 1378944 - RNA, 16 nt, Human
gcggcuggccauggag

SEQ ID NO: 1378945 - RNA, 22 nt, Human
gcguuauuggucggcagccuuc

SEQ ID NO: 1378946 - RNA, 15 nt, Human
gcguuccuuucuuuu

SEQ ID NO: 1378947 - RNA, 13 nt, Human
gcguuccuuucuu

SEQ ID NO: 1378948 - RNA, 15 nt, Human
gcguucuuguaauuu

SEQ ID NO: 1378949 - RNA, 14 nt, Human
gcguucuuguaauu

SEQ ID NO: 1378950 - RNA, 11 nt, Human
gcguucuugua

SEQ ID NO: 1378951 - RNA, 16 nt, Human
gcguuccuuucuuuuc

SEQ ID NO: 1378952 - RNA, 11 nt, Human
gcuaaggcucu

SEQ ID NO: 1378953 - RNA, 22 nt, Human
gcguucuuguaauuuuacacgc

SEQ ID NO: 1378954 - RNA, 17 nt, Human
gcguucuuguaauuuua

SEQ ID NO: 1378955 - RNA, 16 nt, Human
gcguucuuguaauuuu

SEQ ID NO: 1378956 - RNA, 19 nt, Human
gcgcaggccgugacgucug

SEQ ID NO: 1378957 - RNA, 13 nt, Human
gccuugccagaga

SEQ ID NO: 1378958 - RNA, 12 nt, Human
gccuugccagag

SEQ ID NO: 1378959 - RNA, 23 nt, Human
gccuugaacuuugaccucugcag

SEQ ID NO: 1378960 - RNA, 20 nt, Human
gccuggcuggcugagggcag

SEQ ID NO: 1378961 - RNA, 18 nt, Human
gccuggcuggcugagggc

SEQ ID NO: 1378962 - RNA, 17 nt, Human
gccuggcuggcugaggg

SEQ ID NO: 1378963 - RNA, 16 nt, Human
gccuggcuggcugagg

SEQ ID NO: 1378964 - RNA, 15 nt, Human
gccuggcuggcugag

SEQ ID NO: 1378965 - RNA, 14 nt, Human
gccuggcuggcuga

SEQ ID NO: 1378966 - RNA, 12 nt, Human
gccuggcuggcu

SEQ ID NO: 1378967 - RNA, 21 nt, Human
gccuggcugcugaucgccuuc

SEQ ID NO: 1378968 - RNA, 16 nt, Human
gccuggcuccguccag

SEQ ID NO: 1378969 - RNA, 21 nt, Human
gccucugggggguggccaggc

SEQ ID NO: 1378970 - RNA, 23 nt, Human
gccucugggggguggccaggccg

SEQ ID NO: 1378971 - RNA, 20 nt, Human
gccucugggggguggccagg

SEQ ID NO: 1378972 - RNA, 17 nt, Human
gccucugggggguggcc

SEQ ID NO: 1378973 - RNA, 22 nt, Human
gccuguggccaugacccugccu

SEQ ID NO: 1378974 - RNA, 21 nt, Human
gccuggcuggcugagggcagu

SEQ ID NO: 1378975 - RNA, 17 nt, Human
gccuucucaugauccaa

SEQ ID NO: 1378976 - RNA, 19 nt, Human
gccuucgucuuucccaugg

SEQ ID NO: 1378977 - RNA, 23 nt, Human
gccuguggccaugacccugccuc

SEQ ID NO: 1378978 - RNA, 23 nt, Human
gccuucuuuugggggucaacagu

SEQ ID NO: 1378979 - RNA, 14 nt, Human
gccuugaacuuuga

SEQ ID NO: 1378980 - RNA, 19 nt, Human
gccuucugguguuggacaa

SEQ ID NO: 1378981 - RNA, 16 nt, Human
gccuucucuguucauu

SEQ ID NO: 1378982 - RNA, 14 nt, Human
gccuucucuguuca

SEQ ID NO: 1378983 - RNA, 19 nt, Human
gccuucucuaaacauuuca

SEQ ID NO: 1378984 - RNA, 23 nt, Human
gcuaggcucugucuggaagaugg

SEQ ID NO: 1378985 - RNA, 18 nt, Human
gcuaggaaugaaauccug

SEQ ID NO: 1378986 - RNA, 13 nt, Human
gcuaggaaugaaa

SEQ ID NO: 1378987 - RNA, 12 nt, Human
gcuaggaaugaa

SEQ ID NO: 1378988 - RNA, 21 nt, Human
gcuaggaauuguguuuauaau

SEQ ID NO: 1378989 - RNA, 17 nt, Human
gcuauuauuuucacugu

SEQ ID NO: 1378990 - RNA, 21 nt, Human
gcuauuauuuucacuguagaa

SEQ ID NO: 1378991 - RNA, 18 nt, Human
gcuauuauuuucacugua

SEQ ID NO: 1378992 - RNA, 23 nt, Human
gcucaaagguuuggaaggagcag

SEQ ID NO: 1378993 - RNA, 22 nt, Human
gcucaaagguuuggaaggagca

SEQ ID NO: 1378994 - RNA, 23 nt, Human
gcucaaacaaugacaaagcagau

SEQ ID NO: 1378995 - RNA, 22 nt, Human
gcucaaacaaugacaaagcaga

SEQ ID NO: 1378996 - RNA, 21 nt, Human
gcucaaacaaugacaaagcag

SEQ ID NO: 1378997 - RNA, 20 nt, Human
gcucaaacaaugacaaagca

SEQ ID NO: 1378998 - RNA, 18 nt, Human
gcuauguuuuuaauguau

SEQ ID NO: 1378999 - RNA, 16 nt, Human
gcuauguuuuuaaugu

SEQ ID NO: 1379000 - RNA, 18 nt, Human
gcuaggguggggagagac

SEQ ID NO: 1379001 - RNA, 17 nt, Human
gcuaggguggggagaga

SEQ ID NO: 1379002 - RNA, 22 nt, Human
gcuaguuauacuuauuuguaua

SEQ ID NO: 1379003 - RNA, 21 nt, Human
gcuaguaauuggaaaggcagc

SEQ ID NO: 1379004 - RNA, 15 nt, Human
gcuaagguucuaagg

SEQ ID NO: 1379005 - RNA, 14 nt, Human
gcuaagguucuaag

SEQ ID NO: 1379006 - RNA, 16 nt, Human
gcuaagggguggggcu

SEQ ID NO: 1379007 - RNA, 15 nt, Human
gcuaagggguggggc

SEQ ID NO: 1379008 - RNA, 17 nt, Human
gcuaagguucuaaggcc

SEQ ID NO: 1379009 - RNA, 16 nt, Human
gcuaagguucuaaggc

SEQ ID NO: 1379010 - RNA, 20 nt, Human
gcuaaguacacaauaagcaa

SEQ ID NO: 1379011 - RNA, 21 nt, Human
gcuaaguacacaauaagcaaa

SEQ ID NO: 1379012 - RNA, 22 nt, Human
gcuaaguacacaauaagcaaaa

SEQ ID NO: 1379013 - RNA, 19 nt, Human
gcucagaggguguccugca

SEQ ID NO: 1379014 - RNA, 18 nt, Human
gcucagaggguguccugc

SEQ ID NO: 1379015 - RNA, 22 nt, Human
gcucaggagcccugggaggcuc

SEQ ID NO: 1379016 - RNA, 23 nt, Human
gcucaggagcccugggaggcucu

SEQ ID NO: 1379017 - RNA, 23 nt, Human
gcucaagcagcgaccgcccccuc

SEQ ID NO: 1379018 - RNA, 22 nt, Human
gcucaagcagcgaccgcccccu

SEQ ID NO: 1379019 - RNA, 21 nt, Human
gcucaagcagcgaccgccccc

SEQ ID NO: 1379020 - RNA, 15 nt, Human
gcucaagcagcgacc

SEQ ID NO: 1379021 - RNA, 23 nt, Human
gcucaacucucuuauugccucac

SEQ ID NO: 1379022 - RNA, 23 nt, Human
gcucacuucugggcuucaucugg

SEQ ID NO: 1379023 - RNA, 15 nt, Human
gcucacuucugggcu

SEQ ID NO: 1379024 - RNA, 18 nt, Human
gcucagaaguuucuucuu

SEQ ID NO: 1379025 - RNA, 17 nt, Human
gcucagaaaauaucccu

SEQ ID NO: 1379026 - RNA, 21 nt, Human
gcucagaggcgcacugugacc

SEQ ID NO: 1379027 - RNA, 20 nt, Human
gcucagaggcgcacugugac

SEQ ID NO: 1379028 - RNA, 19 nt, Human
gcucagaggcgcacuguga

SEQ ID NO: 1379029 - RNA, 18 nt, Human
gcucagaggcgcacugug

SEQ ID NO: 1379030 - RNA, 16 nt, Human
gcucagagcaguguuu

SEQ ID NO: 1379031 - RNA, 16 nt, Human
gcucaggggcccugga

SEQ ID NO: 1379032 - RNA, 17 nt, Human
gcucaggggcccuggag

SEQ ID NO: 1379033 - RNA, 18 nt, Human
gcucaggggcccuggagc

SEQ ID NO: 1379034 - RNA, 19 nt, Human
gcucaggggcccuggagca

SEQ ID NO: 1379035 - RNA, 20 nt, Human
gcccuuauuuucaagaaacu

SEQ ID NO: 1379036 - RNA, 18 nt, Human
gcccuuauuuucaagaaa

SEQ ID NO: 1379037 - RNA, 17 nt, Human
gcccuuauuuucaagaa

SEQ ID NO: 1379038 - RNA, 19 nt, Human
gcccuuaugacugccaaga

SEQ ID NO: 1379039 - RNA, 22 nt, Human
gcccugccuggaggaccugagc

SEQ ID NO: 1379040 - RNA, 18 nt, Human
gcccugcgguagauggga

SEQ ID NO: 1379041 - RNA, 23 nt, Human
gcccugccuggaggaccugagcc

SEQ ID NO: 1379042 - RNA, 21 nt, Human
gcccugccuggaggaccugag

SEQ ID NO: 1379043 - RNA, 20 nt, Human
gcccugccuggaggaccuga

SEQ ID NO: 1379044 - RNA, 19 nt, Human
gcccugccuggaggaccug

SEQ ID NO: 1379045 - RNA, 18 nt, Human
gcccugccuggaggaccu

SEQ ID NO: 1379046 - RNA, 16 nt, Human
gcccugccuggaggac

SEQ ID NO: 1379047 - RNA, 15 nt, Human
gcccugccuggagga

SEQ ID NO: 1379048 - RNA, 14 nt, Human
gcccugccuggagg

SEQ ID NO: 1379049 - RNA, 13 nt, Human
gcccugccuggag

SEQ ID NO: 1379050 - RNA, 12 nt, Human
gcccugccugga

SEQ ID NO: 1379051 - RNA, 11 nt, Human
gcccugccugg

SEQ ID NO: 1379052 - RNA, 18 nt, Human
gcccugccaccugucugu

SEQ ID NO: 1379053 - RNA, 15 nt, Human
gcccuuccaaacucu

SEQ ID NO: 1379054 - RNA, 21 nt, Human
gccggcacagggucugcucuu

SEQ ID NO: 1379055 - RNA, 13 nt, Human
gccggcacagggu

SEQ ID NO: 1379056 - RNA, 15 nt, Human
gccggaucugaggga

SEQ ID NO: 1379057 - RNA, 17 nt, Human
gccggaucugagggaga

SEQ ID NO: 1379058 - RNA, 14 nt, Human
gcccgucucagugu

SEQ ID NO: 1379059 - RNA, 13 nt, Human
gcccgucucagug

SEQ ID NO: 1379060 - RNA, 18 nt, Human
gcccguccugccuguggc

SEQ ID NO: 1379061 - RNA, 17 nt, Human
gcccguccugccugugg

SEQ ID NO: 1379062 - RNA, 16 nt, Human
gcccguccugccugug

SEQ ID NO: 1379063 - RNA, 15 nt, Human
gcccguccugccugu

SEQ ID NO: 1379064 - RNA, 13 nt, Human
gcccccugccccc

SEQ ID NO: 1379065 - RNA, 23 nt, Human
gcccccugcaggaaggagcugcc

SEQ ID NO: 1379066 - RNA, 21 nt, Human
gcccugccacucacuaggccc

SEQ ID NO: 1379067 - RNA, 20 nt, Human
gcccugccacucacuaggcc

SEQ ID NO: 1379068 - RNA, 19 nt, Human
gcccugccacucacuaggc

SEQ ID NO: 1379069 - RNA, 13 nt, Human
gcccugccacuca

SEQ ID NO: 1379070 - RNA, 12 nt, Human
gcccugccacuc

SEQ ID NO: 1379071 - RNA, 11 nt, Human
gcccugccacu

SEQ ID NO: 1379072 - RNA, 20 nt, Human
gcccugccaccugucugucu

SEQ ID NO: 1379073 - RNA, 14 nt, Human
gccucauguggcug

SEQ ID NO: 1379074 - RNA, 13 nt, Human
gccucauguggcu

SEQ ID NO: 1379075 - RNA, 19 nt, Human
gccucaugucaaauauuua

SEQ ID NO: 1379076 - RNA, 17 nt, Human
gccucauguggcuggaa

SEQ ID NO: 1379077 - RNA, 16 nt, Human
gccucauguggcugga

SEQ ID NO: 1379078 - RNA, 15 nt, Human
gccucauguggcugg

SEQ ID NO: 1379079 - RNA, 16 nt, Human
gccucgaaacacagaa

SEQ ID NO: 1379080 - RNA, 23 nt, Human
gccuagaccagcagacagagcca

SEQ ID NO: 1379081 - RNA, 22 nt, Human
gccuagaccagcagacagagcc

SEQ ID NO: 1379082 - RNA, 16 nt, Human
gccuagaccagcagac

SEQ ID NO: 1379083 - RNA, 14 nt, Human
gccuagaccagcag

SEQ ID NO: 1379084 - RNA, 20 nt, Human
gccuagaaacaacacuguag

SEQ ID NO: 1379085 - RNA, 18 nt, Human
gccuagaaacaacacugu

SEQ ID NO: 1379086 - RNA, 16 nt, Human
gccuagaaacaacacu

SEQ ID NO: 1379087 - RNA, 12 nt, Human
gccuagaaacaa

SEQ ID NO: 1379088 - RNA, 21 nt, Human
gccuacagaacuucagaaaga

SEQ ID NO: 1379089 - RNA, 20 nt, Human
gccuacagaacuucagaaag

SEQ ID NO: 1379090 - RNA, 12 nt, Human
gccuagcauacg

SEQ ID NO: 1379091 - RNA, 19 nt, Human
gccuagcauacguacacau

SEQ ID NO: 1379092 - RNA, 23 nt, Human
gcccaggccaggacucugcagcc

SEQ ID NO: 1379093 - RNA, 24 nt, Human
gcccaggccaggacucugcagccu

SEQ ID NO: 1379094 - RNA, 22 nt, Human
gcccaggccaggacucugcagc

SEQ ID NO: 1379095 - RNA, 21 nt, Human
gcccaggccaggacucugcag

SEQ ID NO: 1379096 - RNA, 20 nt, Human
gcccaggccaggacucugca

SEQ ID NO: 1379097 - RNA, 19 nt, Human
gcccaggccaggacucugc

SEQ ID NO: 1379098 - RNA, 16 nt, Human
gcccaggccaggacuc

SEQ ID NO: 1379099 - RNA, 15 nt, Human
gcccaggccaggacu

SEQ ID NO: 1379100 - RNA, 11 nt, Human
gcccaggccag

SEQ ID NO: 1379101 - RNA, 16 nt, Human
gcccaggcacugcaaa

SEQ ID NO: 1379102 - RNA, 13 nt, Human
gcccaggacccca

SEQ ID NO: 1379103 - RNA, 21 nt, Human
gcccaggaccccauggcagug

SEQ ID NO: 1379104 - RNA, 21 nt, Human
gcccaggaagucucaucuggg

SEQ ID NO: 1379105 - RNA, 15 nt, Human
gcccaggcacugcaa

SEQ ID NO: 1379106 - RNA, 15 nt, Human
gcccaggauggcuuu

SEQ ID NO: 1379107 - RNA, 20 nt, Human
gcccaggaagucucaucugg

SEQ ID NO: 1379108 - RNA, 18 nt, Human
gcccaggaagucucaucu

SEQ ID NO: 1379109 - RNA, 11 nt, Human
gcccaggaagu

SEQ ID NO: 1379110 - RNA, 16 nt, Human
gcccacugugccucag

SEQ ID NO: 1379111 - RNA, 24 nt, Human
gcccacuguccugggccugcagaa

SEQ ID NO: 1379112 - RNA, 23 nt, Human
gcccacuguccugggccugcaga

SEQ ID NO: 1379113 - RNA, 21 nt, Human
gcccacuguccugggccugca

SEQ ID NO: 1379114 - RNA, 18 nt, Human
gcccacuguccugggccu

SEQ ID NO: 1379115 - RNA, 17 nt, Human
gcccacuguccugggcc

SEQ ID NO: 1379116 - RNA, 19 nt, Human
gcccacuuacauuuacaaa

SEQ ID NO: 1379117 - RNA, 23 nt, Human
gcccacugugccucagagaccag

SEQ ID NO: 1379118 - RNA, 22 nt, Human
gcccacugugccucagagacca

SEQ ID NO: 1379119 - RNA, 20 nt, Human
gcccacugugccucagagac

SEQ ID NO: 1379120 - RNA, 20 nt, Human
gccauuggcuauuuaaaacu

SEQ ID NO: 1379121 - RNA, 15 nt, Human
gcccacuguacuugc

SEQ ID NO: 1379122 - RNA, 20 nt, Human
gcccacuguacuugcucuug

SEQ ID NO: 1379123 - RNA, 15 nt, Human
gcccacuguccuggg

SEQ ID NO: 1379124 - RNA, 22 nt, Human
gcccacuguacuugcucuugau

SEQ ID NO: 1379125 - RNA, 12 nt, Human
gccauucuuucc

SEQ ID NO: 1379126 - RNA, 19 nt, Human
gccauucuuucccaacacc

SEQ ID NO: 1379127 - RNA, 12 nt, Human
gcauuuagaugu

SEQ ID NO: 1379128 - RNA, 13 nt, Human
gcauuuagaugua

SEQ ID NO: 1379129 - RNA, 14 nt, Human
gccauuaacaaaug

SEQ ID NO: 1379130 - RNA, 11 nt, Human
gcccccagagc

SEQ ID NO: 1379131 - RNA, 21 nt, Human
gcccccacuugccucuuccuu

SEQ ID NO: 1379132 - RNA, 17 nt, Human
gcccccacuugccucuu

SEQ ID NO: 1379133 - RNA, 16 nt, Human
gcccccacuugccucu

SEQ ID NO: 1379134 - RNA, 14 nt, Human
gcccccacuugccu

SEQ ID NO: 1379135 - RNA, 22 nt, Human
gccccaacccguggaggcugcu

SEQ ID NO: 1379136 - RNA, 23 nt, Human
gccccaacccguggaggcugcuc

SEQ ID NO: 1379137 - RNA, 21 nt, Human
gccccaacccguggaggcugc

SEQ ID NO: 1379138 - RNA, 19 nt, Human
gccccaacccguggaggcu

SEQ ID NO: 1379139 - RNA, 17 nt, Human
gccccaacccguggagg

SEQ ID NO: 1379140 - RNA, 15 nt, Human
gccccaacccgugga

SEQ ID NO: 1379141 - RNA, 15 nt, Human
gcccccagcuaagaa

SEQ ID NO: 1379142 - RNA, 22 nt, Human
gcccccagccugucagauccag

SEQ ID NO: 1379143 - RNA, 21 nt, Human
gcccccagccugucagaucca

SEQ ID NO: 1379144 - RNA, 16 nt, Human
gcccccagccugucag

SEQ ID NO: 1379145 - RNA, 14 nt, Human
gcccccagccuguc

SEQ ID NO: 1379146 - RNA, 13 nt, Human
gcccccagccugu

SEQ ID NO: 1379147 - RNA, 12 nt, Human
gcccccagccug

SEQ ID NO: 1379148 - RNA, 18 nt, Human
gcccccagcccccuccug

SEQ ID NO: 1379149 - RNA, 15 nt, Human
gcccccagcccccuc

SEQ ID NO: 1379150 - RNA, 18 nt, Human
gcccccagagcccaggcu

SEQ ID NO: 1379151 - RNA, 22 nt, Human
gcccccagcccagggcuccugc

SEQ ID NO: 1379152 - RNA, 21 nt, Human
gcccccagcccagggcuccug

SEQ ID NO: 1379153 - RNA, 18 nt, Human
gcccccagcccagggcuc

SEQ ID NO: 1379154 - RNA, 17 nt, Human
gcccccagcccagggcu

SEQ ID NO: 1379155 - RNA, 19 nt, Human
gcccccagagcccaggcuc

SEQ ID NO: 1379156 - RNA, 17 nt, Human
gcccccagagcccaggc

SEQ ID NO: 1379157 - RNA, 16 nt, Human
gcccccagagcccagg

SEQ ID NO: 1379158 - RNA, 13 nt, Human
gcccccagagccc

SEQ ID NO: 1379159 - RNA, 23 nt, Human
gcccccagcuaagaaccuggaac

SEQ ID NO: 1379160 - RNA, 22 nt, Human
gcccccagcuaagaaccuggaa

SEQ ID NO: 1379161 - RNA, 21 nt, Human
gcccccagcuaagaaccugga

SEQ ID NO: 1379162 - RNA, 13 nt, Human
gcccccugcagga

SEQ ID NO: 1379163 - RNA, 12 nt, Human
gcccccugcagg

SEQ ID NO: 1379164 - RNA, 12 nt, Human
gcccccugcaga

SEQ ID NO: 1379165 - RNA, 11 nt, Human
gcccccugcag

SEQ ID NO: 1379166 - RNA, 20 nt, Human
gcccccugaccacucagaga

SEQ ID NO: 1379167 - RNA, 19 nt, Human
gcccccugaccacucagag

SEQ ID NO: 1379168 - RNA, 18 nt, Human
gcccccugaccacucaga

SEQ ID NO: 1379169 - RNA, 17 nt, Human
gcccccugaccacucag

SEQ ID NO: 1379170 - RNA, 24 nt, Human
gcccccugcaggaaggagcugccu

SEQ ID NO: 1379171 - RNA, 22 nt, Human
gcccccugcaggaaggagcugc

SEQ ID NO: 1379172 - RNA, 21 nt, Human
gcccccugcaggaaggagcug

SEQ ID NO: 1379173 - RNA, 20 nt, Human
gcccccugcaggaaggagcu

SEQ ID NO: 1379174 - RNA, 18 nt, Human
gcccccugcaggaaggag

SEQ ID NO: 1379175 - RNA, 16 nt, Human
gcccccugcaggaagg

SEQ ID NO: 1379176 - RNA, 15 nt, Human
gcccccugcaggaag

SEQ ID NO: 1379177 - RNA, 17 nt, Human
gaauaugaaacauagau

SEQ ID NO: 1379178 - RNA, 14 nt, Human
gaauaugaaacaua

SEQ ID NO: 1379179 - RNA, 17 nt, Human
gaauaucuguaauggua

SEQ ID NO: 1379180 - RNA, 15 nt, Human
gaauaucuguaaugg

SEQ ID NO: 1379181 - RNA, 16 nt, Human
gaauauccaugaccua

SEQ ID NO: 1379182 - RNA, 22 nt, Human
gaauaucuccgucaacucauau

SEQ ID NO: 1379183 - RNA, 11 nt, Human
gaauaugccuu

SEQ ID NO: 1379184 - RNA, 15 nt, Human
gaauauauaaccagu

SEQ ID NO: 1379185 - RNA, 19 nt, Human
gaauauugccauuaugcuu

SEQ ID NO: 1379186 - RNA, 21 nt, Human
gacacagaaaauguugagaau

SEQ ID NO: 1379187 - RNA, 19 nt, Human
gacacagaaaauguugaga

SEQ ID NO: 1379188 - RNA, 18 nt, Human
gacaaauagaaaaugguc

SEQ ID NO: 1379189 - RNA, 17 nt, Human
gacaaauagaaaauggu

SEQ ID NO: 1379190 - RNA, 18 nt, Human
gacaaagguuuuccucuu

SEQ ID NO: 1379191 - RNA, 20 nt, Human
gaauuauucaauuuauuuga

SEQ ID NO: 1379192 - RNA, 23 nt, Human
gaauuaggcuguaacuacuuuau

SEQ ID NO: 1379193 - RNA, 19 nt, Human
gaauuaggcuguaacuacu

SEQ ID NO: 1379194 - RNA, 18 nt, Human
gaauuaggcuguaacuac

SEQ ID NO: 1379195 - RNA, 17 nt, Human
gaauuaggcuguaacua

SEQ ID NO: 1379196 - RNA, 16 nt, Human
gaauuaggcuguaacu

SEQ ID NO: 1379197 - RNA, 15 nt, Human
gaauuaggcuguaac

SEQ ID NO: 1379198 - RNA, 12 nt, Human
gaauuauuuugu

SEQ ID NO: 1379199 - RNA, 16 nt, Human
gaauuauucaauuuau

SEQ ID NO: 1379200 - RNA, 19 nt, Human
gaauuauuacaguguuuau

SEQ ID NO: 1379201 - RNA, 13 nt, Human
gacaaaggcaagc

SEQ ID NO: 1379202 - RNA, 18 nt, Human
gacaaaggagccugugaa

SEQ ID NO: 1379203 - RNA, 17 nt, Human
gacaaaggagccuguga

SEQ ID NO: 1379204 - RNA, 16 nt, Human
gacaaaggagccugug

SEQ ID NO: 1379205 - RNA, 15 nt, Human
gacaaaggagccugu

SEQ ID NO: 1379206 - RNA, 14 nt, Human
gacaaaggagccug

SEQ ID NO: 1379207 - RNA, 13 nt, Human
gacaaaggagccu

SEQ ID NO: 1379208 - RNA, 15 nt, Human
gacaaacuuugcauc

SEQ ID NO: 1379209 - RNA, 13 nt, Human
gacaaagaaccuu

SEQ ID NO: 1379210 - RNA, 18 nt, Human
gacaaaaaauuaaagcau

SEQ ID NO: 1379211 - RNA, 22 nt, Human
gaauuuuuuuuuccuagcccuc

SEQ ID NO: 1379212 - RNA, 21 nt, Human
gaauuuuuuuuaacauuccuc

SEQ ID NO: 1379213 - RNA, 20 nt, Human
gaauuuuuuuuaacauuccu

SEQ ID NO: 1379214 - RNA, 19 nt, Human
gaauuuuuuuuaacauucc

SEQ ID NO: 1379215 - RNA, 17 nt, Human
gaauuuuuuuuaacauu

SEQ ID NO: 1379216 - RNA, 16 nt, Human
gaauuuuuuuuaacau

SEQ ID NO: 1379217 - RNA, 15 nt, Human
gaauuuuuuuuaaca

SEQ ID NO: 1379218 - RNA, 16 nt, Human
gaauuauuuuuuuucu

SEQ ID NO: 1379219 - RNA, 22 nt, Human
gacaaacaccucccaggagaca

SEQ ID NO: 1379220 - RNA, 19 nt, Human
gacaaacaccucccaggag

SEQ ID NO: 1379221 - RNA, 14 nt, Human
gacaaaaagcuacu

SEQ ID NO: 1379222 - RNA, 20 nt, Human
gaauuaaauaaacccuuccu

SEQ ID NO: 1379223 - RNA, 12 nt, Human
gaauuaaauaaa

SEQ ID NO: 1379224 - RNA, 22 nt, Human
gaauuaaaguggaccaauaggg

SEQ ID NO: 1379225 - RNA, 14 nt, Human
gaauuaaaguacuu

SEQ ID NO: 1379226 - RNA, 20 nt, Human
gaauuaaacuuuuaauucau

SEQ ID NO: 1379227 - RNA, 13 nt, Human
gaauuaaacuuuu

SEQ ID NO: 1379228 - RNA, 14 nt, Human
gaauguuuuucuaa

SEQ ID NO: 1379229 - RNA, 18 nt, Human
gaaugauuuuucuuuaca

SEQ ID NO: 1379230 - RNA, 16 nt, Human
gaaugauuuuucuuua

SEQ ID NO: 1379231 - RNA, 14 nt, Human
gaaugauuuuucuu

SEQ ID NO: 1379232 - RNA, 20 nt, Human
gaauuacauuuguauaaaau

SEQ ID NO: 1379233 - RNA, 15 nt, Human
gaauuacgugcucug

SEQ ID NO: 1379234 - RNA, 19 nt, Human
gaauuacgugcucuguggg

SEQ ID NO: 1379235 - RNA, 18 nt, Human
gaauuacauuuguauaaa

SEQ ID NO: 1379236 - RNA, 15 nt, Human
gaauuacauuuguau

SEQ ID NO: 1379237 - RNA, 21 nt, Human
gaauuaauaucccuacaugua

SEQ ID NO: 1379238 - RNA, 22 nt, Human
gaauuaauaucccuacauguau

SEQ ID NO: 1379239 - RNA, 13 nt, Human
gaauuacauuugu

SEQ ID NO: 1379240 - RNA, 14 nt, Human
gaaugauuucaugc

SEQ ID NO: 1379241 - RNA, 15 nt, Human
gaaugauucaguguu

SEQ ID NO: 1379242 - RNA, 22 nt, Human
gaaugauuaugaauuacauuug

SEQ ID NO: 1379243 - RNA, 16 nt, Human
gaaugaguugaggcca

SEQ ID NO: 1379244 - RNA, 14 nt, Human
gaaugauuaugaau

SEQ ID NO: 1379245 - RNA, 17 nt, Human
gacccggcacccccugc

SEQ ID NO: 1379246 - RNA, 11 nt, Human
gaccccugcau

SEQ ID NO: 1379247 - RNA, 19 nt, Human
gacccggcacccccugcag

SEQ ID NO: 1379248 - RNA, 17 nt, Human
gacccugaccagcuccc

SEQ ID NO: 1379249 - RNA, 16 nt, Human
gacccugaaggggcca

SEQ ID NO: 1379250 - RNA, 20 nt, Human
gacccugagcugaccagccg

SEQ ID NO: 1379251 - RNA, 16 nt, Human
gacccugagcugacca

SEQ ID NO: 1379252 - RNA, 23 nt, Human
gacccugaccagcucccccuccc

SEQ ID NO: 1379253 - RNA, 18 nt, Human
gacccugaccagcucccc

SEQ ID NO: 1379254 - RNA, 12 nt, Human
gacgccuggggg

SEQ ID NO: 1379255 - RNA, 16 nt, Human
gacgccuggcugcuga

SEQ ID NO: 1379256 - RNA, 15 nt, Human
gacgccuggcugcug

SEQ ID NO: 1379257 - RNA, 14 nt, Human
gacgccuggcugcu

SEQ ID NO: 1379258 - RNA, 14 nt, Human
gacgccugaggaac

SEQ ID NO: 1379259 - RNA, 13 nt, Human
gacgccugaggaa

SEQ ID NO: 1379260 - RNA, 14 nt, Human
gacgccaggguaug

SEQ ID NO: 1379261 - RNA, 19 nt, Human
gaccuccagcuuuccugua

SEQ ID NO: 1379262 - RNA, 18 nt, Human
gaccuccagcuuuccugu

SEQ ID NO: 1379263 - RNA, 16 nt, Human
gaccuccagcuuuccu

SEQ ID NO: 1379264 - RNA, 14 nt, Human
gaccuccagcuguu

SEQ ID NO: 1379265 - RNA, 21 nt, Human
gaccucaguuuuaucauuuuc

SEQ ID NO: 1379266 - RNA, 20 nt, Human
gaccucaguuuuaucauuuu

SEQ ID NO: 1379267 - RNA, 16 nt, Human
gaccucugcagcaaua

SEQ ID NO: 1379268 - RNA, 17 nt, Human
gaccuccuaacaaguag

SEQ ID NO: 1379269 - RNA, 18 nt, Human
gaccucugcagcaauaaa

SEQ ID NO: 1379270 - RNA, 22 nt, Human
gaccucugcagcaauaaagcag

SEQ ID NO: 1379271 - RNA, 16 nt, Human
gacacugguuugaaga

SEQ ID NO: 1379272 - RNA, 14 nt, Human
gacacuggugggga

SEQ ID NO: 1379273 - RNA, 15 nt, Human
gacacuggccccuca

SEQ ID NO: 1379274 - RNA, 14 nt, Human
gacacuggccccuc

SEQ ID NO: 1379275 - RNA, 13 nt, Human
gacacuggccccu

SEQ ID NO: 1379276 - RNA, 12 nt, Human
gacacuggcaug

SEQ ID NO: 1379277 - RNA, 13 nt, Human
gacacugcuggag

SEQ ID NO: 1379278 - RNA, 21 nt, Human
gacacugcucuaacagcccuc

SEQ ID NO: 1379279 - RNA, 20 nt, Human
gacacugcucuaacagcccu

SEQ ID NO: 1379280 - RNA, 14 nt, Human
gacacugcucuaac

SEQ ID NO: 1379281 - RNA, 23 nt, Human
gacacuuuaauuaccaaccuguu

SEQ ID NO: 1379282 - RNA, 15 nt, Human
gacagccccacccug

SEQ ID NO: 1379283 - RNA, 14 nt, Human
gacagccccacccu

SEQ ID NO: 1379284 - RNA, 17 nt, Human
gacauguggggccaggu

SEQ ID NO: 1379285 - RNA, 20 nt, Human
gacaugugacauuuauauau

SEQ ID NO: 1379286 - RNA, 16 nt, Human
gacaugugacauuuau

SEQ ID NO: 1379287 - RNA, 12 nt, Human
gacaugugacau

SEQ ID NO: 1379288 - RNA, 21 nt, Human
gacaguccgucaaaacagauu

SEQ ID NO: 1379289 - RNA, 18 nt, Human
gacagucaccucauggaa

SEQ ID NO: 1379290 - RNA, 21 nt, Human
gacauugcguuugaccuuuua

SEQ ID NO: 1379291 - RNA, 14 nt, Human
gacauugcguuuga

SEQ ID NO: 1379292 - RNA, 23 nt, Human
gacauuggcaccuaauccaggca

SEQ ID NO: 1379293 - RNA, 23 nt, Human
gacauuugggagacaugugacau

SEQ ID NO: 1379294 - RNA, 22 nt, Human
gacauuugggagacaugugaca

SEQ ID NO: 1379295 - RNA, 20 nt, Human
gacauuuuaaaaaaugguca

SEQ ID NO: 1379296 - RNA, 13 nt, Human
gacauuuuacauu

SEQ ID NO: 1379297 - RNA, 14 nt, Human
gacauuuuacauua

SEQ ID NO: 1379298 - RNA, 15 nt, Human
gacauuuuacauuaa

SEQ ID NO: 1379299 - RNA, 21 nt, Human
gacauuuuacauuaaauuuuu

SEQ ID NO: 1379300 - RNA, 19 nt, Human
gaggcauggucugcccucu

SEQ ID NO: 1379301 - RNA, 21 nt, Human
gaggcauuuguuugaacugau

SEQ ID NO: 1379302 - RNA, 19 nt, Human
gaggcauuuguuugaacug

SEQ ID NO: 1379303 - RNA, 11 nt, Human
gaggggagggg

SEQ ID NO: 1379304 - RNA, 17 nt, Human
gaggggaccaggagugg

SEQ ID NO: 1379305 - RNA, 21 nt, Human
gaggggaccaggagugggugg

SEQ ID NO: 1379306 - RNA, 22 nt, Human
gagggccucaaaggcccgcucu

SEQ ID NO: 1379307 - RNA, 13 nt, Human
gaggggcagagcc

SEQ ID NO: 1379308 - RNA, 20 nt, Human
gaggggcagagccaggaaga

SEQ ID NO: 1379309 - RNA, 16 nt, Human
gaggggcagagccagg

SEQ ID NO: 1379310 - RNA, 18 nt, Human
gaggagauucugccuuug

SEQ ID NO: 1379311 - RNA, 17 nt, Human
gaggagaugcuccuugg

SEQ ID NO: 1379312 - RNA, 20 nt, Human
gaggagcagcaggagggggg

SEQ ID NO: 1379313 - RNA, 21 nt, Human
gaggagcagcaggagggggga

SEQ ID NO: 1379314 - RNA, 16 nt, Human
gaggagcagcaggagg

SEQ ID NO: 1379315 - RNA, 15 nt, Human
gaggagcagcaggag

SEQ ID NO: 1379316 - RNA, 22 nt, Human
gaggacuugugucucugugcuu

SEQ ID NO: 1379317 - RNA, 18 nt, Human
gaggacuugugucucugu

SEQ ID NO: 1379318 - RNA, 21 nt, Human
gaggacuguagggagggcggc

SEQ ID NO: 1379319 - RNA, 20 nt, Human
gaggacuguagggagggcgg

SEQ ID NO: 1379320 - RNA, 15 nt, Human
gaggacccagggcuc

SEQ ID NO: 1379321 - RNA, 14 nt, Human
gaggacccagggcu

SEQ ID NO: 1379322 - RNA, 20 nt, Human
gaggacccaggaaaggcagg

SEQ ID NO: 1379323 - RNA, 17 nt, Human
gaggacuugugucucug

SEQ ID NO: 1379324 - RNA, 16 nt, Human
gaggacuugugucucu

SEQ ID NO: 1379325 - RNA, 14 nt, Human
gaggacuugugucu

SEQ ID NO: 1379326 - RNA, 16 nt, Human
gaggacccagggcucu

SEQ ID NO: 1379327 - RNA, 12 nt, Human
gaggacccagga

SEQ ID NO: 1379328 - RNA, 11 nt, Human
gaggacccagg

SEQ ID NO: 1379329 - RNA, 14 nt, Human
gaggacccaggaca

SEQ ID NO: 1379330 - RNA, 15 nt, Human
gaggacccaggacag

SEQ ID NO: 1379331 - RNA, 20 nt, Human
gagcccagggaggccgaagc

SEQ ID NO: 1379332 - RNA, 14 nt, Human
gagcaugagaggag

SEQ ID NO: 1379333 - RNA, 17 nt, Human
gagcaugagaggaggca

SEQ ID NO: 1379334 - RNA, 23 nt, Human
gagcaugagaggaggcagcagga

SEQ ID NO: 1379335 - RNA, 17 nt, Human
gagcccagggaggccga

SEQ ID NO: 1379336 - RNA, 16 nt, Human
gagcaguccuuggccu

SEQ ID NO: 1379337 - RNA, 14 nt, Human
gagcaguccuuggc

SEQ ID NO: 1379338 - RNA, 13 nt, Human
gagcaguccuugg

SEQ ID NO: 1379339 - RNA, 14 nt, Human
gagcagucaggaaa

SEQ ID NO: 1379340 - RNA, 12 nt, Human
gagccccuccua

SEQ ID NO: 1379341 - RNA, 17 nt, Human
gagccccacccucagau

SEQ ID NO: 1379342 - RNA, 16 nt, Human
gagccccacccucaga

SEQ ID NO: 1379343 - RNA, 21 nt, Human
gagccccuucugcucagcucu

SEQ ID NO: 1379344 - RNA, 20 nt, Human
gagccccuucugcucagcuc

SEQ ID NO: 1379345 - RNA, 17 nt, Human
gagccccuucugcucag

SEQ ID NO: 1379346 - RNA, 22 nt, Human
gagccccuucugcucagcucug

SEQ ID NO: 1379347 - RNA, 12 nt, Human
gagcccugggag

SEQ ID NO: 1379348 - RNA, 16 nt, Human
gagcccugggaggcuc

SEQ ID NO: 1379349 - RNA, 18 nt, Human
gagcccugggaggcucug

SEQ ID NO: 1379350 - RNA, 19 nt, Human
gagcccugggaggcucugg

SEQ ID NO: 1379351 - RNA, 20 nt, Human
gagcccugggaggcucugga

SEQ ID NO: 1379352 - RNA, 12 nt, Human
gagcuggcucug

SEQ ID NO: 1379353 - RNA, 12 nt, Human
gagcccugggac

SEQ ID NO: 1379354 - RNA, 22 nt, Human
gagcuggagaugaggccagacc

SEQ ID NO: 1379355 - RNA, 23 nt, Human
gagcuggagaugaggccagacca

SEQ ID NO: 1379356 - RNA, 21 nt, Human
gagcuggagaugaggccagac

SEQ ID NO: 1379357 - RNA, 17 nt, Human
gagcuguuuacuaggga

SEQ ID NO: 1379358 - RNA, 22 nt, Human
gagaaucuauauuuaacaagau

SEQ ID NO: 1379359 - RNA, 15 nt, Human
gagaaucuauauuua

SEQ ID NO: 1379360 - RNA, 21 nt, Human
gagaaucuacccccagaucca

SEQ ID NO: 1379361 - RNA, 20 nt, Human
gagaauaaauugauuuuuau

SEQ ID NO: 1379362 - RNA, 16 nt, Human
gagaaguuguaaagua

SEQ ID NO: 1379363 - RNA, 19 nt, Human
gagaccggccugccaggag

SEQ ID NO: 1379364 - RNA, 18 nt, Human
gagaccggccugccagga

SEQ ID NO: 1379365 - RNA, 17 nt, Human
gagaccggccugccagg

SEQ ID NO: 1379366 - RNA, 15 nt, Human
gagaccggccugcca

SEQ ID NO: 1379367 - RNA, 20 nt, Human
gagaccggccugccaggagg

SEQ ID NO: 1379368 - RNA, 21 nt, Human
gagaccggccugccaggagga

SEQ ID NO: 1379369 - RNA, 23 nt, Human
gagacgggacugcggaggaagga

SEQ ID NO: 1379370 - RNA, 17 nt, Human
gagaagugugccuucuc

SEQ ID NO: 1379371 - RNA, 16 nt, Human
gagaaguauacauaag

SEQ ID NO: 1379372 - RNA, 22 nt, Human
gagaaggauaggccuucauuaa

SEQ ID NO: 1379373 - RNA, 13 nt, Human
gagaaggagcaga

SEQ ID NO: 1379374 - RNA, 16 nt, Human
gacuuuuugcauuuaa

SEQ ID NO: 1379375 - RNA, 19 nt, Human
gacuuuuuuuuuuuauaau

SEQ ID NO: 1379376 - RNA, 22 nt, Human
gacuuuuuauggcacuaguauu

SEQ ID NO: 1379377 - RNA, 19 nt, Human
gagacuccagaccugaggc

SEQ ID NO: 1379378 - RNA, 16 nt, Human
gagacgggcccuggug

SEQ ID NO: 1379379 - RNA, 19 nt, Human
gagagcuaggagcaaagcc

SEQ ID NO: 1379380 - RNA, 22 nt, Human
gagagcuaggagcaaagccugu

SEQ ID NO: 1379381 - RNA, 14 nt, Human
gagagcuaggagca

SEQ ID NO: 1379382 - RNA, 13 nt, Human
gagagcuaggagc

SEQ ID NO: 1379383 - RNA, 14 nt, Human
gagagggaauguga

SEQ ID NO: 1379384 - RNA, 15 nt, Human
gagagggaaugugaa

SEQ ID NO: 1379385 - RNA, 21 nt, Human
gagaggcccuggaucagcgug

SEQ ID NO: 1379386 - RNA, 18 nt, Human
gagaggccuuuuggaaug

SEQ ID NO: 1379387 - RNA, 15 nt, Human
gagaggccuuuugga

SEQ ID NO: 1379388 - RNA, 24 nt, Human
gagaggcccuggaucagcguggcc

SEQ ID NO: 1379389 - RNA, 13 nt, Human
gagaggcccugga

SEQ ID NO: 1379390 - RNA, 12 nt, Human
gagaggcccugg

SEQ ID NO: 1379391 - RNA, 17 nt, Human
gagaggaggcagcagga

SEQ ID NO: 1379392 - RNA, 20 nt, Human
gagaggacuguagggagggc

SEQ ID NO: 1379393 - RNA, 17 nt, Human
gagaggacaagaugggu

SEQ ID NO: 1379394 - RNA, 22 nt, Human
gagauguguguugauacuguug

SEQ ID NO: 1379395 - RNA, 23 nt, Human
gagauguguguugauacuguugc

SEQ ID NO: 1379396 - RNA, 21 nt, Human
gagauguguguugauacuguu

SEQ ID NO: 1379397 - RNA, 18 nt, Human
gagauguguguugauacu

SEQ ID NO: 1379398 - RNA, 17 nt, Human
gagauguguguugauac

SEQ ID NO: 1379399 - RNA, 17 nt, Human
gagauucaguuuucauu

SEQ ID NO: 1379400 - RNA, 14 nt, Human
gagauucagacugu

SEQ ID NO: 1379401 - RNA, 14 nt, Human
gagauuacaggcau

SEQ ID NO: 1379402 - RNA, 15 nt, Human
gagauuaccuccuga

SEQ ID NO: 1379403 - RNA, 14 nt, Human
gagaugccucccug

SEQ ID NO: 1379404 - RNA, 16 nt, Human
gagaugucuuggaaca

SEQ ID NO: 1379405 - RNA, 15 nt, Human
gagaugucuuggaac

SEQ ID NO: 1379406 - RNA, 15 nt, Human
gagaugccucccuga

SEQ ID NO: 1379407 - RNA, 22 nt, Human
gcagccacacuucucaggacac

SEQ ID NO: 1379408 - RNA, 21 nt, Human
gcagccacacuucucaggaca

SEQ ID NO: 1379409 - RNA, 20 nt, Human
gcagccacacuucucaggac

SEQ ID NO: 1379410 - RNA, 19 nt, Human
gcagccacacuucucagga

SEQ ID NO: 1379411 - RNA, 18 nt, Human
gcagccacacuucucagg

SEQ ID NO: 1379412 - RNA, 20 nt, Human
gcagcaucucuaccuucucc

SEQ ID NO: 1379413 - RNA, 22 nt, Human
gcagcaucucuaccuucucccc

SEQ ID NO: 1379414 - RNA, 14 nt, Human
gcagcaucucuacc

SEQ ID NO: 1379415 - RNA, 23 nt, Human
gcagcaucggacaagacccccag

SEQ ID NO: 1379416 - RNA, 23 nt, Human
gcagcagugugaggccagggcag

SEQ ID NO: 1379417 - RNA, 22 nt, Human
gcagcagugugaggccagggca

SEQ ID NO: 1379418 - RNA, 21 nt, Human
gcagcagugugaggccagggc

SEQ ID NO: 1379419 - RNA, 20 nt, Human
gcagcagugugaggccaggg

SEQ ID NO: 1379420 - RNA, 19 nt, Human
gcagcagugugaggccagg

SEQ ID NO: 1379421 - RNA, 15 nt, Human
gcagcagugugaggc

SEQ ID NO: 1379422 - RNA, 24 nt, Human
gcagagggcuggaggcccaggcug

SEQ ID NO: 1379423 - RNA, 23 nt, Human
gcagagggcuggaggcccaggcu

SEQ ID NO: 1379424 - RNA, 21 nt, Human
gcagagggcuggaggcccagg

SEQ ID NO: 1379425 - RNA, 20 nt, Human
gcagagggcuggaggcccag

SEQ ID NO: 1379426 - RNA, 19 nt, Human
gcagagggcuggaggccca

SEQ ID NO: 1379427 - RNA, 18 nt, Human
gcagagggcuggaggccc

SEQ ID NO: 1379428 - RNA, 17 nt, Human
gcagagggcuggaggcc

SEQ ID NO: 1379429 - RNA, 22 nt, Human
gcagaggccugggcugggaaaa

SEQ ID NO: 1379430 - RNA, 20 nt, Human
gcagaggccugggcugggaa

SEQ ID NO: 1379431 - RNA, 17 nt, Human
gcagaggccugggcugg

SEQ ID NO: 1379432 - RNA, 14 nt, Human
gcagaggccugggc

SEQ ID NO: 1379433 - RNA, 20 nt, Human
gcagaggcccaggcugccgu

SEQ ID NO: 1379434 - RNA, 21 nt, Human
gcagaggcccacauuggaaga

SEQ ID NO: 1379435 - RNA, 14 nt, Human
gcagaggcccacau

SEQ ID NO: 1379436 - RNA, 15 nt, Human
gcagaggccagaggc

SEQ ID NO: 1379437 - RNA, 16 nt, Human
gcagagggcuggaggc

SEQ ID NO: 1379438 - RNA, 14 nt, Human
gcagagggcuggag

SEQ ID NO: 1379439 - RNA, 13 nt, Human
gcagagggcugga

SEQ ID NO: 1379440 - RNA, 12 nt, Human
gcagagggcugg

SEQ ID NO: 1379441 - RNA, 12 nt, Human
gcagaggccaga

SEQ ID NO: 1379442 - RNA, 21 nt, Human
gcagaggcaguaccugggcaa

SEQ ID NO: 1379443 - RNA, 18 nt, Human
gcagaggcaguaccuggg

SEQ ID NO: 1379444 - RNA, 14 nt, Human
gcagagcuggugcg

SEQ ID NO: 1379445 - RNA, 21 nt, Human
gcagagcuggugcggcuggcc

SEQ ID NO: 1379446 - RNA, 21 nt, Human
gcagagcugauggagaaggaa

SEQ ID NO: 1379447 - RNA, 22 nt, Human
gcagagcugauggagaaggaag

SEQ ID NO: 1379448 - RNA, 13 nt, Human
gcagagcuggugc

SEQ ID NO: 1379449 - RNA, 12 nt, Human
gcagagcuggug

SEQ ID NO: 1379450 - RNA, 23 nt, Human
gcagagcuggcucugagcgccuc

SEQ ID NO: 1379451 - RNA, 17 nt, Human
gcagagcuggcucugag

SEQ ID NO: 1379452 - RNA, 15 nt, Human
gcagagcuggcucug

SEQ ID NO: 1379453 - RNA, 14 nt, Human
gcagagcuggcucu

SEQ ID NO: 1379454 - RNA, 13 nt, Human
gcagagcuggcuc

SEQ ID NO: 1379455 - RNA, 12 nt, Human
gcagagcuggcu

SEQ ID NO: 1379456 - RNA, 23 nt, Human
gcagagcugauggagaaggaagg

SEQ ID NO: 1379457 - RNA, 20 nt, Human
gcagaaccggagagccagcu

SEQ ID NO: 1379458 - RNA, 19 nt, Human
gcagaaccggagagccagc

SEQ ID NO: 1379459 - RNA, 19 nt, Human
gcagaaagcaucccucacc

SEQ ID NO: 1379460 - RNA, 17 nt, Human
gcagaaaauucugugcc

SEQ ID NO: 1379461 - RNA, 21 nt, Human
gcagaaaacccuugggccaga

SEQ ID NO: 1379462 - RNA, 22 nt, Human
gcagaaaacccuugggccagaa

SEQ ID NO: 1379463 - RNA, 17 nt, Human
gcagaaaacccuugggc

SEQ ID NO: 1379464 - RNA, 16 nt, Human
gcagaaaacccuuggg

SEQ ID NO: 1379465 - RNA, 20 nt, Human
gcagccagggagagcccagg

SEQ ID NO: 1379466 - RNA, 19 nt, Human
gcagccagggagagcccag

SEQ ID NO: 1379467 - RNA, 18 nt, Human
gcagccagggagagccca

SEQ ID NO: 1379468 - RNA, 17 nt, Human
gcagccagggagagccc

SEQ ID NO: 1379469 - RNA, 16 nt, Human
gcagccagggagagcc

SEQ ID NO: 1379470 - RNA, 15 nt, Human
gcagccagggagagc

SEQ ID NO: 1379471 - RNA, 14 nt, Human
gcagccagggagag

SEQ ID NO: 1379472 - RNA, 12 nt, Human
gcagccagggag

SEQ ID NO: 1379473 - RNA, 21 nt, Human
gcagccagcccugccuggagg

SEQ ID NO: 1379474 - RNA, 22 nt, Human
gcagccagcccugccuggagga

SEQ ID NO: 1379475 - RNA, 20 nt, Human
gcagccagcccugccuggag

SEQ ID NO: 1379476 - RNA, 19 nt, Human
gcagccagcccugccugga

SEQ ID NO: 1379477 - RNA, 18 nt, Human
gcagccagcccugccugg

SEQ ID NO: 1379478 - RNA, 17 nt, Human
gcagccagcccugccug

SEQ ID NO: 1379479 - RNA, 16 nt, Human
gcagccagcccugccu

SEQ ID NO: 1379480 - RNA, 15 nt, Human
gcagccagcccugcc

SEQ ID NO: 1379481 - RNA, 14 nt, Human
gcagccagcccugc

SEQ ID NO: 1379482 - RNA, 13 nt, Human
gcagccagcccug

SEQ ID NO: 1379483 - RNA, 17 nt, Human
gcagccagcaucugggc

SEQ ID NO: 1379484 - RNA, 11 nt, Human
gcagccagccc

SEQ ID NO: 1379485 - RNA, 19 nt, Human
gcagccagcaucugggccu

SEQ ID NO: 1379486 - RNA, 19 nt, Human
gcagccagugcccugagcc

SEQ ID NO: 1379487 - RNA, 18 nt, Human
gcagccagugcccugagc

SEQ ID NO: 1379488 - RNA, 17 nt, Human
gcagccagugcccugag

SEQ ID NO: 1379489 - RNA, 16 nt, Human
gcagccagugcccuga

SEQ ID NO: 1379490 - RNA, 21 nt, Human
gcagccagggagagcccagga

SEQ ID NO: 1379491 - RNA, 16 nt, Human
gcagcuccucugucuc

SEQ ID NO: 1379492 - RNA, 15 nt, Human
gcagcucuccccuuc

SEQ ID NO: 1379493 - RNA, 20 nt, Human
gcagcuccucugucucgagc

SEQ ID NO: 1379494 - RNA, 13 nt, Human
gcagcuccucugu

SEQ ID NO: 1379495 - RNA, 15 nt, Human
gcagcugagcagggc

SEQ ID NO: 1379496 - RNA, 14 nt, Human
gcagcugagcaggg

SEQ ID NO: 1379497 - RNA, 12 nt, Human
gcagcugagcag

SEQ ID NO: 1379498 - RNA, 20 nt, Human
gcagcucuggacagccccac

SEQ ID NO: 1379499 - RNA, 21 nt, Human
gcagcugccaggagcacggcu

SEQ ID NO: 1379500 - RNA, 20 nt, Human
gcagcugagcagggccgggg

SEQ ID NO: 1379501 - RNA, 21 nt, Human
gcagcugagcagggccgggga

SEQ ID NO: 1379502 - RNA, 19 nt, Human
gcagcugagcagggccggg

SEQ ID NO: 1379503 - RNA, 18 nt, Human
gcagcugagcagggccgg

SEQ ID NO: 1379504 - RNA, 17 nt, Human
gcagcugagcagggccg

SEQ ID NO: 1379505 - RNA, 16 nt, Human
gcagcugagcagggcc

SEQ ID NO: 1379506 - RNA, 19 nt, Human
gcagucgugccugugucca

SEQ ID NO: 1379507 - RNA, 18 nt, Human
gcagucgugccugugucc

SEQ ID NO: 1379508 - RNA, 17 nt, Human
gcagucgugccuguguc

SEQ ID NO: 1379509 - RNA, 16 nt, Human
gcagucgugccugugu

SEQ ID NO: 1379510 - RNA, 17 nt, Human
gcagcugccaggagcac

SEQ ID NO: 1379511 - RNA, 17 nt, Human
gcagucucuauaccaau

SEQ ID NO: 1379512 - RNA, 20 nt, Human
gcagugaaugauucaguguu

SEQ ID NO: 1379513 - RNA, 18 nt, Human
gcagucucuauaccaaua

SEQ ID NO: 1379514 - RNA, 20 nt, Human
gcagucucuauaccaauaaa

SEQ ID NO: 1379515 - RNA, 21 nt, Human
gcagucucuauaccaauaaag

SEQ ID NO: 1379516 - RNA, 22 nt, Human
gcagucucuauaccaauaaagu

SEQ ID NO: 1379517 - RNA, 23 nt, Human
gcagucucuauaccaauaaagug

SEQ ID NO: 1379518 - RNA, 16 nt, Human
gcaguugucucuguuu

SEQ ID NO: 1379519 - RNA, 15 nt, Human
gcaguugucucuguu

SEQ ID NO: 1379520 - RNA, 14 nt, Human
gcaguugucucugu

SEQ ID NO: 1379521 - RNA, 13 nt, Human
gcaguugucucug

SEQ ID NO: 1379522 - RNA, 15 nt, Human
gcauacguacacauu

SEQ ID NO: 1379523 - RNA, 16 nt, Human
gcauacguacacauuu

SEQ ID NO: 1379524 - RNA, 17 nt, Human
gcauacguacacauuuu

SEQ ID NO: 1379525 - RNA, 22 nt, Human
gcaguuguugcccacagcugua

SEQ ID NO: 1379526 - RNA, 15 nt, Human
gcaguuuaucauuca

SEQ ID NO: 1379527 - RNA, 14 nt, Human
gcaguuuaucauuc

SEQ ID NO: 1379528 - RNA, 18 nt, Human
gcaguuuauauuuaacuc

SEQ ID NO: 1379529 - RNA, 15 nt, Human
gcaguuuauauuuaa

SEQ ID NO: 1379530 - RNA, 18 nt, Human
gcauacguacacauuuua

SEQ ID NO: 1379531 - RNA, 22 nt, Human
gcauuuaaccccccuguacaca

SEQ ID NO: 1379532 - RNA, 21 nt, Human
gcauuuaaccccccuguacac

SEQ ID NO: 1379533 - RNA, 20 nt, Human
gcauuuaaccccccuguaca

SEQ ID NO: 1379534 - RNA, 18 nt, Human
gcauuuaaaagauacagu

SEQ ID NO: 1379535 - RNA, 22 nt, Human
gcauuuaaaagauacaguuacu

SEQ ID NO: 1379536 - RNA, 16 nt, Human
gcauuuaaaagauaca

SEQ ID NO: 1379537 - RNA, 17 nt, Human
gcauuuaaaagauacag

SEQ ID NO: 1379538 - RNA, 17 nt, Human
gcaugguuucagcacua

SEQ ID NO: 1379539 - RNA, 16 nt, Human
gcaugguuucagcacu

SEQ ID NO: 1379540 - RNA, 14 nt, Human
gcaugguuucagca

SEQ ID NO: 1379541 - RNA, 13 nt, Human
gcaugguuucagc

SEQ ID NO: 1379542 - RNA, 20 nt, Human
gcaugguguucuccugcugc

SEQ ID NO: 1379543 - RNA, 18 nt, Human
gcaugguguucuccugcu

SEQ ID NO: 1379544 - RNA, 17 nt, Human
gcaugguguucuccugc

SEQ ID NO: 1379545 - RNA, 21 nt, Human
gcauguaacgcaaguucccag

SEQ ID NO: 1379546 - RNA, 17 nt, Human
gcauguaacgcaaguuc

SEQ ID NO: 1379547 - RNA, 16 nt, Human
gcaugguguucuccug

SEQ ID NO: 1379548 - RNA, 15 nt, Human
gcaugguguucuccu

SEQ ID NO: 1379549 - RNA, 23 nt, Human
gcauggugccccaggaccagcuc

SEQ ID NO: 1379550 - RNA, 21 nt, Human
gcauggugccccaggaccagc

SEQ ID NO: 1379551 - RNA, 20 nt, Human
gcauggugccccaggaccag

SEQ ID NO: 1379552 - RNA, 19 nt, Human
gcauggugccccaggacca

SEQ ID NO: 1379553 - RNA, 18 nt, Human
gcauggugccccaggacc

SEQ ID NO: 1379554 - RNA, 17 nt, Human
gcauggugccccaggac

SEQ ID NO: 1379555 - RNA, 16 nt, Human
gcauggugccccagga

SEQ ID NO: 1379556 - RNA, 15 nt, Human
gcauggugccccagg

SEQ ID NO: 1379557 - RNA, 23 nt, Human
gcauggucccacaucccugggcc

SEQ ID NO: 1379558 - RNA, 21 nt, Human
gcauggucccacaucccuggg

SEQ ID NO: 1379559 - RNA, 20 nt, Human
gcauggucccacaucccugg

SEQ ID NO: 1379560 - RNA, 19 nt, Human
gcauggucccacaucccug

SEQ ID NO: 1379561 - RNA, 18 nt, Human
gcauggucacacacugau

SEQ ID NO: 1379562 - RNA, 15 nt, Human
gcauggucacacacu

SEQ ID NO: 1379563 - RNA, 17 nt, Human
gcaucggggagccggga

SEQ ID NO: 1379564 - RNA, 20 nt, Human
gcauccucuggagccagccg

SEQ ID NO: 1379565 - RNA, 18 nt, Human
gcauccucuggagccagc

SEQ ID NO: 1379566 - RNA, 16 nt, Human
gcauccucuggagcca

SEQ ID NO: 1379567 - RNA, 14 nt, Human
gcauccucuggagc

SEQ ID NO: 1379568 - RNA, 17 nt, Human
gcauccuccagccccug

SEQ ID NO: 1379569 - RNA, 15 nt, Human
gcauccuccagcccc

SEQ ID NO: 1379570 - RNA, 14 nt, Human
gcauccuccagccc

SEQ ID NO: 1379571 - RNA, 15 nt, Human
gcauggcuauuuuau

SEQ ID NO: 1379572 - RNA, 23 nt, Human
gcaucuagaggcuuccuucauuu

SEQ ID NO: 1379573 - RNA, 22 nt, Human
gcaucuagaggcuuccuucauu

SEQ ID NO: 1379574 - RNA, 21 nt, Human
gcaucuagaggcuuccuucau

SEQ ID NO: 1379575 - RNA, 22 nt, Human
gcaucuaaguuauaagacucuc

SEQ ID NO: 1379576 - RNA, 19 nt, Human
gcaucuaaguuauaagacu

SEQ ID NO: 1379577 - RNA, 23 nt, Human
gcaucgucaugcacaguauuugu

SEQ ID NO: 1379578 - RNA, 20 nt, Human
gcaucuagcaugucgucaaa

SEQ ID NO: 1379579 - RNA, 21 nt, Human
gcauccagagucccugccugg

SEQ ID NO: 1379580 - RNA, 23 nt, Human
gcauccagagucccugccuggac

SEQ ID NO: 1379581 - RNA, 22 nt, Human
gcauccagagucccugccugga

SEQ ID NO: 1379582 - RNA, 19 nt, Human
gcauccauucuccugagga

SEQ ID NO: 1379583 - RNA, 11 nt, Human
gcauccagccu

SEQ ID NO: 1379584 - RNA, 13 nt, Human
gcauccuccagcc

SEQ ID NO: 1379585 - RNA, 12 nt, Human
gcauccuccagc

SEQ ID NO: 1379586 - RNA, 18 nt, Human
gcauccuccacaauagca

SEQ ID NO: 1379587 - RNA, 18 nt, Human
gcauccgcaggugcuggu

SEQ ID NO: 1379588 - RNA, 20 nt, Human
gcauccgcaggugcuggucc

SEQ ID NO: 1379589 - RNA, 17 nt, Human
gcauccgcaggugcugg

SEQ ID NO: 1379590 - RNA, 16 nt, Human
gcauccgcaggugcug

SEQ ID NO: 1379591 - RNA, 15 nt, Human
gcauccgcaggugcu

SEQ ID NO: 1379592 - RNA, 19 nt, Human
gcaucccugggccuugggc

SEQ ID NO: 1379593 - RNA, 20 nt, Human
gcaucccugggccuugggcu

SEQ ID NO: 1379594 - RNA, 18 nt, Human
gcaucccugggccuuggg

SEQ ID NO: 1379595 - RNA, 17 nt, Human
gcaucccugggccuugg

SEQ ID NO: 1379596 - RNA, 15 nt, Human
gcaucccugggccuu

SEQ ID NO: 1379597 - RNA, 12 nt, Human
gcaucccugggc

SEQ ID NO: 1379598 - RNA, 17 nt, Human
gcauccauucuccugag

SEQ ID NO: 1379599 - RNA, 16 nt, Human
gcauccauucuccuga

SEQ ID NO: 1379600 - RNA, 21 nt, Human
gcaucccucacccauccuaga

SEQ ID NO: 1379601 - RNA, 15 nt, Human
gauauuucuagcuua

SEQ ID NO: 1379602 - RNA, 22 nt, Human
gauauuugucaugcugggauuu

SEQ ID NO: 1379603 - RNA, 12 nt, Human
gauagaaugaca

SEQ ID NO: 1379604 - RNA, 19 nt, Human
gauagaaaugccaagcacu

SEQ ID NO: 1379605 - RNA, 14 nt, Human
gauagaaaugccaa

SEQ ID NO: 1379606 - RNA, 13 nt, Human
gauagaaaugcca

SEQ ID NO: 1379607 - RNA, 23 nt, Human
gauacuuggauuuaguuucagua

SEQ ID NO: 1379608 - RNA, 13 nt, Human
gauacuuggauuu

SEQ ID NO: 1379609 - RNA, 20 nt, Human
gauacuuggauuuaguuuca

SEQ ID NO: 1379610 - RNA, 17 nt, Human
gaucaaaggcacacagc

SEQ ID NO: 1379611 - RNA, 18 nt, Human
gaucaaagaugaaaagua

SEQ ID NO: 1379612 - RNA, 15 nt, Human
gaucaaagaugaaaa

SEQ ID NO: 1379613 - RNA, 12 nt, Human
gaucaaagauga

SEQ ID NO: 1379614 - RNA, 16 nt, Human
gaucaaaaacuauuug

SEQ ID NO: 1379615 - RNA, 14 nt, Human
gauauuuucucuag

SEQ ID NO: 1379616 - RNA, 21 nt, Human
gauauuuucugugccugaaua

SEQ ID NO: 1379617 - RNA, 15 nt, Human
gauauuuucugugcc

SEQ ID NO: 1379618 - RNA, 15 nt, Human
gauauuuugcuuugu

SEQ ID NO: 1379619 - RNA, 20 nt, Human
gauccaacuaaugccuuacu

SEQ ID NO: 1379620 - RNA, 19 nt, Human
gauccaacuaaugccuuac

SEQ ID NO: 1379621 - RNA, 23 nt, Human
gauccaaaagaagcccccagcua

SEQ ID NO: 1379622 - RNA, 22 nt, Human
gauccaaaagaagcccccagcu

SEQ ID NO: 1379623 - RNA, 20 nt, Human
gauccaaaagaagcccccag

SEQ ID NO: 1379624 - RNA, 19 nt, Human
gauccaaaagaagccccca

SEQ ID NO: 1379625 - RNA, 16 nt, Human
gauccaaaagaagccc

SEQ ID NO: 1379626 - RNA, 13 nt, Human
gauccaaaagaag

SEQ ID NO: 1379627 - RNA, 22 nt, Human
gauccaagcuaagcacugccac

SEQ ID NO: 1379628 - RNA, 17 nt, Human
gauccaagcuaagcacu

SEQ ID NO: 1379629 - RNA, 15 nt, Human
gauccaagcuaagca

SEQ ID NO: 1379630 - RNA, 12 nt, Human
gauccacccgcc

SEQ ID NO: 1379631 - RNA, 13 nt, Human
gauaccagcugga

SEQ ID NO: 1379632 - RNA, 22 nt, Human
gauaccagcgaggaggcuccag

SEQ ID NO: 1379633 - RNA, 15 nt, Human
gauaccagcgaggag

SEQ ID NO: 1379634 - RNA, 23 nt, Human
gauacauccaaagcagacagcuc

SEQ ID NO: 1379635 - RNA, 21 nt, Human
gauacauccaaagcagacagc

SEQ ID NO: 1379636 - RNA, 20 nt, Human
gauacauccaaagcagacag

SEQ ID NO: 1379637 - RNA, 17 nt, Human
gauacauccaaagcaga

SEQ ID NO: 1379638 - RNA, 14 nt, Human
gauacauacagaau

SEQ ID NO: 1379639 - RNA, 16 nt, Human
gauacaguuacucaga

SEQ ID NO: 1379640 - RNA, 19 nt, Human
gauacaguuacucagaauu

SEQ ID NO: 1379641 - RNA, 23 nt, Human
gauacaguuacucagaauucucu

SEQ ID NO: 1379642 - RNA, 21 nt, Human
gauacuguaucaugacaaaga

SEQ ID NO: 1379643 - RNA, 17 nt, Human
gauacuguaucaugaca

SEQ ID NO: 1379644 - RNA, 23 nt, Human
gauacugcgacuuucugccugga

SEQ ID NO: 1379645 - RNA, 21 nt, Human
gauacugcgacuuucugccug

SEQ ID NO: 1379646 - RNA, 20 nt, Human
gauacugcgacuuucugccu

SEQ ID NO: 1379647 - RNA, 19 nt, Human
gauacugcgacuuucugcc

SEQ ID NO: 1379648 - RNA, 18 nt, Human
gauacugcgacuuucugc

SEQ ID NO: 1379649 - RNA, 17 nt, Human
gauacugcgacuuucug

SEQ ID NO: 1379650 - RNA, 18 nt, Human
gauaccauauacagcuca

SEQ ID NO: 1379651 - RNA, 12 nt, Human
gauacugaaaua

SEQ ID NO: 1379652 - RNA, 19 nt, Human
gaucucugaagccacaaau

SEQ ID NO: 1379653 - RNA, 14 nt, Human
gaucucugaagcca

SEQ ID NO: 1379654 - RNA, 11 nt, Human
gaucucugaag

SEQ ID NO: 1379655 - RNA, 19 nt, Human
gaucugauaggguuuguga

SEQ ID NO: 1379656 - RNA, 17 nt, Human
gaucugagucagagcca

SEQ ID NO: 1379657 - RNA, 22 nt, Human
gaucugagucagagccaugucu

SEQ ID NO: 1379658 - RNA, 13 nt, Human
gaucugagggaga

SEQ ID NO: 1379659 - RNA, 15 nt, Human
gaucccaugagcucc

SEQ ID NO: 1379660 - RNA, 17 nt, Human
gaucccagagagcccga

SEQ ID NO: 1379661 - RNA, 21 nt, Human
gaucccagagagcccgaggag

SEQ ID NO: 1379662 - RNA, 21 nt, Human
gaucccaaguagaaucucagu

SEQ ID NO: 1379663 - RNA, 19 nt, Human
gaucccaacacugccagca

SEQ ID NO: 1379664 - RNA, 18 nt, Human
gaucccaacacugccagc

SEQ ID NO: 1379665 - RNA, 12 nt, Human
gauccagccugg

SEQ ID NO: 1379666 - RNA, 17 nt, Human
gaucccaacacugccag

SEQ ID NO: 1379667 - RNA, 18 nt, Human
gauccacucgccucagcc

SEQ ID NO: 1379668 - RNA, 21 nt, Human
gauccacccgccucagccucc

SEQ ID NO: 1379669 - RNA, 17 nt, Human
gaucuggaaccucagcc

SEQ ID NO: 1379670 - RNA, 16 nt, Human
gaucuggaaccucagc

SEQ ID NO: 1379671 - RNA, 12 nt, Human
gaucuggaaccu

SEQ ID NO: 1379672 - RNA, 20 nt, Human
gaucuggaacccagacucag

SEQ ID NO: 1379673 - RNA, 18 nt, Human
gaucuggaacccagacuc

SEQ ID NO: 1379674 - RNA, 17 nt, Human
gaucuggaacccagacu

SEQ ID NO: 1379675 - RNA, 16 nt, Human
gaucuggaacccagac

SEQ ID NO: 1379676 - RNA, 15 nt, Human
gaucuggaacccaga

SEQ ID NO: 1379677 - RNA, 21 nt, Human
gaucuggaaccucagccuggc

SEQ ID NO: 1379678 - RNA, 20 nt, Human
gaucuggaaccucagccugg

SEQ ID NO: 1379679 - RNA, 19 nt, Human
gaucuggaaccucagccug

SEQ ID NO: 1379680 - RNA, 18 nt, Human
gaucuggaaccucagccu

SEQ ID NO: 1379681 - RNA, 20 nt, Human
gaucugcagggggugugucu

SEQ ID NO: 1379682 - RNA, 23 nt, Human
gaucugauaggguuugugacagg

SEQ ID NO: 1379683 - RNA, 14 nt, Human
gaucuggaacccag

SEQ ID NO: 1379684 - RNA, 12 nt, Human
gaucuggaaccc

SEQ ID NO: 1379685 - RNA, 22 nt, Human
gaugaucaauuauaguuucuga

SEQ ID NO: 1379686 - RNA, 20 nt, Human
gaugaucaauuauaguuucu

SEQ ID NO: 1379687 - RNA, 13 nt, Human
gaugaucaauuau

SEQ ID NO: 1379688 - RNA, 19 nt, Human
gaugauacuaauaaacuaa

SEQ ID NO: 1379689 - RNA, 19 nt, Human
gaugauugacaacacccau

SEQ ID NO: 1379690 - RNA, 17 nt, Human
gauggaacacggccaca

SEQ ID NO: 1379691 - RNA, 17 nt, Human
gauggaaaauucauuuu

SEQ ID NO: 1379692 - RNA, 23 nt, Human
gaugauuucaguucuaggaaaau

SEQ ID NO: 1379693 - RNA, 22 nt, Human
gaugauuucaguucuaggaaaa

SEQ ID NO: 1379694 - RNA, 19 nt, Human
gaugauuucaguucuagga

SEQ ID NO: 1379695 - RNA, 16 nt, Human
gaugauuucaguucua

SEQ ID NO: 1379696 - RNA, 19 nt, Human
gauuuaaucugccaagggc

SEQ ID NO: 1379697 - RNA, 23 nt, Human
gauuuaauauaaaguuuuauaua

SEQ ID NO: 1379698 - RNA, 21 nt, Human
gauuuaauauaaaguuuuaua

SEQ ID NO: 1379699 - RNA, 19 nt, Human
gauuuaacagaaauguaca

SEQ ID NO: 1379700 - RNA, 16 nt, Human
gauuuaacagaaaugu

SEQ ID NO: 1379701 - RNA, 17 nt, Human
gauuuaacagaaaugua

SEQ ID NO: 1379702 - RNA, 18 nt, Human
gauuuaacagaaauguac

SEQ ID NO: 1379703 - RNA, 12 nt, Human
gauuuauuuaaa

SEQ ID NO: 1379704 - RNA, 21 nt, Human
gauuuauuaauauauauuauc

SEQ ID NO: 1379705 - RNA, 16 nt, Human
gauuuaauuugaaaua

SEQ ID NO: 1379706 - RNA, 18 nt, Human
gauuuauuuaaaauagca

SEQ ID NO: 1379707 - RNA, 18 nt, Human
gcaaaaaagaaaaccuuu

SEQ ID NO: 1379708 - RNA, 15 nt, Human
gcaaaaaagaaaacc

SEQ ID NO: 1379709 - RNA, 17 nt, Human
gcaaaaaagaaaaccuu

SEQ ID NO: 1379710 - RNA, 17 nt, Human
gcaaaaaauguuuuugg

SEQ ID NO: 1379711 - RNA, 15 nt, Human
gcaaaaacaaaaaga

SEQ ID NO: 1379712 - RNA, 19 nt, Human
gcaaaagcuuacaaauacu

SEQ ID NO: 1379713 - RNA, 23 nt, Human
gcaaaaauaguuuggauauguaa

SEQ ID NO: 1379714 - RNA, 20 nt, Human
gcaaaaacaaaaagaaaaga

SEQ ID NO: 1379715 - RNA, 21 nt, Human
gcaaaaacaaaaagaaaagaa

SEQ ID NO: 1379716 - RNA, 23 nt, Human
gcaaccucuuggccugaucagac

SEQ ID NO: 1379717 - RNA, 16 nt, Human
gcaaccucuuggccug

SEQ ID NO: 1379718 - RNA, 20 nt, Human
gcaaccaggaacagcaaaug

SEQ ID NO: 1379719 - RNA, 17 nt, Human
gcaaccaggaacagcaa

SEQ ID NO: 1379720 - RNA, 15 nt, Human
gcaaccaggaacagc

SEQ ID NO: 1379721 - RNA, 11 nt, Human
gcaaccaggaa

SEQ ID NO: 1379722 - RNA, 19 nt, Human
gcaaccccaggcugaagca

SEQ ID NO: 1379723 - RNA, 14 nt, Human
gcaaccauuugaaa

SEQ ID NO: 1379724 - RNA, 22 nt, Human
gcaacaugaugagguaguaccu

SEQ ID NO: 1379725 - RNA, 13 nt, Human
gcaacauggcuuu

SEQ ID NO: 1379726 - RNA, 16 nt, Human
gcaacaugaugaggua

SEQ ID NO: 1379727 - RNA, 14 nt, Human
gcaacaugaugagg

SEQ ID NO: 1379728 - RNA, 17 nt, Human
gcaacauccaaaauagu

SEQ ID NO: 1379729 - RNA, 13 nt, Human
gcaacauccaaaa

SEQ ID NO: 1379730 - RNA, 22 nt, Human
gcaacaggguauggacuaucug

SEQ ID NO: 1379731 - RNA, 15 nt, Human
gcaaaauaauuuuaa

SEQ ID NO: 1379732 - RNA, 13 nt, Human
gcaaaauaauuuu

SEQ ID NO: 1379733 - RNA, 20 nt, Human
gcaaaauaauuuuaaacaaa

SEQ ID NO: 1379734 - RNA, 23 nt, Human
gcaaaauuauagaaguuuagauu

SEQ ID NO: 1379735 - RNA, 18 nt, Human
gcaaaauuauagaaguuu

SEQ ID NO: 1379736 - RNA, 21 nt, Human
cugccugucccuaccccaugg

SEQ ID NO: 1379737 - RNA, 24 nt, Human
cugccugucccuaccccauggugc

SEQ ID NO: 1379738 - RNA, 17 nt, Human
cugccucucccaggcag

SEQ ID NO: 1379739 - RNA, 15 nt, Human
cugccucucccaggc

SEQ ID NO: 1379740 - RNA, 14 nt, Human
cugccucucccagg

SEQ ID NO: 1379741 - RNA, 13 nt, Human
cugccucucccag

SEQ ID NO: 1379742 - RNA, 22 nt, Human
cugccucucaucaacugaauga

SEQ ID NO: 1379743 - RNA, 22 nt, Human
cugccucuacugggaaggcuac

SEQ ID NO: 1379744 - RNA, 19 nt, Human
cugccucuacugggaaggc

SEQ ID NO: 1379745 - RNA, 18 nt, Human
cugccucuacugggaagg

SEQ ID NO: 1379746 - RNA, 17 nt, Human
cugccucuacugggaag

SEQ ID NO: 1379747 - RNA, 15 nt, Human
cugccucuacuggga

SEQ ID NO: 1379748 - RNA, 19 nt, Human
cugccucgaaacacagaaa

SEQ ID NO: 1379749 - RNA, 18 nt, Human
cugccucgaaacacagaa

SEQ ID NO: 1379750 - RNA, 15 nt, Human
cugccucgaaacaca

SEQ ID NO: 1379751 - RNA, 23 nt, Human
cugccuccugccggcuccuuggu

SEQ ID NO: 1379752 - RNA, 15 nt, Human
cugccuccugccggc

SEQ ID NO: 1379753 - RNA, 22 nt, Human
cugccuccugccggcuccuugg

SEQ ID NO: 1379754 - RNA, 23 nt, Human
cugcugagcucugagaggcccug

SEQ ID NO: 1379755 - RNA, 21 nt, Human
cugcugagcucugagaggccc

SEQ ID NO: 1379756 - RNA, 19 nt, Human
cugcugagcucugagaggc

SEQ ID NO: 1379757 - RNA, 18 nt, Human
cugcugagcucugagagg

SEQ ID NO: 1379758 - RNA, 17 nt, Human
cugcugagcucugagag

SEQ ID NO: 1379759 - RNA, 16 nt, Human
cugcugagcucugaga

SEQ ID NO: 1379760 - RNA, 15 nt, Human
cugcugagcucugag

SEQ ID NO: 1379761 - RNA, 14 nt, Human
cugcugagcucuga

SEQ ID NO: 1379762 - RNA, 13 nt, Human
cugcugagcucug

SEQ ID NO: 1379763 - RNA, 19 nt, Human
cugcugagauacauacaga

SEQ ID NO: 1379764 - RNA, 20 nt, Human
cugcugagauacauacagaa

SEQ ID NO: 1379765 - RNA, 20 nt, Human
cugcugagaaccuggccuuc

SEQ ID NO: 1379766 - RNA, 19 nt, Human
cugcugagaaccuggccuu

SEQ ID NO: 1379767 - RNA, 18 nt, Human
cugcugagaaccuggccu

SEQ ID NO: 1379768 - RNA, 17 nt, Human
cugcugagaaccuggcc

SEQ ID NO: 1379769 - RNA, 16 nt, Human
cugcugagaaccuggc

SEQ ID NO: 1379770 - RNA, 22 nt, Human
cugcugagcucugagaggcccu

SEQ ID NO: 1379771 - RNA, 15 nt, Human
cugcugagaaccugg

SEQ ID NO: 1379772 - RNA, 21 nt, Human
cugcuauuaggccagcaagcg

SEQ ID NO: 1379773 - RNA, 21 nt, Human
cugcuaugguuuucuccaaga

SEQ ID NO: 1379774 - RNA, 15 nt, Human
cugcuaucauuauuc

SEQ ID NO: 1379775 - RNA, 14 nt, Human
cugcuauuugaagu

SEQ ID NO: 1379776 - RNA, 18 nt, Human
cugcuauuaggccagcaa

SEQ ID NO: 1379777 - RNA, 21 nt, Human
cugcuacuuauauaauugcca

SEQ ID NO: 1379778 - RNA, 13 nt, Human
cugcuacuuauau

SEQ ID NO: 1379779 - RNA, 15 nt, Human
cugcuagaacauggu

SEQ ID NO: 1379780 - RNA, 18 nt, Human
cugcccugguggcccucu

SEQ ID NO: 1379781 - RNA, 17 nt, Human
cugcccugguggcccuc

SEQ ID NO: 1379782 - RNA, 13 nt, Human
cugcccccugcug

SEQ ID NO: 1379783 - RNA, 18 nt, Human
cugcccccugcugccaug

SEQ ID NO: 1379784 - RNA, 23 nt, Human
cugcccccugcaggaaggagcug

SEQ ID NO: 1379785 - RNA, 22 nt, Human
cugcccccugcaggaaggagcu

SEQ ID NO: 1379786 - RNA, 16 nt, Human
cugcccccugcaggaa

SEQ ID NO: 1379787 - RNA, 15 nt, Human
cugcccccugcagga

SEQ ID NO: 1379788 - RNA, 14 nt, Human
cugcccccugcagg

SEQ ID NO: 1379789 - RNA, 15 nt, Human
cugcccccugcagaa

SEQ ID NO: 1379790 - RNA, 14 nt, Human
cugcccccugcaga

SEQ ID NO: 1379791 - RNA, 13 nt, Human
cugcccccugcag

SEQ ID NO: 1379792 - RNA, 12 nt, Human
cugcccccugca

SEQ ID NO: 1379793 - RNA, 17 nt, Human
cuggaguuagggacuga

SEQ ID NO: 1379794 - RNA, 19 nt, Human
cuggaucagcguggccuug

SEQ ID NO: 1379795 - RNA, 16 nt, Human
cuggaguuagggacug

SEQ ID NO: 1379796 - RNA, 18 nt, Human
cuggaucagcguggccuu

SEQ ID NO: 1379797 - RNA, 19 nt, Human
cuggagaagacccuccccg

SEQ ID NO: 1379798 - RNA, 23 nt, Human
cuggagaaagggcccugggccug

SEQ ID NO: 1379799 - RNA, 13 nt, Human
cuggagaaagggc

SEQ ID NO: 1379800 - RNA, 23 nt, Human
cuggacucucagucucugagcag

SEQ ID NO: 1379801 - RNA, 23 nt, Human
cuggaaagcuuuucuauuuuaau

SEQ ID NO: 1379802 - RNA, 11 nt, Human
cuggaaagaag

SEQ ID NO: 1379803 - RNA, 17 nt, Human
cuggacucucagucucu

SEQ ID NO: 1379804 - RNA, 14 nt, Human
cuggacucucaguc

SEQ ID NO: 1379805 - RNA, 23 nt, Human
cuggacucuaaagucuguugauu

SEQ ID NO: 1379806 - RNA, 21 nt, Human
cuggacucucagucucugagc

SEQ ID NO: 1379807 - RNA, 20 nt, Human
cuggacucucagucucugag

SEQ ID NO: 1379808 - RNA, 19 nt, Human
cuggacucucagucucuga

SEQ ID NO: 1379809 - RNA, 18 nt, Human
cuggacucucagucucug

SEQ ID NO: 1379810 - RNA, 21 nt, Human
cugcuucaguguauggaaaua

SEQ ID NO: 1379811 - RNA, 19 nt, Human
cugcuucaguguauggaaa

SEQ ID NO: 1379812 - RNA, 24 nt, Human
cugcuuccaauuuucuggaauaca

SEQ ID NO: 1379813 - RNA, 19 nt, Human
cuggaaaacagaacacuua

SEQ ID NO: 1379814 - RNA, 18 nt, Human
cuggaaaacagaacacuu

SEQ ID NO: 1379815 - RNA, 17 nt, Human
cuggaaaacagaacacu

SEQ ID NO: 1379816 - RNA, 16 nt, Human
cuggaaaacagaacac

SEQ ID NO: 1379817 - RNA, 14 nt, Human
cuggaaaacagaac

SEQ ID NO: 1379818 - RNA, 23 nt, Human
cuggaaaaguauguuagugcaaa

SEQ ID NO: 1379819 - RNA, 23 nt, Human
cuggaaaauaauacugcugagau

SEQ ID NO: 1379820 - RNA, 20 nt, Human
cuggaaaauaauacugcuga

SEQ ID NO: 1379821 - RNA, 17 nt, Human
cuggaaaauaauacugc

SEQ ID NO: 1379822 - RNA, 17 nt, Human
cuggaaaccuuccaccc

SEQ ID NO: 1379823 - RNA, 20 nt, Human
cuggaaaccuuccacccagu

SEQ ID NO: 1379824 - RNA, 17 nt, Human
cuggccgccugggucca

SEQ ID NO: 1379825 - RNA, 22 nt, Human
cuggccgcccccugccccccag

SEQ ID NO: 1379826 - RNA, 14 nt, Human
cuggccgcccccug

SEQ ID NO: 1379827 - RNA, 13 nt, Human
cuggccgcccccu

SEQ ID NO: 1379828 - RNA, 21 nt, Human
cuggccgcccccagcccccuc

SEQ ID NO: 1379829 - RNA, 23 nt, Human
cuggccgaguccaagcugggaga

SEQ ID NO: 1379830 - RNA, 20 nt, Human
cuggccgaguccaagcuggg

SEQ ID NO: 1379831 - RNA, 18 nt, Human
cuggccgaguccaagcug

SEQ ID NO: 1379832 - RNA, 17 nt, Human
cuggccgaguccaagcu

SEQ ID NO: 1379833 - RNA, 14 nt, Human
cuggcccuauuuag

SEQ ID NO: 1379834 - RNA, 17 nt, Human
cugguuuucacauuaga

SEQ ID NO: 1379835 - RNA, 16 nt, Human
cuguagcacuuacugg

SEQ ID NO: 1379836 - RNA, 17 nt, Human
cuguagaguugcugaga

SEQ ID NO: 1379837 - RNA, 23 nt, Human
cuguagaguugcugagagggcuc

SEQ ID NO: 1379838 - RNA, 16 nt, Human
cuguagaguugcugag

SEQ ID NO: 1379839 - RNA, 15 nt, Human
cuguagaguugcuga

SEQ ID NO: 1379840 - RNA, 13 nt, Human
cuguagaguugcu

SEQ ID NO: 1379841 - RNA, 21 nt, Human
cuguacuugcucuugaugccu

SEQ ID NO: 1379842 - RNA, 16 nt, Human
cuguacuugcucuuga

SEQ ID NO: 1379843 - RNA, 19 nt, Human
cuguacuugcucuugaugc

SEQ ID NO: 1379844 - RNA, 20 nt, Human
cuguacuugcucuugaugcc

SEQ ID NO: 1379845 - RNA, 16 nt, Human
cuguaacaagccagau

SEQ ID NO: 1379846 - RNA, 18 nt, Human
cuguaaaucuacacacgg

SEQ ID NO: 1379847 - RNA, 14 nt, Human
cuguaaaucuacac

SEQ ID NO: 1379848 - RNA, 18 nt, Human
cuguaaagcuaaaauaaa

SEQ ID NO: 1379849 - RNA, 21 nt, Human
cuguaaauaaugugcacugaa

SEQ ID NO: 1379850 - RNA, 23 nt, Human
cuguaaagcuaaaauaaagaaau

SEQ ID NO: 1379851 - RNA, 22 nt, Human
cuguaaagauguuuauuucagg

SEQ ID NO: 1379852 - RNA, 21 nt, Human
cuguaaagauguuuauuucag

SEQ ID NO: 1379853 - RNA, 16 nt, Human
cuguaaagauguuuau

SEQ ID NO: 1379854 - RNA, 12 nt, Human
cuguaaagaugu

SEQ ID NO: 1379855 - RNA, 14 nt, Human
cuguaaagaguugc

SEQ ID NO: 1379856 - RNA, 22 nt, Human
cuguaagaaaccuacugcccag

SEQ ID NO: 1379857 - RNA, 21 nt, Human
cuguaagaaaccuacugccca

SEQ ID NO: 1379858 - RNA, 13 nt, Human
cuguaagaaaccu

SEQ ID NO: 1379859 - RNA, 23 nt, Human
cuguaacuugauccauuucuaau

SEQ ID NO: 1379860 - RNA, 22 nt, Human
cuguaacuugauccauuucuaa

SEQ ID NO: 1379861 - RNA, 20 nt, Human
cuguaagaaaauaucacuug

SEQ ID NO: 1379862 - RNA, 15 nt, Human
cugucaucugugcac

SEQ ID NO: 1379863 - RNA, 21 nt, Human
cugucaucugugcacugccca

SEQ ID NO: 1379864 - RNA, 14 nt, Human
cugucaucugugca

SEQ ID NO: 1379865 - RNA, 18 nt, Human
cugucagucacagccacc

SEQ ID NO: 1379866 - RNA, 22 nt, Human
cugucaugguguccagacagag

SEQ ID NO: 1379867 - RNA, 21 nt, Human
cuguagccccagugacagcua

SEQ ID NO: 1379868 - RNA, 20 nt, Human
cuguagccccagugacagcu

SEQ ID NO: 1379869 - RNA, 18 nt, Human
cuguagccccagugacag

SEQ ID NO: 1379870 - RNA, 17 nt, Human
cuguagccccagugaca

SEQ ID NO: 1379871 - RNA, 14 nt, Human
cuguaggaaaccca

SEQ ID NO: 1379872 - RNA, 17 nt, Human
cugucagucacagccac

SEQ ID NO: 1379873 - RNA, 15 nt, Human
cugucagucacagcc

SEQ ID NO: 1379874 - RNA, 14 nt, Human
cugucagucacagc

SEQ ID NO: 1379875 - RNA, 13 nt, Human
cugucagucacag

SEQ ID NO: 1379876 - RNA, 23 nt, Human
cugucaggauugcgagagaugug

SEQ ID NO: 1379877 - RNA, 24 nt, Human
cugucaggauugcgagagaugugu

SEQ ID NO: 1379878 - RNA, 22 nt, Human
cugucaggauugcgagagaugu

SEQ ID NO: 1379879 - RNA, 21 nt, Human
cugucaggauugcgagagaug

SEQ ID NO: 1379880 - RNA, 19 nt, Human
cugucaggauugcgagaga

SEQ ID NO: 1379881 - RNA, 17 nt, Human
cugucaggauugcgaga

SEQ ID NO: 1379882 - RNA, 15 nt, Human
cugucaggauugcga

SEQ ID NO: 1379883 - RNA, 14 nt, Human
cugucaggauugcg

SEQ ID NO: 1379884 - RNA, 23 nt, Human
cuguccuuucuagagcacugcca

SEQ ID NO: 1379885 - RNA, 22 nt, Human
cuguccuuucuagagcacugcc

SEQ ID NO: 1379886 - RNA, 21 nt, Human
cuguccuuucuagagcacugc

SEQ ID NO: 1379887 - RNA, 20 nt, Human
cuguccuuucuagagcacug

SEQ ID NO: 1379888 - RNA, 13 nt, Human
cuguccuuucuag

SEQ ID NO: 1379889 - RNA, 20 nt, Human
cuguccuugaaggacuaaua

SEQ ID NO: 1379890 - RNA, 14 nt, Human
cuguccugucauca

SEQ ID NO: 1379891 - RNA, 17 nt, Human
cuguccuugaaggacua

SEQ ID NO: 1379892 - RNA, 21 nt, Human
cuguccugucaucaucauggc

SEQ ID NO: 1379893 - RNA, 20 nt, Human
cuguccugucaucaucaugg

SEQ ID NO: 1379894 - RNA, 23 nt, Human
cuguccugucaucaucauggcca

SEQ ID NO: 1379895 - RNA, 15 nt, Human
cugucguuaaaaaca

SEQ ID NO: 1379896 - RNA, 20 nt, Human
cugucuacacuaagagagaa

SEQ ID NO: 1379897 - RNA, 14 nt, Human
cuggucucuccuug

SEQ ID NO: 1379898 - RNA, 24 nt, Human
cuggucucucuaugccucucuaca

SEQ ID NO: 1379899 - RNA, 23 nt, Human
cuggucucucuaugccucucuac

SEQ ID NO: 1379900 - RNA, 21 nt, Human
cuggucucucuaugccucucu

SEQ ID NO: 1379901 - RNA, 17 nt, Human
cuggucucucuaugccu

SEQ ID NO: 1379902 - RNA, 19 nt, Human
cuggucugcuguuccagug

SEQ ID NO: 1379903 - RNA, 14 nt, Human
cuggucuguaggga

SEQ ID NO: 1379904 - RNA, 15 nt, Human
cuguugcugaauagg

SEQ ID NO: 1379905 - RNA, 16 nt, Human
cuguugcugaauaggc

SEQ ID NO: 1379906 - RNA, 19 nt, Human
cuguuggcaggcuggccag

SEQ ID NO: 1379907 - RNA, 18 nt, Human
cuguuggcaggcuggcca

SEQ ID NO: 1379908 - RNA, 16 nt, Human
cuguuggcaggcuggc

SEQ ID NO: 1379909 - RNA, 15 nt, Human
cuguuggcaggcugg

SEQ ID NO: 1379910 - RNA, 12 nt, Human
cuguugcuaagc

SEQ ID NO: 1379911 - RNA, 21 nt, Human
cuguugcuaagccccagcaag

SEQ ID NO: 1379912 - RNA, 22 nt, Human
cuguugcuaagccccagcaagc

SEQ ID NO: 1379913 - RNA, 23 nt, Human
cuguugcuaagccccagcaagca

SEQ ID NO: 1379914 - RNA, 18 nt, Human
cuuaaaauacaagacugc

SEQ ID NO: 1379915 - RNA, 19 nt, Human
cuuaaaauacaagacugcc

SEQ ID NO: 1379916 - RNA, 16 nt, Human
cuuaaaauacaagacu

SEQ ID NO: 1379917 - RNA, 14 nt, Human
cuuaaaauacaaga

SEQ ID NO: 1379918 - RNA, 15 nt, Human
cuuaaacuaaaugug

SEQ ID NO: 1379919 - RNA, 14 nt, Human
cuuaaacuaaaugu

SEQ ID NO: 1379920 - RNA, 23 nt, Human
cuuaaaccuucaguuaugauuuu

SEQ ID NO: 1379921 - RNA, 15 nt, Human
cuuaaaccuucaguu

SEQ ID NO: 1379922 - RNA, 14 nt, Human
cuuaaauaauguga

SEQ ID NO: 1379923 - RNA, 16 nt, Human
cuuaaauaaugugaaa

SEQ ID NO: 1379924 - RNA, 19 nt, Human
cuuaaauaaugugaaacug

SEQ ID NO: 1379925 - RNA, 12 nt, Human
cuuaaaacuuug

SEQ ID NO: 1379926 - RNA, 12 nt, Human
cuuaaaacuccu

SEQ ID NO: 1379927 - RNA, 15 nt, Human
cuuaaaauaagcagg

SEQ ID NO: 1379928 - RNA, 14 nt, Human
cuuaaaauaagcag

SEQ ID NO: 1379929 - RNA, 13 nt, Human
cuuaaaauaagca

SEQ ID NO: 1379930 - RNA, 12 nt, Human
cuuaaaauaagc

SEQ ID NO: 1379931 - RNA, 13 nt, Human
cuuaaaauacaag

SEQ ID NO: 1379932 - RNA, 12 nt, Human
cuuaaaauacaa

SEQ ID NO: 1379933 - RNA, 22 nt, Human
cuuaaaauaaugaauacauuuc

SEQ ID NO: 1379934 - RNA, 19 nt, Human
cuguuaugcugugacacau

SEQ ID NO: 1379935 - RNA, 19 nt, Human
cuguuaucaaaacuuucuu

SEQ ID NO: 1379936 - RNA, 23 nt, Human
cuguuaucaaacaccaacauaaa

SEQ ID NO: 1379937 - RNA, 14 nt, Human
cuguuaugcuguga

SEQ ID NO: 1379938 - RNA, 15 nt, Human
cuguuagcagacagg

SEQ ID NO: 1379939 - RNA, 13 nt, Human
cuguuagcagaca

SEQ ID NO: 1379940 - RNA, 21 nt, Human
cuguguccaugcgcucagggc

SEQ ID NO: 1379941 - RNA, 19 nt, Human
cuguguccaugcgcucagg

SEQ ID NO: 1379942 - RNA, 18 nt, Human
cuguguccaugcgcucag

SEQ ID NO: 1379943 - RNA, 13 nt, Human
cuguguccaugcg

SEQ ID NO: 1379944 - RNA, 22 nt, Human
cuguguccaaaaccgccagcuc

SEQ ID NO: 1379945 - RNA, 21 nt, Human
cuguguccaaaaccgccagcu

SEQ ID NO: 1379946 - RNA, 23 nt, Human
cuguguccaugcgcucagggcca

SEQ ID NO: 1379947 - RNA, 22 nt, Human
cuguguccaugcgcucagggcc

SEQ ID NO: 1379948 - RNA, 16 nt, Human
cuguguauuugcuuuu

SEQ ID NO: 1379949 - RNA, 15 nt, Human
cuguguauuugcuuu

SEQ ID NO: 1379950 - RNA, 14 nt, Human
cuguguauuugcuu

SEQ ID NO: 1379951 - RNA, 19 nt, Human
cuguguauuccaagacaug

SEQ ID NO: 1379952 - RNA, 15 nt, Human
cuguguauuccaaga

SEQ ID NO: 1379953 - RNA, 22 nt, Human
cuguguagcugugaccugcuga

SEQ ID NO: 1379954 - RNA, 23 nt, Human
cuguguagcugugaccugcugag

SEQ ID NO: 1379955 - RNA, 20 nt, Human
cuguguagcugugaccugcu

SEQ ID NO: 1379956 - RNA, 19 nt, Human
cuguguagcugugaccugc

SEQ ID NO: 1379957 - RNA, 18 nt, Human
cuguguagcugugaccug

SEQ ID NO: 1379958 - RNA, 17 nt, Human
cuguguagcugugaccu

SEQ ID NO: 1379959 - RNA, 16 nt, Human
cuguguagcugugacc

SEQ ID NO: 1379960 - RNA, 15 nt, Human
cuguguagcugugac

SEQ ID NO: 1379961 - RNA, 14 nt, Human
cugugagcccagcu

SEQ ID NO: 1379962 - RNA, 13 nt, Human
cugugaauuaagc

SEQ ID NO: 1379963 - RNA, 21 nt, Human
cugugaaugccacugccuucg

SEQ ID NO: 1379964 - RNA, 20 nt, Human
cugugaaugccacugccuuc

SEQ ID NO: 1379965 - RNA, 16 nt, Human
cugugaaugccacugc

SEQ ID NO: 1379966 - RNA, 15 nt, Human
cugugaaugccacug

SEQ ID NO: 1379967 - RNA, 15 nt, Human
cugugagcccagcug

SEQ ID NO: 1379968 - RNA, 19 nt, Human
cuuacaugcauuacugcau

SEQ ID NO: 1379969 - RNA, 18 nt, Human
cuuacaugcauuacugca

SEQ ID NO: 1379970 - RNA, 12 nt, Human
cuuacaugauuc

SEQ ID NO: 1379971 - RNA, 23 nt, Human
cuuacaguaggagcccagcucug

SEQ ID NO: 1379972 - RNA, 16 nt, Human
cuuacaguaggagccc

SEQ ID NO: 1379973 - RNA, 17 nt, Human
cuucccaagggcugccg

SEQ ID NO: 1379974 - RNA, 23 nt, Human
cuucccaagugagucucucuggg

SEQ ID NO: 1379975 - RNA, 13 nt, Human
cuuccauuugcaa

SEQ ID NO: 1379976 - RNA, 16 nt, Human
cuucccaaagcaagca

SEQ ID NO: 1379977 - RNA, 14 nt, Human
cuuccauuugcaag

SEQ ID NO: 1379978 - RNA, 23 nt, Human
cuucccaaaguccugggauuaca

SEQ ID NO: 1379979 - RNA, 13 nt, Human
cuucucuuugccu

SEQ ID NO: 1379980 - RNA, 22 nt, Human
cuucucuguauuccuagaaacu

SEQ ID NO: 1379981 - RNA, 22 nt, Human
cuucugaacucaaacugaggaa

SEQ ID NO: 1379982 - RNA, 18 nt, Human
cuucugaacucaaacuga

SEQ ID NO: 1379983 - RNA, 17 nt, Human
cuucugaacucaaacug

SEQ ID NO: 1379984 - RNA, 16 nt, Human
cuucucuuugccucaa

SEQ ID NO: 1379985 - RNA, 15 nt, Human
cuucuaauugccaug

SEQ ID NO: 1379986 - RNA, 23 nt, Human
cuucuacucacuuuucccacucc

SEQ ID NO: 1379987 - RNA, 19 nt, Human
cuucuacucacuuuuccca

SEQ ID NO: 1379988 - RNA, 18 nt, Human
cuucuacucacuuuuccc

SEQ ID NO: 1379989 - RNA, 20 nt, Human
cuucuacucacuuuucccac

SEQ ID NO: 1379990 - RNA, 15 nt, Human
cuucuauacccaccc

SEQ ID NO: 1379991 - RNA, 18 nt, Human
cuucuauacccacccaga

SEQ ID NO: 1379992 - RNA, 22 nt, Human
cuucucugacuucugccuggag

SEQ ID NO: 1379993 - RNA, 17 nt, Human
cuucuauacccacccag

SEQ ID NO: 1379994 - RNA, 19 nt, Human
cuuccucuccugucucccu

SEQ ID NO: 1379995 - RNA, 15 nt, Human
cuuccucuccugucu

SEQ ID NO: 1379996 - RNA, 16 nt, Human
cuucuaauugccaugu

SEQ ID NO: 1379997 - RNA, 17 nt, Human
cuuccucuucccccaag

SEQ ID NO: 1379998 - RNA, 12 nt, Human
cuucuugaaggu

SEQ ID NO: 1379999 - RNA, 22 nt, Human
cuucuugaaauuuuaaccuaug

SEQ ID NO: 1380000 - RNA, 22 nt, Human
cuucuuagcuaucauugcuucc

SEQ ID NO: 1380001 - RNA, 22 nt, Human
cuucuuauggaauugauuugca

SEQ ID NO: 1380002 - RNA, 23 nt, Human
cuucuuauggaauugauuugcau

SEQ ID NO: 1380003 - RNA, 19 nt, Human
cuucuuauggaauugauuu

SEQ ID NO: 1380004 - RNA, 22 nt, Human
cuucuuacuuggaacugaaggg

SEQ ID NO: 1380005 - RNA, 21 nt, Human
cuucuuacuuggaacugaagg

SEQ ID NO: 1380006 - RNA, 15 nt, Human
cuucucuuugccuca

SEQ ID NO: 1380007 - RNA, 13 nt, Human
cuugguuccccca

SEQ ID NO: 1380008 - RNA, 15 nt, Human
cuugguccuugauuu

SEQ ID NO: 1380009 - RNA, 23 nt, Human
cuugguucuugaggggaccagga

SEQ ID NO: 1380010 - RNA, 16 nt, Human
cuugguugaggaaaca

SEQ ID NO: 1380011 - RNA, 15 nt, Human
cuugguugaggaaac

SEQ ID NO: 1380012 - RNA, 14 nt, Human
cuugguugaggaaa

SEQ ID NO: 1380013 - RNA, 20 nt, Human
cuugucucccagcucagggc

SEQ ID NO: 1380014 - RNA, 22 nt, Human
cuugguucuugaggggaccagg

SEQ ID NO: 1380015 - RNA, 19 nt, Human
cuugguucuugaggggacc

SEQ ID NO: 1380016 - RNA, 16 nt, Human
cuugguuccuucccaa

SEQ ID NO: 1380017 - RNA, 19 nt, Human
cuugguucccccacugauc

SEQ ID NO: 1380018 - RNA, 16 nt, Human
cuugguucccccacug

SEQ ID NO: 1380019 - RNA, 20 nt, Human
cuugucuuauucccuuccug

SEQ ID NO: 1380020 - RNA, 20 nt, Human
cuuucaauacagauauauuu

SEQ ID NO: 1380021 - RNA, 19 nt, Human
cuuucaauacagauauauu

SEQ ID NO: 1380022 - RNA, 18 nt, Human
cuuucaauacagauauau

SEQ ID NO: 1380023 - RNA, 17 nt, Human
cuuucaauacagauaua

SEQ ID NO: 1380024 - RNA, 22 nt, Human
cuuuaaugauaugcuuguaacu

SEQ ID NO: 1380025 - RNA, 21 nt, Human
cuuuaaugauaugcuuguaac

SEQ ID NO: 1380026 - RNA, 16 nt, Human
cuuuaaugauaugcuu

SEQ ID NO: 1380027 - RNA, 20 nt, Human
cuuuaagaguuuaaaaucau

SEQ ID NO: 1380028 - RNA, 22 nt, Human
cuuuaagaguuuaaaaucauca

SEQ ID NO: 1380029 - RNA, 19 nt, Human
cuuuaagaguuuaaaauca

SEQ ID NO: 1380030 - RNA, 15 nt, Human
cuuuaagaguuuaaa

SEQ ID NO: 1380031 - RNA, 15 nt, Human
cuuuaacuuaaauag

SEQ ID NO: 1380032 - RNA, 23 nt, Human
cuuuaacugccguaauuuaacuu

SEQ ID NO: 1380033 - RNA, 21 nt, Human
cuuuaacugccguaauuuaac

SEQ ID NO: 1380034 - RNA, 15 nt, Human
cuuucacaggcagcc

SEQ ID NO: 1380035 - RNA, 14 nt, Human
cuuucacaggcagc

SEQ ID NO: 1380036 - RNA, 13 nt, Human
cuuucacaggcag

SEQ ID NO: 1380037 - RNA, 18 nt, Human
cuuucacagcuccuccca

SEQ ID NO: 1380038 - RNA, 15 nt, Human
cuuucacagcuccuc

SEQ ID NO: 1380039 - RNA, 14 nt, Human
cuuucacagcuccu

SEQ ID NO: 1380040 - RNA, 13 nt, Human
cuuucacagcucc

SEQ ID NO: 1380041 - RNA, 19 nt, Human
cuuucacaggcagccagug

SEQ ID NO: 1380042 - RNA, 13 nt, Human
cuugccucauuuu

SEQ ID NO: 1380043 - RNA, 23 nt, Human
cuugccucauuuuuuuccuugca

SEQ ID NO: 1380044 - RNA, 18 nt, Human
cuugccucaaugccagua

SEQ ID NO: 1380045 - RNA, 22 nt, Human
cuugauuuaucacacaaagcag

SEQ ID NO: 1380046 - RNA, 21 nt, Human
cuugauuuaucacacaaagca

SEQ ID NO: 1380047 - RNA, 22 nt, Human
cuugauucugcaguaaaucuuu

SEQ ID NO: 1380048 - RNA, 21 nt, Human
cuugauucugcaguaaaucuu

SEQ ID NO: 1380049 - RNA, 20 nt, Human
cuugauucugcaguaaaucu

SEQ ID NO: 1380050 - RNA, 17 nt, Human
cuugauucugcaguaaa

SEQ ID NO: 1380051 - RNA, 13 nt, Human
cuugauucugcag

SEQ ID NO: 1380052 - RNA, 22 nt, Human
cuugauguaaaaucuugucaug

SEQ ID NO: 1380053 - RNA, 21 nt, Human
cuugauguaaaaucuugucau

SEQ ID NO: 1380054 - RNA, 20 nt, Human
cuugauguaaaaucuuguca

SEQ ID NO: 1380055 - RNA, 18 nt, Human
cuugauguaaaaucuugu

SEQ ID NO: 1380056 - RNA, 17 nt, Human
cuugauguaaaaucuug

SEQ ID NO: 1380057 - RNA, 15 nt, Human
cuugauguaaaaucu

SEQ ID NO: 1380058 - RNA, 14 nt, Human
cuugauguaaaauc

SEQ ID NO: 1380059 - RNA, 13 nt, Human
cuugauguaaaau

SEQ ID NO: 1380060 - RNA, 19 nt, Human
cuugaugggauucuggaca

SEQ ID NO: 1380061 - RNA, 18 nt, Human
cuugaugggauucuggac

SEQ ID NO: 1380062 - RNA, 17 nt, Human
cuugaugggauucugga

SEQ ID NO: 1380063 - RNA, 21 nt, Human
cuugauguaaggaugggcaug

SEQ ID NO: 1380064 - RNA, 20 nt, Human
cuugaugucuuuguuaagac

SEQ ID NO: 1380065 - RNA, 19 nt, Human
cuugauguaaggaugggca

SEQ ID NO: 1380066 - RNA, 23 nt, Human
cuugauguaaaaucuugucaugu

SEQ ID NO: 1380067 - RNA, 16 nt, Human
gaacaagagaagcauu

SEQ ID NO: 1380068 - RNA, 15 nt, Human
gaacaagagaagcau

SEQ ID NO: 1380069 - RNA, 17 nt, Human
gaacaagagaagcauuc

SEQ ID NO: 1380070 - RNA, 15 nt, Human
gaaauuuuucuucuu

SEQ ID NO: 1380071 - RNA, 15 nt, Human
gaaaucaacuugcuu

SEQ ID NO: 1380072 - RNA, 13 nt, Human
gaaauauuuuaaa

SEQ ID NO: 1380073 - RNA, 20 nt, Human
gaaaguacacucugcuguuu

SEQ ID NO: 1380074 - RNA, 22 nt, Human
gaaaguacacucugcuguuuga

SEQ ID NO: 1380075 - RNA, 19 nt, Human
gaaaguacacucugcuguu

SEQ ID NO: 1380076 - RNA, 18 nt, Human
gaaaguacacucugcugu

SEQ ID NO: 1380077 - RNA, 17 nt, Human
gaaaguacacucugcug

SEQ ID NO: 1380078 - RNA, 13 nt, Human
gaaagguuuuuuu

SEQ ID NO: 1380079 - RNA, 20 nt, Human
gaaauauuuuaaaaucagcu

SEQ ID NO: 1380080 - RNA, 19 nt, Human
gaaauauuugugacaaaaa

SEQ ID NO: 1380081 - RNA, 19 nt, Human
gaaagaccaggccaauguc

SEQ ID NO: 1380082 - RNA, 17 nt, Human
gaaagacagcuucucau

SEQ ID NO: 1380083 - RNA, 16 nt, Human
gaaagacagcuucuca

SEQ ID NO: 1380084 - RNA, 19 nt, Human
gaaagacgcacuuuggcuu

SEQ ID NO: 1380085 - RNA, 17 nt, Human
gaaagacgcacuuuggc

SEQ ID NO: 1380086 - RNA, 15 nt, Human
gaaagacgcacuuug

SEQ ID NO: 1380087 - RNA, 21 nt, Human
gaaacuuaaauguuauuaucu

SEQ ID NO: 1380088 - RNA, 19 nt, Human
gaaacuuaaauguuauuau

SEQ ID NO: 1380089 - RNA, 23 nt, Human
gaaacuucagcgguuuauauaag

SEQ ID NO: 1380090 - RNA, 16 nt, Human
gaaagaagaaaagguu

SEQ ID NO: 1380091 - RNA, 13 nt, Human
gaaagaauagaac

SEQ ID NO: 1380092 - RNA, 20 nt, Human
gaaagaaguguggggauuuu

SEQ ID NO: 1380093 - RNA, 12 nt, Human
gaaacuuggcuc

SEQ ID NO: 1380094 - RNA, 16 nt, Human
gaaagaacggaagaag

SEQ ID NO: 1380095 - RNA, 18 nt, Human
gaaaauuagacugugauu

SEQ ID NO: 1380096 - RNA, 13 nt, Human
gaaacaaaauaca

SEQ ID NO: 1380097 - RNA, 23 nt, Human
gaaacaaaaacacuaaaaauaaa

SEQ ID NO: 1380098 - RNA, 19 nt, Human
gaaacaaaaacacuaaaaa

SEQ ID NO: 1380099 - RNA, 14 nt, Human
gaaacaaaaacacu

SEQ ID NO: 1380100 - RNA, 16 nt, Human
gaaaauuagacuguga

SEQ ID NO: 1380101 - RNA, 14 nt, Human
gaaaauuagacugu

SEQ ID NO: 1380102 - RNA, 13 nt, Human
gaaaauuuuugua

SEQ ID NO: 1380103 - RNA, 16 nt, Human
gaaaauuuuuguagua

SEQ ID NO: 1380104 - RNA, 18 nt, Human
gaaaauuuugauguuuua

SEQ ID NO: 1380105 - RNA, 16 nt, Human
gaaaacucuuugcugc

SEQ ID NO: 1380106 - RNA, 18 nt, Human
gaaaacuccaccuuccca

SEQ ID NO: 1380107 - RNA, 21 nt, Human
gaaaaaauauauguauauaca

SEQ ID NO: 1380108 - RNA, 18 nt, Human
gaaaacuuguauuaugug

SEQ ID NO: 1380109 - RNA, 14 nt, Human
gaaaauuacaaaaa

SEQ ID NO: 1380110 - RNA, 21 nt, Human
gaaaauguugagaaucccaaa

SEQ ID NO: 1380111 - RNA, 20 nt, Human
gaaaagccuggguuuggugu

SEQ ID NO: 1380112 - RNA, 14 nt, Human
gaaaauuaacauga

SEQ ID NO: 1380113 - RNA, 22 nt, Human
gaaaagccuggguuugguguau

SEQ ID NO: 1380114 - RNA, 23 nt, Human
gaaaagcauggcuugaauaagga

SEQ ID NO: 1380115 - RNA, 18 nt, Human
gaaaagcaucagaaagag

SEQ ID NO: 1380116 - RNA, 15 nt, Human
gaaaagcagacauuu

SEQ ID NO: 1380117 - RNA, 16 nt, Human
gaaaagcagacauuuu

SEQ ID NO: 1380118 - RNA, 15 nt, Human
cuuuuuuuucuuuaa

SEQ ID NO: 1380119 - RNA, 14 nt, Human
cuuuuuuuucuuua

SEQ ID NO: 1380120 - RNA, 18 nt, Human
cuuuuuuuucuauuucac

SEQ ID NO: 1380121 - RNA, 17 nt, Human
cuuuuuuuucuauuuca

SEQ ID NO: 1380122 - RNA, 15 nt, Human
cuuuuuuuuccuucu

SEQ ID NO: 1380123 - RNA, 22 nt, Human
cuuuuuuuguguguauuugcua

SEQ ID NO: 1380124 - RNA, 21 nt, Human
cuuuuuuuguguguauuugcu

SEQ ID NO: 1380125 - RNA, 13 nt, Human
cuuuuuuugugug

SEQ ID NO: 1380126 - RNA, 21 nt, Human
cuuuuuuuguauaguuaacac

SEQ ID NO: 1380127 - RNA, 16 nt, Human
cuuuuuuuguauaguu

SEQ ID NO: 1380128 - RNA, 13 nt, Human
cuuuuuuuguaua

SEQ ID NO: 1380129 - RNA, 12 nt, Human
cuuuuuuuguau

SEQ ID NO: 1380130 - RNA, 20 nt, Human
cuuuuuuucuguaccaguua

SEQ ID NO: 1380131 - RNA, 21 nt, Human
cuuuugugggggacuguaagu

SEQ ID NO: 1380132 - RNA, 19 nt, Human
cuuuugugggggacuguaa

SEQ ID NO: 1380133 - RNA, 19 nt, Human
cuuuugucuacacacccug

SEQ ID NO: 1380134 - RNA, 11 nt, Human
cuuuugucuac

SEQ ID NO: 1380135 - RNA, 17 nt, Human
cuuuuguauuaagaaag

SEQ ID NO: 1380136 - RNA, 14 nt, Human
cuuuugugcauuau

SEQ ID NO: 1380137 - RNA, 18 nt, Human
cuuuugugcauuaucuag

SEQ ID NO: 1380138 - RNA, 21 nt, Human
cuuuuuuuuuuuuuaauaaau

SEQ ID NO: 1380139 - RNA, 21 nt, Human
cuuuuuuuuuuuuuuugacaa

SEQ ID NO: 1380140 - RNA, 12 nt, Human
gaaaaaauauau

SEQ ID NO: 1380141 - RNA, 11 nt, Human
gaaaaaauaua

SEQ ID NO: 1380142 - RNA, 14 nt, Human
gaaaaaauauauau

SEQ ID NO: 1380143 - RNA, 11 nt, Human
cuuuugcuuuu

SEQ ID NO: 1380144 - RNA, 14 nt, Human
cuuuugcuuuauuc

SEQ ID NO: 1380145 - RNA, 22 nt, Human
cuuuugcucuuagcugucugcu

SEQ ID NO: 1380146 - RNA, 20 nt, Human
cuuuugccuuuugcaaccag

SEQ ID NO: 1380147 - RNA, 23 nt, Human
cuuuugcgguucaggaaaauuga

SEQ ID NO: 1380148 - RNA, 18 nt, Human
cuuuugccguuauuaaaa

SEQ ID NO: 1380149 - RNA, 14 nt, Human
cuuuuguauuaaga

SEQ ID NO: 1380150 - RNA, 13 nt, Human
cuuuuguauuaag

SEQ ID NO: 1380151 - RNA, 12 nt, Human
cuuuuguauuaa

SEQ ID NO: 1380152 - RNA, 11 nt, Human
cuuuuguauua

SEQ ID NO: 1380153 - RNA, 21 nt, Human
cuuuugguaaagacuggcuuu

SEQ ID NO: 1380154 - RNA, 20 nt, Human
cuuuugguaaagacuggcuu

SEQ ID NO: 1380155 - RNA, 20 nt, Human
cuuuuggguuucugcccugc

SEQ ID NO: 1380156 - RNA, 19 nt, Human
cuuuuggguuucugcccug

SEQ ID NO: 1380157 - RNA, 17 nt, Human
cuuuuggguuucugccc

SEQ ID NO: 1380158 - RNA, 18 nt, Human
cuuuugggggucaacagu

SEQ ID NO: 1380159 - RNA, 15 nt, Human
cuuuugcuuuuggca

SEQ ID NO: 1380160 - RNA, 18 nt, Human
cuuuugcuuuugcccauu

SEQ ID NO: 1380161 - RNA, 16 nt, Human
cuuuugcuuuugccca

SEQ ID NO: 1380162 - RNA, 17 nt, Human
cuuuugcuuuuggcaaa

SEQ ID NO: 1380163 - RNA, 18 nt, Human
cuuuuggaagguauuuaa

SEQ ID NO: 1380164 - RNA, 18 nt, Human
cuuuuauugacacagaaa

SEQ ID NO: 1380165 - RNA, 17 nt, Human
cuuuuauugacacagaa

SEQ ID NO: 1380166 - RNA, 19 nt, Human
cuuuuauuaaugcacuuuc

SEQ ID NO: 1380167 - RNA, 16 nt, Human
cuuuuauuaaugcacu

SEQ ID NO: 1380168 - RNA, 14 nt, Human
cuuuuauuaaugca

SEQ ID NO: 1380169 - RNA, 19 nt, Human
cuuuuaugugaaacauguu

SEQ ID NO: 1380170 - RNA, 17 nt, Human
cuccuaaaguacuggga

SEQ ID NO: 1380171 - RNA, 20 nt, Human
cuccguuggccacuccgaga

SEQ ID NO: 1380172 - RNA, 12 nt, Human
cuccguuggcca

SEQ ID NO: 1380173 - RNA, 22 nt, Human
cuccguuagcuccuguggcccc

SEQ ID NO: 1380174 - RNA, 21 nt, Human
cuccguuagcuccuguggccc

SEQ ID NO: 1380175 - RNA, 18 nt, Human
cuccguuagcuccugugg

SEQ ID NO: 1380176 - RNA, 17 nt, Human
cuccguuagcuccugug

SEQ ID NO: 1380177 - RNA, 22 nt, Human
cuccuaagcaccuguaaugugc

SEQ ID NO: 1380178 - RNA, 14 nt, Human
cuccuaagcaccug

SEQ ID NO: 1380179 - RNA, 22 nt, Human
cuccuaagcaacuaggccuuca

SEQ ID NO: 1380180 - RNA, 13 nt, Human
cuccucugugacc

SEQ ID NO: 1380181 - RNA, 22 nt, Human
cuccucugugaccaaugucuug

SEQ ID NO: 1380182 - RNA, 23 nt, Human
cuccucugugaccaaugucuuga

SEQ ID NO: 1380183 - RNA, 11 nt, Human
cuccucuucca

SEQ ID NO: 1380184 - RNA, 21 nt, Human
cuccuggcuucccauccccag

SEQ ID NO: 1380185 - RNA, 23 nt, Human
cuccuggcuucccauccccagcg

SEQ ID NO: 1380186 - RNA, 14 nt, Human
cuccuggcuuccca

SEQ ID NO: 1380187 - RNA, 19 nt, Human
cuccuggcugucugaggcu

SEQ ID NO: 1380188 - RNA, 18 nt, Human
cuccuggcugucugaggc

SEQ ID NO: 1380189 - RNA, 21 nt, Human
cuccuggaucucccugagaug

SEQ ID NO: 1380190 - RNA, 19 nt, Human
cuccuggaucucccugaga

SEQ ID NO: 1380191 - RNA, 16 nt, Human
cuccuggaucucccug

SEQ ID NO: 1380192 - RNA, 15 nt, Human
cuccuggaucucccu

SEQ ID NO: 1380193 - RNA, 22 nt, Human
cucccccagcaaagcccccaga

SEQ ID NO: 1380194 - RNA, 21 nt, Human
cucccccagcaaagcccccag

SEQ ID NO: 1380195 - RNA, 20 nt, Human
cucccccagcaaagccccca

SEQ ID NO: 1380196 - RNA, 12 nt, Human
cucccccagcaa

SEQ ID NO: 1380197 - RNA, 19 nt, Human
cucccccacuuucuuucuu

SEQ ID NO: 1380198 - RNA, 13 nt, Human
cucccccacuuuc

SEQ ID NO: 1380199 - RNA, 22 nt, Human
cucccccaccguugucucaugc

SEQ ID NO: 1380200 - RNA, 19 nt, Human
cucccccaccguugucuca

SEQ ID NO: 1380201 - RNA, 21 nt, Human
cucccccaacagcuggacccu

SEQ ID NO: 1380202 - RNA, 13 nt, Human
cucccccccaugc

SEQ ID NO: 1380203 - RNA, 15 nt, Human
cucccccccaugcac

SEQ ID NO: 1380204 - RNA, 20 nt, Human
cucccccaggggcugucccg

SEQ ID NO: 1380205 - RNA, 22 nt, Human
cuccuggguuuuguauucucug

SEQ ID NO: 1380206 - RNA, 21 nt, Human
cuccuggguuuuguauucucu

SEQ ID NO: 1380207 - RNA, 19 nt, Human
cuccuggguucaagcgauu

SEQ ID NO: 1380208 - RNA, 14 nt, Human
cuccugggcccucu

SEQ ID NO: 1380209 - RNA, 12 nt, Human
cuccugggcccu

SEQ ID NO: 1380210 - RNA, 15 nt, Human
cucgugucuggcaca

SEQ ID NO: 1380211 - RNA, 14 nt, Human
cucguuaauuugua

SEQ ID NO: 1380212 - RNA, 20 nt, Human
cucguugacuggcugugugu

SEQ ID NO: 1380213 - RNA, 14 nt, Human
cucguguguuucua

SEQ ID NO: 1380214 - RNA, 16 nt, Human
cucucaggauccaagc

SEQ ID NO: 1380215 - RNA, 14 nt, Human
cucucaggauccaa

SEQ ID NO: 1380216 - RNA, 13 nt, Human
cucucaggaucca

SEQ ID NO: 1380217 - RNA, 17 nt, Human
cucucaggaccaaagcu

SEQ ID NO: 1380218 - RNA, 15 nt, Human
cucucagcuccaggu

SEQ ID NO: 1380219 - RNA, 13 nt, Human
cucucagcuccag

SEQ ID NO: 1380220 - RNA, 12 nt, Human
cucucagcucca

SEQ ID NO: 1380221 - RNA, 23 nt, Human
cucucacggccacacagcugccg

SEQ ID NO: 1380222 - RNA, 14 nt, Human
cucucaccuggccc

SEQ ID NO: 1380223 - RNA, 14 nt, Human
cucucaccucuagg

SEQ ID NO: 1380224 - RNA, 16 nt, Human
cucucaccauuuggau

SEQ ID NO: 1380225 - RNA, 23 nt, Human
cucucaccauuuggauccugugu

SEQ ID NO: 1380226 - RNA, 21 nt, Human
cucucaauauucaauaaagcu

SEQ ID NO: 1380227 - RNA, 18 nt, Human
cucuauccucucuuccuc

SEQ ID NO: 1380228 - RNA, 14 nt, Human
cucuaucauuuaau

SEQ ID NO: 1380229 - RNA, 15 nt, Human
cucuaucauuuaaua

SEQ ID NO: 1380230 - RNA, 21 nt, Human
cucuaucauuuaauaauauac

SEQ ID NO: 1380231 - RNA, 23 nt, Human
cucuaucauuuaauaauauacuu

SEQ ID NO: 1380232 - RNA, 21 nt, Human
cucuauauaccaaagcacauu

SEQ ID NO: 1380233 - RNA, 22 nt, Human
cucuauauuguucagcaugcaa

SEQ ID NO: 1380234 - RNA, 12 nt, Human
cucuaaagcaaa

SEQ ID NO: 1380235 - RNA, 19 nt, Human
cucuauaccaauaaaguga

SEQ ID NO: 1380236 - RNA, 13 nt, Human
cucguuuguguuc

SEQ ID NO: 1380237 - RNA, 19 nt, Human
cucguuuguguucuguuuu

SEQ ID NO: 1380238 - RNA, 23 nt, Human
cucguugacuggcuguguguugg

SEQ ID NO: 1380239 - RNA, 17 nt, Human
cucuaaaauuauaaaug

SEQ ID NO: 1380240 - RNA, 15 nt, Human
cucuaaaauuauaaa

SEQ ID NO: 1380241 - RNA, 16 nt, Human
cucuaaagcaaauuua

SEQ ID NO: 1380242 - RNA, 18 nt, Human
cucuauaccaauaaagug

SEQ ID NO: 1380243 - RNA, 16 nt, Human
cucccccaacagcugg

SEQ ID NO: 1380244 - RNA, 21 nt, Human
cuccccauguguccugguucc

SEQ ID NO: 1380245 - RNA, 20 nt, Human
cuccccauguguccugguuc

SEQ ID NO: 1380246 - RNA, 18 nt, Human
cuccccauguguccuggu

SEQ ID NO: 1380247 - RNA, 14 nt, Human
cuccccaugugucc

SEQ ID NO: 1380248 - RNA, 21 nt, Human
cucccaccugacacaccaggc

SEQ ID NO: 1380249 - RNA, 20 nt, Human
cucccaccugacacaccagg

SEQ ID NO: 1380250 - RNA, 15 nt, Human
cucccaccugacaca

SEQ ID NO: 1380251 - RNA, 14 nt, Human
cucccaccugacac

SEQ ID NO: 1380252 - RNA, 21 nt, Human
cucccaccuccugacacccuu

SEQ ID NO: 1380253 - RNA, 15 nt, Human
cucccaccuccugac

SEQ ID NO: 1380254 - RNA, 14 nt, Human
cucccaccuccuga

SEQ ID NO: 1380255 - RNA, 13 nt, Human
cucccaccuccug

SEQ ID NO: 1380256 - RNA, 18 nt, Human
cucccaccuccccuuggg

SEQ ID NO: 1380257 - RNA, 22 nt, Human
cucccacaugggcccaggccuc

SEQ ID NO: 1380258 - RNA, 23 nt, Human
cucccacaugggcccaggccuca

SEQ ID NO: 1380259 - RNA, 21 nt, Human
cuccaggggcugcuuccuccu

SEQ ID NO: 1380260 - RNA, 18 nt, Human
cuccaggggcugcuuccu

SEQ ID NO: 1380261 - RNA, 15 nt, Human
cuccaggggcugcuu

SEQ ID NO: 1380262 - RNA, 14 nt, Human
cuccaggggcugcu

SEQ ID NO: 1380263 - RNA, 19 nt, Human
cuccacuuucagcugucuu

SEQ ID NO: 1380264 - RNA, 18 nt, Human
cuccacuuucagcugucu

SEQ ID NO: 1380265 - RNA, 20 nt, Human
cuccacuuucagcugucuuu

SEQ ID NO: 1380266 - RNA, 17 nt, Human
cuccacuuucagcuguc

SEQ ID NO: 1380267 - RNA, 16 nt, Human
cuccacuuucagcugu

SEQ ID NO: 1380268 - RNA, 15 nt, Human
cuccacuuucagcug

SEQ ID NO: 1380269 - RNA, 14 nt, Human
cuccacuuucagcu

SEQ ID NO: 1380270 - RNA, 13 nt, Human
cuccacuuucagc

SEQ ID NO: 1380271 - RNA, 14 nt, Human
cucaugccccuggc

SEQ ID NO: 1380272 - RNA, 22 nt, Human
cucaugccaguaacaggcucaa

SEQ ID NO: 1380273 - RNA, 18 nt, Human
cucaucugucccuccggg

SEQ ID NO: 1380274 - RNA, 17 nt, Human
cucaucugucccuccgg

SEQ ID NO: 1380275 - RNA, 15 nt, Human
cucaucugucccucc

SEQ ID NO: 1380276 - RNA, 13 nt, Human
cucaucugucccu

SEQ ID NO: 1380277 - RNA, 14 nt, Human
cucaucugucacca

SEQ ID NO: 1380278 - RNA, 12 nt, Human
cucaucugucac

SEQ ID NO: 1380279 - RNA, 21 nt, Human
cucaucuggggagcaggcagc

SEQ ID NO: 1380280 - RNA, 20 nt, Human
cucaucuggggagcaggcag

SEQ ID NO: 1380281 - RNA, 19 nt, Human
cucaucuggggagcaggca

SEQ ID NO: 1380282 - RNA, 12 nt, Human
cucaucugggga

SEQ ID NO: 1380283 - RNA, 20 nt, Human
cucaucugcugguccguggg

SEQ ID NO: 1380284 - RNA, 16 nt, Human
cucaucugcugguccg

SEQ ID NO: 1380285 - RNA, 15 nt, Human
cucaucugcuggucc

SEQ ID NO: 1380286 - RNA, 14 nt, Human
cucaucugcugguc

SEQ ID NO: 1380287 - RNA, 16 nt, Human
cucaguaaagcacuug

SEQ ID NO: 1380288 - RNA, 13 nt, Human
cucaguaccccau

SEQ ID NO: 1380289 - RNA, 13 nt, Human
cucaguaauuugu

SEQ ID NO: 1380290 - RNA, 22 nt, Human
cucaguaauuuagaaaucauuu

SEQ ID NO: 1380291 - RNA, 19 nt, Human
cucaguaauuuagaaauca

SEQ ID NO: 1380292 - RNA, 18 nt, Human
cucaguaauuuagaaauc

SEQ ID NO: 1380293 - RNA, 13 nt, Human
cucaguaauuuag

SEQ ID NO: 1380294 - RNA, 18 nt, Human
cucaguagucagacugga

SEQ ID NO: 1380295 - RNA, 18 nt, Human
cuccaagccccaucuucu

SEQ ID NO: 1380296 - RNA, 17 nt, Human
cuccaagccccaucuuc

SEQ ID NO: 1380297 - RNA, 19 nt, Human
cuccaagcagcuuagaguu

SEQ ID NO: 1380298 - RNA, 16 nt, Human
cuccaagcagcuuaga

SEQ ID NO: 1380299 - RNA, 13 nt, Human
cuccaagcagcuu

SEQ ID NO: 1380300 - RNA, 18 nt, Human
cuccaagauucuagauga

SEQ ID NO: 1380301 - RNA, 15 nt, Human
cuccaagccccaucu

SEQ ID NO: 1380302 - RNA, 17 nt, Human
cuccaagcccagcccau

SEQ ID NO: 1380303 - RNA, 13 nt, Human
cuccacuggcucc

SEQ ID NO: 1380304 - RNA, 22 nt, Human
cuccaagcccagcccauggaga

SEQ ID NO: 1380305 - RNA, 17 nt, Human
cuccaagauucuagaug

SEQ ID NO: 1380306 - RNA, 16 nt, Human
cuccaagauucuagau

SEQ ID NO: 1380307 - RNA, 15 nt, Human
cuccaagauucuaga

SEQ ID NO: 1380308 - RNA, 14 nt, Human
cuccaagauucuag

SEQ ID NO: 1380309 - RNA, 13 nt, Human
cuccaagauucua

SEQ ID NO: 1380310 - RNA, 12 nt, Human
cuccaagauucu

SEQ ID NO: 1380311 - RNA, 20 nt, Human
cuccaagagcuacauaauuu

SEQ ID NO: 1380312 - RNA, 14 nt, Human
cuccaagagcuaca

SEQ ID NO: 1380313 - RNA, 14 nt, Human
cuccaagaauuucu

SEQ ID NO: 1380314 - RNA, 17 nt, Human
cucaugccccuggcugg

SEQ ID NO: 1380315 - RNA, 16 nt, Human
cucaugccccuggcug

SEQ ID NO: 1380316 - RNA, 15 nt, Human
cucauguggcuggaa

SEQ ID NO: 1380317 - RNA, 14 nt, Human
cucauguggcugga

SEQ ID NO: 1380318 - RNA, 13 nt, Human
cucauguggcugg

SEQ ID NO: 1380319 - RNA, 12 nt, Human
cucauguggcug

SEQ ID NO: 1380320 - RNA, 18 nt, Human
cucaugugacucuuucca

SEQ ID NO: 1380321 - RNA, 23 nt, Human
cucauguuaaauaggcggggcuu

SEQ ID NO: 1380322 - RNA, 16 nt, Human
cucaugugugcaacag

SEQ ID NO: 1380323 - RNA, 21 nt, Human
cuccaaccugcaaagaucugu

SEQ ID NO: 1380324 - RNA, 12 nt, Human
cucauguucuua

SEQ ID NO: 1380325 - RNA, 13 nt, Human
cuccaagaauuuc

SEQ ID NO: 1380326 - RNA, 20 nt, Human
cucugggggguggccaggcc

SEQ ID NO: 1380327 - RNA, 15 nt, Human
cucuggggugggcag

SEQ ID NO: 1380328 - RNA, 21 nt, Human
cucugggggguggccaggccg

SEQ ID NO: 1380329 - RNA, 19 nt, Human
cucugggggguggccaggc

SEQ ID NO: 1380330 - RNA, 16 nt, Human
cucugggggguggcca

SEQ ID NO: 1380331 - RNA, 17 nt, Human
cucugguaauauugacu

SEQ ID NO: 1380332 - RNA, 15 nt, Human
cucugguaaccucuu

SEQ ID NO: 1380333 - RNA, 22 nt, Human
cucugcagacuucccagcuagg

SEQ ID NO: 1380334 - RNA, 19 nt, Human
cucugcagacuucccagcu

SEQ ID NO: 1380335 - RNA, 13 nt, Human
cucugcucugcgu

SEQ ID NO: 1380336 - RNA, 18 nt, Human
cucuggugccuccagagg

SEQ ID NO: 1380337 - RNA, 16 nt, Human
cucuggugccuccaga

SEQ ID NO: 1380338 - RNA, 14 nt, Human
cucuggugccucca

SEQ ID NO: 1380339 - RNA, 13 nt, Human
cucuggugccucc

SEQ ID NO: 1380340 - RNA, 23 nt, Human
cucuggugagucaccacuucagg

SEQ ID NO: 1380341 - RNA, 20 nt, Human
cucuggucgcuccugcccac

SEQ ID NO: 1380342 - RNA, 18 nt, Human
cucuggucgcuccugccc

SEQ ID NO: 1380343 - RNA, 17 nt, Human
cucuggucgcuccugcc

SEQ ID NO: 1380344 - RNA, 16 nt, Human
cucuggucgcuccugc

SEQ ID NO: 1380345 - RNA, 19 nt, Human
cucuguccaggcacugaga

SEQ ID NO: 1380346 - RNA, 14 nt, Human
cucuguccaggcac

SEQ ID NO: 1380347 - RNA, 20 nt, Human
cucugucagucacagccacc

SEQ ID NO: 1380348 - RNA, 19 nt, Human
cucugucagucacagccac

SEQ ID NO: 1380349 - RNA, 17 nt, Human
cucugucagucacagcc

SEQ ID NO: 1380350 - RNA, 16 nt, Human
cucugucagucacagc

SEQ ID NO: 1380351 - RNA, 14 nt, Human
cucugucagucaca

SEQ ID NO: 1380352 - RNA, 17 nt, Human
cucugguggcacaggag

SEQ ID NO: 1380353 - RNA, 21 nt, Human
cucuccccuggaacugucucu

SEQ ID NO: 1380354 - RNA, 14 nt, Human
cucuccccugccug

SEQ ID NO: 1380355 - RNA, 21 nt, Human
cucuccccugcccccugcagg

SEQ ID NO: 1380356 - RNA, 16 nt, Human
cucuccccuucucugu

SEQ ID NO: 1380357 - RNA, 22 nt, Human
cucuccccugcccccugcagga

SEQ ID NO: 1380358 - RNA, 20 nt, Human
cucuccccugcccccugcag

SEQ ID NO: 1380359 - RNA, 19 nt, Human
cucuccccugcccccugca

SEQ ID NO: 1380360 - RNA, 15 nt, Human
cucuccccugccccc

SEQ ID NO: 1380361 - RNA, 12 nt, Human
cucuccccugcc

SEQ ID NO: 1380362 - RNA, 17 nt, Human
cucuccccugaccugug

SEQ ID NO: 1380363 - RNA, 15 nt, Human
cucuccccugaccug

SEQ ID NO: 1380364 - RNA, 16 nt, Human
cucuccccugccugcc

SEQ ID NO: 1380365 - RNA, 23 nt, Human
cucucccggagguugggugggcc

SEQ ID NO: 1380366 - RNA, 13 nt, Human
cucugcagcaaua

SEQ ID NO: 1380367 - RNA, 18 nt, Human
cucugcagacuucccagc

SEQ ID NO: 1380368 - RNA, 17 nt, Human
cucugcagacuucccag

SEQ ID NO: 1380369 - RNA, 18 nt, Human
cucugcagaaacuacuga

SEQ ID NO: 1380370 - RNA, 18 nt, Human
cucugcaggucccuaaua

SEQ ID NO: 1380371 - RNA, 14 nt, Human
cucugcaggucccu

SEQ ID NO: 1380372 - RNA, 15 nt, Human
cucugcaggucccua

SEQ ID NO: 1380373 - RNA, 16 nt, Human
cucugcaggucccuaa

SEQ ID NO: 1380374 - RNA, 17 nt, Human
cucugcaggucccuaau

SEQ ID NO: 1380375 - RNA, 17 nt, Human
cucuucagaggcccucg

SEQ ID NO: 1380376 - RNA, 13 nt, Human
cucuucagaggcc

SEQ ID NO: 1380377 - RNA, 14 nt, Human
cucuuauugccuca

SEQ ID NO: 1380378 - RNA, 20 nt, Human
cucuuauugccucacuucag

SEQ ID NO: 1380379 - RNA, 17 nt, Human
cucuuauugccucacuu

SEQ ID NO: 1380380 - RNA, 22 nt, Human
cucuuauugccucacuucaggu

SEQ ID NO: 1380381 - RNA, 15 nt, Human
cucuucaaaugccug

SEQ ID NO: 1380382 - RNA, 18 nt, Human
cucuucacucuucaaaug

SEQ ID NO: 1380383 - RNA, 18 nt, Human
cucuucagaucucuaacu

SEQ ID NO: 1380384 - RNA, 19 nt, Human
cucuucagaucucuaacuu

SEQ ID NO: 1380385 - RNA, 19 nt, Human
cucuuagcagcuuccagau

SEQ ID NO: 1380386 - RNA, 18 nt, Human
cucuuagcagcuuccaga

SEQ ID NO: 1380387 - RNA, 17 nt, Human
cucuuagcagcuuccag

SEQ ID NO: 1380388 - RNA, 22 nt, Human
cucuuagaugcaguucugaaga

SEQ ID NO: 1380389 - RNA, 19 nt, Human
cugaaggccugagguuacu

SEQ ID NO: 1380390 - RNA, 15 nt, Human
cugaaggccugaggu

SEQ ID NO: 1380391 - RNA, 13 nt, Human
cugaaggccugag

SEQ ID NO: 1380392 - RNA, 21 nt, Human
cugaaggagccccauuccugg

SEQ ID NO: 1380393 - RNA, 22 nt, Human
cugaauuuuuaaacaaguauuu

SEQ ID NO: 1380394 - RNA, 13 nt, Human
cugaaggagcccc

SEQ ID NO: 1380395 - RNA, 12 nt, Human
cugaaggagccc

SEQ ID NO: 1380396 - RNA, 15 nt, Human
cugaagcucccacag

SEQ ID NO: 1380397 - RNA, 23 nt, Human
cugaagccuuugcauuuuggaga

SEQ ID NO: 1380398 - RNA, 13 nt, Human
cugaagcccuugu

SEQ ID NO: 1380399 - RNA, 21 nt, Human
cugaagcccucccagguguua

SEQ ID NO: 1380400 - RNA, 21 nt, Human
cugaagcuaucguaaaauuaa

SEQ ID NO: 1380401 - RNA, 22 nt, Human
cugaagcuaucguaaaauuaag

SEQ ID NO: 1380402 - RNA, 22 nt, Human
cugaaacucacacaacuaggaa

SEQ ID NO: 1380403 - RNA, 14 nt, Human
cugaaaccaguguu

SEQ ID NO: 1380404 - RNA, 20 nt, Human
cugaaacaacuuggaaagau

SEQ ID NO: 1380405 - RNA, 16 nt, Human
cugaaacaacuuggaa

SEQ ID NO: 1380406 - RNA, 15 nt, Human
cugaaacaacuugga

SEQ ID NO: 1380407 - RNA, 12 nt, Human
cucuuuuuccaa

SEQ ID NO: 1380408 - RNA, 21 nt, Human
cucuuuuuccaacuuggcugc

SEQ ID NO: 1380409 - RNA, 21 nt, Human
cucuuuugcuuuauuccagaa

SEQ ID NO: 1380410 - RNA, 22 nt, Human
cucuuuuccuuugguccuucaa

SEQ ID NO: 1380411 - RNA, 21 nt, Human
cucuugauuauccauauugag

SEQ ID NO: 1380412 - RNA, 13 nt, Human
cucuugaugccug

SEQ ID NO: 1380413 - RNA, 15 nt, Human
cucuugaugccuggc

SEQ ID NO: 1380414 - RNA, 16 nt, Human
cucuugaugccuggcg

SEQ ID NO: 1380415 - RNA, 21 nt, Human
cucuugaugccuggcggggug

SEQ ID NO: 1380416 - RNA, 16 nt, Human
cucuugagccuugaac

SEQ ID NO: 1380417 - RNA, 17 nt, Human
cucuugagccuugaacu

SEQ ID NO: 1380418 - RNA, 18 nt, Human
cucuugagccuugaacuu

SEQ ID NO: 1380419 - RNA, 23 nt, Human
cucuugagccuugaacuuugacc

SEQ ID NO: 1380420 - RNA, 18 nt, Human
cugacaaccacuggucug

SEQ ID NO: 1380421 - RNA, 20 nt, Human
cugacaaccacuggucugua

SEQ ID NO: 1380422 - RNA, 14 nt, Human
cugacaagccaucu

SEQ ID NO: 1380423 - RNA, 14 nt, Human
cugacaacauuucu

SEQ ID NO: 1380424 - RNA, 22 nt, Human
cugacaacauuucuauagccaa

SEQ ID NO: 1380425 - RNA, 14 nt, Human
cugagaggcugucu

SEQ ID NO: 1380426 - RNA, 15 nt, Human
cugagaggcccugga

SEQ ID NO: 1380427 - RNA, 14 nt, Human
cugagaggcccugg

SEQ ID NO: 1380428 - RNA, 13 nt, Human
cugagaggcccug

SEQ ID NO: 1380429 - RNA, 21 nt, Human
cugagaggacagagagaaaua

SEQ ID NO: 1380430 - RNA, 20 nt, Human
cugagaggacagagagaaau

SEQ ID NO: 1380431 - RNA, 16 nt, Human
cugagauaugaacaua

SEQ ID NO: 1380432 - RNA, 15 nt, Human
cugagauaugaacau

SEQ ID NO: 1380433 - RNA, 12 nt, Human
cugagauaugaa

SEQ ID NO: 1380434 - RNA, 18 nt, Human
cugagauaccagcgagga

SEQ ID NO: 1380435 - RNA, 19 nt, Human
cugagauacauacagaauu

SEQ ID NO: 1380436 - RNA, 17 nt, Human
cugagauacauacagaa

SEQ ID NO: 1380437 - RNA, 22 nt, Human
cugagagucuagauucucuggc

SEQ ID NO: 1380438 - RNA, 17 nt, Human
cugagagucuagauucu

SEQ ID NO: 1380439 - RNA, 15 nt, Human
cugagagucuagauu

SEQ ID NO: 1380440 - RNA, 14 nt, Human
cugagagucuagau

SEQ ID NO: 1380441 - RNA, 16 nt, Human
cugagaggcccuggau

SEQ ID NO: 1380442 - RNA, 17 nt, Human
cugagagggcucgaggg

SEQ ID NO: 1380443 - RNA, 17 nt, Human
cugagaggacagagaga

SEQ ID NO: 1380444 - RNA, 19 nt, Human
cugagagaugcagaaauau

SEQ ID NO: 1380445 - RNA, 22 nt, Human
cugagagaggccauucuuuccc

SEQ ID NO: 1380446 - RNA, 21 nt, Human
cugagagaggccauucuuucc

SEQ ID NO: 1380447 - RNA, 14 nt, Human
cugagagaggccau

SEQ ID NO: 1380448 - RNA, 13 nt, Human
cugagagaggcca

SEQ ID NO: 1380449 - RNA, 18 nt, Human
cugagacgucaugaggag

SEQ ID NO: 1380450 - RNA, 16 nt, Human
cugagacgucaugagg

SEQ ID NO: 1380451 - RNA, 21 nt, Human
cugagaccaaggcuuucucua

SEQ ID NO: 1380452 - RNA, 22 nt, Human
cugagaccaaggcuuucucuac

SEQ ID NO: 1380453 - RNA, 18 nt, Human
cugagacuaaucuuauuc

SEQ ID NO: 1380454 - RNA, 13 nt, Human
cugagaccugaag

SEQ ID NO: 1380455 - RNA, 20 nt, Human
cugaccuggcccccucagug

SEQ ID NO: 1380456 - RNA, 17 nt, Human
cugaccuggcccccuca

SEQ ID NO: 1380457 - RNA, 14 nt, Human
cugaccuggccccc

SEQ ID NO: 1380458 - RNA, 13 nt, Human
cugaccuggcccc

SEQ ID NO: 1380459 - RNA, 12 nt, Human
cugaccuggccc

SEQ ID NO: 1380460 - RNA, 10 nt, Human
cugaccuggc

SEQ ID NO: 1380461 - RNA, 20 nt, Human
cugaccugcugaccugugca

SEQ ID NO: 1380462 - RNA, 19 nt, Human
cugaccugcugaccugugc

SEQ ID NO: 1380463 - RNA, 15 nt, Human
cugaccugcugaccu

SEQ ID NO: 1380464 - RNA, 14 nt, Human
cugaccugcugacc

SEQ ID NO: 1380465 - RNA, 13 nt, Human
cugaccugcugac

SEQ ID NO: 1380466 - RNA, 14 nt, Human
cugaccugcacugg

SEQ ID NO: 1380467 - RNA, 22 nt, Human
cugaccccaaacaccuuccagc

SEQ ID NO: 1380468 - RNA, 21 nt, Human
cugaccccaaacaccuuccag

SEQ ID NO: 1380469 - RNA, 20 nt, Human
cugaccccaaacaccuucca

SEQ ID NO: 1380470 - RNA, 16 nt, Human
cugagucaaguuguuc

SEQ ID NO: 1380471 - RNA, 15 nt, Human
cugagucaaguuguu

SEQ ID NO: 1380472 - RNA, 23 nt, Human
cugaguauuaaaauguaugcaug

SEQ ID NO: 1380473 - RNA, 22 nt, Human
cugaguauuaaaauguaugcau

SEQ ID NO: 1380474 - RNA, 21 nt, Human
cugaguauuaaaauguaugca

SEQ ID NO: 1380475 - RNA, 16 nt, Human
cugaguauuaaaaugu

SEQ ID NO: 1380476 - RNA, 22 nt, Human
cugaggugccugucccaccccc

SEQ ID NO: 1380477 - RNA, 19 nt, Human
cugaggugccugucccacc

SEQ ID NO: 1380478 - RNA, 17 nt, Human
cugaggugccuguccca

SEQ ID NO: 1380479 - RNA, 19 nt, Human
cugaggugcccaggagaag

SEQ ID NO: 1380480 - RNA, 18 nt, Human
cugaggugcccaggagaa

SEQ ID NO: 1380481 - RNA, 17 nt, Human
cugaggugcccaggaga

SEQ ID NO: 1380482 - RNA, 16 nt, Human
cugaggugcccaggag

SEQ ID NO: 1380483 - RNA, 15 nt, Human
cugaggugcccagga

SEQ ID NO: 1380484 - RNA, 14 nt, Human
cugaggugcccagg

SEQ ID NO: 1380485 - RNA, 13 nt, Human
cugaggugcccag

SEQ ID NO: 1380486 - RNA, 18 nt, Human
cugaggugcacugggagg

SEQ ID NO: 1380487 - RNA, 17 nt, Human
cugaggugcacugggag

SEQ ID NO: 1380488 - RNA, 16 nt, Human
cugaggugcacuggga

SEQ ID NO: 1380489 - RNA, 18 nt, Human
cugaggagucugaggucc

SEQ ID NO: 1380490 - RNA, 17 nt, Human
cugaggagucugagguc

SEQ ID NO: 1380491 - RNA, 16 nt, Human
cugaggagucugaggu

SEQ ID NO: 1380492 - RNA, 15 nt, Human
cugaggagucugagg

SEQ ID NO: 1380493 - RNA, 12 nt, Human
cugaggagucug

SEQ ID NO: 1380494 - RNA, 23 nt, Human
cugaggagcagcaggagggggga

SEQ ID NO: 1380495 - RNA, 21 nt, Human
cugaggagcagcaggaggggg

SEQ ID NO: 1380496 - RNA, 14 nt, Human
cugaggagcagcag

SEQ ID NO: 1380497 - RNA, 22 nt, Human
cugaggacugauuucagaguga

SEQ ID NO: 1380498 - RNA, 14 nt, Human
cugaggacugauuu

SEQ ID NO: 1380499 - RNA, 18 nt, Human
cugaggacagaugccucc

SEQ ID NO: 1380500 - RNA, 23 nt, Human
cugaguacuccacacugcacaau

SEQ ID NO: 1380501 - RNA, 12 nt, Human
cugaguagaaag

SEQ ID NO: 1380502 - RNA, 19 nt, Human
cugaguacuccacacugca

SEQ ID NO: 1380503 - RNA, 18 nt, Human
cugaguacuccacacugc

SEQ ID NO: 1380504 - RNA, 14 nt, Human
cugaguagaaaggc

SEQ ID NO: 1380505 - RNA, 19 nt, Human
cugaguagaaaggccuuua

SEQ ID NO: 1380506 - RNA, 20 nt, Human
cugaguagaaaggccuuuaa

SEQ ID NO: 1380507 - RNA, 16 nt, Human
cugaguacuccacacu

SEQ ID NO: 1380508 - RNA, 15 nt, Human
cugaguacuccacac

SEQ ID NO: 1380509 - RNA, 13 nt, Human
cugaguacuccac

SEQ ID NO: 1380510 - RNA, 20 nt, Human
cugaggugcccaggagaaga

SEQ ID NO: 1380511 - RNA, 21 nt, Human
cugaguacguugugcauuugg

SEQ ID NO: 1380512 - RNA, 18 nt, Human
cugaguacguugugcauu

SEQ ID NO: 1380513 - RNA, 17 nt, Human
cugaguacguugugcau

SEQ ID NO: 1380514 - RNA, 19 nt, Human
cugaguacguugugcauuu

SEQ ID NO: 1380515 - RNA, 20 nt, Human
cugaguacguugugcauuug

SEQ ID NO: 1380516 - RNA, 23 nt, Human
cugagauaugaacauauuguuga

SEQ ID NO: 1380517 - RNA, 21 nt, Human
cugagauaugaacauauuguu

SEQ ID NO: 1380518 - RNA, 20 nt, Human
cugagaugggcuucccaagg

SEQ ID NO: 1380519 - RNA, 21 nt, Human
cugagauggcucccaggggcu

SEQ ID NO: 1380520 - RNA, 20 nt, Human
cugagauggcucccaggggc

SEQ ID NO: 1380521 - RNA, 18 nt, Human
cugagauggcucccaggg

SEQ ID NO: 1380522 - RNA, 17 nt, Human
cugagauggcucccagg

SEQ ID NO: 1380523 - RNA, 16 nt, Human
cugagauggcucccag

SEQ ID NO: 1380524 - RNA, 13 nt, Human
cugagauggcucc

SEQ ID NO: 1380525 - RNA, 20 nt, Human
cugaggacagaugccuccuu

SEQ ID NO: 1380526 - RNA, 15 nt, Human
cugaggacagaugcc

SEQ ID NO: 1380527 - RNA, 14 nt, Human
cugaggacagaugc

SEQ ID NO: 1380528 - RNA, 23 nt, Human
cugaggacaagagaaaaaagcca

SEQ ID NO: 1380529 - RNA, 11 nt, Human
cgguuucucca

SEQ ID NO: 1380530 - RNA, 21 nt, Human
cgguuauaaaaaaugguucag

SEQ ID NO: 1380531 - RNA, 20 nt, Human
cgguuauaaaaaaugguuca

SEQ ID NO: 1380532 - RNA, 18 nt, Human
cgguuauaaaaaaugguu

SEQ ID NO: 1380533 - RNA, 13 nt, Human
cgguguucuaaga

SEQ ID NO: 1380534 - RNA, 12 nt, Human
cguaaagauuug

SEQ ID NO: 1380535 - RNA, 16 nt, Human
cguaaaaaugauuuca

SEQ ID NO: 1380536 - RNA, 14 nt, Human
cguaaaauuaagaa

SEQ ID NO: 1380537 - RNA, 17 nt, Human
cgugguggucccugggu

SEQ ID NO: 1380538 - RNA, 15 nt, Human
cgugguggucccugg

SEQ ID NO: 1380539 - RNA, 13 nt, Human
cgugguggucccu

SEQ ID NO: 1380540 - RNA, 18 nt, Human
cguggugcgagugcguga

SEQ ID NO: 1380541 - RNA, 22 nt, Human
cguggugauuuagcaggaagcu

SEQ ID NO: 1380542 - RNA, 23 nt, Human
cgugaucaaguugaggggcuucc

SEQ ID NO: 1380543 - RNA, 13 nt, Human
cgugauccacccg

SEQ ID NO: 1380544 - RNA, 17 nt, Human
cgugauccacccgccuc

SEQ ID NO: 1380545 - RNA, 24 nt, Human
cgugauccacccgccucagccucc

SEQ ID NO: 1380546 - RNA, 14 nt, Human
cgugaucucagcuc

SEQ ID NO: 1380547 - RNA, 15 nt, Human
cgugaucucagcuca

SEQ ID NO: 1380548 - RNA, 20 nt, Human
cggggaacuggccaagcuga

SEQ ID NO: 1380549 - RNA, 22 nt, Human
cggggaacuggccaagcugagg

SEQ ID NO: 1380550 - RNA, 17 nt, Human
cggggaacuggccaagc

SEQ ID NO: 1380551 - RNA, 15 nt, Human
cggggaacuggccaa

SEQ ID NO: 1380552 - RNA, 22 nt, Human
cgggccuguccacaggcuucug

SEQ ID NO: 1380553 - RNA, 17 nt, Human
cgggccuguccacaggc

SEQ ID NO: 1380554 - RNA, 18 nt, Human
cgggccaaggaccugaga

SEQ ID NO: 1380555 - RNA, 15 nt, Human
cgggccaaggaccug

SEQ ID NO: 1380556 - RNA, 20 nt, Human
cggcuccccauguguccugg

SEQ ID NO: 1380557 - RNA, 17 nt, Human
cggcuccccaugugucc

SEQ ID NO: 1380558 - RNA, 15 nt, Human
cggcuccccaugugu

SEQ ID NO: 1380559 - RNA, 14 nt, Human
cgccuggccuggcc

SEQ ID NO: 1380560 - RNA, 20 nt, Human
cgccuggguccaaugcucag

SEQ ID NO: 1380561 - RNA, 19 nt, Human
cgcugccagcucuguauca

SEQ ID NO: 1380562 - RNA, 15 nt, Human
cgcugccagcucugu

SEQ ID NO: 1380563 - RNA, 14 nt, Human
cggaggacucacca

SEQ ID NO: 1380564 - RNA, 19 nt, Human
cggaggaaggaggacccag

SEQ ID NO: 1380565 - RNA, 20 nt, Human
cggaggaaggaggacccagg

SEQ ID NO: 1380566 - RNA, 21 nt, Human
cggaggaaggaggacccagga

SEQ ID NO: 1380567 - RNA, 23 nt, Human
cggaggaaggaggacccaggaca

SEQ ID NO: 1380568 - RNA, 19 nt, Human
cgcauggucacacacugau

SEQ ID NO: 1380569 - RNA, 16 nt, Human
cgcauggucacacacu

SEQ ID NO: 1380570 - RNA, 14 nt, Human
cgcaugcggcccag

SEQ ID NO: 1380571 - RNA, 16 nt, Human
cgcaugcggcccagga

SEQ ID NO: 1380572 - RNA, 22 nt, Human
cgaucacaacgugcauugugcu

SEQ ID NO: 1380573 - RNA, 23 nt, Human
cgaucacaacgugcauugugcuu

SEQ ID NO: 1380574 - RNA, 24 nt, Human
cgaucacaacgugcauugugcuuc

SEQ ID NO: 1380575 - RNA, 19 nt, Human
cgagucauucguucugugg

SEQ ID NO: 1380576 - RNA, 18 nt, Human
cgagucauucguucugug

SEQ ID NO: 1380577 - RNA, 15 nt, Human
cgauauacucuagau

SEQ ID NO: 1380578 - RNA, 12 nt, Human
cgauagagucuc

SEQ ID NO: 1380579 - RNA, 18 nt, Human
cgaucacaacgugcauug

SEQ ID NO: 1380580 - RNA, 15 nt, Human
cgaguccaagcuggg

SEQ ID NO: 1380581 - RNA, 14 nt, Human
cgaguccaagcugg

SEQ ID NO: 1380582 - RNA, 13 nt, Human
cgaguccaagcug

SEQ ID NO: 1380583 - RNA, 20 nt, Human
cgagucauucguucugugga

SEQ ID NO: 1380584 - RNA, 19 nt, Human
cgccuggcugcagccugcg

SEQ ID NO: 1380585 - RNA, 21 nt, Human
cgccuggcaguccgugggacg

SEQ ID NO: 1380586 - RNA, 20 nt, Human
cgccugagcccagggaggcc

SEQ ID NO: 1380587 - RNA, 17 nt, Human
cgccugaggcaauuaga

SEQ ID NO: 1380588 - RNA, 20 nt, Human
cgccugaggaacccuuacag

SEQ ID NO: 1380589 - RNA, 21 nt, Human
cgccugagcccagggaggccg

SEQ ID NO: 1380590 - RNA, 19 nt, Human
cgccugagcccagggaggc

SEQ ID NO: 1380591 - RNA, 18 nt, Human
cgccugagcccagggagg

SEQ ID NO: 1380592 - RNA, 17 nt, Human
cgccugagcccagggag

SEQ ID NO: 1380593 - RNA, 16 nt, Human
cgccugagcccaggga

SEQ ID NO: 1380594 - RNA, 15 nt, Human
cgccugagcccaggg

SEQ ID NO: 1380595 - RNA, 14 nt, Human
cgccugagcccagg

SEQ ID NO: 1380596 - RNA, 13 nt, Human
cgccugagcccag

SEQ ID NO: 1380597 - RNA, 11 nt, Human
cgccugagccc

SEQ ID NO: 1380598 - RNA, 23 nt, Human
cgccugacaaccacuggucugua

SEQ ID NO: 1380599 - RNA, 21 nt, Human
cgccugacaaccacuggucug

SEQ ID NO: 1380600 - RNA, 20 nt, Human
cgccugacaaccacuggucu

SEQ ID NO: 1380601 - RNA, 15 nt, Human
cgccucuuucaagca

SEQ ID NO: 1380602 - RNA, 17 nt, Human
cgccucuugaccaggcu

SEQ ID NO: 1380603 - RNA, 15 nt, Human
cgccucuugaccagg

SEQ ID NO: 1380604 - RNA, 18 nt, Human
cgccuccauccaaggcca

SEQ ID NO: 1380605 - RNA, 16 nt, Human
cgccuccauccaaggc

SEQ ID NO: 1380606 - RNA, 19 nt, Human
cgccacuggggcucagagc

SEQ ID NO: 1380607 - RNA, 15 nt, Human
cgccacuggggcuca

SEQ ID NO: 1380608 - RNA, 13 nt, Human
cgccacuggggcu

SEQ ID NO: 1380609 - RNA, 18 nt, Human
cgccacuggggcucagag

SEQ ID NO: 1380610 - RNA, 17 nt, Human
cgccacuggggcucaga

SEQ ID NO: 1380611 - RNA, 21 nt, Human
cgccucacugcaaccuucacc

SEQ ID NO: 1380612 - RNA, 16 nt, Human
cgccuccaacccuagc

SEQ ID NO: 1380613 - RNA, 17 nt, Human
cgccuccaacccuagca

SEQ ID NO: 1380614 - RNA, 21 nt, Human
ccuugccccccuggccucccc

SEQ ID NO: 1380615 - RNA, 16 nt, Human
ccuugccccccuggcc

SEQ ID NO: 1380616 - RNA, 17 nt, Human
ccuugcuuaccucucag

SEQ ID NO: 1380617 - RNA, 18 nt, Human
ccuugcuuaugacaucac

SEQ ID NO: 1380618 - RNA, 16 nt, Human
ccuugcuuaccucuca

SEQ ID NO: 1380619 - RNA, 12 nt, Human
ccuugcugugaa

SEQ ID NO: 1380620 - RNA, 22 nt, Human
ccuugcugcaagcacagcccuu

SEQ ID NO: 1380621 - RNA, 17 nt, Human
ccuugccccccuggccu

SEQ ID NO: 1380622 - RNA, 15 nt, Human
ccuuuugacacugcu

SEQ ID NO: 1380623 - RNA, 13 nt, Human
ccuuuugacacug

SEQ ID NO: 1380624 - RNA, 19 nt, Human
ccuuuccaccacagccagc

SEQ ID NO: 1380625 - RNA, 17 nt, Human
ccuuucaggaucuauuu

SEQ ID NO: 1380626 - RNA, 19 nt, Human
ccuuucaggaucuauuuuu

SEQ ID NO: 1380627 - RNA, 14 nt, Human
ccuuucaggaucua

SEQ ID NO: 1380628 - RNA, 19 nt, Human
ccuuuuuaauaugcuuaaa

SEQ ID NO: 1380629 - RNA, 11 nt, Human
ccuuuugcaaa

SEQ ID NO: 1380630 - RNA, 23 nt, Human
ccuuuugaggagccccagcuacc

SEQ ID NO: 1380631 - RNA, 21 nt, Human
ccuuuugaggagccccagcua

SEQ ID NO: 1380632 - RNA, 16 nt, Human
ccuuuugaggagcccc

SEQ ID NO: 1380633 - RNA, 18 nt, Human
ccuuuugacacugcucua

SEQ ID NO: 1380634 - RNA, 22 nt, Human
ccuuucacaggcagccagugcc

SEQ ID NO: 1380635 - RNA, 14 nt, Human
ccuuucacaggcag

SEQ ID NO: 1380636 - RNA, 18 nt, Human
ccuuuacaugaggacucu

SEQ ID NO: 1380637 - RNA, 12 nt, Human
ccuuuacaugag

SEQ ID NO: 1380638 - RNA, 18 nt, Human
ccuuuaauuguaaaguaa

SEQ ID NO: 1380639 - RNA, 15 nt, Human
ccuuuacuugaccuc

SEQ ID NO: 1380640 - RNA, 15 nt, Human
cgacuggccagggcc

SEQ ID NO: 1380641 - RNA, 14 nt, Human
cgacuggccagggc

SEQ ID NO: 1380642 - RNA, 20 nt, Human
cgacucugugcuggccagcg

SEQ ID NO: 1380643 - RNA, 20 nt, Human
cgacuggccagggccacgcu

SEQ ID NO: 1380644 - RNA, 17 nt, Human
cgacuggccagggccac

SEQ ID NO: 1380645 - RNA, 14 nt, Human
cgacugcaacagga

SEQ ID NO: 1380646 - RNA, 18 nt, Human
cgacugaaaauauuguuu

SEQ ID NO: 1380647 - RNA, 17 nt, Human
cgacugccaucuuggac

SEQ ID NO: 1380648 - RNA, 21 nt, Human
cgacucacaccacuagccuca

SEQ ID NO: 1380649 - RNA, 14 nt, Human
cgacuaauuucaaa

SEQ ID NO: 1380650 - RNA, 19 nt, Human
cgacuccguuggccacucc

SEQ ID NO: 1380651 - RNA, 16 nt, Human
cgacuccguuggccac

SEQ ID NO: 1380652 - RNA, 16 nt, Human
cgacucugugcuggcc

SEQ ID NO: 1380653 - RNA, 19 nt, Human
cgacucacaccacuagccu

SEQ ID NO: 1380654 - RNA, 22 nt, Human
cgacucugugcuggccagcgag

SEQ ID NO: 1380655 - RNA, 17 nt, Human
cgacugaaaauauuguu

SEQ ID NO: 1380656 - RNA, 23 nt, Human
cgacccccucucccugcauggca

SEQ ID NO: 1380657 - RNA, 21 nt, Human
cgacacugcagccccacccag

SEQ ID NO: 1380658 - RNA, 16 nt, Human
cgacacggucggggca

SEQ ID NO: 1380659 - RNA, 12 nt, Human
cgacaagugcug

SEQ ID NO: 1380660 - RNA, 14 nt, Human
ccuuuuuguauaaa

SEQ ID NO: 1380661 - RNA, 19 nt, Human
ccuuuuuguauaaaauaga

SEQ ID NO: 1380662 - RNA, 21 nt, Human
ccuuuuuuagaguugauacua

SEQ ID NO: 1380663 - RNA, 21 nt, Human
ccuuuuucaaugaauuuuaua

SEQ ID NO: 1380664 - RNA, 12 nt, Human
ccuuuuucaaug

SEQ ID NO: 1380665 - RNA, 17 nt, Human
ccuuuuuauuugcaugu

SEQ ID NO: 1380666 - RNA, 18 nt, Human
ccuuuuuauuugcaugug

SEQ ID NO: 1380667 - RNA, 13 nt, Human
cucaauggacugg

SEQ ID NO: 1380668 - RNA, 15 nt, Human
cucaaugcucauaac

SEQ ID NO: 1380669 - RNA, 21 nt, Human
cucaaugagcauguuuagacu

SEQ ID NO: 1380670 - RNA, 12 nt, Human
cucaaugcucau

SEQ ID NO: 1380671 - RNA, 13 nt, Human
cucaaugcucaua

SEQ ID NO: 1380672 - RNA, 23 nt, Human
cucaauuuuaucccucaccugua

SEQ ID NO: 1380673 - RNA, 22 nt, Human
cucacaaaccaugcaaaugcua

SEQ ID NO: 1380674 - RNA, 16 nt, Human
cucaauuucugaacac

SEQ ID NO: 1380675 - RNA, 14 nt, Human
cucaauucuucccu

SEQ ID NO: 1380676 - RNA, 19 nt, Human
cucaauucuucccuaucuu

SEQ ID NO: 1380677 - RNA, 14 nt, Human
cucaaacuccugac

SEQ ID NO: 1380678 - RNA, 19 nt, Human
cucaaacuccugaccucag

SEQ ID NO: 1380679 - RNA, 16 nt, Human
cucaauaaaugauucu

SEQ ID NO: 1380680 - RNA, 16 nt, Human
cucaauauucaauaaa

SEQ ID NO: 1380681 - RNA, 17 nt, Human
cucaauauucaauaaag

SEQ ID NO: 1380682 - RNA, 18 nt, Human
cucaauauucaauaaagc

SEQ ID NO: 1380683 - RNA, 19 nt, Human
cucaauauucaauaaagcu

SEQ ID NO: 1380684 - RNA, 22 nt, Human
cuauuaaagugcuaagguucua

SEQ ID NO: 1380685 - RNA, 21 nt, Human
cuauuaaagugcuaagguucu

SEQ ID NO: 1380686 - RNA, 20 nt, Human
cuauuaaagugcuaagguuc

SEQ ID NO: 1380687 - RNA, 23 nt, Human
cuauuaaagugcuaagguucuaa

SEQ ID NO: 1380688 - RNA, 19 nt, Human
cuauuaaagugcuaagguu

SEQ ID NO: 1380689 - RNA, 19 nt, Human
cuauuaaaagacucauccg

SEQ ID NO: 1380690 - RNA, 18 nt, Human
cuauuaaaagacucaucc

SEQ ID NO: 1380691 - RNA, 20 nt, Human
cuauuaaaagacucauccgu

SEQ ID NO: 1380692 - RNA, 18 nt, Human
cuauuuuuuuuuuuuugu

SEQ ID NO: 1380693 - RNA, 13 nt, Human
cucaaacaaugac

SEQ ID NO: 1380694 - RNA, 18 nt, Human
cucaaaauauuuguacau

SEQ ID NO: 1380695 - RNA, 13 nt, Human
cucaaaauauuug

SEQ ID NO: 1380696 - RNA, 21 nt, Human
cucaaacaaugacaaagcaga

SEQ ID NO: 1380697 - RNA, 20 nt, Human
cucaaacaaugacaaagcag

SEQ ID NO: 1380698 - RNA, 15 nt, Human
cucaaacaaugacaa

SEQ ID NO: 1380699 - RNA, 18 nt, Human
cucaaaccaaaucacuga

SEQ ID NO: 1380700 - RNA, 19 nt, Human
cucaaaccaaaucacugaa

SEQ ID NO: 1380701 - RNA, 22 nt, Human
cucaaaccaaaucacugaacuu

SEQ ID NO: 1380702 - RNA, 17 nt, Human
cuaguuuucuccuccca

SEQ ID NO: 1380703 - RNA, 16 nt, Human
cuaguuuucuccuccc

SEQ ID NO: 1380704 - RNA, 19 nt, Human
cuaguuuucuccucccagg

SEQ ID NO: 1380705 - RNA, 18 nt, Human
cuaguuuucuccucccag

SEQ ID NO: 1380706 - RNA, 22 nt, Human
cuaguuugauuaaauucuugca

SEQ ID NO: 1380707 - RNA, 16 nt, Human
cuagcaugaagacaga

SEQ ID NO: 1380708 - RNA, 13 nt, Human
cuaguuugauuaa

SEQ ID NO: 1380709 - RNA, 15 nt, Human
cuaguuugauuaaau

SEQ ID NO: 1380710 - RNA, 18 nt, Human
cuaucauugcuuccuccu

SEQ ID NO: 1380711 - RNA, 20 nt, Human
cuaucguucucucuuugcau

SEQ ID NO: 1380712 - RNA, 20 nt, Human
cuaucauugcuuccuccucc

SEQ ID NO: 1380713 - RNA, 19 nt, Human
cuaucauugcuuccuccuc

SEQ ID NO: 1380714 - RNA, 13 nt, Human
cuaucauuuaaua

SEQ ID NO: 1380715 - RNA, 15 nt, Human
cuaucauuuaauaau

SEQ ID NO: 1380716 - RNA, 17 nt, Human
cuaucauuuaauaauau

SEQ ID NO: 1380717 - RNA, 21 nt, Human
cuaucauuuaauaauauacuu

SEQ ID NO: 1380718 - RNA, 23 nt, Human
cuauccaaucaaucuugcaugua

SEQ ID NO: 1380719 - RNA, 20 nt, Human
cuauccaaucaaucuugcau

SEQ ID NO: 1380720 - RNA, 18 nt, Human
cuaucguaaaauuaagaa

SEQ ID NO: 1380721 - RNA, 14 nt, Human
cuagaacccucugu

SEQ ID NO: 1380722 - RNA, 14 nt, Human
cuagcauaucugcc

SEQ ID NO: 1380723 - RNA, 15 nt, Human
cuagcauaucugccu

SEQ ID NO: 1380724 - RNA, 17 nt, Human
cuagcauaucugccuuu

SEQ ID NO: 1380725 - RNA, 18 nt, Human
cuagcauaucugccuuua

SEQ ID NO: 1380726 - RNA, 21 nt, Human
cuagcauacguacacauuuua

SEQ ID NO: 1380727 - RNA, 23 nt, Human
cuagcauacguacacauuuuauu

SEQ ID NO: 1380728 - RNA, 17 nt, Human
cuagacaagccagaacu

SEQ ID NO: 1380729 - RNA, 16 nt, Human
cuagacaagccagaac

SEQ ID NO: 1380730 - RNA, 14 nt, Human
cuagacaagccaga

SEQ ID NO: 1380731 - RNA, 13 nt, Human
cuagacaagccag

SEQ ID NO: 1380732 - RNA, 21 nt, Human
cuagaauuugauuauuaacau

SEQ ID NO: 1380733 - RNA, 23 nt, Human
cuagaauuugauaugugaacagu

SEQ ID NO: 1380734 - RNA, 15 nt, Human
cuacaguuuuaacug

SEQ ID NO: 1380735 - RNA, 16 nt, Human
cuacagucucgucucu

SEQ ID NO: 1380736 - RNA, 22 nt, Human
cuaauuucaaaaugcuuuuuau

SEQ ID NO: 1380737 - RNA, 19 nt, Human
cuaauuucaaaaugcuuuu

SEQ ID NO: 1380738 - RNA, 18 nt, Human
cuaauuucaaaaugcuuu

SEQ ID NO: 1380739 - RNA, 17 nt, Human
cuaauuucaaaaugcuu

SEQ ID NO: 1380740 - RNA, 23 nt, Human
cuaauuuauccugaaauuucaga

SEQ ID NO: 1380741 - RNA, 21 nt, Human
cuaauuuauccugaaauuuca

SEQ ID NO: 1380742 - RNA, 17 nt, Human
cuaauuuauaaaaaggu

SEQ ID NO: 1380743 - RNA, 16 nt, Human
cuaccuggucucuccu

SEQ ID NO: 1380744 - RNA, 19 nt, Human
cuaccugcucagcccugca

SEQ ID NO: 1380745 - RNA, 21 nt, Human
cuaccugccccacuuguccuu

SEQ ID NO: 1380746 - RNA, 13 nt, Human
cuacaugaaacag

SEQ ID NO: 1380747 - RNA, 10 nt, Human
cuacaugaaa

SEQ ID NO: 1380748 - RNA, 16 nt, Human
cuacaucuucugccuu

SEQ ID NO: 1380749 - RNA, 15 nt, Human
cuacaucuucugccu

SEQ ID NO: 1380750 - RNA, 14 nt, Human
cuacaucuucugcc

SEQ ID NO: 1380751 - RNA, 16 nt, Human
cuacauaugaucuguc

SEQ ID NO: 1380752 - RNA, 14 nt, Human
cuacaugaaacaga

SEQ ID NO: 1380753 - RNA, 21 nt, Human
cuacucacuuuucccacucca

SEQ ID NO: 1380754 - RNA, 19 nt, Human
cuacucacuuuucccacuc

SEQ ID NO: 1380755 - RNA, 15 nt, Human
cuacucacuuuuccc

SEQ ID NO: 1380756 - RNA, 14 nt, Human
cuacucacuuuucc

SEQ ID NO: 1380757 - RNA, 14 nt, Human
cuacguauuuaaua

SEQ ID NO: 1380758 - RNA, 16 nt, Human
cuacgcuguccagaaa

SEQ ID NO: 1380759 - RNA, 22 nt, Human
cuaccuguugagcaucacagaa

SEQ ID NO: 1380760 - RNA, 17 nt, Human
cuaccuguguggacagg

SEQ ID NO: 1380761 - RNA, 11 nt, Human
cuaccugugug

SEQ ID NO: 1380762 - RNA, 13 nt, Human
cuaccugugccug

SEQ ID NO: 1380763 - RNA, 12 nt, Human
cuaccugugccu

SEQ ID NO: 1380764 - RNA, 21 nt, Human
cuaccuguugagcaucacaga

SEQ ID NO: 1380765 - RNA, 17 nt, Human
cuaccuuuguauucucu

SEQ ID NO: 1380766 - RNA, 23 nt, Human
cgugugggagaccggccugccag

SEQ ID NO: 1380767 - RNA, 20 nt, Human
cgugugugugcguccugucg

SEQ ID NO: 1380768 - RNA, 21 nt, Human
cuaaguuaauuuaaaguuguu

SEQ ID NO: 1380769 - RNA, 17 nt, Human
cuaaguuaauuuaaagu

SEQ ID NO: 1380770 - RNA, 15 nt, Human
cuaaguuaauuuaaa

SEQ ID NO: 1380771 - RNA, 17 nt, Human
cuaaguguuucauaaau

SEQ ID NO: 1380772 - RNA, 14 nt, Human
cuaagugugaacug

SEQ ID NO: 1380773 - RNA, 17 nt, Human
cuaaguaaauaggaauu

SEQ ID NO: 1380774 - RNA, 19 nt, Human
cuaaguaaauacaauuuuu

SEQ ID NO: 1380775 - RNA, 18 nt, Human
cuaaguaaauacaauuuu

SEQ ID NO: 1380776 - RNA, 17 nt, Human
cuaaguaaauacaauuu

SEQ ID NO: 1380777 - RNA, 16 nt, Human
cuaaguaaauacaauu

SEQ ID NO: 1380778 - RNA, 15 nt, Human
cuaaguaaauacaau

SEQ ID NO: 1380779 - RNA, 14 nt, Human
cuaaguaaauacaa

SEQ ID NO: 1380780 - RNA, 14 nt, Human
cuaauuuauaaaaa

SEQ ID NO: 1380781 - RNA, 13 nt, Human
cuaauuuauaaaa

SEQ ID NO: 1380782 - RNA, 13 nt, Human
cuaauugccaugu

SEQ ID NO: 1380783 - RNA, 20 nt, Human
cuaauucuauuaaagugcua

SEQ ID NO: 1380784 - RNA, 16 nt, Human
cuaauucuauuaaagu

SEQ ID NO: 1380785 - RNA, 15 nt, Human
cuaauucuaugccug

SEQ ID NO: 1380786 - RNA, 21 nt, Human
cuaaguuauaagacucucaca

SEQ ID NO: 1380787 - RNA, 17 nt, Human
cuaaguuauaagacucu

SEQ ID NO: 1380788 - RNA, 23 nt, Human
cuaaguuuuuauggcuuuugugc

SEQ ID NO: 1380789 - RNA, 22 nt, Human
cuaauaaaaagcuuuugucuac

SEQ ID NO: 1380790 - RNA, 20 nt, Human
cuaauaaaaagcuuuugucu

SEQ ID NO: 1380791 - RNA, 18 nt, Human
cuaauaaaaagcuuuugu

SEQ ID NO: 1380792 - RNA, 17 nt, Human
cuaauaaaaagcuuuug

SEQ ID NO: 1380793 - RNA, 14 nt, Human
cuaauucuaaugug

SEQ ID NO: 1380794 - RNA, 13 nt, Human
ccucuuucagcuc

SEQ ID NO: 1380795 - RNA, 12 nt, Human
ccucuuucagcu

SEQ ID NO: 1380796 - RNA, 23 nt, Human
ccucuuucaagcagucgugccug

SEQ ID NO: 1380797 - RNA, 23 nt, Human
ccugaccaguugcagucacucua

SEQ ID NO: 1380798 - RNA, 20 nt, Human
ccugaccaguugcagucacu

SEQ ID NO: 1380799 - RNA, 13 nt, Human
ccugaccaguugc

SEQ ID NO: 1380800 - RNA, 12 nt, Human
ccugaccaguug

SEQ ID NO: 1380801 - RNA, 22 nt, Human
ccugaccagcugcuccgaggac

SEQ ID NO: 1380802 - RNA, 21 nt, Human
ccugaccagcugcuccgagga

SEQ ID NO: 1380803 - RNA, 20 nt, Human
ccugaccagcugcuccgagg

SEQ ID NO: 1380804 - RNA, 15 nt, Human
ccugaccagcugcuc

SEQ ID NO: 1380805 - RNA, 14 nt, Human
ccugaccagcugcu

SEQ ID NO: 1380806 - RNA, 14 nt, Human
ccugaccagcuccc

SEQ ID NO: 1380807 - RNA, 20 nt, Human
ccugaccacucagagacaug

SEQ ID NO: 1380808 - RNA, 18 nt, Human
ccugaccacucagagaca

SEQ ID NO: 1380809 - RNA, 17 nt, Human
ccugaccacucagagac

SEQ ID NO: 1380810 - RNA, 16 nt, Human
ccugaccacucagaga

SEQ ID NO: 1380811 - RNA, 15 nt, Human
ccugaccacucagag

SEQ ID NO: 1380812 - RNA, 21 nt, Human
ccugaccaguugcagucacuc

SEQ ID NO: 1380813 - RNA, 13 nt, Human
ccugaccacucag

SEQ ID NO: 1380814 - RNA, 16 nt, Human
ccucuuucagcuccug

SEQ ID NO: 1380815 - RNA, 18 nt, Human
ccucuuucagcuccugac

SEQ ID NO: 1380816 - RNA, 15 nt, Human
ccucuuucagcuccu

SEQ ID NO: 1380817 - RNA, 14 nt, Human
ccucuuucagcucc

SEQ ID NO: 1380818 - RNA, 22 nt, Human
ccugagucgugaccugcuaggc

SEQ ID NO: 1380819 - RNA, 21 nt, Human
ccugagucgugaccugcuagg

SEQ ID NO: 1380820 - RNA, 18 nt, Human
ccugagucgugaccugcu

SEQ ID NO: 1380821 - RNA, 23 nt, Human
ccugagucacccuaccugugccu

SEQ ID NO: 1380822 - RNA, 11 nt, Human
ccugaguccca

SEQ ID NO: 1380823 - RNA, 22 nt, Human
ccugagucguacagaaagcugc

SEQ ID NO: 1380824 - RNA, 21 nt, Human
ccugagucguacagaaagcug

SEQ ID NO: 1380825 - RNA, 19 nt, Human
ccugagucguacagaaagc

SEQ ID NO: 1380826 - RNA, 16 nt, Human
ccugagucccaucccu

SEQ ID NO: 1380827 - RNA, 16 nt, Human
ccugcccccaauccau

SEQ ID NO: 1380828 - RNA, 15 nt, Human
ccugcccccaaucca

SEQ ID NO: 1380829 - RNA, 14 nt, Human
ccugccccaggccu

SEQ ID NO: 1380830 - RNA, 18 nt, Human
ccugccccaggccugaaa

SEQ ID NO: 1380831 - RNA, 16 nt, Human
ccugccccaggccuga

SEQ ID NO: 1380832 - RNA, 24 nt, Human
ccugccccaacucuccccugaccu

SEQ ID NO: 1380833 - RNA, 20 nt, Human
ccugcugcugagaaccuggc

SEQ ID NO: 1380834 - RNA, 19 nt, Human
ccugcugcugagaaccugg

SEQ ID NO: 1380835 - RNA, 17 nt, Human
ccugcugcugagaaccu

SEQ ID NO: 1380836 - RNA, 16 nt, Human
ccugcugcugagaacc

SEQ ID NO: 1380837 - RNA, 15 nt, Human
ccugcugcugagaac

SEQ ID NO: 1380838 - RNA, 14 nt, Human
ccugcugcugagaa

SEQ ID NO: 1380839 - RNA, 17 nt, Human
ccugcugcucccucaga

SEQ ID NO: 1380840 - RNA, 18 nt, Human
ccugcugcucccucagac

SEQ ID NO: 1380841 - RNA, 16 nt, Human
ccugcugcucccucag

SEQ ID NO: 1380842 - RNA, 15 nt, Human
ccugcugcucccuca

SEQ ID NO: 1380843 - RNA, 23 nt, Human
ccugcugcugagaaccuggccuu

SEQ ID NO: 1380844 - RNA, 22 nt, Human
ccugcugcugagaaccuggccu

SEQ ID NO: 1380845 - RNA, 21 nt, Human
ccugcugcugagaaccuggcc

SEQ ID NO: 1380846 - RNA, 14 nt, Human
ccugcugcucccuc

SEQ ID NO: 1380847 - RNA, 13 nt, Human
ccugcugcucccu

SEQ ID NO: 1380848 - RNA, 12 nt, Human
ccugcugcuccc

SEQ ID NO: 1380849 - RNA, 21 nt, Human
ccugccucuacugggaaggcu

SEQ ID NO: 1380850 - RNA, 20 nt, Human
ccugccucucaucaacugaa

SEQ ID NO: 1380851 - RNA, 12 nt, Human
ccugccucuacu

SEQ ID NO: 1380852 - RNA, 16 nt, Human
ccugccuccccugccu

SEQ ID NO: 1380853 - RNA, 11 nt, Human
ccugccuccug

SEQ ID NO: 1380854 - RNA, 16 nt, Human
ccugccucccuucaug

SEQ ID NO: 1380855 - RNA, 18 nt, Human
ccuggccgccugggucca

SEQ ID NO: 1380856 - RNA, 16 nt, Human
ccuggccgccuggguc

SEQ ID NO: 1380857 - RNA, 22 nt, Human
ccuggccgcccccugcccccca

SEQ ID NO: 1380858 - RNA, 21 nt, Human
ccuggccgcccccugcccccc

SEQ ID NO: 1380859 - RNA, 14 nt, Human
ccugggcccucucu

SEQ ID NO: 1380860 - RNA, 11 nt, Human
ccugggcccuc

SEQ ID NO: 1380861 - RNA, 20 nt, Human
ccuggccuagaccagcagac

SEQ ID NO: 1380862 - RNA, 17 nt, Human
ccuggccuagaccagca

SEQ ID NO: 1380863 - RNA, 16 nt, Human
ccuggccuagaccagc

SEQ ID NO: 1380864 - RNA, 22 nt, Human
ccuggccuagcauacguacaca

SEQ ID NO: 1380865 - RNA, 13 nt, Human
ccugguggggcag

SEQ ID NO: 1380866 - RNA, 23 nt, Human
ccuggugggccaacaaagaacac

SEQ ID NO: 1380867 - RNA, 14 nt, Human
ccuggugggccaac

SEQ ID NO: 1380868 - RNA, 23 nt, Human
ccugguggcccucuccccugccc

SEQ ID NO: 1380869 - RNA, 22 nt, Human
ccugguggcccucuccccugcc

SEQ ID NO: 1380870 - RNA, 21 nt, Human
ccugguggcccucuccccugc

SEQ ID NO: 1380871 - RNA, 18 nt, Human
ccugguggcccucucccc

SEQ ID NO: 1380872 - RNA, 16 nt, Human
ccugguggcccucucc

SEQ ID NO: 1380873 - RNA, 12 nt, Human
ccugguggcccu

SEQ ID NO: 1380874 - RNA, 24 nt, Human
ccugguggccaugcuccucuuccc

SEQ ID NO: 1380875 - RNA, 20 nt, Human
ccugguggccaugcuccucu

SEQ ID NO: 1380876 - RNA, 18 nt, Human
ccugguggccaugcuccu

SEQ ID NO: 1380877 - RNA, 16 nt, Human
ccugguggccaugcuc

SEQ ID NO: 1380878 - RNA, 14 nt, Human
ccugguggccaugc

SEQ ID NO: 1380879 - RNA, 16 nt, Human
ccugucgauuagacug

SEQ ID NO: 1380880 - RNA, 16 nt, Human
ccugucggagcccugu

SEQ ID NO: 1380881 - RNA, 17 nt, Human
ccugucggagcccuguc

SEQ ID NO: 1380882 - RNA, 21 nt, Human
ccugucggagcccugucuccu

SEQ ID NO: 1380883 - RNA, 21 nt, Human
ccuguccuuuaccaaagauga

SEQ ID NO: 1380884 - RNA, 15 nt, Human
ccuguccugguggua

SEQ ID NO: 1380885 - RNA, 19 nt, Human
ccuguccuuagccuaggcc

SEQ ID NO: 1380886 - RNA, 12 nt, Human
ccuguccugccu

SEQ ID NO: 1380887 - RNA, 22 nt, Human
ccuguccucuuucagcuccuga

SEQ ID NO: 1380888 - RNA, 19 nt, Human
ccuguccugaccugucuca

SEQ ID NO: 1380889 - RNA, 21 nt, Human
ccuguccucuuucagcuccug

SEQ ID NO: 1380890 - RNA, 11 nt, Human
ccuguccugcc

SEQ ID NO: 1380891 - RNA, 20 nt, Human
ccuguaaucauauaauaaau

SEQ ID NO: 1380892 - RNA, 17 nt, Human
ccugggccuugggcucc

SEQ ID NO: 1380893 - RNA, 13 nt, Human
ccugggccuuggg

SEQ ID NO: 1380894 - RNA, 20 nt, Human
ccugggccugcugcugagaa

SEQ ID NO: 1380895 - RNA, 19 nt, Human
ccugggccugcugcugaga

SEQ ID NO: 1380896 - RNA, 18 nt, Human
ccugggccugcugcugag

SEQ ID NO: 1380897 - RNA, 17 nt, Human
ccugggccugcugcuga

SEQ ID NO: 1380898 - RNA, 16 nt, Human
ccugggccugcugcug

SEQ ID NO: 1380899 - RNA, 15 nt, Human
ccugggccugcugcu

SEQ ID NO: 1380900 - RNA, 14 nt, Human
ccugggccugcugc

SEQ ID NO: 1380901 - RNA, 13 nt, Human
ccugggccugcug

SEQ ID NO: 1380902 - RNA, 15 nt, Human
ccugggccugccuca

SEQ ID NO: 1380903 - RNA, 13 nt, Human
ccugggccugccu

SEQ ID NO: 1380904 - RNA, 23 nt, Human
ccugggccuauggagagcccugg

SEQ ID NO: 1380905 - RNA, 12 nt, Human
ccugggccugca

SEQ ID NO: 1380906 - RNA, 22 nt, Human
ccugggccuauggagagcccug

SEQ ID NO: 1380907 - RNA, 21 nt, Human
ccugggccuauggagagcccu

SEQ ID NO: 1380908 - RNA, 20 nt, Human
ccugggccuauggagagccc

SEQ ID NO: 1380909 - RNA, 19 nt, Human
ccugggccuauggagagcc

SEQ ID NO: 1380910 - RNA, 18 nt, Human
ccugggccuauggagagc

SEQ ID NO: 1380911 - RNA, 17 nt, Human
ccugggccuauggagag

SEQ ID NO: 1380912 - RNA, 17 nt, Human
ccugggccgcugccacg

SEQ ID NO: 1380913 - RNA, 16 nt, Human
ccugggccgcugccac

SEQ ID NO: 1380914 - RNA, 13 nt, Human
ccugggccgcugc

SEQ ID NO: 1380915 - RNA, 22 nt, Human
ccugggcccuggggccuguacu

SEQ ID NO: 1380916 - RNA, 21 nt, Human
ccugggcccuggggccuguac

SEQ ID NO: 1380917 - RNA, 20 nt, Human
ccugggcccuggggccugua

SEQ ID NO: 1380918 - RNA, 18 nt, Human
ccugggcccuggggccug

SEQ ID NO: 1380919 - RNA, 17 nt, Human
ccugggcccuggggccu

SEQ ID NO: 1380920 - RNA, 16 nt, Human
ccugggcccuggggcc

SEQ ID NO: 1380921 - RNA, 15 nt, Human
ccugggcccuggggc

SEQ ID NO: 1380922 - RNA, 14 nt, Human
ccugggcccugggg

SEQ ID NO: 1380923 - RNA, 19 nt, Human
ccugggcccugggcuggaa

SEQ ID NO: 1380924 - RNA, 18 nt, Human
ccugggcccugggcugga

SEQ ID NO: 1380925 - RNA, 16 nt, Human
ccugggcccugggcug

SEQ ID NO: 1380926 - RNA, 15 nt, Human
ccugggcccugggcu

SEQ ID NO: 1380927 - RNA, 14 nt, Human
ccugggcccugggc

SEQ ID NO: 1380928 - RNA, 18 nt, Human
ccugggcccucucugcuc

SEQ ID NO: 1380929 - RNA, 15 nt, Human
ccugggcccucucug

SEQ ID NO: 1380930 - RNA, 22 nt, Human
ccuggggccuguacugccugcu

SEQ ID NO: 1380931 - RNA, 23 nt, Human
ccuggggccuguacugccugcuu

SEQ ID NO: 1380932 - RNA, 21 nt, Human
ccuggggccuguacugccugc

SEQ ID NO: 1380933 - RNA, 20 nt, Human
ccuggggccuguacugccug

SEQ ID NO: 1380934 - RNA, 19 nt, Human
ccuggggccuguacugccu

SEQ ID NO: 1380935 - RNA, 18 nt, Human
ccuggggccuguacugcc

SEQ ID NO: 1380936 - RNA, 16 nt, Human
ccuggggccuguacug

SEQ ID NO: 1380937 - RNA, 14 nt, Human
ccuggggccuguac

SEQ ID NO: 1380938 - RNA, 13 nt, Human
ccuggggccugua

SEQ ID NO: 1380939 - RNA, 19 nt, Human
ccugggggccuggcuggcu

SEQ ID NO: 1380940 - RNA, 17 nt, Human
ccugggggccuggcugg

SEQ ID NO: 1380941 - RNA, 15 nt, Human
ccugggggccuggcu

SEQ ID NO: 1380942 - RNA, 14 nt, Human
ccugggggccuggc

SEQ ID NO: 1380943 - RNA, 13 nt, Human
ccugggggccugg

SEQ ID NO: 1380944 - RNA, 12 nt, Human
ccugggggccug

SEQ ID NO: 1380945 - RNA, 23 nt, Human
ccugggggccuggcuggcugagg

SEQ ID NO: 1380946 - RNA, 22 nt, Human
ccugugaaugccacugccuucg

SEQ ID NO: 1380947 - RNA, 21 nt, Human
ccugugaaugccacugccuuc

SEQ ID NO: 1380948 - RNA, 19 nt, Human
ccugugaaugccacugccu

SEQ ID NO: 1380949 - RNA, 17 nt, Human
ccugugaaugccacugc

SEQ ID NO: 1380950 - RNA, 16 nt, Human
ccugugaaugccacug

SEQ ID NO: 1380951 - RNA, 18 nt, Human
ccugugaacccaggacaa

SEQ ID NO: 1380952 - RNA, 17 nt, Human
ccugugaacccaggaca

SEQ ID NO: 1380953 - RNA, 16 nt, Human
ccugugaacccaggac

SEQ ID NO: 1380954 - RNA, 15 nt, Human
ccugugaacccagga

SEQ ID NO: 1380955 - RNA, 14 nt, Human
ccugugaacccagg

SEQ ID NO: 1380956 - RNA, 19 nt, Human
ccugugaccacaacaugag

SEQ ID NO: 1380957 - RNA, 18 nt, Human
ccugugaccacaacauga

SEQ ID NO: 1380958 - RNA, 15 nt, Human
ccugugaccacaaca

SEQ ID NO: 1380959 - RNA, 20 nt, Human
ccugucucucagggccaggc

SEQ ID NO: 1380960 - RNA, 21 nt, Human
ccugucucucagggccaggcc

SEQ ID NO: 1380961 - RNA, 15 nt, Human
ccugucucaccugga

SEQ ID NO: 1380962 - RNA, 22 nt, Human
ccugucgauuagacuggacagc

SEQ ID NO: 1380963 - RNA, 22 nt, Human
ccugucggagcccugucuccuc

SEQ ID NO: 1380964 - RNA, 20 nt, Human
ccugucugucugucuguccc

SEQ ID NO: 1380965 - RNA, 21 nt, Human
ccugucugucugucuguccca

SEQ ID NO: 1380966 - RNA, 19 nt, Human
ccugucuucagagaaccca

SEQ ID NO: 1380967 - RNA, 17 nt, Human
ccugucuuauccuccac

SEQ ID NO: 1380968 - RNA, 22 nt, Human
ccugucugucugucugucccaa

SEQ ID NO: 1380969 - RNA, 22 nt, Human
ccugucuuauccuccaccgucu

SEQ ID NO: 1380970 - RNA, 17 nt, Human
ccgcagugggagcaaac

SEQ ID NO: 1380971 - RNA, 16 nt, Human
ccgcagugggagcaaa

SEQ ID NO: 1380972 - RNA, 23 nt, Human
ccgcaggauuugggcucuuggaa

SEQ ID NO: 1380973 - RNA, 16 nt, Human
ccgcaugcggcccagg

SEQ ID NO: 1380974 - RNA, 17 nt, Human
ccgcaugcggcccagga

SEQ ID NO: 1380975 - RNA, 18 nt, Human
ccggccccaguacacagg

SEQ ID NO: 1380976 - RNA, 22 nt, Human
cccugucucucagggccaggcc

SEQ ID NO: 1380977 - RNA, 21 nt, Human
cccugucucucagggccaggc

SEQ ID NO: 1380978 - RNA, 19 nt, Human
cccugucuccucucucugu

SEQ ID NO: 1380979 - RNA, 16 nt, Human
ccggccugccaggagg

SEQ ID NO: 1380980 - RNA, 18 nt, Human
ccggccugccaggaggac

SEQ ID NO: 1380981 - RNA, 15 nt, Human
ccggccugccaggag

SEQ ID NO: 1380982 - RNA, 14 nt, Human
ccggccugccagga

SEQ ID NO: 1380983 - RNA, 17 nt, Human
ccggccccucccccuga

SEQ ID NO: 1380984 - RNA, 19 nt, Human
ccuccaacccuagcaaaag

SEQ ID NO: 1380985 - RNA, 21 nt, Human
ccucauguacauacccuggcc

SEQ ID NO: 1380986 - RNA, 22 nt, Human
ccucauggccccucugaccugc

SEQ ID NO: 1380987 - RNA, 18 nt, Human
ccucauggccccucugac

SEQ ID NO: 1380988 - RNA, 22 nt, Human
ccuccaaaaugugccuauugcu

SEQ ID NO: 1380989 - RNA, 19 nt, Human
ccuccaaagcuucccacgg

SEQ ID NO: 1380990 - RNA, 17 nt, Human
ccuccaaaaugugccua

SEQ ID NO: 1380991 - RNA, 18 nt, Human
ccucauuuuuuuccuugc

SEQ ID NO: 1380992 - RNA, 19 nt, Human
ccuccaacaccaagcacag

SEQ ID NO: 1380993 - RNA, 18 nt, Human
ccuccaacccuagcaaaa

SEQ ID NO: 1380994 - RNA, 18 nt, Human
ccucccauguucaagcga

SEQ ID NO: 1380995 - RNA, 12 nt, Human
ccucagccuuaa

SEQ ID NO: 1380996 - RNA, 21 nt, Human
ccucagccugggcgcuggucc

SEQ ID NO: 1380997 - RNA, 20 nt, Human
ccucagccugggcgcugguc

SEQ ID NO: 1380998 - RNA, 17 nt, Human
ccucagccugggcgcug

SEQ ID NO: 1380999 - RNA, 16 nt, Human
ccucagccugggcgcu

SEQ ID NO: 1381000 - RNA, 14 nt, Human
ccucagccugggcg

SEQ ID NO: 1381001 - RNA, 13 nt, Human
ccucagccugggc

SEQ ID NO: 1381002 - RNA, 12 nt, Human
ccucagccuggg

SEQ ID NO: 1381003 - RNA, 22 nt, Human
ccucagccuggccagacacagg

SEQ ID NO: 1381004 - RNA, 21 nt, Human
ccucagccuggccagacacag

SEQ ID NO: 1381005 - RNA, 20 nt, Human
ccucagccuggccagacaca

SEQ ID NO: 1381006 - RNA, 16 nt, Human
ccucaaaggcccgcuc

SEQ ID NO: 1381007 - RNA, 21 nt, Human
ccucaaagcaagcauucagaa

SEQ ID NO: 1381008 - RNA, 16 nt, Human
ccucaaagaaagugua

SEQ ID NO: 1381009 - RNA, 14 nt, Human
ccucaaagaaagug

SEQ ID NO: 1381010 - RNA, 23 nt, Human
ccucaaaauuuaacaguuaccug

SEQ ID NO: 1381011 - RNA, 14 nt, Human
ccucaaaacaaagg

SEQ ID NO: 1381012 - RNA, 20 nt, Human
ccucaaaaagauuuccccau

SEQ ID NO: 1381013 - RNA, 13 nt, Human
ccucaggacuggg

SEQ ID NO: 1381014 - RNA, 21 nt, Human
ccucagccuugccagagaucc

SEQ ID NO: 1381015 - RNA, 20 nt, Human
ccucagccuugccagagauc

SEQ ID NO: 1381016 - RNA, 19 nt, Human
ccucagccuugccagagau

SEQ ID NO: 1381017 - RNA, 18 nt, Human
ccucagccuugccagaga

SEQ ID NO: 1381018 - RNA, 17 nt, Human
ccucagccuugccagag

SEQ ID NO: 1381019 - RNA, 15 nt, Human
ccucaggacugggag

SEQ ID NO: 1381020 - RNA, 14 nt, Human
ccucaggacuggga

SEQ ID NO: 1381021 - RNA, 17 nt, Human
ccucaggacugggagcc

SEQ ID NO: 1381022 - RNA, 16 nt, Human
ccucauggccccucug

SEQ ID NO: 1381023 - RNA, 15 nt, Human
ccucauggccccucu

SEQ ID NO: 1381024 - RNA, 16 nt, Human
ccucaggacugggagc

SEQ ID NO: 1381025 - RNA, 23 nt, Human
ccucauggaauuggagcucgugg

SEQ ID NO: 1381026 - RNA, 23 nt, Human
ccccauuccugggaaauauuccc

SEQ ID NO: 1381027 - RNA, 23 nt, Human
ccccaugcacugugaaggacccu

SEQ ID NO: 1381028 - RNA, 19 nt, Human
ccccaugcacugugaagga

SEQ ID NO: 1381029 - RNA, 13 nt, Human
ccccaugcacugu

SEQ ID NO: 1381030 - RNA, 15 nt, Human
ccccaugaccuccag

SEQ ID NO: 1381031 - RNA, 16 nt, Human
ccccaugaccuccagc

SEQ ID NO: 1381032 - RNA, 13 nt, Human
ccccaugaccucc

SEQ ID NO: 1381033 - RNA, 14 nt, Human
ccccaucuugcuuc

SEQ ID NO: 1381034 - RNA, 12 nt, Human
ccccaucuugcu

SEQ ID NO: 1381035 - RNA, 16 nt, Human
ccccauucccgcagug

SEQ ID NO: 1381036 - RNA, 15 nt, Human
ccccugaccugugag

SEQ ID NO: 1381037 - RNA, 22 nt, Human
ccccugaccacucagagacaug

SEQ ID NO: 1381038 - RNA, 18 nt, Human
ccccugaccacucagaga

SEQ ID NO: 1381039 - RNA, 17 nt, Human
ccccugaccacucagag

SEQ ID NO: 1381040 - RNA, 20 nt, Human
ccccugaccacucagagaca

SEQ ID NO: 1381041 - RNA, 20 nt, Human
ccccugaccugugagcccag

SEQ ID NO: 1381042 - RNA, 21 nt, Human
ccccugagacaaauggaggcc

SEQ ID NO: 1381043 - RNA, 15 nt, Human
ccccugcaggaagga

SEQ ID NO: 1381044 - RNA, 14 nt, Human
ccccugcaggaagg

SEQ ID NO: 1381045 - RNA, 23 nt, Human
ccccugcagcuuguagccagccg

SEQ ID NO: 1381046 - RNA, 22 nt, Human
ccccugcagcuuguagccagcc

SEQ ID NO: 1381047 - RNA, 17 nt, Human
ccccugcacuguaaaau

SEQ ID NO: 1381048 - RNA, 16 nt, Human
ccccugcacuguaaaa

SEQ ID NO: 1381049 - RNA, 14 nt, Human
ccccugcacuguaa

SEQ ID NO: 1381050 - RNA, 18 nt, Human
ccccugcacuguaaaaug

SEQ ID NO: 1381051 - RNA, 11 nt, Human
ccccugcacug

SEQ ID NO: 1381052 - RNA, 19 nt, Human
ccccuucuccccugcacug

SEQ ID NO: 1381053 - RNA, 12 nt, Human
ccccuucucccc

SEQ ID NO: 1381054 - RNA, 18 nt, Human
ccccuucuauuuggggcu

SEQ ID NO: 1381055 - RNA, 22 nt, Human
ccccugcauuggaacuggaggc

SEQ ID NO: 1381056 - RNA, 21 nt, Human
ccccugcauuggaacuggagg

SEQ ID NO: 1381057 - RNA, 22 nt, Human
ccccugcaggaaggagcugccu

SEQ ID NO: 1381058 - RNA, 23 nt, Human
ccccugcaggaaggagcugccug

SEQ ID NO: 1381059 - RNA, 21 nt, Human
ccccugcaggaaggagcugcc

SEQ ID NO: 1381060 - RNA, 20 nt, Human
ccccugcaggaaggagcugc

SEQ ID NO: 1381061 - RNA, 19 nt, Human
ccccugcaggaaggagcug

SEQ ID NO: 1381062 - RNA, 18 nt, Human
ccccugcaggaaggagcu

SEQ ID NO: 1381063 - RNA, 20 nt, Human
cccucacuggcucuccuggc

SEQ ID NO: 1381064 - RNA, 19 nt, Human
cccucacuggcucuccugg

SEQ ID NO: 1381065 - RNA, 16 nt, Human
cccucagacuggggca

SEQ ID NO: 1381066 - RNA, 15 nt, Human
cccucagacuggggc

SEQ ID NO: 1381067 - RNA, 22 nt, Human
ccccuugaggucucagccccuu

SEQ ID NO: 1381068 - RNA, 19 nt, Human
ccccuugaggucucagccc

SEQ ID NO: 1381069 - RNA, 23 nt, Human
ccccuugacaacuggcaggcagg

SEQ ID NO: 1381070 - RNA, 18 nt, Human
ccccuugacaacuggcag

SEQ ID NO: 1381071 - RNA, 21 nt, Human
ccccuucugcucagcucuggg

SEQ ID NO: 1381072 - RNA, 20 nt, Human
ccccuucugcucagcucugg

SEQ ID NO: 1381073 - RNA, 19 nt, Human
ccccuucugcucagcucug

SEQ ID NO: 1381074 - RNA, 14 nt, Human
ccccuucugcucag

SEQ ID NO: 1381075 - RNA, 18 nt, Human
ccccuucuccccugcacu

SEQ ID NO: 1381076 - RNA, 22 nt, Human
ccccuugaaggagaaucaucag

SEQ ID NO: 1381077 - RNA, 14 nt, Human
cccuaucuuugcca

SEQ ID NO: 1381078 - RNA, 16 nt, Human
cccuaucuuugccacc

SEQ ID NO: 1381079 - RNA, 19 nt, Human
cccuaucuuugccacccuc

SEQ ID NO: 1381080 - RNA, 14 nt, Human
cccuaucuguauuc

SEQ ID NO: 1381081 - RNA, 21 nt, Human
cccuaucuuugccacccucau

SEQ ID NO: 1381082 - RNA, 14 nt, Human
cccucacacacccu

SEQ ID NO: 1381083 - RNA, 23 nt, Human
cccucaagucuuucucuuucccu

SEQ ID NO: 1381084 - RNA, 15 nt, Human
cccucacacacccug

SEQ ID NO: 1381085 - RNA, 10 nt, Human
cccucacacu

SEQ ID NO: 1381086 - RNA, 12 nt, Human
cccucacacugg

SEQ ID NO: 1381087 - RNA, 13 nt, Human
cccucacacuggg

SEQ ID NO: 1381088 - RNA, 14 nt, Human
cccucacacuggga

SEQ ID NO: 1381089 - RNA, 22 nt, Human
cccaguuucuaaacuggagacu

SEQ ID NO: 1381090 - RNA, 21 nt, Human
cccaguuucuaaacuggagac

SEQ ID NO: 1381091 - RNA, 20 nt, Human
cccaguuucuaaacuggaga

SEQ ID NO: 1381092 - RNA, 19 nt, Human
cccaguuucuaaacuggag

SEQ ID NO: 1381093 - RNA, 19 nt, Human
cccaggggaacacugggga

SEQ ID NO: 1381094 - RNA, 23 nt, Human
cccagggcuguaacugccaggcu

SEQ ID NO: 1381095 - RNA, 21 nt, Human
cccagggcuguaacugccagg

SEQ ID NO: 1381096 - RNA, 21 nt, Human
cccagggcugggaggaaggac

SEQ ID NO: 1381097 - RNA, 20 nt, Human
cccagggcugggaggaagga

SEQ ID NO: 1381098 - RNA, 17 nt, Human
cccagggcugggaggaa

SEQ ID NO: 1381099 - RNA, 16 nt, Human
cccagggcugggagga

SEQ ID NO: 1381100 - RNA, 14 nt, Human
cccagggcugggag

SEQ ID NO: 1381101 - RNA, 16 nt, Human
cccagggcucuguaag

SEQ ID NO: 1381102 - RNA, 13 nt, Human
cccagggcucugu

SEQ ID NO: 1381103 - RNA, 15 nt, Human
cccagggcuccugca

SEQ ID NO: 1381104 - RNA, 14 nt, Human
cccagggcuccugc

SEQ ID NO: 1381105 - RNA, 23 nt, Human
cccaguuucuaaacuggagacug

SEQ ID NO: 1381106 - RNA, 24 nt, Human
ccccagcaaagcccccagagccca

SEQ ID NO: 1381107 - RNA, 22 nt, Human
ccccagcaaagcccccagagcc

SEQ ID NO: 1381108 - RNA, 14 nt, Human
ccccagcaaagccc

SEQ ID NO: 1381109 - RNA, 13 nt, Human
cccauuucagcug

SEQ ID NO: 1381110 - RNA, 12 nt, Human
cccauuucagcu

SEQ ID NO: 1381111 - RNA, 19 nt, Human
cccauuuauagauggggga

SEQ ID NO: 1381112 - RNA, 14 nt, Human
cccagcagcugcca

SEQ ID NO: 1381113 - RNA, 15 nt, Human
cccagcagcugccag

SEQ ID NO: 1381114 - RNA, 21 nt, Human
cccagcacugcuugaggaaaa

SEQ ID NO: 1381115 - RNA, 18 nt, Human
cccagcacuuguguuguc

SEQ ID NO: 1381116 - RNA, 13 nt, Human
cccagcccacccc

SEQ ID NO: 1381117 - RNA, 15 nt, Human
cccagcccacccccg

SEQ ID NO: 1381118 - RNA, 15 nt, Human
cccaggaacugggcc

SEQ ID NO: 1381119 - RNA, 22 nt, Human
cccagcugugcuuaugguacca

SEQ ID NO: 1381120 - RNA, 14 nt, Human
cccaggcugggaac

SEQ ID NO: 1381121 - RNA, 21 nt, Human
cccaggcugggaacucaucug

SEQ ID NO: 1381122 - RNA, 13 nt, Human
cccaggcugggaa

SEQ ID NO: 1381123 - RNA, 12 nt, Human
cccaggcuggga

SEQ ID NO: 1381124 - RNA, 16 nt, Human
cccaggacaagcaugg

SEQ ID NO: 1381125 - RNA, 21 nt, Human
cccaggacaagcaugguccca

SEQ ID NO: 1381126 - RNA, 22 nt, Human
cccaggaagucucaucugggga

SEQ ID NO: 1381127 - RNA, 23 nt, Human
cccaggaaucaguuuaaaagcac

SEQ ID NO: 1381128 - RNA, 20 nt, Human
ccacucugcuucucugacuu

SEQ ID NO: 1381129 - RNA, 19 nt, Human
ccacucugcuucucugacu

SEQ ID NO: 1381130 - RNA, 17 nt, Human
ccacucugcuucucuga

SEQ ID NO: 1381131 - RNA, 14 nt, Human
ccacucugcuucuc

SEQ ID NO: 1381132 - RNA, 13 nt, Human
ccacucugcuucu

SEQ ID NO: 1381133 - RNA, 18 nt, Human
ccacucugcucugaugca

SEQ ID NO: 1381134 - RNA, 15 nt, Human
ccacucugcucugau

SEQ ID NO: 1381135 - RNA, 14 nt, Human
ccacucugcucuga

SEQ ID NO: 1381136 - RNA, 13 nt, Human
ccacucugcucug

SEQ ID NO: 1381137 - RNA, 13 nt, Human
ccacucuccuagg

SEQ ID NO: 1381138 - RNA, 14 nt, Human
ccacucuccuaggc

SEQ ID NO: 1381139 - RNA, 23 nt, Human
ccacucuggagcauuucucauca

SEQ ID NO: 1381140 - RNA, 23 nt, Human
ccacucugcucugaugcaucaga

SEQ ID NO: 1381141 - RNA, 18 nt, Human
ccaggaacagcaaaugca

SEQ ID NO: 1381142 - RNA, 13 nt, Human
ccagcucagcacu

SEQ ID NO: 1381143 - RNA, 20 nt, Human
ccagcuuccuucagagagca

SEQ ID NO: 1381144 - RNA, 23 nt, Human
ccagcuuccuucagagagcagug

SEQ ID NO: 1381145 - RNA, 15 nt, Human
ccagcuuccuucaga

SEQ ID NO: 1381146 - RNA, 14 nt, Human
ccagcuuccuucag

SEQ ID NO: 1381147 - RNA, 13 nt, Human
ccagcuuccuuca

SEQ ID NO: 1381148 - RNA, 18 nt, Human
ccagccccuuagacagag

SEQ ID NO: 1381149 - RNA, 19 nt, Human
ccagccccuguagaacuca

SEQ ID NO: 1381150 - RNA, 23 nt, Human
ccagccccuggccccaggaccug

SEQ ID NO: 1381151 - RNA, 21 nt, Human
ccagccccuggccccaggacc

SEQ ID NO: 1381152 - RNA, 13 nt, Human
ccagccccuggcc

SEQ ID NO: 1381153 - RNA, 18 nt, Human
ccagcuaauaacugaucu

SEQ ID NO: 1381154 - RNA, 16 nt, Human
ccagcuaagggguggg

SEQ ID NO: 1381155 - RNA, 15 nt, Human
ccagcuaaggggugg

SEQ ID NO: 1381156 - RNA, 19 nt, Human
ccagcuaagaaccuggaac

SEQ ID NO: 1381157 - RNA, 18 nt, Human
ccagcuaagaaccuggaa

SEQ ID NO: 1381158 - RNA, 17 nt, Human
ccagcuaagaaccugga

SEQ ID NO: 1381159 - RNA, 15 nt, Human
ccagcuaagaaccug

SEQ ID NO: 1381160 - RNA, 14 nt, Human
ccagcuaagaaccu

SEQ ID NO: 1381161 - RNA, 13 nt, Human
ccagcuaagaacc

SEQ ID NO: 1381162 - RNA, 18 nt, Human
ccagcgucggucugugcc

SEQ ID NO: 1381163 - RNA, 19 nt, Human
ccagcgucggucugugccc

SEQ ID NO: 1381164 - RNA, 17 nt, Human
ccagcgucggucugugc

SEQ ID NO: 1381165 - RNA, 16 nt, Human
ccagcgucggucugug

SEQ ID NO: 1381166 - RNA, 19 nt, Human
ccagccccuuagacagagg

SEQ ID NO: 1381167 - RNA, 20 nt, Human
ccagcucaggacagaugcca

SEQ ID NO: 1381168 - RNA, 23 nt, Human
ccagcucaggacagaugccacac

SEQ ID NO: 1381169 - RNA, 19 nt, Human
ccagcucaggacagaugcc

SEQ ID NO: 1381170 - RNA, 13 nt, Human
ccagcucaggaca

SEQ ID NO: 1381171 - RNA, 15 nt, Human
ccagcucagcacugc

SEQ ID NO: 1381172 - RNA, 12 nt, Human
ccagcucagcac

SEQ ID NO: 1381173 - RNA, 11 nt, Human
ccagcucagca

SEQ ID NO: 1381174 - RNA, 15 nt, Human
ccagcuaauuuuugu

SEQ ID NO: 1381175 - RNA, 24 nt, Human
ccaggagggacaaaggagccugug

SEQ ID NO: 1381176 - RNA, 23 nt, Human
ccaggagggacaaaggagccugu

SEQ ID NO: 1381177 - RNA, 22 nt, Human
ccaggagggacaaaggagccug

SEQ ID NO: 1381178 - RNA, 21 nt, Human
ccaggagggacaaaggagccu

SEQ ID NO: 1381179 - RNA, 23 nt, Human
ccaggggcugcuuccuccuggaa

SEQ ID NO: 1381180 - RNA, 22 nt, Human
ccaggggcugcuuccuccugga

SEQ ID NO: 1381181 - RNA, 21 nt, Human
ccaggggcugcuuccuccugg

SEQ ID NO: 1381182 - RNA, 20 nt, Human
ccaggggcugcuuccuccug

SEQ ID NO: 1381183 - RNA, 16 nt, Human
ccaggggcucccuccg

SEQ ID NO: 1381184 - RNA, 15 nt, Human
ccaggggcucccucc

SEQ ID NO: 1381185 - RNA, 11 nt, Human
ccaggcuggga

SEQ ID NO: 1381186 - RNA, 16 nt, Human
ccaggcaaggcugugg

SEQ ID NO: 1381187 - RNA, 15 nt, Human
ccaggcaaggcugug

SEQ ID NO: 1381188 - RNA, 14 nt, Human
ccaggcaaggcugu

SEQ ID NO: 1381189 - RNA, 19 nt, Human
ccaggaggugccacuggag

SEQ ID NO: 1381190 - RNA, 21 nt, Human
ccaggaggugccacuggagug

SEQ ID NO: 1381191 - RNA, 18 nt, Human
ccaggaggugccacugga

SEQ ID NO: 1381192 - RNA, 19 nt, Human
ccaggaguggguggggagu

SEQ ID NO: 1381193 - RNA, 12 nt, Human
ccaggcaaggcu

SEQ ID NO: 1381194 - RNA, 14 nt, Human
ccaguauuuuaaaa

SEQ ID NO: 1381195 - RNA, 23 nt, Human
ccagggggagcugggccuggucu

SEQ ID NO: 1381196 - RNA, 15 nt, Human
ccaguccccccaccc

SEQ ID NO: 1381197 - RNA, 17 nt, Human
ccaguccccccacccuc

SEQ ID NO: 1381198 - RNA, 22 nt, Human
ccaggggcucccuccgccccca

SEQ ID NO: 1381199 - RNA, 15 nt, Human
ccagggggcaagagg

SEQ ID NO: 1381200 - RNA, 14 nt, Human
ccagucaaccuggg

SEQ ID NO: 1381201 - RNA, 18 nt, Human
ccaguauuuagaagccaa

SEQ ID NO: 1381202 - RNA, 17 nt, Human
ccaguauuuagaagcca

SEQ ID NO: 1381203 - RNA, 23 nt, Human
ccauuucuaauuauguagcucuu

SEQ ID NO: 1381204 - RNA, 21 nt, Human
ccauuucuaauuauguagcuc

SEQ ID NO: 1381205 - RNA, 14 nt, Human
ccauuucuaauuau

SEQ ID NO: 1381206 - RNA, 13 nt, Human
ccauuucuaauua

SEQ ID NO: 1381207 - RNA, 12 nt, Human
ccauuucuaauu

SEQ ID NO: 1381208 - RNA, 11 nt, Human
ccauuucuaau

SEQ ID NO: 1381209 - RNA, 21 nt, Human
ccauuuagguuucugaguucc

SEQ ID NO: 1381210 - RNA, 16 nt, Human
ccauuuagguuucuga

SEQ ID NO: 1381211 - RNA, 22 nt, Human
ccauuuacauguuuuaaagaaa

SEQ ID NO: 1381212 - RNA, 20 nt, Human
ccauuuacauguuuuaaaga

SEQ ID NO: 1381213 - RNA, 17 nt, Human
ccauuuacauguuuuaa

SEQ ID NO: 1381214 - RNA, 20 nt, Human
ccauuuaauggggaggacaa

SEQ ID NO: 1381215 - RNA, 19 nt, Human
ccauuuaaauuuuuuuccu

SEQ ID NO: 1381216 - RNA, 24 nt, Human
ccauugaggcuugguuccuuccca

SEQ ID NO: 1381217 - RNA, 22 nt, Human
ccauugaauucuugguugagga

SEQ ID NO: 1381218 - RNA, 13 nt, Human
ccauugaauucuu

SEQ ID NO: 1381219 - RNA, 21 nt, Human
ccauugaaggcuuaaacccau

SEQ ID NO: 1381220 - RNA, 17 nt, Human
ccauugaaggcuuaaac

SEQ ID NO: 1381221 - RNA, 12 nt, Human
ccauugaaggcu

SEQ ID NO: 1381222 - RNA, 11 nt, Human
ccauugaaggc

SEQ ID NO: 1381223 - RNA, 13 nt, Human
ccauaacugaaca

SEQ ID NO: 1381224 - RNA, 14 nt, Human
ccauacauuugugu

SEQ ID NO: 1381225 - RNA, 13 nt, Human
ccauacauuugug

SEQ ID NO: 1381226 - RNA, 14 nt, Human
ccaguuuuuauuaa

SEQ ID NO: 1381227 - RNA, 22 nt, Human
ccaguuuggguaaaauacuuuu

SEQ ID NO: 1381228 - RNA, 20 nt, Human
ccaguuuggguaaaauacuu

SEQ ID NO: 1381229 - RNA, 13 nt, Human
ccaguuugcuuug

SEQ ID NO: 1381230 - RNA, 17 nt, Human
ccauccuacccccugug

SEQ ID NO: 1381231 - RNA, 22 nt, Human
ccaucccuggcccccucccugg

SEQ ID NO: 1381232 - RNA, 23 nt, Human
ccaucccuggcccccucccugga

SEQ ID NO: 1381233 - RNA, 19 nt, Human
ccaucccuggcccccuccc

SEQ ID NO: 1381234 - RNA, 16 nt, Human
ccaucccuggcccccu

SEQ ID NO: 1381235 - RNA, 13 nt, Human
ccaucccuggccc

SEQ ID NO: 1381236 - RNA, 12 nt, Human
ccaucccugcgu

SEQ ID NO: 1381237 - RNA, 22 nt, Human
caaugcugugcccuaaagugua

SEQ ID NO: 1381238 - RNA, 21 nt, Human
caaugcuuugccccugagaca

SEQ ID NO: 1381239 - RNA, 18 nt, Human
caauuguguagccuuuuu

SEQ ID NO: 1381240 - RNA, 20 nt, Human
caauuguguagccuuuuugu

SEQ ID NO: 1381241 - RNA, 17 nt, Human
caauuguguagccuuuu

SEQ ID NO: 1381242 - RNA, 16 nt, Human
caauuguguagccuuu

SEQ ID NO: 1381243 - RNA, 20 nt, Human
caauucuucccuaucuuugc

SEQ ID NO: 1381244 - RNA, 15 nt, Human
caauuguguagccuu

SEQ ID NO: 1381245 - RNA, 17 nt, Human
caauucuucccuaucuu

SEQ ID NO: 1381246 - RNA, 14 nt, Human
caaugcuguauuuu

SEQ ID NO: 1381247 - RNA, 21 nt, Human
caauauuucagauaaucacaa

SEQ ID NO: 1381248 - RNA, 20 nt, Human
caauauuucagauaaucaca

SEQ ID NO: 1381249 - RNA, 12 nt, Human
caauauuucaga

SEQ ID NO: 1381250 - RNA, 20 nt, Human
cacaagccucugcccaggca

SEQ ID NO: 1381251 - RNA, 15 nt, Human
cacaagccucugccc

SEQ ID NO: 1381252 - RNA, 15 nt, Human
cacaagccugaggga

SEQ ID NO: 1381253 - RNA, 13 nt, Human
cacaagccugagg

SEQ ID NO: 1381254 - RNA, 12 nt, Human
cacaagccugag

SEQ ID NO: 1381255 - RNA, 22 nt, Human
cacaagccucugcccaggcacu

SEQ ID NO: 1381256 - RNA, 23 nt, Human
cacaagauugguguuuuuuucua

SEQ ID NO: 1381257 - RNA, 22 nt, Human
cacaagauugguguuuuuuucu

SEQ ID NO: 1381258 - RNA, 17 nt, Human
cacaagauugguguuuu

SEQ ID NO: 1381259 - RNA, 15 nt, Human
cacaagauugguguu

SEQ ID NO: 1381260 - RNA, 18 nt, Human
cacaagacugcacaucaa

SEQ ID NO: 1381261 - RNA, 20 nt, Human
cacaagacugacgccagggu

SEQ ID NO: 1381262 - RNA, 11 nt, Human
cacaagacuga

SEQ ID NO: 1381263 - RNA, 16 nt, Human
cacaagacugcacauc

SEQ ID NO: 1381264 - RNA, 22 nt, Human
caaguuguuccuuaagucagaa

SEQ ID NO: 1381265 - RNA, 21 nt, Human
caaguuguuccuuaagucaga

SEQ ID NO: 1381266 - RNA, 18 nt, Human
caaguugugccaaauuau

SEQ ID NO: 1381267 - RNA, 19 nt, Human
caaguugugccaaauuauu

SEQ ID NO: 1381268 - RNA, 13 nt, Human
caaguuggaguca

SEQ ID NO: 1381269 - RNA, 15 nt, Human
caaguuggagucacu

SEQ ID NO: 1381270 - RNA, 15 nt, Human
caaguugcuaauaca

SEQ ID NO: 1381271 - RNA, 19 nt, Human
caaguugaggacuucuugc

SEQ ID NO: 1381272 - RNA, 21 nt, Human
caaguucuaagauucuaauga

SEQ ID NO: 1381273 - RNA, 20 nt, Human
caaguucuaagauucuaaug

SEQ ID NO: 1381274 - RNA, 18 nt, Human
caaguucuaagauucuaa

SEQ ID NO: 1381275 - RNA, 17 nt, Human
caaguucuaagauucua

SEQ ID NO: 1381276 - RNA, 13 nt, Human
caaguauuauacc

SEQ ID NO: 1381277 - RNA, 20 nt, Human
caaguauuagaauaccacag

SEQ ID NO: 1381278 - RNA, 22 nt, Human
caagauuccggauccuaagcau

SEQ ID NO: 1381279 - RNA, 19 nt, Human
caagauuccggauccuaag

SEQ ID NO: 1381280 - RNA, 12 nt, Human
caagauucuaga

SEQ ID NO: 1381281 - RNA, 18 nt, Human
caagauuccggauccuaa

SEQ ID NO: 1381282 - RNA, 10 nt, Human
caagauuccg

SEQ ID NO: 1381283 - RNA, 15 nt, Human
caagacccccagcac

SEQ ID NO: 1381284 - RNA, 23 nt, Human
caaguagaaucucaguugauuuu

SEQ ID NO: 1381285 - RNA, 13 nt, Human
caaguagaaucuc

SEQ ID NO: 1381286 - RNA, 19 nt, Human
caaguacaaccacacccac

SEQ ID NO: 1381287 - RNA, 24 nt, Human
caaguacaaccacacccacacuca

SEQ ID NO: 1381288 - RNA, 22 nt, Human
caaguagauaggaagaaagaag

SEQ ID NO: 1381289 - RNA, 16 nt, Human
caaguagaaucucagu

SEQ ID NO: 1381290 - RNA, 14 nt, Human
caaguauuagaaua

SEQ ID NO: 1381291 - RNA, 17 nt, Human
caauaaaaauguuuaac

SEQ ID NO: 1381292 - RNA, 13 nt, Human
caauaaaaauguu

SEQ ID NO: 1381293 - RNA, 18 nt, Human
caccaggcagccucuggg

SEQ ID NO: 1381294 - RNA, 22 nt, Human
caccaggccaccuccccagcau

SEQ ID NO: 1381295 - RNA, 19 nt, Human
caccaggccaccuccccag

SEQ ID NO: 1381296 - RNA, 15 nt, Human
caccaggccaccucc

SEQ ID NO: 1381297 - RNA, 14 nt, Human
caccaggccaccuc

SEQ ID NO: 1381298 - RNA, 13 nt, Human
caccaggccaccu

SEQ ID NO: 1381299 - RNA, 15 nt, Human
caccaggcagccucu

SEQ ID NO: 1381300 - RNA, 14 nt, Human
caccaggcagccuc

SEQ ID NO: 1381301 - RNA, 15 nt, Human
caccagcugugucca

SEQ ID NO: 1381302 - RNA, 14 nt, Human
caccagcugugucc

SEQ ID NO: 1381303 - RNA, 21 nt, Human
caccaggcugagguccugauc

SEQ ID NO: 1381304 - RNA, 14 nt, Human
caccaggcugcuca

SEQ ID NO: 1381305 - RNA, 21 nt, Human
caccaggcugcucagggcugg

SEQ ID NO: 1381306 - RNA, 23 nt, Human
caccaggcgcuaauucaaggaau

SEQ ID NO: 1381307 - RNA, 17 nt, Human
caccaggcgcuaauuca

SEQ ID NO: 1381308 - RNA, 15 nt, Human
caccaaaacugcucc

SEQ ID NO: 1381309 - RNA, 17 nt, Human
cacauuuuuuaggaaau

SEQ ID NO: 1381310 - RNA, 13 nt, Human
cacauuuuucuua

SEQ ID NO: 1381311 - RNA, 14 nt, Human
cacauuuuucuuag

SEQ ID NO: 1381312 - RNA, 17 nt, Human
cacauuuuuuaaaugca

SEQ ID NO: 1381313 - RNA, 21 nt, Human
cacauuuuuuaaaugcaccug

SEQ ID NO: 1381314 - RNA, 15 nt, Human
cacauuuuaaaagug

SEQ ID NO: 1381315 - RNA, 18 nt, Human
cacauuuuccuuuucaaa

SEQ ID NO: 1381316 - RNA, 15 nt, Human
cacauuuuauuuuau

SEQ ID NO: 1381317 - RNA, 21 nt, Human
cacauuugcuuuuugugauau

SEQ ID NO: 1381318 - RNA, 19 nt, Human
cacauuuggaauacuuuuu

SEQ ID NO: 1381319 - RNA, 17 nt, Human
cacauuuggaauacuuu

SEQ ID NO: 1381320 - RNA, 16 nt, Human
cacauuuggaauacuu

SEQ ID NO: 1381321 - RNA, 19 nt, Human
cacauuugcuuuuugugau

SEQ ID NO: 1381322 - RNA, 17 nt, Human
cacauuucuaaaaucuu

SEQ ID NO: 1381323 - RNA, 13 nt, Human
cacauuucuaaaa

SEQ ID NO: 1381324 - RNA, 17 nt, Human
cacaucuaaccucaucu

SEQ ID NO: 1381325 - RNA, 19 nt, Human
cacaucgcagauucucccu

SEQ ID NO: 1381326 - RNA, 22 nt, Human
cacauccuccacguucugcuca

SEQ ID NO: 1381327 - RNA, 21 nt, Human
cacaucccugggccugcugcu

SEQ ID NO: 1381328 - RNA, 20 nt, Human
cacaucccugggccugcugc

SEQ ID NO: 1381329 - RNA, 18 nt, Human
cacaucccugggccugcu

SEQ ID NO: 1381330 - RNA, 17 nt, Human
cacaucccugggccugc

SEQ ID NO: 1381331 - RNA, 16 nt, Human
cacaucccugggccug

SEQ ID NO: 1381332 - RNA, 15 nt, Human
cacaucccugggccu

SEQ ID NO: 1381333 - RNA, 14 nt, Human
cacaucccugggcc

SEQ ID NO: 1381334 - RNA, 13 nt, Human
cacaucccugggc

SEQ ID NO: 1381335 - RNA, 22 nt, Human
cacaucccugggccugcugcug

SEQ ID NO: 1381336 - RNA, 12 nt, Human
cacaucccuggg

SEQ ID NO: 1381337 - RNA, 22 nt, Human
cacaucagcacgauuucuguuu

SEQ ID NO: 1381338 - RNA, 20 nt, Human
cacaucagcacgauuucugu

SEQ ID NO: 1381339 - RNA, 21 nt, Human
cacaucagcacgauuucuguu

SEQ ID NO: 1381340 - RNA, 16 nt, Human
cacaguagucuugaug

SEQ ID NO: 1381341 - RNA, 14 nt, Human
cacaggucuagacu

SEQ ID NO: 1381342 - RNA, 13 nt, Human
cacaggucuagac

SEQ ID NO: 1381343 - RNA, 14 nt, Human
cacaggucccaaau

SEQ ID NO: 1381344 - RNA, 13 nt, Human
cacaguagucuug

SEQ ID NO: 1381345 - RNA, 19 nt, Human
cacagaagugcuuucuucu

SEQ ID NO: 1381346 - RNA, 21 nt, Human
cacagcggagguguggagccg

SEQ ID NO: 1381347 - RNA, 18 nt, Human
cacagacauacuaaccag

SEQ ID NO: 1381348 - RNA, 19 nt, Human
cacagacagggucaaagug

SEQ ID NO: 1381349 - RNA, 16 nt, Human
cacagcuacucucccc

SEQ ID NO: 1381350 - RNA, 22 nt, Human
cacagcuaugaaggcuguacac

SEQ ID NO: 1381351 - RNA, 12 nt, Human
cacagcuaugaa

SEQ ID NO: 1381352 - RNA, 21 nt, Human
cacaggucccaaauggcccug

SEQ ID NO: 1381353 - RNA, 23 nt, Human
cacagggucugcucuuucucugc

SEQ ID NO: 1381354 - RNA, 19 nt, Human
cacagggucugcucuuucu

SEQ ID NO: 1381355 - RNA, 17 nt, Human
cacagggucugcucuuu

SEQ ID NO: 1381356 - RNA, 16 nt, Human
cacagggucugcucuu

SEQ ID NO: 1381357 - RNA, 15 nt, Human
cacagggcaguaccu

SEQ ID NO: 1381358 - RNA, 11 nt, Human
cacagggcagu

SEQ ID NO: 1381359 - RNA, 21 nt, Human
cacagggcaguaccugagggu

SEQ ID NO: 1381360 - RNA, 18 nt, Human
cacagggcaguaccugag

SEQ ID NO: 1381361 - RNA, 21 nt, Human
cacagggccuuuggcaggugc

SEQ ID NO: 1381362 - RNA, 13 nt, Human
cacuuucccaccc

SEQ ID NO: 1381363 - RNA, 18 nt, Human
cacuuucagcugucuuuu

SEQ ID NO: 1381364 - RNA, 17 nt, Human
cacuuucagcugucuuu

SEQ ID NO: 1381365 - RNA, 16 nt, Human
cacuuucagcugucuu

SEQ ID NO: 1381366 - RNA, 15 nt, Human
cacuuucagcugucu

SEQ ID NO: 1381367 - RNA, 14 nt, Human
cacuuucagcuguc

SEQ ID NO: 1381368 - RNA, 13 nt, Human
cacuuucagcugu

SEQ ID NO: 1381369 - RNA, 12 nt, Human
cacuuucagcug

SEQ ID NO: 1381370 - RNA, 11 nt, Human
cacuuucagcu

SEQ ID NO: 1381371 - RNA, 23 nt, Human
cacuggucacggauuugugucug

SEQ ID NO: 1381372 - RNA, 15 nt, Human
cacuggggcaggggc

SEQ ID NO: 1381373 - RNA, 13 nt, Human
cacuggggcaggg

SEQ ID NO: 1381374 - RNA, 20 nt, Human
cacuggucuguuugcauuug

SEQ ID NO: 1381375 - RNA, 21 nt, Human
cacuggucugcuguuccagug

SEQ ID NO: 1381376 - RNA, 16 nt, Human
cacuggucugcuguuc

SEQ ID NO: 1381377 - RNA, 15 nt, Human
cacuggucugcuguc

SEQ ID NO: 1381378 - RNA, 14 nt, Human
cacuggucugcugu

SEQ ID NO: 1381379 - RNA, 22 nt, Human
cacuggggagcccgucucagug

SEQ ID NO: 1381380 - RNA, 21 nt, Human
cacuggggagcccgucucagu

SEQ ID NO: 1381381 - RNA, 21 nt, Human
cacuggggacuuggccucucu

SEQ ID NO: 1381382 - RNA, 20 nt, Human
cacuggggacuuggccucuc

SEQ ID NO: 1381383 - RNA, 19 nt, Human
cacuggggacuuggccucu

SEQ ID NO: 1381384 - RNA, 18 nt, Human
cacuggggacuuggccuc

SEQ ID NO: 1381385 - RNA, 16 nt, Human
cacuggggaaaacucc

SEQ ID NO: 1381386 - RNA, 22 nt, Human
cacuuguccuuagccuggaccu

SEQ ID NO: 1381387 - RNA, 21 nt, Human
cacuuguccuuagccuggacc

SEQ ID NO: 1381388 - RNA, 20 nt, Human
cacuuguccuuagccuggac

SEQ ID NO: 1381389 - RNA, 19 nt, Human
cacuuguccuuagccugga

SEQ ID NO: 1381390 - RNA, 20 nt, Human
cacuuguaauuuuguaucuu

SEQ ID NO: 1381391 - RNA, 17 nt, Human
cacuuguacaaaauaaa

SEQ ID NO: 1381392 - RNA, 12 nt, Human
cacuuguacaaa

SEQ ID NO: 1381393 - RNA, 21 nt, Human
cacuuacugguaggaccaagc

SEQ ID NO: 1381394 - RNA, 15 nt, Human
cacuuacugguagga

SEQ ID NO: 1381395 - RNA, 21 nt, Human
cacuuacuuuuucuggucucu

SEQ ID NO: 1381396 - RNA, 16 nt, Human
cacuuacuugcuuauu

SEQ ID NO: 1381397 - RNA, 20 nt, Human
cacuguuuagaacacacaca

SEQ ID NO: 1381398 - RNA, 19 nt, Human
cacuguuuauacacugugu

SEQ ID NO: 1381399 - RNA, 21 nt, Human
cacuguuuauacacuguguaa

SEQ ID NO: 1381400 - RNA, 19 nt, Human
cacuguuucaaacuuuacu

SEQ ID NO: 1381401 - RNA, 19 nt, Human
cagaaauuguauauuguaa

SEQ ID NO: 1381402 - RNA, 18 nt, Human
cagaaauuguauauugua

SEQ ID NO: 1381403 - RNA, 16 nt, Human
cagaaauuguauauug

SEQ ID NO: 1381404 - RNA, 15 nt, Human
cagaaauuguauauu

SEQ ID NO: 1381405 - RNA, 14 nt, Human
cagaaauuguauau

SEQ ID NO: 1381406 - RNA, 13 nt, Human
cagaaauuguaua

SEQ ID NO: 1381407 - RNA, 12 nt, Human
cagaaauuguau

SEQ ID NO: 1381408 - RNA, 20 nt, Human
cagaaauucaauuuggauuu

SEQ ID NO: 1381409 - RNA, 16 nt, Human
cagaaauucaauuugg

SEQ ID NO: 1381410 - RNA, 14 nt, Human
cagaagugcaucug

SEQ ID NO: 1381411 - RNA, 12 nt, Human
cagaagugcauc

SEQ ID NO: 1381412 - RNA, 16 nt, Human
cagaaguuaguuugua

SEQ ID NO: 1381413 - RNA, 17 nt, Human
cagaagugugacuggcu

SEQ ID NO: 1381414 - RNA, 13 nt, Human
cagaagugugacu

SEQ ID NO: 1381415 - RNA, 18 nt, Human
cagaaguuaguuuguaua

SEQ ID NO: 1381416 - RNA, 19 nt, Human
cagaaguuaguuuguauau

SEQ ID NO: 1381417 - RNA, 17 nt, Human
cagaaauuuaauucaga

SEQ ID NO: 1381418 - RNA, 22 nt, Human
cagaaauuguauauuguaauuu

SEQ ID NO: 1381419 - RNA, 21 nt, Human
cagaaauuguauauuguaauu

SEQ ID NO: 1381420 - RNA, 13 nt, Human
cagaauaugucag

SEQ ID NO: 1381421 - RNA, 17 nt, Human
cagaauaucacagaaaa

SEQ ID NO: 1381422 - RNA, 14 nt, Human
cagaauaguauuuu

SEQ ID NO: 1381423 - RNA, 22 nt, Human
cagaauagccacauuuggaaua

SEQ ID NO: 1381424 - RNA, 21 nt, Human
cagaauagccacauuuggaau

SEQ ID NO: 1381425 - RNA, 15 nt, Human
cagaauagccacauu

SEQ ID NO: 1381426 - RNA, 15 nt, Human
cagaauacauacaaa

SEQ ID NO: 1381427 - RNA, 23 nt, Human
cagaauaaguuauugcaguuuau

SEQ ID NO: 1381428 - RNA, 21 nt, Human
cagaauaaguuauugcaguuu

SEQ ID NO: 1381429 - RNA, 20 nt, Human
cagaauaaguuauugcaguu

SEQ ID NO: 1381430 - RNA, 19 nt, Human
cagaauaaguuauugcagu

SEQ ID NO: 1381431 - RNA, 18 nt, Human
cagaauaaguuauugcag

SEQ ID NO: 1381432 - RNA, 17 nt, Human
cagaauaaguuauugca

SEQ ID NO: 1381433 - RNA, 15 nt, Human
cagaauaaguuauug

SEQ ID NO: 1381434 - RNA, 22 nt, Human
cagaaguuugcacuaucuuuca

SEQ ID NO: 1381435 - RNA, 18 nt, Human
cagaaguuugcacuaucu

SEQ ID NO: 1381436 - RNA, 16 nt, Human
cagaaguuugcacuau

SEQ ID NO: 1381437 - RNA, 21 nt, Human
caccuuggacauccuccuccc

SEQ ID NO: 1381438 - RNA, 18 nt, Human
caccuuggacauccuccu

SEQ ID NO: 1381439 - RNA, 17 nt, Human
caccuuggacauccucc

SEQ ID NO: 1381440 - RNA, 16 nt, Human
caccuuggacauccuc

SEQ ID NO: 1381441 - RNA, 22 nt, Human
caccuugcagcucuccccuucu

SEQ ID NO: 1381442 - RNA, 17 nt, Human
caccuuggcaccagaca

SEQ ID NO: 1381443 - RNA, 22 nt, Human
caccuuggacauccuccuccca

SEQ ID NO: 1381444 - RNA, 13 nt, Human
caccuugcagcuc

SEQ ID NO: 1381445 - RNA, 15 nt, Human
caccuugcagcucuc

SEQ ID NO: 1381446 - RNA, 23 nt, Human
caccuugugcuggggacaggucc

SEQ ID NO: 1381447 - RNA, 23 nt, Human
caccuugcuccuccuucugcugc

SEQ ID NO: 1381448 - RNA, 15 nt, Human
caccuuuagguucuu

SEQ ID NO: 1381449 - RNA, 14 nt, Human
caccuuuagguucu

SEQ ID NO: 1381450 - RNA, 13 nt, Human
caccguugucuca

SEQ ID NO: 1381451 - RNA, 15 nt, Human
caccguucugugcac

SEQ ID NO: 1381452 - RNA, 14 nt, Human
caccguucugugca

SEQ ID NO: 1381453 - RNA, 13 nt, Human
caccguucugugc

SEQ ID NO: 1381454 - RNA, 14 nt, Human
caccguucauucag

SEQ ID NO: 1381455 - RNA, 15 nt, Human
caccuaacucuucuu

SEQ ID NO: 1381456 - RNA, 17 nt, Human
caccuaaagaaaaacaa

SEQ ID NO: 1381457 - RNA, 13 nt, Human
caccuaaagaaaa

SEQ ID NO: 1381458 - RNA, 12 nt, Human
caccuaaagaaa

SEQ ID NO: 1381459 - RNA, 19 nt, Human
caccguugucucaugccag

SEQ ID NO: 1381460 - RNA, 14 nt, Human
caccguugucucau

SEQ ID NO: 1381461 - RNA, 17 nt, Human
caccuaauccaggcaga

SEQ ID NO: 1381462 - RNA, 13 nt, Human
caccuauuuccau

SEQ ID NO: 1381463 - RNA, 21 nt, Human
caccuauuaucccagcugccu

SEQ ID NO: 1381464 - RNA, 19 nt, Human
caccuauuaucccagcugc

SEQ ID NO: 1381465 - RNA, 18 nt, Human
caccuauuaucccagcug

SEQ ID NO: 1381466 - RNA, 17 nt, Human
caccuauuaucccagcu

SEQ ID NO: 1381467 - RNA, 15 nt, Human
caccuauuaucccag

SEQ ID NO: 1381468 - RNA, 17 nt, Human
caccuacucacacaggc

SEQ ID NO: 1381469 - RNA, 23 nt, Human
caccuaugucauuucauuuccua

SEQ ID NO: 1381470 - RNA, 20 nt, Human
caccuaugucauuucauuuc

SEQ ID NO: 1381471 - RNA, 19 nt, Human
caccuaugucauuucauuu

SEQ ID NO: 1381472 - RNA, 18 nt, Human
caccuacucacacaggca

SEQ ID NO: 1381473 - RNA, 18 nt, Human
caccuaccgaguucaagu

SEQ ID NO: 1381474 - RNA, 14 nt, Human
cacuacacccagca

SEQ ID NO: 1381475 - RNA, 15 nt, Human
cacuacacccagcaa

SEQ ID NO: 1381476 - RNA, 16 nt, Human
cacuacacccagcaau

SEQ ID NO: 1381477 - RNA, 17 nt, Human
cacuacacccagcaaua

SEQ ID NO: 1381478 - RNA, 18 nt, Human
cacuacacccagcaauag

SEQ ID NO: 1381479 - RNA, 23 nt, Human
cacuacgccuggcugauuuuugu

SEQ ID NO: 1381480 - RNA, 21 nt, Human
cacuaauauauuuaaaaauaa

SEQ ID NO: 1381481 - RNA, 20 nt, Human
cacuaauauauuuaaaaaua

SEQ ID NO: 1381482 - RNA, 19 nt, Human
cacuaauauauuuaaaaau

SEQ ID NO: 1381483 - RNA, 17 nt, Human
cacuaauauauuuaaaa

SEQ ID NO: 1381484 - RNA, 16 nt, Human
cacuaauauauuuaaa

SEQ ID NO: 1381485 - RNA, 22 nt, Human
cacggcaccugggcccuggggc

SEQ ID NO: 1381486 - RNA, 20 nt, Human
cacggcagccacagcuuggg

SEQ ID NO: 1381487 - RNA, 22 nt, Human
cacuaauucauuaaucugccuc

SEQ ID NO: 1381488 - RNA, 12 nt, Human
cacuaauucaua

SEQ ID NO: 1381489 - RNA, 11 nt, Human
cacuaauucau

SEQ ID NO: 1381490 - RNA, 14 nt, Human
cacuacaaccuccg

SEQ ID NO: 1381491 - RNA, 13 nt, Human
cacuacaaccucc

SEQ ID NO: 1381492 - RNA, 12 nt, Human
cacuacacccag

SEQ ID NO: 1381493 - RNA, 23 nt, Human
cacggagucguggggugugcugg

SEQ ID NO: 1381494 - RNA, 19 nt, Human
cacggcaccugggcccugg

SEQ ID NO: 1381495 - RNA, 17 nt, Human
cacggcaaaggaagacg

SEQ ID NO: 1381496 - RNA, 17 nt, Human
cacggauuugugucugu

SEQ ID NO: 1381497 - RNA, 21 nt, Human
cacggcaccugggcccugggg

SEQ ID NO: 1381498 - RNA, 20 nt, Human
cacggcaccugggcccuggg

SEQ ID NO: 1381499 - RNA, 13 nt, Human
cacggcagccaca

SEQ ID NO: 1381500 - RNA, 14 nt, Human
cacuccccacaucc

SEQ ID NO: 1381501 - RNA, 15 nt, Human
cacuccccaaccccc

SEQ ID NO: 1381502 - RNA, 12 nt, Human
cacuagcucuug

SEQ ID NO: 1381503 - RNA, 23 nt, Human
cacucccaccugacacaccaggc

SEQ ID NO: 1381504 - RNA, 22 nt, Human
cacucccaccugacacaccagg

SEQ ID NO: 1381505 - RNA, 23 nt, Human
cacuaggcccccacuugccucuu

SEQ ID NO: 1381506 - RNA, 22 nt, Human
cacuaggcccccacuugccucu

SEQ ID NO: 1381507 - RNA, 21 nt, Human
cacuaggcccccacuugccuc

SEQ ID NO: 1381508 - RNA, 20 nt, Human
cacuaggcccccacuugccu

SEQ ID NO: 1381509 - RNA, 17 nt, Human
cacuaggcccccacuug

SEQ ID NO: 1381510 - RNA, 22 nt, Human
cacuagcucuuguugagccgug

SEQ ID NO: 1381511 - RNA, 15 nt, Human
cacuacugacaugug

SEQ ID NO: 1381512 - RNA, 13 nt, Human
cacuacugacaug

SEQ ID NO: 1381513 - RNA, 19 nt, Human
cacuagccucaggggucug

SEQ ID NO: 1381514 - RNA, 15 nt, Human
cacuagccucagggg

SEQ ID NO: 1381515 - RNA, 19 nt, Human
cacuccccgaagucuuuug

SEQ ID NO: 1381516 - RNA, 18 nt, Human
cacuccccgaagucuuuu

SEQ ID NO: 1381517 - RNA, 21 nt, Human
cacucuuaugcuguacccagu

SEQ ID NO: 1381518 - RNA, 19 nt, Human
cacucuuaugcuguaccca

SEQ ID NO: 1381519 - RNA, 18 nt, Human
cacucuuaugcuguaccc

SEQ ID NO: 1381520 - RNA, 14 nt, Human
cacucuuaugcugu

SEQ ID NO: 1381521 - RNA, 17 nt, Human
cacucuugaaaaaugca

SEQ ID NO: 1381522 - RNA, 23 nt, Human
cacugaaaaaucuaagugauaua

SEQ ID NO: 1381523 - RNA, 20 nt, Human
cacugaaaaaucuaagugau

SEQ ID NO: 1381524 - RNA, 17 nt, Human
cacugaaaaaauauaug

SEQ ID NO: 1381525 - RNA, 16 nt, Human
cacugaaaaaauauau

SEQ ID NO: 1381526 - RNA, 11 nt, Human
cacugaagaag

SEQ ID NO: 1381527 - RNA, 20 nt, Human
cacugaacuuugcugagccu

SEQ ID NO: 1381528 - RNA, 17 nt, Human
auuuugacauaaaguug

SEQ ID NO: 1381529 - RNA, 24 nt, Human
auuuugacauaaaguugauaaaga

SEQ ID NO: 1381530 - RNA, 23 nt, Human
auuuucuuuguguagcuuugcuc

SEQ ID NO: 1381531 - RNA, 16 nt, Human
auuuucuuucuguaac

SEQ ID NO: 1381532 - RNA, 20 nt, Human
auuuuaucccucaccuguag

SEQ ID NO: 1381533 - RNA, 14 nt, Human
auuuugaguugcca

SEQ ID NO: 1381534 - RNA, 20 nt, Human
auuuguuucuuucucugagg

SEQ ID NO: 1381535 - RNA, 20 nt, Human
auuuguuugaacugauaaag

SEQ ID NO: 1381536 - RNA, 14 nt, Human
auuuguuugaacug

SEQ ID NO: 1381537 - RNA, 16 nt, Human
auuuguuugaacugau

SEQ ID NO: 1381538 - RNA, 15 nt, Human
auuuuauauuacacu

SEQ ID NO: 1381539 - RNA, 18 nt, Human
auuuuauauuacacuaca

SEQ ID NO: 1381540 - RNA, 23 nt, Human
auuuuauaugcuuacugauauau

SEQ ID NO: 1381541 - RNA, 17 nt, Human
auuuuauagcuacuaau

SEQ ID NO: 1381542 - RNA, 13 nt, Human
auuuguuugaacu

SEQ ID NO: 1381543 - RNA, 22 nt, Human
auuuuuacagaauugcuuguuu

SEQ ID NO: 1381544 - RNA, 16 nt, Human
auuuuuacagaauugc

SEQ ID NO: 1381545 - RNA, 14 nt, Human
auuuuuacagaauu

SEQ ID NO: 1381546 - RNA, 19 nt, Human
auuuuuacaauguaauuau

SEQ ID NO: 1381547 - RNA, 18 nt, Human
auuuuuacaauguaauua

SEQ ID NO: 1381548 - RNA, 17 nt, Human
auuuuuacaauguaauu

SEQ ID NO: 1381549 - RNA, 22 nt, Human
auuuuuaauuaauugggccagc

SEQ ID NO: 1381550 - RNA, 13 nt, Human
auuuuuaagugcu

SEQ ID NO: 1381551 - RNA, 21 nt, Human
caaaaaaaaauuuuaaagacc

SEQ ID NO: 1381552 - RNA, 22 nt, Human
caaaaaaaaauuuuaaagaccc

SEQ ID NO: 1381553 - RNA, 14 nt, Human
caaaaaaaaauaca

SEQ ID NO: 1381554 - RNA, 17 nt, Human
auuuuuuuuuccuagcc

SEQ ID NO: 1381555 - RNA, 23 nt, Human
caaaagcgugagcuuaaaauaca

SEQ ID NO: 1381556 - RNA, 21 nt, Human
caaaagcuauuuaaagcaucu

SEQ ID NO: 1381557 - RNA, 20 nt, Human
caaaagcccauucauuccau

SEQ ID NO: 1381558 - RNA, 22 nt, Human
caaaagcccauucauuccauuc

SEQ ID NO: 1381559 - RNA, 17 nt, Human
caaaccaaaucacugaa

SEQ ID NO: 1381560 - RNA, 19 nt, Human
caaaccacuuuuugcagcu

SEQ ID NO: 1381561 - RNA, 17 nt, Human
caaaccacgccucuuga

SEQ ID NO: 1381562 - RNA, 16 nt, Human
caaaaguuacauguuu

SEQ ID NO: 1381563 - RNA, 22 nt, Human
caaaccacgccucuugaccagg

SEQ ID NO: 1381564 - RNA, 19 nt, Human
caaaccacgccucuugacc

SEQ ID NO: 1381565 - RNA, 17 nt, Human
caaaccacuuuuugcag

SEQ ID NO: 1381566 - RNA, 22 nt, Human
caaccauuccagacugcuucca

SEQ ID NO: 1381567 - RNA, 16 nt, Human
caaccauuccagacug

SEQ ID NO: 1381568 - RNA, 14 nt, Human
caaccauuccagac

SEQ ID NO: 1381569 - RNA, 13 nt, Human
caaccauuccaga

SEQ ID NO: 1381570 - RNA, 22 nt, Human
caaccauuauaaccuuaauuua

SEQ ID NO: 1381571 - RNA, 18 nt, Human
caaccauuauaaccuuaa

SEQ ID NO: 1381572 - RNA, 22 nt, Human
caaccaugucauuucagaaguu

SEQ ID NO: 1381573 - RNA, 16 nt, Human
caaccaugucauuuca

SEQ ID NO: 1381574 - RNA, 14 nt, Human
caaccaugucauuu

SEQ ID NO: 1381575 - RNA, 23 nt, Human
caaccacuggucuguagggauuu

SEQ ID NO: 1381576 - RNA, 22 nt, Human
caaccacuggucuguagggauu

SEQ ID NO: 1381577 - RNA, 14 nt, Human
caaccacuggucug

SEQ ID NO: 1381578 - RNA, 14 nt, Human
caacccaaugggcu

SEQ ID NO: 1381579 - RNA, 18 nt, Human
caacccaaccucauccuc

SEQ ID NO: 1381580 - RNA, 17 nt, Human
caaccauuuccucagac

SEQ ID NO: 1381581 - RNA, 14 nt, Human
caaccauuugaaac

SEQ ID NO: 1381582 - RNA, 16 nt, Human
caaccauuuccucaga

SEQ ID NO: 1381583 - RNA, 13 nt, Human
caaccauuuccuc

SEQ ID NO: 1381584 - RNA, 16 nt, Human
caaccccagacacugg

SEQ ID NO: 1381585 - RNA, 20 nt, Human
caagaauaaucacgcuuucc

SEQ ID NO: 1381586 - RNA, 18 nt, Human
caagaauaaucacgcuuu

SEQ ID NO: 1381587 - RNA, 17 nt, Human
caagaauaaucacgcuu

SEQ ID NO: 1381588 - RNA, 16 nt, Human
caagaagggacugaga

SEQ ID NO: 1381589 - RNA, 14 nt, Human
caagaagugaagaa

SEQ ID NO: 1381590 - RNA, 18 nt, Human
caagaagggacugagaga

SEQ ID NO: 1381591 - RNA, 13 nt, Human
caagaagggacug

SEQ ID NO: 1381592 - RNA, 16 nt, Human
caagacccccagcacu

SEQ ID NO: 1381593 - RNA, 14 nt, Human
caagacccccagca

SEQ ID NO: 1381594 - RNA, 13 nt, Human
caagacccccagc

SEQ ID NO: 1381595 - RNA, 23 nt, Human
caagaauuucuaggacugaauua

SEQ ID NO: 1381596 - RNA, 13 nt, Human
caacacaaagauu

SEQ ID NO: 1381597 - RNA, 18 nt, Human
caacaccucuuggggagu

SEQ ID NO: 1381598 - RNA, 21 nt, Human
caaaugaguaacauuugcugu

SEQ ID NO: 1381599 - RNA, 19 nt, Human
caaaugaguaacauuugcu

SEQ ID NO: 1381600 - RNA, 18 nt, Human
caaaugaguaacauuugc

SEQ ID NO: 1381601 - RNA, 14 nt, Human
caaaugaguaacau

SEQ ID NO: 1381602 - RNA, 19 nt, Human
caaauuuugaguugccaca

SEQ ID NO: 1381603 - RNA, 19 nt, Human
caaaugcaaaaacucuuug

SEQ ID NO: 1381604 - RNA, 21 nt, Human
caaaugcaaaaacucuuugag

SEQ ID NO: 1381605 - RNA, 14 nt, Human
caaaucuaccacug

SEQ ID NO: 1381606 - RNA, 18 nt, Human
caaaucuaccacuguaug

SEQ ID NO: 1381607 - RNA, 21 nt, Human
caaaucguccagcgaccuucc

SEQ ID NO: 1381608 - RNA, 19 nt, Human
caaaucguccagcgaccuu

SEQ ID NO: 1381609 - RNA, 14 nt, Human
caaaucgaaugaaa

SEQ ID NO: 1381610 - RNA, 20 nt, Human
caacaauuucuacuuugaag

SEQ ID NO: 1381611 - RNA, 19 nt, Human
caacaauuucuacuuugaa

SEQ ID NO: 1381612 - RNA, 18 nt, Human
caacaauuucuacuuuga

SEQ ID NO: 1381613 - RNA, 13 nt, Human
caacaauuucuac

SEQ ID NO: 1381614 - RNA, 18 nt, Human
caacaauuuaugaauuga

SEQ ID NO: 1381615 - RNA, 17 nt, Human
caacaauuuaugaauug

SEQ ID NO: 1381616 - RNA, 16 nt, Human
caacaauuuaugaauu

SEQ ID NO: 1381617 - RNA, 14 nt, Human
caacaauuuaugaa

SEQ ID NO: 1381618 - RNA, 22 nt, Human
caacaaaagaagcccggcuccu

SEQ ID NO: 1381619 - RNA, 14 nt, Human
caacaaaagaagcc

SEQ ID NO: 1381620 - RNA, 15 nt, Human
caacaaagaaacaaa

SEQ ID NO: 1381621 - RNA, 20 nt, Human
caaagaugaaugaagcaaau

SEQ ID NO: 1381622 - RNA, 18 nt, Human
caaagaugaaugaagcaa

SEQ ID NO: 1381623 - RNA, 12 nt, Human
caaagaugaaaa

SEQ ID NO: 1381624 - RNA, 21 nt, Human
caaagaucuguccucagccuu

SEQ ID NO: 1381625 - RNA, 20 nt, Human
caaagaucuguccucagccu

SEQ ID NO: 1381626 - RNA, 21 nt, Human
caaaguacacuguuucaaacu

SEQ ID NO: 1381627 - RNA, 16 nt, Human
caaaguacacuguuuc

SEQ ID NO: 1381628 - RNA, 20 nt, Human
caaaguacacuguuucaaac

SEQ ID NO: 1381629 - RNA, 18 nt, Human
caaaucauuuguuuaaaa

SEQ ID NO: 1381630 - RNA, 17 nt, Human
caaaucauuuguuuaaa

SEQ ID NO: 1381631 - RNA, 16 nt, Human
caaaucauuuguuuaa

SEQ ID NO: 1381632 - RNA, 14 nt, Human
caaaucauuuguuu

SEQ ID NO: 1381633 - RNA, 13 nt, Human
caaaucauuuguu

SEQ ID NO: 1381634 - RNA, 13 nt, Human
caaaucaggcuuu

SEQ ID NO: 1381635 - RNA, 16 nt, Human
caaaucaggcuuuugu

SEQ ID NO: 1381636 - RNA, 22 nt, Human
caaauccagccugcugccugcu

SEQ ID NO: 1381637 - RNA, 14 nt, Human
auuuaauguuuuca

SEQ ID NO: 1381638 - RNA, 17 nt, Human
auuuaauggggaggaca

SEQ ID NO: 1381639 - RNA, 15 nt, Human
auuuaauuagugcua

SEQ ID NO: 1381640 - RNA, 16 nt, Human
auuuaauuagugcuaa

SEQ ID NO: 1381641 - RNA, 18 nt, Human
auuuaauuagugcuaagu

SEQ ID NO: 1381642 - RNA, 14 nt, Human
auuuaaugcugugg

SEQ ID NO: 1381643 - RNA, 13 nt, Human
auuucaagguucu

SEQ ID NO: 1381644 - RNA, 12 nt, Human
auuucaagguuc

SEQ ID NO: 1381645 - RNA, 17 nt, Human
auuuaucacacaaagca

SEQ ID NO: 1381646 - RNA, 14 nt, Human
auuuaucacacaaa

SEQ ID NO: 1381647 - RNA, 19 nt, Human
auuuaucacacaaagcaga

SEQ ID NO: 1381648 - RNA, 21 nt, Human
auuuaucaaacccuagccuug

SEQ ID NO: 1381649 - RNA, 20 nt, Human
auuuauauuguaaauauugu

SEQ ID NO: 1381650 - RNA, 21 nt, Human
auuuauauuguaaauauugug

SEQ ID NO: 1381651 - RNA, 18 nt, Human
auuuauauuguaaauauu

SEQ ID NO: 1381652 - RNA, 17 nt, Human
auuuauaccuaacugaa

SEQ ID NO: 1381653 - RNA, 23 nt, Human
auuucagagugacuacacacagu

SEQ ID NO: 1381654 - RNA, 22 nt, Human
auuucagagaggccuuuuggaa

SEQ ID NO: 1381655 - RNA, 16 nt, Human
auuucagagaggccuu

SEQ ID NO: 1381656 - RNA, 23 nt, Human
auuucagacucccauuccugaag

SEQ ID NO: 1381657 - RNA, 18 nt, Human
auuucagacucccauucc

SEQ ID NO: 1381658 - RNA, 23 nt, Human
auuucaaguuccaaguugcuaau

SEQ ID NO: 1381659 - RNA, 22 nt, Human
auuucaaguuccaaguugcuaa

SEQ ID NO: 1381660 - RNA, 16 nt, Human
auuucaaguuccaagu

SEQ ID NO: 1381661 - RNA, 11 nt, Human
auuucaaguuc

SEQ ID NO: 1381662 - RNA, 17 nt, Human
auuucaagguucuaacc

SEQ ID NO: 1381663 - RNA, 15 nt, Human
auuucaagguucuaa

SEQ ID NO: 1381664 - RNA, 14 nt, Human
auuucaagguucua

SEQ ID NO: 1381665 - RNA, 13 nt, Human
auuucaucuauuu

SEQ ID NO: 1381666 - RNA, 18 nt, Human
auuucagauucccagagc

SEQ ID NO: 1381667 - RNA, 15 nt, Human
auuucagauuuguga

SEQ ID NO: 1381668 - RNA, 16 nt, Human
auuucagcagcugcag

SEQ ID NO: 1381669 - RNA, 15 nt, Human
auuucuguguugcca

SEQ ID NO: 1381670 - RNA, 23 nt, Human
auuucuguguugccaagcuccaa

SEQ ID NO: 1381671 - RNA, 19 nt, Human
auuucuguuuagauaauac

SEQ ID NO: 1381672 - RNA, 12 nt, Human
auuucuguuuag

SEQ ID NO: 1381673 - RNA, 14 nt, Human
auuucuguuuagau

SEQ ID NO: 1381674 - RNA, 16 nt, Human
auuucuguuuagauaa

SEQ ID NO: 1381675 - RNA, 20 nt, Human
auuucuccuccaugggagaa

SEQ ID NO: 1381676 - RNA, 20 nt, Human
auuucuaugaaauauuaugu

SEQ ID NO: 1381677 - RNA, 14 nt, Human
auuucaucuauuuu

SEQ ID NO: 1381678 - RNA, 18 nt, Human
auuucuaugaaauauuau

SEQ ID NO: 1381679 - RNA, 15 nt, Human
auuucuaugaaauau

SEQ ID NO: 1381680 - RNA, 13 nt, Human
auuguaaaauaau

SEQ ID NO: 1381681 - RNA, 17 nt, Human
auuguaaaauaauucug

SEQ ID NO: 1381682 - RNA, 14 nt, Human
auuguaaauauugu

SEQ ID NO: 1381683 - RNA, 23 nt, Human
auuguaauaggcguaacuaauuu

SEQ ID NO: 1381684 - RNA, 23 nt, Human
auuguaaaagcauuuuguaauaa

SEQ ID NO: 1381685 - RNA, 21 nt, Human
auuguaaaagcauuuuguaau

SEQ ID NO: 1381686 - RNA, 20 nt, Human
auuguaaaagcauuuuguaa

SEQ ID NO: 1381687 - RNA, 19 nt, Human
auuguaaaagcauuuugua

SEQ ID NO: 1381688 - RNA, 13 nt, Human
auuguaaaagcau

SEQ ID NO: 1381689 - RNA, 14 nt, Human
auuguaaaacaggu

SEQ ID NO: 1381690 - RNA, 15 nt, Human
auuguaaaaauggca

SEQ ID NO: 1381691 - RNA, 19 nt, Human
auugaucggagccuccucu

SEQ ID NO: 1381692 - RNA, 18 nt, Human
auugaugggauuugguca

SEQ ID NO: 1381693 - RNA, 18 nt, Human
auugauccagaaagaaaa

SEQ ID NO: 1381694 - RNA, 19 nt, Human
auugauccagaaagaaaac

SEQ ID NO: 1381695 - RNA, 22 nt, Human
auugauccagaaagaaaacuug

SEQ ID NO: 1381696 - RNA, 23 nt, Human
auugaucggagccuccucucuca

SEQ ID NO: 1381697 - RNA, 13 nt, Human
auuguuucaauug

SEQ ID NO: 1381698 - RNA, 19 nt, Human
auuguugaaaaaguuuguu

SEQ ID NO: 1381699 - RNA, 20 nt, Human
auuguugaaaaaguuuguuu

SEQ ID NO: 1381700 - RNA, 18 nt, Human
auuguugaaaaaguuugu

SEQ ID NO: 1381701 - RNA, 17 nt, Human
auuguugaaaaaguuug

SEQ ID NO: 1381702 - RNA, 17 nt, Human
auuguucucagaauccc

SEQ ID NO: 1381703 - RNA, 14 nt, Human
auuguucucagaau

SEQ ID NO: 1381704 - RNA, 20 nt, Human
auuccucuacuaacaaucag

SEQ ID NO: 1381705 - RNA, 17 nt, Human
auuccaaagaacagccu

SEQ ID NO: 1381706 - RNA, 20 nt, Human
auuccaaagaguagaauugc

SEQ ID NO: 1381707 - RNA, 17 nt, Human
auucauuuuuuaaauuc

SEQ ID NO: 1381708 - RNA, 15 nt, Human
auucauuuucucuaa

SEQ ID NO: 1381709 - RNA, 16 nt, Human
auucauuuucucuaau

SEQ ID NO: 1381710 - RNA, 14 nt, Human
auucauuuucucua

SEQ ID NO: 1381711 - RNA, 21 nt, Human
auucauuuuaacaucugagaa

SEQ ID NO: 1381712 - RNA, 13 nt, Human
auucaugacuaug

SEQ ID NO: 1381713 - RNA, 19 nt, Human
auucauccaaguuaaaugu

SEQ ID NO: 1381714 - RNA, 18 nt, Human
auucauuuuaacaucuga

SEQ ID NO: 1381715 - RNA, 20 nt, Human
auucauccaaguuaaaugua

SEQ ID NO: 1381716 - RNA, 18 nt, Human
auucauccaaguuaaaug

SEQ ID NO: 1381717 - RNA, 17 nt, Human
auucauccaaguuaaau

SEQ ID NO: 1381718 - RNA, 17 nt, Human
auucacaaacuuuuaua

SEQ ID NO: 1381719 - RNA, 17 nt, Human
auuaaauuggaaagcag

SEQ ID NO: 1381720 - RNA, 15 nt, Human
auuaaauuggaaagc

SEQ ID NO: 1381721 - RNA, 17 nt, Human
auuaaauaagauucuaa

SEQ ID NO: 1381722 - RNA, 20 nt, Human
auuaaauucuugcaaaguau

SEQ ID NO: 1381723 - RNA, 14 nt, Human
auuaaauucuugca

SEQ ID NO: 1381724 - RNA, 18 nt, Human
auuaaauucuugcaaagu

SEQ ID NO: 1381725 - RNA, 16 nt, Human
auuaugugguuuuaga

SEQ ID NO: 1381726 - RNA, 14 nt, Human
auuaugugguuuua

SEQ ID NO: 1381727 - RNA, 15 nt, Human
auuauguguguuuua

SEQ ID NO: 1381728 - RNA, 20 nt, Human
auuauguguguuuuaaaaug

SEQ ID NO: 1381729 - RNA, 21 nt, Human
auuauguguguuuuaaaauga

SEQ ID NO: 1381730 - RNA, 18 nt, Human
auucaaggaauuucuuaa

SEQ ID NO: 1381731 - RNA, 17 nt, Human
auucaaggaauuucuua

SEQ ID NO: 1381732 - RNA, 19 nt, Human
auucaaggaauuucuuaac

SEQ ID NO: 1381733 - RNA, 20 nt, Human
auucaaggaauuucuuaacu

SEQ ID NO: 1381734 - RNA, 13 nt, Human
auucacaaacuuu

SEQ ID NO: 1381735 - RNA, 22 nt, Human
auucacaaacuuuuauacucuu

SEQ ID NO: 1381736 - RNA, 14 nt, Human
auucacaaacuuuu

SEQ ID NO: 1381737 - RNA, 16 nt, Human
auucaaggaauuucuu

SEQ ID NO: 1381738 - RNA, 17 nt, Human
auuaugugguuuuagau

SEQ ID NO: 1381739 - RNA, 11 nt, Human
auuauguuaaa

SEQ ID NO: 1381740 - RNA, 15 nt, Human
auuauguguguuuug

SEQ ID NO: 1381741 - RNA, 18 nt, Human
auucuugguugaggaaac

SEQ ID NO: 1381742 - RNA, 17 nt, Human
auucuugguugaggaaa

SEQ ID NO: 1381743 - RNA, 22 nt, Human
auucugauucgaaugacacugu

SEQ ID NO: 1381744 - RNA, 21 nt, Human
auucugauucgaaugacacug

SEQ ID NO: 1381745 - RNA, 20 nt, Human
auucugauucgaaugacacu

SEQ ID NO: 1381746 - RNA, 23 nt, Human
auucugaguuuuguguuuguugu

SEQ ID NO: 1381747 - RNA, 22 nt, Human
auucugaguuuuguguuuguug

SEQ ID NO: 1381748 - RNA, 17 nt, Human
auucugaguuuuguguu

SEQ ID NO: 1381749 - RNA, 11 nt, Human
auucucugagc

SEQ ID NO: 1381750 - RNA, 20 nt, Human
auucugacucgguuucucca

SEQ ID NO: 1381751 - RNA, 18 nt, Human
auucugacucgguuucuc

SEQ ID NO: 1381752 - RNA, 18 nt, Human
auucugaccuuaaaugca

SEQ ID NO: 1381753 - RNA, 18 nt, Human
auuccugaccuccgccau

SEQ ID NO: 1381754 - RNA, 19 nt, Human
auucucuccuguaccucuu

SEQ ID NO: 1381755 - RNA, 21 nt, Human
auucucuccuguaccucuuga

SEQ ID NO: 1381756 - RNA, 22 nt, Human
auuccugaccuccgccauccac

SEQ ID NO: 1381757 - RNA, 19 nt, Human
auuccugaagaaccagucc

SEQ ID NO: 1381758 - RNA, 16 nt, Human
auuccugaagaaccag

SEQ ID NO: 1381759 - RNA, 15 nt, Human
auuccugaagaacca

SEQ ID NO: 1381760 - RNA, 13 nt, Human
auuccugaacagg

SEQ ID NO: 1381761 - RNA, 20 nt, Human
auugagaaaaauauauacua

SEQ ID NO: 1381762 - RNA, 15 nt, Human
auugagcucucucau

SEQ ID NO: 1381763 - RNA, 11 nt, Human
auugagagaau

SEQ ID NO: 1381764 - RNA, 20 nt, Human
auugagcucucugcccuuga

SEQ ID NO: 1381765 - RNA, 16 nt, Human
auugauccagaaagaa

SEQ ID NO: 1381766 - RNA, 17 nt, Human
auugauccagaaagaaa

SEQ ID NO: 1381767 - RNA, 18 nt, Human
ccaaugcaccuaaagaaa

SEQ ID NO: 1381768 - RNA, 22 nt, Human
ccaaugucuggagaccaccagg

SEQ ID NO: 1381769 - RNA, 16 nt, Human
ccaaugucuggagacc

SEQ ID NO: 1381770 - RNA, 15 nt, Human
ccaaugucuggagac

SEQ ID NO: 1381771 - RNA, 14 nt, Human
ccaaugucuggaga

SEQ ID NO: 1381772 - RNA, 12 nt, Human
ccaaugucuuga

SEQ ID NO: 1381773 - RNA, 15 nt, Human
ccaauguacccaccg

SEQ ID NO: 1381774 - RNA, 20 nt, Human
ccaauggguuuuucccugua

SEQ ID NO: 1381775 - RNA, 22 nt, Human
ccaaugagcuuucugaacagcu

SEQ ID NO: 1381776 - RNA, 23 nt, Human
ccaaugagcuuucugaacagcug

SEQ ID NO: 1381777 - RNA, 21 nt, Human
ccaaugagcuuucugaacagc

SEQ ID NO: 1381778 - RNA, 20 nt, Human
ccaaugagcuuucugaacag

SEQ ID NO: 1381779 - RNA, 18 nt, Human
ccaaugagcuuucugaac

SEQ ID NO: 1381780 - RNA, 16 nt, Human
ccaaugagcuuucuga

SEQ ID NO: 1381781 - RNA, 15 nt, Human
ccaaugagcuuucug

SEQ ID NO: 1381782 - RNA, 14 nt, Human
ccaaugagcuuucu

SEQ ID NO: 1381783 - RNA, 22 nt, Human
ccaaucauuuuaauuauuauuc

SEQ ID NO: 1381784 - RNA, 12 nt, Human
ccaaugaaauga

SEQ ID NO: 1381785 - RNA, 14 nt, Human
ccaaucauuuuaau

SEQ ID NO: 1381786 - RNA, 12 nt, Human
ccaaucauuuua

SEQ ID NO: 1381787 - RNA, 16 nt, Human
ccaaucaaucuugcau

SEQ ID NO: 1381788 - RNA, 22 nt, Human
ccaacuccgugugguaagcaac

SEQ ID NO: 1381789 - RNA, 22 nt, Human
ccaaucaaucuugcauguaacg

SEQ ID NO: 1381790 - RNA, 23 nt, Human
ccaagcugccuccccucuccuuc

SEQ ID NO: 1381791 - RNA, 19 nt, Human
ccaagcugaguuuccuaug

SEQ ID NO: 1381792 - RNA, 18 nt, Human
ccaagcugaguuuccuau

SEQ ID NO: 1381793 - RNA, 17 nt, Human
ccaagcugaguuuccua

SEQ ID NO: 1381794 - RNA, 16 nt, Human
ccaagcugaguuuccu

SEQ ID NO: 1381795 - RNA, 15 nt, Human
ccaagcugaguuucc

SEQ ID NO: 1381796 - RNA, 23 nt, Human
ccaagcugaggugcccaggagaa

SEQ ID NO: 1381797 - RNA, 22 nt, Human
ccaagcugaggugcccaggaga

SEQ ID NO: 1381798 - RNA, 21 nt, Human
ccaagcugaggugcccaggag

SEQ ID NO: 1381799 - RNA, 20 nt, Human
ccaagcugaggugcccagga

SEQ ID NO: 1381800 - RNA, 19 nt, Human
ccaagcugaggugcccagg

SEQ ID NO: 1381801 - RNA, 17 nt, Human
ccaagcugaggugccca

SEQ ID NO: 1381802 - RNA, 15 nt, Human
ccaagcugaggugcc

SEQ ID NO: 1381803 - RNA, 13 nt, Human
ccaagcugaggug

SEQ ID NO: 1381804 - RNA, 12 nt, Human
ccaagcugaggu

SEQ ID NO: 1381805 - RNA, 15 nt, Human
ccaagcucugcaguc

SEQ ID NO: 1381806 - RNA, 14 nt, Human
ccaagcucugcagu

SEQ ID NO: 1381807 - RNA, 15 nt, Human
ccaacugaccaccuu

SEQ ID NO: 1381808 - RNA, 15 nt, Human
ccaacuccuuccagc

SEQ ID NO: 1381809 - RNA, 16 nt, Human
ccaacuccuuccagcu

SEQ ID NO: 1381810 - RNA, 14 nt, Human
ccaacuccuuccag

SEQ ID NO: 1381811 - RNA, 12 nt, Human
ccaacuccuucc

SEQ ID NO: 1381812 - RNA, 23 nt, Human
ccaacuccuaguucuagaaaaac

SEQ ID NO: 1381813 - RNA, 19 nt, Human
ccaacuccuaguucuagaa

SEQ ID NO: 1381814 - RNA, 15 nt, Human
ccaacuccuaguucu

SEQ ID NO: 1381815 - RNA, 22 nt, Human
ccaaaagauugcugaaauuuua

SEQ ID NO: 1381816 - RNA, 19 nt, Human
ccaaaagauugcugaaauu

SEQ ID NO: 1381817 - RNA, 16 nt, Human
ccaaaagauugcugaa

SEQ ID NO: 1381818 - RNA, 22 nt, Human
ccaaaagaagcccccagcuaag

SEQ ID NO: 1381819 - RNA, 23 nt, Human
ccaaaagauugcugaaauuuuau

SEQ ID NO: 1381820 - RNA, 12 nt, Human
ccaaaacugcuc

SEQ ID NO: 1381821 - RNA, 11 nt, Human
ccaaaacugcu

SEQ ID NO: 1381822 - RNA, 22 nt, Human
cauuuuuuuuaagaaaaaggau

SEQ ID NO: 1381823 - RNA, 15 nt, Human
cauuuuuuaggaaau

SEQ ID NO: 1381824 - RNA, 14 nt, Human
cauuuuuuaggaaa

SEQ ID NO: 1381825 - RNA, 20 nt, Human
cauuuguguugaagagguuu

SEQ ID NO: 1381826 - RNA, 18 nt, Human
cauuuuuuuccuugcaaa

SEQ ID NO: 1381827 - RNA, 18 nt, Human
cauuuuuugggcagcaau

SEQ ID NO: 1381828 - RNA, 19 nt, Human
cauuuuuugggcagcaauu

SEQ ID NO: 1381829 - RNA, 22 nt, Human
cauuuuuugggcagcaauuuaa

SEQ ID NO: 1381830 - RNA, 19 nt, Human
cauuuguguacacagucag

SEQ ID NO: 1381831 - RNA, 16 nt, Human
cauuuguguugaagag

SEQ ID NO: 1381832 - RNA, 20 nt, Human
cauuuguauaaaauaauuuu

SEQ ID NO: 1381833 - RNA, 19 nt, Human
cauuuguauaaaauaauuu

SEQ ID NO: 1381834 - RNA, 13 nt, Human
ccacuccucugac

SEQ ID NO: 1381835 - RNA, 23 nt, Human
ccacuccgagaggugggccaguc

SEQ ID NO: 1381836 - RNA, 19 nt, Human
ccacuccgagaggugggcc

SEQ ID NO: 1381837 - RNA, 17 nt, Human
ccacuccgagagguggg

SEQ ID NO: 1381838 - RNA, 16 nt, Human
ccacuccgagaggugg

SEQ ID NO: 1381839 - RNA, 20 nt, Human
ccacuccgagaggugggcca

SEQ ID NO: 1381840 - RNA, 12 nt, Human
ccacuccucuga

SEQ ID NO: 1381841 - RNA, 14 nt, Human
ccacagcacagcca

SEQ ID NO: 1381842 - RNA, 20 nt, Human
ccacagcaaccccaggcuga

SEQ ID NO: 1381843 - RNA, 19 nt, Human
ccacagcaaccccaggcug

SEQ ID NO: 1381844 - RNA, 15 nt, Human
ccacagccagcaccu

SEQ ID NO: 1381845 - RNA, 12 nt, Human
ccacagcaggcc

SEQ ID NO: 1381846 - RNA, 20 nt, Human
ccacagccuccccugccagg

SEQ ID NO: 1381847 - RNA, 19 nt, Human
ccacagccuccccugccag

SEQ ID NO: 1381848 - RNA, 16 nt, Human
ccacagccuccccugc

SEQ ID NO: 1381849 - RNA, 22 nt, Human
ccacagccagcaccuggcaucg

SEQ ID NO: 1381850 - RNA, 19 nt, Human
ccacagccagcaccuggca

SEQ ID NO: 1381851 - RNA, 18 nt, Human
ccacagccagcaccuggc

SEQ ID NO: 1381852 - RNA, 17 nt, Human
ccacagccagcaccugg

SEQ ID NO: 1381853 - RNA, 19 nt, Human
ccacccuguuccugcugcu

SEQ ID NO: 1381854 - RNA, 18 nt, Human
ccacccuguuccugcugc

SEQ ID NO: 1381855 - RNA, 17 nt, Human
ccacccuguuccugcug

SEQ ID NO: 1381856 - RNA, 16 nt, Human
ccacccuguuccugcu

SEQ ID NO: 1381857 - RNA, 15 nt, Human
ccacccuguuccugc

SEQ ID NO: 1381858 - RNA, 22 nt, Human
ccacccugggcccugggcugga

SEQ ID NO: 1381859 - RNA, 20 nt, Human
ccacccugggcccugggcug

SEQ ID NO: 1381860 - RNA, 17 nt, Human
ccacccugggcccuggg

SEQ ID NO: 1381861 - RNA, 16 nt, Human
ccacccugggcccugg

SEQ ID NO: 1381862 - RNA, 15 nt, Human
ccacccugggcccug

SEQ ID NO: 1381863 - RNA, 12 nt, Human
ccaccaguucuc

SEQ ID NO: 1381864 - RNA, 21 nt, Human
ccaccacagccagcaccuggc

SEQ ID NO: 1381865 - RNA, 20 nt, Human
ccaccacagccagcaccugg

SEQ ID NO: 1381866 - RNA, 18 nt, Human
ccaccacagccagcaccu

SEQ ID NO: 1381867 - RNA, 15 nt, Human
ccaccacagccagca

SEQ ID NO: 1381868 - RNA, 14 nt, Human
ccaccacagccagc

SEQ ID NO: 1381869 - RNA, 14 nt, Human
ccacagcugccucu

SEQ ID NO: 1381870 - RNA, 22 nt, Human
ccacgcccguccugccuguggc

SEQ ID NO: 1381871 - RNA, 21 nt, Human
ccacgcccguccugccugugg

SEQ ID NO: 1381872 - RNA, 20 nt, Human
ccacgcccguccugccugug

SEQ ID NO: 1381873 - RNA, 19 nt, Human
ccacgcccguccugccugu

SEQ ID NO: 1381874 - RNA, 23 nt, Human
ccacgcccguccugccuguggcg

SEQ ID NO: 1381875 - RNA, 18 nt, Human
ccacgacuggccagggcc

SEQ ID NO: 1381876 - RNA, 14 nt, Human
ccacgacugucucc

SEQ ID NO: 1381877 - RNA, 15 nt, Human
ccacgacuggccagg

SEQ ID NO: 1381878 - RNA, 17 nt, Human
ccacgacacugcagccc

SEQ ID NO: 1381879 - RNA, 16 nt, Human
ccacgacacugcagcc

SEQ ID NO: 1381880 - RNA, 14 nt, Human
ccacgaaggagccc

SEQ ID NO: 1381881 - RNA, 16 nt, Human
ccaccuuuguuucucc

SEQ ID NO: 1381882 - RNA, 20 nt, Human
ccaccuuuguuucuccccca

SEQ ID NO: 1381883 - RNA, 18 nt, Human
ccacgcccguccugccug

SEQ ID NO: 1381884 - RNA, 17 nt, Human
ccacgcccguccugccu

SEQ ID NO: 1381885 - RNA, 15 nt, Human
ccacgcccguccugc

SEQ ID NO: 1381886 - RNA, 15 nt, Human
ccacgacugucucca

SEQ ID NO: 1381887 - RNA, 16 nt, Human
ccacgacugucuccau

SEQ ID NO: 1381888 - RNA, 13 nt, Human
ccaccgcccagag

SEQ ID NO: 1381889 - RNA, 17 nt, Human
ccaccgcccagagaccc

SEQ ID NO: 1381890 - RNA, 18 nt, Human
ccaccgaagccgccugug

SEQ ID NO: 1381891 - RNA, 15 nt, Human
ccaccgcagaaggaa

SEQ ID NO: 1381892 - RNA, 16 nt, Human
ccaccgcagaaggaag

SEQ ID NO: 1381893 - RNA, 22 nt, Human
cauaugcuaccaccagcugugu

SEQ ID NO: 1381894 - RNA, 21 nt, Human
cauaugcuaccaccagcugug

SEQ ID NO: 1381895 - RNA, 23 nt, Human
cauaugcuaccaccagcuguguc

SEQ ID NO: 1381896 - RNA, 19 nt, Human
caguggugguuuucuguuc

SEQ ID NO: 1381897 - RNA, 20 nt, Human
caguggugguuuucuguucu

SEQ ID NO: 1381898 - RNA, 21 nt, Human
caguggugguuuucuguucuu

SEQ ID NO: 1381899 - RNA, 22 nt, Human
caguggugguuuucuguucuuu

SEQ ID NO: 1381900 - RNA, 14 nt, Human
cauauguuugguaa

SEQ ID NO: 1381901 - RNA, 16 nt, Human
cauauuaccacagaca

SEQ ID NO: 1381902 - RNA, 20 nt, Human
cauaugcuaccaccagcugu

SEQ ID NO: 1381903 - RNA, 16 nt, Human
caucccguguucuccu

SEQ ID NO: 1381904 - RNA, 14 nt, Human
caucccguguucuc

SEQ ID NO: 1381905 - RNA, 18 nt, Human
caucccgucuucuccaac

SEQ ID NO: 1381906 - RNA, 16 nt, Human
caucccgucuucucca

SEQ ID NO: 1381907 - RNA, 19 nt, Human
cauccccuugaacucuuca

SEQ ID NO: 1381908 - RNA, 17 nt, Human
caucccgagcaccucca

SEQ ID NO: 1381909 - RNA, 21 nt, Human
caucccguguucuccuuuucc

SEQ ID NO: 1381910 - RNA, 17 nt, Human
caucccguguucuccuu

SEQ ID NO: 1381911 - RNA, 22 nt, Human
cauccccuugaggucucagccc

SEQ ID NO: 1381912 - RNA, 15 nt, Human
caucacuuguacaaa

SEQ ID NO: 1381913 - RNA, 14 nt, Human
caucacuuguacaa

SEQ ID NO: 1381914 - RNA, 22 nt, Human
caucacuuaacggaccaaagca

SEQ ID NO: 1381915 - RNA, 19 nt, Human
caucugcugguccguggga

SEQ ID NO: 1381916 - RNA, 14 nt, Human
caucugcugguccg

SEQ ID NO: 1381917 - RNA, 20 nt, Human
caucggacaagacccccagc

SEQ ID NO: 1381918 - RNA, 21 nt, Human
caucggacaagacccccagca

SEQ ID NO: 1381919 - RNA, 19 nt, Human
caucggacaagacccccag

SEQ ID NO: 1381920 - RNA, 16 nt, Human
caucggaaaaauaauc

SEQ ID NO: 1381921 - RNA, 15 nt, Human
caucggaaaaauaau

SEQ ID NO: 1381922 - RNA, 14 nt, Human
caucggaaaaauaa

SEQ ID NO: 1381923 - RNA, 19 nt, Human
caucgcaccauucugacuc

SEQ ID NO: 1381924 - RNA, 18 nt, Human
caucgcaccauucugacu

SEQ ID NO: 1381925 - RNA, 16 nt, Human
caucgcaccauucuga

SEQ ID NO: 1381926 - RNA, 12 nt, Human
cauccuggaaua

SEQ ID NO: 1381927 - RNA, 14 nt, Human
caucugugucuugu

SEQ ID NO: 1381928 - RNA, 13 nt, Human
caucugugucuug

SEQ ID NO: 1381929 - RNA, 11 nt, Human
caucugugucu

SEQ ID NO: 1381930 - RNA, 21 nt, Human
caucugugcacugcccaugga

SEQ ID NO: 1381931 - RNA, 18 nt, Human
caucugugcacugcccau

SEQ ID NO: 1381932 - RNA, 17 nt, Human
caucugugcacugccca

SEQ ID NO: 1381933 - RNA, 17 nt, Human
caucuggagagaacagg

SEQ ID NO: 1381934 - RNA, 16 nt, Human
caucugcuucaggccc

SEQ ID NO: 1381935 - RNA, 12 nt, Human
caucuggaacca

SEQ ID NO: 1381936 - RNA, 17 nt, Human
caucuggaaccaucaga

SEQ ID NO: 1381937 - RNA, 19 nt, Human
caucuggaaccaucagaaa

SEQ ID NO: 1381938 - RNA, 18 nt, Human
cauguaggaaguaggaag

SEQ ID NO: 1381939 - RNA, 20 nt, Human
cauguagaaaauuuguuauu

SEQ ID NO: 1381940 - RNA, 16 nt, Human
cauguuagcccuuccu

SEQ ID NO: 1381941 - RNA, 13 nt, Human
cauguuagccagg

SEQ ID NO: 1381942 - RNA, 15 nt, Human
cauguccuguaaagg

SEQ ID NO: 1381943 - RNA, 14 nt, Human
cauguccuguaaag

SEQ ID NO: 1381944 - RNA, 22 nt, Human
cauguccugccuauuaucuguc

SEQ ID NO: 1381945 - RNA, 13 nt, Human
cauguccugccua

SEQ ID NO: 1381946 - RNA, 14 nt, Human
caugucaacagcgu

SEQ ID NO: 1381947 - RNA, 15 nt, Human
caugucaacagcguu

SEQ ID NO: 1381948 - RNA, 15 nt, Human
caugucaaacaaaua

SEQ ID NO: 1381949 - RNA, 14 nt, Human
caugucaaacaaau

SEQ ID NO: 1381950 - RNA, 15 nt, Human
cauguauuuggugau

SEQ ID NO: 1381951 - RNA, 20 nt, Human
cauguauuuggugauuacau

SEQ ID NO: 1381952 - RNA, 24 nt, Human
cauguuaguuaccuuauaguuacu

SEQ ID NO: 1381953 - RNA, 22 nt, Human
cauguuaguuaccuuauaguua

SEQ ID NO: 1381954 - RNA, 21 nt, Human
cauguuaguuaccuuauaguu

SEQ ID NO: 1381955 - RNA, 14 nt, Human
cauguuaguuaccu

SEQ ID NO: 1381956 - RNA, 21 nt, Human
cauguugggaaacuuggcucg

SEQ ID NO: 1381957 - RNA, 20 nt, Human
cauguugggaaacuuggcuc

SEQ ID NO: 1381958 - RNA, 19 nt, Human
cauguugggaaacuuggcu

SEQ ID NO: 1381959 - RNA, 15 nt, Human
cauguugggaaacuu

SEQ ID NO: 1381960 - RNA, 21 nt, Human
cauguuggccaggcuggucua

SEQ ID NO: 1381961 - RNA, 20 nt, Human
cauguuggccaggcuggucu

SEQ ID NO: 1381962 - RNA, 17 nt, Human
cauucuccacagcaacc

SEQ ID NO: 1381963 - RNA, 15 nt, Human
cauucuccacagcaa

SEQ ID NO: 1381964 - RNA, 18 nt, Human
cauucuccacagcaaccc

SEQ ID NO: 1381965 - RNA, 15 nt, Human
cauucuacugaaaag

SEQ ID NO: 1381966 - RNA, 13 nt, Human
cauucgugaaaac

SEQ ID NO: 1381967 - RNA, 14 nt, Human
cauucguucugugg

SEQ ID NO: 1381968 - RNA, 19 nt, Human
cauuauauuuauuacugua

SEQ ID NO: 1381969 - RNA, 15 nt, Human
cauguuuagacuuua

SEQ ID NO: 1381970 - RNA, 19 nt, Human
cauguugucuaagaaauug

SEQ ID NO: 1381971 - RNA, 15 nt, Human
cauuauaaugaauuu

SEQ ID NO: 1381972 - RNA, 14 nt, Human
cauuauaaugaauu

SEQ ID NO: 1381973 - RNA, 13 nt, Human
cauuauaaugaau

SEQ ID NO: 1381974 - RNA, 18 nt, Human
cauuauaaccuuaauuua

SEQ ID NO: 1381975 - RNA, 16 nt, Human
cauuauaaccuuaauu

SEQ ID NO: 1381976 - RNA, 13 nt, Human
cauuauaaaaaga

SEQ ID NO: 1381977 - RNA, 17 nt, Human
caugauuuccuugaaug

SEQ ID NO: 1381978 - RNA, 16 nt, Human
caugauuuccuugaau

SEQ ID NO: 1381979 - RNA, 14 nt, Human
caugauuuccuuga

SEQ ID NO: 1381980 - RNA, 12 nt, Human
caugauuuccuu

SEQ ID NO: 1381981 - RNA, 24 nt, Human
caugauuuuaaguuucucugcaga

SEQ ID NO: 1381982 - RNA, 22 nt, Human
caugauuuuaaguuucucugca

SEQ ID NO: 1381983 - RNA, 18 nt, Human
caugauuuccuugaaugu

SEQ ID NO: 1381984 - RNA, 21 nt, Human
caugauuuuaaguuucucugc

SEQ ID NO: 1381985 - RNA, 14 nt, Human
caugcuacacacug

SEQ ID NO: 1381986 - RNA, 20 nt, Human
caugcuacacacugcauguu

SEQ ID NO: 1381987 - RNA, 23 nt, Human
caugcuacacacugcauguuugu

SEQ ID NO: 1381988 - RNA, 14 nt, Human
caugauguuuagaa

SEQ ID NO: 1381989 - RNA, 17 nt, Human
cauggcuauuuuauauu

SEQ ID NO: 1381990 - RNA, 15 nt, Human
cauggcuauuuuaua

SEQ ID NO: 1381991 - RNA, 14 nt, Human
cauggcuauuuuau

SEQ ID NO: 1381992 - RNA, 12 nt, Human
cauggcuaucug

SEQ ID NO: 1381993 - RNA, 19 nt, Human
caugcugggauuuccaacu

SEQ ID NO: 1381994 - RNA, 14 nt, Human
caugcugggauuuc

SEQ ID NO: 1381995 - RNA, 13 nt, Human
caugcugggauuu

SEQ ID NO: 1381996 - RNA, 23 nt, Human
caugcuggaaaauaauacugcug

SEQ ID NO: 1381997 - RNA, 22 nt, Human
caugcuggaaaauaauacugcu

SEQ ID NO: 1381998 - RNA, 17 nt, Human
caugcuggaaaauaaua

SEQ ID NO: 1381999 - RNA, 21 nt, Human
caugcugcuggggaagacagu

SEQ ID NO: 1382000 - RNA, 17 nt, Human
caugcugcuggggaaga

SEQ ID NO: 1382001 - RNA, 22 nt, Human
caugcugcuggggaagacagug

SEQ ID NO: 1382002 - RNA, 15 nt, Human
caugcugaggccugg

SEQ ID NO: 1382003 - RNA, 19 nt, Human
caugcugaaggcugaaaga

SEQ ID NO: 1382004 - RNA, 12 nt, Human
caugcuccuuac

SEQ ID NO: 1382005 - RNA, 23 nt, Human
caugcuaucucugugugcacaaa

SEQ ID NO: 1382006 - RNA, 12 nt, Human
caugcaaacucu

SEQ ID NO: 1382007 - RNA, 16 nt, Human
caugcuaucucugugu

SEQ ID NO: 1382008 - RNA, 20 nt, Human
caugcucuccaaaccacuuu

SEQ ID NO: 1382009 - RNA, 13 nt, Human
cauggcugagcug

SEQ ID NO: 1382010 - RNA, 16 nt, Human
cauggcugagcugccc

SEQ ID NO: 1382011 - RNA, 17 nt, Human
cauggcugagcugccca

SEQ ID NO: 1382012 - RNA, 20 nt, Human
cauggcugagcugcccacag

SEQ ID NO: 1382013 - RNA, 19 nt, Human
cagccgcugagcgaggaga

SEQ ID NO: 1382014 - RNA, 22 nt, Human
cagccgacccccucucccugca

SEQ ID NO: 1382015 - RNA, 20 nt, Human
cagccgcugagcgaggagau

SEQ ID NO: 1382016 - RNA, 15 nt, Human
cagccgacccccucu

SEQ ID NO: 1382017 - RNA, 14 nt, Human
cagccgacccccuc

SEQ ID NO: 1382018 - RNA, 23 nt, Human
cagcccuuggggguccuccucca

SEQ ID NO: 1382019 - RNA, 20 nt, Human
cagcccuuggggguccuccu

SEQ ID NO: 1382020 - RNA, 21 nt, Human
cagcgcccaaaggacgcacug

SEQ ID NO: 1382021 - RNA, 22 nt, Human
cagcgccaggcugaccacagca

SEQ ID NO: 1382022 - RNA, 21 nt, Human
cagcgccaggcugaccacagc

SEQ ID NO: 1382023 - RNA, 20 nt, Human
cagcgccaggcugaccacag

SEQ ID NO: 1382024 - RNA, 19 nt, Human
cagcgccaggcugaccaca

SEQ ID NO: 1382025 - RNA, 18 nt, Human
cagcgccaggcugaccac

SEQ ID NO: 1382026 - RNA, 13 nt, Human
cagccucuggcau

SEQ ID NO: 1382027 - RNA, 13 nt, Human
cagccucuggggg

SEQ ID NO: 1382028 - RNA, 18 nt, Human
cagcgcccaaaggacgca

SEQ ID NO: 1382029 - RNA, 22 nt, Human
cagcucccugugcccccagggu

SEQ ID NO: 1382030 - RNA, 20 nt, Human
cagcucccugugcccccagg

SEQ ID NO: 1382031 - RNA, 19 nt, Human
cagcucccugugcccccag

SEQ ID NO: 1382032 - RNA, 18 nt, Human
cagcucccugugccccca

SEQ ID NO: 1382033 - RNA, 14 nt, Human
cagcucccugugcc

SEQ ID NO: 1382034 - RNA, 14 nt, Human
cagcuccucccaca

SEQ ID NO: 1382035 - RNA, 16 nt, Human
cagcuccggccugucc

SEQ ID NO: 1382036 - RNA, 21 nt, Human
cagcuccggccuguccuccaa

SEQ ID NO: 1382037 - RNA, 20 nt, Human
cagcucccccucccuccccu

SEQ ID NO: 1382038 - RNA, 18 nt, Human
cagcucccccucccuccc

SEQ ID NO: 1382039 - RNA, 16 nt, Human
cagcucccccucccuc

SEQ ID NO: 1382040 - RNA, 15 nt, Human
cagcucccccucccu

SEQ ID NO: 1382041 - RNA, 14 nt, Human
cagcucccccuccc

SEQ ID NO: 1382042 - RNA, 24 nt, Human
cagcucccaggaccacaggcucag

SEQ ID NO: 1382043 - RNA, 18 nt, Human
cagcucccaggaccacag

SEQ ID NO: 1382044 - RNA, 11 nt, Human
cagcucccagg

SEQ ID NO: 1382045 - RNA, 21 nt, Human
cagcucccaccuccccuuggg

SEQ ID NO: 1382046 - RNA, 15 nt, Human
cagcucccaccuccc

SEQ ID NO: 1382047 - RNA, 23 nt, Human
cagcuguuuuguugacauucuga

SEQ ID NO: 1382048 - RNA, 22 nt, Human
cagcuguuuuguugacauucug

SEQ ID NO: 1382049 - RNA, 19 nt, Human
cagcuguuuuguugacauu

SEQ ID NO: 1382050 - RNA, 17 nt, Human
cagcuguuuuguugaca

SEQ ID NO: 1382051 - RNA, 16 nt, Human
cagcuguuuuguugac

SEQ ID NO: 1382052 - RNA, 15 nt, Human
cagcuguuuuguuga

SEQ ID NO: 1382053 - RNA, 23 nt, Human
cagcuguugagccccuccuaguu

SEQ ID NO: 1382054 - RNA, 14 nt, Human
cagcugugcuuaug

SEQ ID NO: 1382055 - RNA, 16 nt, Human
cagcuguggcagaguu

SEQ ID NO: 1382056 - RNA, 17 nt, Human
cagcuguggcagaguua

SEQ ID NO: 1382057 - RNA, 12 nt, Human
cagcuguggcag

SEQ ID NO: 1382058 - RNA, 11 nt, Human
cagcugugcuu

SEQ ID NO: 1382059 - RNA, 12 nt, Human
cagcuccucugu

SEQ ID NO: 1382060 - RNA, 22 nt, Human
cagcugccuggaagagcagccc

SEQ ID NO: 1382061 - RNA, 23 nt, Human
cagccagcgucggucugugcccc

SEQ ID NO: 1382062 - RNA, 22 nt, Human
cagccagcgucggucugugccc

SEQ ID NO: 1382063 - RNA, 19 nt, Human
cagccagcgucggucugug

SEQ ID NO: 1382064 - RNA, 19 nt, Human
cagccagccucgcccaucc

SEQ ID NO: 1382065 - RNA, 11 nt, Human
cagccaggagc

SEQ ID NO: 1382066 - RNA, 23 nt, Human
cagccagccucgcccauccccuu

SEQ ID NO: 1382067 - RNA, 14 nt, Human
cagccagccucgcc

SEQ ID NO: 1382068 - RNA, 11 nt, Human
cagccagccuc

SEQ ID NO: 1382069 - RNA, 22 nt, Human
cagccagcccugccuggaggac

SEQ ID NO: 1382070 - RNA, 17 nt, Human
cagcauccgcaggugcu

SEQ ID NO: 1382071 - RNA, 12 nt, Human
cagcauccgcag

SEQ ID NO: 1382072 - RNA, 19 nt, Human
cagcauccccuugaacucu

SEQ ID NO: 1382073 - RNA, 20 nt, Human
cagcauccccuugaacucuu

SEQ ID NO: 1382074 - RNA, 23 nt, Human
cagcaucaggguuaagaagacuu

SEQ ID NO: 1382075 - RNA, 13 nt, Human
cagcaucaggguu

SEQ ID NO: 1382076 - RNA, 24 nt, Human
cagccagggagagcccaggagcuc

SEQ ID NO: 1382077 - RNA, 22 nt, Human
cagccagggagagcccaggagc

SEQ ID NO: 1382078 - RNA, 21 nt, Human
cagccagggagagcccaggag

SEQ ID NO: 1382079 - RNA, 20 nt, Human
cagccagggagagcccagga

SEQ ID NO: 1382080 - RNA, 19 nt, Human
cagccagggagagcccagg

SEQ ID NO: 1382081 - RNA, 18 nt, Human
cagccagggagagcccag

SEQ ID NO: 1382082 - RNA, 17 nt, Human
cagccagggagagccca

SEQ ID NO: 1382083 - RNA, 16 nt, Human
cagccagggagagccc

SEQ ID NO: 1382084 - RNA, 15 nt, Human
cagccagggagagcc

SEQ ID NO: 1382085 - RNA, 14 nt, Human
cagccagggagagc

SEQ ID NO: 1382086 - RNA, 15 nt, Human
cagccaggggagcag

SEQ ID NO: 1382087 - RNA, 16 nt, Human
cagccagggcucaauc

SEQ ID NO: 1382088 - RNA, 17 nt, Human
cagccaggggagcagag

SEQ ID NO: 1382089 - RNA, 23 nt, Human
cagccaggggagcagaggggcag

SEQ ID NO: 1382090 - RNA, 13 nt, Human
cagccaguaaaug

SEQ ID NO: 1382091 - RNA, 22 nt, Human
cagcagugugaggccagggcag

SEQ ID NO: 1382092 - RNA, 20 nt, Human
cagcagugugaggccagggc

SEQ ID NO: 1382093 - RNA, 19 nt, Human
cagcagugugaggccaggg

SEQ ID NO: 1382094 - RNA, 17 nt, Human
cagcagugugaggccag

SEQ ID NO: 1382095 - RNA, 13 nt, Human
cagcauaauacuu

SEQ ID NO: 1382096 - RNA, 16 nt, Human
cagcacgauuucuguu

SEQ ID NO: 1382097 - RNA, 18 nt, Human
cagcacgauuucuguuua

SEQ ID NO: 1382098 - RNA, 19 nt, Human
cagcacgauuucuguuuag

SEQ ID NO: 1382099 - RNA, 20 nt, Human
cagcacgauuucuguuuaga

SEQ ID NO: 1382100 - RNA, 16 nt, Human
cagagggucugggggc

SEQ ID NO: 1382101 - RNA, 18 nt, Human
cagaaucccuuaacaguu

SEQ ID NO: 1382102 - RNA, 13 nt, Human
cagaaucccuuaa

SEQ ID NO: 1382103 - RNA, 21 nt, Human
cagaaucgcuccaccuugcag

SEQ ID NO: 1382104 - RNA, 17 nt, Human
cagagggucugggggca

SEQ ID NO: 1382105 - RNA, 17 nt, Human
cagaggguguccugcac

SEQ ID NO: 1382106 - RNA, 15 nt, Human
cagaauaucacagaa

SEQ ID NO: 1382107 - RNA, 21 nt, Human
cagaguaauccaagcaaaugu

SEQ ID NO: 1382108 - RNA, 18 nt, Human
cagaucacagcuucagcc

SEQ ID NO: 1382109 - RNA, 22 nt, Human
cagaucacagcuucagccagga

SEQ ID NO: 1382110 - RNA, 16 nt, Human
cagauccuccucauuc

SEQ ID NO: 1382111 - RNA, 14 nt, Human
cagauccuccucau

SEQ ID NO: 1382112 - RNA, 13 nt, Human
cagauccuccuca

SEQ ID NO: 1382113 - RNA, 16 nt, Human
cagaucaguguaccau

SEQ ID NO: 1382114 - RNA, 16 nt, Human
cagaucaguaaagaac

SEQ ID NO: 1382115 - RNA, 15 nt, Human
cagaucaucuuggaa

SEQ ID NO: 1382116 - RNA, 18 nt, Human
cagaucaucuuggaacug

SEQ ID NO: 1382117 - RNA, 12 nt, Human
cagauccuggaa

SEQ ID NO: 1382118 - RNA, 13 nt, Human
cagauccuggaaa

SEQ ID NO: 1382119 - RNA, 16 nt, Human
caguaaaccacugaaa

SEQ ID NO: 1382120 - RNA, 14 nt, Human
caguaaaccacuga

SEQ ID NO: 1382121 - RNA, 23 nt, Human
caguaaagaacaucccuccuggg

SEQ ID NO: 1382122 - RNA, 20 nt, Human
caguaaaauugccauauugc

SEQ ID NO: 1382123 - RNA, 21 nt, Human
caguaaaauugccauauugca

SEQ ID NO: 1382124 - RNA, 20 nt, Human
cagucacucuagucaaugac

SEQ ID NO: 1382125 - RNA, 15 nt, Human
cagucacucuaguca

SEQ ID NO: 1382126 - RNA, 24 nt, Human
cagucacucuagucaaugacauga

SEQ ID NO: 1382127 - RNA, 21 nt, Human
cagucacucuagucaaugaca

SEQ ID NO: 1382128 - RNA, 16 nt, Human
cagucacagccacccc

SEQ ID NO: 1382129 - RNA, 14 nt, Human
cagucacagccacc

SEQ ID NO: 1382130 - RNA, 13 nt, Human
cagucacagccac

SEQ ID NO: 1382131 - RNA, 12 nt, Human
cagucacagcca

SEQ ID NO: 1382132 - RNA, 15 nt, Human
cagucaauauuuuua

SEQ ID NO: 1382133 - RNA, 15 nt, Human
caguaaagcacuugc

SEQ ID NO: 1382134 - RNA, 18 nt, Human
caguaaaccacugaaaaa

SEQ ID NO: 1382135 - RNA, 21 nt, Human
caguaaaccacugaaaaaaua

SEQ ID NO: 1382136 - RNA, 19 nt, Human
cagucaccucauggaauug

SEQ ID NO: 1382137 - RNA, 16 nt, Human
cagucaccucauggaa

SEQ ID NO: 1382138 - RNA, 15 nt, Human
caguggggcagucau

SEQ ID NO: 1382139 - RNA, 21 nt, Human
caguggggcagaggcaguacc

SEQ ID NO: 1382140 - RNA, 13 nt, Human
caguggggcagag

SEQ ID NO: 1382141 - RNA, 21 nt, Human
cagugggaggugagaccaccu

SEQ ID NO: 1382142 - RNA, 18 nt, Human
caguggugguuuucuguu

SEQ ID NO: 1382143 - RNA, 14 nt, Human
caguggggaaugaa

SEQ ID NO: 1382144 - RNA, 22 nt, Human
cagugggaggguaccagcagaa

SEQ ID NO: 1382145 - RNA, 22 nt, Human
cagugggaggugagaccaccuc

SEQ ID NO: 1382146 - RNA, 14 nt, Human
cagucucugagcag

SEQ ID NO: 1382147 - RNA, 12 nt, Human
cagucucugagc

SEQ ID NO: 1382148 - RNA, 17 nt, Human
cagucugagagaggcca

SEQ ID NO: 1382149 - RNA, 20 nt, Human
cagucugacuguuuccauca

SEQ ID NO: 1382150 - RNA, 21 nt, Human
caggggaacacuggggacuug

SEQ ID NO: 1382151 - RNA, 16 nt, Human
cagggcuccagccccu

SEQ ID NO: 1382152 - RNA, 13 nt, Human
cagggcuccagcc

SEQ ID NO: 1382153 - RNA, 22 nt, Human
cagggcuccagccccucuugga

SEQ ID NO: 1382154 - RNA, 15 nt, Human
cagggcucuguaagu

SEQ ID NO: 1382155 - RNA, 17 nt, Human
caggggaacacugggga

SEQ ID NO: 1382156 - RNA, 19 nt, Human
cagggauaaggccuguggg

SEQ ID NO: 1382157 - RNA, 12 nt, Human
cagggaguguuc

SEQ ID NO: 1382158 - RNA, 23 nt, Human
cagggagcggccggccagccccu

SEQ ID NO: 1382159 - RNA, 21 nt, Human
cagggagcggccggccagccc

SEQ ID NO: 1382160 - RNA, 19 nt, Human
cagggagcggccggccagc

SEQ ID NO: 1382161 - RNA, 17 nt, Human
cagggagcggccggcca

SEQ ID NO: 1382162 - RNA, 15 nt, Human
cagggagcggccggc

SEQ ID NO: 1382163 - RNA, 18 nt, Human
caggcuggcuccagaugc

SEQ ID NO: 1382164 - RNA, 17 nt, Human
caggcuggcuccagaug

SEQ ID NO: 1382165 - RNA, 20 nt, Human
caggcuggcuccagaugcag

SEQ ID NO: 1382166 - RNA, 12 nt, Human
caggcugggaac

SEQ ID NO: 1382167 - RNA, 16 nt, Human
caggcuggcuccagau

SEQ ID NO: 1382168 - RNA, 18 nt, Human
caggcugggaacucaucu

SEQ ID NO: 1382169 - RNA, 14 nt, Human
caggcagauccagg

SEQ ID NO: 1382170 - RNA, 13 nt, Human
caggccagagcca

SEQ ID NO: 1382171 - RNA, 21 nt, Human
caggcagaggcccaggcugcc

SEQ ID NO: 1382172 - RNA, 20 nt, Human
caggcagaggcccaggcugc

SEQ ID NO: 1382173 - RNA, 19 nt, Human
caggcagaggcccaggcug

SEQ ID NO: 1382174 - RNA, 18 nt, Human
caggcagaggcccaggcu

SEQ ID NO: 1382175 - RNA, 17 nt, Human
caggcagaggcccaggc

SEQ ID NO: 1382176 - RNA, 15 nt, Human
caggcagaggcccag

SEQ ID NO: 1382177 - RNA, 14 nt, Human
caggcagaggccca

SEQ ID NO: 1382178 - RNA, 14 nt, Human
caggcaccaggcag

SEQ ID NO: 1382179 - RNA, 19 nt, Human
caggcaccaaaagaaguaa

SEQ ID NO: 1382180 - RNA, 16 nt, Human
caggcaccaaaagaag

SEQ ID NO: 1382181 - RNA, 15 nt, Human
caggcaccaaaagaa

SEQ ID NO: 1382182 - RNA, 13 nt, Human
caggcagauccag

SEQ ID NO: 1382183 - RNA, 22 nt, Human
caggcagaggcccaggcugccg

SEQ ID NO: 1382184 - RNA, 20 nt, Human
caggcacacagcuacucucc

SEQ ID NO: 1382185 - RNA, 23 nt, Human
caggcacacagcuacucucccca

SEQ ID NO: 1382186 - RNA, 14 nt, Human
caggcacacagcua

SEQ ID NO: 1382187 - RNA, 13 nt, Human
caggcacacagcu

SEQ ID NO: 1382188 - RNA, 12 nt, Human
caggcacacagc

SEQ ID NO: 1382189 - RNA, 16 nt, Human
caggcacacaccacca

SEQ ID NO: 1382190 - RNA, 17 nt, Human
guauuuaacagaaauug

SEQ ID NO: 1382191 - RNA, 21 nt, Human
guauuguuguccuuuucauag

SEQ ID NO: 1382192 - RNA, 20 nt, Human
guauuguuguccuuuucaua

SEQ ID NO: 1382193 - RNA, 19 nt, Human
guauuguuguccuuuucau

SEQ ID NO: 1382194 - RNA, 18 nt, Human
guauuguuguccuuuuca

SEQ ID NO: 1382195 - RNA, 15 nt, Human
guauuguuguccuuu

SEQ ID NO: 1382196 - RNA, 13 nt, Human
guauuguuguccu

SEQ ID NO: 1382197 - RNA, 16 nt, Human
guauuguugaaaaagu

SEQ ID NO: 1382198 - RNA, 23 nt, Human
guauugugcaauguguauaaaca

SEQ ID NO: 1382199 - RNA, 22 nt, Human
guauugugcaauguguauaaac

SEQ ID NO: 1382200 - RNA, 19 nt, Human
guauugugcaauguguaua

SEQ ID NO: 1382201 - RNA, 17 nt, Human
guauugugcaaugugua

SEQ ID NO: 1382202 - RNA, 14 nt, Human
guauugugcaaugu

SEQ ID NO: 1382203 - RNA, 17 nt, Human
guauugucugaacuugc

SEQ ID NO: 1382204 - RNA, 16 nt, Human
guauugugauuaucaa

SEQ ID NO: 1382205 - RNA, 13 nt, Human
guauuuauaaaua

SEQ ID NO: 1382206 - RNA, 14 nt, Human
guauuuagaagcca

SEQ ID NO: 1382207 - RNA, 19 nt, Human
guauuuacgcuuugauuca

SEQ ID NO: 1382208 - RNA, 17 nt, Human
guauuuacgcuuugauu

SEQ ID NO: 1382209 - RNA, 16 nt, Human
guauuuacgcuuugau

SEQ ID NO: 1382210 - RNA, 13 nt, Human
guauuuaucuuua

SEQ ID NO: 1382211 - RNA, 22 nt, Human
aaauguaguauggccuguguca

SEQ ID NO: 1382212 - RNA, 11 nt, Human
guauuuauuca

SEQ ID NO: 1382213 - RNA, 12 nt, Human
aaaugucuugug

SEQ ID NO: 1382214 - RNA, 17 nt, Human
aaauguaucauagaaau

SEQ ID NO: 1382215 - RNA, 20 nt, Human
aaauguaucauagaaaugua

SEQ ID NO: 1382216 - RNA, 15 nt, Human
aaauguauaugcacu

SEQ ID NO: 1382217 - RNA, 14 nt, Human
aaauguauaugcac

SEQ ID NO: 1382218 - RNA, 20 nt, Human
aaauguaguucugcuccaga

SEQ ID NO: 1382219 - RNA, 11 nt, Human
aaauguauacu

SEQ ID NO: 1382220 - RNA, 20 nt, Human
aaaucaucagaaaggaaaaa

SEQ ID NO: 1382221 - RNA, 15 nt, Human
aaaucaucagaaagg

SEQ ID NO: 1382222 - RNA, 22 nt, Human
aaaucaucagaaaggaaaaaca

SEQ ID NO: 1382223 - RNA, 19 nt, Human
aaaucagcuauuuugugaa

SEQ ID NO: 1382224 - RNA, 16 nt, Human
aaaucauucauuuucu

SEQ ID NO: 1382225 - RNA, 18 nt, Human
guauucucuccuguaccu

SEQ ID NO: 1382226 - RNA, 21 nt, Human
guauucucuccuguaccucuu

SEQ ID NO: 1382227 - RNA, 12 nt, Human
guauuguauuua

SEQ ID NO: 1382228 - RNA, 13 nt, Human
guauuguauuuau

SEQ ID NO: 1382229 - RNA, 15 nt, Human
guauuguauuuauuc

SEQ ID NO: 1382230 - RNA, 16 nt, Human
guauuguauuuauuca

SEQ ID NO: 1382231 - RNA, 17 nt, Human
guauuguauuuauucaa

SEQ ID NO: 1382232 - RNA, 18 nt, Human
guauuguauuuauucaau

SEQ ID NO: 1382233 - RNA, 22 nt, Human
guauuguauuuauucaauaaag

SEQ ID NO: 1382234 - RNA, 22 nt, Human
aaauuccaaagucucuaauucu

SEQ ID NO: 1382235 - RNA, 21 nt, Human
aaauuccaaagucucuaauuc

SEQ ID NO: 1382236 - RNA, 18 nt, Human
aaauuccaaagucucuaa

SEQ ID NO: 1382237 - RNA, 17 nt, Human
aaauuccaaagucucua

SEQ ID NO: 1382238 - RNA, 14 nt, Human
aaauuccaaagucu

SEQ ID NO: 1382239 - RNA, 12 nt, Human
aaauuccaaagu

SEQ ID NO: 1382240 - RNA, 21 nt, Human
aaauucacaugaugcacuuca

SEQ ID NO: 1382241 - RNA, 19 nt, Human
aaauucacaugaugcacuu

SEQ ID NO: 1382242 - RNA, 15 nt, Human
aaauucguguguuuu

SEQ ID NO: 1382243 - RNA, 18 nt, Human
aaauucacaaacuuuuau

SEQ ID NO: 1382244 - RNA, 17 nt, Human
aaauucacaaacuuuua

SEQ ID NO: 1382245 - RNA, 15 nt, Human
aaauucacaaacuuu

SEQ ID NO: 1382246 - RNA, 14 nt, Human
aaauucacaaacuu

SEQ ID NO: 1382247 - RNA, 17 nt, Human
aaauuccaagugauuga

SEQ ID NO: 1382248 - RNA, 14 nt, Human
aaauuuaaacuaua

SEQ ID NO: 1382249 - RNA, 21 nt, Human
aaauugucccuuaaacaaaaa

SEQ ID NO: 1382250 - RNA, 15 nt, Human
aaauuguauauugua

SEQ ID NO: 1382251 - RNA, 13 nt, Human
aaauuguauauug

SEQ ID NO: 1382252 - RNA, 17 nt, Human
aaauuguauauucacuu

SEQ ID NO: 1382253 - RNA, 16 nt, Human
aaauucuccuggaggu

SEQ ID NO: 1382254 - RNA, 14 nt, Human
aaauucuccuggag

SEQ ID NO: 1382255 - RNA, 19 nt, Human
aaauuguauauuguaauuu

SEQ ID NO: 1382256 - RNA, 13 nt, Human
aaauucuccugga

SEQ ID NO: 1382257 - RNA, 17 nt, Human
aaauuguauuacaaauc

SEQ ID NO: 1382258 - RNA, 16 nt, Human
aaaugugcuuugagaa

SEQ ID NO: 1382259 - RNA, 22 nt, Human
aaaugugccuauugcuagagcu

SEQ ID NO: 1382260 - RNA, 19 nt, Human
aaaugugggauuauggguc

SEQ ID NO: 1382261 - RNA, 22 nt, Human
aaauuacacccaaagagguauu

SEQ ID NO: 1382262 - RNA, 16 nt, Human
aaauuacacccaaaga

SEQ ID NO: 1382263 - RNA, 12 nt, Human
aaauuacaacua

SEQ ID NO: 1382264 - RNA, 13 nt, Human
aaauuacaacuaa

SEQ ID NO: 1382265 - RNA, 15 nt, Human
aaauuauguaaauua

SEQ ID NO: 1382266 - RNA, 16 nt, Human
aaauuaucuauagcua

SEQ ID NO: 1382267 - RNA, 14 nt, Human
aaauucaacaaaca

SEQ ID NO: 1382268 - RNA, 16 nt, Human
aaauucaacaaacauu

SEQ ID NO: 1382269 - RNA, 11 nt, Human
aaauucaaaua

SEQ ID NO: 1382270 - RNA, 22 nt, Human
aaauuauguaaauuaucaggca

SEQ ID NO: 1382271 - RNA, 17 nt, Human
aaauuaugugacauuuu

SEQ ID NO: 1382272 - RNA, 20 nt, Human
aaauuaugugacauuuuaca

SEQ ID NO: 1382273 - RNA, 22 nt, Human
aaauuaugugacauuuuacauu

SEQ ID NO: 1382274 - RNA, 23 nt, Human
aaauuaugugccagauuuaugca

SEQ ID NO: 1382275 - RNA, 23 nt, Human
gucagugcugugcugugcuaugg

SEQ ID NO: 1382276 - RNA, 16 nt, Human
gucaguaccuucaaac

SEQ ID NO: 1382277 - RNA, 13 nt, Human
aaauuucuaaauc

SEQ ID NO: 1382278 - RNA, 15 nt, Human
aaauuucuaaaucuc

SEQ ID NO: 1382279 - RNA, 18 nt, Human
gucaggagugugugugag

SEQ ID NO: 1382280 - RNA, 17 nt, Human
gucagggaguguucccu

SEQ ID NO: 1382281 - RNA, 20 nt, Human
gucaggagugugugugagug

SEQ ID NO: 1382282 - RNA, 16 nt, Human
gucagaacagcagacu

SEQ ID NO: 1382283 - RNA, 17 nt, Human
gucacuguuccuuguca

SEQ ID NO: 1382284 - RNA, 21 nt, Human
gucacugguagaccaaaauaa

SEQ ID NO: 1382285 - RNA, 19 nt, Human
gucacuggaccacugggca

SEQ ID NO: 1382286 - RNA, 15 nt, Human
gucacugcuuaacuu

SEQ ID NO: 1382287 - RNA, 21 nt, Human
gucacugcuuaacuucacaua

SEQ ID NO: 1382288 - RNA, 18 nt, Human
gucacuuagguaguacca

SEQ ID NO: 1382289 - RNA, 18 nt, Human
gucacuuuuugaggcaaa

SEQ ID NO: 1382290 - RNA, 19 nt, Human
gucacuuuuugaggcaaaa

SEQ ID NO: 1382291 - RNA, 17 nt, Human
gucacuuuuugaggcaa

SEQ ID NO: 1382292 - RNA, 14 nt, Human
gucacuuuuucuga

SEQ ID NO: 1382293 - RNA, 19 nt, Human
gucagaacagcagacucag

SEQ ID NO: 1382294 - RNA, 14 nt, Human
gucaggaaagagaa

SEQ ID NO: 1382295 - RNA, 19 nt, Human
gucaccaauguacccaccg

SEQ ID NO: 1382296 - RNA, 22 nt, Human
gucaccaauguacccaccgggc

SEQ ID NO: 1382297 - RNA, 12 nt, Human
gucacugagacc

SEQ ID NO: 1382298 - RNA, 16 nt, Human
gucacugacacacacg

SEQ ID NO: 1382299 - RNA, 10 nt, Human
gucacugcuu

SEQ ID NO: 1382300 - RNA, 12 nt, Human
gucacagcugua

SEQ ID NO: 1382301 - RNA, 22 nt, Human
gucaauuucuguguugccaagc

SEQ ID NO: 1382302 - RNA, 17 nt, Human
gucaauuucuguguugc

SEQ ID NO: 1382303 - RNA, 21 nt, Human
aaauuuaaagcagguucuugu

SEQ ID NO: 1382304 - RNA, 18 nt, Human
aaauuuaaagcagguucu

SEQ ID NO: 1382305 - RNA, 13 nt, Human
aaauuuaaagcag

SEQ ID NO: 1382306 - RNA, 19 nt, Human
aaauuuaaacuauaagcaa

SEQ ID NO: 1382307 - RNA, 14 nt, Human
gucacauaaaacuu

SEQ ID NO: 1382308 - RNA, 23 nt, Human
gucacagggcaguaccugagggu

SEQ ID NO: 1382309 - RNA, 15 nt, Human
gucacaggaaaaagu

SEQ ID NO: 1382310 - RNA, 17 nt, Human
gucacagggcaguaccu

SEQ ID NO: 1382311 - RNA, 18 nt, Human
gucacagggccuggggag

SEQ ID NO: 1382312 - RNA, 18 nt, Human
gucacauuccugaacagg

SEQ ID NO: 1382313 - RNA, 19 nt, Human
guccgugggacggugccca

SEQ ID NO: 1382314 - RNA, 17 nt, Human
guccgguguucuaagau

SEQ ID NO: 1382315 - RNA, 16 nt, Human
guccgguguucuaaga

SEQ ID NO: 1382316 - RNA, 15 nt, Human
guccgguguucuaag

SEQ ID NO: 1382317 - RNA, 14 nt, Human
guccgguguucuaa

SEQ ID NO: 1382318 - RNA, 12 nt, Human
aacauagauaaa

SEQ ID NO: 1382319 - RNA, 21 nt, Human
aacauagacagaagaaacaag

SEQ ID NO: 1382320 - RNA, 14 nt, Human
aacauaaaaaugau

SEQ ID NO: 1382321 - RNA, 13 nt, Human
aacauaaaaauga

SEQ ID NO: 1382322 - RNA, 21 nt, Human
aacauauaauguuguuauuua

SEQ ID NO: 1382323 - RNA, 18 nt, Human
aacauauaauguuguuau

SEQ ID NO: 1382324 - RNA, 13 nt, Human
aacauauaauguu

SEQ ID NO: 1382325 - RNA, 12 nt, Human
aacauauauaac

SEQ ID NO: 1382326 - RNA, 21 nt, Human
aacaguuuuuuaugcuaauca

SEQ ID NO: 1382327 - RNA, 21 nt, Human
aacaguuuuccuaugcuuuga

SEQ ID NO: 1382328 - RNA, 20 nt, Human
aacaguuuuccuaugcuuug

SEQ ID NO: 1382329 - RNA, 18 nt, Human
aacaguuuuccuaugcuu

SEQ ID NO: 1382330 - RNA, 15 nt, Human
aacauaaaaaggaca

SEQ ID NO: 1382331 - RNA, 19 nt, Human
aacauaaaaaggacaucag

SEQ ID NO: 1382332 - RNA, 20 nt, Human
aacauaaaaaggacaucagc

SEQ ID NO: 1382333 - RNA, 22 nt, Human
aacauaaaaaggacaucagcaa

SEQ ID NO: 1382334 - RNA, 18 nt, Human
guccucguuuguguucug

SEQ ID NO: 1382335 - RNA, 14 nt, Human
guccuccucuguga

SEQ ID NO: 1382336 - RNA, 13 nt, Human
guccuccucugug

SEQ ID NO: 1382337 - RNA, 12 nt, Human
guccuccucugu

SEQ ID NO: 1382338 - RNA, 18 nt, Human
guccuccuccagggacag

SEQ ID NO: 1382339 - RNA, 20 nt, Human
guccuccuccagggacagca

SEQ ID NO: 1382340 - RNA, 17 nt, Human
guccuccuccagggaca

SEQ ID NO: 1382341 - RNA, 14 nt, Human
guccuccuccaggg

SEQ ID NO: 1382342 - RNA, 13 nt, Human
guccuccuccagg

SEQ ID NO: 1382343 - RNA, 14 nt, Human
aacauuguagccuc

SEQ ID NO: 1382344 - RNA, 16 nt, Human
aacauuggaauguucu

SEQ ID NO: 1382345 - RNA, 21 nt, Human
aacauuggaauguucucagau

SEQ ID NO: 1382346 - RNA, 15 nt, Human
aacauuggaauguuc

SEQ ID NO: 1382347 - RNA, 21 nt, Human
aacauuccucaugaauguaaa

SEQ ID NO: 1382348 - RNA, 22 nt, Human
aacauuccucaugaauguaaau

SEQ ID NO: 1382349 - RNA, 20 nt, Human
aacauguccugccuauuauc

SEQ ID NO: 1382350 - RNA, 19 nt, Human
aacauguccugccuauuau

SEQ ID NO: 1382351 - RNA, 15 nt, Human
aacauguaggaagua

SEQ ID NO: 1382352 - RNA, 22 nt, Human
aacauauaauguuguuauuuaa

SEQ ID NO: 1382353 - RNA, 17 nt, Human
aacaugugaaaagaaua

SEQ ID NO: 1382354 - RNA, 12 nt, Human
aacauuccaaga

SEQ ID NO: 1382355 - RNA, 16 nt, Human
aacauucauagucuuu

SEQ ID NO: 1382356 - RNA, 17 nt, Human
aacauuccaagacucua

SEQ ID NO: 1382357 - RNA, 10 nt, Human
aacauuccau

SEQ ID NO: 1382358 - RNA, 13 nt, Human
aacauuccauccu

SEQ ID NO: 1382359 - RNA, 14 nt, Human
aacauuccauccuu

SEQ ID NO: 1382360 - RNA, 20 nt, Human
aacauuccucaugaauguaa

SEQ ID NO: 1382361 - RNA, 19 nt, Human
aacauuccucaugaaugua

SEQ ID NO: 1382362 - RNA, 11 nt, Human
aacauuccaag

SEQ ID NO: 1382363 - RNA, 23 nt, Human
aacauuccauccuugagucaaaa

SEQ ID NO: 1382364 - RNA, 21 nt, Human
guccuggaagcgcgagggccu

SEQ ID NO: 1382365 - RNA, 19 nt, Human
guccugaaggccugagguu

SEQ ID NO: 1382366 - RNA, 14 nt, Human
guccugaaggccug

SEQ ID NO: 1382367 - RNA, 17 nt, Human
guccucuuucagcuccu

SEQ ID NO: 1382368 - RNA, 16 nt, Human
guccucuuucagcucc

SEQ ID NO: 1382369 - RNA, 15 nt, Human
guccucuuucagcuc

SEQ ID NO: 1382370 - RNA, 14 nt, Human
guccucuuucagcu

SEQ ID NO: 1382371 - RNA, 13 nt, Human
guccucuuucagc

SEQ ID NO: 1382372 - RNA, 14 nt, Human
guccucguuugugu

SEQ ID NO: 1382373 - RNA, 20 nt, Human
guccucuuucagcuccugac

SEQ ID NO: 1382374 - RNA, 19 nt, Human
guccucuuucagcuccuga

SEQ ID NO: 1382375 - RNA, 18 nt, Human
guccucuuucagcuccug

SEQ ID NO: 1382376 - RNA, 14 nt, Human
gucgauagagcugu

SEQ ID NO: 1382377 - RNA, 15 nt, Human
gucgaggaguaacaa

SEQ ID NO: 1382378 - RNA, 21 nt, Human
guccuuuugacacugcucuaa

SEQ ID NO: 1382379 - RNA, 20 nt, Human
guccuuuugacacugcucua

SEQ ID NO: 1382380 - RNA, 19 nt, Human
guccuuuugacacugcucu

SEQ ID NO: 1382381 - RNA, 17 nt, Human
guccuuuugacacugcu

SEQ ID NO: 1382382 - RNA, 16 nt, Human
guccuuuugacacugc

SEQ ID NO: 1382383 - RNA, 15 nt, Human
guccuuuugacacug

SEQ ID NO: 1382384 - RNA, 22 nt, Human
guccuuuucauaggucugaaau

SEQ ID NO: 1382385 - RNA, 21 nt, Human
guccuuuucauaggucugaaa

SEQ ID NO: 1382386 - RNA, 20 nt, Human
guccuuucuuccggccccuc

SEQ ID NO: 1382387 - RNA, 13 nt, Human
guccuuucuuccg

SEQ ID NO: 1382388 - RNA, 22 nt, Human
guccuuucuagagcacugccac

SEQ ID NO: 1382389 - RNA, 11 nt, Human
guccuuucccu

SEQ ID NO: 1382390 - RNA, 19 nt, Human
guccuggagcagaccaccc

SEQ ID NO: 1382391 - RNA, 17 nt, Human
guccuggaugauacuaa

SEQ ID NO: 1382392 - RNA, 19 nt, Human
guccuggaugauacuaaua

SEQ ID NO: 1382393 - RNA, 15 nt, Human
gucgcuccugcccac

SEQ ID NO: 1382394 - RNA, 11 nt, Human
gucgcuccugc

SEQ ID NO: 1382395 - RNA, 21 nt, Human
gucgcucaugugugcaacagg

SEQ ID NO: 1382396 - RNA, 16 nt, Human
gucgcucaugugugca

SEQ ID NO: 1382397 - RNA, 21 nt, Human
gucgcccuuugcugcauggca

SEQ ID NO: 1382398 - RNA, 17 nt, Human
gucgcccuuugcugcau

SEQ ID NO: 1382399 - RNA, 14 nt, Human
gucgauuagacugg

SEQ ID NO: 1382400 - RNA, 13 nt, Human
gucgauuagacug

SEQ ID NO: 1382401 - RNA, 22 nt, Human
gucgcccuuugcugcauggcag

SEQ ID NO: 1382402 - RNA, 22 nt, Human
gucuagucacgcaugcaguguu

SEQ ID NO: 1382403 - RNA, 12 nt, Human
gucuagauucuc

SEQ ID NO: 1382404 - RNA, 22 nt, Human
gucuagauucaaagguucuagg

SEQ ID NO: 1382405 - RNA, 21 nt, Human
gucuagauucaaagguucuag

SEQ ID NO: 1382406 - RNA, 20 nt, Human
gucuagauucaaagguucua

SEQ ID NO: 1382407 - RNA, 19 nt, Human
gucuagauucaaagguucu

SEQ ID NO: 1382408 - RNA, 15 nt, Human
gucuagauucaaagg

SEQ ID NO: 1382409 - RNA, 11 nt, Human
gucuagauuca

SEQ ID NO: 1382410 - RNA, 22 nt, Human
gucuagauguuuauucuucuag

SEQ ID NO: 1382411 - RNA, 13 nt, Human
gucuauucagcuu

SEQ ID NO: 1382412 - RNA, 20 nt, Human
gucuauuuacggaacucaaa

SEQ ID NO: 1382413 - RNA, 19 nt, Human
aacacagcaguucugcaga

SEQ ID NO: 1382414 - RNA, 23 nt, Human
aacacagcaguucugcagaggac

SEQ ID NO: 1382415 - RNA, 18 nt, Human
aacacagcaauuccucag

SEQ ID NO: 1382416 - RNA, 21 nt, Human
aacacacaggugcaacagacu

SEQ ID NO: 1382417 - RNA, 14 nt, Human
aacacacacaaaag

SEQ ID NO: 1382418 - RNA, 21 nt, Human
aacacaagauugguguuuuuu

SEQ ID NO: 1382419 - RNA, 23 nt, Human
aacacaagauugguguuuuuuuc

SEQ ID NO: 1382420 - RNA, 20 nt, Human
aacacaagauugguguuuuu

SEQ ID NO: 1382421 - RNA, 19 nt, Human
aacacaagauugguguuuu

SEQ ID NO: 1382422 - RNA, 18 nt, Human
aacacaagauugguguuu

SEQ ID NO: 1382423 - RNA, 18 nt, Human
aaauuucuguaaaacagg

SEQ ID NO: 1382424 - RNA, 19 nt, Human
aaauuucuaaaucuccaaa

SEQ ID NO: 1382425 - RNA, 19 nt, Human
aacacaaacuguaaauaaa

SEQ ID NO: 1382426 - RNA, 16 nt, Human
aacacaaacuguaaau

SEQ ID NO: 1382427 - RNA, 15 nt, Human
aacacaaacuguaaa

SEQ ID NO: 1382428 - RNA, 13 nt, Human
aacacaaacugua

SEQ ID NO: 1382429 - RNA, 18 nt, Human
aaauuugacuuuucugua

SEQ ID NO: 1382430 - RNA, 16 nt, Human
aaauuugacuuuucug

SEQ ID NO: 1382431 - RNA, 15 nt, Human
gucauuucauuuccu

SEQ ID NO: 1382432 - RNA, 23 nt, Human
aacacuggucugcuguuccagug

SEQ ID NO: 1382433 - RNA, 22 nt, Human
aacacaggcaaaauccuugcuu

SEQ ID NO: 1382434 - RNA, 15 nt, Human
aacacaggcaaaauc

SEQ ID NO: 1382435 - RNA, 20 nt, Human
aacacucagaagccuggggg

SEQ ID NO: 1382436 - RNA, 18 nt, Human
aacacucagaagccuggg

SEQ ID NO: 1382437 - RNA, 17 nt, Human
aacacucagaagccugg

SEQ ID NO: 1382438 - RNA, 16 nt, Human
aacacucagaagccug

SEQ ID NO: 1382439 - RNA, 12 nt, Human
aacacucaccau

SEQ ID NO: 1382440 - RNA, 22 nt, Human
aacacuggucugcuguuccagu

SEQ ID NO: 1382441 - RNA, 23 nt, Human
aacacuggggacuuggccucucu

SEQ ID NO: 1382442 - RNA, 19 nt, Human
aacacuggggacuuggccu

SEQ ID NO: 1382443 - RNA, 24 nt, Human
aacacucaguggcccauggcauuu

SEQ ID NO: 1382444 - RNA, 17 nt, Human
aacacucaguggcccau

SEQ ID NO: 1382445 - RNA, 19 nt, Human
aacacucagaagccugggg

SEQ ID NO: 1382446 - RNA, 21 nt, Human
aacacugggagaaaugaaaaa

SEQ ID NO: 1382447 - RNA, 18 nt, Human
guccauaucacacacauu

SEQ ID NO: 1382448 - RNA, 15 nt, Human
guccaucagccucca

SEQ ID NO: 1382449 - RNA, 20 nt, Human
guccaacccgaggcccgcau

SEQ ID NO: 1382450 - RNA, 23 nt, Human
guccaaaaccgccagcucuguuc

SEQ ID NO: 1382451 - RNA, 19 nt, Human
guccaaagaggcugccccu

SEQ ID NO: 1382452 - RNA, 16 nt, Human
guccaaagaggcugcc

SEQ ID NO: 1382453 - RNA, 18 nt, Human
guccaaaagauugcugaa

SEQ ID NO: 1382454 - RNA, 21 nt, Human
guccaaaaccgccagcucugu

SEQ ID NO: 1382455 - RNA, 14 nt, Human
guccaaacugccua

SEQ ID NO: 1382456 - RNA, 21 nt, Human
guccaaacugccuaagcccuc

SEQ ID NO: 1382457 - RNA, 22 nt, Human
gucccacaucccugggccugcu

SEQ ID NO: 1382458 - RNA, 23 nt, Human
gucccacaucccugggccugcug

SEQ ID NO: 1382459 - RNA, 15 nt, Human
gucccacagccacgu

SEQ ID NO: 1382460 - RNA, 14 nt, Human
gucccacagccacg

SEQ ID NO: 1382461 - RNA, 20 nt, Human
guccaaaaccgccagcucug

SEQ ID NO: 1382462 - RNA, 17 nt, Human
guccauaucacacacau

SEQ ID NO: 1382463 - RNA, 21 nt, Human
gucccacaucccugggccugc

SEQ ID NO: 1382464 - RNA, 20 nt, Human
gucccacaucccugggccug

SEQ ID NO: 1382465 - RNA, 19 nt, Human
gucccacaucccugggccu

SEQ ID NO: 1382466 - RNA, 18 nt, Human
gucccacaucccugggcc

SEQ ID NO: 1382467 - RNA, 17 nt, Human
gucccacaucccugggc

SEQ ID NO: 1382468 - RNA, 15 nt, Human
gucccacaucccugg

SEQ ID NO: 1382469 - RNA, 14 nt, Human
gucccacaucccug

SEQ ID NO: 1382470 - RNA, 13 nt, Human
gucccacaucccu

SEQ ID NO: 1382471 - RNA, 15 nt, Human
gucccuaauaaagcu

SEQ ID NO: 1382472 - RNA, 17 nt, Human
guccccuccuucccaag

SEQ ID NO: 1382473 - RNA, 12 nt, Human
guccccagcaga

SEQ ID NO: 1382474 - RNA, 14 nt, Human
guccccagcagaga

SEQ ID NO: 1382475 - RNA, 13 nt, Human
guccccugcuaca

SEQ ID NO: 1382476 - RNA, 15 nt, Human
guccccuccuuccca

SEQ ID NO: 1382477 - RNA, 17 nt, Human
gucccggggccagcacu

SEQ ID NO: 1382478 - RNA, 15 nt, Human
gucccggggccagca

SEQ ID NO: 1382479 - RNA, 18 nt, Human
guccccugcuacaccuau

SEQ ID NO: 1382480 - RNA, 22 nt, Human
gucccgggacaccuaggcuagg

SEQ ID NO: 1382481 - RNA, 21 nt, Human
gucccggggccagcacuucca

SEQ ID NO: 1382482 - RNA, 22 nt, Human
gucccggggccagcacuuccau

SEQ ID NO: 1382483 - RNA, 12 nt, Human
gucccuaauaaa

SEQ ID NO: 1382484 - RNA, 17 nt, Human
gugagggagggcuguca

SEQ ID NO: 1382485 - RNA, 16 nt, Human
gugaggcuguccugua

SEQ ID NO: 1382486 - RNA, 14 nt, Human
gugaggcuguccug

SEQ ID NO: 1382487 - RNA, 19 nt, Human
gugagagacauuaacucau

SEQ ID NO: 1382488 - RNA, 23 nt, Human
gugagagacauuaacucauuaga

SEQ ID NO: 1382489 - RNA, 23 nt, Human
gugagacugggaaggcuugggau

SEQ ID NO: 1382490 - RNA, 19 nt, Human
aacucuuuguuauuugaaa

SEQ ID NO: 1382491 - RNA, 15 nt, Human
aacucuuuguuauuu

SEQ ID NO: 1382492 - RNA, 23 nt, Human
aacucuuugcugcugcccauguu

SEQ ID NO: 1382493 - RNA, 13 nt, Human
aacucuuugcugc

SEQ ID NO: 1382494 - RNA, 14 nt, Human
aacucuuugagaaa

SEQ ID NO: 1382495 - RNA, 13 nt, Human
aacucuuucggua

SEQ ID NO: 1382496 - RNA, 13 nt, Human
aacucuuucaaaa

SEQ ID NO: 1382497 - RNA, 12 nt, Human
aacucuuucaaa

SEQ ID NO: 1382498 - RNA, 17 nt, Human
aacucuugauuauccau

SEQ ID NO: 1382499 - RNA, 11 nt, Human
aacucuugauu

SEQ ID NO: 1382500 - RNA, 23 nt, Human
aacucuucccccucucccaguug

SEQ ID NO: 1382501 - RNA, 23 nt, Human
aacucuucacucuucaaaugccu

SEQ ID NO: 1382502 - RNA, 17 nt, Human
aacucuucacucuucaa

SEQ ID NO: 1382503 - RNA, 15 nt, Human
aacucuucacucuuc

SEQ ID NO: 1382504 - RNA, 21 nt, Human
aacucucuuauugccucacuu

SEQ ID NO: 1382505 - RNA, 19 nt, Human
aacucucuuauugccucac

SEQ ID NO: 1382506 - RNA, 18 nt, Human
aacucucuuauugccuca

SEQ ID NO: 1382507 - RNA, 22 nt, Human
gugagucaauacauagugcugc

SEQ ID NO: 1382508 - RNA, 22 nt, Human
gugacagggcggggguggcggc

SEQ ID NO: 1382509 - RNA, 19 nt, Human
gugacagggcggggguggc

SEQ ID NO: 1382510 - RNA, 16 nt, Human
gugaauaaaugucuug

SEQ ID NO: 1382511 - RNA, 13 nt, Human
gugaauaaauguc

SEQ ID NO: 1382512 - RNA, 11 nt, Human
aacuccuccca

SEQ ID NO: 1382513 - RNA, 14 nt, Human
aacuccucccaggg

SEQ ID NO: 1382514 - RNA, 16 nt, Human
aacuccucauuguaaa

SEQ ID NO: 1382515 - RNA, 19 nt, Human
aacuccuaguucuagaaaa

SEQ ID NO: 1382516 - RNA, 21 nt, Human
aacuccuaguucuagaaaaac

SEQ ID NO: 1382517 - RNA, 15 nt, Human
aacuccaccuuccca

SEQ ID NO: 1382518 - RNA, 15 nt, Human
aacuccuaguucuag

SEQ ID NO: 1382519 - RNA, 14 nt, Human
aacuccuaguucua

SEQ ID NO: 1382520 - RNA, 23 nt, Human
gugaaguugcugcuucucccagg

SEQ ID NO: 1382521 - RNA, 15 nt, Human
gugaaguugcugcuu

SEQ ID NO: 1382522 - RNA, 14 nt, Human
gugaaguugcugcu

SEQ ID NO: 1382523 - RNA, 13 nt, Human
gugaaguugcugc

SEQ ID NO: 1382524 - RNA, 17 nt, Human
aacuccugaccucaggc

SEQ ID NO: 1382525 - RNA, 18 nt, Human
aacuccugaccucaggca

SEQ ID NO: 1382526 - RNA, 15 nt, Human
gugacugucugggga

SEQ ID NO: 1382527 - RNA, 16 nt, Human
gugacugucuggggag

SEQ ID NO: 1382528 - RNA, 22 nt, Human
gugacauuugggagacauguga

SEQ ID NO: 1382529 - RNA, 21 nt, Human
gugacauugcaucaaagcauc

SEQ ID NO: 1382530 - RNA, 13 nt, Human
gugacuucugaga

SEQ ID NO: 1382531 - RNA, 17 nt, Human
gugacuugugucccaug

SEQ ID NO: 1382532 - RNA, 11 nt, Human
gugacuucuga

SEQ ID NO: 1382533 - RNA, 23 nt, Human
gugacuugugucccaugaucccu

SEQ ID NO: 1382534 - RNA, 18 nt, Human
gugacuuuggcugcaugc

SEQ ID NO: 1382535 - RNA, 20 nt, Human
gugacuuuggcugcaugcga

SEQ ID NO: 1382536 - RNA, 13 nt, Human
gugagaccaccuc

SEQ ID NO: 1382537 - RNA, 14 nt, Human
gugagaccaccucu

SEQ ID NO: 1382538 - RNA, 20 nt, Human
gugagacccagcccucaucc

SEQ ID NO: 1382539 - RNA, 20 nt, Human
gugagaccaccucucaauau

SEQ ID NO: 1382540 - RNA, 21 nt, Human
aacguuuucuaauugcuuauu

SEQ ID NO: 1382541 - RNA, 17 nt, Human
aacguuuucuaauugcu

SEQ ID NO: 1382542 - RNA, 15 nt, Human
aacguuuucuaauug

SEQ ID NO: 1382543 - RNA, 13 nt, Human
aacguuuucuaau

SEQ ID NO: 1382544 - RNA, 17 nt, Human
aacuaaaauaauuuugu

SEQ ID NO: 1382545 - RNA, 19 nt, Human
aacuaaaauaauuuuguaa

SEQ ID NO: 1382546 - RNA, 15 nt, Human
aacuaaaauaauuuu

SEQ ID NO: 1382547 - RNA, 21 nt, Human
aacuaggugcauauuuauaaa

SEQ ID NO: 1382548 - RNA, 24 nt, Human
aacuauauauaaucaucaaguaau

SEQ ID NO: 1382549 - RNA, 17 nt, Human
aacuagggccaagccca

SEQ ID NO: 1382550 - RNA, 18 nt, Human
aacuauggaucagaauag

SEQ ID NO: 1382551 - RNA, 12 nt, Human
aacuauggccug

SEQ ID NO: 1382552 - RNA, 11 nt, Human
aaccuggccuu

SEQ ID NO: 1382553 - RNA, 12 nt, Human
aaccuggccuuc

SEQ ID NO: 1382554 - RNA, 16 nt, Human
gucuuucucuuucccu

SEQ ID NO: 1382555 - RNA, 21 nt, Human
gucuuucucuuucccuggucc

SEQ ID NO: 1382556 - RNA, 14 nt, Human
gucuuucucuuucc

SEQ ID NO: 1382557 - RNA, 14 nt, Human
gucuuucucucuca

SEQ ID NO: 1382558 - RNA, 16 nt, Human
gucuuuccuggcacua

SEQ ID NO: 1382559 - RNA, 20 nt, Human
gucuuucccauggggaggga

SEQ ID NO: 1382560 - RNA, 19 nt, Human
gucuuucccauggggaggg

SEQ ID NO: 1382561 - RNA, 20 nt, Human
gucuuuccauuggaucucau

SEQ ID NO: 1382562 - RNA, 17 nt, Human
aaccuggguugcagaca

SEQ ID NO: 1382563 - RNA, 20 nt, Human
aaccuggguugcagacagga

SEQ ID NO: 1382564 - RNA, 19 nt, Human
aaccuggguugcagacagg

SEQ ID NO: 1382565 - RNA, 19 nt, Human
aacgugcucuuuguuuugu

SEQ ID NO: 1382566 - RNA, 20 nt, Human
aacgugcucuuuguuuugug

SEQ ID NO: 1382567 - RNA, 13 nt, Human
aacguggcccaga

SEQ ID NO: 1382568 - RNA, 17 nt, Human
aacgugcucuuuguuuu

SEQ ID NO: 1382569 - RNA, 23 nt, Human
aacgugcauugugcuucuuucuu

SEQ ID NO: 1382570 - RNA, 14 nt, Human
aacgugcauugugc

SEQ ID NO: 1382571 - RNA, 16 nt, Human
aacgugcauugugcuu

SEQ ID NO: 1382572 - RNA, 15 nt, Human
aacgucuuaaauauu

SEQ ID NO: 1382573 - RNA, 11 nt, Human
aacgugcauug

SEQ ID NO: 1382574 - RNA, 13 nt, Human
aaccuucucuaug

SEQ ID NO: 1382575 - RNA, 14 nt, Human
aacgucuuaaauau

SEQ ID NO: 1382576 - RNA, 12 nt, Human
aacgucuuaaau

SEQ ID NO: 1382577 - RNA, 13 nt, Human
aaccuuccaccca

SEQ ID NO: 1382578 - RNA, 15 nt, Human
aaccuuccacccagu

SEQ ID NO: 1382579 - RNA, 14 nt, Human
gucuggaaguccaa

SEQ ID NO: 1382580 - RNA, 23 nt, Human
gucuggaagauggggaccagcag

SEQ ID NO: 1382581 - RNA, 14 nt, Human
gucuggaagauggg

SEQ ID NO: 1382582 - RNA, 22 nt, Human
gucucuuuuacccuggccccuc

SEQ ID NO: 1382583 - RNA, 21 nt, Human
gucucuuuuacccuggccccu

SEQ ID NO: 1382584 - RNA, 20 nt, Human
gucucuuuuacccuggcccc

SEQ ID NO: 1382585 - RNA, 23 nt, Human
gucucuuuuacccuggccccucu

SEQ ID NO: 1382586 - RNA, 18 nt, Human
gucucuuuuacccuggcc

SEQ ID NO: 1382587 - RNA, 14 nt, Human
gucucuuuuacccu

SEQ ID NO: 1382588 - RNA, 13 nt, Human
gucugaaauuuuu

SEQ ID NO: 1382589 - RNA, 15 nt, Human
gucugaacagcugua

SEQ ID NO: 1382590 - RNA, 22 nt, Human
gucuuaaacuaaaugugcaaua

SEQ ID NO: 1382591 - RNA, 17 nt, Human
gucuuaaacuaaaugug

SEQ ID NO: 1382592 - RNA, 14 nt, Human
gucuuaaugaaguu

SEQ ID NO: 1382593 - RNA, 16 nt, Human
gucuuaaugaaguuug

SEQ ID NO: 1382594 - RNA, 17 nt, Human
gucuuaaugaaguuuga

SEQ ID NO: 1382595 - RNA, 18 nt, Human
gucuuaaugaaguuugaa

SEQ ID NO: 1382596 - RNA, 19 nt, Human
gucuuaaugaaguuugaau

SEQ ID NO: 1382597 - RNA, 20 nt, Human
gucuuaaugaaguuugaaug

SEQ ID NO: 1382598 - RNA, 22 nt, Human
gucuuaaugaaguuugaauguu

SEQ ID NO: 1382599 - RNA, 23 nt, Human
gucuuguguuuccacagccugca

SEQ ID NO: 1382600 - RNA, 18 nt, Human
gucuuuccacggagccac

SEQ ID NO: 1382601 - RNA, 16 nt, Human
gucuuauucccuuccu

SEQ ID NO: 1382602 - RNA, 14 nt, Human
gucuuauuuccuca

SEQ ID NO: 1382603 - RNA, 20 nt, Human
aagaaaaacaaacucguuuu

SEQ ID NO: 1382604 - RNA, 18 nt, Human
gugccagagccuggggcu

SEQ ID NO: 1382605 - RNA, 17 nt, Human
gugccagagccuggggc

SEQ ID NO: 1382606 - RNA, 16 nt, Human
gugccagagccugggg

SEQ ID NO: 1382607 - RNA, 15 nt, Human
gugccagagccuggg

SEQ ID NO: 1382608 - RNA, 14 nt, Human
gugccagagccugg

SEQ ID NO: 1382609 - RNA, 13 nt, Human
gugccagagccug

SEQ ID NO: 1382610 - RNA, 12 nt, Human
gugccagagccu

SEQ ID NO: 1382611 - RNA, 18 nt, Human
gugccagagaacccagcc

SEQ ID NO: 1382612 - RNA, 19 nt, Human
gugccagauuuaugcauau

SEQ ID NO: 1382613 - RNA, 21 nt, Human
aacuuuaccuuuuuuauacau

SEQ ID NO: 1382614 - RNA, 22 nt, Human
aacuuuaccuuuuuuauacaua

SEQ ID NO: 1382615 - RNA, 23 nt, Human
aacuuuaccuuuuuuauacauaa

SEQ ID NO: 1382616 - RNA, 16 nt, Human
aagaaacaagguuuuc

SEQ ID NO: 1382617 - RNA, 19 nt, Human
aagaaacaacucuuugaga

SEQ ID NO: 1382618 - RNA, 15 nt, Human
aagaaacaaagaugu

SEQ ID NO: 1382619 - RNA, 14 nt, Human
aagaaacaaagaug

SEQ ID NO: 1382620 - RNA, 22 nt, Human
aagaaaauuuuuguaguagcgu

SEQ ID NO: 1382621 - RNA, 14 nt, Human
aagaaacauuuaua

SEQ ID NO: 1382622 - RNA, 11 nt, Human
aagaaacauuu

SEQ ID NO: 1382623 - RNA, 15 nt, Human
aagaaaauaguggug

SEQ ID NO: 1382624 - RNA, 21 nt, Human
aagaaaauaguggugugauuu

SEQ ID NO: 1382625 - RNA, 22 nt, Human
aagaaaauaguggugugauuug

SEQ ID NO: 1382626 - RNA, 22 nt, Human
aagaaagcuucaaacugcauga

SEQ ID NO: 1382627 - RNA, 22 nt, Human
aagaaagccugaguacuccaca

SEQ ID NO: 1382628 - RNA, 12 nt, Human
aagaaagccuga

SEQ ID NO: 1382629 - RNA, 23 nt, Human
aagaaagaggugaccccagggca

SEQ ID NO: 1382630 - RNA, 19 nt, Human
aagaaagcccuuaggaaga

SEQ ID NO: 1382631 - RNA, 14 nt, Human
aagaaagaacggaa

SEQ ID NO: 1382632 - RNA, 18 nt, Human
gugcuacuggggaaacug

SEQ ID NO: 1382633 - RNA, 13 nt, Human
gugcuacugggga

SEQ ID NO: 1382634 - RNA, 11 nt, Human
gugcuacuggg

SEQ ID NO: 1382635 - RNA, 21 nt, Human
gugcuacacccuuuuccagcu

SEQ ID NO: 1382636 - RNA, 23 nt, Human
aagaauaaucacgcuuuccugaa

SEQ ID NO: 1382637 - RNA, 21 nt, Human
gugcuauacugcauacuuuuu

SEQ ID NO: 1382638 - RNA, 19 nt, Human
gugcuacuggggaaacugg

SEQ ID NO: 1382639 - RNA, 22 nt, Human
aagaauaaucacgcuuuccuga

SEQ ID NO: 1382640 - RNA, 16 nt, Human
aagaauaaucacgcuu

SEQ ID NO: 1382641 - RNA, 18 nt, Human
aagaaguuuuaaaaagcc

SEQ ID NO: 1382642 - RNA, 23 nt, Human
aagaaguuuuaaaaagccaguuu

SEQ ID NO: 1382643 - RNA, 13 nt, Human
aagaaguuuuaaa

SEQ ID NO: 1382644 - RNA, 18 nt, Human
aagaaguuucaucauuuu

SEQ ID NO: 1382645 - RNA, 15 nt, Human
aagaaguuucaucau

SEQ ID NO: 1382646 - RNA, 21 nt, Human
aagaagcaaccucaguaauuu

SEQ ID NO: 1382647 - RNA, 23 nt, Human
aagaagagcgagagaucaaagau

SEQ ID NO: 1382648 - RNA, 22 nt, Human
aagaagagcgagagaucaaaga

SEQ ID NO: 1382649 - RNA, 19 nt, Human
aagaagagcgagagaucaa

SEQ ID NO: 1382650 - RNA, 13 nt, Human
aagaagacuuuuu

SEQ ID NO: 1382651 - RNA, 13 nt, Human
aagaaagccugag

SEQ ID NO: 1382652 - RNA, 22 nt, Human
aagaagcaccaaucaugaauua

SEQ ID NO: 1382653 - RNA, 13 nt, Human
gugcucuccauuc

SEQ ID NO: 1382654 - RNA, 22 nt, Human
gugcucgcuguugcugaauagg

SEQ ID NO: 1382655 - RNA, 18 nt, Human
gugcucaggagcccuggg

SEQ ID NO: 1382656 - RNA, 21 nt, Human
gugcucagggggcgccugugg

SEQ ID NO: 1382657 - RNA, 19 nt, Human
gugcucaggagcccuggga

SEQ ID NO: 1382658 - RNA, 14 nt, Human
gugcucgcccugcg

SEQ ID NO: 1382659 - RNA, 15 nt, Human
gugcucgcuguugcu

SEQ ID NO: 1382660 - RNA, 18 nt, Human
gugcucgcuguugcugaa

SEQ ID NO: 1382661 - RNA, 19 nt, Human
gugcucgcuguugcugaau

SEQ ID NO: 1382662 - RNA, 16 nt, Human
gugcucgccccagcag

SEQ ID NO: 1382663 - RNA, 14 nt, Human
gugcucgccccagc

SEQ ID NO: 1382664 - RNA, 16 nt, Human
gugcucauuucaggau

SEQ ID NO: 1382665 - RNA, 23 nt, Human
aacugucucgaugcaaugaacac

SEQ ID NO: 1382666 - RNA, 20 nt, Human
aacuguauuugaaauaagaa

SEQ ID NO: 1382667 - RNA, 13 nt, Human
aacuguauuugaa

SEQ ID NO: 1382668 - RNA, 20 nt, Human
aacugccuacuccaaaaugu

SEQ ID NO: 1382669 - RNA, 16 nt, Human
aacugccuacuccaaa

SEQ ID NO: 1382670 - RNA, 18 nt, Human
aacugccguaauuuaacu

SEQ ID NO: 1382671 - RNA, 17 nt, Human
aacugccguaauuuaac

SEQ ID NO: 1382672 - RNA, 16 nt, Human
aacugccguaauuuaa

SEQ ID NO: 1382673 - RNA, 14 nt, Human
aacugcccaaagca

SEQ ID NO: 1382674 - RNA, 14 nt, Human
aacugccaggcucu

SEQ ID NO: 1382675 - RNA, 23 nt, Human
aacuguguacauaacugaaaaug

SEQ ID NO: 1382676 - RNA, 21 nt, Human
aacuguguacauaacugaaaa

SEQ ID NO: 1382677 - RNA, 20 nt, Human
aacuguguacauaacugaaa

SEQ ID NO: 1382678 - RNA, 13 nt, Human
aacuguguaacug

SEQ ID NO: 1382679 - RNA, 18 nt, Human
aacuguggauauuguuac

SEQ ID NO: 1382680 - RNA, 14 nt, Human
aacuguggauauug

SEQ ID NO: 1382681 - RNA, 13 nt, Human
aacuguggauauu

SEQ ID NO: 1382682 - RNA, 11 nt, Human
aacuguggaua

SEQ ID NO: 1382683 - RNA, 21 nt, Human
aacugucuccuaccucugcuc

SEQ ID NO: 1382684 - RNA, 19 nt, Human
aacugucucucaugaaccu

SEQ ID NO: 1382685 - RNA, 14 nt, Human
aacuucacauauug

SEQ ID NO: 1382686 - RNA, 22 nt, Human
aacuucacauauugauuuccgu

SEQ ID NO: 1382687 - RNA, 22 nt, Human
aacuucaccauauuaccacaga

SEQ ID NO: 1382688 - RNA, 20 nt, Human
aacuucuugcuucuuucuag

SEQ ID NO: 1382689 - RNA, 17 nt, Human
aacuucuaauugccaug

SEQ ID NO: 1382690 - RNA, 22 nt, Human
aacuucuccccugguagaaaga

SEQ ID NO: 1382691 - RNA, 16 nt, Human
aacuucuaauugccau

SEQ ID NO: 1382692 - RNA, 15 nt, Human
aacuucuaauugcca

SEQ ID NO: 1382693 - RNA, 21 nt, Human
aacuucagcgguuuauauaag

SEQ ID NO: 1382694 - RNA, 14 nt, Human
aacuucagaaagac

SEQ ID NO: 1382695 - RNA, 22 nt, Human
aacuguguaacugcccaaagca

SEQ ID NO: 1382696 - RNA, 18 nt, Human
aacuucagcgguuuauau

SEQ ID NO: 1382697 - RNA, 22 nt, Human
aacuucuugcuucuuucuagaa

SEQ ID NO: 1382698 - RNA, 19 nt, Human
aacuucuugcuucuuucua

SEQ ID NO: 1382699 - RNA, 21 nt, Human
aacuugaaauauccugcuuga

SEQ ID NO: 1382700 - RNA, 14 nt, Human
aacuugaacugauu

SEQ ID NO: 1382701 - RNA, 21 nt, Human
aacuugaacugauucacaucu

SEQ ID NO: 1382702 - RNA, 18 nt, Human
aacuugacccugagcuga

SEQ ID NO: 1382703 - RNA, 19 nt, Human
aacuugacccugagcugac

SEQ ID NO: 1382704 - RNA, 15 nt, Human
aacuugacccugagc

SEQ ID NO: 1382705 - RNA, 15 nt, Human
aacuugagcauguua

SEQ ID NO: 1382706 - RNA, 12 nt, Human
aacuugaggaca

SEQ ID NO: 1382707 - RNA, 13 nt, Human
aacuugaggacac

SEQ ID NO: 1382708 - RNA, 14 nt, Human
aacuugaggacaca

SEQ ID NO: 1382709 - RNA, 15 nt, Human
aacuugaggacacau

SEQ ID NO: 1382710 - RNA, 16 nt, Human
aacuugaggacacaug

SEQ ID NO: 1382711 - RNA, 17 nt, Human
aacuugaggacacaugu

SEQ ID NO: 1382712 - RNA, 18 nt, Human
aacuugaggacacauguc

SEQ ID NO: 1382713 - RNA, 19 nt, Human
aacuugaggacacaugucc

SEQ ID NO: 1382714 - RNA, 20 nt, Human
aacuugaggacacaugucca

SEQ ID NO: 1382715 - RNA, 22 nt, Human
gugccaaacaaaaagguucuca

SEQ ID NO: 1382716 - RNA, 17 nt, Human
gugcauuuaugagcucu

SEQ ID NO: 1382717 - RNA, 20 nt, Human
gugcauuugaggucuguucu

SEQ ID NO: 1382718 - RNA, 11 nt, Human
gugcauugugc

SEQ ID NO: 1382719 - RNA, 13 nt, Human
gugcauugugcuu

SEQ ID NO: 1382720 - RNA, 21 nt, Human
gugcauuuggugguuucagaa

SEQ ID NO: 1382721 - RNA, 17 nt, Human
gugcauuugaggucugu

SEQ ID NO: 1382722 - RNA, 19 nt, Human
gugcauuugaggucuguuc

SEQ ID NO: 1382723 - RNA, 18 nt, Human
gugcacgcacacugucug

SEQ ID NO: 1382724 - RNA, 13 nt, Human
gugcaccugcccc

SEQ ID NO: 1382725 - RNA, 12 nt, Human
gugcaauagaag

SEQ ID NO: 1382726 - RNA, 23 nt, Human
gugcaauaaaucugacccagugc

SEQ ID NO: 1382727 - RNA, 22 nt, Human
gugcaauaaaucugacccagug

SEQ ID NO: 1382728 - RNA, 21 nt, Human
gugcaauaaaucugacccagu

SEQ ID NO: 1382729 - RNA, 19 nt, Human
gugcaauaaaucugaccca

SEQ ID NO: 1382730 - RNA, 20 nt, Human
gugcaaguugaggacuucuu

SEQ ID NO: 1382731 - RNA, 16 nt, Human
gugauucaaucuguaa

SEQ ID NO: 1382732 - RNA, 14 nt, Human
gugauucaaucugu

SEQ ID NO: 1382733 - RNA, 22 nt, Human
gugauuagagggaggagaauga

SEQ ID NO: 1382734 - RNA, 23 nt, Human
gugauucaaucuguaaacugugu

SEQ ID NO: 1382735 - RNA, 21 nt, Human
gugauucaaucuguaaacugu

SEQ ID NO: 1382736 - RNA, 21 nt, Human
gugaugucauacagagaaguc

SEQ ID NO: 1382737 - RNA, 15 nt, Human
gugaugugaagccaa

SEQ ID NO: 1382738 - RNA, 22 nt, Human
gugaugucauacagagaaguca

SEQ ID NO: 1382739 - RNA, 20 nt, Human
gugaugucauacagagaagu

SEQ ID NO: 1382740 - RNA, 19 nt, Human
gugaugucauacagagaag

SEQ ID NO: 1382741 - RNA, 18 nt, Human
gugaugucauacagagaa

SEQ ID NO: 1382742 - RNA, 17 nt, Human
gugaugucauacagaga

SEQ ID NO: 1382743 - RNA, 16 nt, Human
gugaugucauacagag

SEQ ID NO: 1382744 - RNA, 22 nt, Human
gugauguucuaaggcucugaga

SEQ ID NO: 1382745 - RNA, 19 nt, Human
gugauguucuaaggcucug

SEQ ID NO: 1382746 - RNA, 18 nt, Human
gugauguucuaaggcucu

SEQ ID NO: 1382747 - RNA, 16 nt, Human
gugauguucuaaggcu

SEQ ID NO: 1382748 - RNA, 13 nt, Human
gugauguucuaag

SEQ ID NO: 1382749 - RNA, 12 nt, Human
gugauguucuaa

SEQ ID NO: 1382750 - RNA, 15 nt, Human
gugauguucaugggu

SEQ ID NO: 1382751 - RNA, 15 nt, Human
gugaugugaguugca

SEQ ID NO: 1382752 - RNA, 14 nt, Human
gugaucucagauca

SEQ ID NO: 1382753 - RNA, 15 nt, Human
gugaucucagaucag

SEQ ID NO: 1382754 - RNA, 14 nt, Human
gugaucucagcuca

SEQ ID NO: 1382755 - RNA, 21 nt, Human
uaaaacuuugaaguuagcuuu

SEQ ID NO: 1382756 - RNA, 22 nt, Human
uaaaacuucaguuucacagaaa

SEQ ID NO: 1382757 - RNA, 12 nt, Human
uaaaacuuuuua

SEQ ID NO: 1382758 - RNA, 15 nt, Human
uaaaacuuuuuaaaa

SEQ ID NO: 1382759 - RNA, 21 nt, Human
uaaaaccauguagaaaauuug

SEQ ID NO: 1382760 - RNA, 23 nt, Human
uaaaaaucucaaauuucuaaauc

SEQ ID NO: 1382761 - RNA, 20 nt, Human
uaaaaagcuuccaugauucu

SEQ ID NO: 1382762 - RNA, 22 nt, Human
uaaaaaaaaaaaaaauguucuu

SEQ ID NO: 1382763 - RNA, 21 nt, Human
aagucaggcccuuauuuucaa

SEQ ID NO: 1382764 - RNA, 18 nt, Human
aagucagcucuucuccau

SEQ ID NO: 1382765 - RNA, 23 nt, Human
aagucagauggaaaauucauuuu

SEQ ID NO: 1382766 - RNA, 20 nt, Human
aagucagauggaaaauucau

SEQ ID NO: 1382767 - RNA, 19 nt, Human
uaaaaaguaauaaaauuca

SEQ ID NO: 1382768 - RNA, 16 nt, Human
uaaaaaggccuccugg

SEQ ID NO: 1382769 - RNA, 17 nt, Human
uaaaaagcuuuugucua

SEQ ID NO: 1382770 - RNA, 11 nt, Human
uaaaaaggaca

SEQ ID NO: 1382771 - RNA, 18 nt, Human
uaaaaaggacaucagcaa

SEQ ID NO: 1382772 - RNA, 19 nt, Human
uaaaaaggacaucagcaaa

SEQ ID NO: 1382773 - RNA, 21 nt, Human
uaaaaaggacaucagcaaaca

SEQ ID NO: 1382774 - RNA, 17 nt, Human
uaaaaaggcuaaaugga

SEQ ID NO: 1382775 - RNA, 17 nt, Human
aagugcagaaugcuccu

SEQ ID NO: 1382776 - RNA, 23 nt, Human
aagugcaauaaaucugacccagu

SEQ ID NO: 1382777 - RNA, 22 nt, Human
aagugcaauaaaucugacccag

SEQ ID NO: 1382778 - RNA, 16 nt, Human
uaaaauagcaaaagaa

SEQ ID NO: 1382779 - RNA, 13 nt, Human
uaaaauagcaaaa

SEQ ID NO: 1382780 - RNA, 16 nt, Human
uaaaauacagaauaca

SEQ ID NO: 1382781 - RNA, 21 nt, Human
uaaaauaccagccaguaaaug

SEQ ID NO: 1382782 - RNA, 17 nt, Human
uaaaauagcguucuugu

SEQ ID NO: 1382783 - RNA, 22 nt, Human
uaaaauagcaaaagaagaaguu

SEQ ID NO: 1382784 - RNA, 21 nt, Human
uaaaauagcaaaagaagaagu

SEQ ID NO: 1382785 - RNA, 17 nt, Human
uaaaauagcaaaagaag

SEQ ID NO: 1382786 - RNA, 21 nt, Human
uaaaauagcguucuuguaauu

SEQ ID NO: 1382787 - RNA, 20 nt, Human
uaaaauagcguucuuguaau

SEQ ID NO: 1382788 - RNA, 19 nt, Human
uaaaauagcguucuuguaa

SEQ ID NO: 1382789 - RNA, 18 nt, Human
uaaaauagucucuuuaaa

SEQ ID NO: 1382790 - RNA, 12 nt, Human
uaaaagaaaauu

SEQ ID NO: 1382791 - RNA, 16 nt, Human
uaaaagaaacccugca

SEQ ID NO: 1382792 - RNA, 17 nt, Human
uaaaagaaacuuucuuu

SEQ ID NO: 1382793 - RNA, 14 nt, Human
uaaaagaaacuuuc

SEQ ID NO: 1382794 - RNA, 13 nt, Human
uaaaagaaacuuu

SEQ ID NO: 1382795 - RNA, 17 nt, Human
uaaaagaaacccugcac

SEQ ID NO: 1382796 - RNA, 13 nt, Human
uaaaauaaagaaa

SEQ ID NO: 1382797 - RNA, 17 nt, Human
uaaaauaaagaaauaga

SEQ ID NO: 1382798 - RNA, 17 nt, Human
uaaaagugccauuaaca

SEQ ID NO: 1382799 - RNA, 19 nt, Human
uaaaagugggcuugauucu

SEQ ID NO: 1382800 - RNA, 15 nt, Human
uaaaauaaugggauu

SEQ ID NO: 1382801 - RNA, 21 nt, Human
uaaaauaagcagguggaucua

SEQ ID NO: 1382802 - RNA, 16 nt, Human
uaaaauaagcaggugg

SEQ ID NO: 1382803 - RNA, 18 nt, Human
uaaaauacaagacugcca

SEQ ID NO: 1382804 - RNA, 22 nt, Human
uaaaauaauuuuuauauuugaa

SEQ ID NO: 1382805 - RNA, 15 nt, Human
uaaaauuauuucaug

SEQ ID NO: 1382806 - RNA, 23 nt, Human
uaaaaugugggauuaugggucac

SEQ ID NO: 1382807 - RNA, 20 nt, Human
uaaaaugugggauuaugggu

SEQ ID NO: 1382808 - RNA, 18 nt, Human
uaaaaugugggauuaugg

SEQ ID NO: 1382809 - RNA, 22 nt, Human
uaaaaugugauguucuaaggcu

SEQ ID NO: 1382810 - RNA, 21 nt, Human
uaaaaugugauguucuaaggc

SEQ ID NO: 1382811 - RNA, 20 nt, Human
uaaaaugugauguucuaagg

SEQ ID NO: 1382812 - RNA, 19 nt, Human
uaaaaugugauguucuaag

SEQ ID NO: 1382813 - RNA, 17 nt, Human
uaaaaugugauguucua

SEQ ID NO: 1382814 - RNA, 12 nt, Human
uaaaauugccau

SEQ ID NO: 1382815 - RNA, 13 nt, Human
uaaaauugccaua

SEQ ID NO: 1382816 - RNA, 14 nt, Human
uaaaauugccauau

SEQ ID NO: 1382817 - RNA, 15 nt, Human
uaaaauugccauauu

SEQ ID NO: 1382818 - RNA, 16 nt, Human
uaaaauugccauauug

SEQ ID NO: 1382819 - RNA, 18 nt, Human
uaaaauugccauauugca

SEQ ID NO: 1382820 - RNA, 19 nt, Human
uaaaauugccauauugcac

SEQ ID NO: 1382821 - RNA, 17 nt, Human
uaaaauguaugcauguu

SEQ ID NO: 1382822 - RNA, 19 nt, Human
uaaaauguaugcauguugu

SEQ ID NO: 1382823 - RNA, 16 nt, Human
uaaaauguaugcaugu

SEQ ID NO: 1382824 - RNA, 14 nt, Human
uaaaauguaagauu

SEQ ID NO: 1382825 - RNA, 23 nt, Human
uaaaauguaaagccaugcuggaa

SEQ ID NO: 1382826 - RNA, 18 nt, Human
uaaaauguaaagccaugc

SEQ ID NO: 1382827 - RNA, 15 nt, Human
uaaaauguaaagcca

SEQ ID NO: 1382828 - RNA, 16 nt, Human
aaguuugauuucauua

SEQ ID NO: 1382829 - RNA, 15 nt, Human
aaguuugauuucauu

SEQ ID NO: 1382830 - RNA, 21 nt, Human
aaguuucuaagauucuaaagg

SEQ ID NO: 1382831 - RNA, 20 nt, Human
aaguuucuaagauucuaaag

SEQ ID NO: 1382832 - RNA, 19 nt, Human
aaguuucuaagauucuaaa

SEQ ID NO: 1382833 - RNA, 18 nt, Human
aaguuucuaagauucuaa

SEQ ID NO: 1382834 - RNA, 17 nt, Human
aaguuucuaagauucua

SEQ ID NO: 1382835 - RNA, 16 nt, Human
aaguuucuaagauucu

SEQ ID NO: 1382836 - RNA, 15 nt, Human
aaguuucuaagauuc

SEQ ID NO: 1382837 - RNA, 13 nt, Human
aaguuucuaagau

SEQ ID NO: 1382838 - RNA, 12 nt, Human
aaguuucuaaga

SEQ ID NO: 1382839 - RNA, 11 nt, Human
aaguuucuaag

SEQ ID NO: 1382840 - RNA, 15 nt, Human
aaguuucucugcaga

SEQ ID NO: 1382841 - RNA, 13 nt, Human
aaguuugaauguu

SEQ ID NO: 1382842 - RNA, 14 nt, Human
aaguuugaauguua

SEQ ID NO: 1382843 - RNA, 15 nt, Human
aaguuugaauguuaa

SEQ ID NO: 1382844 - RNA, 16 nt, Human
aaguuugaauguuaaa

SEQ ID NO: 1382845 - RNA, 18 nt, Human
aaguuugaauguuaaaua

SEQ ID NO: 1382846 - RNA, 22 nt, Human
aaguuugaauguuaaauaaauu

SEQ ID NO: 1382847 - RNA, 16 nt, Human
aaguucaacauguuau

SEQ ID NO: 1382848 - RNA, 23 nt, Human
aaguucaaauucuucugaacuca

SEQ ID NO: 1382849 - RNA, 19 nt, Human
aaguuauuuuuaauuuggu

SEQ ID NO: 1382850 - RNA, 17 nt, Human
aaguucccaguuggagc

SEQ ID NO: 1382851 - RNA, 13 nt, Human
aaguucccaguug

SEQ ID NO: 1382852 - RNA, 19 nt, Human
aaguuccaaguugcuaaua

SEQ ID NO: 1382853 - RNA, 22 nt, Human
aaguucaauauaagcuuuucuu

SEQ ID NO: 1382854 - RNA, 21 nt, Human
aaguucaccagacucuauaaa

SEQ ID NO: 1382855 - RNA, 19 nt, Human
aaguucccaguuggagcuc

SEQ ID NO: 1382856 - RNA, 18 nt, Human
aaguucccaguuggagcu

SEQ ID NO: 1382857 - RNA, 15 nt, Human
aaguucgucuguugu

SEQ ID NO: 1382858 - RNA, 12 nt, Human
aaguucgucugu

SEQ ID NO: 1382859 - RNA, 20 nt, Human
aaguuccuuggccaugcaga

SEQ ID NO: 1382860 - RNA, 11 nt, Human
aaguucuaaga

SEQ ID NO: 1382861 - RNA, 16 nt, Human
aaguuuccaucaucua

SEQ ID NO: 1382862 - RNA, 17 nt, Human
aagugucaacucuuugu

SEQ ID NO: 1382863 - RNA, 16 nt, Human
aagugucaacucuuug

SEQ ID NO: 1382864 - RNA, 16 nt, Human
aagugccauuaacaaa

SEQ ID NO: 1382865 - RNA, 17 nt, Human
aagugccauuaacaaau

SEQ ID NO: 1382866 - RNA, 23 nt, Human
aagugccaguauuuuaaaauagc

SEQ ID NO: 1382867 - RNA, 13 nt, Human
aagugugaacugg

SEQ ID NO: 1382868 - RNA, 21 nt, Human
aagugugaacuggacccuguu

SEQ ID NO: 1382869 - RNA, 21 nt, Human
aagugcaucuggagagaacag

SEQ ID NO: 1382870 - RNA, 15 nt, Human
aagugccaguauuuu

SEQ ID NO: 1382871 - RNA, 14 nt, Human
aagugccaguauuu

SEQ ID NO: 1382872 - RNA, 23 nt, Human
aaguguauuuuuuuacuaauaga

SEQ ID NO: 1382873 - RNA, 20 nt, Human
aaguguggggauuuucacug

SEQ ID NO: 1382874 - RNA, 12 nt, Human
aaguguguguuu

SEQ ID NO: 1382875 - RNA, 16 nt, Human
aaguuauuuaaaucug

SEQ ID NO: 1382876 - RNA, 15 nt, Human
aaguuauuaacuuua

SEQ ID NO: 1382877 - RNA, 17 nt, Human
aaguuauuaacuuuaau

SEQ ID NO: 1382878 - RNA, 17 nt, Human
aaguuauagugaauacu

SEQ ID NO: 1382879 - RNA, 15 nt, Human
aaguuauagugaaua

SEQ ID NO: 1382880 - RNA, 14 nt, Human
aaguuauaagacuc

SEQ ID NO: 1382881 - RNA, 15 nt, Human
aaguuauaagacucu

SEQ ID NO: 1382882 - RNA, 23 nt, Human
aaguuaguuuguauauauuauua

SEQ ID NO: 1382883 - RNA, 22 nt, Human
aaguuaguuuguauauauuauu

SEQ ID NO: 1382884 - RNA, 17 nt, Human
aaguuaguuuguauaua

SEQ ID NO: 1382885 - RNA, 15 nt, Human
aaguuaguuuguaua

SEQ ID NO: 1382886 - RNA, 19 nt, Human
aaguuaguuccacugagac

SEQ ID NO: 1382887 - RNA, 18 nt, Human
aaguuaguuccacugaga

SEQ ID NO: 1382888 - RNA, 19 nt, Human
aaguuaguaucuuuugaua

SEQ ID NO: 1382889 - RNA, 20 nt, Human
aaguuaguaucuuuugauau

SEQ ID NO: 1382890 - RNA, 16 nt, Human
aaguuaguaucuuuug

SEQ ID NO: 1382891 - RNA, 16 nt, Human
aaguuagcuuuaacuu

SEQ ID NO: 1382892 - RNA, 17 nt, Human
aaguuaauuuaaaguug

SEQ ID NO: 1382893 - RNA, 16 nt, Human
aaguuaauuuaaaguu

SEQ ID NO: 1382894 - RNA, 15 nt, Human
aaguuaauuuaaagu

SEQ ID NO: 1382895 - RNA, 12 nt, Human
aaguuaauuuaa

SEQ ID NO: 1382896 - RNA, 19 nt, Human
aaguuaauccacugugacu

SEQ ID NO: 1382897 - RNA, 16 nt, Human
aaguguguguuuuuca

SEQ ID NO: 1382898 - RNA, 21 nt, Human
aaguguguguuuuucauaaag

SEQ ID NO: 1382899 - RNA, 19 nt, Human
guuuaaagagucuagauuc

SEQ ID NO: 1382900 - RNA, 18 nt, Human
guuuaaagagucuagauu

SEQ ID NO: 1382901 - RNA, 19 nt, Human
guuuaaaugaacaagagaa

SEQ ID NO: 1382902 - RNA, 14 nt, Human
guuuaaaugaacaa

SEQ ID NO: 1382903 - RNA, 11 nt, Human
guuuaaaugaa

SEQ ID NO: 1382904 - RNA, 17 nt, Human
guuuaaagagucuagau

SEQ ID NO: 1382905 - RNA, 14 nt, Human
guuuaaagagucua

SEQ ID NO: 1382906 - RNA, 21 nt, Human
guuuaaagaaaguguauuugg

SEQ ID NO: 1382907 - RNA, 18 nt, Human
guuuaaagaaaguguauu

SEQ ID NO: 1382908 - RNA, 17 nt, Human
guuuaaagaaaguguau

SEQ ID NO: 1382909 - RNA, 16 nt, Human
guuuaaagaaagugua

SEQ ID NO: 1382910 - RNA, 15 nt, Human
guuuaaagaaagugu

SEQ ID NO: 1382911 - RNA, 14 nt, Human
guuuaaagaaagug

SEQ ID NO: 1382912 - RNA, 13 nt, Human
guuguuugugccu

SEQ ID NO: 1382913 - RNA, 19 nt, Human
guuucacaguuugaaauaa

SEQ ID NO: 1382914 - RNA, 18 nt, Human
guuucacaguuugaaaua

SEQ ID NO: 1382915 - RNA, 16 nt, Human
guuucacaguuugaaa

SEQ ID NO: 1382916 - RNA, 23 nt, Human
guuucacagccuauaaccagaca

SEQ ID NO: 1382917 - RNA, 14 nt, Human
guuucacagaaaau

SEQ ID NO: 1382918 - RNA, 19 nt, Human
guuucacaaggucuuuaaa

SEQ ID NO: 1382919 - RNA, 22 nt, Human
guuucaauugcaucucccagau

SEQ ID NO: 1382920 - RNA, 17 nt, Human
guuucaauugcaucucc

SEQ ID NO: 1382921 - RNA, 16 nt, Human
guuucaauugcaucuc

SEQ ID NO: 1382922 - RNA, 22 nt, Human
guuucaauuccaccugcaauca

SEQ ID NO: 1382923 - RNA, 19 nt, Human
guuucaaggcacucuagau

SEQ ID NO: 1382924 - RNA, 23 nt, Human
guuucaaggcacucuagauucca

SEQ ID NO: 1382925 - RNA, 18 nt, Human
guuucaaggcacucuaga

SEQ ID NO: 1382926 - RNA, 20 nt, Human
guuucaagaggagcccccac

SEQ ID NO: 1382927 - RNA, 13 nt, Human
guuucaagaggag

SEQ ID NO: 1382928 - RNA, 18 nt, Human
guuucaacggaaagugcu

SEQ ID NO: 1382929 - RNA, 20 nt, Human
guuucaaagaugcugugagu

SEQ ID NO: 1382930 - RNA, 19 nt, Human
guuucaaagaugcugugag

SEQ ID NO: 1382931 - RNA, 13 nt, Human
guuuauuacguau

SEQ ID NO: 1382932 - RNA, 20 nt, Human
guuuauucuucuagaguuca

SEQ ID NO: 1382933 - RNA, 19 nt, Human
guuuauucuucuagaguuc

SEQ ID NO: 1382934 - RNA, 16 nt, Human
guuuauucuucuagag

SEQ ID NO: 1382935 - RNA, 15 nt, Human
guuuauucuucuaga

SEQ ID NO: 1382936 - RNA, 23 nt, Human
guuuauuaaucuuaguguaugau

SEQ ID NO: 1382937 - RNA, 23 nt, Human
guuuauuacguaugucugguucu

SEQ ID NO: 1382938 - RNA, 19 nt, Human
aaggggacccuccgcucug

SEQ ID NO: 1382939 - RNA, 16 nt, Human
aagggcugcuucccug

SEQ ID NO: 1382940 - RNA, 17 nt, Human
aagggcuguuauaaucu

SEQ ID NO: 1382941 - RNA, 15 nt, Human
aaggcuuaaacccau

SEQ ID NO: 1382942 - RNA, 22 nt, Human
aaggcuguuaaauacaggaaac

SEQ ID NO: 1382943 - RNA, 21 nt, Human
aaggcuguuaaauacaggaaa

SEQ ID NO: 1382944 - RNA, 20 nt, Human
aaggcuguuaaauacaggaa

SEQ ID NO: 1382945 - RNA, 21 nt, Human
aaggcuguguaagauuuguuu

SEQ ID NO: 1382946 - RNA, 16 nt, Human
aaggcuguguaagauu

SEQ ID NO: 1382947 - RNA, 14 nt, Human
aaggcuguguaaga

SEQ ID NO: 1382948 - RNA, 13 nt, Human
aaggcuguguaag

SEQ ID NO: 1382949 - RNA, 21 nt, Human
aagggcugccggggcagcccc

SEQ ID NO: 1382950 - RNA, 19 nt, Human
aagggcugccggggcagcc

SEQ ID NO: 1382951 - RNA, 15 nt, Human
aagggcuguuauaau

SEQ ID NO: 1382952 - RNA, 11 nt, Human
guuucagaaau

SEQ ID NO: 1382953 - RNA, 13 nt, Human
guuucagaaaugu

SEQ ID NO: 1382954 - RNA, 14 nt, Human
guuucagaaaugug

SEQ ID NO: 1382955 - RNA, 22 nt, Human
aagggggcggccuaugacuugg

SEQ ID NO: 1382956 - RNA, 22 nt, Human
aaggggcuucagguccaggcug

SEQ ID NO: 1382957 - RNA, 17 nt, Human
aagguuuaugaaaaaga

SEQ ID NO: 1382958 - RNA, 22 nt, Human
aagguauuaaauugauguugcu

SEQ ID NO: 1382959 - RNA, 18 nt, Human
aagguauuaaauugaugu

SEQ ID NO: 1382960 - RNA, 19 nt, Human
aagguuuggaaggagcaga

SEQ ID NO: 1382961 - RNA, 23 nt, Human
aagguuuuagguucuaaaguucu

SEQ ID NO: 1382962 - RNA, 20 nt, Human
aagguuuuauaaggcugaug

SEQ ID NO: 1382963 - RNA, 20 nt, Human
aagguuuuagguucuaaagu

SEQ ID NO: 1382964 - RNA, 19 nt, Human
aagguuuuagguucuaaag

SEQ ID NO: 1382965 - RNA, 17 nt, Human
aagguuuuagguucuaa

SEQ ID NO: 1382966 - RNA, 16 nt, Human
aagguuuuagguucua

SEQ ID NO: 1382967 - RNA, 15 nt, Human
aagguuuuagguucu

SEQ ID NO: 1382968 - RNA, 23 nt, Human
aagguuuuaauuuaguaaaccaa

SEQ ID NO: 1382969 - RNA, 20 nt, Human
aagguuuuaauuuaguaaac

SEQ ID NO: 1382970 - RNA, 18 nt, Human
aagguuuggaaggagcag

SEQ ID NO: 1382971 - RNA, 16 nt, Human
aaguaacaaaaauaaa

SEQ ID NO: 1382972 - RNA, 13 nt, Human
aaguaacaaaaau

SEQ ID NO: 1382973 - RNA, 12 nt, Human
aaguaacaaaaa

SEQ ID NO: 1382974 - RNA, 23 nt, Human
aaguaacugggauuacaggcaug

SEQ ID NO: 1382975 - RNA, 20 nt, Human
guuuugauuuaauguuuuca

SEQ ID NO: 1382976 - RNA, 21 nt, Human
guuuugaaggcaaaauugcaa

SEQ ID NO: 1382977 - RNA, 19 nt, Human
guuuucuguucuuucuggc

SEQ ID NO: 1382978 - RNA, 12 nt, Human
guuuuauuucau

SEQ ID NO: 1382979 - RNA, 14 nt, Human
guuuucuguucuuu

SEQ ID NO: 1382980 - RNA, 15 nt, Human
guuuucuguucuuuc

SEQ ID NO: 1382981 - RNA, 16 nt, Human
guuuucuguucuuucu

SEQ ID NO: 1382982 - RNA, 17 nt, Human
guuuuauucuugguuuu

SEQ ID NO: 1382983 - RNA, 21 nt, Human
guuuuaugagaaagccuucuu

SEQ ID NO: 1382984 - RNA, 20 nt, Human
guuuuaauuuaguaaaccaa

SEQ ID NO: 1382985 - RNA, 21 nt, Human
guuuuaauuuaaacaccuccu

SEQ ID NO: 1382986 - RNA, 14 nt, Human
guuuuaauuuaaac

SEQ ID NO: 1382987 - RNA, 16 nt, Human
guuuuaacuguggaua

SEQ ID NO: 1382988 - RNA, 15 nt, Human
guuuuaacuguggau

SEQ ID NO: 1382989 - RNA, 22 nt, Human
guuuuaaggaugcuuguacaua

SEQ ID NO: 1382990 - RNA, 21 nt, Human
guuugcuucaugugucccaga

SEQ ID NO: 1382991 - RNA, 20 nt, Human
guuugcuucaugugucccag

SEQ ID NO: 1382992 - RNA, 15 nt, Human
guuugcuucaugugu

SEQ ID NO: 1382993 - RNA, 19 nt, Human
guuugcuucaacugucucc

SEQ ID NO: 1382994 - RNA, 21 nt, Human
aaguaauaugcacacauuuuu

SEQ ID NO: 1382995 - RNA, 18 nt, Human
aaguaauaugcacacauu

SEQ ID NO: 1382996 - RNA, 20 nt, Human
aaguaauaugcacacauuuu

SEQ ID NO: 1382997 - RNA, 21 nt, Human
guuuggauauguaaaacauuu

SEQ ID NO: 1382998 - RNA, 20 nt, Human
guuuggauauguaaaacauu

SEQ ID NO: 1382999 - RNA, 17 nt, Human
guuuggagagagcagac

SEQ ID NO: 1383000 - RNA, 21 nt, Human
guuuggagagagcagacuggc

SEQ ID NO: 1383001 - RNA, 23 nt, Human
guuuuaaacauuaauagcagccu

SEQ ID NO: 1383002 - RNA, 15 nt, Human
guuuuaaagcuucca

SEQ ID NO: 1383003 - RNA, 21 nt, Human
guuuggaaauugauuuugaac

SEQ ID NO: 1383004 - RNA, 21 nt, Human
guuugcuuucugaucaaggcc

SEQ ID NO: 1383005 - RNA, 11 nt, Human
guuugcuuucu

SEQ ID NO: 1383006 - RNA, 16 nt, Human
guuuggaaggagcaga

SEQ ID NO: 1383007 - RNA, 13 nt, Human
guuuggaaggagc

SEQ ID NO: 1383008 - RNA, 20 nt, Human
guuugcuuugcccuucuuuc

SEQ ID NO: 1383009 - RNA, 19 nt, Human
guuuggacaaaauggaaua

SEQ ID NO: 1383010 - RNA, 19 nt, Human
aaguacacucugcuguuug

SEQ ID NO: 1383011 - RNA, 16 nt, Human
aaguacacucugcugu

SEQ ID NO: 1383012 - RNA, 15 nt, Human
aaguacacucugcug

SEQ ID NO: 1383013 - RNA, 19 nt, Human
aaguacacaauaagcaaaa

SEQ ID NO: 1383014 - RNA, 22 nt, Human
guuuugcacagccaaauuuaaa

SEQ ID NO: 1383015 - RNA, 15 nt, Human
guuuugcacagccaa

SEQ ID NO: 1383016 - RNA, 19 nt, Human
guuuugauuuguacugaaa

SEQ ID NO: 1383017 - RNA, 16 nt, Human
aaguacacaauaagca

SEQ ID NO: 1383018 - RNA, 17 nt, Human
aaguacacaauaagcaa

SEQ ID NO: 1383019 - RNA, 18 nt, Human
aaguacacaauaagcaaa

SEQ ID NO: 1383020 - RNA, 19 nt, Human
aaguacuaagcgcuagagg

SEQ ID NO: 1383021 - RNA, 21 nt, Human
aaguauguuagugcaaauugu

SEQ ID NO: 1383022 - RNA, 15 nt, Human
aaguauuauaccuuu

SEQ ID NO: 1383023 - RNA, 19 nt, Human
aaguauguuagugcaaauu

SEQ ID NO: 1383024 - RNA, 18 nt, Human
aaguauguuagugcaaau

SEQ ID NO: 1383025 - RNA, 15 nt, Human
aaguauuuugcugga

SEQ ID NO: 1383026 - RNA, 15 nt, Human
aaguauuuuccuguu

SEQ ID NO: 1383027 - RNA, 15 nt, Human
aaguauuaugucucu

SEQ ID NO: 1383028 - RNA, 12 nt, Human
aaguauuauuag

SEQ ID NO: 1383029 - RNA, 13 nt, Human
aaguauuaucaga

SEQ ID NO: 1383030 - RNA, 16 nt, Human
aaguauuauaccuuuu

SEQ ID NO: 1383031 - RNA, 19 nt, Human
aaguauuauaccuuuuuua

SEQ ID NO: 1383032 - RNA, 15 nt, Human
aagucaaacuuggau

SEQ ID NO: 1383033 - RNA, 19 nt, Human
aaguauuuuuucaguauua

SEQ ID NO: 1383034 - RNA, 16 nt, Human
aaguauuuuuucagua

SEQ ID NO: 1383035 - RNA, 15 nt, Human
aaguauuuuuucagu

SEQ ID NO: 1383036 - RNA, 18 nt, Human
aaguauuuuuaauuaauu

SEQ ID NO: 1383037 - RNA, 15 nt, Human
aaguauuuuuaauua

SEQ ID NO: 1383038 - RNA, 20 nt, Human
aagucaaagcaaggaaacua

SEQ ID NO: 1383039 - RNA, 18 nt, Human
aagucagaacagcagacu

SEQ ID NO: 1383040 - RNA, 19 nt, Human
guucuuccucagccagccu

SEQ ID NO: 1383041 - RNA, 18 nt, Human
guucuuccucagccagcc

SEQ ID NO: 1383042 - RNA, 17 nt, Human
guucuuccucagccagc

SEQ ID NO: 1383043 - RNA, 16 nt, Human
guucuuccucagccag

SEQ ID NO: 1383044 - RNA, 15 nt, Human
guucuuccucagcca

SEQ ID NO: 1383045 - RNA, 14 nt, Human
guucuuccucagcc

SEQ ID NO: 1383046 - RNA, 13 nt, Human
guucuuccucagc

SEQ ID NO: 1383047 - RNA, 15 nt, Human
guucucucuuugcau

SEQ ID NO: 1383048 - RNA, 16 nt, Human
guucuguuuuguuucg

SEQ ID NO: 1383049 - RNA, 14 nt, Human
guucuuaauucuua

SEQ ID NO: 1383050 - RNA, 17 nt, Human
guucuuaauucuuagcu

SEQ ID NO: 1383051 - RNA, 13 nt, Human
guucuuaauucuu

SEQ ID NO: 1383052 - RNA, 22 nt, Human
guucuagguuucaaagaugcug

SEQ ID NO: 1383053 - RNA, 19 nt, Human
guucuagguuucaaagaug

SEQ ID NO: 1383054 - RNA, 16 nt, Human
guucuagguuucaaag

SEQ ID NO: 1383055 - RNA, 14 nt, Human
guucuagguuucaa

SEQ ID NO: 1383056 - RNA, 23 nt, Human
guucuaggcacuguaguucuaag

SEQ ID NO: 1383057 - RNA, 22 nt, Human
guucuaggcacuguaguucuaa

SEQ ID NO: 1383058 - RNA, 17 nt, Human
guucuaggaaaauaaaa

SEQ ID NO: 1383059 - RNA, 13 nt, Human
guucuaggaaaau

SEQ ID NO: 1383060 - RNA, 12 nt, Human
guucuaggaaaa

SEQ ID NO: 1383061 - RNA, 17 nt, Human
guucuagcgcaguuuuu

SEQ ID NO: 1383062 - RNA, 21 nt, Human
guucuugaggggaccaggagu

SEQ ID NO: 1383063 - RNA, 20 nt, Human
guucuugaggggaccaggag

SEQ ID NO: 1383064 - RNA, 16 nt, Human
guucuugaggggacca

SEQ ID NO: 1383065 - RNA, 19 nt, Human
guucuucuaccacccacca

SEQ ID NO: 1383066 - RNA, 20 nt, Human
guucuuccucagccagccuc

SEQ ID NO: 1383067 - RNA, 22 nt, Human
guucuugaggggaccaggagug

SEQ ID NO: 1383068 - RNA, 23 nt, Human
guucuugaggggaccaggagugg

SEQ ID NO: 1383069 - RNA, 14 nt, Human
guucuugguuugua

SEQ ID NO: 1383070 - RNA, 14 nt, Human
guugaccccagagg

SEQ ID NO: 1383071 - RNA, 15 nt, Human
guugaccccagagga

SEQ ID NO: 1383072 - RNA, 19 nt, Human
guugacuuauaguacauga

SEQ ID NO: 1383073 - RNA, 15 nt, Human
guucuugguuuguaa

SEQ ID NO: 1383074 - RNA, 18 nt, Human
guucuugguuuguaaauu

SEQ ID NO: 1383075 - RNA, 15 nt, Human
aaggaaaaacaaacu

SEQ ID NO: 1383076 - RNA, 19 nt, Human
guugauacuguugcacgug

SEQ ID NO: 1383077 - RNA, 21 nt, Human
guugauacuguugcacgugug

SEQ ID NO: 1383078 - RNA, 18 nt, Human
guugauacuguugcacgu

SEQ ID NO: 1383079 - RNA, 17 nt, Human
guugauacuguugcacg

SEQ ID NO: 1383080 - RNA, 16 nt, Human
guugauacuguugcac

SEQ ID NO: 1383081 - RNA, 15 nt, Human
guugauacuguugca

SEQ ID NO: 1383082 - RNA, 14 nt, Human
guugauacuguugc

SEQ ID NO: 1383083 - RNA, 13 nt, Human
guugauacuguug

SEQ ID NO: 1383084 - RNA, 12 nt, Human
guugauacuguu

SEQ ID NO: 1383085 - RNA, 15 nt, Human
guugagacaagaaaa

SEQ ID NO: 1383086 - RNA, 19 nt, Human
guugagaaucccaaauuug

SEQ ID NO: 1383087 - RNA, 16 nt, Human
guugagaaucccaaau

SEQ ID NO: 1383088 - RNA, 24 nt, Human
guugacuuauaguacaugauaaau

SEQ ID NO: 1383089 - RNA, 14 nt, Human
guuccggcauggac

SEQ ID NO: 1383090 - RNA, 18 nt, Human
guucccuugaugaagaag

SEQ ID NO: 1383091 - RNA, 18 nt, Human
guucccccuguuucagag

SEQ ID NO: 1383092 - RNA, 14 nt, Human
guuccccagagaaa

SEQ ID NO: 1383093 - RNA, 13 nt, Human
guuccccagagaa

SEQ ID NO: 1383094 - RNA, 12 nt, Human
guuccccagaga

SEQ ID NO: 1383095 - RNA, 20 nt, Human
guuccccacuguaucuaggc

SEQ ID NO: 1383096 - RNA, 17 nt, Human
guuccccacuggagcag

SEQ ID NO: 1383097 - RNA, 14 nt, Human
guuccccacuggag

SEQ ID NO: 1383098 - RNA, 13 nt, Human
guuccccacugga

SEQ ID NO: 1383099 - RNA, 23 nt, Human
aagcuuuuuauuccuccugcuca

SEQ ID NO: 1383100 - RNA, 22 nt, Human
aagcuuuugucuacacacccug

SEQ ID NO: 1383101 - RNA, 19 nt, Human
aagcuuuugucuacacacc

SEQ ID NO: 1383102 - RNA, 17 nt, Human
aagcuuuucuauuuuaa

SEQ ID NO: 1383103 - RNA, 13 nt, Human
aagcuuuucuauu

SEQ ID NO: 1383104 - RNA, 12 nt, Human
aagcuuggggaa

SEQ ID NO: 1383105 - RNA, 19 nt, Human
aagcuuuuaugugaaacau

SEQ ID NO: 1383106 - RNA, 21 nt, Human
aagcuuuuaugugaaacaugu

SEQ ID NO: 1383107 - RNA, 12 nt, Human
aagcucuuccuu

SEQ ID NO: 1383108 - RNA, 23 nt, Human
aagcucagaggcgcacugugacc

SEQ ID NO: 1383109 - RNA, 22 nt, Human
aagcucagaggcgcacugugac

SEQ ID NO: 1383110 - RNA, 19 nt, Human
aagcucacguccugagaaa

SEQ ID NO: 1383111 - RNA, 23 nt, Human
aagcucacuucugggcuucaucu

SEQ ID NO: 1383112 - RNA, 14 nt, Human
aagcucacuucugg

SEQ ID NO: 1383113 - RNA, 18 nt, Human
aagcucacguccugagaa

SEQ ID NO: 1383114 - RNA, 17 nt, Human
aagcucacguccugaga

SEQ ID NO: 1383115 - RNA, 15 nt, Human
aagcucacguccuga

SEQ ID NO: 1383116 - RNA, 20 nt, Human
aagcuauaaagcaguauuuu

SEQ ID NO: 1383117 - RNA, 15 nt, Human
aagcuauaaagcagu

SEQ ID NO: 1383118 - RNA, 13 nt, Human
aagcuauaaagca

SEQ ID NO: 1383119 - RNA, 21 nt, Human
aagcuuaauggcugauaauuu

SEQ ID NO: 1383120 - RNA, 19 nt, Human
aagcuuaauggcugauaau

SEQ ID NO: 1383121 - RNA, 17 nt, Human
aagcuuaaaacuuugaa

SEQ ID NO: 1383122 - RNA, 15 nt, Human
aagcuuaaaacuuug

SEQ ID NO: 1383123 - RNA, 14 nt, Human
aagcuuaaaacuuu

SEQ ID NO: 1383124 - RNA, 13 nt, Human
aagcuuaaaacuu

SEQ ID NO: 1383125 - RNA, 19 nt, Human
aagcucuuggagcugugag

SEQ ID NO: 1383126 - RNA, 23 nt, Human
aagcuuguauuccuuuuucucuc

SEQ ID NO: 1383127 - RNA, 23 nt, Human
aagcuucccacggccuuucuagc

SEQ ID NO: 1383128 - RNA, 21 nt, Human
aagcuuccaugauucuauuua

SEQ ID NO: 1383129 - RNA, 14 nt, Human
aagcuuaguauaaa

SEQ ID NO: 1383130 - RNA, 18 nt, Human
aagcuuaugcuuaaauuc

SEQ ID NO: 1383131 - RNA, 14 nt, Human
guuaauuuuuccua

SEQ ID NO: 1383132 - RNA, 20 nt, Human
guuaauuuuuccaacuacua

SEQ ID NO: 1383133 - RNA, 14 nt, Human
guuaauuuuuccaa

SEQ ID NO: 1383134 - RNA, 22 nt, Human
guuaauuuugaagugcuguuua

SEQ ID NO: 1383135 - RNA, 17 nt, Human
guuaauuuugaagugcu

SEQ ID NO: 1383136 - RNA, 22 nt, Human
guuaauuuaguggaaaaggcac

SEQ ID NO: 1383137 - RNA, 14 nt, Human
guuaauuuuugaua

SEQ ID NO: 1383138 - RNA, 12 nt, Human
guuaauuuuuga

SEQ ID NO: 1383139 - RNA, 19 nt, Human
guuaauuuagaaaacuuua

SEQ ID NO: 1383140 - RNA, 23 nt, Human
guuaauuuaaaguuguuugugcc

SEQ ID NO: 1383141 - RNA, 12 nt, Human
guuaauuuaaag

SEQ ID NO: 1383142 - RNA, 21 nt, Human
guuaauauugauuuauuaaua

SEQ ID NO: 1383143 - RNA, 18 nt, Human
guuaaucauuagguguga

SEQ ID NO: 1383144 - RNA, 23 nt, Human
aagcccagcacugcuugaggaaa

SEQ ID NO: 1383145 - RNA, 20 nt, Human
aagcccagcacugcuugagg

SEQ ID NO: 1383146 - RNA, 17 nt, Human
aagcccagagggucugg

SEQ ID NO: 1383147 - RNA, 16 nt, Human
aagcccagagggucug

SEQ ID NO: 1383148 - RNA, 16 nt, Human
aagcccaccauuuggc

SEQ ID NO: 1383149 - RNA, 18 nt, Human
aagcccagcccauggaga

SEQ ID NO: 1383150 - RNA, 15 nt, Human
guuaauauuuaagac

SEQ ID NO: 1383151 - RNA, 18 nt, Human
guuaauauugauuuauua

SEQ ID NO: 1383152 - RNA, 14 nt, Human
guuaauaguuccug

SEQ ID NO: 1383153 - RNA, 18 nt, Human
aagcccagagggucuggg

SEQ ID NO: 1383154 - RNA, 22 nt, Human
aagccauucuccugccucagcc

SEQ ID NO: 1383155 - RNA, 14 nt, Human
guuagaccuacagg

SEQ ID NO: 1383156 - RNA, 13 nt, Human
guuacuguguaau

SEQ ID NO: 1383157 - RNA, 19 nt, Human
guuacugugccauguguuu

SEQ ID NO: 1383158 - RNA, 13 nt, Human
guuacuguaauuc

SEQ ID NO: 1383159 - RNA, 15 nt, Human
guuagagaauaaauu

SEQ ID NO: 1383160 - RNA, 19 nt, Human
guuauuauauuuacaaaug

SEQ ID NO: 1383161 - RNA, 13 nt, Human
guuauuuaaagaa

SEQ ID NO: 1383162 - RNA, 22 nt, Human
guuauugguguaagguacuuuc

SEQ ID NO: 1383163 - RNA, 23 nt, Human
guuauugcaguuuaucauucaag

SEQ ID NO: 1383164 - RNA, 16 nt, Human
guuauugcaguuuauc

SEQ ID NO: 1383165 - RNA, 14 nt, Human
guuauugcaguuua

SEQ ID NO: 1383166 - RNA, 13 nt, Human
guuauugcaguuu

SEQ ID NO: 1383167 - RNA, 18 nt, Human
guuagagcaggacugaug

SEQ ID NO: 1383168 - RNA, 20 nt, Human
guuauuauauuuacaaaugg

SEQ ID NO: 1383169 - RNA, 20 nt, Human
guuauuuugauguaaagaug

SEQ ID NO: 1383170 - RNA, 18 nt, Human
guuauuuugauguaaaga

SEQ ID NO: 1383171 - RNA, 19 nt, Human
guucaggcccggcagggcg

SEQ ID NO: 1383172 - RNA, 14 nt, Human
guucaguaccacau

SEQ ID NO: 1383173 - RNA, 23 nt, Human
aagccuaaaagugggcuugauuc

SEQ ID NO: 1383174 - RNA, 22 nt, Human
aagccgugcucgccccagcagg

SEQ ID NO: 1383175 - RNA, 21 nt, Human
aagccucagauuccuucccau

SEQ ID NO: 1383176 - RNA, 15 nt, Human
aagccuguuuaagag

SEQ ID NO: 1383177 - RNA, 18 nt, Human
aagccuguucauggcaga

SEQ ID NO: 1383178 - RNA, 17 nt, Human
aagccuguucauggcag

SEQ ID NO: 1383179 - RNA, 18 nt, Human
aagccuguuuaagagaca

SEQ ID NO: 1383180 - RNA, 21 nt, Human
aagcuagucuuuugcuuuugc

SEQ ID NO: 1383181 - RNA, 20 nt, Human
aagcuagucuuuugcuuuug

SEQ ID NO: 1383182 - RNA, 19 nt, Human
aagcuagucuuuugcuuuu

SEQ ID NO: 1383183 - RNA, 17 nt, Human
aagcuagucuuuugcuu

SEQ ID NO: 1383184 - RNA, 16 nt, Human
aagcuagucuuuugcu

SEQ ID NO: 1383185 - RNA, 15 nt, Human
aagcuagucuuuugc

SEQ ID NO: 1383186 - RNA, 14 nt, Human
aagcuagucuuuug

SEQ ID NO: 1383187 - RNA, 12 nt, Human
aagcuagucuuu

SEQ ID NO: 1383188 - RNA, 23 nt, Human
aagcuaggugcuauuugucaucu

SEQ ID NO: 1383189 - RNA, 21 nt, Human
aagcuaggugcuauuugucau

SEQ ID NO: 1383190 - RNA, 20 nt, Human
aagccucagauuccuuccca

SEQ ID NO: 1383191 - RNA, 21 nt, Human
aagccuucaagcucugaggga

SEQ ID NO: 1383192 - RNA, 18 nt, Human
aagccuucaagcucugag

SEQ ID NO: 1383193 - RNA, 16 nt, Human
aagccuucaagcucug

SEQ ID NO: 1383194 - RNA, 16 nt, Human
aagccuucauugccuu

SEQ ID NO: 1383195 - RNA, 14 nt, Human
aagccuucaagcuc

SEQ ID NO: 1383196 - RNA, 13 nt, Human
aagccuucaagcu

SEQ ID NO: 1383197 - RNA, 22 nt, Human
aagccuuccccuuauccucccu

SEQ ID NO: 1383198 - RNA, 21 nt, Human
aagccuuccccuuauccuccc

SEQ ID NO: 1383199 - RNA, 20 nt, Human
aagccuuccccuuauccucc

SEQ ID NO: 1383200 - RNA, 12 nt, Human
aagccuuccccu

SEQ ID NO: 1383201 - RNA, 21 nt, Human
aagccuuggggcugaugcagu

SEQ ID NO: 1383202 - RNA, 12 nt, Human
aagcaugugaga

SEQ ID NO: 1383203 - RNA, 23 nt, Human
aagcauggucccacaucccuggg

SEQ ID NO: 1383204 - RNA, 22 nt, Human
aagcauggucccacaucccugg

SEQ ID NO: 1383205 - RNA, 17 nt, Human
aagcauggucccacauc

SEQ ID NO: 1383206 - RNA, 17 nt, Human
aagcaugggauuauuag

SEQ ID NO: 1383207 - RNA, 23 nt, Human
aagcauggcuugaauaaggaaau

SEQ ID NO: 1383208 - RNA, 15 nt, Human
aagcauggcuauuuu

SEQ ID NO: 1383209 - RNA, 20 nt, Human
aagcaucuuggggggguggc

SEQ ID NO: 1383210 - RNA, 23 nt, Human
aagcaugcacaaauucugucucu

SEQ ID NO: 1383211 - RNA, 12 nt, Human
aagcaugaaaug

SEQ ID NO: 1383212 - RNA, 14 nt, Human
aagcaucuugcauu

SEQ ID NO: 1383213 - RNA, 18 nt, Human
aagcaucauuauuuaugu

SEQ ID NO: 1383214 - RNA, 19 nt, Human
aagcaucauuauuuaugua

SEQ ID NO: 1383215 - RNA, 17 nt, Human
aagcaucauuauuuaug

SEQ ID NO: 1383216 - RNA, 15 nt, Human
aagcaucauuauuua

SEQ ID NO: 1383217 - RNA, 14 nt, Human
aagcaucauuauuu

SEQ ID NO: 1383218 - RNA, 13 nt, Human
aagcaucagaaag

SEQ ID NO: 1383219 - RNA, 12 nt, Human
aagccaaagagu

SEQ ID NO: 1383220 - RNA, 19 nt, Human
aagcauuuuguaaguugaa

SEQ ID NO: 1383221 - RNA, 13 nt, Human
aagcauuuuguaa

SEQ ID NO: 1383222 - RNA, 12 nt, Human
aagcauuuugua

SEQ ID NO: 1383223 - RNA, 23 nt, Human
aagcauuuguuucuacuuugaua

SEQ ID NO: 1383224 - RNA, 19 nt, Human
aagcauuuguuucuacuuu

SEQ ID NO: 1383225 - RNA, 18 nt, Human
aagcauuugaaugcauuu

SEQ ID NO: 1383226 - RNA, 21 nt, Human
aagcauuugaaugcauuuugu

SEQ ID NO: 1383227 - RNA, 21 nt, Human
aagcauuuaaccccccuguac

SEQ ID NO: 1383228 - RNA, 22 nt, Human
aagcauuuaaccccccuguaca

SEQ ID NO: 1383229 - RNA, 23 nt, Human
aagcauuuaaccccccuguacac

SEQ ID NO: 1383230 - RNA, 20 nt, Human
aagccaagggaaccuguguc

SEQ ID NO: 1383231 - RNA, 19 nt, Human
aagccaagggaaccugugu

SEQ ID NO: 1383232 - RNA, 18 nt, Human
aagccaagggaaccugug

SEQ ID NO: 1383233 - RNA, 18 nt, Human
aagcacauuuuaaaagug

SEQ ID NO: 1383234 - RNA, 22 nt, Human
aagcacugacugggaccaggca

SEQ ID NO: 1383235 - RNA, 21 nt, Human
aagcacgugguaaaacacuug

SEQ ID NO: 1383236 - RNA, 15 nt, Human
aagcacgaaauguua

SEQ ID NO: 1383237 - RNA, 19 nt, Human
aagcaccuuagcuggcauu

SEQ ID NO: 1383238 - RNA, 16 nt, Human
aagcaccuuagcuggc

SEQ ID NO: 1383239 - RNA, 13 nt, Human
aagcaccuguaau

SEQ ID NO: 1383240 - RNA, 16 nt, Human
aagcacuaaacaaaga

SEQ ID NO: 1383241 - RNA, 13 nt, Human
aagcacagcccuu

SEQ ID NO: 1383242 - RNA, 16 nt, Human
aagcacagcagccugg

SEQ ID NO: 1383243 - RNA, 11 nt, Human
aagcacagcag

SEQ ID NO: 1383244 - RNA, 16 nt, Human
guguuucuugccucau

SEQ ID NO: 1383245 - RNA, 18 nt, Human
guguuucuguaagaaacc

SEQ ID NO: 1383246 - RNA, 13 nt, Human
guguuucugacuc

SEQ ID NO: 1383247 - RNA, 13 nt, Human
gugugaaugaaca

SEQ ID NO: 1383248 - RNA, 13 nt, Human
guguuugcuuucu

SEQ ID NO: 1383249 - RNA, 15 nt, Human
guguuucuugccuca

SEQ ID NO: 1383250 - RNA, 14 nt, Human
guguuucuugccuc

SEQ ID NO: 1383251 - RNA, 12 nt, Human
guguuugaagca

SEQ ID NO: 1383252 - RNA, 23 nt, Human
aagauuuuuuuuuuuucucucaa

SEQ ID NO: 1383253 - RNA, 15 nt, Human
aagcaaaaaagaaaa

SEQ ID NO: 1383254 - RNA, 16 nt, Human
aagauuuuuuaauaau

SEQ ID NO: 1383255 - RNA, 14 nt, Human
aagauuuuuuaaua

SEQ ID NO: 1383256 - RNA, 17 nt, Human
aagauuuuuuaauaauu

SEQ ID NO: 1383257 - RNA, 20 nt, Human
aagcaacauucauagucuuu

SEQ ID NO: 1383258 - RNA, 15 nt, Human
aagcaacauggcuuu

SEQ ID NO: 1383259 - RNA, 14 nt, Human
aagcaacauggcuu

SEQ ID NO: 1383260 - RNA, 13 nt, Human
aagcaacauggcu

SEQ ID NO: 1383261 - RNA, 19 nt, Human
aagauggcauaaccugucu

SEQ ID NO: 1383262 - RNA, 20 nt, Human
aagauggaguuucuaagguc

SEQ ID NO: 1383263 - RNA, 18 nt, Human
aagauggaguuucuaagg

SEQ ID NO: 1383264 - RNA, 13 nt, Human
aagauuuuuuaau

SEQ ID NO: 1383265 - RNA, 15 nt, Human
aagauggcccauccu

SEQ ID NO: 1383266 - RNA, 17 nt, Human
aagauggaguuucuaag

SEQ ID NO: 1383267 - RNA, 16 nt, Human
aagauggaguuucuaa

SEQ ID NO: 1383268 - RNA, 19 nt, Human
aagauauuuuuaucuuuau

SEQ ID NO: 1383269 - RNA, 17 nt, Human
aagauauuuuuaucuuu

SEQ ID NO: 1383270 - RNA, 19 nt, Human
gugucuuaauuauuauuug

SEQ ID NO: 1383271 - RNA, 15 nt, Human
gugucuuaauuauua

SEQ ID NO: 1383272 - RNA, 14 nt, Human
gugugaacuggacc

SEQ ID NO: 1383273 - RNA, 17 nt, Human
gugugaacuggacccug

SEQ ID NO: 1383274 - RNA, 22 nt, Human
gugugaacuggacccuguugcu

SEQ ID NO: 1383275 - RNA, 14 nt, Human
gugucuuaauuauu

SEQ ID NO: 1383276 - RNA, 15 nt, Human
gugucacucaaggcg

SEQ ID NO: 1383277 - RNA, 14 nt, Human
gugucaccugugcu

SEQ ID NO: 1383278 - RNA, 20 nt, Human
guguauuccaagacaugucu

SEQ ID NO: 1383279 - RNA, 13 nt, Human
guguauuccaaga

SEQ ID NO: 1383280 - RNA, 15 nt, Human
aagcaaccucaguaa

SEQ ID NO: 1383281 - RNA, 14 nt, Human
aagauagcugugac

SEQ ID NO: 1383282 - RNA, 15 nt, Human
aagauauaagugcug

SEQ ID NO: 1383283 - RNA, 16 nt, Human
aagauauaagugcugu

SEQ ID NO: 1383284 - RNA, 17 nt, Human
aagauauaagugcugua

SEQ ID NO: 1383285 - RNA, 15 nt, Human
aagauagcugugacu

SEQ ID NO: 1383286 - RNA, 15 nt, Human
aagagguguuauuug

SEQ ID NO: 1383287 - RNA, 20 nt, Human
aagaggugaccccagggcac

SEQ ID NO: 1383288 - RNA, 19 nt, Human
aagaggugaccccagggca

SEQ ID NO: 1383289 - RNA, 18 nt, Human
aagaggugaccccagggc

SEQ ID NO: 1383290 - RNA, 17 nt, Human
aagaggugaccccaggg

SEQ ID NO: 1383291 - RNA, 16 nt, Human
aagaggugaccccagg

SEQ ID NO: 1383292 - RNA, 21 nt, Human
aagagguauuuaucuuuacuu

SEQ ID NO: 1383293 - RNA, 24 nt, Human
aagaggugaccccagggcacagga

SEQ ID NO: 1383294 - RNA, 22 nt, Human
aagaggugaccccagggcacag

SEQ ID NO: 1383295 - RNA, 21 nt, Human
aagaggugaccccagggcaca

SEQ ID NO: 1383296 - RNA, 13 nt, Human
aagagguguuauu

SEQ ID NO: 1383297 - RNA, 17 nt, Human
aagagggacgccugggg

SEQ ID NO: 1383298 - RNA, 16 nt, Human
aagagggacgccuggg

SEQ ID NO: 1383299 - RNA, 17 nt, Human
aagaggcugcccuccug

SEQ ID NO: 1383300 - RNA, 18 nt, Human
aagaggccguggcugcug

SEQ ID NO: 1383301 - RNA, 18 nt, Human
aagaggcaccaggaagcc

SEQ ID NO: 1383302 - RNA, 18 nt, Human
aagaggcaccugucccag

SEQ ID NO: 1383303 - RNA, 15 nt, Human
aagaggcaccugucc

SEQ ID NO: 1383304 - RNA, 19 nt, Human
guguaacugcccaaagcag

SEQ ID NO: 1383305 - RNA, 18 nt, Human
guguaagaaauacagacu

SEQ ID NO: 1383306 - RNA, 20 nt, Human
gugguucugagauggcuccc

SEQ ID NO: 1383307 - RNA, 15 nt, Human
gugguuucagaaaug

SEQ ID NO: 1383308 - RNA, 19 nt, Human
gugcugccucuaccugaca

SEQ ID NO: 1383309 - RNA, 12 nt, Human
gugcugccucua

SEQ ID NO: 1383310 - RNA, 11 nt, Human
gugcugccucu

SEQ ID NO: 1383311 - RNA, 13 nt, Human
gugcucucuuucu

SEQ ID NO: 1383312 - RNA, 22 nt, Human
gugcucuccauucugcuccuuc

SEQ ID NO: 1383313 - RNA, 18 nt, Human
gugcugccgcgcagugug

SEQ ID NO: 1383314 - RNA, 16 nt, Human
gugcucucuuucuguc

SEQ ID NO: 1383315 - RNA, 19 nt, Human
guguaaaauauuuugaauc

SEQ ID NO: 1383316 - RNA, 18 nt, Human
guguaaaauauuuugaau

SEQ ID NO: 1383317 - RNA, 17 nt, Human
guguaaaauauuuugaa

SEQ ID NO: 1383318 - RNA, 19 nt, Human
gugguuuucuuuugccaug

SEQ ID NO: 1383319 - RNA, 18 nt, Human
gugguuuaggcuauuugu

SEQ ID NO: 1383320 - RNA, 17 nt, Human
gugguuuauauauuuaa

SEQ ID NO: 1383321 - RNA, 20 nt, Human
guguaacugcccaaagcagc

SEQ ID NO: 1383322 - RNA, 23 nt, Human
guguaacaauuguguagccuuuu

SEQ ID NO: 1383323 - RNA, 19 nt, Human
guguaacaauuguguagcc

SEQ ID NO: 1383324 - RNA, 17 nt, Human
guguaacaauuguguag

SEQ ID NO: 1383325 - RNA, 22 nt, Human
uagaugcuggcccagggcccag

SEQ ID NO: 1383326 - RNA, 21 nt, Human
uagaugcuggcccagggccca

SEQ ID NO: 1383327 - RNA, 18 nt, Human
uagaugcuggcccagggc

SEQ ID NO: 1383328 - RNA, 16 nt, Human
uagaugcuggcccagg

SEQ ID NO: 1383329 - RNA, 18 nt, Human
uagaugauuucaguucua

SEQ ID NO: 1383330 - RNA, 22 nt, Human
uagaugauuucaguucuaggaa

SEQ ID NO: 1383331 - RNA, 23 nt, Human
uagaugauuaaauaagauucuaa

SEQ ID NO: 1383332 - RNA, 21 nt, Human
uagaugauuaaauaagauucu

SEQ ID NO: 1383333 - RNA, 20 nt, Human
uagaugauuaaauaagauuc

SEQ ID NO: 1383334 - RNA, 19 nt, Human
uagaugauuaaauaagauu

SEQ ID NO: 1383335 - RNA, 15 nt, Human
uagaugcaguucuga

SEQ ID NO: 1383336 - RNA, 15 nt, Human
uagaugcuggcccag

SEQ ID NO: 1383337 - RNA, 14 nt, Human
uagaugcuggccca

SEQ ID NO: 1383338 - RNA, 13 nt, Human
uagaugcuggccc

SEQ ID NO: 1383339 - RNA, 16 nt, Human
uagaugcaguucugaa

SEQ ID NO: 1383340 - RNA, 21 nt, Human
uagccaaaaauagcuaaauac

SEQ ID NO: 1383341 - RNA, 16 nt, Human
uagccaaaaauagcua

SEQ ID NO: 1383342 - RNA, 17 nt, Human
uagcaugucacuaaagc

SEQ ID NO: 1383343 - RNA, 18 nt, Human
uagcaugucgucaaagcu

SEQ ID NO: 1383344 - RNA, 19 nt, Human
acaagaccacguuucuaaa

SEQ ID NO: 1383345 - RNA, 23 nt, Human
acaacacuguaguaaauaaugcu

SEQ ID NO: 1383346 - RNA, 14 nt, Human
acaacacuguagua

SEQ ID NO: 1383347 - RNA, 17 nt, Human
uagccagaggcucuaau

SEQ ID NO: 1383348 - RNA, 20 nt, Human
uagccagcacacagggcagu

SEQ ID NO: 1383349 - RNA, 19 nt, Human
uagccagcacacagggcag

SEQ ID NO: 1383350 - RNA, 18 nt, Human
uagccagcacacagggca

SEQ ID NO: 1383351 - RNA, 16 nt, Human
uagccacauuuggaau

SEQ ID NO: 1383352 - RNA, 17 nt, Human
uagccacaccaggauag

SEQ ID NO: 1383353 - RNA, 15 nt, Human
uagccacaccaggau

SEQ ID NO: 1383354 - RNA, 14 nt, Human
uagccacaccagga

SEQ ID NO: 1383355 - RNA, 14 nt, Human
uagccaagugcagg

SEQ ID NO: 1383356 - RNA, 12 nt, Human
acaaagcagcca

SEQ ID NO: 1383357 - RNA, 21 nt, Human
acaaagaguucaagaaauaag

SEQ ID NO: 1383358 - RNA, 22 nt, Human
acaaagaguucaagaaauaagu

SEQ ID NO: 1383359 - RNA, 19 nt, Human
acaaagaguucaagaaaua

SEQ ID NO: 1383360 - RNA, 23 nt, Human
aauuguugcuaaucuucuuaugc

SEQ ID NO: 1383361 - RNA, 17 nt, Human
aauuguugagauacuuu

SEQ ID NO: 1383362 - RNA, 18 nt, Human
acaaaggcuuauuaauuu

SEQ ID NO: 1383363 - RNA, 11 nt, Human
acaaaggcaag

SEQ ID NO: 1383364 - RNA, 21 nt, Human
acaaagcagaauaguauuuuu

SEQ ID NO: 1383365 - RNA, 14 nt, Human
acaaagcagccacg

SEQ ID NO: 1383366 - RNA, 13 nt, Human
acaaagcagccac

SEQ ID NO: 1383367 - RNA, 18 nt, Human
acaaaaggauaaugaaua

SEQ ID NO: 1383368 - RNA, 11 nt, Human
acaaaagcaug

SEQ ID NO: 1383369 - RNA, 22 nt, Human
acaaaagcaugugagacugguu

SEQ ID NO: 1383370 - RNA, 20 nt, Human
aauuguguuuuaauuguaaa

SEQ ID NO: 1383371 - RNA, 20 nt, Human
aauugccuuuuuucuguaua

SEQ ID NO: 1383372 - RNA, 23 nt, Human
aauugccuuuuuucuguauaaau

SEQ ID NO: 1383373 - RNA, 21 nt, Human
aauuguguuuauaauuuuaaa

SEQ ID NO: 1383374 - RNA, 13 nt, Human
aauuguucucaga

SEQ ID NO: 1383375 - RNA, 16 nt, Human
aauuguuacaaauugu

SEQ ID NO: 1383376 - RNA, 22 nt, Human
uagaggauggucuuacagcagg

SEQ ID NO: 1383377 - RNA, 12 nt, Human
uagaugauaaag

SEQ ID NO: 1383378 - RNA, 15 nt, Human
uagauaugaaagcug

SEQ ID NO: 1383379 - RNA, 23 nt, Human
uagauaucgacuuguuuuugcac

SEQ ID NO: 1383380 - RNA, 20 nt, Human
uagauaucaugcaaauuuca

SEQ ID NO: 1383381 - RNA, 19 nt, Human
uagagauuaccuccugaga

SEQ ID NO: 1383382 - RNA, 18 nt, Human
uagagauuaccuccugag

SEQ ID NO: 1383383 - RNA, 17 nt, Human
uagagauuaccuccuga

SEQ ID NO: 1383384 - RNA, 11 nt, Human
uagagcacugc

SEQ ID NO: 1383385 - RNA, 21 nt, Human
uagagauuaccuccugagaaa

SEQ ID NO: 1383386 - RNA, 15 nt, Human
acaaucauguguguu

SEQ ID NO: 1383387 - RNA, 21 nt, Human
acaaucauguguguuaaccca

SEQ ID NO: 1383388 - RNA, 14 nt, Human
acaaucaugugugu

SEQ ID NO: 1383389 - RNA, 12 nt, Human
acaaugacuuac

SEQ ID NO: 1383390 - RNA, 16 nt, Human
acaaugacauuuauau

SEQ ID NO: 1383391 - RNA, 16 nt, Human
acaaugacaaagcaga

SEQ ID NO: 1383392 - RNA, 19 nt, Human
acaaugacuuacuguacau

SEQ ID NO: 1383393 - RNA, 19 nt, Human
uagcuaauaacaugugaaa

SEQ ID NO: 1383394 - RNA, 21 nt, Human
uagcuaauaaaaagcuuuugu

SEQ ID NO: 1383395 - RNA, 20 nt, Human
uagcuaauaaaaagcuuuug

SEQ ID NO: 1383396 - RNA, 15 nt, Human
uagcuaaguacacaa

SEQ ID NO: 1383397 - RNA, 22 nt, Human
uagcuaaguacacaauaagcaa

SEQ ID NO: 1383398 - RNA, 17 nt, Human
acaaugacuuacuguac

SEQ ID NO: 1383399 - RNA, 18 nt, Human
acaaugacuuacuguaca

SEQ ID NO: 1383400 - RNA, 10 nt, Human
uagcuguggg

SEQ ID NO: 1383401 - RNA, 24 nt, Human
uagcugugaccugcugagcucuga

SEQ ID NO: 1383402 - RNA, 22 nt, Human
uagcugugaccugcugagcucu

SEQ ID NO: 1383403 - RNA, 20 nt, Human
uagcugugaccugcugagcu

SEQ ID NO: 1383404 - RNA, 19 nt, Human
uagcugugaccugcugagc

SEQ ID NO: 1383405 - RNA, 18 nt, Human
uagcugugaccugcugag

SEQ ID NO: 1383406 - RNA, 17 nt, Human
uagcugugaccugcuga

SEQ ID NO: 1383407 - RNA, 15 nt, Human
uagcugugaccugcu

SEQ ID NO: 1383408 - RNA, 14 nt, Human
uagcugugaccugc

SEQ ID NO: 1383409 - RNA, 13 nt, Human
uagcugugaccug

SEQ ID NO: 1383410 - RNA, 17 nt, Human
uagcuacagagaaacca

SEQ ID NO: 1383411 - RNA, 14 nt, Human
uagcuacagagaaa

SEQ ID NO: 1383412 - RNA, 13 nt, Human
uagcuacagagaa

SEQ ID NO: 1383413 - RNA, 12 nt, Human
uagcuacagaga

SEQ ID NO: 1383414 - RNA, 11 nt, Human
uagcuacagag

SEQ ID NO: 1383415 - RNA, 22 nt, Human
uagcuaauaaaaagcuuuuguc

SEQ ID NO: 1383416 - RNA, 24 nt, Human
uagcuacagagaaaccagcuuccu

SEQ ID NO: 1383417 - RNA, 23 nt, Human
uagcuacagagaaaccagcuucc

SEQ ID NO: 1383418 - RNA, 22 nt, Human
uagcuacagagaaaccagcuuc

SEQ ID NO: 1383419 - RNA, 21 nt, Human
uagcuacagagaaaccagcuu

SEQ ID NO: 1383420 - RNA, 20 nt, Human
uagcuacagagaaaccagcu

SEQ ID NO: 1383421 - RNA, 16 nt, Human
acaauacaaauggauu

SEQ ID NO: 1383422 - RNA, 15 nt, Human
acaauacaaauggau

SEQ ID NO: 1383423 - RNA, 14 nt, Human
acaauacaaaugga

SEQ ID NO: 1383424 - RNA, 17 nt, Human
acaauacagaucaucuu

SEQ ID NO: 1383425 - RNA, 13 nt, Human
acaauacaaaugg

SEQ ID NO: 1383426 - RNA, 12 nt, Human
acaauacaaaug

SEQ ID NO: 1383427 - RNA, 14 nt, Human
acaauaauuuucua

SEQ ID NO: 1383428 - RNA, 23 nt, Human
acaauacaucccuuaccugggaa

SEQ ID NO: 1383429 - RNA, 16 nt, Human
acaauaaauggcugua

SEQ ID NO: 1383430 - RNA, 13 nt, Human
acaauaaauagac

SEQ ID NO: 1383431 - RNA, 19 nt, Human
acaauaacuccucccaggg

SEQ ID NO: 1383432 - RNA, 16 nt, Human
acaauaacuccuccca

SEQ ID NO: 1383433 - RNA, 15 nt, Human
acaauaacuccuccc

SEQ ID NO: 1383434 - RNA, 15 nt, Human
acaauaagcaaaaac

SEQ ID NO: 1383435 - RNA, 16 nt, Human
acaauaagcaaaaaca

SEQ ID NO: 1383436 - RNA, 21 nt, Human
acaaggauagaugcuggccca

SEQ ID NO: 1383437 - RNA, 18 nt, Human
acaaggauagaugcuggc

SEQ ID NO: 1383438 - RNA, 17 nt, Human
acaaggauagaugcugg

SEQ ID NO: 1383439 - RNA, 16 nt, Human
acaaggauagaugcug

SEQ ID NO: 1383440 - RNA, 15 nt, Human
acaaggacuuccugu

SEQ ID NO: 1383441 - RNA, 17 nt, Human
acaagagaagcauucuc

SEQ ID NO: 1383442 - RNA, 15 nt, Human
acaagagaagcauuc

SEQ ID NO: 1383443 - RNA, 14 nt, Human
acaagagaagcauu

SEQ ID NO: 1383444 - RNA, 14 nt, Human
acaagagaaaaagc

SEQ ID NO: 1383445 - RNA, 22 nt, Human
acaagacugacgccaggguaug

SEQ ID NO: 1383446 - RNA, 15 nt, Human
acaagacccccagca

SEQ ID NO: 1383447 - RNA, 14 nt, Human
acaagacugcacau

SEQ ID NO: 1383448 - RNA, 13 nt, Human
acaagacugcaca

SEQ ID NO: 1383449 - RNA, 17 nt, Human
uagggacugaccagcag

SEQ ID NO: 1383450 - RNA, 15 nt, Human
uagggacugaccagc

SEQ ID NO: 1383451 - RNA, 14 nt, Human
uagggacugaccag

SEQ ID NO: 1383452 - RNA, 14 nt, Human
uagggaagggccug

SEQ ID NO: 1383453 - RNA, 21 nt, Human
uaggcauuuuuaccaucacug

SEQ ID NO: 1383454 - RNA, 19 nt, Human
uaggcauuuuuaccaucac

SEQ ID NO: 1383455 - RNA, 12 nt, Human
uaggcauuuccu

SEQ ID NO: 1383456 - RNA, 22 nt, Human
uaggcaggaagcccaauugcug

SEQ ID NO: 1383457 - RNA, 21 nt, Human
uaggcacuguaguucuaagac

SEQ ID NO: 1383458 - RNA, 22 nt, Human
uaggcacuguaguucuaagacu

SEQ ID NO: 1383459 - RNA, 20 nt, Human
uaggcacuguaguucuaaga

SEQ ID NO: 1383460 - RNA, 19 nt, Human
uaggcacuguaguucuaag

SEQ ID NO: 1383461 - RNA, 18 nt, Human
uaggcacuguaguucuaa

SEQ ID NO: 1383462 - RNA, 13 nt, Human
uaggaggguccuc

SEQ ID NO: 1383463 - RNA, 16 nt, Human
uaggagggugggaagg

SEQ ID NO: 1383464 - RNA, 23 nt, Human
uaggagggacugucgcugcuucg

SEQ ID NO: 1383465 - RNA, 14 nt, Human
uaggagggagacac

SEQ ID NO: 1383466 - RNA, 14 nt, Human
uaggagggacuguc

SEQ ID NO: 1383467 - RNA, 12 nt, Human
uaggagggacug

SEQ ID NO: 1383468 - RNA, 23 nt, Human
uaggagcuuugacucaggagccu

SEQ ID NO: 1383469 - RNA, 22 nt, Human
uaggcagacucuuuaugcuugc

SEQ ID NO: 1383470 - RNA, 20 nt, Human
uaggaggaccagagcuacug

SEQ ID NO: 1383471 - RNA, 19 nt, Human
uaggagcuuugacucagga

SEQ ID NO: 1383472 - RNA, 16 nt, Human
uaggagcuaaggcucu

SEQ ID NO: 1383473 - RNA, 17 nt, Human
uaggagcuaaggcucua

SEQ ID NO: 1383474 - RNA, 14 nt, Human
uaggagcuaaggcu

SEQ ID NO: 1383475 - RNA, 13 nt, Human
uaggagcuaaggc

SEQ ID NO: 1383476 - RNA, 16 nt, Human
uaggagcaaagccugu

SEQ ID NO: 1383477 - RNA, 17 nt, Human
uaggagcaaagccuguu

SEQ ID NO: 1383478 - RNA, 12 nt, Human
uaggagcaugag

SEQ ID NO: 1383479 - RNA, 14 nt, Human
uaggagagaaggua

SEQ ID NO: 1383480 - RNA, 16 nt, Human
uaggagaagccaggaa

SEQ ID NO: 1383481 - RNA, 15 nt, Human
uaggagaagccagga

SEQ ID NO: 1383482 - RNA, 12 nt, Human
uaggagaagcca

SEQ ID NO: 1383483 - RNA, 20 nt, Human
uaggagaaccaaaucuggaa

SEQ ID NO: 1383484 - RNA, 17 nt, Human
uaggagaaccaaaucug

SEQ ID NO: 1383485 - RNA, 22 nt, Human
uagcugugugaauaccugcuca

SEQ ID NO: 1383486 - RNA, 14 nt, Human
uagcugugggggug

SEQ ID NO: 1383487 - RNA, 13 nt, Human
uagcugugggggu

SEQ ID NO: 1383488 - RNA, 18 nt, Human
uaggaaauauuuauuuua

SEQ ID NO: 1383489 - RNA, 22 nt, Human
uaggaccuuuccaccacagcca

SEQ ID NO: 1383490 - RNA, 21 nt, Human
uaggaccuuuccaccacagcc

SEQ ID NO: 1383491 - RNA, 19 nt, Human
uaggaccuuuccaccacag

SEQ ID NO: 1383492 - RNA, 20 nt, Human
uaggaaaucuagaaguaguc

SEQ ID NO: 1383493 - RNA, 19 nt, Human
uaggaaauauuuauuuuaa

SEQ ID NO: 1383494 - RNA, 23 nt, Human
uaguaccaaucauuuuaauuauu

SEQ ID NO: 1383495 - RNA, 16 nt, Human
uaguaccaaucauuuu

SEQ ID NO: 1383496 - RNA, 14 nt, Human
uaguaccaaaauaa

SEQ ID NO: 1383497 - RNA, 19 nt, Human
uaguaacuucuuauggaau

SEQ ID NO: 1383498 - RNA, 18 nt, Human
uaguaacuucuuauggaa

SEQ ID NO: 1383499 - RNA, 22 nt, Human
uaguaacacuaauauauuuaaa

SEQ ID NO: 1383500 - RNA, 15 nt, Human
uaguaacacuaauau

SEQ ID NO: 1383501 - RNA, 14 nt, Human
uaguaacacuaaua

SEQ ID NO: 1383502 - RNA, 22 nt, Human
uaguaaaucacgcuuuuugaaa

SEQ ID NO: 1383503 - RNA, 21 nt, Human
uaguaaaucacgcuuuuugaa

SEQ ID NO: 1383504 - RNA, 18 nt, Human
uaguaaaucacgcuuuuu

SEQ ID NO: 1383505 - RNA, 19 nt, Human
uaguaaauaaugcuuugaa

SEQ ID NO: 1383506 - RNA, 17 nt, Human
uaguaaauaaugcuuug

SEQ ID NO: 1383507 - RNA, 16 nt, Human
uaguaaauaaugcuuu

SEQ ID NO: 1383508 - RNA, 15 nt, Human
uaguaaauaaugcuu

SEQ ID NO: 1383509 - RNA, 14 nt, Human
uaguaaauaaugcu

SEQ ID NO: 1383510 - RNA, 17 nt, Human
uaguaaagucaaggaga

SEQ ID NO: 1383511 - RNA, 17 nt, Human
uaguaaaccaauccuau

SEQ ID NO: 1383512 - RNA, 22 nt, Human
uaguaaaccaauccuaugcaug

SEQ ID NO: 1383513 - RNA, 12 nt, Human
uaguaaaccaau

SEQ ID NO: 1383514 - RNA, 11 nt, Human
uaguaaaccaa

SEQ ID NO: 1383515 - RNA, 15 nt, Human
acacauacccucuuc

SEQ ID NO: 1383516 - RNA, 22 nt, Human
acacagugcugaccagacagcc

SEQ ID NO: 1383517 - RNA, 17 nt, Human
acacacugaugcuuaga

SEQ ID NO: 1383518 - RNA, 15 nt, Human
acacacugaugcuua

SEQ ID NO: 1383519 - RNA, 14 nt, Human
acacacuuacuuuu

SEQ ID NO: 1383520 - RNA, 21 nt, Human
uaguuaccuuauaguuacugu

SEQ ID NO: 1383521 - RNA, 19 nt, Human
uaguuaccuuauaguuacu

SEQ ID NO: 1383522 - RNA, 18 nt, Human
uaguuaccuuauaguuac

SEQ ID NO: 1383523 - RNA, 17 nt, Human
uaguuaccuuauaguua

SEQ ID NO: 1383524 - RNA, 14 nt, Human
uaguuaccuuauag

SEQ ID NO: 1383525 - RNA, 12 nt, Human
uaguuaccuuau

SEQ ID NO: 1383526 - RNA, 20 nt, Human
uaguuaaucaucaagagaau

SEQ ID NO: 1383527 - RNA, 16 nt, Human
uaguuaaucaucaaga

SEQ ID NO: 1383528 - RNA, 20 nt, Human
uaguuaacacacuaccgaau

SEQ ID NO: 1383529 - RNA, 23 nt, Human
uaguuaagacaugauuuccuuga

SEQ ID NO: 1383530 - RNA, 21 nt, Human
uaguuaagacaugauuuccuu

SEQ ID NO: 1383531 - RNA, 19 nt, Human
uaguuaagacaugauuucc

SEQ ID NO: 1383532 - RNA, 14 nt, Human
uaguuaagacauga

SEQ ID NO: 1383533 - RNA, 14 nt, Human
uaguuaacacacua

SEQ ID NO: 1383534 - RNA, 15 nt, Human
uagugacccacaugc

SEQ ID NO: 1383535 - RNA, 21 nt, Human
uagugaaggcuucucucugug

SEQ ID NO: 1383536 - RNA, 18 nt, Human
uagugaauacugcuacag

SEQ ID NO: 1383537 - RNA, 23 nt, Human
uaguguuggagaagaacugaaau

SEQ ID NO: 1383538 - RNA, 18 nt, Human
uagucccucaugcaaauc

SEQ ID NO: 1383539 - RNA, 20 nt, Human
uaguaccuuuuauaucccau

SEQ ID NO: 1383540 - RNA, 19 nt, Human
uagugaaggcuucucucug

SEQ ID NO: 1383541 - RNA, 14 nt, Human
uagugaacuugaaa

SEQ ID NO: 1383542 - RNA, 22 nt, Human
uagugaaacucguuaauuugua

SEQ ID NO: 1383543 - RNA, 18 nt, Human
uagggagggcggcagggg

SEQ ID NO: 1383544 - RNA, 12 nt, Human
uagggagccaug

SEQ ID NO: 1383545 - RNA, 17 nt, Human
uagggagccauuugaga

SEQ ID NO: 1383546 - RNA, 22 nt, Human
acaaugcuguauuuuaaaagaa

SEQ ID NO: 1383547 - RNA, 21 nt, Human
acaaugcugugcccuaaagug

SEQ ID NO: 1383548 - RNA, 19 nt, Human
acaauggauaggcacagga

SEQ ID NO: 1383549 - RNA, 24 nt, Human
acaaugcugugcccuaaaguguau

SEQ ID NO: 1383550 - RNA, 22 nt, Human
acaaugcugugcccuaaagugu

SEQ ID NO: 1383551 - RNA, 23 nt, Human
acaaugcugugcccuaaagugua

SEQ ID NO: 1383552 - RNA, 14 nt, Human
acacaaugugucug

SEQ ID NO: 1383553 - RNA, 22 nt, Human
acacacaaauuaucuuaaaacu

SEQ ID NO: 1383554 - RNA, 23 nt, Human
acaauggaccggagagugggggu

SEQ ID NO: 1383555 - RNA, 16 nt, Human
acaauggaccggagag

SEQ ID NO: 1383556 - RNA, 22 nt, Human
acaauguccuaacugaaagaug

SEQ ID NO: 1383557 - RNA, 22 nt, Human
acacacuaccgaaugugucuuu

SEQ ID NO: 1383558 - RNA, 23 nt, Human
acacacggugccuuuauuuccac

SEQ ID NO: 1383559 - RNA, 16 nt, Human
acacacggugccuuua

SEQ ID NO: 1383560 - RNA, 13 nt, Human
acacacugaugcu

SEQ ID NO: 1383561 - RNA, 20 nt, Human
acacacuaccgaaugugucu

SEQ ID NO: 1383562 - RNA, 21 nt, Human
acacacugcauguuugugauu

SEQ ID NO: 1383563 - RNA, 17 nt, Human
acacaccaccacgccug

SEQ ID NO: 1383564 - RNA, 20 nt, Human
acacaccaccacgccuggcu

SEQ ID NO: 1383565 - RNA, 18 nt, Human
uauaaaaagcuuccauga

SEQ ID NO: 1383566 - RNA, 17 nt, Human
uauaaaaaaugguucag

SEQ ID NO: 1383567 - RNA, 21 nt, Human
uauaaaaaaugguucagaauu

SEQ ID NO: 1383568 - RNA, 16 nt, Human
uauaaaaaaugguuca

SEQ ID NO: 1383569 - RNA, 15 nt, Human
uauaaaaaaugguuc

SEQ ID NO: 1383570 - RNA, 14 nt, Human
uauaaaaaaugguu

SEQ ID NO: 1383571 - RNA, 20 nt, Human
uaguuccacuuauagccucu

SEQ ID NO: 1383572 - RNA, 18 nt, Human
uaguuccacuuauagccu

SEQ ID NO: 1383573 - RNA, 17 nt, Human
uaguucaugucugcuau

SEQ ID NO: 1383574 - RNA, 14 nt, Human
uaguucauguaaau

SEQ ID NO: 1383575 - RNA, 23 nt, Human
uaguuaccuuauaguuacugugu

SEQ ID NO: 1383576 - RNA, 22 nt, Human
uaguuaccuuauaguuacugug

SEQ ID NO: 1383577 - RNA, 15 nt, Human
uaguuccacugagac

SEQ ID NO: 1383578 - RNA, 14 nt, Human
uaguuccacugaga

SEQ ID NO: 1383579 - RNA, 22 nt, Human
uaguucauguaaauaauacauu

SEQ ID NO: 1383580 - RNA, 21 nt, Human
uaguucauguaaauaauacau

SEQ ID NO: 1383581 - RNA, 16 nt, Human
uaguucauguaaauaa

SEQ ID NO: 1383582 - RNA, 15 nt, Human
uaguucauguaaaua

SEQ ID NO: 1383583 - RNA, 19 nt, Human
acacauacucauuuuucau

SEQ ID NO: 1383584 - RNA, 22 nt, Human
acacauacucauuuuucaugau

SEQ ID NO: 1383585 - RNA, 19 nt, Human
uauaaaaauaaaaaacacu

SEQ ID NO: 1383586 - RNA, 20 nt, Human
uauaaaagccuguuuaagag

SEQ ID NO: 1383587 - RNA, 20 nt, Human
uauaaaaauaaaaaacacug

SEQ ID NO: 1383588 - RNA, 22 nt, Human
uauaaaagggacugagaaauuu

SEQ ID NO: 1383589 - RNA, 15 nt, Human
acacaugaaguccaa

SEQ ID NO: 1383590 - RNA, 18 nt, Human
acacaugcaaggucauuu

SEQ ID NO: 1383591 - RNA, 14 nt, Human
acacauuuuauuuu

SEQ ID NO: 1383592 - RNA, 19 nt, Human
acacauuuuauuuuauuau

SEQ ID NO: 1383593 - RNA, 20 nt, Human
acacauuuuauuuuauuaug

SEQ ID NO: 1383594 - RNA, 15 nt, Human
acaccaugauuccuu

SEQ ID NO: 1383595 - RNA, 21 nt, Human
acaccauagguagaauguaaa

SEQ ID NO: 1383596 - RNA, 17 nt, Human
acaccauagguagaaug

SEQ ID NO: 1383597 - RNA, 21 nt, Human
acacauuuuauuuuauuaugc

SEQ ID NO: 1383598 - RNA, 20 nt, Human
acaccaugauuccuuuaaca

SEQ ID NO: 1383599 - RNA, 17 nt, Human
acaccauugaaggcuua

SEQ ID NO: 1383600 - RNA, 18 nt, Human
acaccaugauuccuuuaa

SEQ ID NO: 1383601 - RNA, 16 nt, Human
acaccaugauuccuuu

SEQ ID NO: 1383602 - RNA, 19 nt, Human
acacccaaagagguauuua

SEQ ID NO: 1383603 - RNA, 20 nt, Human
acacccaaagagguauuuau

SEQ ID NO: 1383604 - RNA, 16 nt, Human
acacccucacacuggg

SEQ ID NO: 1383605 - RNA, 13 nt, Human
acacccucacacu

SEQ ID NO: 1383606 - RNA, 16 nt, Human
acaccucuuggggagu

SEQ ID NO: 1383607 - RNA, 22 nt, Human
acacccuucucccacucuccua

SEQ ID NO: 1383608 - RNA, 21 nt, Human
acacccuucucccacucuccu

SEQ ID NO: 1383609 - RNA, 17 nt, Human
acacccuucucccacuc

SEQ ID NO: 1383610 - RNA, 23 nt, Human
acaccuuggacauccuccuccca

SEQ ID NO: 1383611 - RNA, 20 nt, Human
acaccuuccagcuccuguaa

SEQ ID NO: 1383612 - RNA, 16 nt, Human
acaccuuccagcuccu

SEQ ID NO: 1383613 - RNA, 14 nt, Human
acaccuuccagcuc

SEQ ID NO: 1383614 - RNA, 20 nt, Human
acaccuguagcacuuacugg

SEQ ID NO: 1383615 - RNA, 23 nt, Human
acaccugcccugcccugccaccu

SEQ ID NO: 1383616 - RNA, 16 nt, Human
acaccuuuagguucuu

SEQ ID NO: 1383617 - RNA, 15 nt, Human
acaccuuuagguucu

SEQ ID NO: 1383618 - RNA, 22 nt, Human
acaccuuggacauccuccuccc

SEQ ID NO: 1383619 - RNA, 21 nt, Human
acaccuuuuauugacacagaa

SEQ ID NO: 1383620 - RNA, 23 nt, Human
acaccuuuuauugacacagaaaa

SEQ ID NO: 1383621 - RNA, 14 nt, Human
acacuaagagagaa

SEQ ID NO: 1383622 - RNA, 13 nt, Human
acacuaagagaga

SEQ ID NO: 1383623 - RNA, 15 nt, Human
uauaaguguguguuu

SEQ ID NO: 1383624 - RNA, 18 nt, Human
uauuacuuguaaauauaa

SEQ ID NO: 1383625 - RNA, 23 nt, Human
uauuacuuauuuuugacaguguu

SEQ ID NO: 1383626 - RNA, 16 nt, Human
uauuaaaauguaugca

SEQ ID NO: 1383627 - RNA, 13 nt, Human
uauuaaaauguau

SEQ ID NO: 1383628 - RNA, 12 nt, Human
uauuaaaaugua

SEQ ID NO: 1383629 - RNA, 22 nt, Human
uauuacguaugucugguucuca

SEQ ID NO: 1383630 - RNA, 16 nt, Human
uauuacguaugucugg

SEQ ID NO: 1383631 - RNA, 16 nt, Human
uauuacgguuugcccc

SEQ ID NO: 1383632 - RNA, 14 nt, Human
uauuacuguaagaa

SEQ ID NO: 1383633 - RNA, 17 nt, Human
uauuaguauuguugucc

SEQ ID NO: 1383634 - RNA, 16 nt, Human
uauuaguauuguuguc

SEQ ID NO: 1383635 - RNA, 15 nt, Human
uauuaguauuguugu

SEQ ID NO: 1383636 - RNA, 13 nt, Human
uauuaguauuguu

SEQ ID NO: 1383637 - RNA, 21 nt, Human
uauuaggugcaauuucaaggu

SEQ ID NO: 1383638 - RNA, 17 nt, Human
uauuaggugcaauuuca

SEQ ID NO: 1383639 - RNA, 22 nt, Human
uauuacuuguaaauauaaagac

SEQ ID NO: 1383640 - RNA, 23 nt, Human
uauuacuuguaaauauaaagacg

SEQ ID NO: 1383641 - RNA, 21 nt, Human
uauuacuuguaaauauaaaga

SEQ ID NO: 1383642 - RNA, 19 nt, Human
uauuacuuguaaauauaaa

SEQ ID NO: 1383643 - RNA, 15 nt, Human
uauuagaauaccaca

SEQ ID NO: 1383644 - RNA, 21 nt, Human
uauuaguauuguuguccuuuu

SEQ ID NO: 1383645 - RNA, 20 nt, Human
uauuaguauuguuguccuuu

SEQ ID NO: 1383646 - RNA, 19 nt, Human
uauuaguauuguuguccuu

SEQ ID NO: 1383647 - RNA, 23 nt, Human
uauucaaaaauuaucuauagcua

SEQ ID NO: 1383648 - RNA, 20 nt, Human
acaggcucaaacaaugacaa

SEQ ID NO: 1383649 - RNA, 20 nt, Human
acaggcgugagccaccucgc

SEQ ID NO: 1383650 - RNA, 19 nt, Human
acaggcgugagccaccucg

SEQ ID NO: 1383651 - RNA, 16 nt, Human
acaggcucaggcaggg

SEQ ID NO: 1383652 - RNA, 15 nt, Human
acaggcucaggcagg

SEQ ID NO: 1383653 - RNA, 14 nt, Human
acaggcucaggcag

SEQ ID NO: 1383654 - RNA, 12 nt, Human
acaggcucaggc

SEQ ID NO: 1383655 - RNA, 15 nt, Human
uauucagugucacug

SEQ ID NO: 1383656 - RNA, 14 nt, Human
uauucauaauuauu

SEQ ID NO: 1383657 - RNA, 12 nt, Human
uauucaauaaag

SEQ ID NO: 1383658 - RNA, 13 nt, Human
uauucaauaaagc

SEQ ID NO: 1383659 - RNA, 21 nt, Human
uauucaauaaaguauuuaauu

SEQ ID NO: 1383660 - RNA, 19 nt, Human
uauucaauaaaguauuuaa

SEQ ID NO: 1383661 - RNA, 20 nt, Human
uauucaauaaaguauuuaau

SEQ ID NO: 1383662 - RNA, 14 nt, Human
uauucaauaaagcu

SEQ ID NO: 1383663 - RNA, 14 nt, Human
uauucaauaaagua

SEQ ID NO: 1383664 - RNA, 15 nt, Human
uauucaauaaaguau

SEQ ID NO: 1383665 - RNA, 17 nt, Human
uauucaauaaaguauuu

SEQ ID NO: 1383666 - RNA, 16 nt, Human
uauucaauucuuuuaa

SEQ ID NO: 1383667 - RNA, 21 nt, Human
uauucagcucauggacuucug

SEQ ID NO: 1383668 - RNA, 22 nt, Human
acagggaaggcaggcagggcuc

SEQ ID NO: 1383669 - RNA, 21 nt, Human
acagggaaggcaggcagggcu

SEQ ID NO: 1383670 - RNA, 20 nt, Human
acagggaaggcaggcagggc

SEQ ID NO: 1383671 - RNA, 19 nt, Human
acagggaaggcaggcaggg

SEQ ID NO: 1383672 - RNA, 17 nt, Human
acagggaaggcaggcag

SEQ ID NO: 1383673 - RNA, 15 nt, Human
acagggaaggcaggc

SEQ ID NO: 1383674 - RNA, 14 nt, Human
acagggaaggcagg

SEQ ID NO: 1383675 - RNA, 13 nt, Human
acagggaaggcag

SEQ ID NO: 1383676 - RNA, 12 nt, Human
acagggaaggca

SEQ ID NO: 1383677 - RNA, 16 nt, Human
acaggcuucugagcag

SEQ ID NO: 1383678 - RNA, 21 nt, Human
acaggcuggaagauagcugug

SEQ ID NO: 1383679 - RNA, 23 nt, Human
acaggcuucugagcagcgagccu

SEQ ID NO: 1383680 - RNA, 18 nt, Human
acaggcuucugagcagcg

SEQ ID NO: 1383681 - RNA, 17 nt, Human
acaggcuucugagcagc

SEQ ID NO: 1383682 - RNA, 22 nt, Human
acagggaauuaggcccccauca

SEQ ID NO: 1383683 - RNA, 23 nt, Human
acagggaaggcaggcagggcucu

SEQ ID NO: 1383684 - RNA, 20 nt, Human
acaggcucuuagcagcuucc

SEQ ID NO: 1383685 - RNA, 19 nt, Human
acaggcucuuagcagcuuc

SEQ ID NO: 1383686 - RNA, 15 nt, Human
acaggcucuuagcag

SEQ ID NO: 1383687 - RNA, 13 nt, Human
acaggcucuuagc

SEQ ID NO: 1383688 - RNA, 20 nt, Human
acaggcuggaagauagcugu

SEQ ID NO: 1383689 - RNA, 18 nt, Human
acaggcuggaagauagcu

SEQ ID NO: 1383690 - RNA, 13 nt, Human
acaguaggagccc

SEQ ID NO: 1383691 - RNA, 15 nt, Human
acaguacccaaacug

SEQ ID NO: 1383692 - RNA, 14 nt, Human
acaguacacuguca

SEQ ID NO: 1383693 - RNA, 22 nt, Human
acagggauaaggccuguggggg

SEQ ID NO: 1383694 - RNA, 18 nt, Human
acagggauaaggccugug

SEQ ID NO: 1383695 - RNA, 14 nt, Human
acagucacugcucu

SEQ ID NO: 1383696 - RNA, 18 nt, Human
acagucaccucauggaau

SEQ ID NO: 1383697 - RNA, 17 nt, Human
acagucaccucauggaa

SEQ ID NO: 1383698 - RNA, 16 nt, Human
acagucaccucaugga

SEQ ID NO: 1383699 - RNA, 14 nt, Human
acaguagucuugau

SEQ ID NO: 1383700 - RNA, 22 nt, Human
acaguaggagcccagcucugaa

SEQ ID NO: 1383701 - RNA, 14 nt, Human
acaguaggagccca

SEQ ID NO: 1383702 - RNA, 23 nt, Human
acaguagucuugaugaccaaagu

SEQ ID NO: 1383703 - RNA, 22 nt, Human
acagcuuuugcaacuuaauacu

SEQ ID NO: 1383704 - RNA, 15 nt, Human
acagcuuuugcaacu

SEQ ID NO: 1383705 - RNA, 14 nt, Human
acagcuuuugcaac

SEQ ID NO: 1383706 - RNA, 13 nt, Human
acagcuuuugcaa

SEQ ID NO: 1383707 - RNA, 12 nt, Human
acagcuuuugca

SEQ ID NO: 1383708 - RNA, 15 nt, Human
acagccugcaaguca

SEQ ID NO: 1383709 - RNA, 13 nt, Human
acagcguuccuag

SEQ ID NO: 1383710 - RNA, 22 nt, Human
acagcguuccuagagaagacag

SEQ ID NO: 1383711 - RNA, 21 nt, Human
acagcuuuugcaacuuaauac

SEQ ID NO: 1383712 - RNA, 12 nt, Human
acaggaaaaagu

SEQ ID NO: 1383713 - RNA, 24 nt, Human
acaggacuaacacucagaagccug

SEQ ID NO: 1383714 - RNA, 23 nt, Human
acaggacuaacacucagaagccu

SEQ ID NO: 1383715 - RNA, 22 nt, Human
acaggacuaacacucagaagcc

SEQ ID NO: 1383716 - RNA, 21 nt, Human
acaggacuaacacucagaagc

SEQ ID NO: 1383717 - RNA, 20 nt, Human
acaggacuaacacucagaag

SEQ ID NO: 1383718 - RNA, 19 nt, Human
acaggacuaacacucagaa

SEQ ID NO: 1383719 - RNA, 18 nt, Human
acaggacuaacacucaga

SEQ ID NO: 1383720 - RNA, 16 nt, Human
acaggacuaacacuca

SEQ ID NO: 1383721 - RNA, 22 nt, Human
acaggacaugcgguagccagca

SEQ ID NO: 1383722 - RNA, 21 nt, Human
acaggaguguccucuucccuc

SEQ ID NO: 1383723 - RNA, 17 nt, Human
acaggaguguccucuuc

SEQ ID NO: 1383724 - RNA, 20 nt, Human
acaggagggggucguggaga

SEQ ID NO: 1383725 - RNA, 23 nt, Human
acaggagggggucguggagagcu

SEQ ID NO: 1383726 - RNA, 20 nt, Human
acaggagggcggccuccuuc

SEQ ID NO: 1383727 - RNA, 19 nt, Human
acaggagggcggccuccuu

SEQ ID NO: 1383728 - RNA, 23 nt, Human
acaggaguguccucuucccucuc

SEQ ID NO: 1383729 - RNA, 16 nt, Human
acaggcaugugucacc

SEQ ID NO: 1383730 - RNA, 19 nt, Human
acaggcaugugucaccaug

SEQ ID NO: 1383731 - RNA, 18 nt, Human
acaggcauuuccugggug

SEQ ID NO: 1383732 - RNA, 20 nt, Human
acaggcauuuccuggguggc

SEQ ID NO: 1383733 - RNA, 17 nt, Human
acaggcauuuccugggu

SEQ ID NO: 1383734 - RNA, 14 nt, Human
uaugugaaacaugu

SEQ ID NO: 1383735 - RNA, 21 nt, Human
uaugugacauuuuacauuaaa

SEQ ID NO: 1383736 - RNA, 19 nt, Human
uaugugacauuuuacauua

SEQ ID NO: 1383737 - RNA, 22 nt, Human
uaugugaacaguuguguuugaa

SEQ ID NO: 1383738 - RNA, 12 nt, Human
uaugugaacagu

SEQ ID NO: 1383739 - RNA, 17 nt, Human
uaugugaaacauguuuc

SEQ ID NO: 1383740 - RNA, 14 nt, Human
uaugugacauuuua

SEQ ID NO: 1383741 - RNA, 18 nt, Human
uaugugacauuuuacauu

SEQ ID NO: 1383742 - RNA, 18 nt, Human
uauuaaaagacucauccg

SEQ ID NO: 1383743 - RNA, 16 nt, Human
uauuaaaagacucauc

SEQ ID NO: 1383744 - RNA, 15 nt, Human
uauuaaaagacucau

SEQ ID NO: 1383745 - RNA, 14 nt, Human
uauuaaaagacuca

SEQ ID NO: 1383746 - RNA, 13 nt, Human
uauuaaaagacuc

SEQ ID NO: 1383747 - RNA, 12 nt, Human
uauuaaaagacu

SEQ ID NO: 1383748 - RNA, 20 nt, Human
uauuaaaaagguuuacagaa

SEQ ID NO: 1383749 - RNA, 15 nt, Human
uauguuuuuguucaa

SEQ ID NO: 1383750 - RNA, 16 nt, Human
uauguuuuuguucaaa

SEQ ID NO: 1383751 - RNA, 13 nt, Human
uauguuuuuaaug

SEQ ID NO: 1383752 - RNA, 18 nt, Human
uauguuuucgaaaaucaa

SEQ ID NO: 1383753 - RNA, 23 nt, Human
uaugugggcagauuuucagcaaa

SEQ ID NO: 1383754 - RNA, 17 nt, Human
uaugugggcagauuuuc

SEQ ID NO: 1383755 - RNA, 20 nt, Human
uauguguaugcacaguaaaa

SEQ ID NO: 1383756 - RNA, 19 nt, Human
uauauuauauggaaauaua

SEQ ID NO: 1383757 - RNA, 13 nt, Human
uauauuauaugga

SEQ ID NO: 1383758 - RNA, 20 nt, Human
uauauuauacuuguaauuau

SEQ ID NO: 1383759 - RNA, 18 nt, Human
uauauuauacuuguaauu

SEQ ID NO: 1383760 - RNA, 17 nt, Human
uauauuauacuuguaau

SEQ ID NO: 1383761 - RNA, 12 nt, Human
uauauuacaaug

SEQ ID NO: 1383762 - RNA, 13 nt, Human
uauauuacaauga

SEQ ID NO: 1383763 - RNA, 17 nt, Human
uauauuacagauauuug

SEQ ID NO: 1383764 - RNA, 22 nt, Human
uauauuacacuacacacugugu

SEQ ID NO: 1383765 - RNA, 17 nt, Human
uauauuacaaugaucac

SEQ ID NO: 1383766 - RNA, 18 nt, Human
uauauuguguuuguguau

SEQ ID NO: 1383767 - RNA, 14 nt, Human
uauauuguaauuua

SEQ ID NO: 1383768 - RNA, 12 nt, Human
uauauuguaauu

SEQ ID NO: 1383769 - RNA, 14 nt, Human
uauauuauauggaa

SEQ ID NO: 1383770 - RNA, 19 nt, Human
uauauuguguuuguguauu

SEQ ID NO: 1383771 - RNA, 15 nt, Human
uauauuguuugcuaa

SEQ ID NO: 1383772 - RNA, 19 nt, Human
uauauuguucagcaugcaa

SEQ ID NO: 1383773 - RNA, 16 nt, Human
uauauuuaguaucuuu

SEQ ID NO: 1383774 - RNA, 18 nt, Human
uauaaguguacauaugug

SEQ ID NO: 1383775 - RNA, 15 nt, Human
uauaaguguacauau

SEQ ID NO: 1383776 - RNA, 17 nt, Human
uauaaguguguguuuuu

SEQ ID NO: 1383777 - RNA, 23 nt, Human
uauaaguguguguuuuucauaaa

SEQ ID NO: 1383778 - RNA, 14 nt, Human
acagaaauguacag

SEQ ID NO: 1383779 - RNA, 16 nt, Human
acagaaauguacagca

SEQ ID NO: 1383780 - RNA, 17 nt, Human
acagaaauguacagcaa

SEQ ID NO: 1383781 - RNA, 16 nt, Human
uauccuaaacaucauu

SEQ ID NO: 1383782 - RNA, 18 nt, Human
uauccggacagagcacgu

SEQ ID NO: 1383783 - RNA, 17 nt, Human
uauccauauugagucaa

SEQ ID NO: 1383784 - RNA, 24 nt, Human
uauccauaaugcauucuucucugu

SEQ ID NO: 1383785 - RNA, 19 nt, Human
uauccagguucccucccag

SEQ ID NO: 1383786 - RNA, 18 nt, Human
uauccagguaauccaaga

SEQ ID NO: 1383787 - RNA, 21 nt, Human
uauccagguaauccaagauau

SEQ ID NO: 1383788 - RNA, 18 nt, Human
uauccacuuugcacagcu

SEQ ID NO: 1383789 - RNA, 15 nt, Human
uauccacuuugcaca

SEQ ID NO: 1383790 - RNA, 13 nt, Human
uauccaaaagcuu

SEQ ID NO: 1383791 - RNA, 18 nt, Human
uaucauuuaauaauauac

SEQ ID NO: 1383792 - RNA, 19 nt, Human
uaucauuuaauaauauacu

SEQ ID NO: 1383793 - RNA, 20 nt, Human
uaucauuuaauaauauacuu

SEQ ID NO: 1383794 - RNA, 21 nt, Human
uaucauuuaauaauauacuug

SEQ ID NO: 1383795 - RNA, 22 nt, Human
uaucauuuaauaauauacuugu

SEQ ID NO: 1383796 - RNA, 19 nt, Human
uaucaacuuccuaaauauu

SEQ ID NO: 1383797 - RNA, 14 nt, Human
uaucaacuuccuaa

SEQ ID NO: 1383798 - RNA, 19 nt, Human
uaucaaccccagacacugg

SEQ ID NO: 1383799 - RNA, 21 nt, Human
uaucaaccccagacacugguu

SEQ ID NO: 1383800 - RNA, 18 nt, Human
uaucaaccccagacacug

SEQ ID NO: 1383801 - RNA, 17 nt, Human
uaucaaccccagacacu

SEQ ID NO: 1383802 - RNA, 21 nt, Human
uaucaaggucguuuuuuucau

SEQ ID NO: 1383803 - RNA, 18 nt, Human
uaucaaguauuauaccuu

SEQ ID NO: 1383804 - RNA, 19 nt, Human
acagagaagucacagggca

SEQ ID NO: 1383805 - RNA, 18 nt, Human
acagagaagucacagggc

SEQ ID NO: 1383806 - RNA, 17 nt, Human
acagagaagucacaggg

SEQ ID NO: 1383807 - RNA, 16 nt, Human
acagagaagucacagg

SEQ ID NO: 1383808 - RNA, 14 nt, Human
acagagaagucaca

SEQ ID NO: 1383809 - RNA, 13 nt, Human
acagagaagucac

SEQ ID NO: 1383810 - RNA, 12 nt, Human
acagagaaguca

SEQ ID NO: 1383811 - RNA, 22 nt, Human
acagagaagccuucaagcucug

SEQ ID NO: 1383812 - RNA, 23 nt, Human
acagagaagccuucaagcucuga

SEQ ID NO: 1383813 - RNA, 20 nt, Human
acagagaagccuucaagcuc

SEQ ID NO: 1383814 - RNA, 16 nt, Human
acagagaagccuucaa

SEQ ID NO: 1383815 - RNA, 15 nt, Human
acagagaagccuuca

SEQ ID NO: 1383816 - RNA, 14 nt, Human
acagagaagccuuc

SEQ ID NO: 1383817 - RNA, 13 nt, Human
acagagaagccuu

SEQ ID NO: 1383818 - RNA, 12 nt, Human
acagagaagccu

SEQ ID NO: 1383819 - RNA, 21 nt, Human
acagagaagccaucaccucag

SEQ ID NO: 1383820 - RNA, 20 nt, Human
acagagaagccaucaccuca

SEQ ID NO: 1383821 - RNA, 15 nt, Human
acagagaagccauca

SEQ ID NO: 1383822 - RNA, 14 nt, Human
acagagaagccauc

SEQ ID NO: 1383823 - RNA, 13 nt, Human
acagagaagccau

SEQ ID NO: 1383824 - RNA, 19 nt, Human
acagagaagccagcuuguu

SEQ ID NO: 1383825 - RNA, 18 nt, Human
acagagaagccagcuugu

SEQ ID NO: 1383826 - RNA, 17 nt, Human
acagagaagccagcuug

SEQ ID NO: 1383827 - RNA, 16 nt, Human
acagagaagccagcuu

SEQ ID NO: 1383828 - RNA, 15 nt, Human
acagagaagccagcu

SEQ ID NO: 1383829 - RNA, 14 nt, Human
acagagaagccagc

SEQ ID NO: 1383830 - RNA, 13 nt, Human
acagagaagccag

SEQ ID NO: 1383831 - RNA, 12 nt, Human
acagagaagcca

SEQ ID NO: 1383832 - RNA, 11 nt, Human
acagagaagcc

SEQ ID NO: 1383833 - RNA, 10 nt, Human
acagagaagc

SEQ ID NO: 1383834 - RNA, 9 nt, Human
acagagaag

SEQ ID NO: 1383835 - RNA, 23 nt, Human
acagagaaaccagcuuccuucag

SEQ ID NO: 1383836 - RNA, 22 nt, Human
acagagaaaccagcuuccuuca

SEQ ID NO: 1383837 - RNA, 20 nt, Human
acagagaaaccagcuuccuu

SEQ ID NO: 1383838 - RNA, 19 nt, Human
acagagaaaccagcuuccu

SEQ ID NO: 1383839 - RNA, 18 nt, Human
acagagaaaccagcuucc

SEQ ID NO: 1383840 - RNA, 17 nt, Human
acagagaaaccagcuuc

SEQ ID NO: 1383841 - RNA, 16 nt, Human
acagagaaaccagcuu

SEQ ID NO: 1383842 - RNA, 18 nt, Human
uaucuccagcggcccugu

SEQ ID NO: 1383843 - RNA, 16 nt, Human
uaucuccagcggcccu

SEQ ID NO: 1383844 - RNA, 11 nt, Human
uaucucaucuc

SEQ ID NO: 1383845 - RNA, 23 nt, Human
uaucuauauuuuacauaaauuua

SEQ ID NO: 1383846 - RNA, 18 nt, Human
acagaugccacacaagga

SEQ ID NO: 1383847 - RNA, 13 nt, Human
acagaugagucac

SEQ ID NO: 1383848 - RNA, 22 nt, Human
acagaucuggaaccucagccug

SEQ ID NO: 1383849 - RNA, 21 nt, Human
acagaucuggaaccucagccu

SEQ ID NO: 1383850 - RNA, 20 nt, Human
acagaucuggaaccucagcc

SEQ ID NO: 1383851 - RNA, 16 nt, Human
acagaucuggaaccuc

SEQ ID NO: 1383852 - RNA, 14 nt, Human
acagaucuggaacc

SEQ ID NO: 1383853 - RNA, 15 nt, Human
acagauuguuugcaa

SEQ ID NO: 1383854 - RNA, 14 nt, Human
acagauuguuugca

SEQ ID NO: 1383855 - RNA, 17 nt, Human
acagcaaggagauuuac

SEQ ID NO: 1383856 - RNA, 21 nt, Human
acagagaagucacagggcagu

SEQ ID NO: 1383857 - RNA, 12 nt, Human
acagaucuggaa

SEQ ID NO: 1383858 - RNA, 22 nt, Human
acagaucaucuuggaacugcau

SEQ ID NO: 1383859 - RNA, 23 nt, Human
acagaucgaaccguuuugaagcu

SEQ ID NO: 1383860 - RNA, 12 nt, Human
acagaucaguaa

SEQ ID NO: 1383861 - RNA, 12 nt, Human
acagauauauuu

SEQ ID NO: 1383862 - RNA, 21 nt, Human
acagcaaggagauuuacaacu

SEQ ID NO: 1383863 - RNA, 11 nt, Human
uaucuuugcca

SEQ ID NO: 1383864 - RNA, 14 nt, Human
uaucuuugccaccc

SEQ ID NO: 1383865 - RNA, 16 nt, Human
uaucuuugccacccuc

SEQ ID NO: 1383866 - RNA, 14 nt, Human
uaugaacauauugu

SEQ ID NO: 1383867 - RNA, 18 nt, Human
uaucuuuuuaccuuucau

SEQ ID NO: 1383868 - RNA, 21 nt, Human
uaucuuuucauacauuuucua

SEQ ID NO: 1383869 - RNA, 23 nt, Human
uaucuuuucauacauuuucuaag

SEQ ID NO: 1383870 - RNA, 22 nt, Human
uaucuuugccacccucaugcug

SEQ ID NO: 1383871 - RNA, 21 nt, Human
uaugauuaaguaaugauaacu

SEQ ID NO: 1383872 - RNA, 11 nt, Human
uaugcauuuga

SEQ ID NO: 1383873 - RNA, 23 nt, Human
uaugcauuugaaaauuuugaugu

SEQ ID NO: 1383874 - RNA, 24 nt, Human
uaugcauuugaaaauuuugauguu

SEQ ID NO: 1383875 - RNA, 20 nt, Human
uaugauuaaguaaugauaac

SEQ ID NO: 1383876 - RNA, 16 nt, Human
uaugauuaaguaauga

SEQ ID NO: 1383877 - RNA, 17 nt, Human
uaugaacauauuguuga

SEQ ID NO: 1383878 - RNA, 19 nt, Human
uaugaacauauuguugaaa

SEQ ID NO: 1383879 - RNA, 16 nt, Human
uaugaacuugaggaca

SEQ ID NO: 1383880 - RNA, 18 nt, Human
uaugaacuugaggacaca

SEQ ID NO: 1383881 - RNA, 19 nt, Human
uaugaacuugaggacacau

SEQ ID NO: 1383882 - RNA, 18 nt, Human
uaugccugcuauuugaag

SEQ ID NO: 1383883 - RNA, 15 nt, Human
uaugcuaccaccagc

SEQ ID NO: 1383884 - RNA, 14 nt, Human
uaugcuaccaccag

SEQ ID NO: 1383885 - RNA, 13 nt, Human
uaugcuaaucagg

SEQ ID NO: 1383886 - RNA, 13 nt, Human
uaugcgguuaauu

SEQ ID NO: 1383887 - RNA, 16 nt, Human
uaugccuuguuucaua

SEQ ID NO: 1383888 - RNA, 14 nt, Human
uaugccugcuauuu

SEQ ID NO: 1383889 - RNA, 16 nt, Human
uaugccucuguauuua

SEQ ID NO: 1383890 - RNA, 22 nt, Human
uaugcauuuaaauacagucuuc

SEQ ID NO: 1383891 - RNA, 21 nt, Human
uaugcauuuaaauacagucuu

SEQ ID NO: 1383892 - RNA, 19 nt, Human
uaugccccauucaacaucu

SEQ ID NO: 1383893 - RNA, 21 nt, Human
uaugcuuacugauauauuuua

SEQ ID NO: 1383894 - RNA, 16 nt, Human
uaugcuuacugauaua

SEQ ID NO: 1383895 - RNA, 19 nt, Human
uaugcuuaaaauaagcagg

SEQ ID NO: 1383896 - RNA, 17 nt, Human
uauggcuuuugugcauu

SEQ ID NO: 1383897 - RNA, 18 nt, Human
uauggcuuuugugcauua

SEQ ID NO: 1383898 - RNA, 21 nt, Human
uauggcuuuugugcauuaucu

SEQ ID NO: 1383899 - RNA, 15 nt, Human
uaugcugauuuauuu

SEQ ID NO: 1383900 - RNA, 19 nt, Human
uaugcuaccaccagcugug

SEQ ID NO: 1383901 - RNA, 18 nt, Human
uaugcuaccaccagcugu

SEQ ID NO: 1383902 - RNA, 17 nt, Human
uaugcuaccaccagcug

SEQ ID NO: 1383903 - RNA, 15 nt, Human
uaugcuuacugauau

SEQ ID NO: 1383904 - RNA, 16 nt, Human
uaugcuuaaaauaagc

SEQ ID NO: 1383905 - RNA, 13 nt, Human
uaugcuuaaaaua

SEQ ID NO: 1383906 - RNA, 15 nt, Human
uaugcuguacccagu

SEQ ID NO: 1383907 - RNA, 19 nt, Human
uaugguaacugcuuucugu

SEQ ID NO: 1383908 - RNA, 11 nt, Human
uaugguaaaaa

SEQ ID NO: 1383909 - RNA, 15 nt, Human
uaugggucacaggaa

SEQ ID NO: 1383910 - RNA, 14 nt, Human
uaugggucacagga

SEQ ID NO: 1383911 - RNA, 13 nt, Human
uaugggucacagg

SEQ ID NO: 1383912 - RNA, 11 nt, Human
uaugggucaca

SEQ ID NO: 1383913 - RNA, 19 nt, Human
uauggguaggguaaaucag

SEQ ID NO: 1383914 - RNA, 18 nt, Human
uauggguaggguaaauca

SEQ ID NO: 1383915 - RNA, 23 nt, Human
uauggggguuguaaauuggcaug

SEQ ID NO: 1383916 - RNA, 19 nt, Human
uauggggguuguaaauugg

SEQ ID NO: 1383917 - RNA, 17 nt, Human
uauggggaugguaguuu

SEQ ID NO: 1383918 - RNA, 23 nt, Human
uauggcuuuugugcauuaucuag

SEQ ID NO: 1383919 - RNA, 21 nt, Human
acagccugacaacauuucuau

SEQ ID NO: 1383920 - RNA, 20 nt, Human
acagccugacaacauuucua

SEQ ID NO: 1383921 - RNA, 17 nt, Human
acagccugacaacauuu

SEQ ID NO: 1383922 - RNA, 17 nt, Human
uaugguaccagaugcag

SEQ ID NO: 1383923 - RNA, 16 nt, Human
uaugguaccagaugca

SEQ ID NO: 1383924 - RNA, 15 nt, Human
uaugguaaaaaauuu

SEQ ID NO: 1383925 - RNA, 16 nt, Human
acagccucuuagaugc

SEQ ID NO: 1383926 - RNA, 22 nt, Human
aauuccuauacgcagcgugcuu

SEQ ID NO: 1383927 - RNA, 13 nt, Human
aauuccgucacca

SEQ ID NO: 1383928 - RNA, 20 nt, Human
aauucccucacucgucuccc

SEQ ID NO: 1383929 - RNA, 21 nt, Human
aauucccguuuugucacuuuu

SEQ ID NO: 1383930 - RNA, 20 nt, Human
aauucccguuuugucacuuu

SEQ ID NO: 1383931 - RNA, 19 nt, Human
uacgagagcagaggucucc

SEQ ID NO: 1383932 - RNA, 13 nt, Human
uacgaugcuucaa

SEQ ID NO: 1383933 - RNA, 22 nt, Human
uacgcagcgugcuuuaaaaaau

SEQ ID NO: 1383934 - RNA, 20 nt, Human
uacgguuugccccuuuauaa

SEQ ID NO: 1383935 - RNA, 13 nt, Human
uacggugggggua

SEQ ID NO: 1383936 - RNA, 12 nt, Human
uacggugggggu

SEQ ID NO: 1383937 - RNA, 12 nt, Human
uacguacacauu

SEQ ID NO: 1383938 - RNA, 13 nt, Human
uacguacacauuu

SEQ ID NO: 1383939 - RNA, 14 nt, Human
uacguacacauuuu

SEQ ID NO: 1383940 - RNA, 15 nt, Human
uacguugugcauuug

SEQ ID NO: 1383941 - RNA, 16 nt, Human
uacguugugcauuugg

SEQ ID NO: 1383942 - RNA, 23 nt, Human
uacuauggcccuggccuagcaua

SEQ ID NO: 1383943 - RNA, 19 nt, Human
uacguaauaagguuuuaau

SEQ ID NO: 1383944 - RNA, 16 nt, Human
uacguaauaagguuuu

SEQ ID NO: 1383945 - RNA, 18 nt, Human
uacuaaaaaaaagaugaa

SEQ ID NO: 1383946 - RNA, 16 nt, Human
uacuaaaaaaaagaug

SEQ ID NO: 1383947 - RNA, 14 nt, Human
uacuacuguguaag

SEQ ID NO: 1383948 - RNA, 14 nt, Human
uacuauauuuaugg

SEQ ID NO: 1383949 - RNA, 12 nt, Human
uacuauaguacc

SEQ ID NO: 1383950 - RNA, 13 nt, Human
uacuauaguacca

SEQ ID NO: 1383951 - RNA, 16 nt, Human
uacuauaguaccagua

SEQ ID NO: 1383952 - RNA, 19 nt, Human
uacucugugccagagccug

SEQ ID NO: 1383953 - RNA, 18 nt, Human
uacucugugccagagccu

SEQ ID NO: 1383954 - RNA, 17 nt, Human
uacucugugccagagcc

SEQ ID NO: 1383955 - RNA, 16 nt, Human
uacucugugccagagc

SEQ ID NO: 1383956 - RNA, 15 nt, Human
uacucugugccagag

SEQ ID NO: 1383957 - RNA, 14 nt, Human
uacucugugccaga

SEQ ID NO: 1383958 - RNA, 21 nt, Human
uacucugaaauuguaacuaaa

SEQ ID NO: 1383959 - RNA, 23 nt, Human
uacucugugccagagccuggggc

SEQ ID NO: 1383960 - RNA, 22 nt, Human
uacucugugccagagccugggg

SEQ ID NO: 1383961 - RNA, 21 nt, Human
uacucugugccagagccuggg

SEQ ID NO: 1383962 - RNA, 20 nt, Human
uacucugugccagagccugg

SEQ ID NO: 1383963 - RNA, 19 nt, Human
uacuguaaggcaaucaugg

SEQ ID NO: 1383964 - RNA, 18 nt, Human
uacuguaauuugugauac

SEQ ID NO: 1383965 - RNA, 19 nt, Human
uacuguaauuugugauaca

SEQ ID NO: 1383966 - RNA, 20 nt, Human
uacuguaauuugugauacaa

SEQ ID NO: 1383967 - RNA, 18 nt, Human
uacuggccuuuuucauuu

SEQ ID NO: 1383968 - RNA, 23 nt, Human
uacugggaaagggauuuucagcc

SEQ ID NO: 1383969 - RNA, 14 nt, Human
uacuguaagaaaau

SEQ ID NO: 1383970 - RNA, 18 nt, Human
uacuguaaggcaaucaug

SEQ ID NO: 1383971 - RNA, 15 nt, Human
uacuguauauucagg

SEQ ID NO: 1383972 - RNA, 14 nt, Human
uacuguaguauucu

SEQ ID NO: 1383973 - RNA, 14 nt, Human
aauugacugucacu

SEQ ID NO: 1383974 - RNA, 23 nt, Human
uacuguaauuugugauacaaugc

SEQ ID NO: 1383975 - RNA, 21 nt, Human
uacuguacaugaaaacacauu

SEQ ID NO: 1383976 - RNA, 22 nt, Human
uacuguacaugaaaacacauuu

SEQ ID NO: 1383977 - RNA, 23 nt, Human
aauugccugacgaacuccuugau

SEQ ID NO: 1383978 - RNA, 15 nt, Human
aauugccugacgaac

SEQ ID NO: 1383979 - RNA, 20 nt, Human
aauugccauguacaguaugu

SEQ ID NO: 1383980 - RNA, 16 nt, Human
aauugccauauugcac

SEQ ID NO: 1383981 - RNA, 17 nt, Human
aauugccauauugcaca

SEQ ID NO: 1383982 - RNA, 19 nt, Human
aauugccauauugcacaug

SEQ ID NO: 1383983 - RNA, 23 nt, Human
aauugccauauugcacaugucuu

SEQ ID NO: 1383984 - RNA, 23 nt, Human
aauugccaccucuaacagcacca

SEQ ID NO: 1383985 - RNA, 21 nt, Human
aauugccaaaaagugaaauaa

SEQ ID NO: 1383986 - RNA, 12 nt, Human
aauugccauauu

SEQ ID NO: 1383987 - RNA, 13 nt, Human
aauugccauauug

SEQ ID NO: 1383988 - RNA, 15 nt, Human
aauugccauauugca

SEQ ID NO: 1383989 - RNA, 23 nt, Human
aauugccaaaaagugaaauaaug

SEQ ID NO: 1383990 - RNA, 17 nt, Human
aauugaucgacuugcca

SEQ ID NO: 1383991 - RNA, 21 nt, Human
aauugaguaaugguguagaac

SEQ ID NO: 1383992 - RNA, 17 nt, Human
aauugaguuuucagugg

SEQ ID NO: 1383993 - RNA, 18 nt, Human
aauugaguguuuaaaguu

SEQ ID NO: 1383994 - RNA, 16 nt, Human
aauugaguaauggugu

SEQ ID NO: 1383995 - RNA, 19 nt, Human
aauugaugggauuugguca

SEQ ID NO: 1383996 - RNA, 18 nt, Human
aauuccaacaguuuaaug

SEQ ID NO: 1383997 - RNA, 20 nt, Human
aauuccaacaguuuaaugaa

SEQ ID NO: 1383998 - RNA, 18 nt, Human
aauuccaaagucucuaau

SEQ ID NO: 1383999 - RNA, 13 nt, Human
aauuccaaagucu

SEQ ID NO: 1384000 - RNA, 12 nt, Human
aauuccaaaguc

SEQ ID NO: 1384001 - RNA, 21 nt, Human
aauucacccccuuuccuggac

SEQ ID NO: 1384002 - RNA, 21 nt, Human
aauucacaugaugcacuucaa

SEQ ID NO: 1384003 - RNA, 22 nt, Human
aauucacaucuaaccucaucuu

SEQ ID NO: 1384004 - RNA, 21 nt, Human
aauucacaucuaaccucaucu

SEQ ID NO: 1384005 - RNA, 20 nt, Human
aauucacagugcucuuuucu

SEQ ID NO: 1384006 - RNA, 14 nt, Human
aauucacaaacuuu

SEQ ID NO: 1384007 - RNA, 19 nt, Human
aauucacaaacuuuuauac

SEQ ID NO: 1384008 - RNA, 15 nt, Human
aauucaacaaacauu

SEQ ID NO: 1384009 - RNA, 18 nt, Human
aauucauuuuuuaaauuc

SEQ ID NO: 1384010 - RNA, 23 nt, Human
aauucacuuagggucgagcaucc

SEQ ID NO: 1384011 - RNA, 15 nt, Human
aauucacuuaggguc

SEQ ID NO: 1384012 - RNA, 21 nt, Human
aauucacuguacuaucagguu

SEQ ID NO: 1384013 - RNA, 13 nt, Human
aauucacuguacu

SEQ ID NO: 1384014 - RNA, 23 nt, Human
aauucacucugaguguuuuauga

SEQ ID NO: 1384015 - RNA, 12 nt, Human
aauucacucuga

SEQ ID NO: 1384016 - RNA, 18 nt, Human
aauuccaagugauugaaa

SEQ ID NO: 1384017 - RNA, 17 nt, Human
aauucaaauaaaaaucc

SEQ ID NO: 1384018 - RNA, 22 nt, Human
aauucaaagcuguguguuugga

SEQ ID NO: 1384019 - RNA, 23 nt, Human
aauucaaaaguuccaagagucua

SEQ ID NO: 1384020 - RNA, 22 nt, Human
aauucaaaaguuccaagagucu

SEQ ID NO: 1384021 - RNA, 16 nt, Human
aauucaaaaguuccaa

SEQ ID NO: 1384022 - RNA, 16 nt, Human
aauuauuuuuuuucuu

SEQ ID NO: 1384023 - RNA, 19 nt, Human
aauuauuuuuuuucuuuua

SEQ ID NO: 1384024 - RNA, 11 nt, Human
aauuauuuugu

SEQ ID NO: 1384025 - RNA, 13 nt, Human
aauuauuuucauc

SEQ ID NO: 1384026 - RNA, 15 nt, Human
aauuagugccacuua

SEQ ID NO: 1384027 - RNA, 17 nt, Human
aauuaguaacauguguu

SEQ ID NO: 1384028 - RNA, 21 nt, Human
aauuaggcccccaucauccuc

SEQ ID NO: 1384029 - RNA, 23 nt, Human
aauuaggcuguaacuacuuuaua

SEQ ID NO: 1384030 - RNA, 12 nt, Human
aauuauuauuug

SEQ ID NO: 1384031 - RNA, 22 nt, Human
aauuauuauuuauauauguauu

SEQ ID NO: 1384032 - RNA, 20 nt, Human
aauuagugcuaagugugaac

SEQ ID NO: 1384033 - RNA, 21 nt, Human
aauuagugcuaagugugaacu

SEQ ID NO: 1384034 - RNA, 20 nt, Human
aauuagugccacuuaaugua

SEQ ID NO: 1384035 - RNA, 17 nt, Human
aauuagugccacuuaau

SEQ ID NO: 1384036 - RNA, 14 nt, Human
aauuagugcuaagu

SEQ ID NO: 1384037 - RNA, 18 nt, Human
aauuagugcuaaguguga

SEQ ID NO: 1384038 - RNA, 14 nt, Human
aauuauucaauuua

SEQ ID NO: 1384039 - RNA, 18 nt, Human
aauuauuauuuguguuuu

SEQ ID NO: 1384040 - RNA, 16 nt, Human
aauuauuauuuguguu

SEQ ID NO: 1384041 - RNA, 15 nt, Human
aauuauuauuugugu

SEQ ID NO: 1384042 - RNA, 16 nt, Human
aauuauuauuuggccc

SEQ ID NO: 1384043 - RNA, 21 nt, Human
uaccugcucacgucaaaugca

SEQ ID NO: 1384044 - RNA, 17 nt, Human
uaccugcucagcccugc

SEQ ID NO: 1384045 - RNA, 19 nt, Human
uaccuguagauucagguaa

SEQ ID NO: 1384046 - RNA, 14 nt, Human
uaccacucuguaau

SEQ ID NO: 1384047 - RNA, 13 nt, Human
uaccacucuguaa

SEQ ID NO: 1384048 - RNA, 20 nt, Human
uaccugccccacuuguccuu

SEQ ID NO: 1384049 - RNA, 19 nt, Human
uaccacucuguaauugcaa

SEQ ID NO: 1384050 - RNA, 18 nt, Human
uaccacucuguaauugca

SEQ ID NO: 1384051 - RNA, 17 nt, Human
uaccacucuguaauugc

SEQ ID NO: 1384052 - RNA, 16 nt, Human
uaccacucuguaauug

SEQ ID NO: 1384053 - RNA, 15 nt, Human
uaccacucuguaauu

SEQ ID NO: 1384054 - RNA, 22 nt, Human
aauuaggcuguaacuacuuuau

SEQ ID NO: 1384055 - RNA, 21 nt, Human
aauuaggcuguaacuacuuua

SEQ ID NO: 1384056 - RNA, 19 nt, Human
aauuaggcuguaacuacuu

SEQ ID NO: 1384057 - RNA, 18 nt, Human
aauuaggcuguaacuacu

SEQ ID NO: 1384058 - RNA, 17 nt, Human
aauuaggcuguaacuac

SEQ ID NO: 1384059 - RNA, 16 nt, Human
aauuaggcuguaacua

SEQ ID NO: 1384060 - RNA, 15 nt, Human
aauuaggcuguaacu

SEQ ID NO: 1384061 - RNA, 20 nt, Human
aauuaggcccccaucauccu

SEQ ID NO: 1384062 - RNA, 12 nt, Human
aauuagcaauug

SEQ ID NO: 1384063 - RNA, 23 nt, Human
aauuacuguuuauuaaaguacaa

SEQ ID NO: 1384064 - RNA, 14 nt, Human
aauuacugguccaa

SEQ ID NO: 1384065 - RNA, 18 nt, Human
aauuacaaaaaaaaauuu

SEQ ID NO: 1384066 - RNA, 14 nt, Human
aauuacaacuaagu

SEQ ID NO: 1384067 - RNA, 16 nt, Human
aauuacaacuaaguga

SEQ ID NO: 1384068 - RNA, 18 nt, Human
aauuacaacggagucaaa

SEQ ID NO: 1384069 - RNA, 21 nt, Human
aauuaccuugagccaguaauu

SEQ ID NO: 1384070 - RNA, 14 nt, Human
aauuaccuguggau

SEQ ID NO: 1384071 - RNA, 14 nt, Human
aauuaccuacucug

SEQ ID NO: 1384072 - RNA, 22 nt, Human
aauuacagaaauuuaauucaga

SEQ ID NO: 1384073 - RNA, 17 nt, Human
aauuacagaaauuuaau

SEQ ID NO: 1384074 - RNA, 14 nt, Human
aauuacacccaaag

SEQ ID NO: 1384075 - RNA, 14 nt, Human
aauuacgugcucug

SEQ ID NO: 1384076 - RNA, 17 nt, Human
aaugcuguacaucuauu

SEQ ID NO: 1384077 - RNA, 15 nt, Human
aaugcuguacaucua

SEQ ID NO: 1384078 - RNA, 13 nt, Human
aaugcuguacauc

SEQ ID NO: 1384079 - RNA, 12 nt, Human
aaugcuguacau

SEQ ID NO: 1384080 - RNA, 12 nt, Human
aaugcccagaca

SEQ ID NO: 1384081 - RNA, 11 nt, Human
aaugcccagac

SEQ ID NO: 1384082 - RNA, 23 nt, Human
aaugcuguacaucuauuuuggau

SEQ ID NO: 1384083 - RNA, 15 nt, Human
aaugcuuagaaauuc

SEQ ID NO: 1384084 - RNA, 16 nt, Human
aaugcuguauuuuaaa

SEQ ID NO: 1384085 - RNA, 20 nt, Human
aaugcuguauuuuaaaagaa

SEQ ID NO: 1384086 - RNA, 14 nt, Human
aaugcuuaaucaga

SEQ ID NO: 1384087 - RNA, 22 nt, Human
aaugcuuaaucagauagauauu

SEQ ID NO: 1384088 - RNA, 16 nt, Human
aaugcuucaucccuuu

SEQ ID NO: 1384089 - RNA, 14 nt, Human
aauggaaccacucu

SEQ ID NO: 1384090 - RNA, 14 nt, Human
uacaauguaauuau

SEQ ID NO: 1384091 - RNA, 15 nt, Human
uacaauguaauuauu

SEQ ID NO: 1384092 - RNA, 13 nt, Human
uacaauguaauua

SEQ ID NO: 1384093 - RNA, 15 nt, Human
aaugacaaucaugug

SEQ ID NO: 1384094 - RNA, 21 nt, Human
uacaaugcugugcccuaaagu

SEQ ID NO: 1384095 - RNA, 22 nt, Human
aaugccacugccuucgcuucuu

SEQ ID NO: 1384096 - RNA, 23 nt, Human
aaugccacagcccugucagcaug

SEQ ID NO: 1384097 - RNA, 22 nt, Human
aaugccacagcccugucagcau

SEQ ID NO: 1384098 - RNA, 19 nt, Human
aaugccacagcccugucag

SEQ ID NO: 1384099 - RNA, 18 nt, Human
aaugccacagcccuguca

SEQ ID NO: 1384100 - RNA, 16 nt, Human
aaugccacagcccugu

SEQ ID NO: 1384101 - RNA, 15 nt, Human
aaugccacagcccug

SEQ ID NO: 1384102 - RNA, 14 nt, Human
aaugccacagcccu

SEQ ID NO: 1384103 - RNA, 23 nt, Human
aaugccaguaacgcgucuuccug

SEQ ID NO: 1384104 - RNA, 21 nt, Human
aaugccaguaacgcgucuucc

SEQ ID NO: 1384105 - RNA, 22 nt, Human
aaugccaugaugccucugucuu

SEQ ID NO: 1384106 - RNA, 15 nt, Human
aaugccaucaucucc

SEQ ID NO: 1384107 - RNA, 14 nt, Human
aauggcuauguuuu

SEQ ID NO: 1384108 - RNA, 20 nt, Human
aauggcgucuggaaguccaa

SEQ ID NO: 1384109 - RNA, 17 nt, Human
aauggccuucauaucau

SEQ ID NO: 1384110 - RNA, 13 nt, Human
aauggccuuuauu

SEQ ID NO: 1384111 - RNA, 14 nt, Human
aauggccuucauau

SEQ ID NO: 1384112 - RNA, 22 nt, Human
aauggccucauguggcuggaag

SEQ ID NO: 1384113 - RNA, 20 nt, Human
aauggccucauguggcugga

SEQ ID NO: 1384114 - RNA, 15 nt, Human
aauggccucaugugg

SEQ ID NO: 1384115 - RNA, 21 nt, Human
aauggcccugggucccaggac

SEQ ID NO: 1384116 - RNA, 17 nt, Human
aauggccauuugcuuuu

SEQ ID NO: 1384117 - RNA, 20 nt, Human
aauggcaugagaaauacaaa

SEQ ID NO: 1384118 - RNA, 16 nt, Human
aauggcuauguuuuua

SEQ ID NO: 1384119 - RNA, 20 nt, Human
aauggcuauguuuuuaaugu

SEQ ID NO: 1384120 - RNA, 15 nt, Human
aauggcugauaauuu

SEQ ID NO: 1384121 - RNA, 22 nt, Human
aauguaaauauuuuaaagaauu

SEQ ID NO: 1384122 - RNA, 17 nt, Human
aauguaaauuuguacua

SEQ ID NO: 1384123 - RNA, 18 nt, Human
aauguaaauuuguacuau

SEQ ID NO: 1384124 - RNA, 16 nt, Human
aauguaaauuuguacu

SEQ ID NO: 1384125 - RNA, 15 nt, Human
aauguaaauuuguac

SEQ ID NO: 1384126 - RNA, 14 nt, Human
aauguaaauuugua

SEQ ID NO: 1384127 - RNA, 13 nt, Human
aauguaaauuugu

SEQ ID NO: 1384128 - RNA, 12 nt, Human
aauguaaauuug

SEQ ID NO: 1384129 - RNA, 23 nt, Human
aauggcaugagaaauacaaaaau

SEQ ID NO: 1384130 - RNA, 20 nt, Human
aauggcaguuauauuuugca

SEQ ID NO: 1384131 - RNA, 17 nt, Human
aauggcaguuauauuuu

SEQ ID NO: 1384132 - RNA, 19 nt, Human
aauggcagcagggguuggg

SEQ ID NO: 1384133 - RNA, 13 nt, Human
aauggcagcaggg

SEQ ID NO: 1384134 - RNA, 20 nt, Human
aauggauuuuucuuuaacug

SEQ ID NO: 1384135 - RNA, 18 nt, Human
aauggauuuuucuuuaac

SEQ ID NO: 1384136 - RNA, 17 nt, Human
aauggauuuuucuuuaa

SEQ ID NO: 1384137 - RNA, 13 nt, Human
aauggauuuuucu

SEQ ID NO: 1384138 - RNA, 23 nt, Human
aauggacuggaaggggaagggac

SEQ ID NO: 1384139 - RNA, 17 nt, Human
aauggacuggaagggga

SEQ ID NO: 1384140 - RNA, 19 nt, Human
uacagaguguggacucugg

SEQ ID NO: 1384141 - RNA, 17 nt, Human
uacagacgcugcuguca

SEQ ID NO: 1384142 - RNA, 21 nt, Human
uacagauauauuuucuuucuc

SEQ ID NO: 1384143 - RNA, 13 nt, Human
uacagauauauuu

SEQ ID NO: 1384144 - RNA, 23 nt, Human
uacacguauuugaauggccuuca

SEQ ID NO: 1384145 - RNA, 22 nt, Human
aauguaacuuuuguaagacaaa

SEQ ID NO: 1384146 - RNA, 16 nt, Human
aauguaacuuuuguaa

SEQ ID NO: 1384147 - RNA, 15 nt, Human
aauguaacuuuugua

SEQ ID NO: 1384148 - RNA, 21 nt, Human
uacacauuuuauuuuauuaug

SEQ ID NO: 1384149 - RNA, 22 nt, Human
uacacauuuuauuuuauuaugc

SEQ ID NO: 1384150 - RNA, 18 nt, Human
uacacuaagagagaauga

SEQ ID NO: 1384151 - RNA, 14 nt, Human
uacacuaagagaga

SEQ ID NO: 1384152 - RNA, 23 nt, Human
uacacauuuuauuuuauuaugca

SEQ ID NO: 1384153 - RNA, 19 nt, Human
aauguuaagacuugacagu

SEQ ID NO: 1384154 - RNA, 18 nt, Human
aauguuaaauaaauugua

SEQ ID NO: 1384155 - RNA, 20 nt, Human
aauguuaaauaaauuguaua

SEQ ID NO: 1384156 - RNA, 21 nt, Human
aauguuaaauaaauuguauau

SEQ ID NO: 1384157 - RNA, 22 nt, Human
aauguuaaauaaauuguauauu

SEQ ID NO: 1384158 - RNA, 23 nt, Human
aauguuaaauaaauuguauauuc

SEQ ID NO: 1384159 - RNA, 15 nt, Human
aauguuaaaaugugu

SEQ ID NO: 1384160 - RNA, 16 nt, Human
aauguuaaaauguguu

SEQ ID NO: 1384161 - RNA, 13 nt, Human
aauguuaaauaaa

SEQ ID NO: 1384162 - RNA, 15 nt, Human
aauguuaaauaaauu

SEQ ID NO: 1384163 - RNA, 12 nt, Human
aauguuaaaaug

SEQ ID NO: 1384164 - RNA, 13 nt, Human
aauguuaaaaugu

SEQ ID NO: 1384165 - RNA, 23 nt, Human
aauguguuucacaguuugaaaua

SEQ ID NO: 1384166 - RNA, 23 nt, Human
aauguguuguuccaaauacuaau

SEQ ID NO: 1384167 - RNA, 22 nt, Human
aauguucuuuggaaaguacacu

SEQ ID NO: 1384168 - RNA, 21 nt, Human
aauguucuuuggaaaguacac

SEQ ID NO: 1384169 - RNA, 20 nt, Human
aauguucuuuggaaaguaca

SEQ ID NO: 1384170 - RNA, 17 nt, Human
aauguucuuuggaaagu

SEQ ID NO: 1384171 - RNA, 14 nt, Human
aauguucuuuggaa

SEQ ID NO: 1384172 - RNA, 11 nt, Human
aauguucuuug

SEQ ID NO: 1384173 - RNA, 10 nt, Human
aauguucuuu

SEQ ID NO: 1384174 - RNA, 21 nt, Human
aauuaacuggguaaugaaaca

SEQ ID NO: 1384175 - RNA, 18 nt, Human
aauuaacuggguaaugaa

SEQ ID NO: 1384176 - RNA, 11 nt, Human
aauuaacuuuu

SEQ ID NO: 1384177 - RNA, 22 nt, Human
aauguugaaauaugauguuaaa

SEQ ID NO: 1384178 - RNA, 15 nt, Human
aauguugaaauauga

SEQ ID NO: 1384179 - RNA, 22 nt, Human
uacauguauugcacauuguaaa

SEQ ID NO: 1384180 - RNA, 21 nt, Human
uacauguauugcacauuguaa

SEQ ID NO: 1384181 - RNA, 20 nt, Human
uacauguauugcacauugua

SEQ ID NO: 1384182 - RNA, 19 nt, Human
uacauguauugcacauugu

SEQ ID NO: 1384183 - RNA, 16 nt, Human
uacauguggcccaaca

SEQ ID NO: 1384184 - RNA, 13 nt, Human
uacauucuguuaa

SEQ ID NO: 1384185 - RNA, 16 nt, Human
aauuaagaaggcaaaa

SEQ ID NO: 1384186 - RNA, 14 nt, Human
aauuaagaaggcaa

SEQ ID NO: 1384187 - RNA, 13 nt, Human
aauuaagaaggca

SEQ ID NO: 1384188 - RNA, 23 nt, Human
aauuaagaaggcaaaaauguaaa

SEQ ID NO: 1384189 - RNA, 19 nt, Human
aauuaagaaggcaaaaaug

SEQ ID NO: 1384190 - RNA, 15 nt, Human
aauuaagagagucua

SEQ ID NO: 1384191 - RNA, 22 nt, Human
aauuaacuggguaaugaaacaa

SEQ ID NO: 1384192 - RNA, 21 nt, Human
aauuaagaaaggauaaaguug

SEQ ID NO: 1384193 - RNA, 19 nt, Human
aauuaauaucccuacaugu

SEQ ID NO: 1384194 - RNA, 21 nt, Human
aauuaauaucccuacauguau

SEQ ID NO: 1384195 - RNA, 23 nt, Human
aauuaauuccuguuugucuacau

SEQ ID NO: 1384196 - RNA, 15 nt, Human
aauuaauuguaaucu

SEQ ID NO: 1384197 - RNA, 12 nt, Human
aauuaauuguaa

SEQ ID NO: 1384198 - RNA, 17 nt, Human
aauuaauuccuucagca

SEQ ID NO: 1384199 - RNA, 16 nt, Human
uacauaauucacucug

SEQ ID NO: 1384200 - RNA, 17 nt, Human
uacauaauucacucuga

SEQ ID NO: 1384201 - RNA, 15 nt, Human
uacauaauucacucu

SEQ ID NO: 1384202 - RNA, 24 nt, Human
uacauaaugcgugcauaccacuuu

SEQ ID NO: 1384203 - RNA, 23 nt, Human
uacauaaugcgugcauaccacuu

SEQ ID NO: 1384204 - RNA, 22 nt, Human
uacaggugugugccaccacacc

SEQ ID NO: 1384205 - RNA, 17 nt, Human
uacauaugaucugucug

SEQ ID NO: 1384206 - RNA, 23 nt, Human
uacauccaaagcagacagcucca

SEQ ID NO: 1384207 - RNA, 20 nt, Human
uacauccaaagcagacagcu

SEQ ID NO: 1384208 - RNA, 19 nt, Human
uacauccaaagcagacagc

SEQ ID NO: 1384209 - RNA, 20 nt, Human
uacaucauuucuuuuuggga

SEQ ID NO: 1384210 - RNA, 14 nt, Human
uacaucauuucuuu

SEQ ID NO: 1384211 - RNA, 13 nt, Human
uacaucauuucuu

SEQ ID NO: 1384212 - RNA, 12 nt, Human
uacaucauuucu

SEQ ID NO: 1384213 - RNA, 20 nt, Human
uacaucccuuaccugggaaa

SEQ ID NO: 1384214 - RNA, 22 nt, Human
aaugugaaaaugguccaggaga

SEQ ID NO: 1384215 - RNA, 17 nt, Human
aaugugauguucuaagg

SEQ ID NO: 1384216 - RNA, 16 nt, Human
aaugugauguucuaag

SEQ ID NO: 1384217 - RNA, 15 nt, Human
aaugugauguucuaa

SEQ ID NO: 1384218 - RNA, 15 nt, Human
aaugugaaacuggau

SEQ ID NO: 1384219 - RNA, 14 nt, Human
aaugugaaacugga

SEQ ID NO: 1384220 - RNA, 17 nt, Human
aaugugcaauagaaggu

SEQ ID NO: 1384221 - RNA, 15 nt, Human
aaugugcaauagaag

SEQ ID NO: 1384222 - RNA, 20 nt, Human
aaugugauuuacgcucauug

SEQ ID NO: 1384223 - RNA, 19 nt, Human
aaugugauguucuaaggcu

SEQ ID NO: 1384224 - RNA, 21 nt, Human
aaugugccuauugcuagagcu

SEQ ID NO: 1384225 - RNA, 18 nt, Human
aaugugcuauacugcaua

SEQ ID NO: 1384226 - RNA, 12 nt, Human
aaugugccuauu

SEQ ID NO: 1384227 - RNA, 13 nt, Human
aauguauguuacc

SEQ ID NO: 1384228 - RNA, 18 nt, Human
aauguaucaaauacauuu

SEQ ID NO: 1384229 - RNA, 21 nt, Human
aauguauguuaccaaaaauaa

SEQ ID NO: 1384230 - RNA, 17 nt, Human
aauguauguuaccaaaa

SEQ ID NO: 1384231 - RNA, 22 nt, Human
aauguauuacaguggggaauga

SEQ ID NO: 1384232 - RNA, 14 nt, Human
aauguauaugcacu

SEQ ID NO: 1384233 - RNA, 13 nt, Human
aauguauaugcac

SEQ ID NO: 1384234 - RNA, 13 nt, Human
aauguauaguaaa

SEQ ID NO: 1384235 - RNA, 19 nt, Human
aauguauacuauaguacca

SEQ ID NO: 1384236 - RNA, 17 nt, Human
aaucuaagugauauaaa

SEQ ID NO: 1384237 - RNA, 15 nt, Human
aaucuaagugauaua

SEQ ID NO: 1384238 - RNA, 23 nt, Human
aaucgcuccaccuugcagcucuc

SEQ ID NO: 1384239 - RNA, 20 nt, Human
aauccugucgauuagacugg

SEQ ID NO: 1384240 - RNA, 13 nt, Human
aauccuuuacugu

SEQ ID NO: 1384241 - RNA, 21 nt, Human
aauccugucgauuagacugga

SEQ ID NO: 1384242 - RNA, 19 nt, Human
aauccugucgauuagacug

SEQ ID NO: 1384243 - RNA, 21 nt, Human
aauccuggggaacauagaacu

SEQ ID NO: 1384244 - RNA, 14 nt, Human
aauccuggggaaca

SEQ ID NO: 1384245 - RNA, 12 nt, Human
aaucccuucaua

SEQ ID NO: 1384246 - RNA, 18 nt, Human
aaucccuucauacuugaa

SEQ ID NO: 1384247 - RNA, 11 nt, Human
aaucccuucau

SEQ ID NO: 1384248 - RNA, 21 nt, Human
aaucccuuaauauccuaaaca

SEQ ID NO: 1384249 - RNA, 22 nt, Human
aaucccuuaacaguuguauuua

SEQ ID NO: 1384250 - RNA, 18 nt, Human
aaucccuuaacaguugua

SEQ ID NO: 1384251 - RNA, 12 nt, Human
aauccgcccauc

SEQ ID NO: 1384252 - RNA, 15 nt, Human
aaucauuagguguga

SEQ ID NO: 1384253 - RNA, 17 nt, Human
aaucauuaggugugacu

SEQ ID NO: 1384254 - RNA, 23 nt, Human
aaucauuaggugugacugaauuu

SEQ ID NO: 1384255 - RNA, 20 nt, Human
aaucuuaagguguagccaca

SEQ ID NO: 1384256 - RNA, 19 nt, Human
aaucuuaagguguagccac

SEQ ID NO: 1384257 - RNA, 16 nt, Human
aaucuguuuuucuaac

SEQ ID NO: 1384258 - RNA, 15 nt, Human
aaucuguuuuucuaa

SEQ ID NO: 1384259 - RNA, 20 nt, Human
aaucugugugaaacuuucau

SEQ ID NO: 1384260 - RNA, 23 nt, Human
aaucugugugaaacuuucauucc

SEQ ID NO: 1384261 - RNA, 19 nt, Human
aaucugugggucugggagu

SEQ ID NO: 1384262 - RNA, 19 nt, Human
aaucuuauaauuuaaaaua

SEQ ID NO: 1384263 - RNA, 16 nt, Human
aaucuacacacggugc

SEQ ID NO: 1384264 - RNA, 23 nt, Human
aaucuggcuucuggccaggaagc

SEQ ID NO: 1384265 - RNA, 21 nt, Human
aaucuggcuucuggccaggaa

SEQ ID NO: 1384266 - RNA, 17 nt, Human
aaucugugggucuggga

SEQ ID NO: 1384267 - RNA, 21 nt, Human
uaaguauuaugucucuucuga

SEQ ID NO: 1384268 - RNA, 17 nt, Human
uaaguauuaugucucuu

SEQ ID NO: 1384269 - RNA, 19 nt, Human
uaaguaaugauaacuggaa

SEQ ID NO: 1384270 - RNA, 14 nt, Human
uaaguaaauacaau

SEQ ID NO: 1384271 - RNA, 16 nt, Human
uaaguaaauacaauuu

SEQ ID NO: 1384272 - RNA, 16 nt, Human
uaagcuuuucuuuucu

SEQ ID NO: 1384273 - RNA, 20 nt, Human
uaagcuuuucuuuucuuugu

SEQ ID NO: 1384274 - RNA, 16 nt, Human
uaagcuuguauuccuu

SEQ ID NO: 1384275 - RNA, 15 nt, Human
uaagcuuaugcuuaa

SEQ ID NO: 1384276 - RNA, 20 nt, Human
aaucauagcugguucacacu

SEQ ID NO: 1384277 - RNA, 19 nt, Human
uaauaaacuaauaauugca

SEQ ID NO: 1384278 - RNA, 21 nt, Human
aaucauauaauaaauguacau

SEQ ID NO: 1384279 - RNA, 18 nt, Human
aaucauauaauaaaugua

SEQ ID NO: 1384280 - RNA, 15 nt, Human
aaucaugaauuaguu

SEQ ID NO: 1384281 - RNA, 12 nt, Human
aaucaugaauua

SEQ ID NO: 1384282 - RNA, 22 nt, Human
uaaguugggcuugcuauucugu

SEQ ID NO: 1384283 - RNA, 19 nt, Human
uaaguugggcuugcuauuc

SEQ ID NO: 1384284 - RNA, 18 nt, Human
uaaguugggcuugcuauu

SEQ ID NO: 1384285 - RNA, 16 nt, Human
uaaguugggcuugcua

SEQ ID NO: 1384286 - RNA, 13 nt, Human
uaaguugggcuug

SEQ ID NO: 1384287 - RNA, 22 nt, Human
uaaguugagauaguuuucaucc

SEQ ID NO: 1384288 - RNA, 21 nt, Human
uaaguugagauaguuuucauc

SEQ ID NO: 1384289 - RNA, 20 nt, Human
uaaguugagauaguuuucau

SEQ ID NO: 1384290 - RNA, 20 nt, Human
uaauaaacuaauaauugcag

SEQ ID NO: 1384291 - RNA, 12 nt, Human
uaauaaacucau

SEQ ID NO: 1384292 - RNA, 13 nt, Human
uaauaaacuaaua

SEQ ID NO: 1384293 - RNA, 15 nt, Human
uaauaaaauucaaca

SEQ ID NO: 1384294 - RNA, 12 nt, Human
uaauaaacacuc

SEQ ID NO: 1384295 - RNA, 18 nt, Human
uaauaaacacucuugaaa

SEQ ID NO: 1384296 - RNA, 21 nt, Human
uaauagcagccuuucucucuu

SEQ ID NO: 1384297 - RNA, 15 nt, Human
uaauagcagccuuuc

SEQ ID NO: 1384298 - RNA, 14 nt, Human
uaauagcagccuuu

SEQ ID NO: 1384299 - RNA, 13 nt, Human
uaauagcaaagaa

SEQ ID NO: 1384300 - RNA, 15 nt, Human
uaauagcaaagaauu

SEQ ID NO: 1384301 - RNA, 12 nt, Human
uaauagauucuc

SEQ ID NO: 1384302 - RNA, 22 nt, Human
uaauagauguuugauagauuuu

SEQ ID NO: 1384303 - RNA, 21 nt, Human
uaauagauguuugauagauuu

SEQ ID NO: 1384304 - RNA, 16 nt, Human
uaauagauguuugaua

SEQ ID NO: 1384305 - RNA, 14 nt, Human
uaauagauguuuga

SEQ ID NO: 1384306 - RNA, 18 nt, Human
uaauagacaauuuauuau

SEQ ID NO: 1384307 - RNA, 22 nt, Human
uaauagacaauuuauuauggca

SEQ ID NO: 1384308 - RNA, 19 nt, Human
aaucuuauaguucuaggca

SEQ ID NO: 1384309 - RNA, 18 nt, Human
aaucuuauaguucuaggc

SEQ ID NO: 1384310 - RNA, 15 nt, Human
aaucuuauaguucua

SEQ ID NO: 1384311 - RNA, 14 nt, Human
aaucuuauaguucu

SEQ ID NO: 1384312 - RNA, 21 nt, Human
aaucuuaguguaugauuacug

SEQ ID NO: 1384313 - RNA, 18 nt, Human
aaucuuaguguaugauua

SEQ ID NO: 1384314 - RNA, 16 nt, Human
uaauacaccacuacau

SEQ ID NO: 1384315 - RNA, 18 nt, Human
uaauacaccacuacauuc

SEQ ID NO: 1384316 - RNA, 19 nt, Human
uaauacaccacuacauucu

SEQ ID NO: 1384317 - RNA, 21 nt, Human
uaauacaccacuacauucugu

SEQ ID NO: 1384318 - RNA, 16 nt, Human
uaauagacaauuuauu

SEQ ID NO: 1384319 - RNA, 16 nt, Human
uaaugaaacaaagagu

SEQ ID NO: 1384320 - RNA, 20 nt, Human
uaaugaaguuugaauguuaa

SEQ ID NO: 1384321 - RNA, 21 nt, Human
uaaugaaguuugaauguuaaa

SEQ ID NO: 1384322 - RNA, 22 nt, Human
uaaugaaguuugaauguuaaau

SEQ ID NO: 1384323 - RNA, 21 nt, Human
uaaugaaaacagaaugucucu

SEQ ID NO: 1384324 - RNA, 13 nt, Human
uaaugaaacaaag

SEQ ID NO: 1384325 - RNA, 17 nt, Human
uaauccccaguaaaauu

SEQ ID NO: 1384326 - RNA, 18 nt, Human
uaauccccaguaaaauug

SEQ ID NO: 1384327 - RNA, 20 nt, Human
uaauccccaguaaaauugcc

SEQ ID NO: 1384328 - RNA, 21 nt, Human
uaauccccaguaaaauugcca

SEQ ID NO: 1384329 - RNA, 20 nt, Human
uaaucacucuaauuaauugu

SEQ ID NO: 1384330 - RNA, 18 nt, Human
uaaucacgcuuuccugaa

SEQ ID NO: 1384331 - RNA, 23 nt, Human
uaaucaaauuuguaggguuucua

SEQ ID NO: 1384332 - RNA, 17 nt, Human
uaaucaaaagcuauuua

SEQ ID NO: 1384333 - RNA, 21 nt, Human
uaauauuuuccuccugagugc

SEQ ID NO: 1384334 - RNA, 20 nt, Human
uaauauuuuccuccugagug

SEQ ID NO: 1384335 - RNA, 22 nt, Human
uaauauuuuccuccugagugcu

SEQ ID NO: 1384336 - RNA, 19 nt, Human
uaauccaggcagauccagg

SEQ ID NO: 1384337 - RNA, 18 nt, Human
uaauccaggcagauccag

SEQ ID NO: 1384338 - RNA, 17 nt, Human
uaauccaggcagaucca

SEQ ID NO: 1384339 - RNA, 21 nt, Human
uaaucccagcaugcugagauu

SEQ ID NO: 1384340 - RNA, 23 nt, Human
uaauccaggcagauccaggacua

SEQ ID NO: 1384341 - RNA, 22 nt, Human
uaauccaggcagauccaggacu

SEQ ID NO: 1384342 - RNA, 12 nt, Human
uaauccaguaaa

SEQ ID NO: 1384343 - RNA, 16 nt, Human
aaugaaacaaagaguu

SEQ ID NO: 1384344 - RNA, 23 nt, Human
aaugaaacaaagaguucaagaaa

SEQ ID NO: 1384345 - RNA, 16 nt, Human
aaugaaaaugucuugu

SEQ ID NO: 1384346 - RNA, 16 nt, Human
aaugacaaucaugugu

SEQ ID NO: 1384347 - RNA, 23 nt, Human
aaugaauuuagugagcauaggug

SEQ ID NO: 1384348 - RNA, 17 nt, Human
aaugaauuaaauaaacc

SEQ ID NO: 1384349 - RNA, 23 nt, Human
aaugaauguuuacacucuuugua

SEQ ID NO: 1384350 - RNA, 21 nt, Human
aaugaauggaggaacuuucca

SEQ ID NO: 1384351 - RNA, 17 nt, Human
uaauguauguuaccaaa

SEQ ID NO: 1384352 - RNA, 16 nt, Human
uaauguauguuaccaa

SEQ ID NO: 1384353 - RNA, 19 nt, Human
uaauguaucaaauacauuu

SEQ ID NO: 1384354 - RNA, 16 nt, Human
uaauguuaauauugau

SEQ ID NO: 1384355 - RNA, 17 nt, Human
uaauguuaauauugauu

SEQ ID NO: 1384356 - RNA, 13 nt, Human
uaauguuaauauu

SEQ ID NO: 1384357 - RNA, 22 nt, Human
uaauguguaguucauguaaaua

SEQ ID NO: 1384358 - RNA, 20 nt, Human
uaauguguaguucauguaaa

SEQ ID NO: 1384359 - RNA, 19 nt, Human
uaauguguaguucauguaa

SEQ ID NO: 1384360 - RNA, 18 nt, Human
uaauguguaguucaugua

SEQ ID NO: 1384361 - RNA, 17 nt, Human
uaauguguaguucaugu

SEQ ID NO: 1384362 - RNA, 13 nt, Human
uaaugucuugagc

SEQ ID NO: 1384363 - RNA, 15 nt, Human
uaaugucuugagcuc

SEQ ID NO: 1384364 - RNA, 16 nt, Human
aaucuuuauaaaugua

SEQ ID NO: 1384365 - RNA, 22 nt, Human
aaucuuuagagaaguauacaua

SEQ ID NO: 1384366 - RNA, 21 nt, Human
aaucuuuagagaaguauacau

SEQ ID NO: 1384367 - RNA, 23 nt, Human
aaucuuuaaaccaauugcugcua

SEQ ID NO: 1384368 - RNA, 15 nt, Human
aaucuuuaaaccaau

SEQ ID NO: 1384369 - RNA, 15 nt, Human
aaucuuuaauuuuac

SEQ ID NO: 1384370 - RNA, 16 nt, Human
aaucuuuaauuuuaca

SEQ ID NO: 1384371 - RNA, 23 nt, Human
uaagauuuguuuuuaaacuguac

SEQ ID NO: 1384372 - RNA, 22 nt, Human
uaagauuuguuuuuaaacugua

SEQ ID NO: 1384373 - RNA, 20 nt, Human
uaagauuuguuuuuaaacug

SEQ ID NO: 1384374 - RNA, 19 nt, Human
uaagauuuguuuuuaaacu

SEQ ID NO: 1384375 - RNA, 18 nt, Human
uaagauuuguuuuuaaac

SEQ ID NO: 1384376 - RNA, 15 nt, Human
uaagauuuguuuuua

SEQ ID NO: 1384377 - RNA, 12 nt, Human
uaagauuuguuu

SEQ ID NO: 1384378 - RNA, 16 nt, Human
uaagauuuccuucuuu

SEQ ID NO: 1384379 - RNA, 15 nt, Human
uaagauuuccuucuu

SEQ ID NO: 1384380 - RNA, 14 nt, Human
uaagauucugauuu

SEQ ID NO: 1384381 - RNA, 13 nt, Human
uaagauucugauu

SEQ ID NO: 1384382 - RNA, 17 nt, Human
uaagauucugauuuuag

SEQ ID NO: 1384383 - RNA, 21 nt, Human
uaagauucuagaucagaugcu

SEQ ID NO: 1384384 - RNA, 14 nt, Human
uaagauucuagauc

SEQ ID NO: 1384385 - RNA, 13 nt, Human
uaagauucuagau

SEQ ID NO: 1384386 - RNA, 12 nt, Human
uaagauucuaga

SEQ ID NO: 1384387 - RNA, 11 nt, Human
uaagauucuag

SEQ ID NO: 1384388 - RNA, 15 nt, Human
uaagauucuaaugau

SEQ ID NO: 1384389 - RNA, 14 nt, Human
uaagauucuaauga

SEQ ID NO: 1384390 - RNA, 13 nt, Human
uaagauucuaaug

SEQ ID NO: 1384391 - RNA, 16 nt, Human
uaagcaacauggcuuu

SEQ ID NO: 1384392 - RNA, 14 nt, Human
uaagcaacauggcu

SEQ ID NO: 1384393 - RNA, 23 nt, Human
uaagcaaaaacaaaaagaaaaga

SEQ ID NO: 1384394 - RNA, 20 nt, Human
uaagcagaccacugauaaaa

SEQ ID NO: 1384395 - RNA, 17 nt, Human
uaagcagaccacugaua

SEQ ID NO: 1384396 - RNA, 22 nt, Human
uaagcagaaagugccuuucagg

SEQ ID NO: 1384397 - RNA, 21 nt, Human
uaagcagaaagugccuuucag

SEQ ID NO: 1384398 - RNA, 19 nt, Human
uaagcagaaagugccuuuc

SEQ ID NO: 1384399 - RNA, 16 nt, Human
uaagcagaaagugccu

SEQ ID NO: 1384400 - RNA, 15 nt, Human
uaagcagaaagugcc

SEQ ID NO: 1384401 - RNA, 13 nt, Human
uaagcagaaagug

SEQ ID NO: 1384402 - RNA, 22 nt, Human
uaagcaccuguaaugugcgagg

SEQ ID NO: 1384403 - RNA, 17 nt, Human
uaagcaacauggcuuug

SEQ ID NO: 1384404 - RNA, 14 nt, Human
uaagcaagaaggca

SEQ ID NO: 1384405 - RNA, 16 nt, Human
uaagcuggagugcagu

SEQ ID NO: 1384406 - RNA, 15 nt, Human
aauauuuuaaagaau

SEQ ID NO: 1384407 - RNA, 13 nt, Human
aauauuuuaaaga

SEQ ID NO: 1384408 - RNA, 16 nt, Human
aauauuuuaaaaucag

SEQ ID NO: 1384409 - RNA, 11 nt, Human
aauauuuuaaa

SEQ ID NO: 1384410 - RNA, 17 nt, Human
aauauuugugacaaaaa

SEQ ID NO: 1384411 - RNA, 14 nt, Human
aauauuuguacaua

SEQ ID NO: 1384412 - RNA, 12 nt, Human
aauauuuguaca

SEQ ID NO: 1384413 - RNA, 20 nt, Human
aauauuugaaucuugucuca

SEQ ID NO: 1384414 - RNA, 14 nt, Human
aauauuuuuagaua

SEQ ID NO: 1384415 - RNA, 21 nt, Human
aaucaggguuaguauugucca

SEQ ID NO: 1384416 - RNA, 16 nt, Human
aaucaggguuaguauu

SEQ ID NO: 1384417 - RNA, 12 nt, Human
uaagauucuaau

SEQ ID NO: 1384418 - RNA, 17 nt, Human
uaagauucuaacggucu

SEQ ID NO: 1384419 - RNA, 13 nt, Human
uaagauucuaacg

SEQ ID NO: 1384420 - RNA, 12 nt, Human
uaagauucuaac

SEQ ID NO: 1384421 - RNA, 17 nt, Human
uaagauucuaaaggucc

SEQ ID NO: 1384422 - RNA, 16 nt, Human
uaagauucuaaagguc

SEQ ID NO: 1384423 - RNA, 14 nt, Human
uaagauucuaaagg

SEQ ID NO: 1384424 - RNA, 13 nt, Human
uaagauucuaaag

SEQ ID NO: 1384425 - RNA, 12 nt, Human
uaagauucuaaa

SEQ ID NO: 1384426 - RNA, 11 nt, Human
uaagauucuaa

SEQ ID NO: 1384427 - RNA, 10 nt, Human
uaagauucua

SEQ ID NO: 1384428 - RNA, 21 nt, Human
uaagaugugauauucuaagac

SEQ ID NO: 1384429 - RNA, 20 nt, Human
uaagaugugauauucuaaga

SEQ ID NO: 1384430 - RNA, 19 nt, Human
uaagaugugauauucuaag

SEQ ID NO: 1384431 - RNA, 18 nt, Human
uaagaugugauauucuaa

SEQ ID NO: 1384432 - RNA, 14 nt, Human
uaagaugugauauu

SEQ ID NO: 1384433 - RNA, 23 nt, Human
uaagaugugauauucuaagacuu

SEQ ID NO: 1384434 - RNA, 22 nt, Human
uaagaugugauauucuaagacu

SEQ ID NO: 1384435 - RNA, 22 nt, Human
aaucaggguuaguauuguccag

SEQ ID NO: 1384436 - RNA, 15 nt, Human
uaagagaaguuguaa

SEQ ID NO: 1384437 - RNA, 22 nt, Human
aauaugcacacauuuuuuaaau

SEQ ID NO: 1384438 - RNA, 16 nt, Human
aauaugcacacauuuu

SEQ ID NO: 1384439 - RNA, 17 nt, Human
aauaugcacacauuuuu

SEQ ID NO: 1384440 - RNA, 17 nt, Human
uaagacuugacagugga

SEQ ID NO: 1384441 - RNA, 14 nt, Human
uaagacuugacagu

SEQ ID NO: 1384442 - RNA, 20 nt, Human
uaagacuuacucuaagaucu

SEQ ID NO: 1384443 - RNA, 19 nt, Human
uaagacaugauuuccuuga

SEQ ID NO: 1384444 - RNA, 17 nt, Human
uaagacaugauuuccuu

SEQ ID NO: 1384445 - RNA, 20 nt, Human
uaagagaaguagaaaucaua

SEQ ID NO: 1384446 - RNA, 18 nt, Human
uaagagaaguagaaauca

SEQ ID NO: 1384447 - RNA, 14 nt, Human
uaagagaaguagaa

SEQ ID NO: 1384448 - RNA, 12 nt, Human
uaagagaaguag

SEQ ID NO: 1384449 - RNA, 17 nt, Human
aauauucccuagaaacu

SEQ ID NO: 1384450 - RNA, 15 nt, Human
aauauucccuagaaa

SEQ ID NO: 1384451 - RNA, 18 nt, Human
aauauucauaguuuaauu

SEQ ID NO: 1384452 - RNA, 12 nt, Human
aauauuccagag

SEQ ID NO: 1384453 - RNA, 17 nt, Human
aauaugccuuuuugaag

SEQ ID NO: 1384454 - RNA, 21 nt, Human
aauaugccugcuauuugaagu

SEQ ID NO: 1384455 - RNA, 24 nt, Human
aauaugccccauucaacaucuagu

SEQ ID NO: 1384456 - RNA, 21 nt, Human
aauaugccccauucaacaucu

SEQ ID NO: 1384457 - RNA, 12 nt, Human
aauauuuaagac

SEQ ID NO: 1384458 - RNA, 9 nt, Human
aauauugug

SEQ ID NO: 1384459 - RNA, 13 nt, Human
aauauuguccauu

SEQ ID NO: 1384460 - RNA, 17 nt, Human
aauauugacuuguauau

SEQ ID NO: 1384461 - RNA, 14 nt, Human
aauauugacuugua

SEQ ID NO: 1384462 - RNA, 14 nt, Human
aauauuucagauaa

SEQ ID NO: 1384463 - RNA, 19 nt, Human
aauauuuauuuuaauaaug

SEQ ID NO: 1384464 - RNA, 18 nt, Human
aauauuuauuuuaauaau

SEQ ID NO: 1384465 - RNA, 12 nt, Human
aauauuuagugu

SEQ ID NO: 1384466 - RNA, 13 nt, Human
aauaguuccugcu

SEQ ID NO: 1384467 - RNA, 11 nt, Human
aauaguuccug

SEQ ID NO: 1384468 - RNA, 14 nt, Human
aauauauuuuaaga

SEQ ID NO: 1384469 - RNA, 15 nt, Human
aauauauuuuaagac

SEQ ID NO: 1384470 - RNA, 13 nt, Human
uaaaauuuguucu

SEQ ID NO: 1384471 - RNA, 23 nt, Human
aauagugucauccucacagugaa

SEQ ID NO: 1384472 - RNA, 22 nt, Human
aauaguggugugauuuggggau

SEQ ID NO: 1384473 - RNA, 19 nt, Human
aauagucaaauugugugaa

SEQ ID NO: 1384474 - RNA, 16 nt, Human
uaaaauuuauauugua

SEQ ID NO: 1384475 - RNA, 17 nt, Human
uaaaauuuauauuguaa

SEQ ID NO: 1384476 - RNA, 14 nt, Human
uaaaauuuauauug

SEQ ID NO: 1384477 - RNA, 16 nt, Human
aauagucaaauugugu

SEQ ID NO: 1384478 - RNA, 14 nt, Human
uaacaugaauauuu

SEQ ID NO: 1384479 - RNA, 13 nt, Human
uaacaucugagaa

SEQ ID NO: 1384480 - RNA, 20 nt, Human
uaacaucuaaaaauagacuu

SEQ ID NO: 1384481 - RNA, 14 nt, Human
uaacaucuaaaaau

SEQ ID NO: 1384482 - RNA, 23 nt, Human
uaacauauaauguuguuauuuaa

SEQ ID NO: 1384483 - RNA, 14 nt, Human
uaacauauaauguu

SEQ ID NO: 1384484 - RNA, 23 nt, Human
uaacaguuguauuuaacagaaau

SEQ ID NO: 1384485 - RNA, 19 nt, Human
uaacaguuguauuuaacag

SEQ ID NO: 1384486 - RNA, 18 nt, Human
uaacaguuguauuuaaca

SEQ ID NO: 1384487 - RNA, 14 nt, Human
uaacaguguuuaaa

SEQ ID NO: 1384488 - RNA, 17 nt, Human
uaacaguggacaaaguu

SEQ ID NO: 1384489 - RNA, 22 nt, Human
aauaucacuugucaauaaaauc

SEQ ID NO: 1384490 - RNA, 13 nt, Human
aauaucagacuuu

SEQ ID NO: 1384491 - RNA, 18 nt, Human
aauauauuuuaagacgaa

SEQ ID NO: 1384492 - RNA, 21 nt, Human
uaagaaguuuuaaaaagccag

SEQ ID NO: 1384493 - RNA, 15 nt, Human
uaagaaguuuuaaaa

SEQ ID NO: 1384494 - RNA, 13 nt, Human
uaacuuucugggu

SEQ ID NO: 1384495 - RNA, 23 nt, Human
uaagacacugaaaaaucuaagug

SEQ ID NO: 1384496 - RNA, 20 nt, Human
uaagacacugaaaaaucuaa

SEQ ID NO: 1384497 - RNA, 19 nt, Human
uaagaauaucuguaauggu

SEQ ID NO: 1384498 - RNA, 16 nt, Human
uaagacaugauuuccu

SEQ ID NO: 1384499 - RNA, 22 nt, Human
uaacuugauccauuucuaauua

SEQ ID NO: 1384500 - RNA, 20 nt, Human
uaacuugauccauuucuaau

SEQ ID NO: 1384501 - RNA, 19 nt, Human
uaacuugauccauuucuaa

SEQ ID NO: 1384502 - RNA, 20 nt, Human
uaacuucuugcuucuuucua

SEQ ID NO: 1384503 - RNA, 19 nt, Human
uaacuucuugcuucuuucu

SEQ ID NO: 1384504 - RNA, 15 nt, Human
uaacuucuugcuucu

SEQ ID NO: 1384505 - RNA, 13 nt, Human
uaacuucuugcuu

SEQ ID NO: 1384506 - RNA, 12 nt, Human
uaacuucuugcu

SEQ ID NO: 1384507 - RNA, 23 nt, Human
uaacuucuuauggaauugauuug

SEQ ID NO: 1384508 - RNA, 22 nt, Human
uaacuagacaccaaaguucuaa

SEQ ID NO: 1384509 - RNA, 21 nt, Human
uaacuagacaccaaaguucua

SEQ ID NO: 1384510 - RNA, 20 nt, Human
uaacuagacaccaaaguucu

SEQ ID NO: 1384511 - RNA, 18 nt, Human
uaacuagacaccaaaguu

SEQ ID NO: 1384512 - RNA, 17 nt, Human
uaacuagacaccaaagu

SEQ ID NO: 1384513 - RNA, 17 nt, Human
uaacuuaaauaguauuu

SEQ ID NO: 1384514 - RNA, 16 nt, Human
uaacuuaaauaguauu

SEQ ID NO: 1384515 - RNA, 14 nt, Human
uaacuuaaauagua

SEQ ID NO: 1384516 - RNA, 21 nt, Human
uaacuucacauauugauuucc

SEQ ID NO: 1384517 - RNA, 14 nt, Human
uaacuucaccauau

SEQ ID NO: 1384518 - RNA, 23 nt, Human
uaacuacuuuauaacuaacaugu

SEQ ID NO: 1384519 - RNA, 17 nt, Human
uaacuacuuuauaacua

SEQ ID NO: 1384520 - RNA, 16 nt, Human
uaacuacuuuauaacu

SEQ ID NO: 1384521 - RNA, 14 nt, Human
uaaccuuuacauga

SEQ ID NO: 1384522 - RNA, 21 nt, Human
uaaccuugccugguacaguau

SEQ ID NO: 1384523 - RNA, 19 nt, Human
uaaccuugccugguacagu

SEQ ID NO: 1384524 - RNA, 16 nt, Human
uaaccuugccugguac

SEQ ID NO: 1384525 - RNA, 21 nt, Human
uaaccuuaccagauuuuuaca

SEQ ID NO: 1384526 - RNA, 16 nt, Human
uaaccuuaauuuauua

SEQ ID NO: 1384527 - RNA, 18 nt, Human
uaacauggugugcuucuu

SEQ ID NO: 1384528 - RNA, 20 nt, Human
uaacgauaaaagacagugaa

SEQ ID NO: 1384529 - RNA, 13 nt, Human
ucauaguuuaauu

SEQ ID NO: 1384530 - RNA, 18 nt, Human
ucauaguucagaauuuag

SEQ ID NO: 1384531 - RNA, 16 nt, Human
ucauaguucagaauuu

SEQ ID NO: 1384532 - RNA, 14 nt, Human
ucauaguucagaau

SEQ ID NO: 1384533 - RNA, 16 nt, Human
ucauauaaaguaucau

SEQ ID NO: 1384534 - RNA, 13 nt, Human
ucauauaaaguau

SEQ ID NO: 1384535 - RNA, 18 nt, Human
ucauauaaaguaucauca

SEQ ID NO: 1384536 - RNA, 13 nt, Human
ucauaguucagaa

SEQ ID NO: 1384537 - RNA, 17 nt, Human
ucauauauaucacccag

SEQ ID NO: 1384538 - RNA, 22 nt, Human
ucauauauaucacccagacaua

SEQ ID NO: 1384539 - RNA, 14 nt, Human
ucauauauauacau

SEQ ID NO: 1384540 - RNA, 20 nt, Human
ucauauaguuagcuaauaaa

SEQ ID NO: 1384541 - RNA, 16 nt, Human
ucauauaauuauaugu

SEQ ID NO: 1384542 - RNA, 16 nt, Human
ucauauaauaaaugua

SEQ ID NO: 1384543 - RNA, 15 nt, Human
ucauauaauaaaugu

SEQ ID NO: 1384544 - RNA, 22 nt, Human
ucauaacggaucagaaauacag

SEQ ID NO: 1384545 - RNA, 23 nt, Human
ucauaacggaucagaaauacaga

SEQ ID NO: 1384546 - RNA, 14 nt, Human
ucauaacggaucag

SEQ ID NO: 1384547 - RNA, 16 nt, Human
ucauaacggaucagaa

SEQ ID NO: 1384548 - RNA, 18 nt, Human
ucauaacggaucagaaau

SEQ ID NO: 1384549 - RNA, 19 nt, Human
ucauaacggaucagaaaua

SEQ ID NO: 1384550 - RNA, 21 nt, Human
ucauaacggaucagaaauaca

SEQ ID NO: 1384551 - RNA, 14 nt, Human
ucauaucauccaca

SEQ ID NO: 1384552 - RNA, 16 nt, Human
ucauaucauccacaca

SEQ ID NO: 1384553 - RNA, 13 nt, Human
ucauaucauccac

SEQ ID NO: 1384554 - RNA, 22 nt, Human
ucauauguaccauguacaugaa

SEQ ID NO: 1384555 - RNA, 21 nt, Human
ucauauguaccauguacauga

SEQ ID NO: 1384556 - RNA, 21 nt, Human
ucauauugugauucugccuuu

SEQ ID NO: 1384557 - RNA, 20 nt, Human
ucauauuuuaaacagaggau

SEQ ID NO: 1384558 - RNA, 13 nt, Human
accgaggcaggga

SEQ ID NO: 1384559 - RNA, 15 nt, Human
ucauauuuucaugcu

SEQ ID NO: 1384560 - RNA, 15 nt, Human
accgaggagggagag

SEQ ID NO: 1384561 - RNA, 17 nt, Human
accgaggagggagaguc

SEQ ID NO: 1384562 - RNA, 21 nt, Human
accgaggagggagagucuccc

SEQ ID NO: 1384563 - RNA, 23 nt, Human
accgaggagggagagucucccag

SEQ ID NO: 1384564 - RNA, 12 nt, Human
accgcagaagga

SEQ ID NO: 1384565 - RNA, 13 nt, Human
accgcagaaggaa

SEQ ID NO: 1384566 - RNA, 14 nt, Human
accgcagaaggaag

SEQ ID NO: 1384567 - RNA, 17 nt, Human
ucaguaugaauuauuca

SEQ ID NO: 1384568 - RNA, 13 nt, Human
ucaguaugaauua

SEQ ID NO: 1384569 - RNA, 13 nt, Human
ucaguuuucauuu

SEQ ID NO: 1384570 - RNA, 12 nt, Human
ucaguuuucauu

SEQ ID NO: 1384571 - RNA, 17 nt, Human
ucaguuuuugugaaaag

SEQ ID NO: 1384572 - RNA, 19 nt, Human
ucaguuuuaucauuuucaa

SEQ ID NO: 1384573 - RNA, 17 nt, Human
ucaguuuuaucauuuuc

SEQ ID NO: 1384574 - RNA, 16 nt, Human
ucaguuuuaucauuuu

SEQ ID NO: 1384575 - RNA, 14 nt, Human
ucaguggggcaguc

SEQ ID NO: 1384576 - RNA, 15 nt, Human
ucaguuuuugugaaa

SEQ ID NO: 1384577 - RNA, 23 nt, Human
ucaucccaaaggacagccgccug

SEQ ID NO: 1384578 - RNA, 17 nt, Human
ucauccaucaucaugug

SEQ ID NO: 1384579 - RNA, 16 nt, Human
ucauccaucaucaugu

SEQ ID NO: 1384580 - RNA, 15 nt, Human
ucauccaucaucaug

SEQ ID NO: 1384581 - RNA, 14 nt, Human
ucauccaucaucau

SEQ ID NO: 1384582 - RNA, 12 nt, Human
ucauccaucauc

SEQ ID NO: 1384583 - RNA, 11 nt, Human
ucauccaucau

SEQ ID NO: 1384584 - RNA, 21 nt, Human
ucaucgaaucuacuaauucca

SEQ ID NO: 1384585 - RNA, 14 nt, Human
ucaucgaaucuacu

SEQ ID NO: 1384586 - RNA, 12 nt, Human
ucaucccacucc

SEQ ID NO: 1384587 - RNA, 15 nt, Human
ucauccauaacugaa

SEQ ID NO: 1384588 - RNA, 13 nt, Human
ucaucuaggauuu

SEQ ID NO: 1384589 - RNA, 22 nt, Human
ucaugaaccucaagcugcaucu

SEQ ID NO: 1384590 - RNA, 11 nt, Human
ucaugaaccuc

SEQ ID NO: 1384591 - RNA, 17 nt, Human
ucaugaaagauucaaug

SEQ ID NO: 1384592 - RNA, 16 nt, Human
ucaugaaagauucaau

SEQ ID NO: 1384593 - RNA, 20 nt, Human
ucaucuaccuagauuuaaua

SEQ ID NO: 1384594 - RNA, 22 nt, Human
ucaucuaccauuuucugguucu

SEQ ID NO: 1384595 - RNA, 20 nt, Human
ucaucuaccauuuucugguu

SEQ ID NO: 1384596 - RNA, 14 nt, Human
ucaucuaccuagau

SEQ ID NO: 1384597 - RNA, 22 nt, Human
ucaugauuuuaaguuucucugc

SEQ ID NO: 1384598 - RNA, 23 nt, Human
ucaugauuucauuucaacuguuu

SEQ ID NO: 1384599 - RNA, 17 nt, Human
ucaugauuucauuucaa

SEQ ID NO: 1384600 - RNA, 13 nt, Human
ucaugcaaacucu

SEQ ID NO: 1384601 - RNA, 14 nt, Human
ucaugcaaacuuua

SEQ ID NO: 1384602 - RNA, 14 nt, Human
ucauguguauaaaa

SEQ ID NO: 1384603 - RNA, 10 nt, Human
ucauguguau

SEQ ID NO: 1384604 - RNA, 21 nt, Human
ucauguggcuggaagauccug

SEQ ID NO: 1384605 - RNA, 16 nt, Human
ucauguggcuggaaga

SEQ ID NO: 1384606 - RNA, 13 nt, Human
ucauguggcugga

SEQ ID NO: 1384607 - RNA, 19 nt, Human
ucaugugacucuuuccaac

SEQ ID NO: 1384608 - RNA, 18 nt, Human
ucaugugacucuuuccaa

SEQ ID NO: 1384609 - RNA, 14 nt, Human
ucaugugucccaga

SEQ ID NO: 1384610 - RNA, 13 nt, Human
ucaugugucccag

SEQ ID NO: 1384611 - RNA, 15 nt, Human
ucauguguauaaaaa

SEQ ID NO: 1384612 - RNA, 17 nt, Human
ucaugugacucuuucca

SEQ ID NO: 1384613 - RNA, 14 nt, Human
ucaugugacucuuu

SEQ ID NO: 1384614 - RNA, 17 nt, Human
ucaugugaccacucugu

SEQ ID NO: 1384615 - RNA, 14 nt, Human
ucaugcauggaaau

SEQ ID NO: 1384616 - RNA, 17 nt, Human
ucaugugaaaucauuca

SEQ ID NO: 1384617 - RNA, 16 nt, Human
ucaugugaaaucauuc

SEQ ID NO: 1384618 - RNA, 14 nt, Human
ucaugcagcugugg

SEQ ID NO: 1384619 - RNA, 12 nt, Human
ucaugcagcugu

SEQ ID NO: 1384620 - RNA, 17 nt, Human
ucaugcacaguauuugu

SEQ ID NO: 1384621 - RNA, 20 nt, Human
ucaugcacaguauuuguaau

SEQ ID NO: 1384622 - RNA, 14 nt, Human
ucaugcaaacucuu

SEQ ID NO: 1384623 - RNA, 23 nt, Human
ucaugcaaacuuuauuuuguguu

SEQ ID NO: 1384624 - RNA, 18 nt, Human
accuccagcuuuccugua

SEQ ID NO: 1384625 - RNA, 16 nt, Human
accuccagcuuuccug

SEQ ID NO: 1384626 - RNA, 13 nt, Human
accuccagcuguu

SEQ ID NO: 1384627 - RNA, 17 nt, Human
accuccaccuccugggu

SEQ ID NO: 1384628 - RNA, 15 nt, Human
accuccaccuccugg

SEQ ID NO: 1384629 - RNA, 16 nt, Human
accuccacauccucca

SEQ ID NO: 1384630 - RNA, 14 nt, Human
accuccacauccuc

SEQ ID NO: 1384631 - RNA, 17 nt, Human
accuccagcuuuccugu

SEQ ID NO: 1384632 - RNA, 23 nt, Human
accuccccagcauuccagccccu

SEQ ID NO: 1384633 - RNA, 21 nt, Human
accuccccagcauuccagccc

SEQ ID NO: 1384634 - RNA, 15 nt, Human
accuccccagcauuc

SEQ ID NO: 1384635 - RNA, 13 nt, Human
accuccugagaaa

SEQ ID NO: 1384636 - RNA, 22 nt, Human
accuccugacacccuucuccca

SEQ ID NO: 1384637 - RNA, 21 nt, Human
accuccugacacccuucuccc

SEQ ID NO: 1384638 - RNA, 19 nt, Human
accuccugacacccuucuc

SEQ ID NO: 1384639 - RNA, 18 nt, Human
accuccugacacccuucu

SEQ ID NO: 1384640 - RNA, 17 nt, Human
accuccugacacccuuc

SEQ ID NO: 1384641 - RNA, 22 nt, Human
accuccccuugggcccacaccu

SEQ ID NO: 1384642 - RNA, 14 nt, Human
accuccccuugggc

SEQ ID NO: 1384643 - RNA, 13 nt, Human
accuccccuuggg

SEQ ID NO: 1384644 - RNA, 12 nt, Human
accuccccuugg

SEQ ID NO: 1384645 - RNA, 17 nt, Human
accucccuauacugcuu

SEQ ID NO: 1384646 - RNA, 17 nt, Human
accucccucaaccucau

SEQ ID NO: 1384647 - RNA, 21 nt, Human
accuacuuugacuuuuugcau

SEQ ID NO: 1384648 - RNA, 20 nt, Human
accuacuuugacuuuuugca

SEQ ID NO: 1384649 - RNA, 23 nt, Human
accuacuguucuaaagcucugac

SEQ ID NO: 1384650 - RNA, 21 nt, Human
accuacuguucuaaagcucug

SEQ ID NO: 1384651 - RNA, 20 nt, Human
accuacuguucuaaagcucu

SEQ ID NO: 1384652 - RNA, 18 nt, Human
accuacuguucuaaagcu

SEQ ID NO: 1384653 - RNA, 17 nt, Human
accuacuguucuaaagc

SEQ ID NO: 1384654 - RNA, 16 nt, Human
accuacuguucuaaag

SEQ ID NO: 1384655 - RNA, 15 nt, Human
accuacuguucuaaa

SEQ ID NO: 1384656 - RNA, 23 nt, Human
accuacugcccaggcacugcaaa

SEQ ID NO: 1384657 - RNA, 19 nt, Human
accuacugcccaggcacug

SEQ ID NO: 1384658 - RNA, 22 nt, Human
accuaggaagccucagauuccu

SEQ ID NO: 1384659 - RNA, 17 nt, Human
accuaggaagccucaga

SEQ ID NO: 1384660 - RNA, 17 nt, Human
accuaggcuaggguggg

SEQ ID NO: 1384661 - RNA, 12 nt, Human
accuaggcuagg

SEQ ID NO: 1384662 - RNA, 18 nt, Human
accuacucuggcuagaag

SEQ ID NO: 1384663 - RNA, 17 nt, Human
accuacucacacaggca

SEQ ID NO: 1384664 - RNA, 16 nt, Human
accuacucacacaggc

SEQ ID NO: 1384665 - RNA, 14 nt, Human
accuacucacacag

SEQ ID NO: 1384666 - RNA, 24 nt, Human
accuaccuguugagcaucacagaa

SEQ ID NO: 1384667 - RNA, 17 nt, Human
accuaccuguugagcau

SEQ ID NO: 1384668 - RNA, 15 nt, Human
accuaccuguugagc

SEQ ID NO: 1384669 - RNA, 15 nt, Human
accgcagaaggaagg

SEQ ID NO: 1384670 - RNA, 18 nt, Human
accuaggaagccucagau

SEQ ID NO: 1384671 - RNA, 16 nt, Human
accuagggugauauua

SEQ ID NO: 1384672 - RNA, 22 nt, Human
accuaugucauuucauuuccua

SEQ ID NO: 1384673 - RNA, 16 nt, Human
accuauuaucccagcu

SEQ ID NO: 1384674 - RNA, 16 nt, Human
accuauuuccagaaau

SEQ ID NO: 1384675 - RNA, 17 nt, Human
accuauuuccagaaaua

SEQ ID NO: 1384676 - RNA, 18 nt, Human
accuauuucuuaaacacu

SEQ ID NO: 1384677 - RNA, 23 nt, Human
accuauuucuuaaacacuugcaa

SEQ ID NO: 1384678 - RNA, 12 nt, Human
accuauuuccau

SEQ ID NO: 1384679 - RNA, 19 nt, Human
accuauuuccagaaauaca

SEQ ID NO: 1384680 - RNA, 16 nt, Human
ucaggggcccuggagc

SEQ ID NO: 1384681 - RNA, 18 nt, Human
ucaggggcccuggagcag

SEQ ID NO: 1384682 - RNA, 20 nt, Human
ucaggggcccuggagcagcc

SEQ ID NO: 1384683 - RNA, 23 nt, Human
ucagggcuccuugugggccuggg

SEQ ID NO: 1384684 - RNA, 21 nt, Human
ucagcuuucuuuaaaguucuu

SEQ ID NO: 1384685 - RNA, 14 nt, Human
acccggcugcagag

SEQ ID NO: 1384686 - RNA, 13 nt, Human
acccggcuaauuu

SEQ ID NO: 1384687 - RNA, 22 nt, Human
acccggcacccccugcagcuug

SEQ ID NO: 1384688 - RNA, 20 nt, Human
acccggcacccccugcagcu

SEQ ID NO: 1384689 - RNA, 19 nt, Human
acccggcacccccugcagc

SEQ ID NO: 1384690 - RNA, 18 nt, Human
acccggcacccccugcag

SEQ ID NO: 1384691 - RNA, 16 nt, Human
acccggcacccccugc

SEQ ID NO: 1384692 - RNA, 16 nt, Human
ucagguaauacaaacu

SEQ ID NO: 1384693 - RNA, 15 nt, Human
ucagguaauacaaac

SEQ ID NO: 1384694 - RNA, 17 nt, Human
acccuuuuucuccagcu

SEQ ID NO: 1384695 - RNA, 19 nt, Human
acccuuuuggguuucugcc

SEQ ID NO: 1384696 - RNA, 21 nt, Human
acccuuuuggguuucugcccu

SEQ ID NO: 1384697 - RNA, 17 nt, Human
acccuuucuucagcucu

SEQ ID NO: 1384698 - RNA, 11 nt, Human
acccuugacac

SEQ ID NO: 1384699 - RNA, 21 nt, Human
acccugcccuuguuuggggca

SEQ ID NO: 1384700 - RNA, 12 nt, Human
acccuucuuuuc

SEQ ID NO: 1384701 - RNA, 17 nt, Human
acccugaaggggccaug

SEQ ID NO: 1384702 - RNA, 12 nt, Human
acccugaagggg

SEQ ID NO: 1384703 - RNA, 18 nt, Human
acccugaaggggccauga

SEQ ID NO: 1384704 - RNA, 14 nt, Human
acccucugaaauac

SEQ ID NO: 1384705 - RNA, 16 nt, Human
acccucugaaauacau

SEQ ID NO: 1384706 - RNA, 16 nt, Human
acccucucagcuccag

SEQ ID NO: 1384707 - RNA, 15 nt, Human
acccucucagcucca

SEQ ID NO: 1384708 - RNA, 20 nt, Human
acccucggggauguguccug

SEQ ID NO: 1384709 - RNA, 19 nt, Human
acccucggggauguguccu

SEQ ID NO: 1384710 - RNA, 17 nt, Human
acccucggggauguguc

SEQ ID NO: 1384711 - RNA, 15 nt, Human
acccucguggacacc

SEQ ID NO: 1384712 - RNA, 17 nt, Human
acccucguggacaccug

SEQ ID NO: 1384713 - RNA, 18 nt, Human
acccucguggacaccugc

SEQ ID NO: 1384714 - RNA, 19 nt, Human
acccucguggacaccugcc

SEQ ID NO: 1384715 - RNA, 23 nt, Human
acccucggggauguguccugaca

SEQ ID NO: 1384716 - RNA, 20 nt, Human
acccucguggacaccugccc

SEQ ID NO: 1384717 - RNA, 22 nt, Human
acccucguggacaccugcccug

SEQ ID NO: 1384718 - RNA, 23 nt, Human
acccucguggacaccugcccugc

SEQ ID NO: 1384719 - RNA, 15 nt, Human
ucagccuuagcucuc

SEQ ID NO: 1384720 - RNA, 17 nt, Human
ucagccuuaagaaccau

SEQ ID NO: 1384721 - RNA, 15 nt, Human
ucagcuaagcucacg

SEQ ID NO: 1384722 - RNA, 17 nt, Human
ucagcguggccuuguuc

SEQ ID NO: 1384723 - RNA, 14 nt, Human
ucagcguggccuug

SEQ ID NO: 1384724 - RNA, 13 nt, Human
ucagcguggccuu

SEQ ID NO: 1384725 - RNA, 23 nt, Human
ucagcguggagggguaggggcug

SEQ ID NO: 1384726 - RNA, 14 nt, Human
ucagcuaagcucac

SEQ ID NO: 1384727 - RNA, 12 nt, Human
ucagcuccagcu

SEQ ID NO: 1384728 - RNA, 22 nt, Human
accccugcuuugggcuugggcc

SEQ ID NO: 1384729 - RNA, 22 nt, Human
accccugcauuggaacuggagg

SEQ ID NO: 1384730 - RNA, 23 nt, Human
accccugcauuggaacuggaggc

SEQ ID NO: 1384731 - RNA, 10 nt, Human
accccugcau

SEQ ID NO: 1384732 - RNA, 15 nt, Human
acccccucucccugc

SEQ ID NO: 1384733 - RNA, 17 nt, Human
accccauccaguucaug

SEQ ID NO: 1384734 - RNA, 23 nt, Human
accccaucaccuacucacacagg

SEQ ID NO: 1384735 - RNA, 17 nt, Human
accccaucccuccccag

SEQ ID NO: 1384736 - RNA, 16 nt, Human
accccaucugcauucc

SEQ ID NO: 1384737 - RNA, 17 nt, Human
accccaucugcauuccc

SEQ ID NO: 1384738 - RNA, 19 nt, Human
accccagacuagauguagu

SEQ ID NO: 1384739 - RNA, 18 nt, Human
accccacccacuucugca

SEQ ID NO: 1384740 - RNA, 13 nt, Human
ucagccagccucg

SEQ ID NO: 1384741 - RNA, 21 nt, Human
ucagccagccucgcccauccc

SEQ ID NO: 1384742 - RNA, 12 nt, Human
ucagccagccuc

SEQ ID NO: 1384743 - RNA, 12 nt, Human
ucagccaggagc

SEQ ID NO: 1384744 - RNA, 13 nt, Human
ucagccaggagcu

SEQ ID NO: 1384745 - RNA, 14 nt, Human
ucagcccucagaau

SEQ ID NO: 1384746 - RNA, 22 nt, Human
accaguguuagggaagggccug

SEQ ID NO: 1384747 - RNA, 23 nt, Human
accaguguguggcuuucagagcc

SEQ ID NO: 1384748 - RNA, 18 nt, Human
accaguguuguggauuua

SEQ ID NO: 1384749 - RNA, 18 nt, Human
accauaauguuacauuau

SEQ ID NO: 1384750 - RNA, 15 nt, Human
accauaauguuacau

SEQ ID NO: 1384751 - RNA, 13 nt, Human
accauaauguuac

SEQ ID NO: 1384752 - RNA, 19 nt, Human
ucagauuucugguuguuau

SEQ ID NO: 1384753 - RNA, 16 nt, Human
ucagauuucugaggaa

SEQ ID NO: 1384754 - RNA, 23 nt, Human
ucagccagcacuuguccagcuga

SEQ ID NO: 1384755 - RNA, 14 nt, Human
ucagccagcacuug

SEQ ID NO: 1384756 - RNA, 12 nt, Human
ucagccagcacu

SEQ ID NO: 1384757 - RNA, 16 nt, Human
ucagccacccugaguu

SEQ ID NO: 1384758 - RNA, 17 nt, Human
ucagccacccugaguug

SEQ ID NO: 1384759 - RNA, 18 nt, Human
ucagccaauuauguuaaa

SEQ ID NO: 1384760 - RNA, 13 nt, Human
ucagccaauuaug

SEQ ID NO: 1384761 - RNA, 15 nt, Human
ucagccaauuauguu

SEQ ID NO: 1384762 - RNA, 17 nt, Human
ucagccaauuauguuaa

SEQ ID NO: 1384763 - RNA, 14 nt, Human
ucagauuuuuuccu

SEQ ID NO: 1384764 - RNA, 23 nt, Human
accaaagaugaaugaagcaaaug

SEQ ID NO: 1384765 - RNA, 18 nt, Human
accaaagaugaaugaagc

SEQ ID NO: 1384766 - RNA, 15 nt, Human
accaaagaagaaagu

SEQ ID NO: 1384767 - RNA, 23 nt, Human
accaaaaguuacauguuugcacc

SEQ ID NO: 1384768 - RNA, 21 nt, Human
accaaaaguuacauguuugca

SEQ ID NO: 1384769 - RNA, 14 nt, Human
accaaaaguuacau

SEQ ID NO: 1384770 - RNA, 14 nt, Human
accaaaagaaguaa

SEQ ID NO: 1384771 - RNA, 21 nt, Human
accaaaagaaguaaaagcaaa

SEQ ID NO: 1384772 - RNA, 13 nt, Human
accaaaagaagua

SEQ ID NO: 1384773 - RNA, 13 nt, Human
accaaaacugcuc

SEQ ID NO: 1384774 - RNA, 14 nt, Human
accaaaacugcucc

SEQ ID NO: 1384775 - RNA, 16 nt, Human
accaaaacaguuaauc

SEQ ID NO: 1384776 - RNA, 21 nt, Human
acauuuuuaagugcugcauuu

SEQ ID NO: 1384777 - RNA, 22 nt, Human
acauuuuuaagugcugcauuua

SEQ ID NO: 1384778 - RNA, 23 nt, Human
acauuuuuaagugcugcauuuaa

SEQ ID NO: 1384779 - RNA, 14 nt, Human
acauuuuuuaaaug

SEQ ID NO: 1384780 - RNA, 16 nt, Human
acauuuuuuaaaugca

SEQ ID NO: 1384781 - RNA, 17 nt, Human
acauuuuuuaaaugcac

SEQ ID NO: 1384782 - RNA, 21 nt, Human
acauuuuuuaaaugcaccugg

SEQ ID NO: 1384783 - RNA, 17 nt, Human
acauuguugagcuauug

SEQ ID NO: 1384784 - RNA, 11 nt, Human
acauugugcca

SEQ ID NO: 1384785 - RNA, 18 nt, Human
acauugcaucaaagcauc

SEQ ID NO: 1384786 - RNA, 17 nt, Human
acauugcaucaaagcau

SEQ ID NO: 1384787 - RNA, 20 nt, Human
acauuuuguaacaaagaacu

SEQ ID NO: 1384788 - RNA, 21 nt, Human
acauuuugaaagucuguccuu

SEQ ID NO: 1384789 - RNA, 17 nt, Human
acauuuugaaagucugu

SEQ ID NO: 1384790 - RNA, 13 nt, Human
acauuuugaaagu

SEQ ID NO: 1384791 - RNA, 19 nt, Human
acauuuucuaagaaacauu

SEQ ID NO: 1384792 - RNA, 18 nt, Human
acauuuucuaagaaacau

SEQ ID NO: 1384793 - RNA, 19 nt, Human
acauuuuccuuuucaaaua

SEQ ID NO: 1384794 - RNA, 12 nt, Human
acauuuuccuuu

SEQ ID NO: 1384795 - RNA, 12 nt, Human
acauuuucagug

SEQ ID NO: 1384796 - RNA, 14 nt, Human
acauuguugagcua

SEQ ID NO: 1384797 - RNA, 18 nt, Human
acauuuuauuuuauuaug

SEQ ID NO: 1384798 - RNA, 14 nt, Human
acauuuuauuuuau

SEQ ID NO: 1384799 - RNA, 19 nt, Human
acauuuuauuuuauuaugc

SEQ ID NO: 1384800 - RNA, 20 nt, Human
acauuuuauuuuauuaugca

SEQ ID NO: 1384801 - RNA, 19 nt, Human
ucaacuuauuaacaauuag

SEQ ID NO: 1384802 - RNA, 22 nt, Human
ucaacugucuccuaccucugcu

SEQ ID NO: 1384803 - RNA, 16 nt, Human
ucaacuugagcauguu

SEQ ID NO: 1384804 - RNA, 20 nt, Human
ucaacuugagcauguuacug

SEQ ID NO: 1384805 - RNA, 14 nt, Human
ucaacuugcuuauc

SEQ ID NO: 1384806 - RNA, 15 nt, Human
ucaacuuuuccuuug

SEQ ID NO: 1384807 - RNA, 21 nt, Human
ucaacuuuuccuuugaauccu

SEQ ID NO: 1384808 - RNA, 20 nt, Human
ucaaguccugccucuuaaau

SEQ ID NO: 1384809 - RNA, 19 nt, Human
ucaaguccugccucuuaaa

SEQ ID NO: 1384810 - RNA, 18 nt, Human
ucaauauaagcuuuucuu

SEQ ID NO: 1384811 - RNA, 23 nt, Human
ucaagucuuucucuuucccuggu

SEQ ID NO: 1384812 - RNA, 22 nt, Human
ucaagucuuucucuuucccugg

SEQ ID NO: 1384813 - RNA, 21 nt, Human
ucaagucuuucucuuucccug

SEQ ID NO: 1384814 - RNA, 20 nt, Human
ucaagucuuucucuuucccu

SEQ ID NO: 1384815 - RNA, 18 nt, Human
ucaagucuuucucuuucc

SEQ ID NO: 1384816 - RNA, 15 nt, Human
ucaagucuuucucuu

SEQ ID NO: 1384817 - RNA, 19 nt, Human
ucaagucuguuuacugcaa

SEQ ID NO: 1384818 - RNA, 15 nt, Human
ucaauauucaauaaa

SEQ ID NO: 1384819 - RNA, 16 nt, Human
ucaauauucaauaaag

SEQ ID NO: 1384820 - RNA, 17 nt, Human
ucaauauucaauaaagc

SEQ ID NO: 1384821 - RNA, 17 nt, Human
ucaaugagguguccaac

SEQ ID NO: 1384822 - RNA, 16 nt, Human
ucaaugagguguccaa

SEQ ID NO: 1384823 - RNA, 21 nt, Human
ucaaugagcauguuuagacuu

SEQ ID NO: 1384824 - RNA, 19 nt, Human
ucaaugagcauguuuagac

SEQ ID NO: 1384825 - RNA, 17 nt, Human
ucaaugagcauguuuag

SEQ ID NO: 1384826 - RNA, 14 nt, Human
ucaaugagcauguu

SEQ ID NO: 1384827 - RNA, 13 nt, Human
ucaaugagcaugu

SEQ ID NO: 1384828 - RNA, 12 nt, Human
ucaaugagcaug

SEQ ID NO: 1384829 - RNA, 22 nt, Human
ucaaugacaugaauuuuagcuu

SEQ ID NO: 1384830 - RNA, 23 nt, Human
ucaaugacaugaauuuuagcuuu

SEQ ID NO: 1384831 - RNA, 21 nt, Human
ucaaugacaugaauuuuagcu

SEQ ID NO: 1384832 - RNA, 16 nt, Human
ucaaugacaugaauuu

SEQ ID NO: 1384833 - RNA, 15 nt, Human
ucaaugacaugaauu

SEQ ID NO: 1384834 - RNA, 14 nt, Human
ucaaugacaugaau

SEQ ID NO: 1384835 - RNA, 21 nt, Human
ucaaugaauuuuauaaucugc

SEQ ID NO: 1384836 - RNA, 20 nt, Human
ucaaucuugcauguaacgca

SEQ ID NO: 1384837 - RNA, 18 nt, Human
ucaaucuuuaaaccaauu

SEQ ID NO: 1384838 - RNA, 19 nt, Human
ucaaucucugggggcugag

SEQ ID NO: 1384839 - RNA, 16 nt, Human
ucaaucuguaaacugu

SEQ ID NO: 1384840 - RNA, 14 nt, Human
ucaaucuguaaacu

SEQ ID NO: 1384841 - RNA, 13 nt, Human
ucaaucuguaaac

SEQ ID NO: 1384842 - RNA, 18 nt, Human
ucaaucuugcauguaacg

SEQ ID NO: 1384843 - RNA, 17 nt, Human
ucaaucuugcauguaac

SEQ ID NO: 1384844 - RNA, 16 nt, Human
ucaaucuugcauguaa

SEQ ID NO: 1384845 - RNA, 15 nt, Human
ucaaucuugcaugua

SEQ ID NO: 1384846 - RNA, 17 nt, Human
ucaaucuguaaacugug

SEQ ID NO: 1384847 - RNA, 19 nt, Human
ucaauauuucagauaauca

SEQ ID NO: 1384848 - RNA, 15 nt, Human
ucaauauuucagaua

SEQ ID NO: 1384849 - RNA, 17 nt, Human
acaugaauuuuagcuuu

SEQ ID NO: 1384850 - RNA, 15 nt, Human
acaugaauuuuagcu

SEQ ID NO: 1384851 - RNA, 21 nt, Human
acaugaauuauuacaguguuu

SEQ ID NO: 1384852 - RNA, 18 nt, Human
acaugaauugcauuuuac

SEQ ID NO: 1384853 - RNA, 19 nt, Human
acaugaauuauuacagugu

SEQ ID NO: 1384854 - RNA, 17 nt, Human
acaugaauuauuacagu

SEQ ID NO: 1384855 - RNA, 18 nt, Human
acagucccuauggaaaga

SEQ ID NO: 1384856 - RNA, 18 nt, Human
acaugaauuuuagcuuuu

SEQ ID NO: 1384857 - RNA, 20 nt, Human
acaugaauauuuaguguuca

SEQ ID NO: 1384858 - RNA, 23 nt, Human
acaugcgguagccagcacacagg

SEQ ID NO: 1384859 - RNA, 22 nt, Human
acaugcgguagccagcacacag

SEQ ID NO: 1384860 - RNA, 20 nt, Human
acaugcgguagccagcacac

SEQ ID NO: 1384861 - RNA, 15 nt, Human
acaugcuacacacug

SEQ ID NO: 1384862 - RNA, 21 nt, Human
acaugcuacacacugcauguu

SEQ ID NO: 1384863 - RNA, 19 nt, Human
acaugcuuagcaguccccu

SEQ ID NO: 1384864 - RNA, 24 nt, Human
acaugcuaagagaaguagaaauca

SEQ ID NO: 1384865 - RNA, 19 nt, Human
acaugcuaagagaaguaga

SEQ ID NO: 1384866 - RNA, 18 nt, Human
acaugcuaagagaaguag

SEQ ID NO: 1384867 - RNA, 17 nt, Human
acaugcuaagagaagua

SEQ ID NO: 1384868 - RNA, 22 nt, Human
acaugcuacacacugcauguuu

SEQ ID NO: 1384869 - RNA, 23 nt, Human
acaugcuuauuccaugacugcuu

SEQ ID NO: 1384870 - RNA, 22 nt, Human
acaugcuuauuccaugacugcu

SEQ ID NO: 1384871 - RNA, 21 nt, Human
acaugcuuauuccaugacugc

SEQ ID NO: 1384872 - RNA, 18 nt, Human
acaugcuuauuccaugac

SEQ ID NO: 1384873 - RNA, 17 nt, Human
acaugcuuauuccauga

SEQ ID NO: 1384874 - RNA, 15 nt, Human
acaugcuuauuccau

SEQ ID NO: 1384875 - RNA, 23 nt, Human
acaugcuuagcaguccccuuccc

SEQ ID NO: 1384876 - RNA, 13 nt, Human
acaugcuucccuu

SEQ ID NO: 1384877 - RNA, 16 nt, Human
acaugcuucccuuucc

SEQ ID NO: 1384878 - RNA, 18 nt, Human
acaugcuucccuuuccug

SEQ ID NO: 1384879 - RNA, 19 nt, Human
acaugcuucccuuuccuga

SEQ ID NO: 1384880 - RNA, 13 nt, Human
acauggggaggag

SEQ ID NO: 1384881 - RNA, 15 nt, Human
acauggggaggagga

SEQ ID NO: 1384882 - RNA, 11 nt, Human
acauggggagg

SEQ ID NO: 1384883 - RNA, 23 nt, Human
acaugggagccgggucugccucu

SEQ ID NO: 1384884 - RNA, 14 nt, Human
acaugggacauuug

SEQ ID NO: 1384885 - RNA, 11 nt, Human
acaugggacau

SEQ ID NO: 1384886 - RNA, 20 nt, Human
acaugggagccgggucugcc

SEQ ID NO: 1384887 - RNA, 21 nt, Human
acaugggacauuugcucaugg

SEQ ID NO: 1384888 - RNA, 20 nt, Human
acaugggacauuugcucaug

SEQ ID NO: 1384889 - RNA, 15 nt, Human
acaugggacauuugc

SEQ ID NO: 1384890 - RNA, 14 nt, Human
ucaacauuucucaa

SEQ ID NO: 1384891 - RNA, 21 nt, Human
ucaacaaagaaacaaagaugu

SEQ ID NO: 1384892 - RNA, 20 nt, Human
ucaacaaagaaacaaagaug

SEQ ID NO: 1384893 - RNA, 14 nt, Human
ucaacaaagaaaca

SEQ ID NO: 1384894 - RNA, 12 nt, Human
ucaacaaacauu

SEQ ID NO: 1384895 - RNA, 18 nt, Human
ucaacaaaaauugucccu

SEQ ID NO: 1384896 - RNA, 15 nt, Human
ucaacaaaaauuguc

SEQ ID NO: 1384897 - RNA, 20 nt, Human
acauucugaaugcuucuaag

SEQ ID NO: 1384898 - RNA, 14 nt, Human
ucaaauuucuaaau

SEQ ID NO: 1384899 - RNA, 13 nt, Human
ucaaauuucuaaa

SEQ ID NO: 1384900 - RNA, 20 nt, Human
ucaacugccuacuccaaaau

SEQ ID NO: 1384901 - RNA, 18 nt, Human
ucaacugccuacuccaaa

SEQ ID NO: 1384902 - RNA, 14 nt, Human
ucaacugccuacuc

SEQ ID NO: 1384903 - RNA, 15 nt, Human
ucaaccccuccccuc

SEQ ID NO: 1384904 - RNA, 18 nt, Human
ucaaccccagacacuggu

SEQ ID NO: 1384905 - RNA, 17 nt, Human
ucaaccccagacacugg

SEQ ID NO: 1384906 - RNA, 16 nt, Human
ucaaccccagacacug

SEQ ID NO: 1384907 - RNA, 16 nt, Human
ucaaccaucgcuuuau

SEQ ID NO: 1384908 - RNA, 19 nt, Human
acauuccucaugaauguaa

SEQ ID NO: 1384909 - RNA, 18 nt, Human
acauuccucaugaaugua

SEQ ID NO: 1384910 - RNA, 17 nt, Human
acauuccucaugaaugu

SEQ ID NO: 1384911 - RNA, 21 nt, Human
acaugucaguaccuucaaacu

SEQ ID NO: 1384912 - RNA, 19 nt, Human
acaugucaguaccuucaaa

SEQ ID NO: 1384913 - RNA, 18 nt, Human
acaugucaguaccuucaa

SEQ ID NO: 1384914 - RNA, 15 nt, Human
acaugucaaucuguc

SEQ ID NO: 1384915 - RNA, 12 nt, Human
acaugucaaucu

SEQ ID NO: 1384916 - RNA, 17 nt, Human
acauguaggaaguagga

SEQ ID NO: 1384917 - RNA, 21 nt, Human
acauuccucaugaauguaaau

SEQ ID NO: 1384918 - RNA, 20 nt, Human
acauuccucaugaauguaaa

SEQ ID NO: 1384919 - RNA, 22 nt, Human
acauuccucaugaauguaaauu

SEQ ID NO: 1384920 - RNA, 15 nt, Human
acauuccugaacagg

SEQ ID NO: 1384921 - RNA, 14 nt, Human
acauuccugaacag

SEQ ID NO: 1384922 - RNA, 14 nt, Human
acauucugaaugcu

SEQ ID NO: 1384923 - RNA, 11 nt, Human
acauucugaau

SEQ ID NO: 1384924 - RNA, 23 nt, Human
acauucugauucgaaugacacug

SEQ ID NO: 1384925 - RNA, 21 nt, Human
acauucugaaugcuucuaagu

SEQ ID NO: 1384926 - RNA, 18 nt, Human
acauucugaaugcuucua

SEQ ID NO: 1384927 - RNA, 15 nt, Human
acauucugaaugcuu

SEQ ID NO: 1384928 - RNA, 18 nt, Human
ucaaauugugugaaaggu

SEQ ID NO: 1384929 - RNA, 17 nt, Human
ucacugugucacccagg

SEQ ID NO: 1384930 - RNA, 17 nt, Human
ucacuguuuagaacaca

SEQ ID NO: 1384931 - RNA, 20 nt, Human
ucacuguuuagaacacacac

SEQ ID NO: 1384932 - RNA, 20 nt, Human
accaguaggggcuuauaaua

SEQ ID NO: 1384933 - RNA, 17 nt, Human
accaguccccccacccu

SEQ ID NO: 1384934 - RNA, 15 nt, Human
accaguguuguggau

SEQ ID NO: 1384935 - RNA, 17 nt, Human
accaguguuguggauuu

SEQ ID NO: 1384936 - RNA, 15 nt, Human
accaguccccccacc

SEQ ID NO: 1384937 - RNA, 15 nt, Human
accagucccagagca

SEQ ID NO: 1384938 - RNA, 14 nt, Human
accagucugacugu

SEQ ID NO: 1384939 - RNA, 19 nt, Human
accaguauuuagaagccaa

SEQ ID NO: 1384940 - RNA, 18 nt, Human
accaguauuuagaagcca

SEQ ID NO: 1384941 - RNA, 14 nt, Human
accaguauuuagaa

SEQ ID NO: 1384942 - RNA, 11 nt, Human
accaguauuua

SEQ ID NO: 1384943 - RNA, 20 nt, Human
accaguaucgcucauagauc

SEQ ID NO: 1384944 - RNA, 12 nt, Human
accaggaagccg

SEQ ID NO: 1384945 - RNA, 13 nt, Human
accaggaacagca

SEQ ID NO: 1384946 - RNA, 22 nt, Human
accagcuuccuucagagagcag

SEQ ID NO: 1384947 - RNA, 23 nt, Human
accagcuuccuucagagagcagu

SEQ ID NO: 1384948 - RNA, 21 nt, Human
accagcuuccuucagagagca

SEQ ID NO: 1384949 - RNA, 20 nt, Human
accagcuuccuucagagagc

SEQ ID NO: 1384950 - RNA, 18 nt, Human
accagcuuccuucagaga

SEQ ID NO: 1384951 - RNA, 17 nt, Human
accagcuuccuucagag

SEQ ID NO: 1384952 - RNA, 15 nt, Human
accagcuuccuucag

SEQ ID NO: 1384953 - RNA, 22 nt, Human
accagcugcuccgaggacccag

SEQ ID NO: 1384954 - RNA, 19 nt, Human
accagcucccccucccucc

SEQ ID NO: 1384955 - RNA, 20 nt, Human
accagcucccccucccuccc

SEQ ID NO: 1384956 - RNA, 23 nt, Human
accagcucaggacagaugccaca

SEQ ID NO: 1384957 - RNA, 16 nt, Human
accacuagccucaggg

SEQ ID NO: 1384958 - RNA, 17 nt, Human
accacuacauucuguua

SEQ ID NO: 1384959 - RNA, 16 nt, Human
accacuacauucuguu

SEQ ID NO: 1384960 - RNA, 16 nt, Human
accagcucaggacaga

SEQ ID NO: 1384961 - RNA, 15 nt, Human
accagcucaggacag

SEQ ID NO: 1384962 - RNA, 14 nt, Human
accagcucaggaca

SEQ ID NO: 1384963 - RNA, 13 nt, Human
accagcucaggac

SEQ ID NO: 1384964 - RNA, 16 nt, Human
accagcucagcacugc

SEQ ID NO: 1384965 - RNA, 14 nt, Human
accagcucagcacu

SEQ ID NO: 1384966 - RNA, 13 nt, Human
accagcucagcac

SEQ ID NO: 1384967 - RNA, 19 nt, Human
accagcgcuugaagccuga

SEQ ID NO: 1384968 - RNA, 15 nt, Human
accacuagccucagg

SEQ ID NO: 1384969 - RNA, 14 nt, Human
ucaccucauggaau

SEQ ID NO: 1384970 - RNA, 13 nt, Human
ucaccucauggaa

SEQ ID NO: 1384971 - RNA, 12 nt, Human
ucaccucaugga

SEQ ID NO: 1384972 - RNA, 19 nt, Human
ucaccuguaaaccugaguc

SEQ ID NO: 1384973 - RNA, 17 nt, Human
ucaccuguaaaccugag

SEQ ID NO: 1384974 - RNA, 16 nt, Human
ucaccuguaaaccuga

SEQ ID NO: 1384975 - RNA, 14 nt, Human
ucaccugugcuucg

SEQ ID NO: 1384976 - RNA, 18 nt, Human
ucacuaauucauuaaucu

SEQ ID NO: 1384977 - RNA, 15 nt, Human
ucacuaauucauuaa

SEQ ID NO: 1384978 - RNA, 14 nt, Human
ucacuaauucauua

SEQ ID NO: 1384979 - RNA, 23 nt, Human
ucacuaggcccccacuugccucu

SEQ ID NO: 1384980 - RNA, 12 nt, Human
ucacuaaaucuu

SEQ ID NO: 1384981 - RNA, 17 nt, Human
ucacuaaaucuuuuaua

SEQ ID NO: 1384982 - RNA, 21 nt, Human
ucacguuuggugcuucucaga

SEQ ID NO: 1384983 - RNA, 20 nt, Human
ucacguccugagaaagcuca

SEQ ID NO: 1384984 - RNA, 20 nt, Human
ucacguuaccauuuacaugu

SEQ ID NO: 1384985 - RNA, 22 nt, Human
ucacguuucauguaauccucaa

SEQ ID NO: 1384986 - RNA, 17 nt, Human
ucacguuuggugcuucu

SEQ ID NO: 1384987 - RNA, 21 nt, Human
ucaccauguuagccaggcugg

SEQ ID NO: 1384988 - RNA, 20 nt, Human
ucacauagcccacuuacauu

SEQ ID NO: 1384989 - RNA, 19 nt, Human
ucacauagcccacuuacau

SEQ ID NO: 1384990 - RNA, 14 nt, Human
ucacauagcccacu

SEQ ID NO: 1384991 - RNA, 16 nt, Human
ucacaguuugaaauaa

SEQ ID NO: 1384992 - RNA, 15 nt, Human
ucacaguuugaaaua

SEQ ID NO: 1384993 - RNA, 17 nt, Human
ucacaguuugaaauaag

SEQ ID NO: 1384994 - RNA, 22 nt, Human
ucacaguucuuugggccagaca

SEQ ID NO: 1384995 - RNA, 20 nt, Human
ucacaguucuuugggccaga

SEQ ID NO: 1384996 - RNA, 19 nt, Human
ucacaguucuuugggccag

SEQ ID NO: 1384997 - RNA, 13 nt, Human
ucacagcggaggu

SEQ ID NO: 1384998 - RNA, 18 nt, Human
ucacccccagcuuugcua

SEQ ID NO: 1384999 - RNA, 13 nt, Human
ucacccccagcuu

SEQ ID NO: 1385000 - RNA, 20 nt, Human
ucacccagacauaaaggaaa

SEQ ID NO: 1385001 - RNA, 19 nt, Human
ucacccagacauaaaggaa

SEQ ID NO: 1385002 - RNA, 15 nt, Human
ucacccagacauaaa

SEQ ID NO: 1385003 - RNA, 14 nt, Human
ucacccaccccugc

SEQ ID NO: 1385004 - RNA, 13 nt, Human
ucacccaccccug

SEQ ID NO: 1385005 - RNA, 20 nt, Human
ucaccauuuggauccugugu

SEQ ID NO: 1385006 - RNA, 13 nt, Human
ucacccaacgcuc

SEQ ID NO: 1385007 - RNA, 23 nt, Human
ucaccauuuggcaaugccaucau

SEQ ID NO: 1385008 - RNA, 16 nt, Human
ucaccauuuggauccu

SEQ ID NO: 1385009 - RNA, 22 nt, Human
ucaccauuugauuauguagcaa

SEQ ID NO: 1385010 - RNA, 17 nt, Human
ucaccauuugauuaugu

SEQ ID NO: 1385011 - RNA, 23 nt, Human
ucaccauuauaaugaauuuagug

SEQ ID NO: 1385012 - RNA, 17 nt, Human
ucaccauguuagccagg

SEQ ID NO: 1385013 - RNA, 13 nt, Human
ucaccauucccag

SEQ ID NO: 1385014 - RNA, 20 nt, Human
ucaccauuauaaugaauuua

SEQ ID NO: 1385015 - RNA, 15 nt, Human
ucaccauuauaauga

SEQ ID NO: 1385016 - RNA, 20 nt, Human
accacagccagcaccuggca

SEQ ID NO: 1385017 - RNA, 19 nt, Human
accacagccagcaccuggc

SEQ ID NO: 1385018 - RNA, 18 nt, Human
ucacccccuucuccaucc

SEQ ID NO: 1385019 - RNA, 22 nt, Human
ucacccccuucuccauccacau

SEQ ID NO: 1385020 - RNA, 16 nt, Human
ucacccccuucuccau

SEQ ID NO: 1385021 - RNA, 13 nt, Human
ucacccccuucuc

SEQ ID NO: 1385022 - RNA, 17 nt, Human
accacaggcucaggcag

SEQ ID NO: 1385023 - RNA, 16 nt, Human
accacaggcucaggca

SEQ ID NO: 1385024 - RNA, 15 nt, Human
accacaggcucaggc

SEQ ID NO: 1385025 - RNA, 19 nt, Human
accaccaacuacuaccugu

SEQ ID NO: 1385026 - RNA, 13 nt, Human
accacauugcuuu

SEQ ID NO: 1385027 - RNA, 22 nt, Human
accacaugccccaucccaugcu

SEQ ID NO: 1385028 - RNA, 23 nt, Human
accacaugccccaucccaugcug

SEQ ID NO: 1385029 - RNA, 24 nt, Human
accacauuggagauguuuaguaau

SEQ ID NO: 1385030 - RNA, 15 nt, Human
accacauugcuuuuc

SEQ ID NO: 1385031 - RNA, 16 nt, Human
accaccaagccaaggg

SEQ ID NO: 1385032 - RNA, 16 nt, Human
accaccacgccuggcu

SEQ ID NO: 1385033 - RNA, 16 nt, Human
ucaauuuauuugaaug

SEQ ID NO: 1385034 - RNA, 20 nt, Human
ucaauuuauuugaaugauuu

SEQ ID NO: 1385035 - RNA, 14 nt, Human
ucaauuuauuugaa

SEQ ID NO: 1385036 - RNA, 15 nt, Human
ucaauuucugaacac

SEQ ID NO: 1385037 - RNA, 15 nt, Human
ucaauuucuguguug

SEQ ID NO: 1385038 - RNA, 23 nt, Human
ucaauuucuguguugccaagcuc

SEQ ID NO: 1385039 - RNA, 21 nt, Human
ucacaaacuuuuauacucuuu

SEQ ID NO: 1385040 - RNA, 17 nt, Human
ucacaaacuuuuauacu

SEQ ID NO: 1385041 - RNA, 15 nt, Human
ucacaaacuuuuaua

SEQ ID NO: 1385042 - RNA, 19 nt, Human
ucacaaacuucauuucaga

SEQ ID NO: 1385043 - RNA, 20 nt, Human
ucacaaaauauauuuuguuu

SEQ ID NO: 1385044 - RNA, 12 nt, Human
accaaaguucua

SEQ ID NO: 1385045 - RNA, 11 nt, Human
accaaaguucu

SEQ ID NO: 1385046 - RNA, 21 nt, Human
accaaaguccuuuuuuuccau

SEQ ID NO: 1385047 - RNA, 20 nt, Human
accaaagggagucugccagg

SEQ ID NO: 1385048 - RNA, 19 nt, Human
accaaagggagucugccag

SEQ ID NO: 1385049 - RNA, 17 nt, Human
accaaagggagucugcc

SEQ ID NO: 1385050 - RNA, 11 nt, Human
accaaagcaca

SEQ ID NO: 1385051 - RNA, 20 nt, Human
accaaagcaccuuagcuggc

SEQ ID NO: 1385052 - RNA, 22 nt, Human
ucaauugcaucucccagauaau

SEQ ID NO: 1385053 - RNA, 18 nt, Human
ucaauugcaucucccaga

SEQ ID NO: 1385054 - RNA, 17 nt, Human
ucaauugcaucucccag

SEQ ID NO: 1385055 - RNA, 16 nt, Human
ucaauugcaucuccca

SEQ ID NO: 1385056 - RNA, 16 nt, Human
ucaauucuugccaaau

SEQ ID NO: 1385057 - RNA, 13 nt, Human
ucacaaccaagaa

SEQ ID NO: 1385058 - RNA, 22 nt, Human
ucacaacagccugacaacauuu

SEQ ID NO: 1385059 - RNA, 14 nt, Human
ucacaacagccuga

SEQ ID NO: 1385060 - RNA, 16 nt, Human
ucacaacgugcauugu

SEQ ID NO: 1385061 - RNA, 17 nt, Human
ucacaacgugcauugug

SEQ ID NO: 1385062 - RNA, 18 nt, Human
ucacaacgugcauugugc

SEQ ID NO: 1385063 - RNA, 19 nt, Human
ucacaacgugcauugugcu

SEQ ID NO: 1385064 - RNA, 20 nt, Human
ucacaacgugcauugugcuu

SEQ ID NO: 1385065 - RNA, 21 nt, Human
ucacaacgugcauugugcuuc

SEQ ID NO: 1385066 - RNA, 18 nt, Human
ucacacuggucugcuguc

SEQ ID NO: 1385067 - RNA, 17 nt, Human
ucacacuggucugcugu

SEQ ID NO: 1385068 - RNA, 23 nt, Human
ucacacugggugguggccugguc

SEQ ID NO: 1385069 - RNA, 22 nt, Human
ucacacugggugguggccuggu

SEQ ID NO: 1385070 - RNA, 21 nt, Human
ucacacugggugguggccugg

SEQ ID NO: 1385071 - RNA, 16 nt, Human
ucacacuggguggugg

SEQ ID NO: 1385072 - RNA, 11 nt, Human
ucacacuggga

SEQ ID NO: 1385073 - RNA, 20 nt, Human
ucccagcuaggaagagcagg

SEQ ID NO: 1385074 - RNA, 23 nt, Human
ucccagcuaggaagagcaggacu

SEQ ID NO: 1385075 - RNA, 17 nt, Human
ucccagcucuacccugc

SEQ ID NO: 1385076 - RNA, 19 nt, Human
ucccagcucuacccugcau

SEQ ID NO: 1385077 - RNA, 16 nt, Human
ucccagcuaggaagag

SEQ ID NO: 1385078 - RNA, 18 nt, Human
ucccagcccccugaccac

SEQ ID NO: 1385079 - RNA, 17 nt, Human
ucccauuuaucuaaaua

SEQ ID NO: 1385080 - RNA, 13 nt, Human
ucccauuucagcu

SEQ ID NO: 1385081 - RNA, 16 nt, Human
ucccauuuaucgcaga

SEQ ID NO: 1385082 - RNA, 23 nt, Human
uccccagguccagcucuggaggg

SEQ ID NO: 1385083 - RNA, 17 nt, Human
uccccagguccagcucu

SEQ ID NO: 1385084 - RNA, 16 nt, Human
uccccagguccagcuc

SEQ ID NO: 1385085 - RNA, 15 nt, Human
uccccagguccagcu

SEQ ID NO: 1385086 - RNA, 23 nt, Human
uccccagggaagcagcagccucg

SEQ ID NO: 1385087 - RNA, 16 nt, Human
acuacuguguuaugca

SEQ ID NO: 1385088 - RNA, 22 nt, Human
acuacugacggaguccuguguu

SEQ ID NO: 1385089 - RNA, 23 nt, Human
acuacugacauguggggccaggu

SEQ ID NO: 1385090 - RNA, 18 nt, Human
acuacugacauguggggc

SEQ ID NO: 1385091 - RNA, 16 nt, Human
acuagagcaagcagga

SEQ ID NO: 1385092 - RNA, 16 nt, Human
acuagaccuccagcug

SEQ ID NO: 1385093 - RNA, 22 nt, Human
acuauauuguuugcuaagcauu

SEQ ID NO: 1385094 - RNA, 23 nt, Human
acuauauuugggccugcuccaga

SEQ ID NO: 1385095 - RNA, 22 nt, Human
acuauauuugggccugcuccag

SEQ ID NO: 1385096 - RNA, 22 nt, Human
acuauaggcaugcgccaccaug

SEQ ID NO: 1385097 - RNA, 17 nt, Human
acuauauuguuugcuaa

SEQ ID NO: 1385098 - RNA, 20 nt, Human
acuauaggcaugcgccacca

SEQ ID NO: 1385099 - RNA, 15 nt, Human
acuaucucauuucca

SEQ ID NO: 1385100 - RNA, 17 nt, Human
acuaucugucugguggc

SEQ ID NO: 1385101 - RNA, 14 nt, Human
acuaucugucuggu

SEQ ID NO: 1385102 - RNA, 20 nt, Human
acuaucucuacugaauguca

SEQ ID NO: 1385103 - RNA, 17 nt, Human
acuaucucauuuccaag

SEQ ID NO: 1385104 - RNA, 16 nt, Human
acuaucucauuuccaa

SEQ ID NO: 1385105 - RNA, 24 nt, Human
acuauggauaaacuaaacacguga

SEQ ID NO: 1385106 - RNA, 21 nt, Human
acuauggauaaacuaaacacg

SEQ ID NO: 1385107 - RNA, 23 nt, Human
acuauggagugcaccaaagagaa

SEQ ID NO: 1385108 - RNA, 22 nt, Human
acuauggagugcaccaaagaga

SEQ ID NO: 1385109 - RNA, 20 nt, Human
acuauggagugcaccaaaga

SEQ ID NO: 1385110 - RNA, 22 nt, Human
acuauggcccuggccuagcaua

SEQ ID NO: 1385111 - RNA, 17 nt, Human
acucaaggacuuugcag

SEQ ID NO: 1385112 - RNA, 18 nt, Human
acucaaggcggugcuuga

SEQ ID NO: 1385113 - RNA, 17 nt, Human
acucacaacagcugccu

SEQ ID NO: 1385114 - RNA, 15 nt, Human
acuaaaucuuuuaua

SEQ ID NO: 1385115 - RNA, 15 nt, Human
acuaaaugcccugcu

SEQ ID NO: 1385116 - RNA, 13 nt, Human
acuaaaucuuuua

SEQ ID NO: 1385117 - RNA, 20 nt, Human
acuaaagcaggccuuuugau

SEQ ID NO: 1385118 - RNA, 17 nt, Human
acuaaagcaggccuuuu

SEQ ID NO: 1385119 - RNA, 22 nt, Human
acuaaacuuuuuuucuguacca

SEQ ID NO: 1385120 - RNA, 20 nt, Human
acuaaacuuuuuuucuguac

SEQ ID NO: 1385121 - RNA, 19 nt, Human
acuaaacuuuuuuucugua

SEQ ID NO: 1385122 - RNA, 18 nt, Human
acuaaacuuuuuuucugu

SEQ ID NO: 1385123 - RNA, 17 nt, Human
acuaaacuuuuuuucug

SEQ ID NO: 1385124 - RNA, 22 nt, Human
acguuucuaaaggcuaccuuug

SEQ ID NO: 1385125 - RNA, 15 nt, Human
acuaauuuuuauuuu

SEQ ID NO: 1385126 - RNA, 21 nt, Human
acuaacacucagaagccuggg

SEQ ID NO: 1385127 - RNA, 20 nt, Human
acuaacacucagaagccugg

SEQ ID NO: 1385128 - RNA, 19 nt, Human
acuaacacucagaagccug

SEQ ID NO: 1385129 - RNA, 18 nt, Human
acuaacacucagaagccu

SEQ ID NO: 1385130 - RNA, 17 nt, Human
acuaacacucagaagcc

SEQ ID NO: 1385131 - RNA, 15 nt, Human
acuaacacucagaag

SEQ ID NO: 1385132 - RNA, 18 nt, Human
acuaacaaccaaagacua

SEQ ID NO: 1385133 - RNA, 15 nt, Human
acuaauuuuaaaaug

SEQ ID NO: 1385134 - RNA, 17 nt, Human
ucccagcccccugacca

SEQ ID NO: 1385135 - RNA, 16 nt, Human
ucccagcccccugacc

SEQ ID NO: 1385136 - RNA, 15 nt, Human
ucccagcccccugac

SEQ ID NO: 1385137 - RNA, 14 nt, Human
ucccagcccccuga

SEQ ID NO: 1385138 - RNA, 22 nt, Human
ucccagaggggccugccaccug

SEQ ID NO: 1385139 - RNA, 16 nt, Human
ucccagauaaugugaa

SEQ ID NO: 1385140 - RNA, 19 nt, Human
ucccagaggggccugccac

SEQ ID NO: 1385141 - RNA, 16 nt, Human
ucccagaggggccugc

SEQ ID NO: 1385142 - RNA, 21 nt, Human
ucccagaggagccaccaguuc

SEQ ID NO: 1385143 - RNA, 20 nt, Human
ucccagaggagccaccaguu

SEQ ID NO: 1385144 - RNA, 16 nt, Human
ucccagaggagccacc

SEQ ID NO: 1385145 - RNA, 12 nt, Human
ucccagagcagg

SEQ ID NO: 1385146 - RNA, 19 nt, Human
ucccagagcaccugcuguc

SEQ ID NO: 1385147 - RNA, 15 nt, Human
ucccagagcaccugc

SEQ ID NO: 1385148 - RNA, 23 nt, Human
ucccagaggggccugccaccugg

SEQ ID NO: 1385149 - RNA, 23 nt, Human
ucccagaggagccaccaguucuc

SEQ ID NO: 1385150 - RNA, 13 nt, Human
ucccagagcaccu

SEQ ID NO: 1385151 - RNA, 15 nt, Human
ucccagagagcccga

SEQ ID NO: 1385152 - RNA, 16 nt, Human
ucccagagcaaaauaa

SEQ ID NO: 1385153 - RNA, 14 nt, Human
ucccagagagcccg

SEQ ID NO: 1385154 - RNA, 20 nt, Human
ucccagaagaugacugaggg

SEQ ID NO: 1385155 - RNA, 17 nt, Human
ucccagaagaugacuga

SEQ ID NO: 1385156 - RNA, 13 nt, Human
ucccagaagauga

SEQ ID NO: 1385157 - RNA, 12 nt, Human
ucccacuuguca

SEQ ID NO: 1385158 - RNA, 13 nt, Human
acuacacccagca

SEQ ID NO: 1385159 - RNA, 14 nt, Human
acuacacccagcaa

SEQ ID NO: 1385160 - RNA, 16 nt, Human
acuacacccagcaaua

SEQ ID NO: 1385161 - RNA, 15 nt, Human
acuacacccagcaau

SEQ ID NO: 1385162 - RNA, 16 nt, Human
acguguuugugcugug

SEQ ID NO: 1385163 - RNA, 23 nt, Human
acguguguuuuucuauuaaaaga

SEQ ID NO: 1385164 - RNA, 18 nt, Human
acguguguuuuucuauua

SEQ ID NO: 1385165 - RNA, 17 nt, Human
acguguguuuuucuauu

SEQ ID NO: 1385166 - RNA, 16 nt, Human
acguguguuuuucuau

SEQ ID NO: 1385167 - RNA, 14 nt, Human
acguguguuuuucu

SEQ ID NO: 1385168 - RNA, 16 nt, Human
acguccugagaaagcu

SEQ ID NO: 1385169 - RNA, 20 nt, Human
acguccaucacguuagcugu

SEQ ID NO: 1385170 - RNA, 21 nt, Human
acgucacuggaccacugggca

SEQ ID NO: 1385171 - RNA, 16 nt, Human
acguauuuaauagcaa

SEQ ID NO: 1385172 - RNA, 17 nt, Human
acguuuaagccaaaaca

SEQ ID NO: 1385173 - RNA, 16 nt, Human
acguuucuaaaggcua

SEQ ID NO: 1385174 - RNA, 14 nt, Human
acguugugcauuug

SEQ ID NO: 1385175 - RNA, 15 nt, Human
acguugugcauuugg

SEQ ID NO: 1385176 - RNA, 22 nt, Human
acguguguuuuucuauuaaaag

SEQ ID NO: 1385177 - RNA, 16 nt, Human
acguuagucgugagcu

SEQ ID NO: 1385178 - RNA, 21 nt, Human
acguuagucgugagcucuugu

SEQ ID NO: 1385179 - RNA, 22 nt, Human
acguuagucgugagcucuugug

SEQ ID NO: 1385180 - RNA, 19 nt, Human
acguuggagaagcccgugu

SEQ ID NO: 1385181 - RNA, 13 nt, Human
acguugugcauuu

SEQ ID NO: 1385182 - RNA, 21 nt, Human
acguauuuaauagcaaagaau

SEQ ID NO: 1385183 - RNA, 15 nt, Human
acguaauaagguuuu

SEQ ID NO: 1385184 - RNA, 16 nt, Human
acguaaaguacuugua

SEQ ID NO: 1385185 - RNA, 19 nt, Human
acguaaaguacuuguaguu

SEQ ID NO: 1385186 - RNA, 17 nt, Human
acguaauaagguuuuaa

SEQ ID NO: 1385187 - RNA, 15 nt, Human
acggugcccaagcca

SEQ ID NO: 1385188 - RNA, 14 nt, Human
acggugcccaagcc

SEQ ID NO: 1385189 - RNA, 21 nt, Human
uccaguuaaaaaaaauuuuaa

SEQ ID NO: 1385190 - RNA, 21 nt, Human
uccaguguccugagcucagcg

SEQ ID NO: 1385191 - RNA, 22 nt, Human
uccaguguccugagcucagcgu

SEQ ID NO: 1385192 - RNA, 20 nt, Human
uccaguguccugagcucagc

SEQ ID NO: 1385193 - RNA, 19 nt, Human
uccaguguccugagcucag

SEQ ID NO: 1385194 - RNA, 17 nt, Human
uccaguguccugagcuc

SEQ ID NO: 1385195 - RNA, 16 nt, Human
uccaguguccugagcu

SEQ ID NO: 1385196 - RNA, 15 nt, Human
uccaguguccugagc

SEQ ID NO: 1385197 - RNA, 14 nt, Human
acgcugcugucaca

SEQ ID NO: 1385198 - RNA, 19 nt, Human
uccaguuaaaaaaaauuuu

SEQ ID NO: 1385199 - RNA, 22 nt, Human
acggucggggcaucuggccugg

SEQ ID NO: 1385200 - RNA, 21 nt, Human
acggucggggcaucuggccug

SEQ ID NO: 1385201 - RNA, 19 nt, Human
acgcuccagcugccccggc

SEQ ID NO: 1385202 - RNA, 17 nt, Human
acgcuccagcugccccg

SEQ ID NO: 1385203 - RNA, 16 nt, Human
acgcuccagcugcccc

SEQ ID NO: 1385204 - RNA, 14 nt, Human
acgcuccagcugcc

SEQ ID NO: 1385205 - RNA, 11 nt, Human
acgcuccagcu

SEQ ID NO: 1385206 - RNA, 21 nt, Human
acgcuccaaagucauaauugc

SEQ ID NO: 1385207 - RNA, 13 nt, Human
acgcuccaaaguc

SEQ ID NO: 1385208 - RNA, 13 nt, Human
acgcucagugggg

SEQ ID NO: 1385209 - RNA, 22 nt, Human
acgcuauuccagcugucccccc

SEQ ID NO: 1385210 - RNA, 14 nt, Human
acgcuauuccagcu

SEQ ID NO: 1385211 - RNA, 21 nt, Human
acgcugcugucacaaccaaga

SEQ ID NO: 1385212 - RNA, 19 nt, Human
acgcugcugucacaaccaa

SEQ ID NO: 1385213 - RNA, 21 nt, Human
acggagucucacucugucacc

SEQ ID NO: 1385214 - RNA, 16 nt, Human
acggaucagaaauaca

SEQ ID NO: 1385215 - RNA, 17 nt, Human
acggaucagaaauacag

SEQ ID NO: 1385216 - RNA, 19 nt, Human
acgccugaggcaauuagac

SEQ ID NO: 1385217 - RNA, 15 nt, Human
acgccugaggcaauu

SEQ ID NO: 1385218 - RNA, 21 nt, Human
acgccugaggaacccuuacag

SEQ ID NO: 1385219 - RNA, 13 nt, Human
acgccugaggaac

SEQ ID NO: 1385220 - RNA, 21 nt, Human
acgccugagcccagggaggcc

SEQ ID NO: 1385221 - RNA, 20 nt, Human
acgccugagcccagggaggc

SEQ ID NO: 1385222 - RNA, 19 nt, Human
acgccugagcccagggagg

SEQ ID NO: 1385223 - RNA, 18 nt, Human
acgccugagcccagggag

SEQ ID NO: 1385224 - RNA, 17 nt, Human
acgccugagcccaggga

SEQ ID NO: 1385225 - RNA, 16 nt, Human
acgccugagcccaggg

SEQ ID NO: 1385226 - RNA, 15 nt, Human
acgccugagcccagg

SEQ ID NO: 1385227 - RNA, 13 nt, Human
acgccugagccca

SEQ ID NO: 1385228 - RNA, 12 nt, Human
acgccugagccc

SEQ ID NO: 1385229 - RNA, 11 nt, Human
acgccugagcc

SEQ ID NO: 1385230 - RNA, 24 nt, Human
acgccucuugaccaggcugccucc

SEQ ID NO: 1385231 - RNA, 16 nt, Human
acgccucuugaccagg

SEQ ID NO: 1385232 - RNA, 15 nt, Human
acgccucuugaccag

SEQ ID NO: 1385233 - RNA, 18 nt, Human
acgccugggggugccagg

SEQ ID NO: 1385234 - RNA, 17 nt, Human
acgccuggcugcugauc

SEQ ID NO: 1385235 - RNA, 15 nt, Human
acgcgucuuccugag

SEQ ID NO: 1385236 - RNA, 13 nt, Human
acgcgucuuccug

SEQ ID NO: 1385237 - RNA, 15 nt, Human
acgcgguuugguuug

SEQ ID NO: 1385238 - RNA, 20 nt, Human
acgcgguuugguuugcagcg

SEQ ID NO: 1385239 - RNA, 23 nt, Human
acgcgccucgccggaucugaggg

SEQ ID NO: 1385240 - RNA, 19 nt, Human
uccaguaaucuaauauggc

SEQ ID NO: 1385241 - RNA, 15 nt, Human
uccaguaaucuaaua

SEQ ID NO: 1385242 - RNA, 21 nt, Human
acgggacccacaugcuccaga

SEQ ID NO: 1385243 - RNA, 19 nt, Human
acggcucgauuucuccagg

SEQ ID NO: 1385244 - RNA, 18 nt, Human
acggcucgauuucuccag

SEQ ID NO: 1385245 - RNA, 18 nt, Human
acggccacaucaaagagg

SEQ ID NO: 1385246 - RNA, 13 nt, Human
acggccacaucaa

SEQ ID NO: 1385247 - RNA, 20 nt, Human
acggccacacagcugccggu

SEQ ID NO: 1385248 - RNA, 19 nt, Human
acggccacacagcugccgg

SEQ ID NO: 1385249 - RNA, 16 nt, Human
acggcugcgcacugug

SEQ ID NO: 1385250 - RNA, 18 nt, Human
acggcugcgcacuguguc

SEQ ID NO: 1385251 - RNA, 20 nt, Human
acggcucuguccccagccug

SEQ ID NO: 1385252 - RNA, 19 nt, Human
acggcucuguccccagccu

SEQ ID NO: 1385253 - RNA, 18 nt, Human
acggccacacagcugccg

SEQ ID NO: 1385254 - RNA, 17 nt, Human
acggccacacagcugcc

SEQ ID NO: 1385255 - RNA, 16 nt, Human
acggccacacagcugc

SEQ ID NO: 1385256 - RNA, 15 nt, Human
acggccacacagcug

SEQ ID NO: 1385257 - RNA, 13 nt, Human
uccagucuauuca

SEQ ID NO: 1385258 - RNA, 23 nt, Human
uccaguccuaucugggcuuccug

SEQ ID NO: 1385259 - RNA, 22 nt, Human
uccaguccuaucugggcuuccu

SEQ ID NO: 1385260 - RNA, 19 nt, Human
uccaguccuaucugggcuu

SEQ ID NO: 1385261 - RNA, 18 nt, Human
uccaguccuaucugggcu

SEQ ID NO: 1385262 - RNA, 21 nt, Human
uccaguauaagacuacugaau

SEQ ID NO: 1385263 - RNA, 16 nt, Human
uccaguaggauccagu

SEQ ID NO: 1385264 - RNA, 23 nt, Human
uccaguggacuucgcaguccacu

SEQ ID NO: 1385265 - RNA, 23 nt, Human
uccagugggaggugagaccaccu

SEQ ID NO: 1385266 - RNA, 18 nt, Human
uccagaaugcuguacauc

SEQ ID NO: 1385267 - RNA, 19 nt, Human
uccacugugcagguuccca

SEQ ID NO: 1385268 - RNA, 21 nt, Human
uccagaaugcuguacaucuau

SEQ ID NO: 1385269 - RNA, 16 nt, Human
uccacucguguguuuc

SEQ ID NO: 1385270 - RNA, 18 nt, Human
uccacucguguguuucua

SEQ ID NO: 1385271 - RNA, 21 nt, Human
accuuuugaggagccccagcu

SEQ ID NO: 1385272 - RNA, 17 nt, Human
accuuuugaggagcccc

SEQ ID NO: 1385273 - RNA, 16 nt, Human
accuuuuauugacaca

SEQ ID NO: 1385274 - RNA, 20 nt, Human
accuuuuggucuggagggaa

SEQ ID NO: 1385275 - RNA, 20 nt, Human
accuuuuauugacacagaaa

SEQ ID NO: 1385276 - RNA, 20 nt, Human
accuuuuauguaguaauuga

SEQ ID NO: 1385277 - RNA, 15 nt, Human
accuuuuauguagua

SEQ ID NO: 1385278 - RNA, 19 nt, Human
accuuuuuauuugcaugug

SEQ ID NO: 1385279 - RNA, 13 nt, Human
accuuuuuuauac

SEQ ID NO: 1385280 - RNA, 14 nt, Human
uccacucguguguu

SEQ ID NO: 1385281 - RNA, 15 nt, Human
uccacucguguguuu

SEQ ID NO: 1385282 - RNA, 14 nt, Human
accuuuuuuauaca

SEQ ID NO: 1385283 - RNA, 20 nt, Human
accuugaaaauaagaauaga

SEQ ID NO: 1385284 - RNA, 23 nt, Human
accuugaaaaaaaacaguggauc

SEQ ID NO: 1385285 - RNA, 12 nt, Human
ucauuccuccag

SEQ ID NO: 1385286 - RNA, 13 nt, Human
ucauuccuccagg

SEQ ID NO: 1385287 - RNA, 14 nt, Human
ucauuccuccaggu

SEQ ID NO: 1385288 - RNA, 20 nt, Human
accuuucuucaccaaaucuu

SEQ ID NO: 1385289 - RNA, 17 nt, Human
accuuugacaaagguaa

SEQ ID NO: 1385290 - RNA, 18 nt, Human
accuuugacaaagguaaa

SEQ ID NO: 1385291 - RNA, 18 nt, Human
accuuugugcccuaucac

SEQ ID NO: 1385292 - RNA, 13 nt, Human
accuuugugcccu

SEQ ID NO: 1385293 - RNA, 17 nt, Human
accuuugugcccuauca

SEQ ID NO: 1385294 - RNA, 22 nt, Human
accuuuguuugcaucugaaaau

SEQ ID NO: 1385295 - RNA, 16 nt, Human
acgaaauguuauuuuu

SEQ ID NO: 1385296 - RNA, 23 nt, Human
acgaaauguuauuuuuuaauuau

SEQ ID NO: 1385297 - RNA, 13 nt, Human
acgaaauguuauu

SEQ ID NO: 1385298 - RNA, 12 nt, Human
acgaaauguuau

SEQ ID NO: 1385299 - RNA, 23 nt, Human
acgaaauaauuguuguucuguua

SEQ ID NO: 1385300 - RNA, 21 nt, Human
acgaaauaauuguuguucugu

SEQ ID NO: 1385301 - RNA, 17 nt, Human
acgaaauaauuguuguu

SEQ ID NO: 1385302 - RNA, 18 nt, Human
accuuuuuucaacaguga

SEQ ID NO: 1385303 - RNA, 23 nt, Human
accuuuuuucaacagugaagaca

SEQ ID NO: 1385304 - RNA, 23 nt, Human
uccaggagcuccaguguccugag

SEQ ID NO: 1385305 - RNA, 22 nt, Human
uccaggaugcuaacaucuaaaa

SEQ ID NO: 1385306 - RNA, 19 nt, Human
uccaggaugcuaacaucua

SEQ ID NO: 1385307 - RNA, 24 nt, Human
uccaggagcuccaguguccugagc

SEQ ID NO: 1385308 - RNA, 22 nt, Human
uccaggagcuccaguguccuga

SEQ ID NO: 1385309 - RNA, 21 nt, Human
uccaggagcuccaguguccug

SEQ ID NO: 1385310 - RNA, 20 nt, Human
uccaggagcuccaguguccu

SEQ ID NO: 1385311 - RNA, 17 nt, Human
uccaggagcuccagugu

SEQ ID NO: 1385312 - RNA, 15 nt, Human
uccaggagcuccagu

SEQ ID NO: 1385313 - RNA, 13 nt, Human
uccaggagcucca

SEQ ID NO: 1385314 - RNA, 18 nt, Human
uccaggagccugugccuc

SEQ ID NO: 1385315 - RNA, 19 nt, Human
uccagacagggaauuaggc

SEQ ID NO: 1385316 - RNA, 15 nt, Human
uccaggagccugugc

SEQ ID NO: 1385317 - RNA, 23 nt, Human
uccaggagccuggcuccguccag

SEQ ID NO: 1385318 - RNA, 14 nt, Human
uccaggagccuggc

SEQ ID NO: 1385319 - RNA, 13 nt, Human
uccaggagccugg

SEQ ID NO: 1385320 - RNA, 11 nt, Human
uccagccuggg

SEQ ID NO: 1385321 - RNA, 14 nt, Human
uccagccucagcuc

SEQ ID NO: 1385322 - RNA, 20 nt, Human
uccagccugcugccugcuuu

SEQ ID NO: 1385323 - RNA, 23 nt, Human
acucuccugccuugaaaaagaca

SEQ ID NO: 1385324 - RNA, 14 nt, Human
acucuccugccuug

SEQ ID NO: 1385325 - RNA, 12 nt, Human
acucuccugccu

SEQ ID NO: 1385326 - RNA, 23 nt, Human
acucuccuaggcauucuggaccu

SEQ ID NO: 1385327 - RNA, 20 nt, Human
acucuccuaggcauucugga

SEQ ID NO: 1385328 - RNA, 14 nt, Human
acuccuuccugccc

SEQ ID NO: 1385329 - RNA, 15 nt, Human
acuccuuccugcccc

SEQ ID NO: 1385330 - RNA, 23 nt, Human
uccuaggcauucuggaccucugg

SEQ ID NO: 1385331 - RNA, 19 nt, Human
uccuaggcauucuggaccu

SEQ ID NO: 1385332 - RNA, 14 nt, Human
acucugaguguuuu

SEQ ID NO: 1385333 - RNA, 20 nt, Human
acucucuuauugccucacuu

SEQ ID NO: 1385334 - RNA, 20 nt, Human
acucugaguguuuuaugaga

SEQ ID NO: 1385335 - RNA, 21 nt, Human
acucugaguguuuuaugagaa

SEQ ID NO: 1385336 - RNA, 19 nt, Human
acucugccuacagaacuuc

SEQ ID NO: 1385337 - RNA, 20 nt, Human
uccucagccuugccagagau

SEQ ID NO: 1385338 - RNA, 22 nt, Human
uccucaggcacacagcuacucu

SEQ ID NO: 1385339 - RNA, 17 nt, Human
uccucaggcacacagcu

SEQ ID NO: 1385340 - RNA, 16 nt, Human
uccucaggcacacagc

SEQ ID NO: 1385341 - RNA, 15 nt, Human
uccucaggcacacag

SEQ ID NO: 1385342 - RNA, 21 nt, Human
uccucagccuugccagagauc

SEQ ID NO: 1385343 - RNA, 15 nt, Human
uccucccucagugcc

SEQ ID NO: 1385344 - RNA, 17 nt, Human
uccucccgagcuccucu

SEQ ID NO: 1385345 - RNA, 20 nt, Human
uccucccgagcuccucuucc

SEQ ID NO: 1385346 - RNA, 23 nt, Human
uccucccaggguuuuaacuuugu

SEQ ID NO: 1385347 - RNA, 22 nt, Human
uccucccaggguuuuaacuuug

SEQ ID NO: 1385348 - RNA, 12 nt, Human
uccucccagggu

SEQ ID NO: 1385349 - RNA, 11 nt, Human
uccucccaggg

SEQ ID NO: 1385350 - RNA, 18 nt, Human
uccucauccaccccaucc

SEQ ID NO: 1385351 - RNA, 17 nt, Human
uccucauccaccccauc

SEQ ID NO: 1385352 - RNA, 15 nt, Human
uccucauccacccca

SEQ ID NO: 1385353 - RNA, 14 nt, Human
uccucauccacccc

SEQ ID NO: 1385354 - RNA, 12 nt, Human
uccucccagaaa

SEQ ID NO: 1385355 - RNA, 20 nt, Human
uccucccacuucagccuccc

SEQ ID NO: 1385356 - RNA, 18 nt, Human
acucuugccuguuuccca

SEQ ID NO: 1385357 - RNA, 14 nt, Human
acucuugccuguuu

SEQ ID NO: 1385358 - RNA, 22 nt, Human
acucuugcacagucacugcucu

SEQ ID NO: 1385359 - RNA, 16 nt, Human
acucuugauuauccau

SEQ ID NO: 1385360 - RNA, 16 nt, Human
acucuuauaaauuucu

SEQ ID NO: 1385361 - RNA, 19 nt, Human
acucuuauaucuauauuuu

SEQ ID NO: 1385362 - RNA, 22 nt, Human
acucuuauaucuauauuuuaca

SEQ ID NO: 1385363 - RNA, 18 nt, Human
acucuuauaucuauauuu

SEQ ID NO: 1385364 - RNA, 17 nt, Human
acucuuauaucuauauu

SEQ ID NO: 1385365 - RNA, 16 nt, Human
acucuuauaucuauau

SEQ ID NO: 1385366 - RNA, 22 nt, Human
acucuuaccauauguuugguaa

SEQ ID NO: 1385367 - RNA, 14 nt, Human
acucuuaaucaaau

SEQ ID NO: 1385368 - RNA, 15 nt, Human
acucuggcagccaca

SEQ ID NO: 1385369 - RNA, 14 nt, Human
acucuggcagccac

SEQ ID NO: 1385370 - RNA, 13 nt, Human
acucuggcagcca

SEQ ID NO: 1385371 - RNA, 17 nt, Human
acucuggcagccacacu

SEQ ID NO: 1385372 - RNA, 16 nt, Human
acucuggcagccacac

SEQ ID NO: 1385373 - RNA, 21 nt, Human
acucuuaagaagacugcauua

SEQ ID NO: 1385374 - RNA, 21 nt, Human
acuccucccaggguuuuaacu

SEQ ID NO: 1385375 - RNA, 19 nt, Human
acuccucccaggguuuuaa

SEQ ID NO: 1385376 - RNA, 22 nt, Human
acuccucccaggguuuuaacuu

SEQ ID NO: 1385377 - RNA, 15 nt, Human
acuccucccaggguu

SEQ ID NO: 1385378 - RNA, 13 nt, Human
acuccucccaggg

SEQ ID NO: 1385379 - RNA, 19 nt, Human
acuccucauuguaaacaaa

SEQ ID NO: 1385380 - RNA, 19 nt, Human
acuccuaguucuagaaaaa

SEQ ID NO: 1385381 - RNA, 16 nt, Human
acuccuaugaucugag

SEQ ID NO: 1385382 - RNA, 20 nt, Human
acuccuaguucuagaaaaac

SEQ ID NO: 1385383 - RNA, 18 nt, Human
acuccuaguucuagaaaa

SEQ ID NO: 1385384 - RNA, 19 nt, Human
acuccaucugguagaaggg

SEQ ID NO: 1385385 - RNA, 20 nt, Human
acuccaguuaaaaaaaauuu

SEQ ID NO: 1385386 - RNA, 18 nt, Human
acuccaguuaaaaaaaau

SEQ ID NO: 1385387 - RNA, 16 nt, Human
acucacagugcuuuua

SEQ ID NO: 1385388 - RNA, 21 nt, Human
acucacaccugaacugaacac

SEQ ID NO: 1385389 - RNA, 18 nt, Human
acucacaccacuagccuc

SEQ ID NO: 1385390 - RNA, 17 nt, Human
acucacaccacuagccu

SEQ ID NO: 1385391 - RNA, 23 nt, Human
acucacacaggcauuuccugggu

SEQ ID NO: 1385392 - RNA, 22 nt, Human
acucacacaggcauuuccuggg

SEQ ID NO: 1385393 - RNA, 20 nt, Human
acucacacaggcauuuccug

SEQ ID NO: 1385394 - RNA, 19 nt, Human
acucacacaggcauuuccu

SEQ ID NO: 1385395 - RNA, 14 nt, Human
acucacacaggcau

SEQ ID NO: 1385396 - RNA, 13 nt, Human
acucacacaggca

SEQ ID NO: 1385397 - RNA, 12 nt, Human
acucacacaggc

SEQ ID NO: 1385398 - RNA, 17 nt, Human
uccuagcugugugaaua

SEQ ID NO: 1385399 - RNA, 18 nt, Human
uccuagcuguccuuuuuc

SEQ ID NO: 1385400 - RNA, 15 nt, Human
uccuagcuguccuuu

SEQ ID NO: 1385401 - RNA, 13 nt, Human
uccguaaaaauga

SEQ ID NO: 1385402 - RNA, 15 nt, Human
uccguaaaaaugauu

SEQ ID NO: 1385403 - RNA, 16 nt, Human
uccgguguucuaagau

SEQ ID NO: 1385404 - RNA, 15 nt, Human
uccgguguucuaaga

SEQ ID NO: 1385405 - RNA, 14 nt, Human
uccgguguucuaag

SEQ ID NO: 1385406 - RNA, 16 nt, Human
ucccuuuuuuuaagua

SEQ ID NO: 1385407 - RNA, 21 nt, Human
ucccuuuuuuuaaguaaggaa

SEQ ID NO: 1385408 - RNA, 14 nt, Human
ucccuugggcucug

SEQ ID NO: 1385409 - RNA, 13 nt, Human
ucccuugggcucu

SEQ ID NO: 1385410 - RNA, 14 nt, Human
ucccuugggcuccc

SEQ ID NO: 1385411 - RNA, 12 nt, Human
ucccuugggcuc

SEQ ID NO: 1385412 - RNA, 21 nt, Human
ucccuugggcucugaugaaaa

SEQ ID NO: 1385413 - RNA, 17 nt, Human
ucccuugggcucugaug

SEQ ID NO: 1385414 - RNA, 16 nt, Human
ucccuugggcucugau

SEQ ID NO: 1385415 - RNA, 13 nt, Human
ucccuuuuuuuaa

SEQ ID NO: 1385416 - RNA, 17 nt, Human
uccucccucccucuccg

SEQ ID NO: 1385417 - RNA, 18 nt, Human
uccucuuucagcuccuga

SEQ ID NO: 1385418 - RNA, 17 nt, Human
uccucuuucagcuccug

SEQ ID NO: 1385419 - RNA, 14 nt, Human
uccugaaauuucag

SEQ ID NO: 1385420 - RNA, 15 nt, Human
uccugaaauuucaga

SEQ ID NO: 1385421 - RNA, 17 nt, Human
uccugaaacaacuugga

SEQ ID NO: 1385422 - RNA, 23 nt, Human
uccugaaaagguuuaugaaaaag

SEQ ID NO: 1385423 - RNA, 21 nt, Human
uccugaaaagguuuaugaaaa

SEQ ID NO: 1385424 - RNA, 20 nt, Human
acucuuuugcuuuauuccag

SEQ ID NO: 1385425 - RNA, 14 nt, Human
acucuuuugcuuua

SEQ ID NO: 1385426 - RNA, 12 nt, Human
acucuuuugcuu

SEQ ID NO: 1385427 - RNA, 18 nt, Human
acucuuuuccuucccuuu

SEQ ID NO: 1385428 - RNA, 19 nt, Human
acucuuuggucguuuuuuu

SEQ ID NO: 1385429 - RNA, 18 nt, Human
acucuuuguuauuugaaa

SEQ ID NO: 1385430 - RNA, 14 nt, Human
acucuuuguaagag

SEQ ID NO: 1385431 - RNA, 13 nt, Human
acucuuuguaaga

SEQ ID NO: 1385432 - RNA, 23 nt, Human
acucuuucgguagguggaagcua

SEQ ID NO: 1385433 - RNA, 18 nt, Human
acucuuuaugcuugcaaa

SEQ ID NO: 1385434 - RNA, 17 nt, Human
acucuuuaugcuugcaa

SEQ ID NO: 1385435 - RNA, 15 nt, Human
acucuuuaugcuugc

SEQ ID NO: 1385436 - RNA, 14 nt, Human
acucuuuaugcuug

SEQ ID NO: 1385437 - RNA, 18 nt, Human
acucuuuaugaucuggcc

SEQ ID NO: 1385438 - RNA, 13 nt, Human
acucuuucaaaac

SEQ ID NO: 1385439 - RNA, 11 nt, Human
acucuuucaaa

SEQ ID NO: 1385440 - RNA, 13 nt, Human
uccugacacuuua

SEQ ID NO: 1385441 - RNA, 17 nt, Human
uccugacacugcuggag

SEQ ID NO: 1385442 - RNA, 15 nt, Human
uccugacacugcugg

SEQ ID NO: 1385443 - RNA, 13 nt, Human
uccugacacugca

SEQ ID NO: 1385444 - RNA, 22 nt, Human
uccugacacccuucucccacuc

SEQ ID NO: 1385445 - RNA, 21 nt, Human
uccugacacccuucucccacu

SEQ ID NO: 1385446 - RNA, 20 nt, Human
uccugacacccuucucccac

SEQ ID NO: 1385447 - RNA, 19 nt, Human
uccugacacccuucuccca

SEQ ID NO: 1385448 - RNA, 15 nt, Human
acucuuguuuccuua

SEQ ID NO: 1385449 - RNA, 24 nt, Human
acugaacaucugaguccuggauga

SEQ ID NO: 1385450 - RNA, 23 nt, Human
acugaacaucugaguccuggaug

SEQ ID NO: 1385451 - RNA, 20 nt, Human
acugaacaucugaguccugg

SEQ ID NO: 1385452 - RNA, 19 nt, Human
acugaacaucugaguccug

SEQ ID NO: 1385453 - RNA, 15 nt, Human
acugaaaaaauauau

SEQ ID NO: 1385454 - RNA, 22 nt, Human
acugaacaccauugaaggcuua

SEQ ID NO: 1385455 - RNA, 21 nt, Human
acugaacaccauugaaggcuu

SEQ ID NO: 1385456 - RNA, 20 nt, Human
acugaacaccauugaaggcu

SEQ ID NO: 1385457 - RNA, 16 nt, Human
acugaaaaaauauaug

SEQ ID NO: 1385458 - RNA, 14 nt, Human
acugaaaaaauaua

SEQ ID NO: 1385459 - RNA, 13 nt, Human
acugaaaaaauau

SEQ ID NO: 1385460 - RNA, 21 nt, Human
acucuuuugcuuuauuccaga

SEQ ID NO: 1385461 - RNA, 18 nt, Human
acugaacucacuuuccuc

SEQ ID NO: 1385462 - RNA, 16 nt, Human
acugaacuuugcugag

SEQ ID NO: 1385463 - RNA, 19 nt, Human
acugaacuuugcugagccu

SEQ ID NO: 1385464 - RNA, 19 nt, Human
acugagauaccagcgagga

SEQ ID NO: 1385465 - RNA, 20 nt, Human
acugagauccuuccuuuuga

SEQ ID NO: 1385466 - RNA, 18 nt, Human
acugagauaccagcgagg

SEQ ID NO: 1385467 - RNA, 21 nt, Human
acugagaggacagagagaaau

SEQ ID NO: 1385468 - RNA, 22 nt, Human
acugagcaacgcuauuccagcu

SEQ ID NO: 1385469 - RNA, 21 nt, Human
acugagcaacgcuauuccagc

SEQ ID NO: 1385470 - RNA, 20 nt, Human
acugagcaacgcuauuccag

SEQ ID NO: 1385471 - RNA, 20 nt, Human
acugagagaugcagaaauau

SEQ ID NO: 1385472 - RNA, 16 nt, Human
acugagaccaaggcuu

SEQ ID NO: 1385473 - RNA, 23 nt, Human
acugagaccaaggcuuucucuac

SEQ ID NO: 1385474 - RNA, 16 nt, Human
acugagacaaugccuu

SEQ ID NO: 1385475 - RNA, 23 nt, Human
acugacuuugcuugcuuugaagu

SEQ ID NO: 1385476 - RNA, 17 nt, Human
acugacuuugcuugcuu

SEQ ID NO: 1385477 - RNA, 16 nt, Human
acugacuuugcuugcu

SEQ ID NO: 1385478 - RNA, 15 nt, Human
acugacuuugcuugc

SEQ ID NO: 1385479 - RNA, 13 nt, Human
acugacuuugcuu

SEQ ID NO: 1385480 - RNA, 12 nt, Human
acugagaaauuu

SEQ ID NO: 1385481 - RNA, 17 nt, Human
acugagaaauuuauaaa

SEQ ID NO: 1385482 - RNA, 21 nt, Human
acugagaaauuuauaaacuuu

SEQ ID NO: 1385483 - RNA, 24 nt, Human
acugacuauucuugauguaaaauc

SEQ ID NO: 1385484 - RNA, 23 nt, Human
acugacuauucuugauguaaaau

SEQ ID NO: 1385485 - RNA, 22 nt, Human
acugacuauucuugauguaaaa

SEQ ID NO: 1385486 - RNA, 20 nt, Human
acugacucuuaagaagacug

SEQ ID NO: 1385487 - RNA, 18 nt, Human
acugacucuuaagaagac

SEQ ID NO: 1385488 - RNA, 17 nt, Human
acugacucuuaagaaga

SEQ ID NO: 1385489 - RNA, 16 nt, Human
acugacucuuaagaag

SEQ ID NO: 1385490 - RNA, 15 nt, Human
acugacucuuaagaa

SEQ ID NO: 1385491 - RNA, 14 nt, Human
acugacucuuaaga

SEQ ID NO: 1385492 - RNA, 13 nt, Human
acugacucuuaag

SEQ ID NO: 1385493 - RNA, 20 nt, Human
acugacuauucuugauguaa

SEQ ID NO: 1385494 - RNA, 18 nt, Human
acugacuauucuugaugu

SEQ ID NO: 1385495 - RNA, 16 nt, Human
acugacggacucauga

SEQ ID NO: 1385496 - RNA, 13 nt, Human
acugacggacuca

SEQ ID NO: 1385497 - RNA, 14 nt, Human
acugacgccagggu

SEQ ID NO: 1385498 - RNA, 12 nt, Human
acugaagaagca

SEQ ID NO: 1385499 - RNA, 21 nt, Human
acugaacuuugcugagccugu

SEQ ID NO: 1385500 - RNA, 14 nt, Human
uccugaucagagcc

SEQ ID NO: 1385501 - RNA, 19 nt, Human
uccugcaccggggccuggg

SEQ ID NO: 1385502 - RNA, 18 nt, Human
uccugcaccggggccugg

SEQ ID NO: 1385503 - RNA, 15 nt, Human
uccugaucagagccg

SEQ ID NO: 1385504 - RNA, 16 nt, Human
acugauauauuuuaca

SEQ ID NO: 1385505 - RNA, 22 nt, Human
acugauauaucaugagugaaua

SEQ ID NO: 1385506 - RNA, 14 nt, Human
acugagccuuguaa

SEQ ID NO: 1385507 - RNA, 17 nt, Human
acugauauauuuuacaa

SEQ ID NO: 1385508 - RNA, 13 nt, Human
acugauaaagaug

SEQ ID NO: 1385509 - RNA, 21 nt, Human
acugauaaagaugagugagca

SEQ ID NO: 1385510 - RNA, 19 nt, Human
uccugccuuggccucccaa

SEQ ID NO: 1385511 - RNA, 21 nt, Human
uccugccuuggccucccaagu

SEQ ID NO: 1385512 - RNA, 16 nt, Human
uccugccuugaaaaag

SEQ ID NO: 1385513 - RNA, 23 nt, Human
uccugccuuccuccugggcccuc

SEQ ID NO: 1385514 - RNA, 22 nt, Human
uccugccuuccuccugggcccu

SEQ ID NO: 1385515 - RNA, 19 nt, Human
uccugccuuccuccugggc

SEQ ID NO: 1385516 - RNA, 16 nt, Human
uccugccuuccuccug

SEQ ID NO: 1385517 - RNA, 14 nt, Human
uccugccuuccucc

SEQ ID NO: 1385518 - RNA, 14 nt, Human
uccugccuguggcg

SEQ ID NO: 1385519 - RNA, 18 nt, Human
uccugccuguggccauga

SEQ ID NO: 1385520 - RNA, 15 nt, Human
uccugccuguggcca

SEQ ID NO: 1385521 - RNA, 14 nt, Human
uccugccuguggcc

SEQ ID NO: 1385522 - RNA, 18 nt, Human
uccugcugcucccucaga

SEQ ID NO: 1385523 - RNA, 17 nt, Human
uccugcugcucccucag

SEQ ID NO: 1385524 - RNA, 16 nt, Human
uccugcugcucccuca

SEQ ID NO: 1385525 - RNA, 15 nt, Human
uccugcugcucccuc

SEQ ID NO: 1385526 - RNA, 14 nt, Human
uccugcugcucccu

SEQ ID NO: 1385527 - RNA, 19 nt, Human
uccugcugcugucugggug

SEQ ID NO: 1385528 - RNA, 18 nt, Human
uccugcugcugucugggu

SEQ ID NO: 1385529 - RNA, 17 nt, Human
uccugcugcugucuggg

SEQ ID NO: 1385530 - RNA, 15 nt, Human
uccugcugcugucug

SEQ ID NO: 1385531 - RNA, 14 nt, Human
uccugcugcugucu

SEQ ID NO: 1385532 - RNA, 13 nt, Human
uccugcugcuguc

SEQ ID NO: 1385533 - RNA, 20 nt, Human
uccugcugcucccucagacu

SEQ ID NO: 1385534 - RNA, 19 nt, Human
uccugcugcucccucagac

SEQ ID NO: 1385535 - RNA, 22 nt, Human
uccugcuugaugggauucugga

SEQ ID NO: 1385536 - RNA, 20 nt, Human
uccugcugcugucugggugc

SEQ ID NO: 1385537 - RNA, 13 nt, Human
uccugccuguggc

SEQ ID NO: 1385538 - RNA, 12 nt, Human
uccugccugugg

SEQ ID NO: 1385539 - RNA, 22 nt, Human
uccugccucuacugggaaggcu

SEQ ID NO: 1385540 - RNA, 21 nt, Human
uccugccucuacugggaaggc

SEQ ID NO: 1385541 - RNA, 17 nt, Human
uccugccucuacuggga

SEQ ID NO: 1385542 - RNA, 16 nt, Human
uccugccucuacuggg

SEQ ID NO: 1385543 - RNA, 15 nt, Human
uccugccucuacugg

SEQ ID NO: 1385544 - RNA, 21 nt, Human
uccugggaaauauucccuaga

SEQ ID NO: 1385545 - RNA, 20 nt, Human
uccugggaaauauucccuag

SEQ ID NO: 1385546 - RNA, 16 nt, Human
uccugggaaauauucc

SEQ ID NO: 1385547 - RNA, 14 nt, Human
uccugggaaauauu

SEQ ID NO: 1385548 - RNA, 22 nt, Human
uccuggcuucccauccccagcg

SEQ ID NO: 1385549 - RNA, 20 nt, Human
uccuggcuucccauccccag

SEQ ID NO: 1385550 - RNA, 14 nt, Human
uccuggcuucccau

SEQ ID NO: 1385551 - RNA, 23 nt, Human
uccuggcucuugauaccccccuc

SEQ ID NO: 1385552 - RNA, 20 nt, Human
uccuggcgccuggcaguccg

SEQ ID NO: 1385553 - RNA, 16 nt, Human
uccuggacagcugugc

SEQ ID NO: 1385554 - RNA, 15 nt, Human
uccuggacagcugug

SEQ ID NO: 1385555 - RNA, 14 nt, Human
uccuggacagcugu

SEQ ID NO: 1385556 - RNA, 13 nt, Human
uccuggacagcug

SEQ ID NO: 1385557 - RNA, 11 nt, Human
uccuggacagc

SEQ ID NO: 1385558 - RNA, 19 nt, Human
uccuggacacucagaccug

SEQ ID NO: 1385559 - RNA, 15 nt, Human
uccugggagcuuuug

SEQ ID NO: 1385560 - RNA, 18 nt, Human
uccugcuuugggaagccg

SEQ ID NO: 1385561 - RNA, 19 nt, Human
uccugcuugccaaggcaga

SEQ ID NO: 1385562 - RNA, 17 nt, Human
uccugcuugccaaggca

SEQ ID NO: 1385563 - RNA, 16 nt, Human
uccugcuugccaaggc

SEQ ID NO: 1385564 - RNA, 12 nt, Human
uccugcuugcca

SEQ ID NO: 1385565 - RNA, 23 nt, Human
uccugcuugaugggauucuggac

SEQ ID NO: 1385566 - RNA, 22 nt, Human
uccuggaaauugacgaggggug

SEQ ID NO: 1385567 - RNA, 16 nt, Human
uccuggaaaucagggu

SEQ ID NO: 1385568 - RNA, 22 nt, Human
uccuggaagcgcgagggccuca

SEQ ID NO: 1385569 - RNA, 20 nt, Human
uccuggaagccagcuuuccc

SEQ ID NO: 1385570 - RNA, 18 nt, Human
uccuggaagccagcuuuc

SEQ ID NO: 1385571 - RNA, 14 nt, Human
uccuggaagccagc

SEQ ID NO: 1385572 - RNA, 17 nt, Human
uccuggacacucagacc

SEQ ID NO: 1385573 - RNA, 22 nt, Human
uccuggaauaucuccgucaacu

SEQ ID NO: 1385574 - RNA, 23 nt, Human
uccuggaagugcuaauuuugaaa

SEQ ID NO: 1385575 - RNA, 22 nt, Human
ucucauguugaagccacugccu

SEQ ID NO: 1385576 - RNA, 17 nt, Human
ucucauggguggcacuc

SEQ ID NO: 1385577 - RNA, 17 nt, Human
ucucaggccagagccaa

SEQ ID NO: 1385578 - RNA, 20 nt, Human
ucucauuuuuuaaaaaagcu

SEQ ID NO: 1385579 - RNA, 17 nt, Human
ucucauuuuuccguaaa

SEQ ID NO: 1385580 - RNA, 13 nt, Human
ucuccaaaauaaa

SEQ ID NO: 1385581 - RNA, 22 nt, Human
ucucauuuagccuguccuguca

SEQ ID NO: 1385582 - RNA, 18 nt, Human
ucucauuuagccuguccu

SEQ ID NO: 1385583 - RNA, 15 nt, Human
ucucauuuccaagca

SEQ ID NO: 1385584 - RNA, 23 nt, Human
ucucaggaccaaagcuuucaugu

SEQ ID NO: 1385585 - RNA, 21 nt, Human
ucucaggacacaggccugugu

SEQ ID NO: 1385586 - RNA, 20 nt, Human
ucucaggacacaggccugug

SEQ ID NO: 1385587 - RNA, 16 nt, Human
ucucaggauccaagcu

SEQ ID NO: 1385588 - RNA, 15 nt, Human
ucucaggauccaagc

SEQ ID NO: 1385589 - RNA, 14 nt, Human
ucucaggauccaag

SEQ ID NO: 1385590 - RNA, 13 nt, Human
ucucaggauccaa

SEQ ID NO: 1385591 - RNA, 19 nt, Human
ucucaggacacaggccugu

SEQ ID NO: 1385592 - RNA, 18 nt, Human
ucucaggacacaggccug

SEQ ID NO: 1385593 - RNA, 17 nt, Human
ucucaggacacaggccu

SEQ ID NO: 1385594 - RNA, 16 nt, Human
ucucaggacacaggcc

SEQ ID NO: 1385595 - RNA, 15 nt, Human
ucucaggacacaggc

SEQ ID NO: 1385596 - RNA, 20 nt, Human
ucucagccccuuucccuugu

SEQ ID NO: 1385597 - RNA, 12 nt, Human
ucucagcccuca

SEQ ID NO: 1385598 - RNA, 17 nt, Human
ucucagccccuuucccu

SEQ ID NO: 1385599 - RNA, 12 nt, Human
ucucagccccuu

SEQ ID NO: 1385600 - RNA, 19 nt, Human
acuugauccauuucuaauu

SEQ ID NO: 1385601 - RNA, 20 nt, Human
acuugauccauuucuaauua

SEQ ID NO: 1385602 - RNA, 18 nt, Human
acuugauccauuucuaau

SEQ ID NO: 1385603 - RNA, 17 nt, Human
acuugauccauuucuaa

SEQ ID NO: 1385604 - RNA, 21 nt, Human
acuugcaaccgucuguuaugc

SEQ ID NO: 1385605 - RNA, 23 nt, Human
acuugcaaaaagggucaguaugg

SEQ ID NO: 1385606 - RNA, 17 nt, Human
acuugcaaaaaggguca

SEQ ID NO: 1385607 - RNA, 16 nt, Human
acuugcucuugaugcc

SEQ ID NO: 1385608 - RNA, 17 nt, Human
acuugcucuugaugccu

SEQ ID NO: 1385609 - RNA, 18 nt, Human
acuugcucuugaugccug

SEQ ID NO: 1385610 - RNA, 14 nt, Human
acuugcaucacuua

SEQ ID NO: 1385611 - RNA, 20 nt, Human
acuugcucuugaugccuggc

SEQ ID NO: 1385612 - RNA, 19 nt, Human
acuuguggacuaaaagaua

SEQ ID NO: 1385613 - RNA, 20 nt, Human
acuuguggacuaaaagauau

SEQ ID NO: 1385614 - RNA, 15 nt, Human
acuuguggacuaaaa

SEQ ID NO: 1385615 - RNA, 18 nt, Human
acuuguggacuaaaagau

SEQ ID NO: 1385616 - RNA, 21 nt, Human
acuugcuuaucaacuuccuaa

SEQ ID NO: 1385617 - RNA, 15 nt, Human
acuugucaauaaaau

SEQ ID NO: 1385618 - RNA, 18 nt, Human
acuuguauuauguguguu

SEQ ID NO: 1385619 - RNA, 19 nt, Human
acuuguauuauguguguuu

SEQ ID NO: 1385620 - RNA, 16 nt, Human
acuugcuuauuugaca

SEQ ID NO: 1385621 - RNA, 19 nt, Human
acuugcuuaucaacuuccu

SEQ ID NO: 1385622 - RNA, 14 nt, Human
acuugcuuuuaaaa

SEQ ID NO: 1385623 - RNA, 14 nt, Human
acuuugaauguguu

SEQ ID NO: 1385624 - RNA, 12 nt, Human
acuuugaaugug

SEQ ID NO: 1385625 - RNA, 22 nt, Human
acuuugaauguguuucacaguu

SEQ ID NO: 1385626 - RNA, 17 nt, Human
acuuugaaguuagcuuu

SEQ ID NO: 1385627 - RNA, 14 nt, Human
acuuucugccugga

SEQ ID NO: 1385628 - RNA, 13 nt, Human
acuuucugccugg

SEQ ID NO: 1385629 - RNA, 18 nt, Human
acuuuacacaauagaauu

SEQ ID NO: 1385630 - RNA, 12 nt, Human
acuuuaccuuuu

SEQ ID NO: 1385631 - RNA, 13 nt, Human
acuuuacccauuu

SEQ ID NO: 1385632 - RNA, 20 nt, Human
acuuuacacaauagaauuau

SEQ ID NO: 1385633 - RNA, 22 nt, Human
acuuuaauuaccaaccuguuac

SEQ ID NO: 1385634 - RNA, 16 nt, Human
ucuccuccaugggaga

SEQ ID NO: 1385635 - RNA, 20 nt, Human
acuuuaauuaccaaccuguu

SEQ ID NO: 1385636 - RNA, 20 nt, Human
ucucccuugggcucugauga

SEQ ID NO: 1385637 - RNA, 15 nt, Human
ucucccuuuuccaug

SEQ ID NO: 1385638 - RNA, 22 nt, Human
ucucccuugggcucugaugaaa

SEQ ID NO: 1385639 - RNA, 18 nt, Human
ucucccuugggcucugau

SEQ ID NO: 1385640 - RNA, 17 nt, Human
ucucccuugggcucuga

SEQ ID NO: 1385641 - RNA, 16 nt, Human
ucucccuugggcucug

SEQ ID NO: 1385642 - RNA, 15 nt, Human
ucucccuugggcucu

SEQ ID NO: 1385643 - RNA, 14 nt, Human
ucucccuugggcuc

SEQ ID NO: 1385644 - RNA, 15 nt, Human
ucuccccagcuccca

SEQ ID NO: 1385645 - RNA, 15 nt, Human
ucuccccagguccag

SEQ ID NO: 1385646 - RNA, 18 nt, Human
ucuccccagcucccagga

SEQ ID NO: 1385647 - RNA, 14 nt, Human
ucuccccagcuccc

SEQ ID NO: 1385648 - RNA, 19 nt, Human
ucuccccagcccagagaca

SEQ ID NO: 1385649 - RNA, 18 nt, Human
ucuccccagcccagagac

SEQ ID NO: 1385650 - RNA, 17 nt, Human
ucuccccagcccagaga

SEQ ID NO: 1385651 - RNA, 16 nt, Human
ucuccccagcccagag

SEQ ID NO: 1385652 - RNA, 15 nt, Human
ucuccccagcccaga

SEQ ID NO: 1385653 - RNA, 14 nt, Human
ucuccccagcccag

SEQ ID NO: 1385654 - RNA, 15 nt, Human
ucuccucacuguauc

SEQ ID NO: 1385655 - RNA, 20 nt, Human
ucuccccacgagggcuggcu

SEQ ID NO: 1385656 - RNA, 19 nt, Human
ucuccccacgagggcuggc

SEQ ID NO: 1385657 - RNA, 19 nt, Human
ucuccacagcaaccccagg

SEQ ID NO: 1385658 - RNA, 14 nt, Human
ucuccacagcaacc

SEQ ID NO: 1385659 - RNA, 21 nt, Human
ucucauuuuuccguaaaaaug

SEQ ID NO: 1385660 - RNA, 23 nt, Human
acuuuggaaccagacucuugccu

SEQ ID NO: 1385661 - RNA, 22 nt, Human
acuuuggaaccagacucuugcc

SEQ ID NO: 1385662 - RNA, 21 nt, Human
acuuuggaaccagacucuugc

SEQ ID NO: 1385663 - RNA, 17 nt, Human
acuuuggaaccagacuc

SEQ ID NO: 1385664 - RNA, 16 nt, Human
acuuuggaaccagacu

SEQ ID NO: 1385665 - RNA, 15 nt, Human
acuuuggaaccagac

SEQ ID NO: 1385666 - RNA, 22 nt, Human
acuuugaccuaaauuauuuacu

SEQ ID NO: 1385667 - RNA, 20 nt, Human
acuuugaccuaaauuauuua

SEQ ID NO: 1385668 - RNA, 18 nt, Human
acuuugacaguguuuuua

SEQ ID NO: 1385669 - RNA, 14 nt, Human
acuuugacaguguu

SEQ ID NO: 1385670 - RNA, 14 nt, Human
acuuugaccucugc

SEQ ID NO: 1385671 - RNA, 12 nt, Human
acuuugaccucu

SEQ ID NO: 1385672 - RNA, 13 nt, Human
acuuugaccucug

SEQ ID NO: 1385673 - RNA, 22 nt, Human
acuuuggaguccccucaccucc

SEQ ID NO: 1385674 - RNA, 18 nt, Human
acuuuggaguccccucac

SEQ ID NO: 1385675 - RNA, 23 nt, Human
acuuuggaguccccucaccuccu

SEQ ID NO: 1385676 - RNA, 22 nt, Human
acuuugguaccagauaacuuuu

SEQ ID NO: 1385677 - RNA, 13 nt, Human
acuuuggcugcau

SEQ ID NO: 1385678 - RNA, 17 nt, Human
acuuuguacauuuggga

SEQ ID NO: 1385679 - RNA, 19 nt, Human
acuuugguaccagauaacu

SEQ ID NO: 1385680 - RNA, 12 nt, Human
acuuuuguucuu

SEQ ID NO: 1385681 - RNA, 13 nt, Human
acuuuuguucuug

SEQ ID NO: 1385682 - RNA, 13 nt, Human
ucuccuuguguua

SEQ ID NO: 1385683 - RNA, 21 nt, Human
ucuccuuguguuacuaaguuu

SEQ ID NO: 1385684 - RNA, 14 nt, Human
acuuuuuauauaua

SEQ ID NO: 1385685 - RNA, 13 nt, Human
acuuuuuauauau

SEQ ID NO: 1385686 - RNA, 12 nt, Human
acuuuuuauaua

SEQ ID NO: 1385687 - RNA, 11 nt, Human
acuuuuuacaa

SEQ ID NO: 1385688 - RNA, 18 nt, Human
acuuuuuaaauguaaaga

SEQ ID NO: 1385689 - RNA, 15 nt, Human
acuuuuguucuuggu

SEQ ID NO: 1385690 - RNA, 23 nt, Human
acuuuuguucuugguuuguaaau

SEQ ID NO: 1385691 - RNA, 15 nt, Human
acuuuuuauauauau

SEQ ID NO: 1385692 - RNA, 22 nt, Human
acuuuuuauggcacuaguauuu

SEQ ID NO: 1385693 - RNA, 21 nt, Human
acuguucuuagcucaaugagc

SEQ ID NO: 1385694 - RNA, 23 nt, Human
acuguucuuagcucaaugagcau

SEQ ID NO: 1385695 - RNA, 20 nt, Human
acuguucuuagcucaaugag

SEQ ID NO: 1385696 - RNA, 13 nt, Human
acuguucuugaau

SEQ ID NO: 1385697 - RNA, 18 nt, Human
acuguucccccugugcag

SEQ ID NO: 1385698 - RNA, 16 nt, Human
acuguucccccugugc

SEQ ID NO: 1385699 - RNA, 15 nt, Human
acuguucccccugug

SEQ ID NO: 1385700 - RNA, 15 nt, Human
ucuaccucaggcagc

SEQ ID NO: 1385701 - RNA, 22 nt, Human
ucuaccuagauuuaauauaaag

SEQ ID NO: 1385702 - RNA, 21 nt, Human
ucuaccuagauuuaauauaaa

SEQ ID NO: 1385703 - RNA, 19 nt, Human
ucuaccuagauuuaauaua

SEQ ID NO: 1385704 - RNA, 17 nt, Human
ucuaccuagauuuaaua

SEQ ID NO: 1385705 - RNA, 16 nt, Human
ucuaccuagauuuaau

SEQ ID NO: 1385706 - RNA, 13 nt, Human
ucuacccugggau

SEQ ID NO: 1385707 - RNA, 12 nt, Human
ucuacccuggga

SEQ ID NO: 1385708 - RNA, 13 nt, Human
ucuaaguuucuaa

SEQ ID NO: 1385709 - RNA, 21 nt, Human
uccuggcuucccauccccagc

SEQ ID NO: 1385710 - RNA, 15 nt, Human
ucuaauaauuucuaa

SEQ ID NO: 1385711 - RNA, 23 nt, Human
ucuaaguuucuaagauucuaaag

SEQ ID NO: 1385712 - RNA, 22 nt, Human
ucuaaguuucuaagauucuaaa

SEQ ID NO: 1385713 - RNA, 20 nt, Human
ucuaaguuucuaagauucua

SEQ ID NO: 1385714 - RNA, 18 nt, Human
ucuaaguuucuaagauuc

SEQ ID NO: 1385715 - RNA, 17 nt, Human
ucuaaguuucuaagauu

SEQ ID NO: 1385716 - RNA, 16 nt, Human
ucuaaguuucuaagau

SEQ ID NO: 1385717 - RNA, 15 nt, Human
ucuaaguuucuaaga

SEQ ID NO: 1385718 - RNA, 14 nt, Human
ucuaaguuucuaag

SEQ ID NO: 1385719 - RNA, 17 nt, Human
ucuaauaauuucuaaug

SEQ ID NO: 1385720 - RNA, 16 nt, Human
ucuaauaauuucuaau

SEQ ID NO: 1385721 - RNA, 18 nt, Human
ucuaauaauuucuaaugu

SEQ ID NO: 1385722 - RNA, 18 nt, Human
ucuacagaugagucacac

SEQ ID NO: 1385723 - RNA, 21 nt, Human
acuucaguuucacagaaaaua

SEQ ID NO: 1385724 - RNA, 20 nt, Human
acuucagguauaccucacuu

SEQ ID NO: 1385725 - RNA, 18 nt, Human
acuucagguauaccucac

SEQ ID NO: 1385726 - RNA, 16 nt, Human
acuuauuaucuucagg

SEQ ID NO: 1385727 - RNA, 12 nt, Human
acuuauuaacaa

SEQ ID NO: 1385728 - RNA, 21 nt, Human
acuuauuaacaauuaggcaga

SEQ ID NO: 1385729 - RNA, 14 nt, Human
acuuaugcugauuu

SEQ ID NO: 1385730 - RNA, 23 nt, Human
acuuagggcaccagggguuucuc

SEQ ID NO: 1385731 - RNA, 16 nt, Human
acuuagggcaccaggg

SEQ ID NO: 1385732 - RNA, 14 nt, Human
acuuacaugauuca

SEQ ID NO: 1385733 - RNA, 21 nt, Human
acuuacuguacaugaaaacac

SEQ ID NO: 1385734 - RNA, 15 nt, Human
acuuacaucaugugu

SEQ ID NO: 1385735 - RNA, 14 nt, Human
acuuacuugcuuau

SEQ ID NO: 1385736 - RNA, 13 nt, Human
acuuacuugcuua

SEQ ID NO: 1385737 - RNA, 12 nt, Human
acuuacaugauu

SEQ ID NO: 1385738 - RNA, 22 nt, Human
acuuacuguacaugaaaacaca

SEQ ID NO: 1385739 - RNA, 16 nt, Human
acuuaauguauguuac

SEQ ID NO: 1385740 - RNA, 15 nt, Human
acuuaauguauguua

SEQ ID NO: 1385741 - RNA, 13 nt, Human
acuuaauguaugu

SEQ ID NO: 1385742 - RNA, 17 nt, Human
acuuaagcaucuggcuc

SEQ ID NO: 1385743 - RNA, 22 nt, Human
acuuaaucuaaauggaaccacu

SEQ ID NO: 1385744 - RNA, 17 nt, Human
acuuaaucuaaauggaa

SEQ ID NO: 1385745 - RNA, 19 nt, Human
acuuaaucuaaauggaacc

SEQ ID NO: 1385746 - RNA, 18 nt, Human
acuguugcacguguguuu

SEQ ID NO: 1385747 - RNA, 16 nt, Human
acuguugcacgugugu

SEQ ID NO: 1385748 - RNA, 15 nt, Human
acuguugcacgugug

SEQ ID NO: 1385749 - RNA, 14 nt, Human
acuguugcacgugu

SEQ ID NO: 1385750 - RNA, 13 nt, Human
acuguugcacgug

SEQ ID NO: 1385751 - RNA, 12 nt, Human
acuguugcacgu

SEQ ID NO: 1385752 - RNA, 11 nt, Human
acuguugcacg

SEQ ID NO: 1385753 - RNA, 10 nt, Human
acuguugcac

SEQ ID NO: 1385754 - RNA, 16 nt, Human
acuuaaauaguauuuc

SEQ ID NO: 1385755 - RNA, 22 nt, Human
acuguugcacguguguuuuucu

SEQ ID NO: 1385756 - RNA, 17 nt, Human
acuuaacggaccaaagc

SEQ ID NO: 1385757 - RNA, 15 nt, Human
acuuaaauguuauua

SEQ ID NO: 1385758 - RNA, 18 nt, Human
acuuaaauguuauuaucu

SEQ ID NO: 1385759 - RNA, 13 nt, Human
acuuaaauuuuag

SEQ ID NO: 1385760 - RNA, 15 nt, Human
ucuauuuuggauugu

SEQ ID NO: 1385761 - RNA, 18 nt, Human
ucuauuuuauuaugaaga

SEQ ID NO: 1385762 - RNA, 16 nt, Human
ucuauuuuauuaugaa

SEQ ID NO: 1385763 - RNA, 20 nt, Human
ucuauuuuauuaugaagaag

SEQ ID NO: 1385764 - RNA, 12 nt, Human
ucuauuuuaauu

SEQ ID NO: 1385765 - RNA, 20 nt, Human
ucuauuuuaauaaaaauaau

SEQ ID NO: 1385766 - RNA, 14 nt, Human
ucuauuuuaaagac

SEQ ID NO: 1385767 - RNA, 18 nt, Human
ucuauuuggggcuugaug

SEQ ID NO: 1385768 - RNA, 13 nt, Human
ucuauuuggggcu

SEQ ID NO: 1385769 - RNA, 18 nt, Human
ucuauuuauauguacaug

SEQ ID NO: 1385770 - RNA, 13 nt, Human
ucuauuuauaugu

SEQ ID NO: 1385771 - RNA, 21 nt, Human
ucucaccggcucucaccuggc

SEQ ID NO: 1385772 - RNA, 18 nt, Human
ucucaccggcucucaccu

SEQ ID NO: 1385773 - RNA, 14 nt, Human
ucucaccggcucuc

SEQ ID NO: 1385774 - RNA, 18 nt, Human
ucucacccuggaggcacc

SEQ ID NO: 1385775 - RNA, 19 nt, Human
ucucacccuggaggcaccu

SEQ ID NO: 1385776 - RNA, 16 nt, Human
ucucacccuggaggca

SEQ ID NO: 1385777 - RNA, 14 nt, Human
ucucacccuggagg

SEQ ID NO: 1385778 - RNA, 13 nt, Human
ucucacccuggag

SEQ ID NO: 1385779 - RNA, 12 nt, Human
ucucacccugga

SEQ ID NO: 1385780 - RNA, 18 nt, Human
ucucaccauuuggauccu

SEQ ID NO: 1385781 - RNA, 16 nt, Human
ucucaccauuuggauc

SEQ ID NO: 1385782 - RNA, 15 nt, Human
ucucaccauuuggau

SEQ ID NO: 1385783 - RNA, 17 nt, Human
ucuauuuuguaaacuca

SEQ ID NO: 1385784 - RNA, 18 nt, Human
ucuauuuuggauuguaua

SEQ ID NO: 1385785 - RNA, 16 nt, Human
ucuauucuuuaacucc

SEQ ID NO: 1385786 - RNA, 13 nt, Human
ucuauucuuuaac

SEQ ID NO: 1385787 - RNA, 22 nt, Human
ucuauucgccacacaguauuuu

SEQ ID NO: 1385788 - RNA, 19 nt, Human
ucuauucgccacacaguau

SEQ ID NO: 1385789 - RNA, 18 nt, Human
ucuauucgccacacagua

SEQ ID NO: 1385790 - RNA, 23 nt, Human
ucuauuaugaaugugaagccuuc

SEQ ID NO: 1385791 - RNA, 22 nt, Human
ucuauuaugaaugugaagccuu

SEQ ID NO: 1385792 - RNA, 15 nt, Human
ucuauuaugaaugug

SEQ ID NO: 1385793 - RNA, 12 nt, Human
ucuauucagcuu

SEQ ID NO: 1385794 - RNA, 17 nt, Human
ucuauuacauuuucagu

SEQ ID NO: 1385795 - RNA, 23 nt, Human
ucuauuaaagugcuaagguucua

SEQ ID NO: 1385796 - RNA, 22 nt, Human
ucuauuaaagugcuaagguucu

SEQ ID NO: 1385797 - RNA, 22 nt, Human
ucuauuaaaagacucauccguc

SEQ ID NO: 1385798 - RNA, 21 nt, Human
ucuauuaaaagacucauccgu

SEQ ID NO: 1385799 - RNA, 20 nt, Human
ucuauuaaaagacucauccg

SEQ ID NO: 1385800 - RNA, 19 nt, Human
ucuauuaaaagacucaucc

SEQ ID NO: 1385801 - RNA, 18 nt, Human
ucuauuaaaagacucauc

SEQ ID NO: 1385802 - RNA, 17 nt, Human
ucuauuaaaagacucau

SEQ ID NO: 1385803 - RNA, 16 nt, Human
ucuauuaaaagacuca

SEQ ID NO: 1385804 - RNA, 15 nt, Human
ucuauuaaaagacuc

SEQ ID NO: 1385805 - RNA, 14 nt, Human
ucuauuaaaagacu

SEQ ID NO: 1385806 - RNA, 13 nt, Human
ucuauuaaaagac

SEQ ID NO: 1385807 - RNA, 12 nt, Human
ucuauuaaaaga

SEQ ID NO: 1385808 - RNA, 11 nt, Human
ucuauuaaaag

SEQ ID NO: 1385809 - RNA, 15 nt, Human
ucuauggguguuauc

SEQ ID NO: 1385810 - RNA, 14 nt, Human
ucuauaccaauaaa

SEQ ID NO: 1385811 - RNA, 15 nt, Human
ucuauaccaauaaag

SEQ ID NO: 1385812 - RNA, 16 nt, Human
ucuauaccaauaaagu

SEQ ID NO: 1385813 - RNA, 17 nt, Human
ucuauaccaauaaagug

SEQ ID NO: 1385814 - RNA, 18 nt, Human
ucuauaccaauaaaguga

SEQ ID NO: 1385815 - RNA, 15 nt, Human
ucuauacccacccag

SEQ ID NO: 1385816 - RNA, 17 nt, Human
ucuauacccacccagaa

SEQ ID NO: 1385817 - RNA, 17 nt, Human
ucuauagaacugaauga

SEQ ID NO: 1385818 - RNA, 16 nt, Human
ucuauacccacccaga

SEQ ID NO: 1385819 - RNA, 18 nt, Human
ucuagaguucagaguccu

SEQ ID NO: 1385820 - RNA, 14 nt, Human
ucuagaguucagag

SEQ ID NO: 1385821 - RNA, 20 nt, Human
ucuagaguccaagguuuaaa

SEQ ID NO: 1385822 - RNA, 15 nt, Human
ucuagaguccaaggu

SEQ ID NO: 1385823 - RNA, 13 nt, Human
ucuagaguccaag

SEQ ID NO: 1385824 - RNA, 21 nt, Human
ucuagaggcuuccuucauuuc

SEQ ID NO: 1385825 - RNA, 16 nt, Human
ucuagaggcuuccuuc

SEQ ID NO: 1385826 - RNA, 15 nt, Human
ucuagagcagggauu

SEQ ID NO: 1385827 - RNA, 15 nt, Human
ucuagagcacugcca

SEQ ID NO: 1385828 - RNA, 14 nt, Human
ucuagagcacugcc

SEQ ID NO: 1385829 - RNA, 13 nt, Human
ucuagauacugua

SEQ ID NO: 1385830 - RNA, 22 nt, Human
ucuagacauggagguucuaagg

SEQ ID NO: 1385831 - RNA, 14 nt, Human
ucuagaccaauaaa

SEQ ID NO: 1385832 - RNA, 20 nt, Human
ucuagacauggagguucuaa

SEQ ID NO: 1385833 - RNA, 19 nt, Human
ucuagacauggagguucua

SEQ ID NO: 1385834 - RNA, 18 nt, Human
ucuagacauggagguucu

SEQ ID NO: 1385835 - RNA, 14 nt, Human
ucuagacacugcca

SEQ ID NO: 1385836 - RNA, 12 nt, Human
acuucccugugu

SEQ ID NO: 1385837 - RNA, 18 nt, Human
acuucauauaugaggacu

SEQ ID NO: 1385838 - RNA, 22 nt, Human
acuucaguuucacagaaaauaa

SEQ ID NO: 1385839 - RNA, 22 nt, Human
ucuauaaggccauaaaacaggu

SEQ ID NO: 1385840 - RNA, 16 nt, Human
ucuauaaggccauaaa

SEQ ID NO: 1385841 - RNA, 14 nt, Human
ucuauaaggccaua

SEQ ID NO: 1385842 - RNA, 13 nt, Human
ucuauaaggccau

SEQ ID NO: 1385843 - RNA, 19 nt, Human
ucuauaaagcauuuaaccc

SEQ ID NO: 1385844 - RNA, 20 nt, Human
ucuauaaagcauuuaacccc

SEQ ID NO: 1385845 - RNA, 17 nt, Human
ucuauaaagcauuuaac

SEQ ID NO: 1385846 - RNA, 16 nt, Human
ucuauaaagcauuuaa

SEQ ID NO: 1385847 - RNA, 15 nt, Human
ucuauaaagcauuua

SEQ ID NO: 1385848 - RNA, 14 nt, Human
ucuauaaagcauuu

SEQ ID NO: 1385849 - RNA, 12 nt, Human
ucuauaaagcau

SEQ ID NO: 1385850 - RNA, 21 nt, Human
ucuauaaacuauaaccucucc

SEQ ID NO: 1385851 - RNA, 14 nt, Human
ucuauaaacuauaa

SEQ ID NO: 1385852 - RNA, 22 nt, Human
ucuaguuugauuaaauucuugc

SEQ ID NO: 1385853 - RNA, 21 nt, Human
ucuaguuugauuaaauucuug

SEQ ID NO: 1385854 - RNA, 19 nt, Human
ucuaguugaaaauaaagug

SEQ ID NO: 1385855 - RNA, 13 nt, Human
ucuaguucuuugu

SEQ ID NO: 1385856 - RNA, 17 nt, Human
ucuaguucugccaggag

SEQ ID NO: 1385857 - RNA, 16 nt, Human
ucuaguucugccagga

SEQ ID NO: 1385858 - RNA, 15 nt, Human
ucuaguucugccagg

SEQ ID NO: 1385859 - RNA, 16 nt, Human
ucuaggaaauauuuau

SEQ ID NO: 1385860 - RNA, 14 nt, Human
ucuaggaaaucuag

SEQ ID NO: 1385861 - RNA, 17 nt, Human
ucuaggaaauauuuauu

SEQ ID NO: 1385862 - RNA, 19 nt, Human
agaaauauuuuaaaaucag

SEQ ID NO: 1385863 - RNA, 21 nt, Human
agaaauauuuuaaaaucagcu

SEQ ID NO: 1385864 - RNA, 17 nt, Human
agaaauauuuuaaaauc

SEQ ID NO: 1385865 - RNA, 15 nt, Human
agaaauauuuuaaaa

SEQ ID NO: 1385866 - RNA, 20 nt, Human
agaaauauuugugacaaaaa

SEQ ID NO: 1385867 - RNA, 17 nt, Human
agaaauauggacacuua

SEQ ID NO: 1385868 - RNA, 14 nt, Human
agaaauauggacac

SEQ ID NO: 1385869 - RNA, 21 nt, Human
agaaauaugcacaauagcagu

SEQ ID NO: 1385870 - RNA, 20 nt, Human
agaaauaucuucacuuguca

SEQ ID NO: 1385871 - RNA, 13 nt, Human
agaaauaucuuca

SEQ ID NO: 1385872 - RNA, 12 nt, Human
agaaagccugag

SEQ ID NO: 1385873 - RNA, 18 nt, Human
agaaagccugggugacau

SEQ ID NO: 1385874 - RNA, 11 nt, Human
agaaagccuga

SEQ ID NO: 1385875 - RNA, 17 nt, Human
agaaagccccacccagg

SEQ ID NO: 1385876 - RNA, 18 nt, Human
agaaagccccacccaggc

SEQ ID NO: 1385877 - RNA, 20 nt, Human
agaaagcccuuaggaagaau

SEQ ID NO: 1385878 - RNA, 22 nt, Human
agaaagcccuuaggaagaauuu

SEQ ID NO: 1385879 - RNA, 17 nt, Human
ucuccuuuuccucucuc

SEQ ID NO: 1385880 - RNA, 15 nt, Human
agaaagcauuugaau

SEQ ID NO: 1385881 - RNA, 16 nt, Human
agaaagcauuugaaug

SEQ ID NO: 1385882 - RNA, 17 nt, Human
agaaagcauuugaaugc

SEQ ID NO: 1385883 - RNA, 18 nt, Human
agaaagcauuugaaugca

SEQ ID NO: 1385884 - RNA, 20 nt, Human
agaaagcauuugaaugcauu

SEQ ID NO: 1385885 - RNA, 21 nt, Human
agaaagcauuugaaugcauuu

SEQ ID NO: 1385886 - RNA, 22 nt, Human
agaaagcauuugaaugcauuuu

SEQ ID NO: 1385887 - RNA, 22 nt, Human
ucuccuuuaauuguaaaguaaa

SEQ ID NO: 1385888 - RNA, 16 nt, Human
ucuccuuguucugaua

SEQ ID NO: 1385889 - RNA, 14 nt, Human
ucuccuuguucuga

SEQ ID NO: 1385890 - RNA, 13 nt, Human
ucuccuuguucug

SEQ ID NO: 1385891 - RNA, 17 nt, Human
ucuccuuuaauuguaaa

SEQ ID NO: 1385892 - RNA, 15 nt, Human
ucuccuuuaauugua

SEQ ID NO: 1385893 - RNA, 18 nt, Human
ucuccuuguucugauaau

SEQ ID NO: 1385894 - RNA, 21 nt, Human
ucugaagcucaacucucuuau

SEQ ID NO: 1385895 - RNA, 17 nt, Human
ucugaagcucaacucuc

SEQ ID NO: 1385896 - RNA, 18 nt, Human
ucugaagcccucccaggu

SEQ ID NO: 1385897 - RNA, 11 nt, Human
agaaaugccaa

SEQ ID NO: 1385898 - RNA, 12 nt, Human
agaaaugcagaa

SEQ ID NO: 1385899 - RNA, 21 nt, Human
agaaaugccaagcacuucuuu

SEQ ID NO: 1385900 - RNA, 14 nt, Human
agaaaugccaagca

SEQ ID NO: 1385901 - RNA, 22 nt, Human
agaaaugccaagcacuucuuuu

SEQ ID NO: 1385902 - RNA, 19 nt, Human
ucugaaugcuucuaaguaa

SEQ ID NO: 1385903 - RNA, 17 nt, Human
ucugaaugcuucuaagu

SEQ ID NO: 1385904 - RNA, 13 nt, Human
ucugaaugcuucu

SEQ ID NO: 1385905 - RNA, 22 nt, Human
ucugaaugcuucuaaguaaaua

SEQ ID NO: 1385906 - RNA, 10 nt, Human
ucugaauuau

SEQ ID NO: 1385907 - RNA, 20 nt, Human
ucugacucgguuucuccaaa

SEQ ID NO: 1385908 - RNA, 19 nt, Human
ucugacucgguuucuccaa

SEQ ID NO: 1385909 - RNA, 18 nt, Human
ucugacucgguuucucca

SEQ ID NO: 1385910 - RNA, 16 nt, Human
ucugacucgguuucuc

SEQ ID NO: 1385911 - RNA, 20 nt, Human
ucugacucagggcuccuggg

SEQ ID NO: 1385912 - RNA, 15 nt, Human
ucugacucagggcuc

SEQ ID NO: 1385913 - RNA, 14 nt, Human
ucugacucagggcu

SEQ ID NO: 1385914 - RNA, 13 nt, Human
ucugacucagggc

SEQ ID NO: 1385915 - RNA, 15 nt, Human
ucugaauuauuuucu

SEQ ID NO: 1385916 - RNA, 13 nt, Human
ucugaguccugga

SEQ ID NO: 1385917 - RNA, 21 nt, Human
ucugaugaaaaauugcugacu

SEQ ID NO: 1385918 - RNA, 15 nt, Human
ucugaugaaaaauug

SEQ ID NO: 1385919 - RNA, 22 nt, Human
ucugaugaaaaauugcugacug

SEQ ID NO: 1385920 - RNA, 17 nt, Human
ucugaucagaacaaaug

SEQ ID NO: 1385921 - RNA, 21 nt, Human
ucugaucccucuacagagcuu

SEQ ID NO: 1385922 - RNA, 20 nt, Human
ucugagucagagccaugucu

SEQ ID NO: 1385923 - RNA, 15 nt, Human
ucugagucagagcca

SEQ ID NO: 1385924 - RNA, 16 nt, Human
ucugagucaacuccuu

SEQ ID NO: 1385925 - RNA, 13 nt, Human
ucugaguacagag

SEQ ID NO: 1385926 - RNA, 15 nt, Human
ucugagguuuuauuu

SEQ ID NO: 1385927 - RNA, 23 nt, Human
ucugaggugcacugggaggcucc

SEQ ID NO: 1385928 - RNA, 21 nt, Human
ucugaggugccugucccaccc

SEQ ID NO: 1385929 - RNA, 19 nt, Human
ucugaggugcacugggagg

SEQ ID NO: 1385930 - RNA, 16 nt, Human
ucugaggugcacuggg

SEQ ID NO: 1385931 - RNA, 22 nt, Human
ucugagaauuguugagauacuu

SEQ ID NO: 1385932 - RNA, 14 nt, Human
ucugacucugagcu

SEQ ID NO: 1385933 - RNA, 18 nt, Human
ucugcagcaauaaagcag

SEQ ID NO: 1385934 - RNA, 17 nt, Human
ucugcagcaauaaagca

SEQ ID NO: 1385935 - RNA, 11 nt, Human
ucugcaggucc

SEQ ID NO: 1385936 - RNA, 12 nt, Human
ucugcagguccc

SEQ ID NO: 1385937 - RNA, 13 nt, Human
ucugcaggucccu

SEQ ID NO: 1385938 - RNA, 19 nt, Human
ucugcagggggugugucug

SEQ ID NO: 1385939 - RNA, 14 nt, Human
ucugcaggucccua

SEQ ID NO: 1385940 - RNA, 14 nt, Human
agaaauguacagca

SEQ ID NO: 1385941 - RNA, 15 nt, Human
agaaauguacagcaa

SEQ ID NO: 1385942 - RNA, 18 nt, Human
agaaaugguuguauuaga

SEQ ID NO: 1385943 - RNA, 19 nt, Human
agaaaugguuguauuagau

SEQ ID NO: 1385944 - RNA, 20 nt, Human
agaaaugguuguauuagaug

SEQ ID NO: 1385945 - RNA, 21 nt, Human
agaaaugguuguauuagaugu

SEQ ID NO: 1385946 - RNA, 22 nt, Human
agaaaugguuguauuagauguu

SEQ ID NO: 1385947 - RNA, 23 nt, Human
agaaaugguuguauuagauguuc

SEQ ID NO: 1385948 - RNA, 12 nt, Human
ucugcucccaag

SEQ ID NO: 1385949 - RNA, 11 nt, Human
ucugcucccaa

SEQ ID NO: 1385950 - RNA, 15 nt, Human
ucugcuccagacagg

SEQ ID NO: 1385951 - RNA, 13 nt, Human
ucugcucccaagg

SEQ ID NO: 1385952 - RNA, 14 nt, Human
ucugcuccagacag

SEQ ID NO: 1385953 - RNA, 18 nt, Human
ucugcucagauagaauga

SEQ ID NO: 1385954 - RNA, 22 nt, Human
ucugcucagacagaaccccuac

SEQ ID NO: 1385955 - RNA, 20 nt, Human
ucugcgugucaccugugcuu

SEQ ID NO: 1385956 - RNA, 19 nt, Human
ucugcgugucaccugugcu

SEQ ID NO: 1385957 - RNA, 15 nt, Human
ucugcgugucaccug

SEQ ID NO: 1385958 - RNA, 16 nt, Human
ucugcgugacaauaaa

SEQ ID NO: 1385959 - RNA, 21 nt, Human
ucugccuggaguguaugacug

SEQ ID NO: 1385960 - RNA, 13 nt, Human
ucugccuggagug

SEQ ID NO: 1385961 - RNA, 12 nt, Human
ucugccuggagu

SEQ ID NO: 1385962 - RNA, 23 nt, Human
ucugccuggagacuuagggcacc

SEQ ID NO: 1385963 - RNA, 21 nt, Human
ucugcccucugcauccucugg

SEQ ID NO: 1385964 - RNA, 14 nt, Human
ucugcccugcccac

SEQ ID NO: 1385965 - RNA, 23 nt, Human
agaagccaacuaugauuauuaac

SEQ ID NO: 1385966 - RNA, 18 nt, Human
agaagccaacuaugauua

SEQ ID NO: 1385967 - RNA, 19 nt, Human
agaagcauuuuguaaguug

SEQ ID NO: 1385968 - RNA, 17 nt, Human
agaagccaaaagauugg

SEQ ID NO: 1385969 - RNA, 22 nt, Human
agaagcauucucauuggaaauu

SEQ ID NO: 1385970 - RNA, 16 nt, Human
agaagacaaacuuugc

SEQ ID NO: 1385971 - RNA, 18 nt, Human
agaacuucagaaagacuu

SEQ ID NO: 1385972 - RNA, 17 nt, Human
agaacuucagaaagacu

SEQ ID NO: 1385973 - RNA, 16 nt, Human
agaacuucagaaagac

SEQ ID NO: 1385974 - RNA, 15 nt, Human
agaacuucagaaaga

SEQ ID NO: 1385975 - RNA, 14 nt, Human
agaacuucagaaag

SEQ ID NO: 1385976 - RNA, 22 nt, Human
agaaauugaauacuuugaaugu

SEQ ID NO: 1385977 - RNA, 22 nt, Human
agaacugccuuuggcagaguuc

SEQ ID NO: 1385978 - RNA, 21 nt, Human
agaaauugaauacuuugaaug

SEQ ID NO: 1385979 - RNA, 18 nt, Human
agaaauugaauacuuuga

SEQ ID NO: 1385980 - RNA, 17 nt, Human
agaaauugaauacuuug

SEQ ID NO: 1385981 - RNA, 16 nt, Human
agaaauugaauacuuu

SEQ ID NO: 1385982 - RNA, 15 nt, Human
agaaauugaauacuu

SEQ ID NO: 1385983 - RNA, 23 nt, Human
agaaauucguguguuuuuuuaug

SEQ ID NO: 1385984 - RNA, 20 nt, Human
agaaauucguguguuuuuuu

SEQ ID NO: 1385985 - RNA, 18 nt, Human
agaaauucguguguuuuu

SEQ ID NO: 1385986 - RNA, 22 nt, Human
agaagaaguuucaucauuuuuu

SEQ ID NO: 1385987 - RNA, 14 nt, Human
agaagaacugaaau

SEQ ID NO: 1385988 - RNA, 16 nt, Human
agaagaaagaggugac

SEQ ID NO: 1385989 - RNA, 13 nt, Human
agaagaacugaaa

SEQ ID NO: 1385990 - RNA, 19 nt, Human
agaagaaugcuuaaucaga

SEQ ID NO: 1385991 - RNA, 22 nt, Human
agaagaaucucaucucagugaa

SEQ ID NO: 1385992 - RNA, 18 nt, Human
agaagaugguaccaccag

SEQ ID NO: 1385993 - RNA, 15 nt, Human
agaagacaaacuuug

SEQ ID NO: 1385994 - RNA, 12 nt, Human
agaagacaaaau

SEQ ID NO: 1385995 - RNA, 12 nt, Human
agacacugguuu

SEQ ID NO: 1385996 - RNA, 16 nt, Human
agacacuggccccuca

SEQ ID NO: 1385997 - RNA, 15 nt, Human
agacacuggccccuc

SEQ ID NO: 1385998 - RNA, 13 nt, Human
agacacuggcccc

SEQ ID NO: 1385999 - RNA, 20 nt, Human
agacacugccacacaggguc

SEQ ID NO: 1386000 - RNA, 21 nt, Human
agacagagccaggagaagcuc

SEQ ID NO: 1386001 - RNA, 22 nt, Human
agacagagccccacccucagau

SEQ ID NO: 1386002 - RNA, 14 nt, Human
agacagagccagga

SEQ ID NO: 1386003 - RNA, 13 nt, Human
agacagagccagg

SEQ ID NO: 1386004 - RNA, 20 nt, Human
agacagagaggacuguaggg

SEQ ID NO: 1386005 - RNA, 15 nt, Human
agacagagaggacug

SEQ ID NO: 1386006 - RNA, 19 nt, Human
agacagagcccugugaggc

SEQ ID NO: 1386007 - RNA, 20 nt, Human
agacagagccaggagaagcu

SEQ ID NO: 1386008 - RNA, 19 nt, Human
agacagagccaggagaagc

SEQ ID NO: 1386009 - RNA, 16 nt, Human
agacagagccaggaga

SEQ ID NO: 1386010 - RNA, 24 nt, Human
agacagagccccacccucagaugc

SEQ ID NO: 1386011 - RNA, 19 nt, Human
agacaccguucauucaggc

SEQ ID NO: 1386012 - RNA, 21 nt, Human
agacacaugaagguaaauaaa

SEQ ID NO: 1386013 - RNA, 23 nt, Human
agacacaugaagguaaauaaaaa

SEQ ID NO: 1386014 - RNA, 20 nt, Human
agacacaugaagguaaauaa

SEQ ID NO: 1386015 - RNA, 19 nt, Human
agacacaugaagguaaaua

SEQ ID NO: 1386016 - RNA, 13 nt, Human
agacacaugaagg

SEQ ID NO: 1386017 - RNA, 12 nt, Human
agacacaugaag

SEQ ID NO: 1386018 - RNA, 16 nt, Human
agacacauacucauuu

SEQ ID NO: 1386019 - RNA, 12 nt, Human
agacacaggccc

SEQ ID NO: 1386020 - RNA, 12 nt, Human
agacacagacug

SEQ ID NO: 1386021 - RNA, 15 nt, Human
agacacacaugaagu

SEQ ID NO: 1386022 - RNA, 12 nt, Human
agacacacauga

SEQ ID NO: 1386023 - RNA, 17 nt, Human
agaauugaguguuuaaa

SEQ ID NO: 1386024 - RNA, 14 nt, Human
agaauugaguguuu

SEQ ID NO: 1386025 - RNA, 18 nt, Human
agaauugaguaauggugu

SEQ ID NO: 1386026 - RNA, 17 nt, Human
agaauugaguaauggug

SEQ ID NO: 1386027 - RNA, 22 nt, Human
agaauuugauaugugaacaguu

SEQ ID NO: 1386028 - RNA, 16 nt, Human
ucuguugcaagugcaa

SEQ ID NO: 1386029 - RNA, 22 nt, Human
ucuguucuuuccaaaguacacu

SEQ ID NO: 1386030 - RNA, 13 nt, Human
ucuguucuuucca

SEQ ID NO: 1386031 - RNA, 15 nt, Human
ucuguuggcaggcug

SEQ ID NO: 1386032 - RNA, 23 nt, Human
ucuguugucguaaagauuugggu

SEQ ID NO: 1386033 - RNA, 20 nt, Human
ucuguuggcaggcuggccag

SEQ ID NO: 1386034 - RNA, 18 nt, Human
ucuguuggcaggcuggcc

SEQ ID NO: 1386035 - RNA, 16 nt, Human
ucuguuguauucauug

SEQ ID NO: 1386036 - RNA, 13 nt, Human
ucuguuuagauaa

SEQ ID NO: 1386037 - RNA, 21 nt, Human
ucugggccuuggccuggagca

SEQ ID NO: 1386038 - RNA, 23 nt, Human
ucuguauuugaaucagccuacag

SEQ ID NO: 1386039 - RNA, 22 nt, Human
ucugggccuuggccuggagcac

SEQ ID NO: 1386040 - RNA, 20 nt, Human
ucugggccuuggccuggagc

SEQ ID NO: 1386041 - RNA, 19 nt, Human
ucugggccuuggccuggag

SEQ ID NO: 1386042 - RNA, 18 nt, Human
ucugggccuuggccugga

SEQ ID NO: 1386043 - RNA, 15 nt, Human
ucugggccuuggccu

SEQ ID NO: 1386044 - RNA, 14 nt, Human
ucugggccuuggcc

SEQ ID NO: 1386045 - RNA, 12 nt, Human
ucugggccugac

SEQ ID NO: 1386046 - RNA, 21 nt, Human
ucugggccauucuccacagca

SEQ ID NO: 1386047 - RNA, 15 nt, Human
agaagggaaagccca

SEQ ID NO: 1386048 - RNA, 12 nt, Human
agaagggaaagc

SEQ ID NO: 1386049 - RNA, 13 nt, Human
agaaggccaagag

SEQ ID NO: 1386050 - RNA, 17 nt, Human
agaaggccaagaggcug

SEQ ID NO: 1386051 - RNA, 18 nt, Human
agaaggcauuugcagggu

SEQ ID NO: 1386052 - RNA, 15 nt, Human
agaaggcaaaaaugu

SEQ ID NO: 1386053 - RNA, 19 nt, Human
ucugcuuguuauuagagau

SEQ ID NO: 1386054 - RNA, 19 nt, Human
agaaggcaaaaauaguuug

SEQ ID NO: 1386055 - RNA, 17 nt, Human
ucugcuuucuccuuuaa

SEQ ID NO: 1386056 - RNA, 23 nt, Human
agaaguuucaucauuuuuuacuu

SEQ ID NO: 1386057 - RNA, 21 nt, Human
agaaguuucaucauuuuuuac

SEQ ID NO: 1386058 - RNA, 19 nt, Human
agaaguuucaucauuuuuu

SEQ ID NO: 1386059 - RNA, 18 nt, Human
agaaguuuagauuuuaau

SEQ ID NO: 1386060 - RNA, 19 nt, Human
agaaguucaauauaagcuu

SEQ ID NO: 1386061 - RNA, 19 nt, Human
agaaguuaguuuguauaua

SEQ ID NO: 1386062 - RNA, 18 nt, Human
agaaguuaguuuguauau

SEQ ID NO: 1386063 - RNA, 16 nt, Human
agaaguuaguuuguau

SEQ ID NO: 1386064 - RNA, 15 nt, Human
agaaguuaguuugua

SEQ ID NO: 1386065 - RNA, 22 nt, Human
agaaguguggggauuuucacug

SEQ ID NO: 1386066 - RNA, 21 nt, Human
agaagugugccuucucucucc

SEQ ID NO: 1386067 - RNA, 17 nt, Human
agaauagaacacaguuu

SEQ ID NO: 1386068 - RNA, 22 nt, Human
agaauagaaauaaaggauguga

SEQ ID NO: 1386069 - RNA, 15 nt, Human
agaauacuucucauu

SEQ ID NO: 1386070 - RNA, 19 nt, Human
agaauacuucucauuuuuu

SEQ ID NO: 1386071 - RNA, 16 nt, Human
agaauaucacagaaaa

SEQ ID NO: 1386072 - RNA, 17 nt, Human
agaauauccaugaccua

SEQ ID NO: 1386073 - RNA, 19 nt, Human
agaauagccacauuuggaa

SEQ ID NO: 1386074 - RNA, 17 nt, Human
agaauagccacauuugg

SEQ ID NO: 1386075 - RNA, 14 nt, Human
agaauaugucagug

SEQ ID NO: 1386076 - RNA, 13 nt, Human
agaauaugaaaca

SEQ ID NO: 1386077 - RNA, 12 nt, Human
agaauaugccuu

SEQ ID NO: 1386078 - RNA, 21 nt, Human
agaauaaguuauugcaguuua

SEQ ID NO: 1386079 - RNA, 20 nt, Human
agaauaaguuauugcaguuu

SEQ ID NO: 1386080 - RNA, 19 nt, Human
agaauaaguuauugcaguu

SEQ ID NO: 1386081 - RNA, 17 nt, Human
agaauaaguuauugcag

SEQ ID NO: 1386082 - RNA, 16 nt, Human
agaauaaguuauugca

SEQ ID NO: 1386083 - RNA, 14 nt, Human
agaauaaguuauug

SEQ ID NO: 1386084 - RNA, 13 nt, Human
agaauaaguuauu

SEQ ID NO: 1386085 - RNA, 12 nt, Human
agaauaaguuau

SEQ ID NO: 1386086 - RNA, 12 nt, Human
agaauaaaauuu

SEQ ID NO: 1386087 - RNA, 14 nt, Human
agaauaaaauuuuu

SEQ ID NO: 1386088 - RNA, 17 nt, Human
agaauaaaauuuuuaau

SEQ ID NO: 1386089 - RNA, 18 nt, Human
ucugggauaaguaaguuu

SEQ ID NO: 1386090 - RNA, 17 nt, Human
ucugggagucacacagu

SEQ ID NO: 1386091 - RNA, 18 nt, Human
ucugggagucacacagug

SEQ ID NO: 1386092 - RNA, 16 nt, Human
ucugggagucacacag

SEQ ID NO: 1386093 - RNA, 15 nt, Human
ucugggagucacaca

SEQ ID NO: 1386094 - RNA, 21 nt, Human
ucugggagggcagcagggcua

SEQ ID NO: 1386095 - RNA, 19 nt, Human
ucugggagggcagcagggc

SEQ ID NO: 1386096 - RNA, 13 nt, Human
ucugggagggcag

SEQ ID NO: 1386097 - RNA, 11 nt, Human
agaauuauuua

SEQ ID NO: 1386098 - RNA, 21 nt, Human
agaauuaucuaauuuauaaaa

SEQ ID NO: 1386099 - RNA, 20 nt, Human
agaauuaucuaauuuauaaa

SEQ ID NO: 1386100 - RNA, 18 nt, Human
agaauuaucuaauuuaua

SEQ ID NO: 1386101 - RNA, 13 nt, Human
agaauuauuuugu

SEQ ID NO: 1386102 - RNA, 15 nt, Human
agaauuauuuuguga

SEQ ID NO: 1386103 - RNA, 13 nt, Human
agaauucagacau

SEQ ID NO: 1386104 - RNA, 22 nt, Human
agaauuaaacuuuuaauucauu

SEQ ID NO: 1386105 - RNA, 21 nt, Human
agaauuaaacuuuuaauucau

SEQ ID NO: 1386106 - RNA, 20 nt, Human
agaauuaaacuuuuaauuca

SEQ ID NO: 1386107 - RNA, 18 nt, Human
agaauuaaacuuuuaauu

SEQ ID NO: 1386108 - RNA, 15 nt, Human
agaauuaaacuuuua

SEQ ID NO: 1386109 - RNA, 14 nt, Human
agaauuaaacuuuu

SEQ ID NO: 1386110 - RNA, 17 nt, Human
agaauuaucuaauuuau

SEQ ID NO: 1386111 - RNA, 15 nt, Human
agaauuaucuaauuu

SEQ ID NO: 1386112 - RNA, 14 nt, Human
agaauuaucuaauu

SEQ ID NO: 1386113 - RNA, 14 nt, Human
agaauguaucccca

SEQ ID NO: 1386114 - RNA, 21 nt, Human
agaauguauccccaaaagcgu

SEQ ID NO: 1386115 - RNA, 23 nt, Human
agaauguauauuaagguguggcu

SEQ ID NO: 1386116 - RNA, 17 nt, Human
agaauccacauuucuaa

SEQ ID NO: 1386117 - RNA, 16 nt, Human
agaauccacauuucua

SEQ ID NO: 1386118 - RNA, 15 nt, Human
agaaucauuuagcau

SEQ ID NO: 1386119 - RNA, 13 nt, Human
agaaucaucagga

SEQ ID NO: 1386120 - RNA, 20 nt, Human
agaaucccuuaacaguugua

SEQ ID NO: 1386121 - RNA, 21 nt, Human
agaaucccagcccccugacca

SEQ ID NO: 1386122 - RNA, 19 nt, Human
agaaucccaaauuugauug

SEQ ID NO: 1386123 - RNA, 18 nt, Human
agaaucccaaauuugauu

SEQ ID NO: 1386124 - RNA, 17 nt, Human
agaaucccaaauuugau

SEQ ID NO: 1386125 - RNA, 22 nt, Human
agaauccacauuucuaaaaucu

SEQ ID NO: 1386126 - RNA, 20 nt, Human
agaauccacauuucuaaaau

SEQ ID NO: 1386127 - RNA, 19 nt, Human
agaauccacauuucuaaaa

SEQ ID NO: 1386128 - RNA, 18 nt, Human
agaauccacauuucuaaa

SEQ ID NO: 1386129 - RNA, 15 nt, Human
agaaucccaaauuug

SEQ ID NO: 1386130 - RNA, 12 nt, Human
agaauguaaagc

SEQ ID NO: 1386131 - RNA, 23 nt, Human
agaauggugugggagagggauga

SEQ ID NO: 1386132 - RNA, 17 nt, Human
agaauguaaagcuuguc

SEQ ID NO: 1386133 - RNA, 16 nt, Human
agaauguaaagcuugu

SEQ ID NO: 1386134 - RNA, 13 nt, Human
agaauguaaagcu

SEQ ID NO: 1386135 - RNA, 22 nt, Human
ugaaguaaacuuuuuguucugg

SEQ ID NO: 1386136 - RNA, 16 nt, Human
ugaaguaaacuuuuug

SEQ ID NO: 1386137 - RNA, 14 nt, Human
ugaaguaaacuuuu

SEQ ID NO: 1386138 - RNA, 15 nt, Human
ugaaguaauaugcac

SEQ ID NO: 1386139 - RNA, 16 nt, Human
ugaaguaauaugcaca

SEQ ID NO: 1386140 - RNA, 20 nt, Human
ugaaguaauaugcacacauu

SEQ ID NO: 1386141 - RNA, 21 nt, Human
ugaaguaauaugcacacauuu

SEQ ID NO: 1386142 - RNA, 22 nt, Human
ugaaguaauaugcacacauuuu

SEQ ID NO: 1386143 - RNA, 17 nt, Human
ugaagggccagagccag

SEQ ID NO: 1386144 - RNA, 16 nt, Human
ugaagggccagagcca

SEQ ID NO: 1386145 - RNA, 15 nt, Human
ugaagggccagagcc

SEQ ID NO: 1386146 - RNA, 14 nt, Human
ugaagggccagagc

SEQ ID NO: 1386147 - RNA, 12 nt, Human
ugaagggccaga

SEQ ID NO: 1386148 - RNA, 19 nt, Human
ugaagggcaggugcuucag

SEQ ID NO: 1386149 - RNA, 15 nt, Human
ugaagggcaggugcu

SEQ ID NO: 1386150 - RNA, 20 nt, Human
ugaagauuuaccacuugugu

SEQ ID NO: 1386151 - RNA, 17 nt, Human
ugaagauuuaccacuug

SEQ ID NO: 1386152 - RNA, 21 nt, Human
ugaaguauuuuuucaguauua

SEQ ID NO: 1386153 - RNA, 17 nt, Human
ugaaguauuuuuucagu

SEQ ID NO: 1386154 - RNA, 20 nt, Human
ugaaguauuuugcuggaaua

SEQ ID NO: 1386155 - RNA, 15 nt, Human
ugaauaaaugucuug

SEQ ID NO: 1386156 - RNA, 23 nt, Human
ugaauaauguaagacaaauaugu

SEQ ID NO: 1386157 - RNA, 20 nt, Human
ugaaucaagggucaggccuu

SEQ ID NO: 1386158 - RNA, 18 nt, Human
ugaaucaagggucaggcc

SEQ ID NO: 1386159 - RNA, 21 nt, Human
ugaauauuuguuauguagaua

SEQ ID NO: 1386160 - RNA, 15 nt, Human
ugaauacauuuccaa

SEQ ID NO: 1386161 - RNA, 19 nt, Human
agagcuguauuaagccacu

SEQ ID NO: 1386162 - RNA, 17 nt, Human
agagcuguauuaagcca

SEQ ID NO: 1386163 - RNA, 21 nt, Human
agagcuggugcggcuggccau

SEQ ID NO: 1386164 - RNA, 22 nt, Human
agagcuggugcggcuggccaug

SEQ ID NO: 1386165 - RNA, 19 nt, Human
agagcuggugcggcuggcc

SEQ ID NO: 1386166 - RNA, 18 nt, Human
agagcuggugcggcuggc

SEQ ID NO: 1386167 - RNA, 17 nt, Human
agagcuggugcggcugg

SEQ ID NO: 1386168 - RNA, 15 nt, Human
agagcuggugcggcu

SEQ ID NO: 1386169 - RNA, 19 nt, Human
agaggccugggcugggaaa

SEQ ID NO: 1386170 - RNA, 18 nt, Human
agaggccugggcugggaa

SEQ ID NO: 1386171 - RNA, 14 nt, Human
agaggccugggcug

SEQ ID NO: 1386172 - RNA, 17 nt, Human
agaggccguggcugcug

SEQ ID NO: 1386173 - RNA, 22 nt, Human
agaggccguggcugcuguggga

SEQ ID NO: 1386174 - RNA, 15 nt, Human
agaggccguggcugc

SEQ ID NO: 1386175 - RNA, 14 nt, Human
agaggccguggcug

SEQ ID NO: 1386176 - RNA, 23 nt, Human
agaggcccuggaucagcguggcc

SEQ ID NO: 1386177 - RNA, 24 nt, Human
agaggcccuggaucagcguggccu

SEQ ID NO: 1386178 - RNA, 22 nt, Human
agaggcccuggaucagcguggc

SEQ ID NO: 1386179 - RNA, 21 nt, Human
agaggcccuggaucagcgugg

SEQ ID NO: 1386180 - RNA, 20 nt, Human
agaggcccuggaucagcgug

SEQ ID NO: 1386181 - RNA, 17 nt, Human
agaggcccuggaucagc

SEQ ID NO: 1386182 - RNA, 15 nt, Human
agaggcccuggauca

SEQ ID NO: 1386183 - RNA, 13 nt, Human
agaggcccuggau

SEQ ID NO: 1386184 - RNA, 12 nt, Human
agaggcccugga

SEQ ID NO: 1386185 - RNA, 13 nt, Human
agaggccagaggc

SEQ ID NO: 1386186 - RNA, 13 nt, Human
agaggcaguaccu

SEQ ID NO: 1386187 - RNA, 23 nt, Human
agaggccaggcaggagcccuucu

SEQ ID NO: 1386188 - RNA, 18 nt, Human
agaggccuguuuggccuc

SEQ ID NO: 1386189 - RNA, 21 nt, Human
agaggcugaggcuggcacagg

SEQ ID NO: 1386190 - RNA, 19 nt, Human
agaggcugaggcuggcaca

SEQ ID NO: 1386191 - RNA, 20 nt, Human
agaggccuguuuggccucuc

SEQ ID NO: 1386192 - RNA, 12 nt, Human
agaggcugcccc

SEQ ID NO: 1386193 - RNA, 19 nt, Human
agaggcugccccucucacc

SEQ ID NO: 1386194 - RNA, 18 nt, Human
agaggcugccccucucac

SEQ ID NO: 1386195 - RNA, 16 nt, Human
agaggcugccccucuc

SEQ ID NO: 1386196 - RNA, 14 nt, Human
agaggcugccccuc

SEQ ID NO: 1386197 - RNA, 15 nt, Human
agaggcugcccuccu

SEQ ID NO: 1386198 - RNA, 20 nt, Human
agaggcugccccucucacca

SEQ ID NO: 1386199 - RNA, 13 nt, Human
agagguucaaaga

SEQ ID NO: 1386200 - RNA, 18 nt, Human
agaguaauccaagcaaau

SEQ ID NO: 1386201 - RNA, 20 nt, Human
agaguaauccaagcaaaugu

SEQ ID NO: 1386202 - RNA, 22 nt, Human
agaguaauccaagcaaauguga

SEQ ID NO: 1386203 - RNA, 21 nt, Human
ugaagauucuuucccaauuca

SEQ ID NO: 1386204 - RNA, 16 nt, Human
agagguucaaagauau

SEQ ID NO: 1386205 - RNA, 19 nt, Human
agagguucaaagauauuuu

SEQ ID NO: 1386206 - RNA, 20 nt, Human
agagguucaaagauauuuug

SEQ ID NO: 1386207 - RNA, 20 nt, Human
ugaagaauuauuuuuuuucu

SEQ ID NO: 1386208 - RNA, 21 nt, Human
ugaagaauuauuuuuuuucuu

SEQ ID NO: 1386209 - RNA, 13 nt, Human
ugaagaauguuaa

SEQ ID NO: 1386210 - RNA, 22 nt, Human
ugaagaaugcacaagaauggau

SEQ ID NO: 1386211 - RNA, 20 nt, Human
ugaagaauacuucucauuuu

SEQ ID NO: 1386212 - RNA, 21 nt, Human
ugaagaauacuucucauuuuu

SEQ ID NO: 1386213 - RNA, 19 nt, Human
ugaagaauacuucucauuu

SEQ ID NO: 1386214 - RNA, 16 nt, Human
ugaagaauacuucuca

SEQ ID NO: 1386215 - RNA, 22 nt, Human
ugaagaagcuaaauccuuuacu

SEQ ID NO: 1386216 - RNA, 15 nt, Human
ugaagaaggugaaua

SEQ ID NO: 1386217 - RNA, 14 nt, Human
ugaacuccugccau

SEQ ID NO: 1386218 - RNA, 18 nt, Human
ugaagaacugcaggcccu

SEQ ID NO: 1386219 - RNA, 12 nt, Human
agagcuggugcg

SEQ ID NO: 1386220 - RNA, 13 nt, Human
ugaagacagaagu

SEQ ID NO: 1386221 - RNA, 19 nt, Human
ugaagacagaaccacaggg

SEQ ID NO: 1386222 - RNA, 14 nt, Human
ugaagacagaacca

SEQ ID NO: 1386223 - RNA, 22 nt, Human
ugaagacaaugacuuacuguac

SEQ ID NO: 1386224 - RNA, 23 nt, Human
ugaagacaaugacuuacuguaca

SEQ ID NO: 1386225 - RNA, 20 nt, Human
ugaagaacugcaggcccugg

SEQ ID NO: 1386226 - RNA, 17 nt, Human
ugaagaacugcaggccc

SEQ ID NO: 1386227 - RNA, 16 nt, Human
ugaagaacugcaggcc

SEQ ID NO: 1386228 - RNA, 15 nt, Human
ugaagaacugcaggc

SEQ ID NO: 1386229 - RNA, 14 nt, Human
ugaagaacugcagg

SEQ ID NO: 1386230 - RNA, 19 nt, Human
ugaagaacugaggaggaaa

SEQ ID NO: 1386231 - RNA, 13 nt, Human
ugaagaacugagg

SEQ ID NO: 1386232 - RNA, 20 nt, Human
ugaagaaccaguccccccac

SEQ ID NO: 1386233 - RNA, 19 nt, Human
ugaagaaccagucccccca

SEQ ID NO: 1386234 - RNA, 14 nt, Human
ugaagaacauguga

SEQ ID NO: 1386235 - RNA, 13 nt, Human
ugaagaacaugug

SEQ ID NO: 1386236 - RNA, 20 nt, Human
ugaacucacuuuccuccuga

SEQ ID NO: 1386237 - RNA, 20 nt, Human
ugaacuaccuugguuccccc

SEQ ID NO: 1386238 - RNA, 13 nt, Human
ugaacccaggaca

SEQ ID NO: 1386239 - RNA, 22 nt, Human
ugaacccaggacaagcaugguc

SEQ ID NO: 1386240 - RNA, 12 nt, Human
ugaacccaggac

SEQ ID NO: 1386241 - RNA, 17 nt, Human
ugaaccauuaaccagau

SEQ ID NO: 1386242 - RNA, 12 nt, Human
ugaaccaccgcg

SEQ ID NO: 1386243 - RNA, 17 nt, Human
ugaacguuuucuaauug

SEQ ID NO: 1386244 - RNA, 16 nt, Human
ugaacguuuucuaauu

SEQ ID NO: 1386245 - RNA, 15 nt, Human
ugaacguuuucuaau

SEQ ID NO: 1386246 - RNA, 15 nt, Human
ugaacuaaagugcug

SEQ ID NO: 1386247 - RNA, 19 nt, Human
ugaacguuuucuaauugcu

SEQ ID NO: 1386248 - RNA, 23 nt, Human
ugaacguuuucuaauugcuuauu

SEQ ID NO: 1386249 - RNA, 19 nt, Human
ugaacuaaagugcugcacu

SEQ ID NO: 1386250 - RNA, 21 nt, Human
ugaacuaaagugcugcacuca

SEQ ID NO: 1386251 - RNA, 23 nt, Human
ugaacuagaguuuagcuggaaaa

SEQ ID NO: 1386252 - RNA, 23 nt, Human
agagauuggguuuuuggacuucu

SEQ ID NO: 1386253 - RNA, 19 nt, Human
agagauuaccuccugagaa

SEQ ID NO: 1386254 - RNA, 16 nt, Human
agagauuaccuccuga

SEQ ID NO: 1386255 - RNA, 24 nt, Human
agagauguguguugauacuguugc

SEQ ID NO: 1386256 - RNA, 23 nt, Human
agagauguguguugauacuguug

SEQ ID NO: 1386257 - RNA, 22 nt, Human
agagauguguguugauacuguu

SEQ ID NO: 1386258 - RNA, 21 nt, Human
agagauguguguugauacugu

SEQ ID NO: 1386259 - RNA, 15 nt, Human
agagaugccucccug

SEQ ID NO: 1386260 - RNA, 23 nt, Human
agagauucugaacuaaagugcug

SEQ ID NO: 1386261 - RNA, 20 nt, Human
agagauuaccuccugagaaa

SEQ ID NO: 1386262 - RNA, 20 nt, Human
ugaaauaagaauucagacau

SEQ ID NO: 1386263 - RNA, 21 nt, Human
ugaaauaccaaccugaagaca

SEQ ID NO: 1386264 - RNA, 15 nt, Human
ugaaauaagaauuca

SEQ ID NO: 1386265 - RNA, 23 nt, Human
ugaaauaaacgucuuaaauauuc

SEQ ID NO: 1386266 - RNA, 22 nt, Human
ugaaauaaacgucuuaaauauu

SEQ ID NO: 1386267 - RNA, 18 nt, Human
ugaaauaaacgucuuaaa

SEQ ID NO: 1386268 - RNA, 13 nt, Human
ugaaauaaacguc

SEQ ID NO: 1386269 - RNA, 15 nt, Human
ugaacaaauggccuu

SEQ ID NO: 1386270 - RNA, 23 nt, Human
ugaacaaaguuuaccagaaagca

SEQ ID NO: 1386271 - RNA, 17 nt, Human
ugaacaaagcagccacg

SEQ ID NO: 1386272 - RNA, 16 nt, Human
ugaacaaagcagccac

SEQ ID NO: 1386273 - RNA, 15 nt, Human
ugaacaaagcagcca

SEQ ID NO: 1386274 - RNA, 14 nt, Human
ugaacaaagcagcc

SEQ ID NO: 1386275 - RNA, 15 nt, Human
ugaaauuuuucuucu

SEQ ID NO: 1386276 - RNA, 13 nt, Human
ugaaauuuuucuu

SEQ ID NO: 1386277 - RNA, 21 nt, Human
ugaaauuuccugggagcuuuu

SEQ ID NO: 1386278 - RNA, 22 nt, Human
ugaaauuucagauucccagagc

SEQ ID NO: 1386279 - RNA, 15 nt, Human
ugaaauuuccuggga

SEQ ID NO: 1386280 - RNA, 19 nt, Human
ugaaauugaaccuuugugc

SEQ ID NO: 1386281 - RNA, 17 nt, Human
ugaaauugaaccuuugu

SEQ ID NO: 1386282 - RNA, 13 nt, Human
ugaaauugaaccu

SEQ ID NO: 1386283 - RNA, 12 nt, Human
ugaaauuucaga

SEQ ID NO: 1386284 - RNA, 22 nt, Human
ugaaauugaaccuuugugcccu

SEQ ID NO: 1386285 - RNA, 14 nt, Human
ugaaagagaaacac

SEQ ID NO: 1386286 - RNA, 13 nt, Human
agagaccgaggag

SEQ ID NO: 1386287 - RNA, 16 nt, Human
agagacuuguuuugga

SEQ ID NO: 1386288 - RNA, 18 nt, Human
agagacuuguuuuggaug

SEQ ID NO: 1386289 - RNA, 12 nt, Human
agagacuuguuu

SEQ ID NO: 1386290 - RNA, 22 nt, Human
agagacugaauagauaugaaag

SEQ ID NO: 1386291 - RNA, 18 nt, Human
agagaugccucccugagc

SEQ ID NO: 1386292 - RNA, 14 nt, Human
agagaugccucccu

SEQ ID NO: 1386293 - RNA, 13 nt, Human
agagaugccuccc

SEQ ID NO: 1386294 - RNA, 16 nt, Human
agagaugcagaaauau

SEQ ID NO: 1386295 - RNA, 17 nt, Human
agagaugcagaaauauu

SEQ ID NO: 1386296 - RNA, 13 nt, Human
agagaugcagaaa

SEQ ID NO: 1386297 - RNA, 21 nt, Human
agagaucccaaguagaaucuc

SEQ ID NO: 1386298 - RNA, 13 nt, Human
agagauacagagg

SEQ ID NO: 1386299 - RNA, 15 nt, Human
agagaguugaaccua

SEQ ID NO: 1386300 - RNA, 17 nt, Human
ugaaaauaaagaaugga

SEQ ID NO: 1386301 - RNA, 16 nt, Human
ugaaaauaagaauaga

SEQ ID NO: 1386302 - RNA, 17 nt, Human
ugaaaauaaaguguaua

SEQ ID NO: 1386303 - RNA, 16 nt, Human
ugaaaauaaagaaugg

SEQ ID NO: 1386304 - RNA, 15 nt, Human
ugaaaauaaagaaug

SEQ ID NO: 1386305 - RNA, 14 nt, Human
ugaaaauaaagaau

SEQ ID NO: 1386306 - RNA, 13 nt, Human
ugaaaauaaagaa

SEQ ID NO: 1386307 - RNA, 21 nt, Human
ugaaaauaaaaagaucacuuu

SEQ ID NO: 1386308 - RNA, 20 nt, Human
ugaaaauaaaaagaucacuu

SEQ ID NO: 1386309 - RNA, 19 nt, Human
ugaaaacacauuugcuuuu

SEQ ID NO: 1386310 - RNA, 20 nt, Human
ugaaaacacauuuuucuuag

SEQ ID NO: 1386311 - RNA, 19 nt, Human
ugaaaacacauuuuucuua

SEQ ID NO: 1386312 - RNA, 15 nt, Human
ugaaaacacauuuuu

SEQ ID NO: 1386313 - RNA, 17 nt, Human
ugaaaacacauuuuucu

SEQ ID NO: 1386314 - RNA, 22 nt, Human
ucuuuuuuuuuuuuuaauaaau

SEQ ID NO: 1386315 - RNA, 23 nt, Human
ucuuuuuuuuuuuuuaauaaauu

SEQ ID NO: 1386316 - RNA, 20 nt, Human
ucuuuuuuuucuauuucacu

SEQ ID NO: 1386317 - RNA, 23 nt, Human
ucuuuuuuuguauaguuaacaca

SEQ ID NO: 1386318 - RNA, 18 nt, Human
ucuuuuuuuguauaguua

SEQ ID NO: 1386319 - RNA, 17 nt, Human
ugaaaacacauuugcuu

SEQ ID NO: 1386320 - RNA, 14 nt, Human
ugaaaacacauuug

SEQ ID NO: 1386321 - RNA, 14 nt, Human
ugaaaacacauuuu

SEQ ID NO: 1386322 - RNA, 12 nt, Human
ugaaaacacauu

SEQ ID NO: 1386323 - RNA, 13 nt, Human
ugaaaacacauuu

SEQ ID NO: 1386324 - RNA, 19 nt, Human
ugaaaaugugcuauacugc

SEQ ID NO: 1386325 - RNA, 17 nt, Human
ugaaaaugugcuauacu

SEQ ID NO: 1386326 - RNA, 16 nt, Human
ugaaaaugucuugugu

SEQ ID NO: 1386327 - RNA, 13 nt, Human
ugaaaaugcuggc

SEQ ID NO: 1386328 - RNA, 16 nt, Human
ugaaaaugggcucaac

SEQ ID NO: 1386329 - RNA, 12 nt, Human
ugaaaaugcugg

SEQ ID NO: 1386330 - RNA, 13 nt, Human
ugaaagaaaauaa

SEQ ID NO: 1386331 - RNA, 17 nt, Human
ugaaacuggauuaaacu

SEQ ID NO: 1386332 - RNA, 18 nt, Human
ugaaacuggauuaaacuu

SEQ ID NO: 1386333 - RNA, 22 nt, Human
ugaaaaugugcuauacugcaua

SEQ ID NO: 1386334 - RNA, 21 nt, Human
ugaaaaugugcuauacugcau

SEQ ID NO: 1386335 - RNA, 20 nt, Human
ugaaaaugugcuauacugca

SEQ ID NO: 1386336 - RNA, 14 nt, Human
ugaaaauuaacaug

SEQ ID NO: 1386337 - RNA, 18 nt, Human
ucuuucucacuaaaucuu

SEQ ID NO: 1386338 - RNA, 17 nt, Human
ucuuucucacuaaaucu

SEQ ID NO: 1386339 - RNA, 14 nt, Human
ucuuucccuggucc

SEQ ID NO: 1386340 - RNA, 17 nt, Human
ucuuuaaugcaauauac

SEQ ID NO: 1386341 - RNA, 23 nt, Human
agacuggcuuuuauuaaugcacu

SEQ ID NO: 1386342 - RNA, 22 nt, Human
agacuggcuuuuauuaaugcac

SEQ ID NO: 1386343 - RNA, 18 nt, Human
agacuggcuuuuauuaau

SEQ ID NO: 1386344 - RNA, 11 nt, Human
agacuggcuuu

SEQ ID NO: 1386345 - RNA, 21 nt, Human
agacucuagaguccaagguuu

SEQ ID NO: 1386346 - RNA, 22 nt, Human
agacuccuagcuguccuuuuuc

SEQ ID NO: 1386347 - RNA, 17 nt, Human
agacuccuagcuguccu

SEQ ID NO: 1386348 - RNA, 23 nt, Human
agacucccauuccugaagaacca

SEQ ID NO: 1386349 - RNA, 19 nt, Human
agacucccauuccugaaga

SEQ ID NO: 1386350 - RNA, 17 nt, Human
agacucccauuccugaa

SEQ ID NO: 1386351 - RNA, 18 nt, Human
agacuccagaccugaggc

SEQ ID NO: 1386352 - RNA, 14 nt, Human
agacuccagaccug

SEQ ID NO: 1386353 - RNA, 20 nt, Human
agacucuagaguccaagguu

SEQ ID NO: 1386354 - RNA, 19 nt, Human
agacucuagaguccaaggu

SEQ ID NO: 1386355 - RNA, 17 nt, Human
agacucuagaguccaag

SEQ ID NO: 1386356 - RNA, 16 nt, Human
agacucuagaguccaa

SEQ ID NO: 1386357 - RNA, 19 nt, Human
agacucuacccauauuaca

SEQ ID NO: 1386358 - RNA, 20 nt, Human
agacugggcugagggagccu

SEQ ID NO: 1386359 - RNA, 16 nt, Human
agacugggcugaggga

SEQ ID NO: 1386360 - RNA, 15 nt, Human
agacugggcugaggg

SEQ ID NO: 1386361 - RNA, 14 nt, Human
agacugggcugagg

SEQ ID NO: 1386362 - RNA, 12 nt, Human
agacugggcuga

SEQ ID NO: 1386363 - RNA, 23 nt, Human
agacugggaaggcuugggauuug

SEQ ID NO: 1386364 - RNA, 22 nt, Human
agacugggaaggcuugggauuu

SEQ ID NO: 1386365 - RNA, 21 nt, Human
agacugggaaggcuugggauu

SEQ ID NO: 1386366 - RNA, 19 nt, Human
agacugggaaggcuuggga

SEQ ID NO: 1386367 - RNA, 20 nt, Human
agacugguuccauggccucu

SEQ ID NO: 1386368 - RNA, 12 nt, Human
agacuuuuauga

SEQ ID NO: 1386369 - RNA, 15 nt, Human
agacuuuuaugauac

SEQ ID NO: 1386370 - RNA, 16 nt, Human
agagacacuggugggg

SEQ ID NO: 1386371 - RNA, 16 nt, Human
agagacacacugaaga

SEQ ID NO: 1386372 - RNA, 21 nt, Human
ucuuugucagggaguguuccc

SEQ ID NO: 1386373 - RNA, 15 nt, Human
ucuuugucagggagu

SEQ ID NO: 1386374 - RNA, 15 nt, Human
agagacacugguggg

SEQ ID NO: 1386375 - RNA, 21 nt, Human
ucuuuuuucuaaaguaaaaac

SEQ ID NO: 1386376 - RNA, 22 nt, Human
ucuuuuuucuaaaguaaaaaca

SEQ ID NO: 1386377 - RNA, 17 nt, Human
ucuuuuuuuguauaguu

SEQ ID NO: 1386378 - RNA, 15 nt, Human
ucuuuuuuuguauag

SEQ ID NO: 1386379 - RNA, 15 nt, Human
ucuuuuuuucuugaa

SEQ ID NO: 1386380 - RNA, 21 nt, Human
ucuuuuuuggccaucugcucc

SEQ ID NO: 1386381 - RNA, 22 nt, Human
ucuuuuuuggccaucugcuccu

SEQ ID NO: 1386382 - RNA, 13 nt, Human
ucuuuuuucguuu

SEQ ID NO: 1386383 - RNA, 17 nt, Human
ucuuuuuucaaaagaaa

SEQ ID NO: 1386384 - RNA, 20 nt, Human
ugacuguuuuucggacaguu

SEQ ID NO: 1386385 - RNA, 19 nt, Human
ugacuguuuuucggacagu

SEQ ID NO: 1386386 - RNA, 16 nt, Human
ugacucgguuucucca

SEQ ID NO: 1386387 - RNA, 15 nt, Human
ugacucgguuucucc

SEQ ID NO: 1386388 - RNA, 14 nt, Human
ugacucgguuucuc

SEQ ID NO: 1386389 - RNA, 21 nt, Human
ugacuauucuugauguaaaau

SEQ ID NO: 1386390 - RNA, 19 nt, Human
ugacuauuuuucagaaucu

SEQ ID NO: 1386391 - RNA, 18 nt, Human
ugacucgguuucuccaaa

SEQ ID NO: 1386392 - RNA, 13 nt, Human
ugacuauguaaac

SEQ ID NO: 1386393 - RNA, 22 nt, Human
ugacuauucuugauguaaaauc

SEQ ID NO: 1386394 - RNA, 20 nt, Human
ugacuauucuugauguaaaa

SEQ ID NO: 1386395 - RNA, 19 nt, Human
ugacuauucuugauguaaa

SEQ ID NO: 1386396 - RNA, 17 nt, Human
ugacuauucuugaugua

SEQ ID NO: 1386397 - RNA, 12 nt, Human
ugacuauguaaa

SEQ ID NO: 1386398 - RNA, 15 nt, Human
ugaccuggcccccuc

SEQ ID NO: 1386399 - RNA, 12 nt, Human
ugaccuggcccc

SEQ ID NO: 1386400 - RNA, 22 nt, Human
ugaccuggauggggcaggccac

SEQ ID NO: 1386401 - RNA, 16 nt, Human
ugaccuggauggggca

SEQ ID NO: 1386402 - RNA, 21 nt, Human
ugaccugcugagcucugagag

SEQ ID NO: 1386403 - RNA, 22 nt, Human
ugaccugcugagcucugagagg

SEQ ID NO: 1386404 - RNA, 20 nt, Human
ugaccugcugagcucugaga

SEQ ID NO: 1386405 - RNA, 19 nt, Human
ugaccugcugagcucugag

SEQ ID NO: 1386406 - RNA, 18 nt, Human
ugaccugcugagcucuga

SEQ ID NO: 1386407 - RNA, 17 nt, Human
ugaccugcugagcucug

SEQ ID NO: 1386408 - RNA, 16 nt, Human
ugaccugcugagcucu

SEQ ID NO: 1386409 - RNA, 15 nt, Human
ugaccugcugagcuc

SEQ ID NO: 1386410 - RNA, 14 nt, Human
ugaccugcugagcu

SEQ ID NO: 1386411 - RNA, 13 nt, Human
ugaccugcugagc

SEQ ID NO: 1386412 - RNA, 12 nt, Human
ugaccugcugag

SEQ ID NO: 1386413 - RNA, 18 nt, Human
ugaccugcugaccugugc

SEQ ID NO: 1386414 - RNA, 15 nt, Human
ugaccugcugaccug

SEQ ID NO: 1386415 - RNA, 13 nt, Human
ugaccugcugacc

SEQ ID NO: 1386416 - RNA, 11 nt, Human
ugaccugcuga

SEQ ID NO: 1386417 - RNA, 19 nt, Human
ugaccugcuaggccagagc

SEQ ID NO: 1386418 - RNA, 17 nt, Human
ugaccugccucccuuca

SEQ ID NO: 1386419 - RNA, 19 nt, Human
ugaccugccucccuucaug

SEQ ID NO: 1386420 - RNA, 23 nt, Human
ugaccugccucccuucaugcaug

SEQ ID NO: 1386421 - RNA, 22 nt, Human
ugaccugcuaggccagagccca

SEQ ID NO: 1386422 - RNA, 18 nt, Human
ugaccugcuaggccagag

SEQ ID NO: 1386423 - RNA, 16 nt, Human
ugaccugcuaggccag

SEQ ID NO: 1386424 - RNA, 21 nt, Human
ugaccugccucccuucaugca

SEQ ID NO: 1386425 - RNA, 22 nt, Human
agaugucuuuucccauuuaucu

SEQ ID NO: 1386426 - RNA, 18 nt, Human
agaugucuuuucccauuu

SEQ ID NO: 1386427 - RNA, 18 nt, Human
agaugucuuggaacauug

SEQ ID NO: 1386428 - RNA, 14 nt, Human
agaugucuuggaac

SEQ ID NO: 1386429 - RNA, 13 nt, Human
agaugucuuggaa

SEQ ID NO: 1386430 - RNA, 16 nt, Human
agauguaggagggacu

SEQ ID NO: 1386431 - RNA, 22 nt, Human
agauguauguacuucaugcugu

SEQ ID NO: 1386432 - RNA, 16 nt, Human
ugaccugccucccuuc

SEQ ID NO: 1386433 - RNA, 16 nt, Human
ugaccugccaggcaca

SEQ ID NO: 1386434 - RNA, 19 nt, Human
ugaccugccaggcacacug

SEQ ID NO: 1386435 - RNA, 18 nt, Human
agauuuuaaucaaauuug

SEQ ID NO: 1386436 - RNA, 16 nt, Human
agauuuuaaucaaauu

SEQ ID NO: 1386437 - RNA, 15 nt, Human
agauuuuaaucaaau

SEQ ID NO: 1386438 - RNA, 23 nt, Human
agauuuguuuuuaaacuguacag

SEQ ID NO: 1386439 - RNA, 22 nt, Human
agauuuguuuuuaaacuguaca

SEQ ID NO: 1386440 - RNA, 21 nt, Human
agauuuguuuuuaaacuguac

SEQ ID NO: 1386441 - RNA, 20 nt, Human
agauuuguuuuuaaacugua

SEQ ID NO: 1386442 - RNA, 19 nt, Human
agauuuguuuuuaaacugu

SEQ ID NO: 1386443 - RNA, 17 nt, Human
agauuuguuuuuaaacu

SEQ ID NO: 1386444 - RNA, 15 nt, Human
agauuuguuuuuaaa

SEQ ID NO: 1386445 - RNA, 19 nt, Human
agauuugugugcaucaggc

SEQ ID NO: 1386446 - RNA, 20 nt, Human
agauuucauaguucagaauu

SEQ ID NO: 1386447 - RNA, 19 nt, Human
agauuucauaguucagaau

SEQ ID NO: 1386448 - RNA, 18 nt, Human
agauuucauaguucagaa

SEQ ID NO: 1386449 - RNA, 12 nt, Human
agauuucauagu

SEQ ID NO: 1386450 - RNA, 12 nt, Human
agauuguuugca

SEQ ID NO: 1386451 - RNA, 16 nt, Human
agauucccagagcaaa

SEQ ID NO: 1386452 - RNA, 13 nt, Human
agauucccagagc

SEQ ID NO: 1386453 - RNA, 23 nt, Human
agauuccauugguccaagauucc

SEQ ID NO: 1386454 - RNA, 22 nt, Human
agauuccauugguccaagauuc

SEQ ID NO: 1386455 - RNA, 21 nt, Human
agauuccauugguccaagauu

SEQ ID NO: 1386456 - RNA, 20 nt, Human
agauuccauugguccaagau

SEQ ID NO: 1386457 - RNA, 19 nt, Human
agauuccauugguccaaga

SEQ ID NO: 1386458 - RNA, 20 nt, Human
agauuauagauucuaaagau

SEQ ID NO: 1386459 - RNA, 19 nt, Human
agauuauagauucuaaaga

SEQ ID NO: 1386460 - RNA, 18 nt, Human
agauuauagauucuaaag

SEQ ID NO: 1386461 - RNA, 17 nt, Human
agauuauagauucuaaa

SEQ ID NO: 1386462 - RNA, 16 nt, Human
agauuauagauucuaa

SEQ ID NO: 1386463 - RNA, 15 nt, Human
agauuauagauucua

SEQ ID NO: 1386464 - RNA, 14 nt, Human
agauuauagauucu

SEQ ID NO: 1386465 - RNA, 20 nt, Human
agauucagguaauacaaacu

SEQ ID NO: 1386466 - RNA, 18 nt, Human
agauucagguaauacaaa

SEQ ID NO: 1386467 - RNA, 16 nt, Human
agauucagguaauaca

SEQ ID NO: 1386468 - RNA, 21 nt, Human
agauuagagccuguaaacuuu

SEQ ID NO: 1386469 - RNA, 13 nt, Human
ugacuuauaguac

SEQ ID NO: 1386470 - RNA, 14 nt, Human
ugacuuauaguaca

SEQ ID NO: 1386471 - RNA, 12 nt, Human
ugacuuacugua

SEQ ID NO: 1386472 - RNA, 20 nt, Human
ugacuuacuguacaugaaaa

SEQ ID NO: 1386473 - RNA, 15 nt, Human
agauuaagaaauaga

SEQ ID NO: 1386474 - RNA, 14 nt, Human
agauuaagaaauag

SEQ ID NO: 1386475 - RNA, 15 nt, Human
ugacuuauaguacau

SEQ ID NO: 1386476 - RNA, 17 nt, Human
ugacuuauaguacauga

SEQ ID NO: 1386477 - RNA, 19 nt, Human
ugacuuauaguacaugaua

SEQ ID NO: 1386478 - RNA, 14 nt, Human
agauuaccuccuga

SEQ ID NO: 1386479 - RNA, 20 nt, Human
agauuacaaaucagaaguca

SEQ ID NO: 1386480 - RNA, 24 nt, Human
ugacauuugggagacaugugacau

SEQ ID NO: 1386481 - RNA, 23 nt, Human
ugacauuugggagacaugugaca

SEQ ID NO: 1386482 - RNA, 22 nt, Human
ugacauuugggagacaugugac

SEQ ID NO: 1386483 - RNA, 21 nt, Human
ugacauuugggagacauguga

SEQ ID NO: 1386484 - RNA, 21 nt, Human
ugacauuuggaguguuccccu

SEQ ID NO: 1386485 - RNA, 21 nt, Human
ugacauuuauuuuucauuuag

SEQ ID NO: 1386486 - RNA, 18 nt, Human
ugacauuuauuuuucauu

SEQ ID NO: 1386487 - RNA, 20 nt, Human
ugacauuuauauauugaauu

SEQ ID NO: 1386488 - RNA, 18 nt, Human
ugacauucugaaugcuuc

SEQ ID NO: 1386489 - RNA, 12 nt, Human
ugacauucaccu

SEQ ID NO: 1386490 - RNA, 20 nt, Human
ugacauuaugugguuuuaga

SEQ ID NO: 1386491 - RNA, 21 nt, Human
ugacagggcggggguggcggc

SEQ ID NO: 1386492 - RNA, 18 nt, Human
ugacauucaccugcccca

SEQ ID NO: 1386493 - RNA, 15 nt, Human
ugacauucaccugcc

SEQ ID NO: 1386494 - RNA, 16 nt, Human
ugacauucugaaugcu

SEQ ID NO: 1386495 - RNA, 15 nt, Human
ugacauucugaaugc

SEQ ID NO: 1386496 - RNA, 15 nt, Human
ugacagguaaacuau

SEQ ID NO: 1386497 - RNA, 15 nt, Human
ugacagccucaguga

SEQ ID NO: 1386498 - RNA, 18 nt, Human
ugacagccucagugaccc

SEQ ID NO: 1386499 - RNA, 14 nt, Human
ugacagcagcaucu

SEQ ID NO: 1386500 - RNA, 16 nt, Human
ugacagcagcaucucu

SEQ ID NO: 1386501 - RNA, 12 nt, Human
ugacagcagcau

SEQ ID NO: 1386502 - RNA, 20 nt, Human
ugacacugcuggagaggccc

SEQ ID NO: 1386503 - RNA, 22 nt, Human
ugacacugcucuaacagcccuc

SEQ ID NO: 1386504 - RNA, 21 nt, Human
ugacacugcucuaacagcccu

SEQ ID NO: 1386505 - RNA, 19 nt, Human
ugacacugcucuaacagcc

SEQ ID NO: 1386506 - RNA, 16 nt, Human
ugacacugcucuaaca

SEQ ID NO: 1386507 - RNA, 15 nt, Human
ugacacugcucuaac

SEQ ID NO: 1386508 - RNA, 13 nt, Human
ugacacugcucua

SEQ ID NO: 1386509 - RNA, 17 nt, Human
ugacacugcaauuggca

SEQ ID NO: 1386510 - RNA, 13 nt, Human
ugaaugcugggac

SEQ ID NO: 1386511 - RNA, 12 nt, Human
ugaaugcuggga

SEQ ID NO: 1386512 - RNA, 11 nt, Human
ugaaugcuggg

SEQ ID NO: 1386513 - RNA, 14 nt, Human
ugaaugccguggau

SEQ ID NO: 1386514 - RNA, 13 nt, Human
ugaaugcggccca

SEQ ID NO: 1386515 - RNA, 22 nt, Human
ugaaucaauaauauauuuucug

SEQ ID NO: 1386516 - RNA, 20 nt, Human
ugaaucaauaauauauuuuc

SEQ ID NO: 1386517 - RNA, 19 nt, Human
ugaaucaauaauauauuuu

SEQ ID NO: 1386518 - RNA, 17 nt, Human
ugaaucaauaauauauu

SEQ ID NO: 1386519 - RNA, 16 nt, Human
ugaaucaauaauauau

SEQ ID NO: 1386520 - RNA, 15 nt, Human
ugaaucaauaauaua

SEQ ID NO: 1386521 - RNA, 13 nt, Human
ugaaucaauaaua

SEQ ID NO: 1386522 - RNA, 15 nt, Human
ugaaugcugggacuc

SEQ ID NO: 1386523 - RNA, 14 nt, Human
ugaaugcugggacu

SEQ ID NO: 1386524 - RNA, 19 nt, Human
ugaaugcugggacucagcc

SEQ ID NO: 1386525 - RNA, 19 nt, Human
ugaaugccuaugguggauc

SEQ ID NO: 1386526 - RNA, 20 nt, Human
ugacacccuucucccacucu

SEQ ID NO: 1386527 - RNA, 19 nt, Human
ugacacccuucucccacuc

SEQ ID NO: 1386528 - RNA, 16 nt, Human
ugacacccuucuccca

SEQ ID NO: 1386529 - RNA, 15 nt, Human
ugacacccuucuccc

SEQ ID NO: 1386530 - RNA, 14 nt, Human
ugacacccuucucc

SEQ ID NO: 1386531 - RNA, 15 nt, Human
ugacaccugcugaga

SEQ ID NO: 1386532 - RNA, 17 nt, Human
ugacaccucuuuuuucg

SEQ ID NO: 1386533 - RNA, 18 nt, Human
ugacaccuaacucuucuu

SEQ ID NO: 1386534 - RNA, 15 nt, Human
ugacaccuaacucuu

SEQ ID NO: 1386535 - RNA, 21 nt, Human
ugacacccuucucccacucuc

SEQ ID NO: 1386536 - RNA, 23 nt, Human
ugacacccuucucccacucuccu

SEQ ID NO: 1386537 - RNA, 18 nt, Human
agaucuaaauaaaaugcu

SEQ ID NO: 1386538 - RNA, 19 nt, Human
agaucuaaauaaaaugcua

SEQ ID NO: 1386539 - RNA, 11 nt, Human
agaucuaaaua

SEQ ID NO: 1386540 - RNA, 15 nt, Human
agauccuccucauuc

SEQ ID NO: 1386541 - RNA, 18 nt, Human
agaucucuaacuucacca

SEQ ID NO: 1386542 - RNA, 18 nt, Human
agauccugcggguggggc

SEQ ID NO: 1386543 - RNA, 14 nt, Human
agauccuggaaauc

SEQ ID NO: 1386544 - RNA, 17 nt, Human
agauccugcgggugggg

SEQ ID NO: 1386545 - RNA, 12 nt, Human
agauccuccugc

SEQ ID NO: 1386546 - RNA, 13 nt, Human
agauccuccucau

SEQ ID NO: 1386547 - RNA, 12 nt, Human
agauccuccuca

SEQ ID NO: 1386548 - RNA, 13 nt, Human
agauccuggaaau

SEQ ID NO: 1386549 - RNA, 15 nt, Human
ugaccaagauacuua

SEQ ID NO: 1386550 - RNA, 22 nt, Human
ugaccaaccuuuucccaaccau

SEQ ID NO: 1386551 - RNA, 18 nt, Human
agauccuagauccuaagg

SEQ ID NO: 1386552 - RNA, 16 nt, Human
agauccuagauccuaa

SEQ ID NO: 1386553 - RNA, 23 nt, Human
agauccuaagggucgaaagcucu

SEQ ID NO: 1386554 - RNA, 21 nt, Human
agauccuaagggucgaaagcu

SEQ ID NO: 1386555 - RNA, 14 nt, Human
agauccuaaggguc

SEQ ID NO: 1386556 - RNA, 13 nt, Human
agaucccccagaa

SEQ ID NO: 1386557 - RNA, 19 nt, Human
agaucccccagaaaagaaa

SEQ ID NO: 1386558 - RNA, 15 nt, Human
agaucccccagaaaa

SEQ ID NO: 1386559 - RNA, 19 nt, Human
agaugcuggcccagggccc

SEQ ID NO: 1386560 - RNA, 18 nt, Human
agaugcuggcccagggcc

SEQ ID NO: 1386561 - RNA, 17 nt, Human
agaugcuggcccagggc

SEQ ID NO: 1386562 - RNA, 16 nt, Human
agaugcuggcccaggg

SEQ ID NO: 1386563 - RNA, 15 nt, Human
agaugcuggcccagg

SEQ ID NO: 1386564 - RNA, 14 nt, Human
agaugcuggcccag

SEQ ID NO: 1386565 - RNA, 14 nt, Human
agauguaguauuuu

SEQ ID NO: 1386566 - RNA, 15 nt, Human
agauguaggagggac

SEQ ID NO: 1386567 - RNA, 14 nt, Human
agauguaggaggga

SEQ ID NO: 1386568 - RNA, 13 nt, Human
agauguaggaggg

SEQ ID NO: 1386569 - RNA, 22 nt, Human
agauguagccccucuccuggaa

SEQ ID NO: 1386570 - RNA, 18 nt, Human
agaugcaccaccaagcca

SEQ ID NO: 1386571 - RNA, 16 nt, Human
agaugcacaugagcug

SEQ ID NO: 1386572 - RNA, 16 nt, Human
agaugcaagaaggagg

SEQ ID NO: 1386573 - RNA, 13 nt, Human
agaugcacaugag

SEQ ID NO: 1386574 - RNA, 22 nt, Human
agaugcauuuggguccaggagg

SEQ ID NO: 1386575 - RNA, 23 nt, Human
agaugcauuuggguccaggagga

SEQ ID NO: 1386576 - RNA, 21 nt, Human
agaugcauuuggguccaggag

SEQ ID NO: 1386577 - RNA, 20 nt, Human
agaugcauuuggguccagga

SEQ ID NO: 1386578 - RNA, 19 nt, Human
agaugcauuuggguccagg

SEQ ID NO: 1386579 - RNA, 18 nt, Human
agaugcauuuggguccag

SEQ ID NO: 1386580 - RNA, 20 nt, Human
agaugcaccaccaagccaag

SEQ ID NO: 1386581 - RNA, 21 nt, Human
agaugcaguucugaagaagau

SEQ ID NO: 1386582 - RNA, 17 nt, Human
agcaagcugauuaaaug

SEQ ID NO: 1386583 - RNA, 22 nt, Human
agcaagcauucagaagaaaaag

SEQ ID NO: 1386584 - RNA, 21 nt, Human
agcaagcauucagaagaaaaa

SEQ ID NO: 1386585 - RNA, 18 nt, Human
agcaagcauucagaagaa

SEQ ID NO: 1386586 - RNA, 15 nt, Human
agcaagcauucagaa

SEQ ID NO: 1386587 - RNA, 15 nt, Human
agcaagcaagaggcc

SEQ ID NO: 1386588 - RNA, 11 nt, Human
ugagccacugc

SEQ ID NO: 1386589 - RNA, 18 nt, Human
ugagauuuauuaaagaaa

SEQ ID NO: 1386590 - RNA, 15 nt, Human
ugagcauguuacuga

SEQ ID NO: 1386591 - RNA, 19 nt, Human
ugagcauggaacacuucga

SEQ ID NO: 1386592 - RNA, 16 nt, Human
ugagcaucuguccccc

SEQ ID NO: 1386593 - RNA, 16 nt, Human
ugagcaaaucaccaca

SEQ ID NO: 1386594 - RNA, 18 nt, Human
ugagcaucugucccccuu

SEQ ID NO: 1386595 - RNA, 24 nt, Human
ugagcauguuuagacuuuaacaua

SEQ ID NO: 1386596 - RNA, 23 nt, Human
ugagcauguuuagacuuuaacau

SEQ ID NO: 1386597 - RNA, 15 nt, Human
ugagcauguuuagac

SEQ ID NO: 1386598 - RNA, 14 nt, Human
ugagcauguuuaga

SEQ ID NO: 1386599 - RNA, 16 nt, Human
ugagcauguuacugac

SEQ ID NO: 1386600 - RNA, 21 nt, Human
agcaaggcccgagcagcugag

SEQ ID NO: 1386601 - RNA, 20 nt, Human
agcaaggcccgagcagcuga

SEQ ID NO: 1386602 - RNA, 22 nt, Human
agcaaggcccgagcagcugagc

SEQ ID NO: 1386603 - RNA, 19 nt, Human
agcaaggcccgagcagcug

SEQ ID NO: 1386604 - RNA, 18 nt, Human
agcaaggcccgagcagcu

SEQ ID NO: 1386605 - RNA, 17 nt, Human
agcaaggcccgagcagc

SEQ ID NO: 1386606 - RNA, 14 nt, Human
agcaaggcccgagc

SEQ ID NO: 1386607 - RNA, 12 nt, Human
agcaaggcccga

SEQ ID NO: 1386608 - RNA, 17 nt, Human
agcaagcuuaauggcug

SEQ ID NO: 1386609 - RNA, 14 nt, Human
agcaaggagauuua

SEQ ID NO: 1386610 - RNA, 17 nt, Human
agcaaggagauuuacaa

SEQ ID NO: 1386611 - RNA, 19 nt, Human
agcaaggagauuuacaacu

SEQ ID NO: 1386612 - RNA, 18 nt, Human
agcaaguaaaaaggcuaa

SEQ ID NO: 1386613 - RNA, 14 nt, Human
agcaagucaggguu

SEQ ID NO: 1386614 - RNA, 13 nt, Human
agcaaguaaaaag

SEQ ID NO: 1386615 - RNA, 15 nt, Human
agcaagucagaauag

SEQ ID NO: 1386616 - RNA, 17 nt, Human
agcaccguucugugcac

SEQ ID NO: 1386617 - RNA, 16 nt, Human
agcaccguucugugca

SEQ ID NO: 1386618 - RNA, 15 nt, Human
agcaccguucugugc

SEQ ID NO: 1386619 - RNA, 23 nt, Human
agcaccggaccagccuggcccac

SEQ ID NO: 1386620 - RNA, 18 nt, Human
agcaccggaccagccugg

SEQ ID NO: 1386621 - RNA, 17 nt, Human
agcaccggaccagccug

SEQ ID NO: 1386622 - RNA, 16 nt, Human
agcaccggaccagccu

SEQ ID NO: 1386623 - RNA, 16 nt, Human
agcacaugugcugccc

SEQ ID NO: 1386624 - RNA, 15 nt, Human
agcaccuacuuacau

SEQ ID NO: 1386625 - RNA, 18 nt, Human
agcaccguucugugcaca

SEQ ID NO: 1386626 - RNA, 19 nt, Human
agcaccggaccagccuggc

SEQ ID NO: 1386627 - RNA, 18 nt, Human
agcaccuccucagccuga

SEQ ID NO: 1386628 - RNA, 16 nt, Human
agcaccuccucagccu

SEQ ID NO: 1386629 - RNA, 15 nt, Human
agcaccuccucagcc

SEQ ID NO: 1386630 - RNA, 14 nt, Human
agcaccuccucagc

SEQ ID NO: 1386631 - RNA, 16 nt, Human
agcacaggcuaauuuu

SEQ ID NO: 1386632 - RNA, 17 nt, Human
agcacaggcuaauuuuu

SEQ ID NO: 1386633 - RNA, 12 nt, Human
agcacaggcuaa

SEQ ID NO: 1386634 - RNA, 20 nt, Human
agcacagcuugaccugaggc

SEQ ID NO: 1386635 - RNA, 18 nt, Human
agcacagcuugaccugag

SEQ ID NO: 1386636 - RNA, 12 nt, Human
agcaauaugcau

SEQ ID NO: 1386637 - RNA, 14 nt, Human
agcacagcuugacc

SEQ ID NO: 1386638 - RNA, 19 nt, Human
agcaauccuagguaggguu

SEQ ID NO: 1386639 - RNA, 23 nt, Human
ugagaaucuauauuuaacaagau

SEQ ID NO: 1386640 - RNA, 18 nt, Human
ugagaaucuauauuuaac

SEQ ID NO: 1386641 - RNA, 21 nt, Human
ugagaaucuacccccagaucc

SEQ ID NO: 1386642 - RNA, 12 nt, Human
ugagaaucuacc

SEQ ID NO: 1386643 - RNA, 22 nt, Human
ugagaaucccaaauuugauuga

SEQ ID NO: 1386644 - RNA, 21 nt, Human
ugagaaucccaaauuugauug

SEQ ID NO: 1386645 - RNA, 20 nt, Human
ugagaaucccaaauuugauu

SEQ ID NO: 1386646 - RNA, 13 nt, Human
ugagaaucccaaa

SEQ ID NO: 1386647 - RNA, 16 nt, Human
ugagaauguaucccca

SEQ ID NO: 1386648 - RNA, 19 nt, Human
ugagaaucauuuagcaugu

SEQ ID NO: 1386649 - RNA, 14 nt, Human
ugagaaucauuuag

SEQ ID NO: 1386650 - RNA, 16 nt, Human
agauuuucugcuacuu

SEQ ID NO: 1386651 - RNA, 19 nt, Human
agauuuuacaugaaguauu

SEQ ID NO: 1386652 - RNA, 16 nt, Human
agauuuuccugaaaac

SEQ ID NO: 1386653 - RNA, 20 nt, Human
agauuuuacaugaaguauuu

SEQ ID NO: 1386654 - RNA, 16 nt, Human
agauuuuacaugaagu

SEQ ID NO: 1386655 - RNA, 13 nt, Human
agauuuuacauga

SEQ ID NO: 1386656 - RNA, 15 nt, Human
agauuuuccugaaaa

SEQ ID NO: 1386657 - RNA, 20 nt, Human
ugagagacacacugaagaag

SEQ ID NO: 1386658 - RNA, 19 nt, Human
ugagagacacacugaagaa

SEQ ID NO: 1386659 - RNA, 17 nt, Human
ugagagacacacugaag

SEQ ID NO: 1386660 - RNA, 16 nt, Human
ugagagacacacugaa

SEQ ID NO: 1386661 - RNA, 19 nt, Human
ugagacagaaucucagucu

SEQ ID NO: 1386662 - RNA, 16 nt, Human
ugagauggcucccagg

SEQ ID NO: 1386663 - RNA, 17 nt, Human
ugagauggagucuugcu

SEQ ID NO: 1386664 - RNA, 18 nt, Human
ugagauggagucuugcuc

SEQ ID NO: 1386665 - RNA, 15 nt, Human
ugagaugcuggcuug

SEQ ID NO: 1386666 - RNA, 12 nt, Human
ugagaugcuggc

SEQ ID NO: 1386667 - RNA, 17 nt, Human
ugagaugcuggcuuggg

SEQ ID NO: 1386668 - RNA, 23 nt, Human
ugagauguagccccucuccugga

SEQ ID NO: 1386669 - RNA, 16 nt, Human
ugagaggaggcagcag

SEQ ID NO: 1386670 - RNA, 20 nt, Human
ugagaggaggcagcaggacu

SEQ ID NO: 1386671 - RNA, 22 nt, Human
ugagaugggcuucccaagggcu

SEQ ID NO: 1386672 - RNA, 21 nt, Human
ugagauuuauuaaagaaaaaa

SEQ ID NO: 1386673 - RNA, 17 nt, Human
ugagauuuauuaaagaa

SEQ ID NO: 1386674 - RNA, 16 nt, Human
ugagauuuauuaaaga

SEQ ID NO: 1386675 - RNA, 17 nt, Human
ugagauugaauuucacu

SEQ ID NO: 1386676 - RNA, 18 nt, Human
ugagauugcaccacugca

SEQ ID NO: 1386677 - RNA, 22 nt, Human
ugagauucucaaaggagcgagc

SEQ ID NO: 1386678 - RNA, 15 nt, Human
ugagauucucaaagg

SEQ ID NO: 1386679 - RNA, 16 nt, Human
ugagauuacaggcaug

SEQ ID NO: 1386680 - RNA, 14 nt, Human
ugagauguguucac

SEQ ID NO: 1386681 - RNA, 21 nt, Human
ugagagaugcagaaauauuug

SEQ ID NO: 1386682 - RNA, 21 nt, Human
ugagagcaguuugguuucuag

SEQ ID NO: 1386683 - RNA, 23 nt, Human
ugagagcaguuugguuucuagca

SEQ ID NO: 1386684 - RNA, 13 nt, Human
ugagagaggccau

SEQ ID NO: 1386685 - RNA, 18 nt, Human
ugagagacauuaacucau

SEQ ID NO: 1386686 - RNA, 19 nt, Human
ugagagacauuaacucauu

SEQ ID NO: 1386687 - RNA, 22 nt, Human
ugagagacacacugaagaagca

SEQ ID NO: 1386688 - RNA, 21 nt, Human
ugagagacacacugaagaagc

SEQ ID NO: 1386689 - RNA, 16 nt, Human
aggaaggagcugccug

SEQ ID NO: 1386690 - RNA, 15 nt, Human
aggaaggagcugccu

SEQ ID NO: 1386691 - RNA, 14 nt, Human
aggaaggagcugcc

SEQ ID NO: 1386692 - RNA, 13 nt, Human
aggaaggagcugc

SEQ ID NO: 1386693 - RNA, 12 nt, Human
aggaaggagcug

SEQ ID NO: 1386694 - RNA, 23 nt, Human
aggaagcuuuggugagaaccugg

SEQ ID NO: 1386695 - RNA, 22 nt, Human
aggaagcuuuggugagaaccug

SEQ ID NO: 1386696 - RNA, 18 nt, Human
aggaagcugugagagcag

SEQ ID NO: 1386697 - RNA, 11 nt, Human
aggaauuuaaa

SEQ ID NO: 1386698 - RNA, 20 nt, Human
aggaaggagcugccuggacc

SEQ ID NO: 1386699 - RNA, 19 nt, Human
aggaaggagcugccuggac

SEQ ID NO: 1386700 - RNA, 18 nt, Human
aggaaggagcugccugga

SEQ ID NO: 1386701 - RNA, 17 nt, Human
aggaaggagcugccugg

SEQ ID NO: 1386702 - RNA, 22 nt, Human
aggaaggagcugccuggacccg

SEQ ID NO: 1386703 - RNA, 21 nt, Human
aggaaggagcugccuggaccc

SEQ ID NO: 1386704 - RNA, 18 nt, Human
aggaaggaggacccagga

SEQ ID NO: 1386705 - RNA, 21 nt, Human
aggaaggaggacccaggacag

SEQ ID NO: 1386706 - RNA, 13 nt, Human
aggaauuucuuaa

SEQ ID NO: 1386707 - RNA, 21 nt, Human
aggaauuucccaggacccuga

SEQ ID NO: 1386708 - RNA, 20 nt, Human
aggaauuucccaggacccug

SEQ ID NO: 1386709 - RNA, 19 nt, Human
aggaauuucccaggacccu

SEQ ID NO: 1386710 - RNA, 18 nt, Human
aggaauuucccaggaccc

SEQ ID NO: 1386711 - RNA, 17 nt, Human
aggaauuucccaggacc

SEQ ID NO: 1386712 - RNA, 15 nt, Human
aggaauuucccagga

SEQ ID NO: 1386713 - RNA, 22 nt, Human
aggaauuucaccuguaaaccug

SEQ ID NO: 1386714 - RNA, 23 nt, Human
aggaauuguguuuauaauuuuaa

SEQ ID NO: 1386715 - RNA, 18 nt, Human
aggaauuucaccuguaaa

SEQ ID NO: 1386716 - RNA, 19 nt, Human
aggaaggaggacccaggac

SEQ ID NO: 1386717 - RNA, 20 nt, Human
aggaaggaggacccaggaca

SEQ ID NO: 1386718 - RNA, 18 nt, Human
ugcucccauccugugugu

SEQ ID NO: 1386719 - RNA, 13 nt, Human
ugcuccccacguc

SEQ ID NO: 1386720 - RNA, 16 nt, Human
ugcuccgccuggccug

SEQ ID NO: 1386721 - RNA, 14 nt, Human
ugcuccgccuggcc

SEQ ID NO: 1386722 - RNA, 20 nt, Human
ugcuccgaggacccaggaaa

SEQ ID NO: 1386723 - RNA, 18 nt, Human
ugcuccgaggacccagga

SEQ ID NO: 1386724 - RNA, 23 nt, Human
ugcugaccugcugaccugugcac

SEQ ID NO: 1386725 - RNA, 14 nt, Human
ugcugaccugcuga

SEQ ID NO: 1386726 - RNA, 13 nt, Human
ugcugaccugcug

SEQ ID NO: 1386727 - RNA, 18 nt, Human
ugcuccgccuggccuggc

SEQ ID NO: 1386728 - RNA, 18 nt, Human
ugcugacauucaccugcc

SEQ ID NO: 1386729 - RNA, 20 nt, Human
ugcugacggccagggagaag

SEQ ID NO: 1386730 - RNA, 17 nt, Human
ugcugacggccagggag

SEQ ID NO: 1386731 - RNA, 15 nt, Human
ugcugacggccaggg

SEQ ID NO: 1386732 - RNA, 14 nt, Human
ugcugacggccagg

SEQ ID NO: 1386733 - RNA, 20 nt, Human
ugcugacgggacccacaugc

SEQ ID NO: 1386734 - RNA, 14 nt, Human
ugcugaccugugca

SEQ ID NO: 1386735 - RNA, 22 nt, Human
ugcugacggccagggagaagcu

SEQ ID NO: 1386736 - RNA, 21 nt, Human
ugcuccagaccugauccugga

SEQ ID NO: 1386737 - RNA, 14 nt, Human
ugcuccagaccuga

SEQ ID NO: 1386738 - RNA, 12 nt, Human
ugcuccagaccu

SEQ ID NO: 1386739 - RNA, 17 nt, Human
ugcuccagacagggaau

SEQ ID NO: 1386740 - RNA, 13 nt, Human
ugcuccagacagg

SEQ ID NO: 1386741 - RNA, 15 nt, Human
agcuggagugcagug

SEQ ID NO: 1386742 - RNA, 19 nt, Human
agcuggagugcaguggcau

SEQ ID NO: 1386743 - RNA, 23 nt, Human
agcuggaggcaggggcuuccugg

SEQ ID NO: 1386744 - RNA, 14 nt, Human
ugcuucacaauguu

SEQ ID NO: 1386745 - RNA, 22 nt, Human
ugcuuauuccaugacugcuugc

SEQ ID NO: 1386746 - RNA, 21 nt, Human
ugcuuauuccaugacugcuug

SEQ ID NO: 1386747 - RNA, 19 nt, Human
ugcuuauuccaugacugcu

SEQ ID NO: 1386748 - RNA, 14 nt, Human
ugcuuaugguacca

SEQ ID NO: 1386749 - RNA, 21 nt, Human
ugcuuaugguaccagaugcag

SEQ ID NO: 1386750 - RNA, 18 nt, Human
ugcuuaugcucuuaauug

SEQ ID NO: 1386751 - RNA, 14 nt, Human
ugcugugaggcugu

SEQ ID NO: 1386752 - RNA, 13 nt, Human
ugcugugaggcug

SEQ ID NO: 1386753 - RNA, 14 nt, Human
ugcugucuuaaacu

SEQ ID NO: 1386754 - RNA, 21 nt, Human
ugcugucuuaaacuaaaugug

SEQ ID NO: 1386755 - RNA, 13 nt, Human
ugcugucuuaaac

SEQ ID NO: 1386756 - RNA, 19 nt, Human
ugcugucuggguggcucac

SEQ ID NO: 1386757 - RNA, 18 nt, Human
ugcugucuggguggcuca

SEQ ID NO: 1386758 - RNA, 15 nt, Human
ugcugucugggugcu

SEQ ID NO: 1386759 - RNA, 20 nt, Human
ugcuuaguguacuuggagua

SEQ ID NO: 1386760 - RNA, 23 nt, Human
ugcugugagucuuugguucuaag

SEQ ID NO: 1386761 - RNA, 19 nt, Human
ugcugugaggcuguccugu

SEQ ID NO: 1386762 - RNA, 18 nt, Human
ugcugugaggcuguccug

SEQ ID NO: 1386763 - RNA, 17 nt, Human
ugcugugaggcuguccu

SEQ ID NO: 1386764 - RNA, 16 nt, Human
ugcugugaggcugucc

SEQ ID NO: 1386765 - RNA, 21 nt, Human
ugcuuaugacaucacuuguac

SEQ ID NO: 1386766 - RNA, 14 nt, Human
aggacaggauccag

SEQ ID NO: 1386767 - RNA, 20 nt, Human
aggacaggauccaggccggc

SEQ ID NO: 1386768 - RNA, 16 nt, Human
aggacagccgccugga

SEQ ID NO: 1386769 - RNA, 17 nt, Human
aggacacugauaugggu

SEQ ID NO: 1386770 - RNA, 22 nt, Human
aggacaugcgguagccagcaca

SEQ ID NO: 1386771 - RNA, 20 nt, Human
aggacaugcgguagccagca

SEQ ID NO: 1386772 - RNA, 12 nt, Human
aggacaucagca

SEQ ID NO: 1386773 - RNA, 13 nt, Human
aggacaucagcaa

SEQ ID NO: 1386774 - RNA, 14 nt, Human
aggacaucagcaaa

SEQ ID NO: 1386775 - RNA, 15 nt, Human
aggacaucagcaaac

SEQ ID NO: 1386776 - RNA, 16 nt, Human
aggacaucagcaaaca

SEQ ID NO: 1386777 - RNA, 22 nt, Human
aggacaucagcaaacaggauca

SEQ ID NO: 1386778 - RNA, 14 nt, Human
aggacacugauaug

SEQ ID NO: 1386779 - RNA, 14 nt, Human
ugcuucaucccuuu

SEQ ID NO: 1386780 - RNA, 17 nt, Human
ugcugggagaggcagcc

SEQ ID NO: 1386781 - RNA, 23 nt, Human
ugcugggagcuccacucugcuuc

SEQ ID NO: 1386782 - RNA, 22 nt, Human
ugcugggagcuccacucugcuu

SEQ ID NO: 1386783 - RNA, 21 nt, Human
ugcugggagcuccacucugcu

SEQ ID NO: 1386784 - RNA, 20 nt, Human
ugcugggagcuccacucugc

SEQ ID NO: 1386785 - RNA, 18 nt, Human
ugcugggagcuccacucu

SEQ ID NO: 1386786 - RNA, 17 nt, Human
ugcugggagcuccacuc

SEQ ID NO: 1386787 - RNA, 16 nt, Human
ugcugggagcuccacu

SEQ ID NO: 1386788 - RNA, 15 nt, Human
ugcugggagcuccac

SEQ ID NO: 1386789 - RNA, 16 nt, Human
ugcugggagaggcagc

SEQ ID NO: 1386790 - RNA, 21 nt, Human
ugcuguacaucuauuuuggau

SEQ ID NO: 1386791 - RNA, 17 nt, Human
ugcuguacaucuauuuu

SEQ ID NO: 1386792 - RNA, 16 nt, Human
ugcuguacaucuauuu

SEQ ID NO: 1386793 - RNA, 15 nt, Human
ugcuguacaucuauu

SEQ ID NO: 1386794 - RNA, 17 nt, Human
ugcugucccucccccuu

SEQ ID NO: 1386795 - RNA, 16 nt, Human
ugcugucccucccccu

SEQ ID NO: 1386796 - RNA, 13 nt, Human
ugcugucccuccc

SEQ ID NO: 1386797 - RNA, 12 nt, Human
ugcugucccucc

SEQ ID NO: 1386798 - RNA, 17 nt, Human
ugcugucaccuugcuca

SEQ ID NO: 1386799 - RNA, 18 nt, Human
ugcuguccgguggagauc

SEQ ID NO: 1386800 - RNA, 23 nt, Human
ugcuggcccagggcccagagccc

SEQ ID NO: 1386801 - RNA, 22 nt, Human
ugcuggcccagggcccagagcc

SEQ ID NO: 1386802 - RNA, 21 nt, Human
ugcuggcccagggcccagagc

SEQ ID NO: 1386803 - RNA, 20 nt, Human
ugcuggcccagggcccagag

SEQ ID NO: 1386804 - RNA, 19 nt, Human
ugcuggcccagggcccaga

SEQ ID NO: 1386805 - RNA, 18 nt, Human
ugcuggcccagggcccag

SEQ ID NO: 1386806 - RNA, 17 nt, Human
ugcuggcccagggccca

SEQ ID NO: 1386807 - RNA, 16 nt, Human
ugcuggcccagggccc

SEQ ID NO: 1386808 - RNA, 14 nt, Human
ugcuggcccagggc

SEQ ID NO: 1386809 - RNA, 13 nt, Human
ugcuggcccaggg

SEQ ID NO: 1386810 - RNA, 12 nt, Human
ugcuggcccagg

SEQ ID NO: 1386811 - RNA, 23 nt, Human
aggaauuucuuaacuucuugcuu

SEQ ID NO: 1386812 - RNA, 19 nt, Human
aggaauuucuuaacuucuu

SEQ ID NO: 1386813 - RNA, 15 nt, Human
aggaauuucuuaacu

SEQ ID NO: 1386814 - RNA, 20 nt, Human
aggaauuuuauuuuuuucug

SEQ ID NO: 1386815 - RNA, 20 nt, Human
ugcuuggggggugaugaggg

SEQ ID NO: 1386816 - RNA, 21 nt, Human
ugcuuggggggugaugagggc

SEQ ID NO: 1386817 - RNA, 17 nt, Human
ugcuuugggcuugggcc

SEQ ID NO: 1386818 - RNA, 12 nt, Human
ugcuuuguauug

SEQ ID NO: 1386819 - RNA, 24 nt, Human
ugcuuuuaguauuuuagugaacuu

SEQ ID NO: 1386820 - RNA, 14 nt, Human
ugcuuuucauccuu

SEQ ID NO: 1386821 - RNA, 18 nt, Human
ugcuuuucccuuugugag

SEQ ID NO: 1386822 - RNA, 21 nt, Human
ugcuuuucccuuugugaguca

SEQ ID NO: 1386823 - RNA, 17 nt, Human
ugcuuuucccuuuguga

SEQ ID NO: 1386824 - RNA, 17 nt, Human
ugcuuuucaugcaaacu

SEQ ID NO: 1386825 - RNA, 20 nt, Human
ugcuuuucaugcaaacucuu

SEQ ID NO: 1386826 - RNA, 16 nt, Human
ugcuuuucaugcaaac

SEQ ID NO: 1386827 - RNA, 14 nt, Human
ugcuuuucagcuga

SEQ ID NO: 1386828 - RNA, 13 nt, Human
uggaaauauauau

SEQ ID NO: 1386829 - RNA, 15 nt, Human
uggaaauacacagug

SEQ ID NO: 1386830 - RNA, 14 nt, Human
uggaaauacacagu

SEQ ID NO: 1386831 - RNA, 13 nt, Human
uggaaaggcagcu

SEQ ID NO: 1386832 - RNA, 20 nt, Human
ugcuugcccuaagcagaaag

SEQ ID NO: 1386833 - RNA, 21 nt, Human
ugcuugcccuaagcagaaagu

SEQ ID NO: 1386834 - RNA, 18 nt, Human
ugcuugcccuaagcagaa

SEQ ID NO: 1386835 - RNA, 23 nt, Human
ugcuugccaaggcagaggccugg

SEQ ID NO: 1386836 - RNA, 22 nt, Human
ugcuugccaaggcagaggccug

SEQ ID NO: 1386837 - RNA, 21 nt, Human
ugcuugccaaggcagaggccu

SEQ ID NO: 1386838 - RNA, 15 nt, Human
aggagcuaaggcucu

SEQ ID NO: 1386839 - RNA, 14 nt, Human
aggagcuaaggcuc

SEQ ID NO: 1386840 - RNA, 13 nt, Human
aggagcuaaggcu

SEQ ID NO: 1386841 - RNA, 12 nt, Human
aggagcuaaggc

SEQ ID NO: 1386842 - RNA, 15 nt, Human
aggagcgagcauguc

SEQ ID NO: 1386843 - RNA, 14 nt, Human
aggagcgagcaugu

SEQ ID NO: 1386844 - RNA, 14 nt, Human
aggagccugugaca

SEQ ID NO: 1386845 - RNA, 13 nt, Human
aggagccugugac

SEQ ID NO: 1386846 - RNA, 22 nt, Human
aggagccugugaacccaggaca

SEQ ID NO: 1386847 - RNA, 21 nt, Human
aggagccugugaacccaggac

SEQ ID NO: 1386848 - RNA, 20 nt, Human
aggagccugugaacccagga

SEQ ID NO: 1386849 - RNA, 19 nt, Human
aggagccugugaacccagg

SEQ ID NO: 1386850 - RNA, 18 nt, Human
aggagccugugaacccag

SEQ ID NO: 1386851 - RNA, 17 nt, Human
aggagccugugaaccca

SEQ ID NO: 1386852 - RNA, 13 nt, Human
aggagccugugaa

SEQ ID NO: 1386853 - RNA, 12 nt, Human
aggagccuguga

SEQ ID NO: 1386854 - RNA, 11 nt, Human
aggagccugug

SEQ ID NO: 1386855 - RNA, 21 nt, Human
aggagccuguccugccugugg

SEQ ID NO: 1386856 - RNA, 19 nt, Human
aggagccuguccugccugu

SEQ ID NO: 1386857 - RNA, 17 nt, Human
aggagccuguccugccu

SEQ ID NO: 1386858 - RNA, 16 nt, Human
aggagccuguccugcc

SEQ ID NO: 1386859 - RNA, 12 nt, Human
aggagccugucc

SEQ ID NO: 1386860 - RNA, 11 nt, Human
aggagccuggc

SEQ ID NO: 1386861 - RNA, 19 nt, Human
aggagcccugggaggcucu

SEQ ID NO: 1386862 - RNA, 23 nt, Human
aggagcccugggaggcucuggag

SEQ ID NO: 1386863 - RNA, 22 nt, Human
aggagauucugccuuugccagg

SEQ ID NO: 1386864 - RNA, 20 nt, Human
aggagauucugccuuugcca

SEQ ID NO: 1386865 - RNA, 16 nt, Human
aggagauucugccuuu

SEQ ID NO: 1386866 - RNA, 17 nt, Human
aggagauggggacaggg

SEQ ID NO: 1386867 - RNA, 21 nt, Human
aggagauucugccuuugccag

SEQ ID NO: 1386868 - RNA, 13 nt, Human
aggacuuuguaca

SEQ ID NO: 1386869 - RNA, 11 nt, Human
aggacuuugca

SEQ ID NO: 1386870 - RNA, 15 nt, Human
aggacuuuguacauu

SEQ ID NO: 1386871 - RNA, 21 nt, Human
aggacuuuauagaucagccag

SEQ ID NO: 1386872 - RNA, 20 nt, Human
aggacuuuauagaucagcca

SEQ ID NO: 1386873 - RNA, 15 nt, Human
aggagcaaagccugu

SEQ ID NO: 1386874 - RNA, 16 nt, Human
aggagcaaagccuguu

SEQ ID NO: 1386875 - RNA, 14 nt, Human
aggagcaaagccug

SEQ ID NO: 1386876 - RNA, 13 nt, Human
aggagcaaagccu

SEQ ID NO: 1386877 - RNA, 17 nt, Human
aggagccaccaguucuc

SEQ ID NO: 1386878 - RNA, 15 nt, Human
aggagccaccaguuc

SEQ ID NO: 1386879 - RNA, 14 nt, Human
aggagccaccaguu

SEQ ID NO: 1386880 - RNA, 20 nt, Human
aggagcccacgacacugcag

SEQ ID NO: 1386881 - RNA, 18 nt, Human
aggagcccugggaggcuc

SEQ ID NO: 1386882 - RNA, 20 nt, Human
aggacugaauuaugaaacuu

SEQ ID NO: 1386883 - RNA, 19 nt, Human
aggacugaauuaugaaacu

SEQ ID NO: 1386884 - RNA, 14 nt, Human
aggacuguccccuu

SEQ ID NO: 1386885 - RNA, 21 nt, Human
aggacuguccccuugaaggag

SEQ ID NO: 1386886 - RNA, 23 nt, Human
aggacuguccccuugaaggagaa

SEQ ID NO: 1386887 - RNA, 14 nt, Human
aggacauuucucua

SEQ ID NO: 1386888 - RNA, 20 nt, Human
aggacuuccuguccagcucc

SEQ ID NO: 1386889 - RNA, 15 nt, Human
aggacuucccugugu

SEQ ID NO: 1386890 - RNA, 19 nt, Human
aggacuuauuuaaacucug

SEQ ID NO: 1386891 - RNA, 16 nt, Human
aggacuugugucucug

SEQ ID NO: 1386892 - RNA, 13 nt, Human
aggacuugugucu

SEQ ID NO: 1386893 - RNA, 21 nt, Human
aggacuuccuguccagcucca

SEQ ID NO: 1386894 - RNA, 23 nt, Human
aggacuugcccucgugguggaaa

SEQ ID NO: 1386895 - RNA, 12 nt, Human
aggauaaaauaa

SEQ ID NO: 1386896 - RNA, 15 nt, Human
aggaguuuugcaaag

SEQ ID NO: 1386897 - RNA, 21 nt, Human
aggaggagccuguccugccug

SEQ ID NO: 1386898 - RNA, 20 nt, Human
aggagggagagucucccagg

SEQ ID NO: 1386899 - RNA, 21 nt, Human
aggauacaaaagcaugugaga

SEQ ID NO: 1386900 - RNA, 19 nt, Human
uggaaauauauauuauacu

SEQ ID NO: 1386901 - RNA, 17 nt, Human
uggaaauauauauuaua

SEQ ID NO: 1386902 - RNA, 14 nt, Human
uggaaauauauauu

SEQ ID NO: 1386903 - RNA, 17 nt, Human
aggagcugccuggaccc

SEQ ID NO: 1386904 - RNA, 18 nt, Human
aggagcugccuggacccg

SEQ ID NO: 1386905 - RNA, 16 nt, Human
aggagcugccuggacc

SEQ ID NO: 1386906 - RNA, 15 nt, Human
aggagcugccuggac

SEQ ID NO: 1386907 - RNA, 14 nt, Human
aggagcugccugga

SEQ ID NO: 1386908 - RNA, 12 nt, Human
aggagcugccug

SEQ ID NO: 1386909 - RNA, 17 nt, Human
uggaaauucccuucauc

SEQ ID NO: 1386910 - RNA, 22 nt, Human
uggaaauucccuucaucuggaa

SEQ ID NO: 1386911 - RNA, 17 nt, Human
uggaaauugauuuugaa

SEQ ID NO: 1386912 - RNA, 16 nt, Human
uggaaauugacgaggg

SEQ ID NO: 1386913 - RNA, 18 nt, Human
uggaaauucccuucaucu

SEQ ID NO: 1386914 - RNA, 23 nt, Human
aggaggagggucggugccuucaa

SEQ ID NO: 1386915 - RNA, 22 nt, Human
aggaggagccuguccugccugu

SEQ ID NO: 1386916 - RNA, 23 nt, Human
aggagggagacacuggccccuca

SEQ ID NO: 1386917 - RNA, 16 nt, Human
aggagggagacacugg

SEQ ID NO: 1386918 - RNA, 19 nt, Human
aggagggacugucgcugcu

SEQ ID NO: 1386919 - RNA, 22 nt, Human
aggagggacaaaggagccugug

SEQ ID NO: 1386920 - RNA, 23 nt, Human
aggagggacaaaggagccuguga

SEQ ID NO: 1386921 - RNA, 21 nt, Human
aggagggacaaaggagccugu

SEQ ID NO: 1386922 - RNA, 20 nt, Human
aggagggacaaaggagccug

SEQ ID NO: 1386923 - RNA, 19 nt, Human
aggagggacaaaggagccu

SEQ ID NO: 1386924 - RNA, 18 nt, Human
aggagggacaaaggagcc

SEQ ID NO: 1386925 - RNA, 14 nt, Human
aggagggacaaagg

SEQ ID NO: 1386926 - RNA, 18 nt, Human
aggaggcaccuacacuca

SEQ ID NO: 1386927 - RNA, 14 nt, Human
aggaggcaggaccu

SEQ ID NO: 1386928 - RNA, 14 nt, Human
aggaggcagagaag

SEQ ID NO: 1386929 - RNA, 14 nt, Human
aggaggcagcagga

SEQ ID NO: 1386930 - RNA, 15 nt, Human
aggaggcagcaggac

SEQ ID NO: 1386931 - RNA, 17 nt, Human
aggaggcagcaggacug

SEQ ID NO: 1386932 - RNA, 18 nt, Human
uggacccagccaggccca

SEQ ID NO: 1386933 - RNA, 21 nt, Human
uggacccagccaggcccagcc

SEQ ID NO: 1386934 - RNA, 17 nt, Human
uggacccagccaggccc

SEQ ID NO: 1386935 - RNA, 19 nt, Human
uggaccauggaguggcagc

SEQ ID NO: 1386936 - RNA, 20 nt, Human
uggaccauggaguggcagcc

SEQ ID NO: 1386937 - RNA, 22 nt, Human
uggaccagccucuccacucaug

SEQ ID NO: 1386938 - RNA, 16 nt, Human
uggaccagccucucca

SEQ ID NO: 1386939 - RNA, 19 nt, Human
uggaccucugacagcagca

SEQ ID NO: 1386940 - RNA, 18 nt, Human
uggaccucugacagcagc

SEQ ID NO: 1386941 - RNA, 17 nt, Human
uggaccucugacagcag

SEQ ID NO: 1386942 - RNA, 16 nt, Human
uggaccucugacagca

SEQ ID NO: 1386943 - RNA, 15 nt, Human
uggaccucugacagc

SEQ ID NO: 1386944 - RNA, 14 nt, Human
uggaccucugacag

SEQ ID NO: 1386945 - RNA, 13 nt, Human
uggaccucugaca

SEQ ID NO: 1386946 - RNA, 15 nt, Human
uggaccucaccaagc

SEQ ID NO: 1386947 - RNA, 22 nt, Human
uggaccuaauccaagcaucccu

SEQ ID NO: 1386948 - RNA, 14 nt, Human
uggaccuaauccaa

SEQ ID NO: 1386949 - RNA, 21 nt, Human
uggaccuaaauggccucaugu

SEQ ID NO: 1386950 - RNA, 18 nt, Human
uggaccuaaauggccuca

SEQ ID NO: 1386951 - RNA, 17 nt, Human
uggaccuaaauggccuc

SEQ ID NO: 1386952 - RNA, 22 nt, Human
uggaccggagaguggggguggg

SEQ ID NO: 1386953 - RNA, 18 nt, Human
uggaccggagaguggggg

SEQ ID NO: 1386954 - RNA, 15 nt, Human
uggaccggagagugg

SEQ ID NO: 1386955 - RNA, 23 nt, Human
uggacccugaccagcucccccuc

SEQ ID NO: 1386956 - RNA, 13 nt, Human
uggacccuuccau

SEQ ID NO: 1386957 - RNA, 20 nt, Human
uggacccugaccagcucccc

SEQ ID NO: 1386958 - RNA, 19 nt, Human
uggacccugaccagcuccc

SEQ ID NO: 1386959 - RNA, 18 nt, Human
uggacccugaccagcucc

SEQ ID NO: 1386960 - RNA, 15 nt, Human
uggacccugaccagc

SEQ ID NO: 1386961 - RNA, 13 nt, Human
uggacccugacca

SEQ ID NO: 1386962 - RNA, 22 nt, Human
aggaugagggaaaagaaaaaga

SEQ ID NO: 1386963 - RNA, 15 nt, Human
aggcaaaaauguaaa

SEQ ID NO: 1386964 - RNA, 21 nt, Human
aggauuuuuuuuaauguuuaa

SEQ ID NO: 1386965 - RNA, 19 nt, Human
aggaugcuaacaucuaaaa

SEQ ID NO: 1386966 - RNA, 17 nt, Human
aggaugcuaacaucuaa

SEQ ID NO: 1386967 - RNA, 16 nt, Human
aggaugcuaacaucua

SEQ ID NO: 1386968 - RNA, 16 nt, Human
aggcaacauccaaaau

SEQ ID NO: 1386969 - RNA, 22 nt, Human
aggcaaauuugcauuaaauuac

SEQ ID NO: 1386970 - RNA, 15 nt, Human
aggcaaauuugcauu

SEQ ID NO: 1386971 - RNA, 17 nt, Human
aggcaaaauugcaaauc

SEQ ID NO: 1386972 - RNA, 13 nt, Human
aggcaaaauugca

SEQ ID NO: 1386973 - RNA, 19 nt, Human
aggcaaaauccuugcuuau

SEQ ID NO: 1386974 - RNA, 17 nt, Human
aggcaaaauccuugcuu

SEQ ID NO: 1386975 - RNA, 17 nt, Human
uggaauugggagcuugg

SEQ ID NO: 1386976 - RNA, 18 nt, Human
uggaauuggagcucgugg

SEQ ID NO: 1386977 - RNA, 23 nt, Human
uggaauugauuugcauugaacac

SEQ ID NO: 1386978 - RNA, 15 nt, Human
uggccgccugggucc

SEQ ID NO: 1386979 - RNA, 23 nt, Human
uggccgcccccugccccccagcc

SEQ ID NO: 1386980 - RNA, 21 nt, Human
uggccgcccccugccccccag

SEQ ID NO: 1386981 - RNA, 17 nt, Human
uggccgcccccugcccc

SEQ ID NO: 1386982 - RNA, 15 nt, Human
uggccgcccccugcc

SEQ ID NO: 1386983 - RNA, 13 nt, Human
uggccgcccccug

SEQ ID NO: 1386984 - RNA, 19 nt, Human
uggccgaguccaagcuggg

SEQ ID NO: 1386985 - RNA, 17 nt, Human
uggccgaguccaagcug

SEQ ID NO: 1386986 - RNA, 19 nt, Human
uggccgcugaguggcaggg

SEQ ID NO: 1386987 - RNA, 17 nt, Human
uggccgcugaguggcag

SEQ ID NO: 1386988 - RNA, 20 nt, Human
uggccuggccagugcccuga

SEQ ID NO: 1386989 - RNA, 17 nt, Human
uggccuggccagugccc

SEQ ID NO: 1386990 - RNA, 14 nt, Human
uggccuggccagug

SEQ ID NO: 1386991 - RNA, 13 nt, Human
uggccuggccagu

SEQ ID NO: 1386992 - RNA, 23 nt, Human
uggccuggagcacaaagacccug

SEQ ID NO: 1386993 - RNA, 12 nt, Human
uggccuggagca

SEQ ID NO: 1386994 - RNA, 18 nt, Human
aggccucagggcuccuug

SEQ ID NO: 1386995 - RNA, 13 nt, Human
aggccucagggcu

SEQ ID NO: 1386996 - RNA, 23 nt, Human
aggccuccuggcugucugaggcu

SEQ ID NO: 1386997 - RNA, 14 nt, Human
aggccuccuggcug

SEQ ID NO: 1386998 - RNA, 22 nt, Human
aggcccucgcugccagcucugu

SEQ ID NO: 1386999 - RNA, 17 nt, Human
aggcccucgcugccagc

SEQ ID NO: 1387000 - RNA, 19 nt, Human
aggccauucuuucccaaca

SEQ ID NO: 1387001 - RNA, 18 nt, Human
aggccauucuuucccaac

SEQ ID NO: 1387002 - RNA, 17 nt, Human
aggccauucuuucccaa

SEQ ID NO: 1387003 - RNA, 20 nt, Human
uggcauggaaauuuaaagca

SEQ ID NO: 1387004 - RNA, 19 nt, Human
uggcauggaaauuuaaagc

SEQ ID NO: 1387005 - RNA, 19 nt, Human
aggccugagguuacuggaa

SEQ ID NO: 1387006 - RNA, 21 nt, Human
uggccaagaagcaguggccuu

SEQ ID NO: 1387007 - RNA, 16 nt, Human
uggccaagaagcagug

SEQ ID NO: 1387008 - RNA, 13 nt, Human
uggccaagaagca

SEQ ID NO: 1387009 - RNA, 23 nt, Human
uggcauggaaauuuaaagcaggu

SEQ ID NO: 1387010 - RNA, 21 nt, Human
uggcauggaaauuuaaagcag

SEQ ID NO: 1387011 - RNA, 16 nt, Human
uggccaaggaaaggca

SEQ ID NO: 1387012 - RNA, 23 nt, Human
uggccaagcugaggugcccagga

SEQ ID NO: 1387013 - RNA, 22 nt, Human
uggccaagcugaggugcccagg

SEQ ID NO: 1387014 - RNA, 21 nt, Human
uggccaagcugaggugcccag

SEQ ID NO: 1387015 - RNA, 19 nt, Human
uggccaagcugaggugccc

SEQ ID NO: 1387016 - RNA, 17 nt, Human
uggccaagcugaggugc

SEQ ID NO: 1387017 - RNA, 14 nt, Human
uggccaagcugagg

SEQ ID NO: 1387018 - RNA, 13 nt, Human
uggccaagcugag

SEQ ID NO: 1387019 - RNA, 22 nt, Human
uggccaagaagcaguggccuua

SEQ ID NO: 1387020 - RNA, 22 nt, Human
uggccaaugcaccuaaagaaaa

SEQ ID NO: 1387021 - RNA, 16 nt, Human
uggccaaguuccucua

SEQ ID NO: 1387022 - RNA, 22 nt, Human
uggccagggccacgcuccagcu

SEQ ID NO: 1387023 - RNA, 20 nt, Human
uggccagggccacgcuccag

SEQ ID NO: 1387024 - RNA, 14 nt, Human
uggccaaguuccuc

SEQ ID NO: 1387025 - RNA, 20 nt, Human
uggccaggcuugucucgaac

SEQ ID NO: 1387026 - RNA, 21 nt, Human
uggccaguccaggcugccgug

SEQ ID NO: 1387027 - RNA, 17 nt, Human
uggccaguccaggcugc

SEQ ID NO: 1387028 - RNA, 21 nt, Human
uggccagugcccugaucccag

SEQ ID NO: 1387029 - RNA, 18 nt, Human
uggccagugcccugaucc

SEQ ID NO: 1387030 - RNA, 14 nt, Human
uggccagugcccug

SEQ ID NO: 1387031 - RNA, 23 nt, Human
uggccaguccaggcugccguggg

SEQ ID NO: 1387032 - RNA, 20 nt, Human
uggccagucuggucucgaac

SEQ ID NO: 1387033 - RNA, 21 nt, Human
uggcagccacacuucucagga

SEQ ID NO: 1387034 - RNA, 18 nt, Human
uggcagccacacuucuca

SEQ ID NO: 1387035 - RNA, 11 nt, Human
uggcagccaca

SEQ ID NO: 1387036 - RNA, 21 nt, Human
uggcacaucagcacgauuucu

SEQ ID NO: 1387037 - RNA, 16 nt, Human
uggauguccccagcag

SEQ ID NO: 1387038 - RNA, 15 nt, Human
uggauguccccagca

SEQ ID NO: 1387039 - RNA, 14 nt, Human
uggauguccccagc

SEQ ID NO: 1387040 - RNA, 22 nt, Human
uggauuaaacuuaaucuaaaug

SEQ ID NO: 1387041 - RNA, 20 nt, Human
uggcacaucagcacgauuuc

SEQ ID NO: 1387042 - RNA, 18 nt, Human
uggcagcccagccagcgu

SEQ ID NO: 1387043 - RNA, 17 nt, Human
uggcagcccagccagcg

SEQ ID NO: 1387044 - RNA, 16 nt, Human
uggcagcccagccagc

SEQ ID NO: 1387045 - RNA, 15 nt, Human
uggcagcccagccag

SEQ ID NO: 1387046 - RNA, 14 nt, Human
uggcagcccagcca

SEQ ID NO: 1387047 - RNA, 13 nt, Human
uggcagcccagcc

SEQ ID NO: 1387048 - RNA, 12 nt, Human
uggcagcccagc

SEQ ID NO: 1387049 - RNA, 19 nt, Human
uggcagccacacuucucag

SEQ ID NO: 1387050 - RNA, 22 nt, Human
uggcagccucccauccagggcc

SEQ ID NO: 1387051 - RNA, 21 nt, Human
uggcagccucccauccagggc

SEQ ID NO: 1387052 - RNA, 20 nt, Human
uggcagccucccauccaggg

SEQ ID NO: 1387053 - RNA, 19 nt, Human
uggcagccucccauccagg

SEQ ID NO: 1387054 - RNA, 11 nt, Human
uggcagccuug

SEQ ID NO: 1387055 - RNA, 21 nt, Human
aggccacacuucaaacuacuu

SEQ ID NO: 1387056 - RNA, 18 nt, Human
aggccacacucagcacaa

SEQ ID NO: 1387057 - RNA, 17 nt, Human
aggccacacucagcaca

SEQ ID NO: 1387058 - RNA, 19 nt, Human
aggccacuguguuccuucc

SEQ ID NO: 1387059 - RNA, 14 nt, Human
aggccacuguguuc

SEQ ID NO: 1387060 - RNA, 20 nt, Human
aggccacuggagacgcauau

SEQ ID NO: 1387061 - RNA, 14 nt, Human
aggccacuggagac

SEQ ID NO: 1387062 - RNA, 21 nt, Human
aggccaccuggcucucaccuc

SEQ ID NO: 1387063 - RNA, 19 nt, Human
aggccacuguuuggaaaua

SEQ ID NO: 1387064 - RNA, 20 nt, Human
aggccacuguguuccuuccg

SEQ ID NO: 1387065 - RNA, 16 nt, Human
aggccagaccauggac

SEQ ID NO: 1387066 - RNA, 17 nt, Human
aggccagaccauggaca

SEQ ID NO: 1387067 - RNA, 18 nt, Human
aggccagaccauggacac

SEQ ID NO: 1387068 - RNA, 23 nt, Human
uggaugggggaacucagauccag

SEQ ID NO: 1387069 - RNA, 15 nt, Human
uggagucugccaccc

SEQ ID NO: 1387070 - RNA, 21 nt, Human
uggaguccccucaccuccucu

SEQ ID NO: 1387071 - RNA, 20 nt, Human
uggaguccccucaccuccuc

SEQ ID NO: 1387072 - RNA, 19 nt, Human
uggaguccccucaccuccu

SEQ ID NO: 1387073 - RNA, 15 nt, Human
uggaguccccucacc

SEQ ID NO: 1387074 - RNA, 14 nt, Human
uggaguccccucac

SEQ ID NO: 1387075 - RNA, 16 nt, Human
uggagucaaaaagaac

SEQ ID NO: 1387076 - RNA, 18 nt, Human
aggccaagucaggcccuu

SEQ ID NO: 1387077 - RNA, 21 nt, Human
aggccaagguguccuacagaa

SEQ ID NO: 1387078 - RNA, 20 nt, Human
aggccaagguguccuacaga

SEQ ID NO: 1387079 - RNA, 19 nt, Human
aggccaagguguccuacag

SEQ ID NO: 1387080 - RNA, 14 nt, Human
aggccaaggugucc

SEQ ID NO: 1387081 - RNA, 21 nt, Human
aggccaaaggggaccuggaag

SEQ ID NO: 1387082 - RNA, 21 nt, Human
aggccaagaaacgucuucuaa

SEQ ID NO: 1387083 - RNA, 17 nt, Human
aggccaagaaacgucuu

SEQ ID NO: 1387084 - RNA, 14 nt, Human
aggccaagaaacgu

SEQ ID NO: 1387085 - RNA, 22 nt, Human
aggccaacccaaaauaagcagg

SEQ ID NO: 1387086 - RNA, 22 nt, Human
aggccaaaggggaccuggaagg

SEQ ID NO: 1387087 - RNA, 21 nt, Human
aggccaaagagucuccaguuu

SEQ ID NO: 1387088 - RNA, 15 nt, Human
aggcauuuuuaccau

SEQ ID NO: 1387089 - RNA, 18 nt, Human
aggcauuuguuugaacug

SEQ ID NO: 1387090 - RNA, 22 nt, Human
uggaccucugacagcagcaucu

SEQ ID NO: 1387091 - RNA, 24 nt, Human
uggacgacacggucggggcaucug

SEQ ID NO: 1387092 - RNA, 18 nt, Human
uggacgagaaaacaauaa

SEQ ID NO: 1387093 - RNA, 23 nt, Human
aggcucugagagucuagauucuc

SEQ ID NO: 1387094 - RNA, 22 nt, Human
aggcucugagagucuagauucu

SEQ ID NO: 1387095 - RNA, 21 nt, Human
aggcucugagagucuagauuc

SEQ ID NO: 1387096 - RNA, 20 nt, Human
aggcucugagagucuagauu

SEQ ID NO: 1387097 - RNA, 19 nt, Human
aggcucugagagucuagau

SEQ ID NO: 1387098 - RNA, 16 nt, Human
aggcucugagagucua

SEQ ID NO: 1387099 - RNA, 13 nt, Human
aggcucugagagu

SEQ ID NO: 1387100 - RNA, 18 nt, Human
aggcucucuuugcccagu

SEQ ID NO: 1387101 - RNA, 21 nt, Human
aggcucuaugagucuagaugu

SEQ ID NO: 1387102 - RNA, 20 nt, Human
aggcucuaugagucuagaug

SEQ ID NO: 1387103 - RNA, 19 nt, Human
aggcucuaugagucuagau

SEQ ID NO: 1387104 - RNA, 17 nt, Human
aggcucuagaucauaag

SEQ ID NO: 1387105 - RNA, 18 nt, Human
aggcucguggacugagug

SEQ ID NO: 1387106 - RNA, 17 nt, Human
aggcucggccugccccc

SEQ ID NO: 1387107 - RNA, 22 nt, Human
aggcuccuguuuugcacagcca

SEQ ID NO: 1387108 - RNA, 16 nt, Human
aggcuccuguuuugca

SEQ ID NO: 1387109 - RNA, 20 nt, Human
aggccuggggugacccggca

SEQ ID NO: 1387110 - RNA, 21 nt, Human
aggccuggggugacccggcac

SEQ ID NO: 1387111 - RNA, 18 nt, Human
aggccuggggugacccgg

SEQ ID NO: 1387112 - RNA, 11 nt, Human
aggccuggggu

SEQ ID NO: 1387113 - RNA, 19 nt, Human
aggccugggccgcugccac

SEQ ID NO: 1387114 - RNA, 15 nt, Human
aggccugggcagugg

SEQ ID NO: 1387115 - RNA, 14 nt, Human
aggccugggcagug

SEQ ID NO: 1387116 - RNA, 13 nt, Human
aggccugggcagu

SEQ ID NO: 1387117 - RNA, 20 nt, Human
aggccuguguagcugugacc

SEQ ID NO: 1387118 - RNA, 17 nt, Human
aggccugguguuucuug

SEQ ID NO: 1387119 - RNA, 22 nt, Human
aggccuguccugaccugucuca

SEQ ID NO: 1387120 - RNA, 15 nt, Human
aggcuggccagucca

SEQ ID NO: 1387121 - RNA, 18 nt, Human
aggcuggcacaggacaug

SEQ ID NO: 1387122 - RNA, 17 nt, Human
aggcuggcacaggacau

SEQ ID NO: 1387123 - RNA, 16 nt, Human
aggcuggcacaggaca

SEQ ID NO: 1387124 - RNA, 14 nt, Human
aggcuggcacagga

SEQ ID NO: 1387125 - RNA, 22 nt, Human
aggcuggaagauagcugugacu

SEQ ID NO: 1387126 - RNA, 21 nt, Human
aggcuggccaguccaggcugc

SEQ ID NO: 1387127 - RNA, 19 nt, Human
aggcuggccaguccaggcu

SEQ ID NO: 1387128 - RNA, 18 nt, Human
aggcuggccaguccaggc

SEQ ID NO: 1387129 - RNA, 17 nt, Human
aggcuggccaguccagg

SEQ ID NO: 1387130 - RNA, 23 nt, Human
aggcugcucggggugcacaggag

SEQ ID NO: 1387131 - RNA, 22 nt, Human
aggcugcucggggugcacagga

SEQ ID NO: 1387132 - RNA, 21 nt, Human
aggcugcucggggugcacagg

SEQ ID NO: 1387133 - RNA, 20 nt, Human
aggcugcucggggugcacag

SEQ ID NO: 1387134 - RNA, 17 nt, Human
aggcugcucggggugca

SEQ ID NO: 1387135 - RNA, 18 nt, Human
aggcuggaagcugggagg

SEQ ID NO: 1387136 - RNA, 18 nt, Human
aggcuggaagauagcugu

SEQ ID NO: 1387137 - RNA, 13 nt, Human
aggcucuggagcc

SEQ ID NO: 1387138 - RNA, 14 nt, Human
aggcucuggagccc

SEQ ID NO: 1387139 - RNA, 15 nt, Human
aggcucuggagccca

SEQ ID NO: 1387140 - RNA, 24 nt, Human
aggcugccugagucgugaccugcu

SEQ ID NO: 1387141 - RNA, 15 nt, Human
aggcugcucagggcu

SEQ ID NO: 1387142 - RNA, 16 nt, Human
aggcugcucagggcug

SEQ ID NO: 1387143 - RNA, 17 nt, Human
aggcugcucagggcugg

SEQ ID NO: 1387144 - RNA, 18 nt, Human
aggcucuggagcccacug

SEQ ID NO: 1387145 - RNA, 19 nt, Human
aggcucuggagcccacugu

SEQ ID NO: 1387146 - RNA, 18 nt, Human
uggcuuauaauucuuuca

SEQ ID NO: 1387147 - RNA, 15 nt, Human
uggcuuaccuggccc

SEQ ID NO: 1387148 - RNA, 17 nt, Human
uggcuuaccuggcccau

SEQ ID NO: 1387149 - RNA, 14 nt, Human
uggcuuaccuggcc

SEQ ID NO: 1387150 - RNA, 13 nt, Human
uggcuuaccuggc

SEQ ID NO: 1387151 - RNA, 19 nt, Human
uggcuuauaauucuuucaa

SEQ ID NO: 1387152 - RNA, 15 nt, Human
ugggaagugaagacu

SEQ ID NO: 1387153 - RNA, 23 nt, Human
ugggaagucguccuuacuccugu

SEQ ID NO: 1387154 - RNA, 18 nt, Human
ugggaaguccggccccag

SEQ ID NO: 1387155 - RNA, 18 nt, Human
ugggaaggcuugggauuu

SEQ ID NO: 1387156 - RNA, 17 nt, Human
ugggaaggcuugggauu

SEQ ID NO: 1387157 - RNA, 23 nt, Human
ugggaaggcuacuucggggcugg

SEQ ID NO: 1387158 - RNA, 22 nt, Human
ugggaagcccauccugaccagc

SEQ ID NO: 1387159 - RNA, 19 nt, Human
ugggaagcccauccugacc

SEQ ID NO: 1387160 - RNA, 22 nt, Human
ugggaagacuccuagcuguccu

SEQ ID NO: 1387161 - RNA, 23 nt, Human
ugggaagacuccuagcuguccuu

SEQ ID NO: 1387162 - RNA, 20 nt, Human
ugggaagacuccuagcuguc

SEQ ID NO: 1387163 - RNA, 21 nt, Human
uggcuucccauccccagcgau

SEQ ID NO: 1387164 - RNA, 20 nt, Human
uggcuucccauccccagcga

SEQ ID NO: 1387165 - RNA, 19 nt, Human
uggcuucccauccccagcg

SEQ ID NO: 1387166 - RNA, 18 nt, Human
uggcuucccauccccagc

SEQ ID NO: 1387167 - RNA, 15 nt, Human
uggcuucccaucccc

SEQ ID NO: 1387168 - RNA, 14 nt, Human
uggcuucccauccc

SEQ ID NO: 1387169 - RNA, 18 nt, Human
ugggaaccccuuucccac

SEQ ID NO: 1387170 - RNA, 20 nt, Human
ugggaaagggauuuucagcc

SEQ ID NO: 1387171 - RNA, 22 nt, Human
ugggaaagccccugccccuccu

SEQ ID NO: 1387172 - RNA, 20 nt, Human
ugggaaagccccugccccuc

SEQ ID NO: 1387173 - RNA, 12 nt, Human
uggcuauuuuau

SEQ ID NO: 1387174 - RNA, 18 nt, Human
uggcuauguuuuuaaugu

SEQ ID NO: 1387175 - RNA, 15 nt, Human
uggcuauuuaaaacu

SEQ ID NO: 1387176 - RNA, 17 nt, Human
uggcuauguuuuuaaug

SEQ ID NO: 1387177 - RNA, 13 nt, Human
uggcuauguuuuu

SEQ ID NO: 1387178 - RNA, 19 nt, Human
uggcuaugcauuugaaaau

SEQ ID NO: 1387179 - RNA, 13 nt, Human
aggcugccugagu

SEQ ID NO: 1387180 - RNA, 15 nt, Human
uggcuaguccuuguu

SEQ ID NO: 1387181 - RNA, 14 nt, Human
uggcuaugcauuug

SEQ ID NO: 1387182 - RNA, 15 nt, Human
uggcuaugcauuuga

SEQ ID NO: 1387183 - RNA, 17 nt, Human
uggcuaugcauuugaaa

SEQ ID NO: 1387184 - RNA, 18 nt, Human
aggcugggaacucaucug

SEQ ID NO: 1387185 - RNA, 22 nt, Human
uggcuagagguucaaagauauu

SEQ ID NO: 1387186 - RNA, 19 nt, Human
aggcuggcuccagaugcag

SEQ ID NO: 1387187 - RNA, 22 nt, Human
aggcugggaauggaggggcaga

SEQ ID NO: 1387188 - RNA, 14 nt, Human
uggcugagggcagu

SEQ ID NO: 1387189 - RNA, 17 nt, Human
uggcugaggccacccag

SEQ ID NO: 1387190 - RNA, 13 nt, Human
uggcugagggcag

SEQ ID NO: 1387191 - RNA, 23 nt, Human
uggcugagggcaguucgcagcca

SEQ ID NO: 1387192 - RNA, 22 nt, Human
uggcugagggcaguucgcagcc

SEQ ID NO: 1387193 - RNA, 15 nt, Human
uggcugagggcaguu

SEQ ID NO: 1387194 - RNA, 19 nt, Human
uggcugcauaaauguggua

SEQ ID NO: 1387195 - RNA, 19 nt, Human
uggcugauaauuuuaaauu

SEQ ID NO: 1387196 - RNA, 14 nt, Human
uggcugauaauuuu

SEQ ID NO: 1387197 - RNA, 12 nt, Human
uggcugcaugcg

SEQ ID NO: 1387198 - RNA, 18 nt, Human
agccagccucgcccaucc

SEQ ID NO: 1387199 - RNA, 10 nt, Human
agccagccuc

SEQ ID NO: 1387200 - RNA, 19 nt, Human
agccagccggggcgagugg

SEQ ID NO: 1387201 - RNA, 16 nt, Human
agccagccggggcgag

SEQ ID NO: 1387202 - RNA, 21 nt, Human
agccagccgagcaggaggccu

SEQ ID NO: 1387203 - RNA, 19 nt, Human
agccagccgagcaggaggc

SEQ ID NO: 1387204 - RNA, 24 nt, Human
agccagcccugccuggaggaccug

SEQ ID NO: 1387205 - RNA, 23 nt, Human
agccagcccugccuggaggaccu

SEQ ID NO: 1387206 - RNA, 21 nt, Human
agccagcccugccuggaggac

SEQ ID NO: 1387207 - RNA, 20 nt, Human
agccagcccugccuggagga

SEQ ID NO: 1387208 - RNA, 19 nt, Human
agccagcccugccuggagg

SEQ ID NO: 1387209 - RNA, 18 nt, Human
agccagcccugccuggag

SEQ ID NO: 1387210 - RNA, 17 nt, Human
agccagcccugccugga

SEQ ID NO: 1387211 - RNA, 16 nt, Human
agccagcccugccugg

SEQ ID NO: 1387212 - RNA, 15 nt, Human
agccagcccugccug

SEQ ID NO: 1387213 - RNA, 14 nt, Human
agccagcccugccu

SEQ ID NO: 1387214 - RNA, 13 nt, Human
agccagcccugcc

SEQ ID NO: 1387215 - RNA, 16 nt, Human
agccagcaucugggcc

SEQ ID NO: 1387216 - RNA, 17 nt, Human
agccagcaucugggccu

SEQ ID NO: 1387217 - RNA, 12 nt, Human
agccagcaucug

SEQ ID NO: 1387218 - RNA, 14 nt, Human
agccagcaucggaa

SEQ ID NO: 1387219 - RNA, 13 nt, Human
agccacuccucug

SEQ ID NO: 1387220 - RNA, 19 nt, Human
ugauuaaauucuugcaaag

SEQ ID NO: 1387221 - RNA, 24 nt, Human
ugaugggauucuggacaggaugug

SEQ ID NO: 1387222 - RNA, 20 nt, Human
ugauuaaauucuugcaaagu

SEQ ID NO: 1387223 - RNA, 18 nt, Human
ugauuaaguaaugauaac

SEQ ID NO: 1387224 - RNA, 12 nt, Human
agccacuccucu

SEQ ID NO: 1387225 - RNA, 22 nt, Human
agccacuaaccuugccugguac

SEQ ID NO: 1387226 - RNA, 20 nt, Human
agccacuaaccuugccuggu

SEQ ID NO: 1387227 - RNA, 19 nt, Human
agccacuaaccuugccugg

SEQ ID NO: 1387228 - RNA, 23 nt, Human
ugauuaaguaaugauaacuggaa

SEQ ID NO: 1387229 - RNA, 15 nt, Human
ugauccuggaggccc

SEQ ID NO: 1387230 - RNA, 14 nt, Human
ugauccuggaggcc

SEQ ID NO: 1387231 - RNA, 22 nt, Human
agcaccugcccuaccugcccca

SEQ ID NO: 1387232 - RNA, 18 nt, Human
agcaccugcccuaccugc

SEQ ID NO: 1387233 - RNA, 23 nt, Human
ugaugacuuucuuuuuguagcug

SEQ ID NO: 1387234 - RNA, 16 nt, Human
ugaugacccuuuucau

SEQ ID NO: 1387235 - RNA, 15 nt, Human
ugaugacccuuuuca

SEQ ID NO: 1387236 - RNA, 14 nt, Human
ugaugaccaaaguc

SEQ ID NO: 1387237 - RNA, 18 nt, Human
ugaugaacucuuaaucaa

SEQ ID NO: 1387238 - RNA, 18 nt, Human
ugauccuggaggcccagu

SEQ ID NO: 1387239 - RNA, 17 nt, Human
ugauccuggaggcccag

SEQ ID NO: 1387240 - RNA, 16 nt, Human
ugauccuggaggccca

SEQ ID NO: 1387241 - RNA, 12 nt, Human
ugaugaagaagu

SEQ ID NO: 1387242 - RNA, 11 nt, Human
ugaugaagaag

SEQ ID NO: 1387243 - RNA, 12 nt, Human
ugauggagaagg

SEQ ID NO: 1387244 - RNA, 13 nt, Human
ugauggagaagga

SEQ ID NO: 1387245 - RNA, 14 nt, Human
ugauggagaaggaa

SEQ ID NO: 1387246 - RNA, 15 nt, Human
ugauggagaaggaag

SEQ ID NO: 1387247 - RNA, 16 nt, Human
ugauggagaaggaagg

SEQ ID NO: 1387248 - RNA, 16 nt, Human
ugauggagugcuguuu

SEQ ID NO: 1387249 - RNA, 17 nt, Human
ugaugggauucuggaca

SEQ ID NO: 1387250 - RNA, 16 nt, Human
ugaugggauucuggac

SEQ ID NO: 1387251 - RNA, 14 nt, Human
ugaugggauuuggu

SEQ ID NO: 1387252 - RNA, 21 nt, Human
ugaugggaaguccggccccag

SEQ ID NO: 1387253 - RNA, 14 nt, Human
ugauggagugcugu

SEQ ID NO: 1387254 - RNA, 17 nt, Human
ugauggagaaggaaggc

SEQ ID NO: 1387255 - RNA, 17 nt, Human
ugauucauuuuaacauc

SEQ ID NO: 1387256 - RNA, 19 nt, Human
ugauucaugccaauuagca

SEQ ID NO: 1387257 - RNA, 19 nt, Human
ugauucauaguaacuucuu

SEQ ID NO: 1387258 - RNA, 18 nt, Human
ugauucauaguaacuucu

SEQ ID NO: 1387259 - RNA, 16 nt, Human
ugauucauaguaacuu

SEQ ID NO: 1387260 - RNA, 20 nt, Human
agcccagcugggucaggcag

SEQ ID NO: 1387261 - RNA, 19 nt, Human
agcccagcugggucaggca

SEQ ID NO: 1387262 - RNA, 12 nt, Human
agcccagccagc

SEQ ID NO: 1387263 - RNA, 17 nt, Human
agcccagcugggucagg

SEQ ID NO: 1387264 - RNA, 11 nt, Human
agcccagccag

SEQ ID NO: 1387265 - RNA, 21 nt, Human
agcccagcacugcuugaggaa

SEQ ID NO: 1387266 - RNA, 21 nt, Human
agcccagcugggucaggcagg

SEQ ID NO: 1387267 - RNA, 20 nt, Human
ugauuuaggagaagccagga

SEQ ID NO: 1387268 - RNA, 16 nt, Human
ugauuuaggagaagcc

SEQ ID NO: 1387269 - RNA, 20 nt, Human
ugauuuagcaggaagcugug

SEQ ID NO: 1387270 - RNA, 16 nt, Human
ugauuuacgcucauug

SEQ ID NO: 1387271 - RNA, 17 nt, Human
ugauuuagcaggaagcu

SEQ ID NO: 1387272 - RNA, 22 nt, Human
ugauuuaggagaagccaggaau

SEQ ID NO: 1387273 - RNA, 21 nt, Human
ugauuuaggagaagccaggaa

SEQ ID NO: 1387274 - RNA, 18 nt, Human
ugauuucaguucuaggaa

SEQ ID NO: 1387275 - RNA, 15 nt, Human
ugauuucaguucuag

SEQ ID NO: 1387276 - RNA, 22 nt, Human
ugauuucaguagcacaaguuau

SEQ ID NO: 1387277 - RNA, 20 nt, Human
ugauuucaguucuaggaaaa

SEQ ID NO: 1387278 - RNA, 19 nt, Human
ugauuucaguucuaggaaa

SEQ ID NO: 1387279 - RNA, 21 nt, Human
ugauuucaguucuaggaaaau

SEQ ID NO: 1387280 - RNA, 15 nt, Human
ugauuucauuaauac

SEQ ID NO: 1387281 - RNA, 22 nt, Human
ugauuuccguuaaaauaccagc

SEQ ID NO: 1387282 - RNA, 20 nt, Human
ugauuuguaacccacugaga

SEQ ID NO: 1387283 - RNA, 19 nt, Human
ugauuugaagaacauguga

SEQ ID NO: 1387284 - RNA, 17 nt, Human
ugauuugaagaacaugu

SEQ ID NO: 1387285 - RNA, 17 nt, Human
ugauuuggggauauuuu

SEQ ID NO: 1387286 - RNA, 11 nt, Human
ugauuucuagg

SEQ ID NO: 1387287 - RNA, 23 nt, Human
ugauuuccuugaauguggcuuga

SEQ ID NO: 1387288 - RNA, 19 nt, Human
ugauuuccuugaauguggc

SEQ ID NO: 1387289 - RNA, 17 nt, Human
ugauuuccuugaaugug

SEQ ID NO: 1387290 - RNA, 16 nt, Human
ugauuuccuugaaugu

SEQ ID NO: 1387291 - RNA, 15 nt, Human
ugauuuccuugaaug

SEQ ID NO: 1387292 - RNA, 14 nt, Human
ugauuuccuugaau

SEQ ID NO: 1387293 - RNA, 13 nt, Human
ugauuuccuugaa

SEQ ID NO: 1387294 - RNA, 22 nt, Human
agccagggagagcccaggagcu

SEQ ID NO: 1387295 - RNA, 21 nt, Human
agccagggagagcccaggagc

SEQ ID NO: 1387296 - RNA, 20 nt, Human
agccagggagagcccaggag

SEQ ID NO: 1387297 - RNA, 19 nt, Human
agccagggagagcccagga

SEQ ID NO: 1387298 - RNA, 18 nt, Human
agccagggagagcccagg

SEQ ID NO: 1387299 - RNA, 17 nt, Human
agccagggagagcccag

SEQ ID NO: 1387300 - RNA, 16 nt, Human
agccagggagagccca

SEQ ID NO: 1387301 - RNA, 15 nt, Human
agccagggagagccc

SEQ ID NO: 1387302 - RNA, 22 nt, Human
agccagcgucggucugugcccc

SEQ ID NO: 1387303 - RNA, 23 nt, Human
agccagcuaagggguggggcugc

SEQ ID NO: 1387304 - RNA, 20 nt, Human
agccagcgucggucugugcc

SEQ ID NO: 1387305 - RNA, 23 nt, Human
agccagcguccuccucugugacc

SEQ ID NO: 1387306 - RNA, 21 nt, Human
agccagcguccuccucuguga

SEQ ID NO: 1387307 - RNA, 19 nt, Human
agccagcguccuccucugu

SEQ ID NO: 1387308 - RNA, 18 nt, Human
agccagcguccuccucug

SEQ ID NO: 1387309 - RNA, 17 nt, Human
agccagcguccuccucu

SEQ ID NO: 1387310 - RNA, 16 nt, Human
agccagcguccuccuc

SEQ ID NO: 1387311 - RNA, 22 nt, Human
agccaucaccucagauggcagc

SEQ ID NO: 1387312 - RNA, 21 nt, Human
agccaucaccucagauggcag

SEQ ID NO: 1387313 - RNA, 19 nt, Human
agccaucaccucagauggc

SEQ ID NO: 1387314 - RNA, 18 nt, Human
agccaucaccucagaugg

SEQ ID NO: 1387315 - RNA, 16 nt, Human
agccaucaccucagau

SEQ ID NO: 1387316 - RNA, 15 nt, Human
agccaucaccucaga

SEQ ID NO: 1387317 - RNA, 17 nt, Human
agccaucaagagacuga

SEQ ID NO: 1387318 - RNA, 18 nt, Human
agccaucaaaaugcuuuu

SEQ ID NO: 1387319 - RNA, 22 nt, Human
agccaguaaaugggggugcauu

SEQ ID NO: 1387320 - RNA, 21 nt, Human
agccaguaaaugggggugcau

SEQ ID NO: 1387321 - RNA, 15 nt, Human
agccaggucccucuc

SEQ ID NO: 1387322 - RNA, 13 nt, Human
agccagggcucaa

SEQ ID NO: 1387323 - RNA, 18 nt, Human
agccagguuccacagagg

SEQ ID NO: 1387324 - RNA, 12 nt, Human
agccaggucccu

SEQ ID NO: 1387325 - RNA, 13 nt, Human
agccaguaaaugg

SEQ ID NO: 1387326 - RNA, 15 nt, Human
agcccagcacugcuu

SEQ ID NO: 1387327 - RNA, 21 nt, Human
agcccagagggucugggggca

SEQ ID NO: 1387328 - RNA, 20 nt, Human
agcccagagggucugggggc

SEQ ID NO: 1387329 - RNA, 17 nt, Human
agcccagagggucuggg

SEQ ID NO: 1387330 - RNA, 15 nt, Human
agcccagagggucug

SEQ ID NO: 1387331 - RNA, 23 nt, Human
agcccacuguccugggccugcag

SEQ ID NO: 1387332 - RNA, 22 nt, Human
agcccacuguccugggccugca

SEQ ID NO: 1387333 - RNA, 20 nt, Human
agcccacuguccugggccug

SEQ ID NO: 1387334 - RNA, 19 nt, Human
agcccacuguccugggccu

SEQ ID NO: 1387335 - RNA, 18 nt, Human
agcccacuguccugggcc

SEQ ID NO: 1387336 - RNA, 17 nt, Human
agcccacuguccugggc

SEQ ID NO: 1387337 - RNA, 15 nt, Human
agcccacuguccugg

SEQ ID NO: 1387338 - RNA, 23 nt, Human
agccaugcgcccccuccgcccug

SEQ ID NO: 1387339 - RNA, 16 nt, Human
agccaugcgcccccuc

SEQ ID NO: 1387340 - RNA, 23 nt, Human
agccaugaguuccagaaaguaaa

SEQ ID NO: 1387341 - RNA, 21 nt, Human
agccaugagaugauacaucca

SEQ ID NO: 1387342 - RNA, 18 nt, Human
agccaucccgucuucucc

SEQ ID NO: 1387343 - RNA, 22 nt, Human
agccauggagauucucauaacu

SEQ ID NO: 1387344 - RNA, 19 nt, Human
agccauggagauucucaua

SEQ ID NO: 1387345 - RNA, 18 nt, Human
agccaugcuggaaaauaa

SEQ ID NO: 1387346 - RNA, 14 nt, Human
agcccacuguacuu

SEQ ID NO: 1387347 - RNA, 14 nt, Human
agcccacuguccug

SEQ ID NO: 1387348 - RNA, 20 nt, Human
agccauggagauucucauaa

SEQ ID NO: 1387349 - RNA, 16 nt, Human
agcccacuguacuugc

SEQ ID NO: 1387350 - RNA, 15 nt, Human
agcccgcacaccugc

SEQ ID NO: 1387351 - RNA, 14 nt, Human
agcccgaggaggug

SEQ ID NO: 1387352 - RNA, 23 nt, Human
agccccuuucccuuguagcuccu

SEQ ID NO: 1387353 - RNA, 21 nt, Human
agccccuuucccuuguagcuc

SEQ ID NO: 1387354 - RNA, 14 nt, Human
agccccuuucccuu

SEQ ID NO: 1387355 - RNA, 14 nt, Human
agccccugaaagcc

SEQ ID NO: 1387356 - RNA, 14 nt, Human
agccccugccauug

SEQ ID NO: 1387357 - RNA, 16 nt, Human
agccccugaaagccau

SEQ ID NO: 1387358 - RNA, 23 nt, Human
agccccucuuggagaagucucag

SEQ ID NO: 1387359 - RNA, 20 nt, Human
agccccucuuggagaagucu

SEQ ID NO: 1387360 - RNA, 18 nt, Human
agccccucuuggagaagu

SEQ ID NO: 1387361 - RNA, 17 nt, Human
agccccucuuggagaag

SEQ ID NO: 1387362 - RNA, 15 nt, Human
agccccucuuggaga

SEQ ID NO: 1387363 - RNA, 22 nt, Human
agcccccugaccacucagagac

SEQ ID NO: 1387364 - RNA, 22 nt, Human
agccccucuggucgcuccugcc

SEQ ID NO: 1387365 - RNA, 21 nt, Human
agccccucuggucgcuccugc

SEQ ID NO: 1387366 - RNA, 21 nt, Human
agcccccugaccacucagaga

SEQ ID NO: 1387367 - RNA, 20 nt, Human
agcccccugaccacucagag

SEQ ID NO: 1387368 - RNA, 19 nt, Human
agcccccugaccacucaga

SEQ ID NO: 1387369 - RNA, 12 nt, Human
agcccccugacc

SEQ ID NO: 1387370 - RNA, 21 nt, Human
agcccccuccuggugccaccu

SEQ ID NO: 1387371 - RNA, 20 nt, Human
agcccccuccuggugccacc

SEQ ID NO: 1387372 - RNA, 13 nt, Human
agcccccuccugg

SEQ ID NO: 1387373 - RNA, 23 nt, Human
agcccccucacaguauugcucac

SEQ ID NO: 1387374 - RNA, 22 nt, Human
agcccccucacaguauugcuca

SEQ ID NO: 1387375 - RNA, 14 nt, Human
agcccccucacagu

SEQ ID NO: 1387376 - RNA, 11 nt, Human
agcccccucac

SEQ ID NO: 1387377 - RNA, 19 nt, Human
agcccccuaagagagcacc

SEQ ID NO: 1387378 - RNA, 22 nt, Human
agcccuggcaugucaacagcgu

SEQ ID NO: 1387379 - RNA, 14 nt, Human
agcccggcuccugg

SEQ ID NO: 1387380 - RNA, 13 nt, Human
agcccggcuccug

SEQ ID NO: 1387381 - RNA, 12 nt, Human
agcccggcuccu

SEQ ID NO: 1387382 - RNA, 23 nt, Human
agcccugccuggaggaccugagc

SEQ ID NO: 1387383 - RNA, 21 nt, Human
agcccugccuggaggaccuga

SEQ ID NO: 1387384 - RNA, 20 nt, Human
agcccugccuggaggaccug

SEQ ID NO: 1387385 - RNA, 16 nt, Human
agcccggcuccugguc

SEQ ID NO: 1387386 - RNA, 15 nt, Human
agcccggcuccuggu

SEQ ID NO: 1387387 - RNA, 19 nt, Human
agcccugccuggaggaccu

SEQ ID NO: 1387388 - RNA, 20 nt, Human
agcccugcugcugccugccu

SEQ ID NO: 1387389 - RNA, 22 nt, Human
agcccugccuggaggaccugag

SEQ ID NO: 1387390 - RNA, 18 nt, Human
agcccugcugcugccugc

SEQ ID NO: 1387391 - RNA, 19 nt, Human
agcccugcugcugccugcc

SEQ ID NO: 1387392 - RNA, 15 nt, Human
agcccugggaccgcu

SEQ ID NO: 1387393 - RNA, 14 nt, Human
agcccugggaccgc

SEQ ID NO: 1387394 - RNA, 13 nt, Human
agcccugggaccg

SEQ ID NO: 1387395 - RNA, 11 nt, Human
agcccugggac

SEQ ID NO: 1387396 - RNA, 20 nt, Human
agcccugggaccgcuacacc

SEQ ID NO: 1387397 - RNA, 17 nt, Human
agcccugggaggcucug

SEQ ID NO: 1387398 - RNA, 20 nt, Human
ugcaauaaaucugacccagu

SEQ ID NO: 1387399 - RNA, 23 nt, Human
ugcaauaaaucugacccagugcc

SEQ ID NO: 1387400 - RNA, 21 nt, Human
ugcaauaaaucugacccagug

SEQ ID NO: 1387401 - RNA, 23 nt, Human
agcccaggagcuccccuccccaa

SEQ ID NO: 1387402 - RNA, 19 nt, Human
agcccaggagcuccccucc

SEQ ID NO: 1387403 - RNA, 18 nt, Human
agcccaggagcuccccuc

SEQ ID NO: 1387404 - RNA, 14 nt, Human
agcccaggagcucc

SEQ ID NO: 1387405 - RNA, 12 nt, Human
agcccaggagcu

SEQ ID NO: 1387406 - RNA, 16 nt, Human
ugcaauauacuggaaa

SEQ ID NO: 1387407 - RNA, 20 nt, Human
ugcaauauacuggaaagcuu

SEQ ID NO: 1387408 - RNA, 15 nt, Human
ugcaauauacuggaa

SEQ ID NO: 1387409 - RNA, 16 nt, Human
ugcaauagaaggugau

SEQ ID NO: 1387410 - RNA, 14 nt, Human
ugcaauacauacca

SEQ ID NO: 1387411 - RNA, 23 nt, Human
ugcaagucaguccaggaugcuaa

SEQ ID NO: 1387412 - RNA, 22 nt, Human
ugcaaacugggaaccccuuucc

SEQ ID NO: 1387413 - RNA, 23 nt, Human
ugcaaacugggaaccccuuuccc

SEQ ID NO: 1387414 - RNA, 13 nt, Human
ugcaaacugggaa

SEQ ID NO: 1387415 - RNA, 11 nt, Human
ugcaaacuggg

SEQ ID NO: 1387416 - RNA, 20 nt, Human
ugcaaacucuuuggucguuu

SEQ ID NO: 1387417 - RNA, 23 nt, Human
ugcaaaccugaccccugcucagu

SEQ ID NO: 1387418 - RNA, 22 nt, Human
ugcaaaccugaccccugcucag

SEQ ID NO: 1387419 - RNA, 17 nt, Human
ugauuuguaacccacug

SEQ ID NO: 1387420 - RNA, 18 nt, Human
ugauuuguacugaaaaau

SEQ ID NO: 1387421 - RNA, 15 nt, Human
ugauuuguacugaaa

SEQ ID NO: 1387422 - RNA, 19 nt, Human
agcccauuguggccuaaga

SEQ ID NO: 1387423 - RNA, 22 nt, Human
agcccauuguggccuaagaggc

SEQ ID NO: 1387424 - RNA, 16 nt, Human
agcccauuguggccua

SEQ ID NO: 1387425 - RNA, 20 nt, Human
agcccaggcucggccugccc

SEQ ID NO: 1387426 - RNA, 21 nt, Human
agcccaggccaggacucugca

SEQ ID NO: 1387427 - RNA, 20 nt, Human
agcccaggccaggacucugc

SEQ ID NO: 1387428 - RNA, 19 nt, Human
agcccaggccaggacucug

SEQ ID NO: 1387429 - RNA, 22 nt, Human
agcccaggccaggacucugcag

SEQ ID NO: 1387430 - RNA, 16 nt, Human
agcccaggccaggacu

SEQ ID NO: 1387431 - RNA, 15 nt, Human
agcccaggccaggac

SEQ ID NO: 1387432 - RNA, 14 nt, Human
agcccaggccagga

SEQ ID NO: 1387433 - RNA, 13 nt, Human
agcccaggccagg

SEQ ID NO: 1387434 - RNA, 23 nt, Human
agcccagggcuccugcacuuacu

SEQ ID NO: 1387435 - RNA, 17 nt, Human
agcccagggcuccugca

SEQ ID NO: 1387436 - RNA, 16 nt, Human
agcccagggcuccugc

SEQ ID NO: 1387437 - RNA, 15 nt, Human
agcccagggcuccug

SEQ ID NO: 1387438 - RNA, 14 nt, Human
agcccagggcuccu

SEQ ID NO: 1387439 - RNA, 16 nt, Human
agcccagggaggccga

SEQ ID NO: 1387440 - RNA, 14 nt, Human
agcccauucauucc

SEQ ID NO: 1387441 - RNA, 17 nt, Human
agcccauucauuccauu

SEQ ID NO: 1387442 - RNA, 22 nt, Human
agcccauucauuccauucugga

SEQ ID NO: 1387443 - RNA, 23 nt, Human
agcccauucauuccauucuggaa

SEQ ID NO: 1387444 - RNA, 15 nt, Human
agcccuuuccaagcu

SEQ ID NO: 1387445 - RNA, 21 nt, Human
agcccuugugaaucaaggguc

SEQ ID NO: 1387446 - RNA, 21 nt, Human
agcccuuuacuugaccuccua

SEQ ID NO: 1387447 - RNA, 23 nt, Human
agcccuuggggguccuccuccag

SEQ ID NO: 1387448 - RNA, 22 nt, Human
agcccuuggggguccuccucca

SEQ ID NO: 1387449 - RNA, 21 nt, Human
agcccuuggggguccuccucc

SEQ ID NO: 1387450 - RNA, 14 nt, Human
agcccuuggggguc

SEQ ID NO: 1387451 - RNA, 21 nt, Human
agcccuguccuggugguauuu

SEQ ID NO: 1387452 - RNA, 23 nt, Human
agcccuguccuggugguauuuuc

SEQ ID NO: 1387453 - RNA, 11 nt, Human
agcccugucuc

SEQ ID NO: 1387454 - RNA, 18 nt, Human
agcccugucuccucucuc

SEQ ID NO: 1387455 - RNA, 17 nt, Human
agcccuguccugguggu

SEQ ID NO: 1387456 - RNA, 16 nt, Human
agcccuguccuggugg

SEQ ID NO: 1387457 - RNA, 14 nt, Human
agcccuguccuggu

SEQ ID NO: 1387458 - RNA, 14 nt, Human
ugcagacucacugu

SEQ ID NO: 1387459 - RNA, 19 nt, Human
ugcagacccugcccuuguu

SEQ ID NO: 1387460 - RNA, 15 nt, Human
ugcagacccugcccu

SEQ ID NO: 1387461 - RNA, 23 nt, Human
ugcagaccacgcccguccugccu

SEQ ID NO: 1387462 - RNA, 17 nt, Human
ugcagaagaaggcaucg

SEQ ID NO: 1387463 - RNA, 16 nt, Human
ugcagaagaaggcauc

SEQ ID NO: 1387464 - RNA, 12 nt, Human
ugcacacauuuu

SEQ ID NO: 1387465 - RNA, 13 nt, Human
ugcacacauuuuu

SEQ ID NO: 1387466 - RNA, 15 nt, Human
ugcacacauuuuuua

SEQ ID NO: 1387467 - RNA, 20 nt, Human
ugcacacauuuuuuaaaugc

SEQ ID NO: 1387468 - RNA, 22 nt, Human
agccucugggggguggccaggc

SEQ ID NO: 1387469 - RNA, 21 nt, Human
agccucugggggguggccagg

SEQ ID NO: 1387470 - RNA, 20 nt, Human
agccucugggggguggccag

SEQ ID NO: 1387471 - RNA, 13 nt, Human
agccucugggggg

SEQ ID NO: 1387472 - RNA, 23 nt, Human
agccucuggcauuagaauuauuu

SEQ ID NO: 1387473 - RNA, 22 nt, Human
agccucuggcauuagaauuauu

SEQ ID NO: 1387474 - RNA, 22 nt, Human
agccuccaccccacaacccaaa

SEQ ID NO: 1387475 - RNA, 14 nt, Human
agccuccaauuuuu

SEQ ID NO: 1387476 - RNA, 22 nt, Human
agccucugcccaggcacugcua

SEQ ID NO: 1387477 - RNA, 18 nt, Human
agccucugcccaggcacu

SEQ ID NO: 1387478 - RNA, 22 nt, Human
agccucugcagcggaaucuguu

SEQ ID NO: 1387479 - RNA, 15 nt, Human
agccucaauuucuga

SEQ ID NO: 1387480 - RNA, 23 nt, Human
agccucaagguuuuagguucuaa

SEQ ID NO: 1387481 - RNA, 21 nt, Human
agccucaagucuuauuuccuc

SEQ ID NO: 1387482 - RNA, 22 nt, Human
agccucaagguuuuagguucua

SEQ ID NO: 1387483 - RNA, 21 nt, Human
agccucaagguuuuagguucu

SEQ ID NO: 1387484 - RNA, 21 nt, Human
agccucagugacccuggcucc

SEQ ID NO: 1387485 - RNA, 20 nt, Human
agccucagugacccuggcuc

SEQ ID NO: 1387486 - RNA, 18 nt, Human
agccucagauuccuuccc

SEQ ID NO: 1387487 - RNA, 23 nt, Human
agccucagauuccuucccaugga

SEQ ID NO: 1387488 - RNA, 17 nt, Human
agccucagauuccuucc

SEQ ID NO: 1387489 - RNA, 16 nt, Human
agccucagauuccuuc

SEQ ID NO: 1387490 - RNA, 14 nt, Human
agccucagauuccu

SEQ ID NO: 1387491 - RNA, 23 nt, Human
agccucagagacaucagcccuug

SEQ ID NO: 1387492 - RNA, 20 nt, Human
agccucagagacaucagccc

SEQ ID NO: 1387493 - RNA, 22 nt, Human
agccucacuuuuaaugaacaaa

SEQ ID NO: 1387494 - RNA, 23 nt, Human
agccucacuuuuaaugaacaaau

SEQ ID NO: 1387495 - RNA, 20 nt, Human
agccucaggggucugagcuc

SEQ ID NO: 1387496 - RNA, 23 nt, Human
agccucaggggucugagcuccag

SEQ ID NO: 1387497 - RNA, 23 nt, Human
agccucaggacugggagccccca

SEQ ID NO: 1387498 - RNA, 21 nt, Human
agccucaggacugggagcccc

SEQ ID NO: 1387499 - RNA, 19 nt, Human
agccucaggacugggagcc

SEQ ID NO: 1387500 - RNA, 18 nt, Human
agccucaggacugggagc

SEQ ID NO: 1387501 - RNA, 17 nt, Human
agccucaggacugggag

SEQ ID NO: 1387502 - RNA, 16 nt, Human
agccucaggacuggga

SEQ ID NO: 1387503 - RNA, 13 nt, Human
agccucaggacug

SEQ ID NO: 1387504 - RNA, 23 nt, Human
agccucagcucucaguugcagcc

SEQ ID NO: 1387505 - RNA, 12 nt, Human
ugcccaggagaa

SEQ ID NO: 1387506 - RNA, 11 nt, Human
ugcccaggaga

SEQ ID NO: 1387507 - RNA, 19 nt, Human
ugcccaacccuucccucac

SEQ ID NO: 1387508 - RNA, 20 nt, Human
ugcccaaauccuuagaucug

SEQ ID NO: 1387509 - RNA, 23 nt, Human
ugcccaaagcagcacuuauaaau

SEQ ID NO: 1387510 - RNA, 23 nt, Human
ugccauuuguacugaccccauca

SEQ ID NO: 1387511 - RNA, 22 nt, Human
ugcccccugcagaaccggagag

SEQ ID NO: 1387512 - RNA, 14 nt, Human
ugcccccugcagaa

SEQ ID NO: 1387513 - RNA, 13 nt, Human
ugcccccugcaga

SEQ ID NO: 1387514 - RNA, 12 nt, Human
ugcccccugcag

SEQ ID NO: 1387515 - RNA, 20 nt, Human
ugcccuaaaguguauuuuuu

SEQ ID NO: 1387516 - RNA, 23 nt, Human
ugcccccuaauccccuucucccc

SEQ ID NO: 1387517 - RNA, 21 nt, Human
ugcccccuaauccccuucucc

SEQ ID NO: 1387518 - RNA, 16 nt, Human
ugcccccaaccauuuc

SEQ ID NO: 1387519 - RNA, 21 nt, Human
ugcccccaaccauuuccucag

SEQ ID NO: 1387520 - RNA, 16 nt, Human
ugccccauucaacauc

SEQ ID NO: 1387521 - RNA, 20 nt, Human
agcuacccuuuuucuccagc

SEQ ID NO: 1387522 - RNA, 17 nt, Human
agcuacccgcagaguuc

SEQ ID NO: 1387523 - RNA, 15 nt, Human
agcuacauaauuuag

SEQ ID NO: 1387524 - RNA, 16 nt, Human
agcuagucuuuugcuu

SEQ ID NO: 1387525 - RNA, 23 nt, Human
agcuacagagaaaccagcuuccu

SEQ ID NO: 1387526 - RNA, 22 nt, Human
agcuacagagaaaccagcuucc

SEQ ID NO: 1387527 - RNA, 21 nt, Human
agcuacagagaaaccagcuuc

SEQ ID NO: 1387528 - RNA, 20 nt, Human
agcuacagagaaaccagcuu

SEQ ID NO: 1387529 - RNA, 19 nt, Human
agcuacagagaaaccagcu

SEQ ID NO: 1387530 - RNA, 18 nt, Human
agcuacagagaaaccagc

SEQ ID NO: 1387531 - RNA, 17 nt, Human
agcuacagagaaaccag

SEQ ID NO: 1387532 - RNA, 16 nt, Human
agcgucggucugugcc

SEQ ID NO: 1387533 - RNA, 18 nt, Human
agcgucuuucuuuuuugg

SEQ ID NO: 1387534 - RNA, 15 nt, Human
agcgucggucugugc

SEQ ID NO: 1387535 - RNA, 19 nt, Human
agcguccuccucugugacc

SEQ ID NO: 1387536 - RNA, 16 nt, Human
agcuacagagaaacca

SEQ ID NO: 1387537 - RNA, 15 nt, Human
agcuacagagaaacc

SEQ ID NO: 1387538 - RNA, 18 nt, Human
agcuauccggacagagca

SEQ ID NO: 1387539 - RNA, 20 nt, Human
agcuaucauugcuuccuccu

SEQ ID NO: 1387540 - RNA, 20 nt, Human
agcuagugacccacaugcca

SEQ ID NO: 1387541 - RNA, 21 nt, Human
agcuagugacccacaugccau

SEQ ID NO: 1387542 - RNA, 18 nt, Human
agcuagugacccacaugc

SEQ ID NO: 1387543 - RNA, 17 nt, Human
agcuagugacccacaug

SEQ ID NO: 1387544 - RNA, 23 nt, Human
agcuagucuuuugcuuuugccca

SEQ ID NO: 1387545 - RNA, 19 nt, Human
agcuagucuuuugcuuuug

SEQ ID NO: 1387546 - RNA, 20 nt, Human
agcuaugucccaggaaucag

SEQ ID NO: 1387547 - RNA, 20 nt, Human
agcuauguuauauugaaaaa

SEQ ID NO: 1387548 - RNA, 22 nt, Human
agcuauguuauauugaaaaaau

SEQ ID NO: 1387549 - RNA, 18 nt, Human
agcuauguuauauugaaa

SEQ ID NO: 1387550 - RNA, 17 nt, Human
agcuaucguaaaauuaa

SEQ ID NO: 1387551 - RNA, 22 nt, Human
agcucaggaugagggaaaagaa

SEQ ID NO: 1387552 - RNA, 18 nt, Human
agcucaggaugagggaaa

SEQ ID NO: 1387553 - RNA, 15 nt, Human
ugccauuuguacuga

SEQ ID NO: 1387554 - RNA, 20 nt, Human
ugccauuguagcgucuuucu

SEQ ID NO: 1387555 - RNA, 15 nt, Human
agcuccaagccccau

SEQ ID NO: 1387556 - RNA, 18 nt, Human
agcuccaagaauuucuag

SEQ ID NO: 1387557 - RNA, 22 nt, Human
agcuccaaccugcaaagaucug

SEQ ID NO: 1387558 - RNA, 15 nt, Human
agcuccaagaauuuc

SEQ ID NO: 1387559 - RNA, 20 nt, Human
agcggcuugccugccugcuc

SEQ ID NO: 1387560 - RNA, 17 nt, Human
agcguccuccucuguga

SEQ ID NO: 1387561 - RNA, 16 nt, Human
agcguccuccucugug

SEQ ID NO: 1387562 - RNA, 15 nt, Human
agcguccuccucugu

SEQ ID NO: 1387563 - RNA, 22 nt, Human
ugccagugacagacaggcucuu

SEQ ID NO: 1387564 - RNA, 20 nt, Human
ugccagugacagacaggcuc

SEQ ID NO: 1387565 - RNA, 19 nt, Human
ugccagugacagacaggcu

SEQ ID NO: 1387566 - RNA, 17 nt, Human
ugccagugacagacagg

SEQ ID NO: 1387567 - RNA, 16 nt, Human
ugccagugacagacag

SEQ ID NO: 1387568 - RNA, 14 nt, Human
ugccaguccugucc

SEQ ID NO: 1387569 - RNA, 15 nt, Human
ugccaguccuguccu

SEQ ID NO: 1387570 - RNA, 13 nt, Human
ugccaguccuguc

SEQ ID NO: 1387571 - RNA, 15 nt, Human
ugccagcugcacuga

SEQ ID NO: 1387572 - RNA, 13 nt, Human
ugccagccaagcu

SEQ ID NO: 1387573 - RNA, 23 nt, Human
ugccagcucuguaucaggaccca

SEQ ID NO: 1387574 - RNA, 21 nt, Human
ugccagccaagcucugcaguc

SEQ ID NO: 1387575 - RNA, 22 nt, Human
ugccagaggcugaugucaagca

SEQ ID NO: 1387576 - RNA, 20 nt, Human
ugccagagccuggggcucua

SEQ ID NO: 1387577 - RNA, 19 nt, Human
ugccagagccuggggcucu

SEQ ID NO: 1387578 - RNA, 18 nt, Human
ugccagagccuggggcuc

SEQ ID NO: 1387579 - RNA, 17 nt, Human
ugccagagccuggggcu

SEQ ID NO: 1387580 - RNA, 16 nt, Human
ugccagagccuggggc

SEQ ID NO: 1387581 - RNA, 15 nt, Human
ugccagagccugggg

SEQ ID NO: 1387582 - RNA, 14 nt, Human
ugccagagccuggg

SEQ ID NO: 1387583 - RNA, 13 nt, Human
ugccagagccugg

SEQ ID NO: 1387584 - RNA, 12 nt, Human
ugccagagccug

SEQ ID NO: 1387585 - RNA, 11 nt, Human
ugccagagccu

SEQ ID NO: 1387586 - RNA, 14 nt, Human
ugccagagauccaa

SEQ ID NO: 1387587 - RNA, 20 nt, Human
ugcauuuaugagcucuucau

SEQ ID NO: 1387588 - RNA, 20 nt, Human
ugcauuugaggucuguucuu

SEQ ID NO: 1387589 - RNA, 21 nt, Human
ugcauuugaggucuguucuuu

SEQ ID NO: 1387590 - RNA, 19 nt, Human
agccuugccagagauccaa

SEQ ID NO: 1387591 - RNA, 17 nt, Human
agccuugccagagaucc

SEQ ID NO: 1387592 - RNA, 15 nt, Human
agccuugccagagau

SEQ ID NO: 1387593 - RNA, 14 nt, Human
agccuugccagaga

SEQ ID NO: 1387594 - RNA, 13 nt, Human
agccuugccagag

SEQ ID NO: 1387595 - RNA, 14 nt, Human
agccuucucuguuc

SEQ ID NO: 1387596 - RNA, 23 nt, Human
agccuugaacuuugaccucugca

SEQ ID NO: 1387597 - RNA, 16 nt, Human
agccuugaacuuugac

SEQ ID NO: 1387598 - RNA, 22 nt, Human
agccuugaacuuugaccucugc

SEQ ID NO: 1387599 - RNA, 23 nt, Human
agccuuccccuuauccucccugu

SEQ ID NO: 1387600 - RNA, 21 nt, Human
agccuuccccuuauccucccu

SEQ ID NO: 1387601 - RNA, 20 nt, Human
agccuuccccuaccccuugu

SEQ ID NO: 1387602 - RNA, 16 nt, Human
agccuuccccuacccc

SEQ ID NO: 1387603 - RNA, 12 nt, Human
agccuucucugu

SEQ ID NO: 1387604 - RNA, 15 nt, Human
agccuugaacuuuga

SEQ ID NO: 1387605 - RNA, 20 nt, Human
ugcagcucuccccuucucug

SEQ ID NO: 1387606 - RNA, 22 nt, Human
ugcagcucuccccuucucugua

SEQ ID NO: 1387607 - RNA, 22 nt, Human
agcggaacaaggagucagacau

SEQ ID NO: 1387608 - RNA, 17 nt, Human
agcggaacaaggaguca

SEQ ID NO: 1387609 - RNA, 16 nt, Human
agcgcugucaggauug

SEQ ID NO: 1387610 - RNA, 21 nt, Human
agcgcugucaggauugcgaga

SEQ ID NO: 1387611 - RNA, 23 nt, Human
agcgcaguuuuuuuuuucuuguc

SEQ ID NO: 1387612 - RNA, 14 nt, Human
agcgcaguuuuuuu

SEQ ID NO: 1387613 - RNA, 12 nt, Human
ugcauucuagua

SEQ ID NO: 1387614 - RNA, 14 nt, Human
ugcauucccagcuc

SEQ ID NO: 1387615 - RNA, 20 nt, Human
ugcauucugccucucuagga

SEQ ID NO: 1387616 - RNA, 19 nt, Human
ugcauucugccucucuagg

SEQ ID NO: 1387617 - RNA, 15 nt, Human
ugcauucugccucuc

SEQ ID NO: 1387618 - RNA, 14 nt, Human
ugcauucugccucu

SEQ ID NO: 1387619 - RNA, 20 nt, Human
ugcauuuaaaagauacaguu

SEQ ID NO: 1387620 - RNA, 19 nt, Human
ugcauuugaggucuguucu

SEQ ID NO: 1387621 - RNA, 24 nt, Human
ugcauuuaaauacagucuuccauu

SEQ ID NO: 1387622 - RNA, 22 nt, Human
ugcauuuaaauacagucuucca

SEQ ID NO: 1387623 - RNA, 16 nt, Human
ugcauuuaaauacagu

SEQ ID NO: 1387624 - RNA, 13 nt, Human
ugcauuuauaugu

SEQ ID NO: 1387625 - RNA, 14 nt, Human
ugcauuuauaugua

SEQ ID NO: 1387626 - RNA, 19 nt, Human
ugcauuuaugagcucuuca

SEQ ID NO: 1387627 - RNA, 16 nt, Human
ugcauuuauauguacc

SEQ ID NO: 1387628 - RNA, 16 nt, Human
agcucuucauguuuca

SEQ ID NO: 1387629 - RNA, 13 nt, Human
agcucuucauguu

SEQ ID NO: 1387630 - RNA, 16 nt, Human
agcucuuaacuacagu

SEQ ID NO: 1387631 - RNA, 23 nt, Human
agcucuguucuuccucagccagc

SEQ ID NO: 1387632 - RNA, 22 nt, Human
agcucuguucuuccucagccag

SEQ ID NO: 1387633 - RNA, 21 nt, Human
agcucuguucuuccucagcca

SEQ ID NO: 1387634 - RNA, 20 nt, Human
agcucuguucuuccucagcc

SEQ ID NO: 1387635 - RNA, 19 nt, Human
agcucuguucuuccucagc

SEQ ID NO: 1387636 - RNA, 18 nt, Human
agcucuguucuuccucag

SEQ ID NO: 1387637 - RNA, 17 nt, Human
agcucuguucuuccuca

SEQ ID NO: 1387638 - RNA, 15 nt, Human
agcucuguucuuccu

SEQ ID NO: 1387639 - RNA, 20 nt, Human
agcucuggaggggaggggga

SEQ ID NO: 1387640 - RNA, 19 nt, Human
agcucuggaggggaggggg

SEQ ID NO: 1387641 - RNA, 18 nt, Human
agcucuggaggggagggg

SEQ ID NO: 1387642 - RNA, 17 nt, Human
agcucuggaggggaggg

SEQ ID NO: 1387643 - RNA, 16 nt, Human
agcucuggaggggagg

SEQ ID NO: 1387644 - RNA, 12 nt, Human
agcucuggaggg

SEQ ID NO: 1387645 - RNA, 15 nt, Human
agcucuagaaucugc

SEQ ID NO: 1387646 - RNA, 14 nt, Human
agcucuagaaucug

SEQ ID NO: 1387647 - RNA, 13 nt, Human
agcucuagaaucu

SEQ ID NO: 1387648 - RNA, 17 nt, Human
agcucuacugccucaac

SEQ ID NO: 1387649 - RNA, 14 nt, Human
agcucuacccugca

SEQ ID NO: 1387650 - RNA, 10 nt, Human
agcucugagc

SEQ ID NO: 1387651 - RNA, 23 nt, Human
agcucugagaggcccuggaucag

SEQ ID NO: 1387652 - RNA, 15 nt, Human
agcucugagggaaag

SEQ ID NO: 1387653 - RNA, 12 nt, Human
agcucugaggga

SEQ ID NO: 1387654 - RNA, 16 nt, Human
agcucugagcugucaa

SEQ ID NO: 1387655 - RNA, 15 nt, Human
agcucugagcuguca

SEQ ID NO: 1387656 - RNA, 14 nt, Human
agcucugagcuguc

SEQ ID NO: 1387657 - RNA, 13 nt, Human
agcucugagcugu

SEQ ID NO: 1387658 - RNA, 12 nt, Human
agcucugagcug

SEQ ID NO: 1387659 - RNA, 12 nt, Human
agcucugcauua

SEQ ID NO: 1387660 - RNA, 21 nt, Human
agcucuggacagccccacccu

SEQ ID NO: 1387661 - RNA, 13 nt, Human
agcucugcauuau

SEQ ID NO: 1387662 - RNA, 18 nt, Human
agcucuggacagccccac

SEQ ID NO: 1387663 - RNA, 17 nt, Human
agcucuggacagcccca

SEQ ID NO: 1387664 - RNA, 15 nt, Human
agcucccccucccuc

SEQ ID NO: 1387665 - RNA, 23 nt, Human
agcucccccagcaaagcccccag

SEQ ID NO: 1387666 - RNA, 19 nt, Human
agcucccccagcaaagccc

SEQ ID NO: 1387667 - RNA, 22 nt, Human
agcuccuugagggcaagagcca

SEQ ID NO: 1387668 - RNA, 21 nt, Human
agcuccuugagggcaagagcc

SEQ ID NO: 1387669 - RNA, 21 nt, Human
agcucccaccuccccuugggc

SEQ ID NO: 1387670 - RNA, 19 nt, Human
agcucccaccuccccuugg

SEQ ID NO: 1387671 - RNA, 14 nt, Human
agcucccaccuccc

SEQ ID NO: 1387672 - RNA, 11 nt, Human
agcucccaccu

SEQ ID NO: 1387673 - RNA, 19 nt, Human
agcucccacaagccugagg

SEQ ID NO: 1387674 - RNA, 17 nt, Human
agcucccacaagccuga

SEQ ID NO: 1387675 - RNA, 16 nt, Human
agcucccacaagccug

SEQ ID NO: 1387676 - RNA, 20 nt, Human
agcucccacaagccucugcc

SEQ ID NO: 1387677 - RNA, 18 nt, Human
agcucccacaagccucug

SEQ ID NO: 1387678 - RNA, 17 nt, Human
agcucccacaagccucu

SEQ ID NO: 1387679 - RNA, 16 nt, Human
agcucccacaagccuc

SEQ ID NO: 1387680 - RNA, 16 nt, Human
agcuccagccugacau

SEQ ID NO: 1387681 - RNA, 19 nt, Human
agcuccagcuccuuugggc

SEQ ID NO: 1387682 - RNA, 15 nt, Human
agcuccagccugaca

SEQ ID NO: 1387683 - RNA, 14 nt, Human
agcuccagccugac

SEQ ID NO: 1387684 - RNA, 13 nt, Human
agcuccagccuga

SEQ ID NO: 1387685 - RNA, 15 nt, Human
ugcccucugggcucu

SEQ ID NO: 1387686 - RNA, 14 nt, Human
ugcccucugggcuc

SEQ ID NO: 1387687 - RNA, 13 nt, Human
ugcccucugggcu

SEQ ID NO: 1387688 - RNA, 12 nt, Human
ugcccucugggc

SEQ ID NO: 1387689 - RNA, 20 nt, Human
ugcccucugcauccucugga

SEQ ID NO: 1387690 - RNA, 17 nt, Human
ugcccucucccacccuc

SEQ ID NO: 1387691 - RNA, 16 nt, Human
ugcccucucccacccu

SEQ ID NO: 1387692 - RNA, 15 nt, Human
ugcccucucccaccc

SEQ ID NO: 1387693 - RNA, 13 nt, Human
ugcccucucccac

SEQ ID NO: 1387694 - RNA, 12 nt, Human
ugcccucuccca

SEQ ID NO: 1387695 - RNA, 16 nt, Human
ugcccucuccccucag

SEQ ID NO: 1387696 - RNA, 21 nt, Human
ugcccuccugugcucagcccu

SEQ ID NO: 1387697 - RNA, 23 nt, Human
ugcccuccugugcucagcccuga

SEQ ID NO: 1387698 - RNA, 20 nt, Human
ugcccuccugugcucagccc

SEQ ID NO: 1387699 - RNA, 14 nt, Human
ugcccuccugugcu

SEQ ID NO: 1387700 - RNA, 22 nt, Human
ugcccuacagcacccugugguc

SEQ ID NO: 1387701 - RNA, 17 nt, Human
ugcccuaagcagaaagu

SEQ ID NO: 1387702 - RNA, 15 nt, Human
ugcccuaagcagaaa

SEQ ID NO: 1387703 - RNA, 13 nt, Human
ugcccuaagcaga

SEQ ID NO: 1387704 - RNA, 17 nt, Human
ugccccggccccucccc

SEQ ID NO: 1387705 - RNA, 22 nt, Human
ugcccuaagcagaaagugccuu

SEQ ID NO: 1387706 - RNA, 20 nt, Human
ugcccuaagcagaaagugcc

SEQ ID NO: 1387707 - RNA, 18 nt, Human
ugcccuaagcagaaagug

SEQ ID NO: 1387708 - RNA, 18 nt, Human
ugcccucugggcucugag

SEQ ID NO: 1387709 - RNA, 17 nt, Human
ugcccucugggcucuga

SEQ ID NO: 1387710 - RNA, 16 nt, Human
ugcccucugggcucug

SEQ ID NO: 1387711 - RNA, 19 nt, Human
ugcccucugggcucugagu

SEQ ID NO: 1387712 - RNA, 22 nt, Human
ugcccugagccagggucuccag

SEQ ID NO: 1387713 - RNA, 15 nt, Human
ugcccugaucccaga

SEQ ID NO: 1387714 - RNA, 14 nt, Human
ugcccugccaccug

SEQ ID NO: 1387715 - RNA, 15 nt, Human
ugcccugccaccugu

SEQ ID NO: 1387716 - RNA, 16 nt, Human
ugcccugccaccuguc

SEQ ID NO: 1387717 - RNA, 17 nt, Human
ugcccugccaccugucu

SEQ ID NO: 1387718 - RNA, 19 nt, Human
ugcccugccaccugucugu

SEQ ID NO: 1387719 - RNA, 24 nt, Human
agcuccacucugcuucucugacuu

SEQ ID NO: 1387720 - RNA, 23 nt, Human
agcuccacucugcuucucugacu

SEQ ID NO: 1387721 - RNA, 22 nt, Human
agcuccacucugcuucucugac

SEQ ID NO: 1387722 - RNA, 19 nt, Human
agcuccacucugcuucucu

SEQ ID NO: 1387723 - RNA, 18 nt, Human
agcuccacucugcuucuc

SEQ ID NO: 1387724 - RNA, 17 nt, Human
agcuccacucugcuucu

SEQ ID NO: 1387725 - RNA, 16 nt, Human
agcuccacucugcuuc

SEQ ID NO: 1387726 - RNA, 14 nt, Human
agcuccacucugcu

SEQ ID NO: 1387727 - RNA, 13 nt, Human
agcuccacucugc

SEQ ID NO: 1387728 - RNA, 12 nt, Human
agcuccacucug

SEQ ID NO: 1387729 - RNA, 11 nt, Human
agcuccacucu

SEQ ID NO: 1387730 - RNA, 17 nt, Human
agcuccacccuggccga

SEQ ID NO: 1387731 - RNA, 15 nt, Human
agcuccacccuggcc

SEQ ID NO: 1387732 - RNA, 20 nt, Human
ugcccugccaccugucuguc

SEQ ID NO: 1387733 - RNA, 21 nt, Human
ugcccugccaccugucugucu

SEQ ID NO: 1387734 - RNA, 22 nt, Human
ugcccugccaccugucugucug

SEQ ID NO: 1387735 - RNA, 16 nt, Human
ugcccuucuuucuacc

SEQ ID NO: 1387736 - RNA, 15 nt, Human
ugcccuucacuguca

SEQ ID NO: 1387737 - RNA, 14 nt, Human
ugcccuucuuucua

SEQ ID NO: 1387738 - RNA, 13 nt, Human
ugcccuucuuucu

SEQ ID NO: 1387739 - RNA, 14 nt, Human
ugcccuucuccuua

SEQ ID NO: 1387740 - RNA, 12 nt, Human
ugcccugugcaa

SEQ ID NO: 1387741 - RNA, 22 nt, Human
agcucuuccuuacucccaggca

SEQ ID NO: 1387742 - RNA, 21 nt, Human
agcucuuccuuacucccaggc

SEQ ID NO: 1387743 - RNA, 21 nt, Human
ugccucaggaggcaggaccuu

SEQ ID NO: 1387744 - RNA, 18 nt, Human
ugccucaggaggcaggac

SEQ ID NO: 1387745 - RNA, 19 nt, Human
ugccucagagaccagggcu

SEQ ID NO: 1387746 - RNA, 23 nt, Human
ugccucagccacuugccugugcu

SEQ ID NO: 1387747 - RNA, 18 nt, Human
ugccucagagaccagggc

SEQ ID NO: 1387748 - RNA, 16 nt, Human
ugccucagagaccagg

SEQ ID NO: 1387749 - RNA, 15 nt, Human
ugccucagagaccag

SEQ ID NO: 1387750 - RNA, 14 nt, Human
ugccucagagacca

SEQ ID NO: 1387751 - RNA, 14 nt, Human
ugccucacuucagg

SEQ ID NO: 1387752 - RNA, 18 nt, Human
ugccucagaaaacaagga

SEQ ID NO: 1387753 - RNA, 11 nt, Human
ugccucucugc

SEQ ID NO: 1387754 - RNA, 12 nt, Human
ugccucucugca

SEQ ID NO: 1387755 - RNA, 21 nt, Human
ugccugcucgcucccugcaga

SEQ ID NO: 1387756 - RNA, 16 nt, Human
ugccugcucgcucccu

SEQ ID NO: 1387757 - RNA, 22 nt, Human
ugccugcucccauccugugugu

SEQ ID NO: 1387758 - RNA, 20 nt, Human
ugccugcucccauccugugu

SEQ ID NO: 1387759 - RNA, 18 nt, Human
ugccugcucccauccugu

SEQ ID NO: 1387760 - RNA, 15 nt, Human
ugccugcucccaucc

SEQ ID NO: 1387761 - RNA, 14 nt, Human
ugccugcucccauc

SEQ ID NO: 1387762 - RNA, 17 nt, Human
ugccugcuauuugaagu

SEQ ID NO: 1387763 - RNA, 19 nt, Human
ugccugcgugggugugugc

SEQ ID NO: 1387764 - RNA, 22 nt, Human
ugccugccuuuccauccauggc

SEQ ID NO: 1387765 - RNA, 15 nt, Human
ugccugccuuuccau

SEQ ID NO: 1387766 - RNA, 14 nt, Human
ugccugccuuucca

SEQ ID NO: 1387767 - RNA, 22 nt, Human
ugccucugaggccagccuggcc

SEQ ID NO: 1387768 - RNA, 21 nt, Human
ugccucugaggccagccuggc

SEQ ID NO: 1387769 - RNA, 20 nt, Human
ugccucugaggccagccugg

SEQ ID NO: 1387770 - RNA, 19 nt, Human
ugccucugaggccagccug

SEQ ID NO: 1387771 - RNA, 18 nt, Human
ugccucugaggccagccu

SEQ ID NO: 1387772 - RNA, 17 nt, Human
ugccucugaggccagcc

SEQ ID NO: 1387773 - RNA, 16 nt, Human
ugccucugaggccagc

SEQ ID NO: 1387774 - RNA, 15 nt, Human
ugccucugaggccag

SEQ ID NO: 1387775 - RNA, 13 nt, Human
ugccucugaggcc

SEQ ID NO: 1387776 - RNA, 12 nt, Human
ugccucugaggc

SEQ ID NO: 1387777 - RNA, 22 nt, Human
ugccucugccaaaggaugugau

SEQ ID NO: 1387778 - RNA, 21 nt, Human
ugccucugccaaaggauguga

SEQ ID NO: 1387779 - RNA, 23 nt, Human
ugccucugaggccagccuggccu

SEQ ID NO: 1387780 - RNA, 15 nt, Human
ugccucucugcaggu

SEQ ID NO: 1387781 - RNA, 23 nt, Human
ugccucucugcaggucccuaaua

SEQ ID NO: 1387782 - RNA, 22 nt, Human
ugccugcuuggggggugaugag

SEQ ID NO: 1387783 - RNA, 23 nt, Human
agcugccugucccuaccccaugg

SEQ ID NO: 1387784 - RNA, 13 nt, Human
agcuggaaaagua

SEQ ID NO: 1387785 - RNA, 18 nt, Human
agcuggagaugaggccag

SEQ ID NO: 1387786 - RNA, 17 nt, Human
agcuggaggcaggggcu

SEQ ID NO: 1387787 - RNA, 13 nt, Human
agcuggaggcagg

SEQ ID NO: 1387788 - RNA, 22 nt, Human
agcuggaggcaggggcuuccug

SEQ ID NO: 1387789 - RNA, 21 nt, Human
agcuggaggcaggggcuuccu

SEQ ID NO: 1387790 - RNA, 14 nt, Human
agcuggagugcagu

SEQ ID NO: 1387791 - RNA, 19 nt, Human
agcuggagaugaggccaga

SEQ ID NO: 1387792 - RNA, 20 nt, Human
agcuggagaugaggccagac

SEQ ID NO: 1387793 - RNA, 21 nt, Human
agcuggagaugaggccagacc

SEQ ID NO: 1387794 - RNA, 22 nt, Human
agcuggagaugaggccagacca

SEQ ID NO: 1387795 - RNA, 23 nt, Human
agcuggagaugaggccagaccau

SEQ ID NO: 1387796 - RNA, 23 nt, Human
uguccuuagccuggaccucugac

SEQ ID NO: 1387797 - RNA, 22 nt, Human
uguccuuagccuggaccucuga

SEQ ID NO: 1387798 - RNA, 17 nt, Human
uguccuuagccuggacc

SEQ ID NO: 1387799 - RNA, 16 nt, Human
uguccuuagccuggac

SEQ ID NO: 1387800 - RNA, 15 nt, Human
uguccuuagccugga

SEQ ID NO: 1387801 - RNA, 14 nt, Human
uguccuuagccugg

SEQ ID NO: 1387802 - RNA, 15 nt, Human
uguccugucaucauc

SEQ ID NO: 1387803 - RNA, 19 nt, Human
uguccugucaucaucaugg

SEQ ID NO: 1387804 - RNA, 16 nt, Human
uguccuguacauugug

SEQ ID NO: 1387805 - RNA, 22 nt, Human
uguccuguaaagguuacaagcc

SEQ ID NO: 1387806 - RNA, 15 nt, Human
uguccuguaaagguu

SEQ ID NO: 1387807 - RNA, 15 nt, Human
uguccugguucccgu

SEQ ID NO: 1387808 - RNA, 20 nt, Human
uguccuggugguauuuucaa

SEQ ID NO: 1387809 - RNA, 19 nt, Human
uguccuggugguauuuuca

SEQ ID NO: 1387810 - RNA, 18 nt, Human
uguccuggugguauuuuc

SEQ ID NO: 1387811 - RNA, 17 nt, Human
uguccuggugguauuuu

SEQ ID NO: 1387812 - RNA, 12 nt, Human
ugucccuccggg

SEQ ID NO: 1387813 - RNA, 14 nt, Human
ugucccucccccuu

SEQ ID NO: 1387814 - RNA, 13 nt, Human
ugucccuaggugu

SEQ ID NO: 1387815 - RNA, 22 nt, Human
ugucccuugccucaaugccagu

SEQ ID NO: 1387816 - RNA, 21 nt, Human
ugucccuugccccccuggccu

SEQ ID NO: 1387817 - RNA, 18 nt, Human
ugucccuugccccccugg

SEQ ID NO: 1387818 - RNA, 23 nt, Human
uguccagcuccaaccugcaaaga

SEQ ID NO: 1387819 - RNA, 20 nt, Human
uguccagcuccaaccugcaa

SEQ ID NO: 1387820 - RNA, 16 nt, Human
uguccagcuccaaccu

SEQ ID NO: 1387821 - RNA, 12 nt, Human
uguccagcucca

SEQ ID NO: 1387822 - RNA, 19 nt, Human
uguccacgacugucuccau

SEQ ID NO: 1387823 - RNA, 11 nt, Human
uguccagcucc

SEQ ID NO: 1387824 - RNA, 18 nt, Human
uguccacgacugucucca

SEQ ID NO: 1387825 - RNA, 17 nt, Human
uguccacgacugucucc

SEQ ID NO: 1387826 - RNA, 16 nt, Human
uguccacgacugucuc

SEQ ID NO: 1387827 - RNA, 12 nt, Human
uguccaccccca

SEQ ID NO: 1387828 - RNA, 13 nt, Human
uguccacccccau

SEQ ID NO: 1387829 - RNA, 11 nt, Human
uguccaccccc

SEQ ID NO: 1387830 - RNA, 18 nt, Human
uguccacaggcuucugag

SEQ ID NO: 1387831 - RNA, 21 nt, Human
uguccagcugagcgccaggau

SEQ ID NO: 1387832 - RNA, 17 nt, Human
uguccagcugagcgcca

SEQ ID NO: 1387833 - RNA, 17 nt, Human
uguccacauagguuuag

SEQ ID NO: 1387834 - RNA, 16 nt, Human
uguccacaggcuucug

SEQ ID NO: 1387835 - RNA, 20 nt, Human
ugucagcaugaauuuguaau

SEQ ID NO: 1387836 - RNA, 16 nt, Human
ugucagcaugaauuug

SEQ ID NO: 1387837 - RNA, 14 nt, Human
ugucagcaugaauu

SEQ ID NO: 1387838 - RNA, 12 nt, Human
ugucagcaugaa

SEQ ID NO: 1387839 - RNA, 17 nt, Human
agucacucuuaugcugu

SEQ ID NO: 1387840 - RNA, 21 nt, Human
aguccaguccuaucugggcuu

SEQ ID NO: 1387841 - RNA, 17 nt, Human
aguccaguccaguccua

SEQ ID NO: 1387842 - RNA, 18 nt, Human
aguccagguccugguggg

SEQ ID NO: 1387843 - RNA, 19 nt, Human
aguccagguccuggugggg

SEQ ID NO: 1387844 - RNA, 17 nt, Human
aguccagguccuggugg

SEQ ID NO: 1387845 - RNA, 16 nt, Human
aguccagguccuggug

SEQ ID NO: 1387846 - RNA, 15 nt, Human
aguccagguccuggu

SEQ ID NO: 1387847 - RNA, 14 nt, Human
aguccagguccugg

SEQ ID NO: 1387848 - RNA, 13 nt, Human
aguccagguccug

SEQ ID NO: 1387849 - RNA, 23 nt, Human
agucaucuugcuaccaguauuua

SEQ ID NO: 1387850 - RNA, 19 nt, Human
agucaucuugcuaccagua

SEQ ID NO: 1387851 - RNA, 13 nt, Human
agucaucuugcua

SEQ ID NO: 1387852 - RNA, 11 nt, Human
agucaucuugc

SEQ ID NO: 1387853 - RNA, 14 nt, Human
aguccaucagccuc

SEQ ID NO: 1387854 - RNA, 13 nt, Human
aguccaucagccu

SEQ ID NO: 1387855 - RNA, 17 nt, Human
aguccaguccuaucugg

SEQ ID NO: 1387856 - RNA, 16 nt, Human
aguccaucagccucca

SEQ ID NO: 1387857 - RNA, 23 nt, Human
agucccagguuggcucugccagu

SEQ ID NO: 1387858 - RNA, 21 nt, Human
agucccagguuggcucugcca

SEQ ID NO: 1387859 - RNA, 20 nt, Human
agucccagguuggcucugcc

SEQ ID NO: 1387860 - RNA, 19 nt, Human
agucccagguuggcucugc

SEQ ID NO: 1387861 - RNA, 18 nt, Human
agucccagguuggcucug

SEQ ID NO: 1387862 - RNA, 17 nt, Human
agucccaucugcuucag

SEQ ID NO: 1387863 - RNA, 22 nt, Human
aguccccacagauaacugaaaa

SEQ ID NO: 1387864 - RNA, 22 nt, Human
agucccagguuggcucugccag

SEQ ID NO: 1387865 - RNA, 18 nt, Human
agucccaucccugcguga

SEQ ID NO: 1387866 - RNA, 13 nt, Human
agucauccagucu

SEQ ID NO: 1387867 - RNA, 21 nt, Human
agucagucauucagauaugau

SEQ ID NO: 1387868 - RNA, 15 nt, Human
agucagucauucaga

SEQ ID NO: 1387869 - RNA, 16 nt, Human
ugucuaagauucuaga

SEQ ID NO: 1387870 - RNA, 23 nt, Human
agucagauggaaaauucauuuuu

SEQ ID NO: 1387871 - RNA, 22 nt, Human
agucagauggaaaauucauuuu

SEQ ID NO: 1387872 - RNA, 20 nt, Human
agucagauggaaaauucauu

SEQ ID NO: 1387873 - RNA, 15 nt, Human
ugucuaagauucuag

SEQ ID NO: 1387874 - RNA, 14 nt, Human
ugucuaagauucua

SEQ ID NO: 1387875 - RNA, 21 nt, Human
uguccuuuaccaaagaugaau

SEQ ID NO: 1387876 - RNA, 19 nt, Human
uguccuuuaccaaagauga

SEQ ID NO: 1387877 - RNA, 20 nt, Human
uguccuugaaggacuaauag

SEQ ID NO: 1387878 - RNA, 13 nt, Human
ugucuaagauucu

SEQ ID NO: 1387879 - RNA, 18 nt, Human
ugucuaagaaauugaaua

SEQ ID NO: 1387880 - RNA, 23 nt, Human
ugucuaagaaauugaauacuuug

SEQ ID NO: 1387881 - RNA, 22 nt, Human
aguauguucuaaccuuuacaug

SEQ ID NO: 1387882 - RNA, 21 nt, Human
aguauguucuaaccuuuacau

SEQ ID NO: 1387883 - RNA, 18 nt, Human
aguauguucuaaccuuua

SEQ ID NO: 1387884 - RNA, 14 nt, Human
aguauuauaccuuu

SEQ ID NO: 1387885 - RNA, 14 nt, Human
aguauuauauguac

SEQ ID NO: 1387886 - RNA, 13 nt, Human
aguauuauaugua

SEQ ID NO: 1387887 - RNA, 12 nt, Human
aguauuauaugu

SEQ ID NO: 1387888 - RNA, 15 nt, Human
aguauuauaccuuuu

SEQ ID NO: 1387889 - RNA, 18 nt, Human
aguauuggggucugaccc

SEQ ID NO: 1387890 - RNA, 23 nt, Human
aguagcugagcucacaaggcagc

SEQ ID NO: 1387891 - RNA, 14 nt, Human
aguauguucaaagu

SEQ ID NO: 1387892 - RNA, 22 nt, Human
aguagcugagcucacaaggcag

SEQ ID NO: 1387893 - RNA, 14 nt, Human
aguagcugagcuca

SEQ ID NO: 1387894 - RNA, 13 nt, Human
aguagcugagcuc

SEQ ID NO: 1387895 - RNA, 21 nt, Human
aguauguuagugcaaauuguc

SEQ ID NO: 1387896 - RNA, 18 nt, Human
aguauguuagugcaaauu

SEQ ID NO: 1387897 - RNA, 17 nt, Human
agucacagggcaguacc

SEQ ID NO: 1387898 - RNA, 13 nt, Human
agucacagggcag

SEQ ID NO: 1387899 - RNA, 13 nt, Human
agucacagccacc

SEQ ID NO: 1387900 - RNA, 15 nt, Human
aguauuuagaagcca

SEQ ID NO: 1387901 - RNA, 22 nt, Human
agucacucuagucaaugacaug

SEQ ID NO: 1387902 - RNA, 20 nt, Human
agucacucuagucaaugaca

SEQ ID NO: 1387903 - RNA, 17 nt, Human
agucacucuagucaaug

SEQ ID NO: 1387904 - RNA, 20 nt, Human
agucacucgauaauaaagua

SEQ ID NO: 1387905 - RNA, 14 nt, Human
agucacagggcagu

SEQ ID NO: 1387906 - RNA, 18 nt, Human
agucacauuccugaacag

SEQ ID NO: 1387907 - RNA, 17 nt, Human
aguauuuaacuaauuau

SEQ ID NO: 1387908 - RNA, 12 nt, Human
aguauuuaacua

SEQ ID NO: 1387909 - RNA, 22 nt, Human
aguauuguuguccuuuucauag

SEQ ID NO: 1387910 - RNA, 21 nt, Human
aguauuguuguccuuuucaua

SEQ ID NO: 1387911 - RNA, 24 nt, Human
aguauuguuguccuuuucauaggu

SEQ ID NO: 1387912 - RNA, 20 nt, Human
aguauuguuguccuuuucau

SEQ ID NO: 1387913 - RNA, 19 nt, Human
aguauuguuguccuuuuca

SEQ ID NO: 1387914 - RNA, 16 nt, Human
aguauuguuguccuuu

SEQ ID NO: 1387915 - RNA, 15 nt, Human
aguauuguuguccuu

SEQ ID NO: 1387916 - RNA, 13 nt, Human
aguauuguugucc

SEQ ID NO: 1387917 - RNA, 12 nt, Human
aguauuguuguc

SEQ ID NO: 1387918 - RNA, 22 nt, Human
aguauugcucacccagugcccu

SEQ ID NO: 1387919 - RNA, 16 nt, Human
aguauuguccaggucu

SEQ ID NO: 1387920 - RNA, 15 nt, Human
aguauuguccagguc

SEQ ID NO: 1387921 - RNA, 11 nt, Human
aguauuuaauu

SEQ ID NO: 1387922 - RNA, 13 nt, Human
aguauuuaauuag

SEQ ID NO: 1387923 - RNA, 14 nt, Human
aguauuuaauuagu

SEQ ID NO: 1387924 - RNA, 15 nt, Human
aguauuuaauuagug

SEQ ID NO: 1387925 - RNA, 16 nt, Human
aguauuuaauuagugc

SEQ ID NO: 1387926 - RNA, 17 nt, Human
aguauuuaauuagugcu

SEQ ID NO: 1387927 - RNA, 19 nt, Human
aguauuuaauuagugcuaa

SEQ ID NO: 1387928 - RNA, 21 nt, Human
aguauuuaauuagugcuaagu

SEQ ID NO: 1387929 - RNA, 21 nt, Human
aguauuuaauucauguugccu

SEQ ID NO: 1387930 - RNA, 14 nt, Human
uguauuaagccacu

SEQ ID NO: 1387931 - RNA, 16 nt, Human
uguauuaagaaaggaa

SEQ ID NO: 1387932 - RNA, 19 nt, Human
uguauuagauguucucuau

SEQ ID NO: 1387933 - RNA, 13 nt, Human
uguauuagauguu

SEQ ID NO: 1387934 - RNA, 14 nt, Human
uguauuagauguuc

SEQ ID NO: 1387935 - RNA, 16 nt, Human
uguauuagauguucuc

SEQ ID NO: 1387936 - RNA, 18 nt, Human
uguauuagauguucucua

SEQ ID NO: 1387937 - RNA, 11 nt, Human
uguauuaugug

SEQ ID NO: 1387938 - RNA, 19 nt, Human
ugucaaauauuuagaugua

SEQ ID NO: 1387939 - RNA, 15 nt, Human
ugucaacucuuuguu

SEQ ID NO: 1387940 - RNA, 11 nt, Human
aguagcugagc

SEQ ID NO: 1387941 - RNA, 21 nt, Human
aguagcguuuuuuaaauguau

SEQ ID NO: 1387942 - RNA, 22 nt, Human
aguagcguuuuuuaaauguaua

SEQ ID NO: 1387943 - RNA, 20 nt, Human
uguauuaagaaaggaagcau

SEQ ID NO: 1387944 - RNA, 22 nt, Human
agguuuggaaggagcagaaaac

SEQ ID NO: 1387945 - RNA, 14 nt, Human
agguuuggaaggag

SEQ ID NO: 1387946 - RNA, 18 nt, Human
agguuugcagucccaagc

SEQ ID NO: 1387947 - RNA, 23 nt, Human
agguuuggacaaaauggaauacu

SEQ ID NO: 1387948 - RNA, 13 nt, Human
ugucuucucccug

SEQ ID NO: 1387949 - RNA, 12 nt, Human
ugucuucucccu

SEQ ID NO: 1387950 - RNA, 22 nt, Human
ugucuugaugcaugcacuguuc

SEQ ID NO: 1387951 - RNA, 16 nt, Human
ugucuugagcucuauu

SEQ ID NO: 1387952 - RNA, 14 nt, Human
ugucuugagcucua

SEQ ID NO: 1387953 - RNA, 21 nt, Human
ugugaacccaggacaagcaug

SEQ ID NO: 1387954 - RNA, 16 nt, Human
ugugaacccaggacaa

SEQ ID NO: 1387955 - RNA, 15 nt, Human
ugugaacccaggaca

SEQ ID NO: 1387956 - RNA, 21 nt, Human
ugugaaccccacgaaggagcc

SEQ ID NO: 1387957 - RNA, 14 nt, Human
ugugaacccaggac

SEQ ID NO: 1387958 - RNA, 13 nt, Human
ugugaacccagga

SEQ ID NO: 1387959 - RNA, 17 nt, Human
ugucuuuagauagcccu

SEQ ID NO: 1387960 - RNA, 18 nt, Human
ugucuuuagauagcccug

SEQ ID NO: 1387961 - RNA, 15 nt, Human
ugucuuuagauagcc

SEQ ID NO: 1387962 - RNA, 15 nt, Human
ugucuuuaaugcaau

SEQ ID NO: 1387963 - RNA, 15 nt, Human
ugucuuuaauucugu

SEQ ID NO: 1387964 - RNA, 14 nt, Human
ugucuuuaaugcaa

SEQ ID NO: 1387965 - RNA, 22 nt, Human
ugugaacaguuguguuugaagc

SEQ ID NO: 1387966 - RNA, 13 nt, Human
ugucuuggaacau

SEQ ID NO: 1387967 - RNA, 19 nt, Human
ugucuugagcucuauuaug

SEQ ID NO: 1387968 - RNA, 18 nt, Human
ugucuuaauuuucuuuca

SEQ ID NO: 1387969 - RNA, 15 nt, Human
ugucuuaauuauuau

SEQ ID NO: 1387970 - RNA, 14 nt, Human
ugucuuaauuauua

SEQ ID NO: 1387971 - RNA, 23 nt, Human
ugucucuuuggcgaccuccuuuc

SEQ ID NO: 1387972 - RNA, 17 nt, Human
ugucucuugaguuuguc

SEQ ID NO: 1387973 - RNA, 14 nt, Human
ugucucuugaguuu

SEQ ID NO: 1387974 - RNA, 17 nt, Human
ugucucuucuuuagaac

SEQ ID NO: 1387975 - RNA, 16 nt, Human
ugucucuucugagcua

SEQ ID NO: 1387976 - RNA, 13 nt, Human
ugucucuucugag

SEQ ID NO: 1387977 - RNA, 22 nt, Human
ugucucuuauggauguccccag

SEQ ID NO: 1387978 - RNA, 20 nt, Human
ugucucuuauggaugucccc

SEQ ID NO: 1387979 - RNA, 15 nt, Human
ugucucuuauggaug

SEQ ID NO: 1387980 - RNA, 15 nt, Human
ugucucgaacuauuu

SEQ ID NO: 1387981 - RNA, 13 nt, Human
agucccugccugg

SEQ ID NO: 1387982 - RNA, 15 nt, Human
ugucuccucucucug

SEQ ID NO: 1387983 - RNA, 19 nt, Human
ugucucgagcgcccugcag

SEQ ID NO: 1387984 - RNA, 18 nt, Human
ugucucgagcgcccugca

SEQ ID NO: 1387985 - RNA, 17 nt, Human
ugucucgagcgcccugc

SEQ ID NO: 1387986 - RNA, 15 nt, Human
ugucucgagcgcccu

SEQ ID NO: 1387987 - RNA, 20 nt, Human
ugucucgagcgcccugcaga

SEQ ID NO: 1387988 - RNA, 17 nt, Human
ugucucuccugccccuu

SEQ ID NO: 1387989 - RNA, 12 nt, Human
ugucucucauga

SEQ ID NO: 1387990 - RNA, 20 nt, Human
ugucucugaugcagcuuaua

SEQ ID NO: 1387991 - RNA, 19 nt, Human
ugucucugaugcagcuuau

SEQ ID NO: 1387992 - RNA, 14 nt, Human
ugucucugaugcag

SEQ ID NO: 1387993 - RNA, 13 nt, Human
ugucucugaugca

SEQ ID NO: 1387994 - RNA, 16 nt, Human
ugucucuccugccccu

SEQ ID NO: 1387995 - RNA, 13 nt, Human
ugucucuccugcc

SEQ ID NO: 1387996 - RNA, 18 nt, Human
ugucucucagggccaggc

SEQ ID NO: 1387997 - RNA, 22 nt, Human
ugucucuggauuauauuaugaa

SEQ ID NO: 1387998 - RNA, 21 nt, Human
ugugaagccaauucagacagg

SEQ ID NO: 1387999 - RNA, 20 nt, Human
ugugaagccaauucagacag

SEQ ID NO: 1388000 - RNA, 10 nt, Human
ugugaagcca

SEQ ID NO: 1388001 - RNA, 23 nt, Human
ugugaagccaugaguuccagaaa

SEQ ID NO: 1388002 - RNA, 18 nt, Human
ugugaacuggacccuguu

SEQ ID NO: 1388003 - RNA, 19 nt, Human
ugugaacuggacccuguug

SEQ ID NO: 1388004 - RNA, 20 nt, Human
ugugaagcaaacucuaaaau

SEQ ID NO: 1388005 - RNA, 14 nt, Human
ugugaagcaaaauu

SEQ ID NO: 1388006 - RNA, 23 nt, Human
agucucucuucucuccagcugac

SEQ ID NO: 1388007 - RNA, 21 nt, Human
agucucucuucucuccagcug

SEQ ID NO: 1388008 - RNA, 16 nt, Human
agucucugagcaguga

SEQ ID NO: 1388009 - RNA, 13 nt, Human
agucucugagcag

SEQ ID NO: 1388010 - RNA, 11 nt, Human
agucucugagc

SEQ ID NO: 1388011 - RNA, 16 nt, Human
agucucugaggggcua

SEQ ID NO: 1388012 - RNA, 22 nt, Human
agucucugaggggcuaccagga

SEQ ID NO: 1388013 - RNA, 23 nt, Human
agucucugaggggcuaccaggaa

SEQ ID NO: 1388014 - RNA, 13 nt, Human
agucucccaggga

SEQ ID NO: 1388015 - RNA, 14 nt, Human
agucucccagggag

SEQ ID NO: 1388016 - RNA, 15 nt, Human
agucucccagggagc

SEQ ID NO: 1388017 - RNA, 15 nt, Human
ugugagcccagcugg

SEQ ID NO: 1388018 - RNA, 14 nt, Human
ugugagcccagcug

SEQ ID NO: 1388019 - RNA, 19 nt, Human
agucuccaaagucucugga

SEQ ID NO: 1388020 - RNA, 22 nt, Human
agucuuuuguucgcauggucac

SEQ ID NO: 1388021 - RNA, 20 nt, Human
agucuuuugcuuuuggcaaa

SEQ ID NO: 1388022 - RNA, 19 nt, Human
agucuuuugcuuuuggcaa

SEQ ID NO: 1388023 - RNA, 18 nt, Human
agucuuuugcuuuuggca

SEQ ID NO: 1388024 - RNA, 14 nt, Human
agucuuuugcuuuu

SEQ ID NO: 1388025 - RNA, 13 nt, Human
agucuuuugcuuu

SEQ ID NO: 1388026 - RNA, 12 nt, Human
agucuuuugcuu

SEQ ID NO: 1388027 - RNA, 13 nt, Human
agucuuuuccaug

SEQ ID NO: 1388028 - RNA, 15 nt, Human
agucuuuuccaugaa

SEQ ID NO: 1388029 - RNA, 19 nt, Human
agucuuccugacacuuuaa

SEQ ID NO: 1388030 - RNA, 18 nt, Human
agucuuccugacacuuua

SEQ ID NO: 1388031 - RNA, 17 nt, Human
agucuuccugacacuuu

SEQ ID NO: 1388032 - RNA, 16 nt, Human
agucuuccugacacuu

SEQ ID NO: 1388033 - RNA, 15 nt, Human
agucuuccugacacu

SEQ ID NO: 1388034 - RNA, 12 nt, Human
agucuuccugac

SEQ ID NO: 1388035 - RNA, 19 nt, Human
agucuuccauuugcaaggg

SEQ ID NO: 1388036 - RNA, 17 nt, Human
agucuuccauuugcaag

SEQ ID NO: 1388037 - RNA, 16 nt, Human
agucuuccauuugcaa

SEQ ID NO: 1388038 - RNA, 15 nt, Human
agucuuccauuugca

SEQ ID NO: 1388039 - RNA, 22 nt, Human
agucuuaauauauauauccaga

SEQ ID NO: 1388040 - RNA, 14 nt, Human
agucuuaacugguc

SEQ ID NO: 1388041 - RNA, 16 nt, Human
agucuuacgaauacuu

SEQ ID NO: 1388042 - RNA, 18 nt, Human
agucuuacucuguugcca

SEQ ID NO: 1388043 - RNA, 21 nt, Human
agugagacccagcccucaucc

SEQ ID NO: 1388044 - RNA, 13 nt, Human
agugagacagacu

SEQ ID NO: 1388045 - RNA, 16 nt, Human
agugaaaacuuuguag

SEQ ID NO: 1388046 - RNA, 15 nt, Human
agugaaaacuuugua

SEQ ID NO: 1388047 - RNA, 22 nt, Human
agucuuuugcuuuugcccauuu

SEQ ID NO: 1388048 - RNA, 17 nt, Human
agucuuuuguucgcaug

SEQ ID NO: 1388049 - RNA, 14 nt, Human
agugaaaauauagc

SEQ ID NO: 1388050 - RNA, 20 nt, Human
agugaaacucguuaauuugu

SEQ ID NO: 1388051 - RNA, 15 nt, Human
ugugauucaaucugu

SEQ ID NO: 1388052 - RNA, 14 nt, Human
ugugauucaaucug

SEQ ID NO: 1388053 - RNA, 16 nt, Human
ugugauuagacagaac

SEQ ID NO: 1388054 - RNA, 22 nt, Human
ugugauuagacagaacaccuau

SEQ ID NO: 1388055 - RNA, 18 nt, Human
ugugauguucuaaggcuc

SEQ ID NO: 1388056 - RNA, 17 nt, Human
ugugauguucuaaggcu

SEQ ID NO: 1388057 - RNA, 16 nt, Human
ugugauguucuaaggc

SEQ ID NO: 1388058 - RNA, 15 nt, Human
ugugauguucuaagg

SEQ ID NO: 1388059 - RNA, 14 nt, Human
ugugauguucuaag

SEQ ID NO: 1388060 - RNA, 13 nt, Human
ugugauguucuaa

SEQ ID NO: 1388061 - RNA, 15 nt, Human
ugugaugugaagcca

SEQ ID NO: 1388062 - RNA, 23 nt, Human
ugugaugucauacagagaaguca

SEQ ID NO: 1388063 - RNA, 22 nt, Human
ugugaugucauacagagaaguc

SEQ ID NO: 1388064 - RNA, 20 nt, Human
ugugaugucauacagagaag

SEQ ID NO: 1388065 - RNA, 19 nt, Human
ugugaugucauacagagaa

SEQ ID NO: 1388066 - RNA, 18 nt, Human
ugugaugucauacagaga

SEQ ID NO: 1388067 - RNA, 17 nt, Human
ugugauggagugcuguu

SEQ ID NO: 1388068 - RNA, 15 nt, Human
ugugauggagugcug

SEQ ID NO: 1388069 - RNA, 21 nt, Human
agugagcauggaacacuucga

SEQ ID NO: 1388070 - RNA, 22 nt, Human
agugagcauggaacacuucgag

SEQ ID NO: 1388071 - RNA, 21 nt, Human
agugagagacauuaacucauu

SEQ ID NO: 1388072 - RNA, 13 nt, Human
agugagagacauu

SEQ ID NO: 1388073 - RNA, 22 nt, Human
agugagagacauuaacucauua

SEQ ID NO: 1388074 - RNA, 21 nt, Human
agugagcagucaggaaagaga

SEQ ID NO: 1388075 - RNA, 20 nt, Human
aggugugacugaauuucuuu

SEQ ID NO: 1388076 - RNA, 18 nt, Human
aggugugacugaauuucu

SEQ ID NO: 1388077 - RNA, 18 nt, Human
agguggguugaaagccaa

SEQ ID NO: 1388078 - RNA, 22 nt, Human
aggugcaacaagguccucuguc

SEQ ID NO: 1388079 - RNA, 19 nt, Human
aggugauccauguaacugc

SEQ ID NO: 1388080 - RNA, 21 nt, Human
aggugauccauguaacugccu

SEQ ID NO: 1388081 - RNA, 18 nt, Human
aggugauccauguaacug

SEQ ID NO: 1388082 - RNA, 15 nt, Human
aggugauccauguaa

SEQ ID NO: 1388083 - RNA, 21 nt, Human
agguggggagacugggcugag

SEQ ID NO: 1388084 - RNA, 19 nt, Human
agguggggagacugggcug

SEQ ID NO: 1388085 - RNA, 17 nt, Human
agguguuggcugcacgu

SEQ ID NO: 1388086 - RNA, 23 nt, Human
agguguugccaaauauguccugg

SEQ ID NO: 1388087 - RNA, 22 nt, Human
agguguugccaaauauguccug

SEQ ID NO: 1388088 - RNA, 21 nt, Human
agguguugccaaauauguccu

SEQ ID NO: 1388089 - RNA, 12 nt, Human
agguguugccaa

SEQ ID NO: 1388090 - RNA, 12 nt, Human
agguguuauuug

SEQ ID NO: 1388091 - RNA, 23 nt, Human
agguguuauuuggaaccuuguuu

SEQ ID NO: 1388092 - RNA, 16 nt, Human
agguguuacuguaauu

SEQ ID NO: 1388093 - RNA, 15 nt, Human
agguguuacuguaau

SEQ ID NO: 1388094 - RNA, 23 nt, Human
agguguuaacauuccaagacucu

SEQ ID NO: 1388095 - RNA, 18 nt, Human
agguguuaacauuccaag

SEQ ID NO: 1388096 - RNA, 15 nt, Human
aggugugagacuggg

SEQ ID NO: 1388097 - RNA, 14 nt, Human
aggugugagacugg

SEQ ID NO: 1388098 - RNA, 21 nt, Human
aggugugaaggugauuuaagg

SEQ ID NO: 1388099 - RNA, 22 nt, Human
agguuuaaaugaacaagagaag

SEQ ID NO: 1388100 - RNA, 15 nt, Human
agguuuaaaugaaca

SEQ ID NO: 1388101 - RNA, 14 nt, Human
agguuuaaaugaac

SEQ ID NO: 1388102 - RNA, 13 nt, Human
agguuuaaaugaa

SEQ ID NO: 1388103 - RNA, 20 nt, Human
agguuuaaagagucuagauu

SEQ ID NO: 1388104 - RNA, 16 nt, Human
agguuuaaagagucua

SEQ ID NO: 1388105 - RNA, 15 nt, Human
agguuuaaagagucu

SEQ ID NO: 1388106 - RNA, 14 nt, Human
agguuuaaagaguc

SEQ ID NO: 1388107 - RNA, 13 nt, Human
agguuuaaagagu

SEQ ID NO: 1388108 - RNA, 22 nt, Human
agguuguggccuuugcgcuccu

SEQ ID NO: 1388109 - RNA, 12 nt, Human
agguugucugug

SEQ ID NO: 1388110 - RNA, 17 nt, Human
uguaagaaauacagacu

SEQ ID NO: 1388111 - RNA, 15 nt, Human
uguaagaaauacaga

SEQ ID NO: 1388112 - RNA, 12 nt, Human
uguaagaaaccu

SEQ ID NO: 1388113 - RNA, 19 nt, Human
agguuuaaaugaacaagag

SEQ ID NO: 1388114 - RNA, 18 nt, Human
uguaagaaaauaucacuu

SEQ ID NO: 1388115 - RNA, 17 nt, Human
uguaaggaugggcaugg

SEQ ID NO: 1388116 - RNA, 23 nt, Human
uguaauuuuacacgcuuuuguga

SEQ ID NO: 1388117 - RNA, 21 nt, Human
uguaaggauccggaaagaaga

SEQ ID NO: 1388118 - RNA, 19 nt, Human
uguaaggauccggaaagaa

SEQ ID NO: 1388119 - RNA, 17 nt, Human
uguaauuugugauacaa

SEQ ID NO: 1388120 - RNA, 21 nt, Human
uguaauuugugauacaaugcu

SEQ ID NO: 1388121 - RNA, 15 nt, Human
uguaaggcaaucaug

SEQ ID NO: 1388122 - RNA, 16 nt, Human
uguaauuugugauaca

SEQ ID NO: 1388123 - RNA, 14 nt, Human
uguacaucuauuuu

SEQ ID NO: 1388124 - RNA, 20 nt, Human
uguacauaugugcuggaauu

SEQ ID NO: 1388125 - RNA, 17 nt, Human
uguacauaugugcugga

SEQ ID NO: 1388126 - RNA, 15 nt, Human
uguacauaugugcug

SEQ ID NO: 1388127 - RNA, 16 nt, Human
uguacauuugggaguu

SEQ ID NO: 1388128 - RNA, 14 nt, Human
uguacauuaauuac

SEQ ID NO: 1388129 - RNA, 17 nt, Human
uguacaugaaaacacau

SEQ ID NO: 1388130 - RNA, 18 nt, Human
uguacaugaaaacacauu

SEQ ID NO: 1388131 - RNA, 19 nt, Human
uguacaugaaaacacauuu

SEQ ID NO: 1388132 - RNA, 20 nt, Human
uguacaugaaaacacauuuu

SEQ ID NO: 1388133 - RNA, 18 nt, Human
uguagaaugauuucaugc

SEQ ID NO: 1388134 - RNA, 17 nt, Human
uguagaaugauuucaug

SEQ ID NO: 1388135 - RNA, 16 nt, Human
uguagaaugauuucau

SEQ ID NO: 1388136 - RNA, 21 nt, Human
uguagaagucacauuccugaa

SEQ ID NO: 1388137 - RNA, 15 nt, Human
uguacuugcucuuga

SEQ ID NO: 1388138 - RNA, 17 nt, Human
uguagaaccuaauucaa

SEQ ID NO: 1388139 - RNA, 20 nt, Human
uguagaacacuaauucauaa

SEQ ID NO: 1388140 - RNA, 19 nt, Human
uguagaacacuaauucaua

SEQ ID NO: 1388141 - RNA, 18 nt, Human
uguagaacacuaauucau

SEQ ID NO: 1388142 - RNA, 19 nt, Human
uguacuugcucuugaugcc

SEQ ID NO: 1388143 - RNA, 23 nt, Human
uggugugguacagagaagccagc

SEQ ID NO: 1388144 - RNA, 21 nt, Human
uggugugguacagagaagcca

SEQ ID NO: 1388145 - RNA, 20 nt, Human
uggugugguacagagaagcc

SEQ ID NO: 1388146 - RNA, 19 nt, Human
uggugugguacagagaagc

SEQ ID NO: 1388147 - RNA, 18 nt, Human
uggugugguacagagaag

SEQ ID NO: 1388148 - RNA, 17 nt, Human
uggugugguacagagaa

SEQ ID NO: 1388149 - RNA, 16 nt, Human
uggugugguacagaga

SEQ ID NO: 1388150 - RNA, 15 nt, Human
uggugugguacagag

SEQ ID NO: 1388151 - RNA, 19 nt, Human
uggugugucccccucuguc

SEQ ID NO: 1388152 - RNA, 20 nt, Human
ugguguuaacagaagggagg

SEQ ID NO: 1388153 - RNA, 14 nt, Human
ugguguuaacagaa

SEQ ID NO: 1388154 - RNA, 11 nt, Human
ugguguuaaca

SEQ ID NO: 1388155 - RNA, 23 nt, Human
ugguguucuccugcugcucccuc

SEQ ID NO: 1388156 - RNA, 17 nt, Human
ugguguucuccugcugc

SEQ ID NO: 1388157 - RNA, 14 nt, Human
ugguguucuccugc

SEQ ID NO: 1388158 - RNA, 14 nt, Human
uggugugguacaga

SEQ ID NO: 1388159 - RNA, 16 nt, Human
uggugugaucgucuga

SEQ ID NO: 1388160 - RNA, 16 nt, Human
ugguguggcaaagccu

SEQ ID NO: 1388161 - RNA, 18 nt, Human
uggugugaucgucugacu

SEQ ID NO: 1388162 - RNA, 21 nt, Human
aggugaacauugguucuuuca

SEQ ID NO: 1388163 - RNA, 14 nt, Human
aggugaacauuggu

SEQ ID NO: 1388164 - RNA, 17 nt, Human
ugguuaagaguccaaga

SEQ ID NO: 1388165 - RNA, 16 nt, Human
ugguuaagaguccaag

SEQ ID NO: 1388166 - RNA, 14 nt, Human
ugguuaagagucca

SEQ ID NO: 1388167 - RNA, 13 nt, Human
ugguuaagagucc

SEQ ID NO: 1388168 - RNA, 19 nt, Human
ugguuaaauaaggcagggu

SEQ ID NO: 1388169 - RNA, 22 nt, Human
ugguguuuuuuucuaugggugu

SEQ ID NO: 1388170 - RNA, 20 nt, Human
ugguguuggacaagcuucug

SEQ ID NO: 1388171 - RNA, 22 nt, Human
ugguguucuccugcugcucccu

SEQ ID NO: 1388172 - RNA, 20 nt, Human
ugguucagaauuaaacuuuu

SEQ ID NO: 1388173 - RNA, 15 nt, Human
ugguucacacugacc

SEQ ID NO: 1388174 - RNA, 19 nt, Human
ugguuuaaagaaaguguau

SEQ ID NO: 1388175 - RNA, 17 nt, Human
ugguuuaaagaaagugu

SEQ ID NO: 1388176 - RNA, 16 nt, Human
ugguuuaaagaaagug

SEQ ID NO: 1388177 - RNA, 15 nt, Human
ugguuuaaagaaagu

SEQ ID NO: 1388178 - RNA, 23 nt, Human
ugguuuaaaagacacacuugucc

SEQ ID NO: 1388179 - RNA, 21 nt, Human
ugguucagaauuaaacuuuua

SEQ ID NO: 1388180 - RNA, 16 nt, Human
ugguucagcuaagcua

SEQ ID NO: 1388181 - RNA, 17 nt, Human
ugguuguuucuguucca

SEQ ID NO: 1388182 - RNA, 17 nt, Human
uguaaauauuuuaaaga

SEQ ID NO: 1388183 - RNA, 14 nt, Human
uguaaauauuuuaa

SEQ ID NO: 1388184 - RNA, 15 nt, Human
uguaaauauugugug

SEQ ID NO: 1388185 - RNA, 14 nt, Human
uguaaauauugugu

SEQ ID NO: 1388186 - RNA, 22 nt, Human
uguaaauauuuuaaagaauugu

SEQ ID NO: 1388187 - RNA, 20 nt, Human
uguaaauauuuuaaagaauu

SEQ ID NO: 1388188 - RNA, 18 nt, Human
uguaaauauuuuaaagaa

SEQ ID NO: 1388189 - RNA, 17 nt, Human
uguaaauauaaagacgu

SEQ ID NO: 1388190 - RNA, 16 nt, Human
uguaaauauaaagacg

SEQ ID NO: 1388191 - RNA, 15 nt, Human
uguaaauacccauau

SEQ ID NO: 1388192 - RNA, 14 nt, Human
uguaaauauaaaga

SEQ ID NO: 1388193 - RNA, 13 nt, Human
uguaaagcuuguc

SEQ ID NO: 1388194 - RNA, 11 nt, Human
uguaaagaugu

SEQ ID NO: 1388195 - RNA, 18 nt, Human
uguaaagauauuuuuauc

SEQ ID NO: 1388196 - RNA, 13 nt, Human
ugguuuucuguuc

SEQ ID NO: 1388197 - RNA, 15 nt, Human
ugguuuucuguucuu

SEQ ID NO: 1388198 - RNA, 21 nt, Human
uguaaagcuaaaauaaagaaa

SEQ ID NO: 1388199 - RNA, 20 nt, Human
uguaaagcuaaaauaaagaa

SEQ ID NO: 1388200 - RNA, 17 nt, Human
uguaaagcuaaaauaaa

SEQ ID NO: 1388201 - RNA, 16 nt, Human
uguaaagcuaaaauaa

SEQ ID NO: 1388202 - RNA, 12 nt, Human
uguaaagcuaaa

SEQ ID NO: 1388203 - RNA, 13 nt, Human
uguaaagccaugc

SEQ ID NO: 1388204 - RNA, 16 nt, Human
uguaaaggaauuuaaa

SEQ ID NO: 1388205 - RNA, 15 nt, Human
ugguuucgaacuccu

SEQ ID NO: 1388206 - RNA, 15 nt, Human
ugguuucuagcauga

SEQ ID NO: 1388207 - RNA, 15 nt, Human
ugguuucauguuagu

SEQ ID NO: 1388208 - RNA, 12 nt, Human
ugguuucauguu

SEQ ID NO: 1388209 - RNA, 23 nt, Human
ugguuucagcacuagccaaaccu

SEQ ID NO: 1388210 - RNA, 20 nt, Human
ugguuucagcacuagccaaa

SEQ ID NO: 1388211 - RNA, 13 nt, Human
ugguuucagcacu

SEQ ID NO: 1388212 - RNA, 17 nt, Human
ugguuuauauauuuaaa

SEQ ID NO: 1388213 - RNA, 21 nt, Human
ugguuuaaagaaaguguauuu

SEQ ID NO: 1388214 - RNA, 14 nt, Human
ugguuucagaaaug

SEQ ID NO: 1388215 - RNA, 15 nt, Human
ugguuucagaaaugu

SEQ ID NO: 1388216 - RNA, 23 nt, Human
ugguuugaagaauguuaagacuu

SEQ ID NO: 1388217 - RNA, 22 nt, Human
ugguuucuugugcacuggcacc

SEQ ID NO: 1388218 - RNA, 20 nt, Human
ugguuuucuccaagagcuac

SEQ ID NO: 1388219 - RNA, 19 nt, Human
ugguuuucuccaagagcua

SEQ ID NO: 1388220 - RNA, 12 nt, Human
ugguuuucuguu

SEQ ID NO: 1388221 - RNA, 14 nt, Human
ugguuuuagauuuu

SEQ ID NO: 1388222 - RNA, 13 nt, Human
ugguuuuagauuu

SEQ ID NO: 1388223 - RNA, 18 nt, Human
ugguuuuaguugcaacuu

SEQ ID NO: 1388224 - RNA, 14 nt, Human
agguauauacuuug

SEQ ID NO: 1388225 - RNA, 22 nt, Human
agguaggggccccucucagccc

SEQ ID NO: 1388226 - RNA, 12 nt, Human
agguaggguuua

SEQ ID NO: 1388227 - RNA, 15 nt, Human
agguauaccucacuu

SEQ ID NO: 1388228 - RNA, 17 nt, Human
agguaggggccccucuc

SEQ ID NO: 1388229 - RNA, 23 nt, Human
agguaggccaagguguccuacag

SEQ ID NO: 1388230 - RNA, 19 nt, Human
agguagcugaaaggggaag

SEQ ID NO: 1388231 - RNA, 14 nt, Human
agguaggccaaggu

SEQ ID NO: 1388232 - RNA, 20 nt, Human
aggucaaaauagugccacua

SEQ ID NO: 1388233 - RNA, 15 nt, Human
aggguuugugacagg

SEQ ID NO: 1388234 - RNA, 18 nt, Human
aggguuugugacagggcg

SEQ ID NO: 1388235 - RNA, 21 nt, Human
aggguuucccuacugaagccc

SEQ ID NO: 1388236 - RNA, 22 nt, Human
aggguuucccuacugaagcccu

SEQ ID NO: 1388237 - RNA, 15 nt, Human
aggguuucaccaugu

SEQ ID NO: 1388238 - RNA, 22 nt, Human
aggguuuaauccccaguaaaau

SEQ ID NO: 1388239 - RNA, 21 nt, Human
aggguuuaauccccaguaaaa

SEQ ID NO: 1388240 - RNA, 14 nt, Human
aggguuggagcagu

SEQ ID NO: 1388241 - RNA, 19 nt, Human
aggugaaaguuaauccacu

SEQ ID NO: 1388242 - RNA, 15 nt, Human
aggugaaaggaaauu

SEQ ID NO: 1388243 - RNA, 22 nt, Human
aggugaaacuccagaugccaca

SEQ ID NO: 1388244 - RNA, 21 nt, Human
aggugaaacuccagaugccac

SEQ ID NO: 1388245 - RNA, 20 nt, Human
aggugaaacuccagaugcca

SEQ ID NO: 1388246 - RNA, 19 nt, Human
aggugaaacuccagaugcc

SEQ ID NO: 1388247 - RNA, 16 nt, Human
agguccaaugagcuuu

SEQ ID NO: 1388248 - RNA, 15 nt, Human
agguccaaugagcuu

SEQ ID NO: 1388249 - RNA, 20 nt, Human
agguccaaugagcuuucuga

SEQ ID NO: 1388250 - RNA, 19 nt, Human
agguccaaugagcuuucug

SEQ ID NO: 1388251 - RNA, 17 nt, Human
agguccaaugagcuuuc

SEQ ID NO: 1388252 - RNA, 15 nt, Human
aggucagugcaaaua

SEQ ID NO: 1388253 - RNA, 22 nt, Human
aggucauuuuuuuuaagaaaaa

SEQ ID NO: 1388254 - RNA, 23 nt, Human
aggucauuuuuuuuaagaaaaag

SEQ ID NO: 1388255 - RNA, 18 nt, Human
aggguugaccccagagga

SEQ ID NO: 1388256 - RNA, 17 nt, Human
aggguugaccccagagg

SEQ ID NO: 1388257 - RNA, 16 nt, Human
aggguugaccccagag

SEQ ID NO: 1388258 - RNA, 16 nt, Human
uggucuuuuauaauuc

SEQ ID NO: 1388259 - RNA, 15 nt, Human
uggucuuacagcagg

SEQ ID NO: 1388260 - RNA, 20 nt, Human
uggucuuacagcaggcagua

SEQ ID NO: 1388261 - RNA, 14 nt, Human
uggucuuuugguua

SEQ ID NO: 1388262 - RNA, 13 nt, Human
uggucucuugcuu

SEQ ID NO: 1388263 - RNA, 21 nt, Human
uggucucucuaugccucucua

SEQ ID NO: 1388264 - RNA, 18 nt, Human
uggucugcccucugcauc

SEQ ID NO: 1388265 - RNA, 11 nt, Human
uggucugcugu

SEQ ID NO: 1388266 - RNA, 18 nt, Human
uggucuguuggcaggcug

SEQ ID NO: 1388267 - RNA, 14 nt, Human
uggucuguuggcag

SEQ ID NO: 1388268 - RNA, 23 nt, Human
uggucccacaucccugggccugc

SEQ ID NO: 1388269 - RNA, 22 nt, Human
uggucccacaucccugggccug

SEQ ID NO: 1388270 - RNA, 21 nt, Human
uggucccacaucccugggccu

SEQ ID NO: 1388271 - RNA, 20 nt, Human
uggucccacaucccugggcc

SEQ ID NO: 1388272 - RNA, 19 nt, Human
uggucccacaucccugggc

SEQ ID NO: 1388273 - RNA, 17 nt, Human
uggucccacaucccugg

SEQ ID NO: 1388274 - RNA, 16 nt, Human
uggucccacaucccug

SEQ ID NO: 1388275 - RNA, 15 nt, Human
uggucccacaucccu

SEQ ID NO: 1388276 - RNA, 13 nt, Human
uggucccacaucc

SEQ ID NO: 1388277 - RNA, 22 nt, Human
ugguccaugggccauaugaaaa

SEQ ID NO: 1388278 - RNA, 22 nt, Human
agggugaguuggcuuaccuggc

SEQ ID NO: 1388279 - RNA, 19 nt, Human
agggugaguuggcuuaccu

SEQ ID NO: 1388280 - RNA, 20 nt, Human
agggugcaguaucaugcccu

SEQ ID NO: 1388281 - RNA, 20 nt, Human
agggugaguuggcuuaccug

SEQ ID NO: 1388282 - RNA, 14 nt, Human
ugguaaaacacuug

SEQ ID NO: 1388283 - RNA, 17 nt, Human
uggguuuuuuuccuuua

SEQ ID NO: 1388284 - RNA, 17 nt, Human
uggguuuuuggacuucu

SEQ ID NO: 1388285 - RNA, 21 nt, Human
uggguuuuguauucucugagc

SEQ ID NO: 1388286 - RNA, 19 nt, Human
uggguuuuguauucucuga

SEQ ID NO: 1388287 - RNA, 14 nt, Human
uggguuuuucccug

SEQ ID NO: 1388288 - RNA, 19 nt, Human
ugguacagagaagccagcu

SEQ ID NO: 1388289 - RNA, 18 nt, Human
ugguacagagaagccagc

SEQ ID NO: 1388290 - RNA, 17 nt, Human
ugguacagagaagccag

SEQ ID NO: 1388291 - RNA, 16 nt, Human
ugguacagagaagcca

SEQ ID NO: 1388292 - RNA, 15 nt, Human
ugguacagagaagcc

SEQ ID NO: 1388293 - RNA, 14 nt, Human
ugguacagagaagc

SEQ ID NO: 1388294 - RNA, 13 nt, Human
ugguacagagaag

SEQ ID NO: 1388295 - RNA, 12 nt, Human
ugguacagagaa

SEQ ID NO: 1388296 - RNA, 11 nt, Human
ugguacagaga

SEQ ID NO: 1388297 - RNA, 13 nt, Human
ugguaauuguugc

SEQ ID NO: 1388298 - RNA, 16 nt, Human
ugguaaagacuggcuu

SEQ ID NO: 1388299 - RNA, 14 nt, Human
ugguaauuguacua

SEQ ID NO: 1388300 - RNA, 17 nt, Human
ugguaaagacuggcuuu

SEQ ID NO: 1388301 - RNA, 18 nt, Human
ugguacaugguguuugug

SEQ ID NO: 1388302 - RNA, 15 nt, Human
ugguacaugguguuu

SEQ ID NO: 1388303 - RNA, 22 nt, Human
ugguacagagaagccagcuugu

SEQ ID NO: 1388304 - RNA, 22 nt, Human
ugguacaguauggggguuguaa

SEQ ID NO: 1388305 - RNA, 21 nt, Human
ugguacagagaagccagcuug

SEQ ID NO: 1388306 - RNA, 20 nt, Human
ugguacagagaagccagcuu

SEQ ID NO: 1388307 - RNA, 21 nt, Human
ugguccagggcuagugacuug

SEQ ID NO: 1388308 - RNA, 13 nt, Human
ugguccagggcua

SEQ ID NO: 1388309 - RNA, 16 nt, Human
ugguccaggagaaggc

SEQ ID NO: 1388310 - RNA, 12 nt, Human
ugguccaggaga

SEQ ID NO: 1388311 - RNA, 21 nt, Human
ugguccaauuaguuuccuuuu

SEQ ID NO: 1388312 - RNA, 23 nt, Human
ugguccaauuaguuuccuuuuua

SEQ ID NO: 1388313 - RNA, 19 nt, Human
ugguccaauuaguuuccuu

SEQ ID NO: 1388314 - RNA, 18 nt, Human
ugguccaauuaguuuccu

SEQ ID NO: 1388315 - RNA, 15 nt, Human
ugguccaauuaguuu

SEQ ID NO: 1388316 - RNA, 15 nt, Human
ugguccaagauuccg

SEQ ID NO: 1388317 - RNA, 19 nt, Human
uggucacggauuugugucu

SEQ ID NO: 1388318 - RNA, 23 nt, Human
ugguccaaaagauugcugaaauu

SEQ ID NO: 1388319 - RNA, 21 nt, Human
ugguccaaaagauugcugaaa

SEQ ID NO: 1388320 - RNA, 18 nt, Human
uggucauuuuauguuaag

SEQ ID NO: 1388321 - RNA, 23 nt, Human
uggucaccuaggaagccucagau

SEQ ID NO: 1388322 - RNA, 22 nt, Human
uggucaccuaggaagccucaga

SEQ ID NO: 1388323 - RNA, 21 nt, Human
uggucaccuaggaagccucag

SEQ ID NO: 1388324 - RNA, 16 nt, Human
uggucaccuaggaagc

SEQ ID NO: 1388325 - RNA, 19 nt, Human
uggucacguuuggugcuuc

SEQ ID NO: 1388326 - RNA, 12 nt, Human
aggguaaguauu

SEQ ID NO: 1388327 - RNA, 21 nt, Human
aggggucggcugaccaugcuc

SEQ ID NO: 1388328 - RNA, 15 nt, Human
aggggucggcugacc

SEQ ID NO: 1388329 - RNA, 18 nt, Human
agggggucguggagagcu

SEQ ID NO: 1388330 - RNA, 17 nt, Human
agggggucguggagagc

SEQ ID NO: 1388331 - RNA, 16 nt, Human
agggggucguggagag

SEQ ID NO: 1388332 - RNA, 15 nt, Human
agggggucguggaga

SEQ ID NO: 1388333 - RNA, 16 nt, Human
agggggggcucccugg

SEQ ID NO: 1388334 - RNA, 13 nt, Human
aggggggagggaa

SEQ ID NO: 1388335 - RNA, 17 nt, Human
agggggcuggugggugc

SEQ ID NO: 1388336 - RNA, 19 nt, Human
agggggaaaaagugucaac

SEQ ID NO: 1388337 - RNA, 21 nt, Human
aggguauauuuuccuauauua

SEQ ID NO: 1388338 - RNA, 17 nt, Human
aggguauauuuuccuau

SEQ ID NO: 1388339 - RNA, 16 nt, Human
aggguaggcuggaguu

SEQ ID NO: 1388340 - RNA, 18 nt, Human
aggguaggcaggauuggg

SEQ ID NO: 1388341 - RNA, 16 nt, Human
aggguaggcaggauug

SEQ ID NO: 1388342 - RNA, 15 nt, Human
aggguaggcaggauu

SEQ ID NO: 1388343 - RNA, 13 nt, Human
aggguaggcagga

SEQ ID NO: 1388344 - RNA, 14 nt, Human
aggguaccagcaga

SEQ ID NO: 1388345 - RNA, 15 nt, Human
aggguaccagcagaa

SEQ ID NO: 1388346 - RNA, 18 nt, Human
aggguacauggugcuggg

SEQ ID NO: 1388347 - RNA, 17 nt, Human
aggguacauggugcugg

SEQ ID NO: 1388348 - RNA, 14 nt, Human
aggguacauggugc

SEQ ID NO: 1388349 - RNA, 20 nt, Human
aggguaggagggugggaagg

SEQ ID NO: 1388350 - RNA, 23 nt, Human
aggguagaauucuggcugguaga

SEQ ID NO: 1388351 - RNA, 17 nt, Human
aggggaggcaucagugu

SEQ ID NO: 1388352 - RNA, 23 nt, Human
aggggaccuggaagggagguggg

SEQ ID NO: 1388353 - RNA, 13 nt, Human
aggggaccuggaa

SEQ ID NO: 1388354 - RNA, 19 nt, Human
aggggacccuccgcucugu

SEQ ID NO: 1388355 - RNA, 20 nt, Human
aggggaccaggagugggugg

SEQ ID NO: 1388356 - RNA, 17 nt, Human
aggggaccaggaguggg

SEQ ID NO: 1388357 - RNA, 22 nt, Human
aggggaccaggagugggugggg

SEQ ID NO: 1388358 - RNA, 16 nt, Human
aggggaccaggagugg

SEQ ID NO: 1388359 - RNA, 15 nt, Human
aggggaccaggagug

SEQ ID NO: 1388360 - RNA, 14 nt, Human
aggggaccaggagu

SEQ ID NO: 1388361 - RNA, 13 nt, Human
aggggaccaggag

SEQ ID NO: 1388362 - RNA, 12 nt, Human
aggggaccagga

SEQ ID NO: 1388363 - RNA, 22 nt, Human
ugggaauauuugaaucuugucu

SEQ ID NO: 1388364 - RNA, 19 nt, Human
ugggaauauuugaaucuug

SEQ ID NO: 1388365 - RNA, 20 nt, Human
ugggaauauuugaaucuugu

SEQ ID NO: 1388366 - RNA, 13 nt, Human
ugggaauauuuga

SEQ ID NO: 1388367 - RNA, 14 nt, Human
ugggaauauuugaa

SEQ ID NO: 1388368 - RNA, 15 nt, Human
ugggaauauuugaau

SEQ ID NO: 1388369 - RNA, 16 nt, Human
ugggaauauuugaauc

SEQ ID NO: 1388370 - RNA, 18 nt, Human
ugggaauauuugaaucuu

SEQ ID NO: 1388371 - RNA, 20 nt, Human
aggggaggggcuccuuucca

SEQ ID NO: 1388372 - RNA, 18 nt, Human
aggggagggggauccgac

SEQ ID NO: 1388373 - RNA, 18 nt, Human
aggggaggggcuccuuuc

SEQ ID NO: 1388374 - RNA, 17 nt, Human
aggggaggggcuccuuu

SEQ ID NO: 1388375 - RNA, 14 nt, Human
aggggcugggaaca

SEQ ID NO: 1388376 - RNA, 13 nt, Human
aggggcugggaac

SEQ ID NO: 1388377 - RNA, 23 nt, Human
aggggcuugacuuuuucaacuuc

SEQ ID NO: 1388378 - RNA, 16 nt, Human
aggggcuuccuggugc

SEQ ID NO: 1388379 - RNA, 14 nt, Human
aggggcuuccuggu

SEQ ID NO: 1388380 - RNA, 16 nt, Human
aggggcuucaggucca

SEQ ID NO: 1388381 - RNA, 15 nt, Human
aggggcuucaggucc

SEQ ID NO: 1388382 - RNA, 12 nt, Human
aggggcuucagg

SEQ ID NO: 1388383 - RNA, 21 nt, Human
aggggcuuauaauaaaggacu

SEQ ID NO: 1388384 - RNA, 13 nt, Human
auaauuauauguu

SEQ ID NO: 1388385 - RNA, 14 nt, Human
auaauuauauguug

SEQ ID NO: 1388386 - RNA, 13 nt, Human
auaaugaacagaa

SEQ ID NO: 1388387 - RNA, 19 nt, Human
auaauuauauaacuguauu

SEQ ID NO: 1388388 - RNA, 17 nt, Human
auaauuauauaacugua

SEQ ID NO: 1388389 - RNA, 15 nt, Human
auaauuauauaacug

SEQ ID NO: 1388390 - RNA, 14 nt, Human
auaaugaauacuuu

SEQ ID NO: 1388391 - RNA, 22 nt, Human
auaaucacucuaauuaauugua

SEQ ID NO: 1388392 - RNA, 18 nt, Human
auaaucacgcuuuccuga

SEQ ID NO: 1388393 - RNA, 16 nt, Human
auaaucacgcuuuccu

SEQ ID NO: 1388394 - RNA, 22 nt, Human
auaaucauuauuacuuuugcug

SEQ ID NO: 1388395 - RNA, 21 nt, Human
auaaucauuauuacuuuugcu

SEQ ID NO: 1388396 - RNA, 19 nt, Human
auaaucaucaaguaauaca

SEQ ID NO: 1388397 - RNA, 17 nt, Human
auaaugaacagaacaua

SEQ ID NO: 1388398 - RNA, 17 nt, Human
auaauccaguaaaauaa

SEQ ID NO: 1388399 - RNA, 15 nt, Human
uuagcagcuuccaga

SEQ ID NO: 1388400 - RNA, 18 nt, Human
uuagcaggaagcugugag

SEQ ID NO: 1388401 - RNA, 12 nt, Human
uuagcagacagg

SEQ ID NO: 1388402 - RNA, 21 nt, Human
uuagauuuucugguucuaaca

SEQ ID NO: 1388403 - RNA, 20 nt, Human
uuagauuuucugguucuaac

SEQ ID NO: 1388404 - RNA, 19 nt, Human
uuagauuuucugguucuaa

SEQ ID NO: 1388405 - RNA, 18 nt, Human
uuagauuuucugguucua

SEQ ID NO: 1388406 - RNA, 23 nt, Human
uuagauuuuacaugaaguauuuu

SEQ ID NO: 1388407 - RNA, 21 nt, Human
uuagauuuuacaugaaguauu

SEQ ID NO: 1388408 - RNA, 20 nt, Human
uuagauuuuacaugaaguau

SEQ ID NO: 1388409 - RNA, 19 nt, Human
uuagauuuuacaugaagua

SEQ ID NO: 1388410 - RNA, 15 nt, Human
uuagauuuuacauga

SEQ ID NO: 1388411 - RNA, 14 nt, Human
uuagauuuuacaug

SEQ ID NO: 1388412 - RNA, 12 nt, Human
uuagauuuuaca

SEQ ID NO: 1388413 - RNA, 13 nt, Human
uuagauuuuaauc

SEQ ID NO: 1388414 - RNA, 13 nt, Human
uuagauuugugug

SEQ ID NO: 1388415 - RNA, 22 nt, Human
uuagauuucauaguucagaauu

SEQ ID NO: 1388416 - RNA, 20 nt, Human
uuagauuucauaguucagaa

SEQ ID NO: 1388417 - RNA, 18 nt, Human
uuagauuucauaguucag

SEQ ID NO: 1388418 - RNA, 14 nt, Human
uuagauuucauagu

SEQ ID NO: 1388419 - RNA, 10 nt, Human
uuagauuuca

SEQ ID NO: 1388420 - RNA, 22 nt, Human
uuagauucucugugucuaagau

SEQ ID NO: 1388421 - RNA, 20 nt, Human
uuagauucucugugucuaag

SEQ ID NO: 1388422 - RNA, 19 nt, Human
uuagauucucugugucuaa

SEQ ID NO: 1388423 - RNA, 16 nt, Human
uuagauguaauuuugu

SEQ ID NO: 1388424 - RNA, 20 nt, Human
auaauugugauuagacagaa

SEQ ID NO: 1388425 - RNA, 23 nt, Human
auaauugccaaaaagugaaauaa

SEQ ID NO: 1388426 - RNA, 21 nt, Human
auaauugccaaaaagugaaau

SEQ ID NO: 1388427 - RNA, 17 nt, Human
auaauugccaaaaagug

SEQ ID NO: 1388428 - RNA, 22 nt, Human
auaauugcauugacuuucccca

SEQ ID NO: 1388429 - RNA, 16 nt, Human
auaauugcauugacuu

SEQ ID NO: 1388430 - RNA, 14 nt, Human
auaauugcauugac

SEQ ID NO: 1388431 - RNA, 19 nt, Human
auaauugaguuuucagugg

SEQ ID NO: 1388432 - RNA, 23 nt, Human
auaauucugaguuuuguguuugu

SEQ ID NO: 1388433 - RNA, 20 nt, Human
auaauucugaguuuuguguu

SEQ ID NO: 1388434 - RNA, 23 nt, Human
auaauucucauuaaaagaauauc

SEQ ID NO: 1388435 - RNA, 22 nt, Human
auaauucucauuaaaagaauau

SEQ ID NO: 1388436 - RNA, 15 nt, Human
auaauucucauuaaa

SEQ ID NO: 1388437 - RNA, 14 nt, Human
auaauucucauuaa

SEQ ID NO: 1388438 - RNA, 22 nt, Human
auaauugccaaaaagugaaaua

SEQ ID NO: 1388439 - RNA, 20 nt, Human
auaauuggauuuccuaauac

SEQ ID NO: 1388440 - RNA, 18 nt, Human
auaauuggauuuccuaau

SEQ ID NO: 1388441 - RNA, 17 nt, Human
auaauuggauuuccuaa

SEQ ID NO: 1388442 - RNA, 16 nt, Human
auaauuggauuuccua

SEQ ID NO: 1388443 - RNA, 21 nt, Human
auaauugugauuagacagaac

SEQ ID NO: 1388444 - RNA, 22 nt, Human
uuagaugcaguucugaagaaga

SEQ ID NO: 1388445 - RNA, 23 nt, Human
uuagaugcaguucugaagaagau

SEQ ID NO: 1388446 - RNA, 18 nt, Human
uuaccuaagauuacaaau

SEQ ID NO: 1388447 - RNA, 14 nt, Human
uuaccuaagauuac

SEQ ID NO: 1388448 - RNA, 22 nt, Human
uuaccugaaaacacugugcaca

SEQ ID NO: 1388449 - RNA, 20 nt, Human
uuaccugaaaacacugugca

SEQ ID NO: 1388450 - RNA, 18 nt, Human
uuaccugaaaacacugug

SEQ ID NO: 1388451 - RNA, 12 nt, Human
uuaccugggaaa

SEQ ID NO: 1388452 - RNA, 23 nt, Human
auaagcaagaaggcaaaaauagu

SEQ ID NO: 1388453 - RNA, 21 nt, Human
auaagcaagaaggcaaaaaua

SEQ ID NO: 1388454 - RNA, 16 nt, Human
auaagcaagaaggcaa

SEQ ID NO: 1388455 - RNA, 17 nt, Human
auaagauucuaacgguc

SEQ ID NO: 1388456 - RNA, 16 nt, Human
auaagcagguggaucu

SEQ ID NO: 1388457 - RNA, 15 nt, Human
auaagaagaaugcuu

SEQ ID NO: 1388458 - RNA, 13 nt, Human
auaagaagaaugc

SEQ ID NO: 1388459 - RNA, 11 nt, Human
auaagaagaau

SEQ ID NO: 1388460 - RNA, 16 nt, Human
auaagaacuuugagcu

SEQ ID NO: 1388461 - RNA, 13 nt, Human
auaagauucuaac

SEQ ID NO: 1388462 - RNA, 19 nt, Human
auaagaagaaugcuuaauc

SEQ ID NO: 1388463 - RNA, 20 nt, Human
auaagaagaaugcuuaauca

SEQ ID NO: 1388464 - RNA, 20 nt, Human
auaagcaaaaacaaaaagaa

SEQ ID NO: 1388465 - RNA, 13 nt, Human
auaagcaggugga

SEQ ID NO: 1388466 - RNA, 24 nt, Human
auaaguucaaauucuucugaacuc

SEQ ID NO: 1388467 - RNA, 21 nt, Human
auaaguucaaauucuucugaa

SEQ ID NO: 1388468 - RNA, 20 nt, Human
auaaguucaaauucuucuga

SEQ ID NO: 1388469 - RNA, 18 nt, Human
auaaguucaaauucuucu

SEQ ID NO: 1388470 - RNA, 24 nt, Human
auaaguuauugcaguuuaucauuc

SEQ ID NO: 1388471 - RNA, 21 nt, Human
auaaguuauugcaguuuauca

SEQ ID NO: 1388472 - RNA, 20 nt, Human
auaaguuauugcaguuuauc

SEQ ID NO: 1388473 - RNA, 16 nt, Human
auaaguuauugcaguu

SEQ ID NO: 1388474 - RNA, 14 nt, Human
auaaguuauugcag

SEQ ID NO: 1388475 - RNA, 13 nt, Human
auaaguuauugca

SEQ ID NO: 1388476 - RNA, 14 nt, Human
auaauaauuaguaa

SEQ ID NO: 1388477 - RNA, 23 nt, Human
auaauacaccacuacauucuguu

SEQ ID NO: 1388478 - RNA, 21 nt, Human
auaaguuucugggaccucagu

SEQ ID NO: 1388479 - RNA, 13 nt, Human
auaaguuuuaugu

SEQ ID NO: 1388480 - RNA, 18 nt, Human
uuacccuggccccucucc

SEQ ID NO: 1388481 - RNA, 20 nt, Human
uuacccuggccccucucccu

SEQ ID NO: 1388482 - RNA, 17 nt, Human
uuacccuggccccucuc

SEQ ID NO: 1388483 - RNA, 13 nt, Human
uuacccuggcccc

SEQ ID NO: 1388484 - RNA, 14 nt, Human
uuaccauuuacaug

SEQ ID NO: 1388485 - RNA, 13 nt, Human
uuacaugcuuauu

SEQ ID NO: 1388486 - RNA, 12 nt, Human
uuacaugcuuau

SEQ ID NO: 1388487 - RNA, 22 nt, Human
uuacaugcauuacugcaugcac

SEQ ID NO: 1388488 - RNA, 22 nt, Human
uuacaugaggacucuauucuuu

SEQ ID NO: 1388489 - RNA, 22 nt, Human
uuaccauuaaaccaucucccug

SEQ ID NO: 1388490 - RNA, 23 nt, Human
uuaccauuaaaccaucucccugg

SEQ ID NO: 1388491 - RNA, 20 nt, Human
uuacaugcuuauuccaugac

SEQ ID NO: 1388492 - RNA, 14 nt, Human
uuaccauguaaugg

SEQ ID NO: 1388493 - RNA, 19 nt, Human
uuacaugcuuauuccauga

SEQ ID NO: 1388494 - RNA, 14 nt, Human
uuacaugcuuauuc

SEQ ID NO: 1388495 - RNA, 17 nt, Human
uuacaugauucauuuua

SEQ ID NO: 1388496 - RNA, 16 nt, Human
uuacaugauucauuuu

SEQ ID NO: 1388497 - RNA, 20 nt, Human
uuacaugaaguauuuuuuca

SEQ ID NO: 1388498 - RNA, 17 nt, Human
uuacaugaauugcauuu

SEQ ID NO: 1388499 - RNA, 16 nt, Human
uuacaugaaguauuuu

SEQ ID NO: 1388500 - RNA, 15 nt, Human
uuacaugaaguauuu

SEQ ID NO: 1388501 - RNA, 14 nt, Human
uuacaugaaguauu

SEQ ID NO: 1388502 - RNA, 13 nt, Human
uuacaugaaguau

SEQ ID NO: 1388503 - RNA, 18 nt, Human
auaacuguauuugaaaua

SEQ ID NO: 1388504 - RNA, 15 nt, Human
auaacuguauuugaa

SEQ ID NO: 1388505 - RNA, 20 nt, Human
auaacuguaaaugugacauu

SEQ ID NO: 1388506 - RNA, 14 nt, Human
auaacugaacaucc

SEQ ID NO: 1388507 - RNA, 21 nt, Human
auaacugaaaauuauuuaaac

SEQ ID NO: 1388508 - RNA, 20 nt, Human
auaacugaaaauuauuuaaa

SEQ ID NO: 1388509 - RNA, 17 nt, Human
auaacugaaaauuauuu

SEQ ID NO: 1388510 - RNA, 14 nt, Human
auaacugaaaauua

SEQ ID NO: 1388511 - RNA, 15 nt, Human
auaacugaaaaugug

SEQ ID NO: 1388512 - RNA, 13 nt, Human
auaacugaaaaug

SEQ ID NO: 1388513 - RNA, 12 nt, Human
auaaccacugcu

SEQ ID NO: 1388514 - RNA, 14 nt, Human
auaaccacugcuuc

SEQ ID NO: 1388515 - RNA, 20 nt, Human
auaaccaguguuguggauuu

SEQ ID NO: 1388516 - RNA, 21 nt, Human
auaacuggaaaacagaacacu

SEQ ID NO: 1388517 - RNA, 17 nt, Human
auaacuggaaaacagaa

SEQ ID NO: 1388518 - RNA, 15 nt, Human
auaacuggaaaacag

SEQ ID NO: 1388519 - RNA, 23 nt, Human
auaacuggaaaacagaacacuua

SEQ ID NO: 1388520 - RNA, 22 nt, Human
auaacuggaaaacagaacacuu

SEQ ID NO: 1388521 - RNA, 15 nt, Human
auaacuggaaagaag

SEQ ID NO: 1388522 - RNA, 12 nt, Human
auaacuggaaac

SEQ ID NO: 1388523 - RNA, 19 nt, Human
auaacaugugaaaagaaua

SEQ ID NO: 1388524 - RNA, 13 nt, Human
auaaauaaaguuu

SEQ ID NO: 1388525 - RNA, 19 nt, Human
auaaauaaaguuuguugaa

SEQ ID NO: 1388526 - RNA, 15 nt, Human
auaaaguaucaucag

SEQ ID NO: 1388527 - RNA, 14 nt, Human
auaaaguaucauca

SEQ ID NO: 1388528 - RNA, 17 nt, Human
auaaaguaguccuguga

SEQ ID NO: 1388529 - RNA, 16 nt, Human
auaaaguaguccugug

SEQ ID NO: 1388530 - RNA, 16 nt, Human
auaaacuuuaccuuuu

SEQ ID NO: 1388531 - RNA, 13 nt, Human
auaaacuuuaccu

SEQ ID NO: 1388532 - RNA, 15 nt, Human
auaaacuuuaccuuu

SEQ ID NO: 1388533 - RNA, 18 nt, Human
auaaagugacccugcucu

SEQ ID NO: 1388534 - RNA, 20 nt, Human
auaaagugacccugcucuca

SEQ ID NO: 1388535 - RNA, 12 nt, Human
auaaaguauuua

SEQ ID NO: 1388536 - RNA, 14 nt, Human
auaaaguauuuaau

SEQ ID NO: 1388537 - RNA, 15 nt, Human
auaaaguauuuaauu

SEQ ID NO: 1388538 - RNA, 17 nt, Human
auaaaguauuuaauuag

SEQ ID NO: 1388539 - RNA, 19 nt, Human
auaaaguauuuaauuagug

SEQ ID NO: 1388540 - RNA, 21 nt, Human
auaaaguauuuaauuagugcu

SEQ ID NO: 1388541 - RNA, 22 nt, Human
auaaacuuuaauauaaaguagu

SEQ ID NO: 1388542 - RNA, 20 nt, Human
auaaacuuuaauauaaagua

SEQ ID NO: 1388543 - RNA, 16 nt, Human
auaaacuuuaauauaa

SEQ ID NO: 1388544 - RNA, 17 nt, Human
auaaacuaauaauugca

SEQ ID NO: 1388545 - RNA, 15 nt, Human
auaaacuaauaauug

SEQ ID NO: 1388546 - RNA, 14 nt, Human
auaaacuaauaauu

SEQ ID NO: 1388547 - RNA, 15 nt, Human
auaaacucauuucua

SEQ ID NO: 1388548 - RNA, 18 nt, Human
auaaacgucuuaaauauu

SEQ ID NO: 1388549 - RNA, 16 nt, Human
auaaacgucuuaaaua

SEQ ID NO: 1388550 - RNA, 15 nt, Human
auaaacgucuuaaau

SEQ ID NO: 1388551 - RNA, 22 nt, Human
auaaacauuuguagcauccucu

SEQ ID NO: 1388552 - RNA, 21 nt, Human
auaaacccaguugccaucugc

SEQ ID NO: 1388553 - RNA, 16 nt, Human
auaaaccgaacugaug

SEQ ID NO: 1388554 - RNA, 18 nt, Human
aguuuuccuaugcuuuga

SEQ ID NO: 1388555 - RNA, 16 nt, Human
aguuuuccuaugcuuu

SEQ ID NO: 1388556 - RNA, 17 nt, Human
aguuuucuccucccagg

SEQ ID NO: 1388557 - RNA, 23 nt, Human
auaaacacucuugaaaaaugcau

SEQ ID NO: 1388558 - RNA, 12 nt, Human
auacaaaagcau

SEQ ID NO: 1388559 - RNA, 13 nt, Human
auacaaaagcaug

SEQ ID NO: 1388560 - RNA, 15 nt, Human
auacaaaagcaugug

SEQ ID NO: 1388561 - RNA, 14 nt, Human
auaauuuuuauaug

SEQ ID NO: 1388562 - RNA, 22 nt, Human
auaauuuuuauauuugaaauau

SEQ ID NO: 1388563 - RNA, 21 nt, Human
auaauuuuuauauuugaaaua

SEQ ID NO: 1388564 - RNA, 19 nt, Human
auaauuuuuauauuugaaa

SEQ ID NO: 1388565 - RNA, 16 nt, Human
auaauuuuuauauuug

SEQ ID NO: 1388566 - RNA, 23 nt, Human
auaauuuuguaauguaucaaaua

SEQ ID NO: 1388567 - RNA, 13 nt, Human
auaauuuuguaau

SEQ ID NO: 1388568 - RNA, 12 nt, Human
auaauuuuguaa

SEQ ID NO: 1388569 - RNA, 14 nt, Human
auaauuuuuauauu

SEQ ID NO: 1388570 - RNA, 20 nt, Human
auaauuuugugaagcaaaau

SEQ ID NO: 1388571 - RNA, 15 nt, Human
auaauuuugugaagc

SEQ ID NO: 1388572 - RNA, 14 nt, Human
auaauuuugugaag

SEQ ID NO: 1388573 - RNA, 13 nt, Human
auaauuuugugaa

SEQ ID NO: 1388574 - RNA, 21 nt, Human
uuauauauggggaugguaguu

SEQ ID NO: 1388575 - RNA, 17 nt, Human
uuauauauguauuuaua

SEQ ID NO: 1388576 - RNA, 14 nt, Human
uuauauauauauau

SEQ ID NO: 1388577 - RNA, 18 nt, Human
uuauauauaaauauauua

SEQ ID NO: 1388578 - RNA, 23 nt, Human
uuauauauaaauauauuauuacu

SEQ ID NO: 1388579 - RNA, 15 nt, Human
uuauauauaaauaua

SEQ ID NO: 1388580 - RNA, 14 nt, Human
uuauauauguauuu

SEQ ID NO: 1388581 - RNA, 22 nt, Human
uuauauauauuuuuuucugaaa

SEQ ID NO: 1388582 - RNA, 22 nt, Human
uuauauaauugccaaaaaguga

SEQ ID NO: 1388583 - RNA, 20 nt, Human
uuauauaauugccaaaaagu

SEQ ID NO: 1388584 - RNA, 16 nt, Human
uuauauaaucauuauu

SEQ ID NO: 1388585 - RNA, 20 nt, Human
uuauauaaucauuauuacuu

SEQ ID NO: 1388586 - RNA, 22 nt, Human
uuauauaacuguauuugaaaua

SEQ ID NO: 1388587 - RNA, 18 nt, Human
uuauauaacuguauuuga

SEQ ID NO: 1388588 - RNA, 16 nt, Human
uuauauaacuguauuu

SEQ ID NO: 1388589 - RNA, 12 nt, Human
uuauauaacugu

SEQ ID NO: 1388590 - RNA, 12 nt, Human
uuauaguuucug

SEQ ID NO: 1388591 - RNA, 19 nt, Human
uuauaguuacuguguaauu

SEQ ID NO: 1388592 - RNA, 15 nt, Human
uuauaguuacugugu

SEQ ID NO: 1388593 - RNA, 14 nt, Human
uuauaguuacugug

SEQ ID NO: 1388594 - RNA, 13 nt, Human
uuauaguuacugu

SEQ ID NO: 1388595 - RNA, 13 nt, Human
uuauaguuucuga

SEQ ID NO: 1388596 - RNA, 15 nt, Human
uuauaguuucugagg

SEQ ID NO: 1388597 - RNA, 18 nt, Human
uuauauaagcuuguauuc

SEQ ID NO: 1388598 - RNA, 18 nt, Human
uuauaacuguaaagaugu

SEQ ID NO: 1388599 - RNA, 17 nt, Human
uuauaacuguaaagaug

SEQ ID NO: 1388600 - RNA, 17 nt, Human
uuauaacuggaaagaag

SEQ ID NO: 1388601 - RNA, 16 nt, Human
uuauaacuggaaagaa

SEQ ID NO: 1388602 - RNA, 19 nt, Human
uuauaacuaacauguccug

SEQ ID NO: 1388603 - RNA, 15 nt, Human
uuauaacuaacaugu

SEQ ID NO: 1388604 - RNA, 21 nt, Human
uuauaaccuuaauuuauuauu

SEQ ID NO: 1388605 - RNA, 19 nt, Human
uuauaaccuuaauuuauua

SEQ ID NO: 1388606 - RNA, 16 nt, Human
uuauaaccuuaauuua

SEQ ID NO: 1388607 - RNA, 17 nt, Human
uuauaaauuucuauuuu

SEQ ID NO: 1388608 - RNA, 16 nt, Human
uuauaccaaaauguug

SEQ ID NO: 1388609 - RNA, 23 nt, Human
uuauaaauguaccagagagaguu

SEQ ID NO: 1388610 - RNA, 18 nt, Human
uuagccuggaccucugac

SEQ ID NO: 1388611 - RNA, 17 nt, Human
uuagccuggaccucuga

SEQ ID NO: 1388612 - RNA, 20 nt, Human
uuagccucaauuucugaaca

SEQ ID NO: 1388613 - RNA, 17 nt, Human
uuagccugaguagaaag

SEQ ID NO: 1388614 - RNA, 16 nt, Human
uuagccccugaaagcc

SEQ ID NO: 1388615 - RNA, 15 nt, Human
uuagccccugaaagc

SEQ ID NO: 1388616 - RNA, 21 nt, Human
uuagccguggugauuuagcag

SEQ ID NO: 1388617 - RNA, 16 nt, Human
uuauagaaguuuagau

SEQ ID NO: 1388618 - RNA, 23 nt, Human
uuauacuuucccuacccucuaga

SEQ ID NO: 1388619 - RNA, 18 nt, Human
uuauacuuuguaaagaca

SEQ ID NO: 1388620 - RNA, 18 nt, Human
uuauacuuucccuacccu

SEQ ID NO: 1388621 - RNA, 19 nt, Human
uuauacuuguaauuaugga

SEQ ID NO: 1388622 - RNA, 15 nt, Human
uuauacuuguaauua

SEQ ID NO: 1388623 - RNA, 16 nt, Human
uuauacucuuucugua

SEQ ID NO: 1388624 - RNA, 22 nt, Human
uuauacgcuggcaacacagagg

SEQ ID NO: 1388625 - RNA, 21 nt, Human
uuauacgcuggcaacacagag

SEQ ID NO: 1388626 - RNA, 20 nt, Human
uuauacgaguaauaugccug

SEQ ID NO: 1388627 - RNA, 17 nt, Human
uuauacgaaauaauugu

SEQ ID NO: 1388628 - RNA, 16 nt, Human
uuauacgaaauaauug

SEQ ID NO: 1388629 - RNA, 14 nt, Human
uuauacgaaauaau

SEQ ID NO: 1388630 - RNA, 22 nt, Human
uuauaccaaaauguugcugaaa

SEQ ID NO: 1388631 - RNA, 21 nt, Human
uuauagauucuaaagauucua

SEQ ID NO: 1388632 - RNA, 20 nt, Human
uuauagauucuaaagauucu

SEQ ID NO: 1388633 - RNA, 19 nt, Human
uuauagauucuaaagauuc

SEQ ID NO: 1388634 - RNA, 16 nt, Human
uuauagauucuaaaga

SEQ ID NO: 1388635 - RNA, 15 nt, Human
uuauagauucuaaag

SEQ ID NO: 1388636 - RNA, 14 nt, Human
uuauagauucuaaa

SEQ ID NO: 1388637 - RNA, 13 nt, Human
uuauagauucuaa

SEQ ID NO: 1388638 - RNA, 12 nt, Human
uuauagauucua

SEQ ID NO: 1388639 - RNA, 17 nt, Human
uuauagccucugucugg

SEQ ID NO: 1388640 - RNA, 16 nt, Human
uuauagccucugucug

SEQ ID NO: 1388641 - RNA, 15 nt, Human
uuauagccucugucu

SEQ ID NO: 1388642 - RNA, 19 nt, Human
uuauagccucugucuggca

SEQ ID NO: 1388643 - RNA, 16 nt, Human
uuauaggaucauuugu

SEQ ID NO: 1388644 - RNA, 18 nt, Human
uuauaggauuuauuuaaa

SEQ ID NO: 1388645 - RNA, 21 nt, Human
uuauagugauguaaucuugaa

SEQ ID NO: 1388646 - RNA, 21 nt, Human
uuauagugaauacugcuacag

SEQ ID NO: 1388647 - RNA, 15 nt, Human
uuauagugaauacug

SEQ ID NO: 1388648 - RNA, 24 nt, Human
uuauaggauuuauuuaaaauagca

SEQ ID NO: 1388649 - RNA, 13 nt, Human
uuauaguacauga

SEQ ID NO: 1388650 - RNA, 16 nt, Human
uuauaguacaugauaa

SEQ ID NO: 1388651 - RNA, 17 nt, Human
uuauaguacaugauaaa

SEQ ID NO: 1388652 - RNA, 12 nt, Human
auacagcuguau

SEQ ID NO: 1388653 - RNA, 13 nt, Human
auacagcucagaa

SEQ ID NO: 1388654 - RNA, 22 nt, Human
auacagcagagcuagguggaaa

SEQ ID NO: 1388655 - RNA, 16 nt, Human
auacagcaacaauuua

SEQ ID NO: 1388656 - RNA, 14 nt, Human
auacagauuuugau

SEQ ID NO: 1388657 - RNA, 16 nt, Human
auacagauuuugauag

SEQ ID NO: 1388658 - RNA, 17 nt, Human
auacagauuuugauagc

SEQ ID NO: 1388659 - RNA, 18 nt, Human
auacagauuuugauagca

SEQ ID NO: 1388660 - RNA, 19 nt, Human
auacagauuuugauagcaa

SEQ ID NO: 1388661 - RNA, 22 nt, Human
auacagauuuugauagcaaagc

SEQ ID NO: 1388662 - RNA, 17 nt, Human
auacaaauggauuuugg

SEQ ID NO: 1388663 - RNA, 20 nt, Human
auacaaauggauuuugggag

SEQ ID NO: 1388664 - RNA, 14 nt, Human
auacaaauggauuu

SEQ ID NO: 1388665 - RNA, 13 nt, Human
auacaaauggauu

SEQ ID NO: 1388666 - RNA, 19 nt, Human
auacaaaggcuuauuaauu

SEQ ID NO: 1388667 - RNA, 18 nt, Human
auacaaaaauacucagau

SEQ ID NO: 1388668 - RNA, 21 nt, Human
auacaguucggugagcuacaa

SEQ ID NO: 1388669 - RNA, 20 nt, Human
auacagcuguauugucugaa

SEQ ID NO: 1388670 - RNA, 16 nt, Human
auacauuuucuaagaa

SEQ ID NO: 1388671 - RNA, 16 nt, Human
auaccaaaauguugcu

SEQ ID NO: 1388672 - RNA, 15 nt, Human
auaccaaaauguugc

SEQ ID NO: 1388673 - RNA, 18 nt, Human
auaccaaagcacauuuua

SEQ ID NO: 1388674 - RNA, 17 nt, Human
auaccaaagcacauuuu

SEQ ID NO: 1388675 - RNA, 20 nt, Human
auaccaaaauguugcugaaa

SEQ ID NO: 1388676 - RNA, 12 nt, Human
auaccaauaaag

SEQ ID NO: 1388677 - RNA, 13 nt, Human
auaccaauaaagu

SEQ ID NO: 1388678 - RNA, 21 nt, Human
auacauuuaaaacauuaaaau

SEQ ID NO: 1388679 - RNA, 16 nt, Human
auacauuuaaaacauu

SEQ ID NO: 1388680 - RNA, 20 nt, Human
auacauuguauauaugugua

SEQ ID NO: 1388681 - RNA, 21 nt, Human
auacaguucugcucugguugu

SEQ ID NO: 1388682 - RNA, 20 nt, Human
auacauaaacaagaccacgu

SEQ ID NO: 1388683 - RNA, 22 nt, Human
auacauuauauuucuauuuuau

SEQ ID NO: 1388684 - RNA, 17 nt, Human
auacauuauauuucuau

SEQ ID NO: 1388685 - RNA, 15 nt, Human
auacauuauauuucu

SEQ ID NO: 1388686 - RNA, 20 nt, Human
auacaucccuuaccugggaa

SEQ ID NO: 1388687 - RNA, 19 nt, Human
auacucaaaugaguaacau

SEQ ID NO: 1388688 - RNA, 16 nt, Human
auacuagggagccauu

SEQ ID NO: 1388689 - RNA, 22 nt, Human
auacuauuuaaagccuccucau

SEQ ID NO: 1388690 - RNA, 21 nt, Human
auacuauuuaaagccuccuca

SEQ ID NO: 1388691 - RNA, 17 nt, Human
auacuaccuugaaaaua

SEQ ID NO: 1388692 - RNA, 15 nt, Human
auacuaccuugaaaa

SEQ ID NO: 1388693 - RNA, 14 nt, Human
auacuaccuugaaa

SEQ ID NO: 1388694 - RNA, 13 nt, Human
auacuacaguuug

SEQ ID NO: 1388695 - RNA, 15 nt, Human
auacuacaguuuguu

SEQ ID NO: 1388696 - RNA, 16 nt, Human
auacuacaguuuguua

SEQ ID NO: 1388697 - RNA, 20 nt, Human
auacuacaguuuguuaguau

SEQ ID NO: 1388698 - RNA, 22 nt, Human
auaccagcgaggaggcuccaga

SEQ ID NO: 1388699 - RNA, 16 nt, Human
auaccagcgaggaggc

SEQ ID NO: 1388700 - RNA, 21 nt, Human
auacuaaugaaaacagaaugu

SEQ ID NO: 1388701 - RNA, 22 nt, Human
auacuaauaaacuaauaauugc

SEQ ID NO: 1388702 - RNA, 18 nt, Human
auacuaauaaacuaauaa

SEQ ID NO: 1388703 - RNA, 21 nt, Human
auacuaagcauugaauggcua

SEQ ID NO: 1388704 - RNA, 17 nt, Human
auacuaagcauugaaug

SEQ ID NO: 1388705 - RNA, 21 nt, Human
auacuaaccagcagaaaugcc

SEQ ID NO: 1388706 - RNA, 21 nt, Human
auaccaaugaaaaaauguaua

SEQ ID NO: 1388707 - RNA, 19 nt, Human
auaccagccaguaaauggg

SEQ ID NO: 1388708 - RNA, 22 nt, Human
auaccacaggaaccacaagacu

SEQ ID NO: 1388709 - RNA, 14 nt, Human
auaccaauaaagug

SEQ ID NO: 1388710 - RNA, 15 nt, Human
auaccaauaaaguga

SEQ ID NO: 1388711 - RNA, 19 nt, Human
auaccaaugaaaaaaugua

SEQ ID NO: 1388712 - RNA, 21 nt, Human
auaccaauaaagugacccugc

SEQ ID NO: 1388713 - RNA, 15 nt, Human
uuaucaacaauagug

SEQ ID NO: 1388714 - RNA, 19 nt, Human
uuaucaaacccuagccuug

SEQ ID NO: 1388715 - RNA, 21 nt, Human
uuaucaaacccuagccuugcu

SEQ ID NO: 1388716 - RNA, 18 nt, Human
uuaucaaacccuagccuu

SEQ ID NO: 1388717 - RNA, 16 nt, Human
uuaucaaaacuuucuu

SEQ ID NO: 1388718 - RNA, 20 nt, Human
auacucaaaugaguaacauu

SEQ ID NO: 1388719 - RNA, 16 nt, Human
uuaucaguaaauaacu

SEQ ID NO: 1388720 - RNA, 19 nt, Human
uuaucaccuagcugaaugu

SEQ ID NO: 1388721 - RNA, 23 nt, Human
uuaucaccuagcugaauguuuuu

SEQ ID NO: 1388722 - RNA, 21 nt, Human
uuaucaccgugggcucccuga

SEQ ID NO: 1388723 - RNA, 21 nt, Human
uuaucaacuuccuaaauauua

SEQ ID NO: 1388724 - RNA, 15 nt, Human
uuaucaacuuccuaa

SEQ ID NO: 1388725 - RNA, 14 nt, Human
uuaucagugcuucc

SEQ ID NO: 1388726 - RNA, 23 nt, Human
uuaucagucauaacuaaauaaag

SEQ ID NO: 1388727 - RNA, 21 nt, Human
uuaucagucauaacuaaauaa

SEQ ID NO: 1388728 - RNA, 23 nt, Human
uuaucagucaauauuuuuagaua

SEQ ID NO: 1388729 - RNA, 15 nt, Human
uuaucagucaauauu

SEQ ID NO: 1388730 - RNA, 14 nt, Human
uuaucagucaauau

SEQ ID NO: 1388731 - RNA, 17 nt, Human
uuaucaugugaaaucau

SEQ ID NO: 1388732 - RNA, 18 nt, Human
uuaucaugugaaaucauu

SEQ ID NO: 1388733 - RNA, 20 nt, Human
uuaucaugugaaaucauuca

SEQ ID NO: 1388734 - RNA, 22 nt, Human
uuaucaugugaaaucauucauu

SEQ ID NO: 1388735 - RNA, 12 nt, Human
uuaaaauauaau

SEQ ID NO: 1388736 - RNA, 23 nt, Human
uuaaaauagcguucuuguaauuu

SEQ ID NO: 1388737 - RNA, 23 nt, Human
uuaaacgcucuagguacgaugac

SEQ ID NO: 1388738 - RNA, 22 nt, Human
uuaaacgauuuuuaaaauguac

SEQ ID NO: 1388739 - RNA, 18 nt, Human
uuaaacgauuuuuaaaau

SEQ ID NO: 1388740 - RNA, 15 nt, Human
uuaaacgauuuuuaa

SEQ ID NO: 1388741 - RNA, 19 nt, Human
uuaaaccgcuaaaagaaac

SEQ ID NO: 1388742 - RNA, 14 nt, Human
uuaaaccuuuuuug

SEQ ID NO: 1388743 - RNA, 14 nt, Human
uuaaaccuauacuc

SEQ ID NO: 1388744 - RNA, 17 nt, Human
uuaaaccuauacucacu

SEQ ID NO: 1388745 - RNA, 16 nt, Human
uuaaaccgcuaaaaga

SEQ ID NO: 1388746 - RNA, 16 nt, Human
uuaaaaucagcuauuu

SEQ ID NO: 1388747 - RNA, 20 nt, Human
uuaaauaaugugaaacugga

SEQ ID NO: 1388748 - RNA, 21 nt, Human
uuaaauaaugugaaacuggau

SEQ ID NO: 1388749 - RNA, 22 nt, Human
uuaaauaaugugaaacuggauu

SEQ ID NO: 1388750 - RNA, 16 nt, Human
aguugcacagcuauga

SEQ ID NO: 1388751 - RNA, 17 nt, Human
aguugcacagcuaugaa

SEQ ID NO: 1388752 - RNA, 19 nt, Human
aguugcauguaguaacacu

SEQ ID NO: 1388753 - RNA, 18 nt, Human
aguugcauguaguaacac

SEQ ID NO: 1388754 - RNA, 17 nt, Human
aguugcauguaguaaca

SEQ ID NO: 1388755 - RNA, 15 nt, Human
aguugcauguaguaa

SEQ ID NO: 1388756 - RNA, 13 nt, Human
aguugcauguagu

SEQ ID NO: 1388757 - RNA, 21 nt, Human
aguugcauguaguaacacuaa

SEQ ID NO: 1388758 - RNA, 22 nt, Human
aguugcauguaguaacacuaau

SEQ ID NO: 1388759 - RNA, 18 nt, Human
uuaaaaaagaaacauuug

SEQ ID NO: 1388760 - RNA, 15 nt, Human
uuaaaaaagaaacau

SEQ ID NO: 1388761 - RNA, 17 nt, Human
uuaaaaauucagcaaag

SEQ ID NO: 1388762 - RNA, 21 nt, Human
uuaaaaauaagucaacaguaa

SEQ ID NO: 1388763 - RNA, 22 nt, Human
uuaaaaauaagucaacaguaaa

SEQ ID NO: 1388764 - RNA, 15 nt, Human
uuaaaaauaagucaa

SEQ ID NO: 1388765 - RNA, 20 nt, Human
uuaaaaaguuauaaccaacu

SEQ ID NO: 1388766 - RNA, 13 nt, Human
uuaaaaaacuaaa

SEQ ID NO: 1388767 - RNA, 19 nt, Human
uuaaaaaagaaacauuugg

SEQ ID NO: 1388768 - RNA, 20 nt, Human
aguuuauuuguugagagugu

SEQ ID NO: 1388769 - RNA, 23 nt, Human
aguuuauuuguugagagugugac

SEQ ID NO: 1388770 - RNA, 19 nt, Human
aguuuauuuguugagagug

SEQ ID NO: 1388771 - RNA, 18 nt, Human
aguuuauuuguugagagu

SEQ ID NO: 1388772 - RNA, 16 nt, Human
aguuuauuuguugaga

SEQ ID NO: 1388773 - RNA, 23 nt, Human
uuaaauucucucucuugcaggaa

SEQ ID NO: 1388774 - RNA, 20 nt, Human
uuaaauucuugcaaaguauc

SEQ ID NO: 1388775 - RNA, 16 nt, Human
uuaaauucuugcaaag

SEQ ID NO: 1388776 - RNA, 22 nt, Human
uuaaauucccguuuugucacuu

SEQ ID NO: 1388777 - RNA, 19 nt, Human
uuaaauucccguuuuguca

SEQ ID NO: 1388778 - RNA, 13 nt, Human
uuaaauucuugca

SEQ ID NO: 1388779 - RNA, 12 nt, Human
aguuuccugaaa

SEQ ID NO: 1388780 - RNA, 15 nt, Human
aguuucguuuucaaa

SEQ ID NO: 1388781 - RNA, 18 nt, Human
aguuuccuuuuuaauaug

SEQ ID NO: 1388782 - RNA, 16 nt, Human
aguuuccuuuuuaaua

SEQ ID NO: 1388783 - RNA, 12 nt, Human
aguuuccuuuuu

SEQ ID NO: 1388784 - RNA, 16 nt, Human
aguuucguuuucaaaa

SEQ ID NO: 1388785 - RNA, 22 nt, Human
aguuuuccauggcaggaaggcu

SEQ ID NO: 1388786 - RNA, 20 nt, Human
aguuuuccauggcaggaagg

SEQ ID NO: 1388787 - RNA, 20 nt, Human
aguuuucauccauaacugaa

SEQ ID NO: 1388788 - RNA, 21 nt, Human
aguuuucauccauaacugaac

SEQ ID NO: 1388789 - RNA, 12 nt, Human
aguuuucagugg

SEQ ID NO: 1388790 - RNA, 15 nt, Human
aguuuuaucauuuuc

SEQ ID NO: 1388791 - RNA, 18 nt, Human
aguuuggguaaaauacuu

SEQ ID NO: 1388792 - RNA, 16 nt, Human
aguuugguuucuagca

SEQ ID NO: 1388793 - RNA, 20 nt, Human
aguuuggguaaaauacuuuu

SEQ ID NO: 1388794 - RNA, 13 nt, Human
aguuuggguaaaa

SEQ ID NO: 1388795 - RNA, 16 nt, Human
aguuucuaaacuggag

SEQ ID NO: 1388796 - RNA, 21 nt, Human
aguuugucgcucaugugugca

SEQ ID NO: 1388797 - RNA, 19 nt, Human
aguuugucgcucaugugug

SEQ ID NO: 1388798 - RNA, 17 nt, Human
aguuugucgcucaugug

SEQ ID NO: 1388799 - RNA, 20 nt, Human
aguuuuaucauuuucaaaau

SEQ ID NO: 1388800 - RNA, 14 nt, Human
aguuuuaucauuuu

SEQ ID NO: 1388801 - RNA, 17 nt, Human
aguucuuugggccagac

SEQ ID NO: 1388802 - RNA, 16 nt, Human
aguucuuugggccaga

SEQ ID NO: 1388803 - RNA, 15 nt, Human
aguucuuugggccag

SEQ ID NO: 1388804 - RNA, 17 nt, Human
aguucuuuaaaauguaa

SEQ ID NO: 1388805 - RNA, 23 nt, Human
aguucugugguuucauguuaguu

SEQ ID NO: 1388806 - RNA, 22 nt, Human
aguucugugguuucauguuagu

SEQ ID NO: 1388807 - RNA, 19 nt, Human
aguucugugguuucauguu

SEQ ID NO: 1388808 - RNA, 16 nt, Human
aguucugugguuucau

SEQ ID NO: 1388809 - RNA, 16 nt, Human
aguucuguagaaaugg

SEQ ID NO: 1388810 - RNA, 17 nt, Human
aguucuguagaaauggu

SEQ ID NO: 1388811 - RNA, 18 nt, Human
aguucuguagaaaugguu

SEQ ID NO: 1388812 - RNA, 16 nt, Human
aguucugaagaagaug

SEQ ID NO: 1388813 - RNA, 13 nt, Human
aguucuguagaaa

SEQ ID NO: 1388814 - RNA, 15 nt, Human
aguucuguagaaaug

SEQ ID NO: 1388815 - RNA, 15 nt, Human
aguucugaagaagau

SEQ ID NO: 1388816 - RNA, 14 nt, Human
aguucugaagaaga

SEQ ID NO: 1388817 - RNA, 13 nt, Human
aguucugaagaag

SEQ ID NO: 1388818 - RNA, 21 nt, Human
aguugaucuggaacccagacu

SEQ ID NO: 1388819 - RNA, 20 nt, Human
aguugaucuggaacccagac

SEQ ID NO: 1388820 - RNA, 19 nt, Human
aguugaucuggaacccaga

SEQ ID NO: 1388821 - RNA, 18 nt, Human
aguugaucuggaacccag

SEQ ID NO: 1388822 - RNA, 17 nt, Human
aguugaucuggaaccca

SEQ ID NO: 1388823 - RNA, 15 nt, Human
aguugaucuggaacc

SEQ ID NO: 1388824 - RNA, 13 nt, Human
aguugaucuggaa

SEQ ID NO: 1388825 - RNA, 13 nt, Human
aguugauuagaaa

SEQ ID NO: 1388826 - RNA, 23 nt, Human
aguugaucuggaacccagacuca

SEQ ID NO: 1388827 - RNA, 21 nt, Human
aguugaucgccuuucccaggu

SEQ ID NO: 1388828 - RNA, 19 nt, Human
aguucuuugggccagacau

SEQ ID NO: 1388829 - RNA, 18 nt, Human
aguucuuugggccagaca

SEQ ID NO: 1388830 - RNA, 21 nt, Human
aguugauaugccuuuucccaa

SEQ ID NO: 1388831 - RNA, 23 nt, Human
aguugauuuuuuuuuuuuuuucc

SEQ ID NO: 1388832 - RNA, 16 nt, Human
aguugauuuucuggau

SEQ ID NO: 1388833 - RNA, 19 nt, Human
aguugcaacuuuguauaaa

SEQ ID NO: 1388834 - RNA, 17 nt, Human
uguuguccuuuucauag

SEQ ID NO: 1388835 - RNA, 16 nt, Human
uguuguccuuuucaua

SEQ ID NO: 1388836 - RNA, 14 nt, Human
uguuguccuuuuca

SEQ ID NO: 1388837 - RNA, 14 nt, Human
uguugucuaagaaa

SEQ ID NO: 1388838 - RNA, 20 nt, Human
uguugucguaaagauuuggg

SEQ ID NO: 1388839 - RNA, 18 nt, Human
uguugucguaaagauuug

SEQ ID NO: 1388840 - RNA, 22 nt, Human
uguuguccuuuucauaggucug

SEQ ID NO: 1388841 - RNA, 22 nt, Human
uguugucuaagaaauugaauac

SEQ ID NO: 1388842 - RNA, 17 nt, Human
uguugucuaagaaauug

SEQ ID NO: 1388843 - RNA, 15 nt, Human
uguuugcaucugaaa

SEQ ID NO: 1388844 - RNA, 15 nt, Human
uguuugcuaagcauu

SEQ ID NO: 1388845 - RNA, 14 nt, Human
uguuuggcuuucag

SEQ ID NO: 1388846 - RNA, 13 nt, Human
uguuuggcuuuca

SEQ ID NO: 1388847 - RNA, 12 nt, Human
uguuuggcuggg

SEQ ID NO: 1388848 - RNA, 13 nt, Human
uguuuuacaauag

SEQ ID NO: 1388849 - RNA, 17 nt, Human
uguuuuacaauaguucu

SEQ ID NO: 1388850 - RNA, 22 nt, Human
uguuuuacaauaguucuguggg

SEQ ID NO: 1388851 - RNA, 20 nt, Human
uguuuuacaaguuggaguca

SEQ ID NO: 1388852 - RNA, 21 nt, Human
uguuuuacaauaguucugugg

SEQ ID NO: 1388853 - RNA, 11 nt, Human
uguuuggcugg

SEQ ID NO: 1388854 - RNA, 20 nt, Human
uguuugcucagcuucuccaa

SEQ ID NO: 1388855 - RNA, 20 nt, Human
uguuugccuucuacuuuuaa

SEQ ID NO: 1388856 - RNA, 19 nt, Human
uguuugcuaagcauuccaa

SEQ ID NO: 1388857 - RNA, 21 nt, Human
uguuuucucuggaguauucua

SEQ ID NO: 1388858 - RNA, 17 nt, Human
uguuuucucugaacaca

SEQ ID NO: 1388859 - RNA, 12 nt, Human
uguuuucucuga

SEQ ID NO: 1388860 - RNA, 21 nt, Human
uguuuuauuuucaaaaccagg

SEQ ID NO: 1388861 - RNA, 20 nt, Human
uguuuuauaauuuugugaag

SEQ ID NO: 1388862 - RNA, 13 nt, Human
uguuuuauaauuu

SEQ ID NO: 1388863 - RNA, 14 nt, Human
uguuuuaggagcau

SEQ ID NO: 1388864 - RNA, 19 nt, Human
uguucuugguuuguaaauu

SEQ ID NO: 1388865 - RNA, 13 nt, Human
uguucuuuccaaa

SEQ ID NO: 1388866 - RNA, 14 nt, Human
uguucuuuccaaag

SEQ ID NO: 1388867 - RNA, 20 nt, Human
uguucuuagcucaaugagca

SEQ ID NO: 1388868 - RNA, 18 nt, Human
uguucuuagcucaaugag

SEQ ID NO: 1388869 - RNA, 22 nt, Human
uguucuuaccuguaugucucca

SEQ ID NO: 1388870 - RNA, 17 nt, Human
uguucuuaccuguaugu

SEQ ID NO: 1388871 - RNA, 17 nt, Human
uguucuugguuuguaaa

SEQ ID NO: 1388872 - RNA, 18 nt, Human
uguucuugguuuguaaau

SEQ ID NO: 1388873 - RNA, 15 nt, Human
uguucccccugugca

SEQ ID NO: 1388874 - RNA, 18 nt, Human
uguuccccauggccacuu

SEQ ID NO: 1388875 - RNA, 17 nt, Human
uguuccccacuggagca

SEQ ID NO: 1388876 - RNA, 14 nt, Human
uguuccccagagaa

SEQ ID NO: 1388877 - RNA, 13 nt, Human
uguuccccagaga

SEQ ID NO: 1388878 - RNA, 16 nt, Human
uguuccccacuggagc

SEQ ID NO: 1388879 - RNA, 15 nt, Human
uguuccccacuggag

SEQ ID NO: 1388880 - RNA, 14 nt, Human
uguuccccacugga

SEQ ID NO: 1388881 - RNA, 13 nt, Human
uguuccccacugg

SEQ ID NO: 1388882 - RNA, 16 nt, Human
uguucccccugugcag

SEQ ID NO: 1388883 - RNA, 14 nt, Human
uguucuuaauucuu

SEQ ID NO: 1388884 - RNA, 16 nt, Human
uguucuuaauucuuag

SEQ ID NO: 1388885 - RNA, 16 nt, Human
aguguaccauuugccu

SEQ ID NO: 1388886 - RNA, 18 nt, Human
uguuauuuuuuaauuauu

SEQ ID NO: 1388887 - RNA, 14 nt, Human
uguuauuuugcaac

SEQ ID NO: 1388888 - RNA, 15 nt, Human
uguucaaagcugccu

SEQ ID NO: 1388889 - RNA, 22 nt, Human
uguucaaagccagcguccuccu

SEQ ID NO: 1388890 - RNA, 21 nt, Human
uguucaaagccagcguccucc

SEQ ID NO: 1388891 - RNA, 17 nt, Human
uguucccauuucagcug

SEQ ID NO: 1388892 - RNA, 16 nt, Human
uguucccauuucagcu

SEQ ID NO: 1388893 - RNA, 17 nt, Human
uguuauguagauaacaa

SEQ ID NO: 1388894 - RNA, 17 nt, Human
uguuaugcaaaagcaag

SEQ ID NO: 1388895 - RNA, 15 nt, Human
uguuaugcugugaca

SEQ ID NO: 1388896 - RNA, 17 nt, Human
uguuauuuguaauagau

SEQ ID NO: 1388897 - RNA, 21 nt, Human
uguuauguuuucgaaaaucaa

SEQ ID NO: 1388898 - RNA, 20 nt, Human
uguuauguuuucgaaaauca

SEQ ID NO: 1388899 - RNA, 14 nt, Human
uguuauuaaacaaa

SEQ ID NO: 1388900 - RNA, 21 nt, Human
aguggguuuuuuaguugaauu

SEQ ID NO: 1388901 - RNA, 22 nt, Human
aguggguuuuuuaguugaauuu

SEQ ID NO: 1388902 - RNA, 15 nt, Human
aguggguuuuuuagu

SEQ ID NO: 1388903 - RNA, 12 nt, Human
aguggguuuuuu

SEQ ID NO: 1388904 - RNA, 14 nt, Human
aguggguggggagu

SEQ ID NO: 1388905 - RNA, 11 nt, Human
agugggugggg

SEQ ID NO: 1388906 - RNA, 23 nt, Human
agugguuuaggcuauuuguaaau

SEQ ID NO: 1388907 - RNA, 14 nt, Human
aguguaauugagaa

SEQ ID NO: 1388908 - RNA, 18 nt, Human
ugugcaacaggguaugga

SEQ ID NO: 1388909 - RNA, 20 nt, Human
ugugcaacaggguauggacu

SEQ ID NO: 1388910 - RNA, 19 nt, Human
agugagcagccuggagccc

SEQ ID NO: 1388911 - RNA, 23 nt, Human
aguggcaggcagaggcccaggcu

SEQ ID NO: 1388912 - RNA, 20 nt, Human
aguggcaggcagaggcccag

SEQ ID NO: 1388913 - RNA, 22 nt, Human
aguggguacccccaggaccaga

SEQ ID NO: 1388914 - RNA, 17 nt, Human
aguggguacccccagga

SEQ ID NO: 1388915 - RNA, 21 nt, Human
agugggguuaucucuguguua

SEQ ID NO: 1388916 - RNA, 11 nt, Human
aguggcagggg

SEQ ID NO: 1388917 - RNA, 18 nt, Human
aguggcaggggacaggag

SEQ ID NO: 1388918 - RNA, 15 nt, Human
aguggcaucaucuca

SEQ ID NO: 1388919 - RNA, 22 nt, Human
aguuaguuuguauauauuauua

SEQ ID NO: 1388920 - RNA, 14 nt, Human
aguuaguuuguaua

SEQ ID NO: 1388921 - RNA, 19 nt, Human
aguuaguuccacugagacc

SEQ ID NO: 1388922 - RNA, 17 nt, Human
aguuaguuccacugaga

SEQ ID NO: 1388923 - RNA, 15 nt, Human
aguuaguuccacuga

SEQ ID NO: 1388924 - RNA, 20 nt, Human
aguuaguggauuacugccau

SEQ ID NO: 1388925 - RNA, 17 nt, Human
aguuaguggauuacugc

SEQ ID NO: 1388926 - RNA, 20 nt, Human
aguuaguaucuuuugauaug

SEQ ID NO: 1388927 - RNA, 22 nt, Human
aguuaccuuauaguuacugugu

SEQ ID NO: 1388928 - RNA, 21 nt, Human
aguuaccuuauaguuacugug

SEQ ID NO: 1388929 - RNA, 20 nt, Human
aguuaccuuauaguuacugu

SEQ ID NO: 1388930 - RNA, 17 nt, Human
aguuaccuuauaguuac

SEQ ID NO: 1388931 - RNA, 16 nt, Human
aguuaccuuauaguua

SEQ ID NO: 1388932 - RNA, 20 nt, Human
aguguuuauccuuucauaua

SEQ ID NO: 1388933 - RNA, 18 nt, Human
aguguuuauccuuucaua

SEQ ID NO: 1388934 - RNA, 16 nt, Human
aguguuuauccuuuca

SEQ ID NO: 1388935 - RNA, 14 nt, Human
aguguuuaaaacuu

SEQ ID NO: 1388936 - RNA, 15 nt, Human
aguguuuaaaacuuc

SEQ ID NO: 1388937 - RNA, 18 nt, Human
uguucuuuccaaaguaca

SEQ ID NO: 1388938 - RNA, 20 nt, Human
uguucuuuccaaaguacacu

SEQ ID NO: 1388939 - RNA, 23 nt, Human
aguuaccugagagauuuaacauu

SEQ ID NO: 1388940 - RNA, 19 nt, Human
aguuaccauuaaaccaucu

SEQ ID NO: 1388941 - RNA, 17 nt, Human
aguuaccauuaaaccau

SEQ ID NO: 1388942 - RNA, 18 nt, Human
aguuacccaaauuaagag

SEQ ID NO: 1388943 - RNA, 16 nt, Human
aguuaccagugccuua

SEQ ID NO: 1388944 - RNA, 15 nt, Human
aguuaccagugccuu

SEQ ID NO: 1388945 - RNA, 17 nt, Human
aguuacccaaauuaaga

SEQ ID NO: 1388946 - RNA, 22 nt, Human
aguuauugcaguuuaucauuca

SEQ ID NO: 1388947 - RNA, 19 nt, Human
aguuauugcaguuuaucau

SEQ ID NO: 1388948 - RNA, 18 nt, Human
aguuauugcaguuuauca

SEQ ID NO: 1388949 - RNA, 16 nt, Human
aguuauugcaguuuau

SEQ ID NO: 1388950 - RNA, 13 nt, Human
aguuauugcaguu

SEQ ID NO: 1388951 - RNA, 17 nt, Human
aguuauuaauuucuuca

SEQ ID NO: 1388952 - RNA, 19 nt, Human
aguuauuaaguucuuuaaa

SEQ ID NO: 1388953 - RNA, 18 nt, Human
aguuauuaaguucuuuaa

SEQ ID NO: 1388954 - RNA, 14 nt, Human
aguuauuaacuuua

SEQ ID NO: 1388955 - RNA, 20 nt, Human
aguuauuaacuuuaauguuu

SEQ ID NO: 1388956 - RNA, 20 nt, Human
aguuaugauuuuuuuuucau

SEQ ID NO: 1388957 - RNA, 22 nt, Human
aguuaucuaaguuaauuuaaag

SEQ ID NO: 1388958 - RNA, 15 nt, Human
aguuaucuaaguuaa

SEQ ID NO: 1388959 - RNA, 20 nt, Human
aguuauacuuauuuguauau

SEQ ID NO: 1388960 - RNA, 15 nt, Human
aguuaguuuguauau

SEQ ID NO: 1388961 - RNA, 21 nt, Human
aguuauaaguagcaggccaag

SEQ ID NO: 1388962 - RNA, 20 nt, Human
aguuauuauauuuacaaaug

SEQ ID NO: 1388963 - RNA, 22 nt, Human
aguucgacucugugcuggccag

SEQ ID NO: 1388964 - RNA, 15 nt, Human
aguuccuguggcucc

SEQ ID NO: 1388965 - RNA, 17 nt, Human
aguuccuguggcucccu

SEQ ID NO: 1388966 - RNA, 13 nt, Human
aguucaagaaaua

SEQ ID NO: 1388967 - RNA, 19 nt, Human
aguucaagaaauaaguuuu

SEQ ID NO: 1388968 - RNA, 13 nt, Human
aguucaacauguu

SEQ ID NO: 1388969 - RNA, 18 nt, Human
aguucaaauucuucugaa

SEQ ID NO: 1388970 - RNA, 21 nt, Human
aguuauuuauuuauuggagau

SEQ ID NO: 1388971 - RNA, 12 nt, Human
aguuauuuaaau

SEQ ID NO: 1388972 - RNA, 22 nt, Human
aguuauuuaugccucuguauuu

SEQ ID NO: 1388973 - RNA, 14 nt, Human
uguugggagagggc

SEQ ID NO: 1388974 - RNA, 19 nt, Human
aguucuaauaauuucuaau

SEQ ID NO: 1388975 - RNA, 18 nt, Human
aguucuaauaauuucuaa

SEQ ID NO: 1388976 - RNA, 17 nt, Human
aguucuaauaauuucua

SEQ ID NO: 1388977 - RNA, 16 nt, Human
aguucuaauaauuucu

SEQ ID NO: 1388978 - RNA, 17 nt, Human
aguucuaagauucugau

SEQ ID NO: 1388979 - RNA, 16 nt, Human
aguucuaagauucuga

SEQ ID NO: 1388980 - RNA, 15 nt, Human
aguucuaagauucug

SEQ ID NO: 1388981 - RNA, 19 nt, Human
aguucuaagauucuaauga

SEQ ID NO: 1388982 - RNA, 18 nt, Human
aguucuaagauucuaaug

SEQ ID NO: 1388983 - RNA, 17 nt, Human
aguucuaagauucuaau

SEQ ID NO: 1388984 - RNA, 16 nt, Human
aguucuaagauucuaa

SEQ ID NO: 1388985 - RNA, 15 nt, Human
aguucuaagauucua

SEQ ID NO: 1388986 - RNA, 14 nt, Human
aguucuaagauucu

SEQ ID NO: 1388987 - RNA, 13 nt, Human
aguucuaagauuc

SEQ ID NO: 1388988 - RNA, 23 nt, Human
aguucuaagacucaaauguucua

SEQ ID NO: 1388989 - RNA, 18 nt, Human
aguucuaagacucaaaug

SEQ ID NO: 1388990 - RNA, 13 nt, Human
aguucgucuguug

SEQ ID NO: 1388991 - RNA, 19 nt, Human
uguugggagagggcgcagg

SEQ ID NO: 1388992 - RNA, 17 nt, Human
uguugggagagggcgca

SEQ ID NO: 1388993 - RNA, 20 nt, Human
uguuggggaagggccugccc

SEQ ID NO: 1388994 - RNA, 20 nt, Human
uguugggagagggcgcaggc

SEQ ID NO: 1388995 - RNA, 21 nt, Human
uguuguagauugauuguauug

SEQ ID NO: 1388996 - RNA, 14 nt, Human
uguuguauucauug

SEQ ID NO: 1388997 - RNA, 22 nt, Human
uguuguagauugauuguauugu

SEQ ID NO: 1388998 - RNA, 13 nt, Human
uguugucaccaga

SEQ ID NO: 1388999 - RNA, 20 nt, Human
uguugucaagaauagcauug

SEQ ID NO: 1389000 - RNA, 16 nt, Human
uguugucaagaauagc

SEQ ID NO: 1389001 - RNA, 11 nt, Human
uguugucaaga

SEQ ID NO: 1389002 - RNA, 14 nt, Human
uguuguaagcaaca

SEQ ID NO: 1389003 - RNA, 14 nt, Human
uguuguaaccugcu

SEQ ID NO: 1389004 - RNA, 17 nt, Human
uguuguaagcaacaggc

SEQ ID NO: 1389005 - RNA, 18 nt, Human
uguuguaaccugcuguga

SEQ ID NO: 1389006 - RNA, 18 nt, Human
uugaaguauuuugcugga

SEQ ID NO: 1389007 - RNA, 12 nt, Human
uugaaguauuua

SEQ ID NO: 1389008 - RNA, 16 nt, Human
uugaaguagcucuuuu

SEQ ID NO: 1389009 - RNA, 16 nt, Human
uugaaguaaacuuuuu

SEQ ID NO: 1389010 - RNA, 15 nt, Human
uugaaguaaacuuuu

SEQ ID NO: 1389011 - RNA, 23 nt, Human
uugaaggugcugacggccaggga

SEQ ID NO: 1389012 - RNA, 20 nt, Human
uugaagggccagagccaggg

SEQ ID NO: 1389013 - RNA, 19 nt, Human
uugaagggccagagccagg

SEQ ID NO: 1389014 - RNA, 17 nt, Human
uugaagggccagagcca

SEQ ID NO: 1389015 - RNA, 15 nt, Human
uugaagggccagagc

SEQ ID NO: 1389016 - RNA, 20 nt, Human
uugaagggaggggcuguguu

SEQ ID NO: 1389017 - RNA, 15 nt, Human
uugaagggaggggcu

SEQ ID NO: 1389018 - RNA, 14 nt, Human
uugaaggacuaaua

SEQ ID NO: 1389019 - RNA, 21 nt, Human
uugaaggaugcugucuucgua

SEQ ID NO: 1389020 - RNA, 21 nt, Human
uugaaggacuaauagaaaagu

SEQ ID NO: 1389021 - RNA, 14 nt, Human
uugaaggaugcugu

SEQ ID NO: 1389022 - RNA, 16 nt, Human
uugaaggaugcugucu

SEQ ID NO: 1389023 - RNA, 13 nt, Human
uugaauacuuuuu

SEQ ID NO: 1389024 - RNA, 12 nt, Human
uugaauacuuuu

SEQ ID NO: 1389025 - RNA, 19 nt, Human
uugaauacuuugaaugugu

SEQ ID NO: 1389026 - RNA, 23 nt, Human
uugaaguuagcuuuaacuuaaau

SEQ ID NO: 1389027 - RNA, 19 nt, Human
uugaaguuagcuuuaacuu

SEQ ID NO: 1389028 - RNA, 20 nt, Human
uugaauacuuugaauguguu

SEQ ID NO: 1389029 - RNA, 22 nt, Human
uugacacugcucuaacagcccu

SEQ ID NO: 1389030 - RNA, 16 nt, Human
uugacacugcucuaac

SEQ ID NO: 1389031 - RNA, 15 nt, Human
uugacacugcucuaa

SEQ ID NO: 1389032 - RNA, 14 nt, Human
uugacacugcucua

SEQ ID NO: 1389033 - RNA, 23 nt, Human
aucuaaaaauagacuuaaaucuc

SEQ ID NO: 1389034 - RNA, 17 nt, Human
aucgucaugcacaguau

SEQ ID NO: 1389035 - RNA, 19 nt, Human
aucguccagcgaccuuccu

SEQ ID NO: 1389036 - RNA, 18 nt, Human
aucgucacugcuuaacuu

SEQ ID NO: 1389037 - RNA, 14 nt, Human
aucgucacugcuua

SEQ ID NO: 1389038 - RNA, 16 nt, Human
aucuaaauaaaaugcu

SEQ ID NO: 1389039 - RNA, 22 nt, Human
aucuaaauauggacugcucagg

SEQ ID NO: 1389040 - RNA, 17 nt, Human
aucuaaauaaaaugcua

SEQ ID NO: 1389041 - RNA, 18 nt, Human
aucuaaccucaucuucuu

SEQ ID NO: 1389042 - RNA, 15 nt, Human
aucuaaccucaucuu

SEQ ID NO: 1389043 - RNA, 14 nt, Human
aucuaaccucaucu

SEQ ID NO: 1389044 - RNA, 13 nt, Human
aucuaaccucauc

SEQ ID NO: 1389045 - RNA, 17 nt, Human
aucuaaguuaauuuaaa

SEQ ID NO: 1389046 - RNA, 16 nt, Human
aucuaaguuaauuuaa

SEQ ID NO: 1389047 - RNA, 17 nt, Human
aucuaagugauauaaau

SEQ ID NO: 1389048 - RNA, 15 nt, Human
aucuaagugauauaa

SEQ ID NO: 1389049 - RNA, 14 nt, Human
aucuaagugauaua

SEQ ID NO: 1389050 - RNA, 13 nt, Human
aucuaagugauau

SEQ ID NO: 1389051 - RNA, 16 nt, Human
uugauaagaucuuuua

SEQ ID NO: 1389052 - RNA, 18 nt, Human
uugauaagaucuuuuauu

SEQ ID NO: 1389053 - RNA, 18 nt, Human
uugauaaccuugaaaaaa

SEQ ID NO: 1389054 - RNA, 14 nt, Human
uugauaaagauuuu

SEQ ID NO: 1389055 - RNA, 17 nt, Human
uugaguuuugacugcuu

SEQ ID NO: 1389056 - RNA, 18 nt, Human
uugaguuuugacugcuug

SEQ ID NO: 1389057 - RNA, 20 nt, Human
uugaguagagagcaagggaa

SEQ ID NO: 1389058 - RNA, 16 nt, Human
uugaguaaugguguag

SEQ ID NO: 1389059 - RNA, 21 nt, Human
uugaguaaugguguagaacac

SEQ ID NO: 1389060 - RNA, 12 nt, Human
uugaguaauggu

SEQ ID NO: 1389061 - RNA, 22 nt, Human
uugauaaagauuuuuuaauaau

SEQ ID NO: 1389062 - RNA, 20 nt, Human
uugauaaagauuuuuuaaua

SEQ ID NO: 1389063 - RNA, 17 nt, Human
uugauaaagauuuuuua

SEQ ID NO: 1389064 - RNA, 21 nt, Human
uugagauauuaaugcccagac

SEQ ID NO: 1389065 - RNA, 16 nt, Human
uugaggucuguucuuu

SEQ ID NO: 1389066 - RNA, 20 nt, Human
uugagauauuaaugcccaga

SEQ ID NO: 1389067 - RNA, 22 nt, Human
uugagauaguuuucauccauaa

SEQ ID NO: 1389068 - RNA, 17 nt, Human
uugagauaguuuucauc

SEQ ID NO: 1389069 - RNA, 13 nt, Human
uugagagugugac

SEQ ID NO: 1389070 - RNA, 15 nt, Human
uugagagugugacca

SEQ ID NO: 1389071 - RNA, 16 nt, Human
uugagagaauuugugc

SEQ ID NO: 1389072 - RNA, 17 nt, Human
uugagagaagagacaaa

SEQ ID NO: 1389073 - RNA, 20 nt, Human
uugagaaggaaaauuuuagc

SEQ ID NO: 1389074 - RNA, 19 nt, Human
uugagaaggaaaauuuuag

SEQ ID NO: 1389075 - RNA, 21 nt, Human
uugagaaauauggacacuuaa

SEQ ID NO: 1389076 - RNA, 19 nt, Human
uugacauaaaguugauaaa

SEQ ID NO: 1389077 - RNA, 14 nt, Human
uugacaguguuuuu

SEQ ID NO: 1389078 - RNA, 19 nt, Human
uugacaguguugaaaaugu

SEQ ID NO: 1389079 - RNA, 23 nt, Human
uugacacugcucuaacagcccuc

SEQ ID NO: 1389080 - RNA, 15 nt, Human
uugacauaaaguuga

SEQ ID NO: 1389081 - RNA, 13 nt, Human
auccugcuaaguu

SEQ ID NO: 1389082 - RNA, 16 nt, Human
auccugcggguggggc

SEQ ID NO: 1389083 - RNA, 24 nt, Human
auccugaccagcugcuccgaggac

SEQ ID NO: 1389084 - RNA, 17 nt, Human
auccugaaauuucagau

SEQ ID NO: 1389085 - RNA, 16 nt, Human
auccugaaauuucaga

SEQ ID NO: 1389086 - RNA, 14 nt, Human
auccugaaauuuca

SEQ ID NO: 1389087 - RNA, 15 nt, Human
auccucuuuuuccaa

SEQ ID NO: 1389088 - RNA, 14 nt, Human
auccucuuuuucca

SEQ ID NO: 1389089 - RNA, 22 nt, Human
auccucuuuagaguuagacugu

SEQ ID NO: 1389090 - RNA, 23 nt, Human
auccucuuuagaguuagacuguu

SEQ ID NO: 1389091 - RNA, 16 nt, Human
auccucuuuagaguua

SEQ ID NO: 1389092 - RNA, 19 nt, Human
auccucuuuagaguuagac

SEQ ID NO: 1389093 - RNA, 20 nt, Human
auccucuuuagaguuagacu

SEQ ID NO: 1389094 - RNA, 21 nt, Human
auccucuuuagaguuagacug

SEQ ID NO: 1389095 - RNA, 14 nt, Human
uucuuuugccauga

SEQ ID NO: 1389096 - RNA, 21 nt, Human
uucuuuucuggaauguaauca

SEQ ID NO: 1389097 - RNA, 23 nt, Human
uucuuuugguaaagacuggcuuu

SEQ ID NO: 1389098 - RNA, 22 nt, Human
uucuuuugguaaagacuggcuu

SEQ ID NO: 1389099 - RNA, 13 nt, Human
uucuuuugguaaa

SEQ ID NO: 1389100 - RNA, 20 nt, Human
uucuuuugccguuauuaaaa

SEQ ID NO: 1389101 - RNA, 13 nt, Human
auccucuuuagag

SEQ ID NO: 1389102 - RNA, 15 nt, Human
auccucuuuagaguu

SEQ ID NO: 1389103 - RNA, 20 nt, Human
auccuggaggcccaguucac

SEQ ID NO: 1389104 - RNA, 19 nt, Human
auccuggaggcccaguuca

SEQ ID NO: 1389105 - RNA, 22 nt, Human
auccuggacaugaagauucuuu

SEQ ID NO: 1389106 - RNA, 12 nt, Human
auccugcuugau

SEQ ID NO: 1389107 - RNA, 14 nt, Human
auccugcuucagug

SEQ ID NO: 1389108 - RNA, 17 nt, Human
auccuggaggcccaguu

SEQ ID NO: 1389109 - RNA, 16 nt, Human
auccuggaggcccagu

SEQ ID NO: 1389110 - RNA, 15 nt, Human
auccuggaggcccag

SEQ ID NO: 1389111 - RNA, 14 nt, Human
auccuggaggccca

SEQ ID NO: 1389112 - RNA, 19 nt, Human
auccuguguguuaagcucu

SEQ ID NO: 1389113 - RNA, 21 nt, Human
auccuguguguuaagcucugc

SEQ ID NO: 1389114 - RNA, 13 nt, Human
auccuguguguua

SEQ ID NO: 1389115 - RNA, 12 nt, Human
auccuguguguu

SEQ ID NO: 1389116 - RNA, 11 nt, Human
auccugugugu

SEQ ID NO: 1389117 - RNA, 22 nt, Human
auccuguguggagagggaaugu

SEQ ID NO: 1389118 - RNA, 23 nt, Human
auccuguguggagagggaaugug

SEQ ID NO: 1389119 - RNA, 21 nt, Human
auccuguguggagagggaaug

SEQ ID NO: 1389120 - RNA, 19 nt, Human
auccuguguggagagggaa

SEQ ID NO: 1389121 - RNA, 18 nt, Human
auccuguguggagaggga

SEQ ID NO: 1389122 - RNA, 16 nt, Human
auccuguguggagagg

SEQ ID NO: 1389123 - RNA, 14 nt, Human
auccuguguggaga

SEQ ID NO: 1389124 - RNA, 17 nt, Human
auccuguggucacugac

SEQ ID NO: 1389125 - RNA, 19 nt, Human
auccugucgauuagacugg

SEQ ID NO: 1389126 - RNA, 21 nt, Human
auccugucgauuagacuggac

SEQ ID NO: 1389127 - RNA, 21 nt, Human
auccuguauucagacagauga

SEQ ID NO: 1389128 - RNA, 20 nt, Human
auccuguauucagacagaug

SEQ ID NO: 1389129 - RNA, 18 nt, Human
auccuguauucagacaga

SEQ ID NO: 1389130 - RNA, 16 nt, Human
auccuguauucagaca

SEQ ID NO: 1389131 - RNA, 16 nt, Human
aucggggagccgggag

SEQ ID NO: 1389132 - RNA, 18 nt, Human
aucggggagccgggagcc

SEQ ID NO: 1389133 - RNA, 12 nt, Human
aucguaaaauua

SEQ ID NO: 1389134 - RNA, 13 nt, Human
aucguaaaauuaa

SEQ ID NO: 1389135 - RNA, 14 nt, Human
aucguaaaauuaag

SEQ ID NO: 1389136 - RNA, 17 nt, Human
aucguaaaauuaagaaa

SEQ ID NO: 1389137 - RNA, 19 nt, Human
uucuuugaauaaaugucac

SEQ ID NO: 1389138 - RNA, 18 nt, Human
uucuuugaauaaauguca

SEQ ID NO: 1389139 - RNA, 17 nt, Human
uucuuugaauaaauguc

SEQ ID NO: 1389140 - RNA, 14 nt, Human
uucuuugaauaaau

SEQ ID NO: 1389141 - RNA, 13 nt, Human
uucuuugaauaaa

SEQ ID NO: 1389142 - RNA, 15 nt, Human
uucuuucucacuaaa

SEQ ID NO: 1389143 - RNA, 12 nt, Human
uucuuucuggcu

SEQ ID NO: 1389144 - RNA, 17 nt, Human
uucuuucuggcuaugca

SEQ ID NO: 1389145 - RNA, 20 nt, Human
uucuuucuggcuaugcauuu

SEQ ID NO: 1389146 - RNA, 18 nt, Human
uucuugccugaacuccug

SEQ ID NO: 1389147 - RNA, 22 nt, Human
uucuugccucugugcugugugu

SEQ ID NO: 1389148 - RNA, 17 nt, Human
uucuugccucugugcug

SEQ ID NO: 1389149 - RNA, 16 nt, Human
uucuugccucugugcu

SEQ ID NO: 1389150 - RNA, 15 nt, Human
uucuugccucugugc

SEQ ID NO: 1389151 - RNA, 12 nt, Human
uucuugccucau

SEQ ID NO: 1389152 - RNA, 15 nt, Human
uucuucuagaguuca

SEQ ID NO: 1389153 - RNA, 21 nt, Human
uucuucuagguucuaaaaauu

SEQ ID NO: 1389154 - RNA, 18 nt, Human
uucuucuagguucuaaaa

SEQ ID NO: 1389155 - RNA, 14 nt, Human
uucuucuagaguuc

SEQ ID NO: 1389156 - RNA, 11 nt, Human
uucuucuagag

SEQ ID NO: 1389157 - RNA, 22 nt, Human
uucuucuacaacucauacacuc

SEQ ID NO: 1389158 - RNA, 12 nt, Human
uucuuagcucaa

SEQ ID NO: 1389159 - RNA, 13 nt, Human
uucuguuugcugu

SEQ ID NO: 1389160 - RNA, 17 nt, Human
uucuguuuuauaauuuu

SEQ ID NO: 1389161 - RNA, 23 nt, Human
uucuguuucaaggcacucuagau

SEQ ID NO: 1389162 - RNA, 12 nt, Human
uucuguuucaag

SEQ ID NO: 1389163 - RNA, 16 nt, Human
uucuguuuuauaauuu

SEQ ID NO: 1389164 - RNA, 13 nt, Human
uucuguuuagaua

SEQ ID NO: 1389165 - RNA, 18 nt, Human
uucuguuuagauaauaca

SEQ ID NO: 1389166 - RNA, 19 nt, Human
uucuuaaauaagaaacuuu

SEQ ID NO: 1389167 - RNA, 18 nt, Human
uucuuaaauaagaaacuu

SEQ ID NO: 1389168 - RNA, 11 nt, Human
uucuuaaauaa

SEQ ID NO: 1389169 - RNA, 22 nt, Human
uucuuaaccagaucauugugaa

SEQ ID NO: 1389170 - RNA, 23 nt, Human
uucuuaaccagaucauugugaaa

SEQ ID NO: 1389171 - RNA, 15 nt, Human
uucuuaccuguaugu

SEQ ID NO: 1389172 - RNA, 13 nt, Human
uucuuacugcuug

SEQ ID NO: 1389173 - RNA, 13 nt, Human
uucuuagaaauuu

SEQ ID NO: 1389174 - RNA, 22 nt, Human
uucuuagaaauuuauuuccuag

SEQ ID NO: 1389175 - RNA, 14 nt, Human
uucuuacugcuugg

SEQ ID NO: 1389176 - RNA, 12 nt, Human
uucuuagaaauu

SEQ ID NO: 1389177 - RNA, 14 nt, Human
uucuuacugcuuaa

SEQ ID NO: 1389178 - RNA, 18 nt, Human
aucccagagagcccgagg

SEQ ID NO: 1389179 - RNA, 18 nt, Human
aucccacucacaacagcu

SEQ ID NO: 1389180 - RNA, 23 nt, Human
auccauggccagcagcaccugcc

SEQ ID NO: 1389181 - RNA, 21 nt, Human
auccauggccagcagcaccug

SEQ ID NO: 1389182 - RNA, 12 nt, Human
auccauggccag

SEQ ID NO: 1389183 - RNA, 12 nt, Human
auccaugccuca

SEQ ID NO: 1389184 - RNA, 22 nt, Human
auccaugaccuaguuuuccaug

SEQ ID NO: 1389185 - RNA, 21 nt, Human
auccaugaccuaguuuuccau

SEQ ID NO: 1389186 - RNA, 17 nt, Human
auccauggccagcagca

SEQ ID NO: 1389187 - RNA, 16 nt, Human
auccauggccagcagc

SEQ ID NO: 1389188 - RNA, 14 nt, Human
auccauggccagca

SEQ ID NO: 1389189 - RNA, 13 nt, Human
auccauggccagc

SEQ ID NO: 1389190 - RNA, 22 nt, Human
aucccugaggacugauuucaga

SEQ ID NO: 1389191 - RNA, 18 nt, Human
aucccugaggacugauuu

SEQ ID NO: 1389192 - RNA, 15 nt, Human
aucccugaggacuga

SEQ ID NO: 1389193 - RNA, 14 nt, Human
auccacacaugaau

SEQ ID NO: 1389194 - RNA, 22 nt, Human
auccaauggacugcauaaauaa

SEQ ID NO: 1389195 - RNA, 22 nt, Human
auccacauacccugaccuggcc

SEQ ID NO: 1389196 - RNA, 20 nt, Human
auccaugaccuaguuuucca

SEQ ID NO: 1389197 - RNA, 18 nt, Human
auccaugaccuaguuuuc

SEQ ID NO: 1389198 - RNA, 20 nt, Human
auccauccuugccaauagug

SEQ ID NO: 1389199 - RNA, 18 nt, Human
auccaucaucaugugugu

SEQ ID NO: 1389200 - RNA, 13 nt, Human
auccaguauaaga

SEQ ID NO: 1389201 - RNA, 19 nt, Human
auccagguucccucccaga

SEQ ID NO: 1389202 - RNA, 15 nt, Human
auccagguucccucc

SEQ ID NO: 1389203 - RNA, 16 nt, Human
auccaguaggauccag

SEQ ID NO: 1389204 - RNA, 15 nt, Human
auccaguaaaauaau

SEQ ID NO: 1389205 - RNA, 22 nt, Human
uucugccugccagcugcacuga

SEQ ID NO: 1389206 - RNA, 15 nt, Human
auccaaagcagacag

SEQ ID NO: 1389207 - RNA, 19 nt, Human
uucugccugccagcugcac

SEQ ID NO: 1389208 - RNA, 18 nt, Human
uucugccugccagcugca

SEQ ID NO: 1389209 - RNA, 20 nt, Human
auccaauggguuuuucccug

SEQ ID NO: 1389210 - RNA, 19 nt, Human
auccaagauauuuuaaaau

SEQ ID NO: 1389211 - RNA, 18 nt, Human
auccaagcaaaugugaau

SEQ ID NO: 1389212 - RNA, 20 nt, Human
auccaacuaaugccuuacuc

SEQ ID NO: 1389213 - RNA, 18 nt, Human
auccaacuaaugccuuac

SEQ ID NO: 1389214 - RNA, 16 nt, Human
auccaacuaaugccuu

SEQ ID NO: 1389215 - RNA, 16 nt, Human
auccaagcaaauguga

SEQ ID NO: 1389216 - RNA, 19 nt, Human
uucucguccucguuugugu

SEQ ID NO: 1389217 - RNA, 19 nt, Human
uucucgcuguccuuucuag

SEQ ID NO: 1389218 - RNA, 18 nt, Human
uucuccuuuuccucucuc

SEQ ID NO: 1389219 - RNA, 13 nt, Human
uucuccuuuuccu

SEQ ID NO: 1389220 - RNA, 23 nt, Human
uucuccuccaugggagaaaauag

SEQ ID NO: 1389221 - RNA, 15 nt, Human
uucucucaacaccau

SEQ ID NO: 1389222 - RNA, 16 nt, Human
uucucuaucauuuaau

SEQ ID NO: 1389223 - RNA, 20 nt, Human
uucucucaacaccaugauuc

SEQ ID NO: 1389224 - RNA, 13 nt, Human
uucucuaucauuu

SEQ ID NO: 1389225 - RNA, 21 nt, Human
uucucuaguuugauuaaauuc

SEQ ID NO: 1389226 - RNA, 17 nt, Human
uucugccugccagcugc

SEQ ID NO: 1389227 - RNA, 16 nt, Human
uucugccugccagcug

SEQ ID NO: 1389228 - RNA, 23 nt, Human
uucugcauauguugaauacuuuu

SEQ ID NO: 1389229 - RNA, 22 nt, Human
uucugcauauguugaauacuuu

SEQ ID NO: 1389230 - RNA, 21 nt, Human
uucugcauauguugaauacuu

SEQ ID NO: 1389231 - RNA, 17 nt, Human
uucugcauauguugaau

SEQ ID NO: 1389232 - RNA, 22 nt, Human
uucugcaguaaaucuuuuacaa

SEQ ID NO: 1389233 - RNA, 18 nt, Human
uucugcaguaaaucuuuu

SEQ ID NO: 1389234 - RNA, 15 nt, Human
uucugcaguaaaucu

SEQ ID NO: 1389235 - RNA, 18 nt, Human
uucugaaugcuucuaagu

SEQ ID NO: 1389236 - RNA, 23 nt, Human
uucugaaugcuucuaaguaaaua

SEQ ID NO: 1389237 - RNA, 15 nt, Human
uucugaaugcuucua

SEQ ID NO: 1389238 - RNA, 14 nt, Human
uucugaauaaagca

SEQ ID NO: 1389239 - RNA, 15 nt, Human
uucugaauaaagcaa

SEQ ID NO: 1389240 - RNA, 16 nt, Human
uucugaauaaagcaau

SEQ ID NO: 1389241 - RNA, 17 nt, Human
uucugaauaaagcaauu

SEQ ID NO: 1389242 - RNA, 13 nt, Human
uucuccucccagg

SEQ ID NO: 1389243 - RNA, 18 nt, Human
uucuccucacuguaucca

SEQ ID NO: 1389244 - RNA, 14 nt, Human
uucuccuauguuug

SEQ ID NO: 1389245 - RNA, 22 nt, Human
uucuccguuagcuccuguggcc

SEQ ID NO: 1389246 - RNA, 20 nt, Human
uucuccguuagcuccugugg

SEQ ID NO: 1389247 - RNA, 19 nt, Human
uucuccguuagcuccugug

SEQ ID NO: 1389248 - RNA, 18 nt, Human
uucuccguuagcuccugu

SEQ ID NO: 1389249 - RNA, 17 nt, Human
uucuccguuagcuccug

SEQ ID NO: 1389250 - RNA, 16 nt, Human
uucuccguuagcuccu

SEQ ID NO: 1389251 - RNA, 10 nt, Human
uucucccugu

SEQ ID NO: 1389252 - RNA, 21 nt, Human
uucuccccugcacuguaaaau

SEQ ID NO: 1389253 - RNA, 13 nt, Human
aucauuguaugug

SEQ ID NO: 1389254 - RNA, 24 nt, Human
aucauucucugucucauccaucau

SEQ ID NO: 1389255 - RNA, 13 nt, Human
aucauugugaaau

SEQ ID NO: 1389256 - RNA, 15 nt, Human
aucauugugaaauua

SEQ ID NO: 1389257 - RNA, 20 nt, Human
uucuccccugcacuguaaaa

SEQ ID NO: 1389258 - RNA, 19 nt, Human
uucuccccugcacuguaaa

SEQ ID NO: 1389259 - RNA, 18 nt, Human
uucuccccugcacuguaa

SEQ ID NO: 1389260 - RNA, 19 nt, Human
aucauugugaaauuauuca

SEQ ID NO: 1389261 - RNA, 21 nt, Human
aucauucucugucucauccau

SEQ ID NO: 1389262 - RNA, 16 nt, Human
aucauucucugucuca

SEQ ID NO: 1389263 - RNA, 14 nt, Human
aucauucucugucu

SEQ ID NO: 1389264 - RNA, 12 nt, Human
aucauucucugu

SEQ ID NO: 1389265 - RNA, 13 nt, Human
aucauuacuauaa

SEQ ID NO: 1389266 - RNA, 16 nt, Human
aucauuaggugugacu

SEQ ID NO: 1389267 - RNA, 16 nt, Human
aucauccacacaugaa

SEQ ID NO: 1389268 - RNA, 14 nt, Human
aucauccacacaug

SEQ ID NO: 1389269 - RNA, 13 nt, Human
aucauccacacau

SEQ ID NO: 1389270 - RNA, 14 nt, Human
aucaucauggccag

SEQ ID NO: 1389271 - RNA, 13 nt, Human
aucaucauggcca

SEQ ID NO: 1389272 - RNA, 18 nt, Human
aucaucauguguguccac

SEQ ID NO: 1389273 - RNA, 16 nt, Human
aucaucaguguagaac

SEQ ID NO: 1389274 - RNA, 15 nt, Human
aucaucaguguagaa

SEQ ID NO: 1389275 - RNA, 20 nt, Human
aucauauauauacauacaug

SEQ ID NO: 1389276 - RNA, 20 nt, Human
aucauauaauaaauguacau

SEQ ID NO: 1389277 - RNA, 16 nt, Human
aucauauaauaaaugu

SEQ ID NO: 1389278 - RNA, 21 nt, Human
aucaguuuuuucaccuggaag

SEQ ID NO: 1389279 - RNA, 20 nt, Human
aucaguuuaaaagcacgaca

SEQ ID NO: 1389280 - RNA, 22 nt, Human
aucaguuuaaaagcacgacagu

SEQ ID NO: 1389281 - RNA, 16 nt, Human
aucaguuuaaaagcac

SEQ ID NO: 1389282 - RNA, 21 nt, Human
aucaguucauuagaaauauuu

SEQ ID NO: 1389283 - RNA, 19 nt, Human
aucaguucauuagaaauau

SEQ ID NO: 1389284 - RNA, 18 nt, Human
aucaguucauuagaaaua

SEQ ID NO: 1389285 - RNA, 15 nt, Human
aucagugcucccuca

SEQ ID NO: 1389286 - RNA, 16 nt, Human
aucagucucagaaugu

SEQ ID NO: 1389287 - RNA, 17 nt, Human
aucaguucauuagaaau

SEQ ID NO: 1389288 - RNA, 12 nt, Human
aucaguuaacua

SEQ ID NO: 1389289 - RNA, 22 nt, Human
aucaguuaagaaauuucacaua

SEQ ID NO: 1389290 - RNA, 18 nt, Human
aucaguuaagaaauuuca

SEQ ID NO: 1389291 - RNA, 18 nt, Human
aucaguuaacuauugcau

SEQ ID NO: 1389292 - RNA, 23 nt, Human
aucacuuaacggaccaaagcaag

SEQ ID NO: 1389293 - RNA, 17 nt, Human
aucacuuaaacuugcau

SEQ ID NO: 1389294 - RNA, 20 nt, Human
aucacuuaggaaauggcuuu

SEQ ID NO: 1389295 - RNA, 14 nt, Human
aucacuuaaacuug

SEQ ID NO: 1389296 - RNA, 21 nt, Human
aucacucuguucauuccucca

SEQ ID NO: 1389297 - RNA, 22 nt, Human
aucacucuguucauuccuccag

SEQ ID NO: 1389298 - RNA, 23 nt, Human
aucacucuguucauuccuccagg

SEQ ID NO: 1389299 - RNA, 14 nt, Human
aucacugaacuuug

SEQ ID NO: 1389300 - RNA, 21 nt, Human
aucacugaacuuugcugagcc

SEQ ID NO: 1389301 - RNA, 15 nt, Human
aucaacuugcuuauc

SEQ ID NO: 1389302 - RNA, 21 nt, Human
aucaacuuaccaggcaccaaa

SEQ ID NO: 1389303 - RNA, 14 nt, Human
aucaacugaaugag

SEQ ID NO: 1389304 - RNA, 13 nt, Human
aucaacugaauga

SEQ ID NO: 1389305 - RNA, 11 nt, Human
aucaacugaau

SEQ ID NO: 1389306 - RNA, 20 nt, Human
uuccuuacuuuuuauauaua

SEQ ID NO: 1389307 - RNA, 13 nt, Human
uuccuuaccuuuu

SEQ ID NO: 1389308 - RNA, 23 nt, Human
uuccuguuuuucacauuuuccuu

SEQ ID NO: 1389309 - RNA, 19 nt, Human
uuccuguuuuucacauuuu

SEQ ID NO: 1389310 - RNA, 20 nt, Human
uuccuuaagucagaacagca

SEQ ID NO: 1389311 - RNA, 19 nt, Human
uuccuuaagucagaacagc

SEQ ID NO: 1389312 - RNA, 18 nt, Human
uuccuuacagaacuacuu

SEQ ID NO: 1389313 - RNA, 12 nt, Human
aucacucaccau

SEQ ID NO: 1389314 - RNA, 13 nt, Human
aucacgcuuuccu

SEQ ID NO: 1389315 - RNA, 20 nt, Human
aucacucuaauuaauuguaa

SEQ ID NO: 1389316 - RNA, 19 nt, Human
aucacucuguucauuccuc

SEQ ID NO: 1389317 - RNA, 17 nt, Human
aucaauuauaguuucug

SEQ ID NO: 1389318 - RNA, 16 nt, Human
aucaauuauaguuucu

SEQ ID NO: 1389319 - RNA, 19 nt, Human
aucaauguuucuucuaggu

SEQ ID NO: 1389320 - RNA, 18 nt, Human
aucaauuauaguuucuga

SEQ ID NO: 1389321 - RNA, 17 nt, Human
aucaaguaauacaaacu

SEQ ID NO: 1389322 - RNA, 16 nt, Human
aucaaguaauacaaac

SEQ ID NO: 1389323 - RNA, 15 nt, Human
aucaaguaauacaaa

SEQ ID NO: 1389324 - RNA, 14 nt, Human
aucaaguaauacaa

SEQ ID NO: 1389325 - RNA, 15 nt, Human
aucaaggucguuuuu

SEQ ID NO: 1389326 - RNA, 14 nt, Human
aucaaggucguuuu

SEQ ID NO: 1389327 - RNA, 16 nt, Human
aucaagggucaggccu

SEQ ID NO: 1389328 - RNA, 17 nt, Human
aucaagggucaggccuu

SEQ ID NO: 1389329 - RNA, 15 nt, Human
aucaagggucaggcc

SEQ ID NO: 1389330 - RNA, 21 nt, Human
aucaaggguacacugccuucu

SEQ ID NO: 1389331 - RNA, 21 nt, Human
uuccugggaaauauucccuag

SEQ ID NO: 1389332 - RNA, 17 nt, Human
uuccugggaaauauucc

SEQ ID NO: 1389333 - RNA, 18 nt, Human
uuccugaaacaacuugga

SEQ ID NO: 1389334 - RNA, 19 nt, Human
uuccucuuuuccuucccaa

SEQ ID NO: 1389335 - RNA, 12 nt, Human
uuccugaacagg

SEQ ID NO: 1389336 - RNA, 21 nt, Human
uuccucucgcggcccucagua

SEQ ID NO: 1389337 - RNA, 20 nt, Human
uuccucucgcggcccucagu

SEQ ID NO: 1389338 - RNA, 16 nt, Human
uuccucucgcggcccu

SEQ ID NO: 1389339 - RNA, 21 nt, Human
uuccuaaauuuuccuguccuc

SEQ ID NO: 1389340 - RNA, 20 nt, Human
uuccuaaauuuuccuguccu

SEQ ID NO: 1389341 - RNA, 18 nt, Human
uuccuaaauuuuccuguc

SEQ ID NO: 1389342 - RNA, 12 nt, Human
uuccuaaauuuu

SEQ ID NO: 1389343 - RNA, 16 nt, Human
uuccuaaauauuauga

SEQ ID NO: 1389344 - RNA, 18 nt, Human
uuccuaaauauuaugaga

SEQ ID NO: 1389345 - RNA, 21 nt, Human
uuccuaaauauauuuuaagac

SEQ ID NO: 1389346 - RNA, 20 nt, Human
uucccgcagugggagcaaac

SEQ ID NO: 1389347 - RNA, 17 nt, Human
auauuugaaucuugucu

SEQ ID NO: 1389348 - RNA, 18 nt, Human
auauuugaaucuugucuc

SEQ ID NO: 1389349 - RNA, 19 nt, Human
auauuugaaucuugucuca

SEQ ID NO: 1389350 - RNA, 21 nt, Human
auauuugaaucuugucucaau

SEQ ID NO: 1389351 - RNA, 17 nt, Human
uucccguuucuccaccu

SEQ ID NO: 1389352 - RNA, 15 nt, Human
uucccguuucuccac

SEQ ID NO: 1389353 - RNA, 14 nt, Human
uucccguuucucca

SEQ ID NO: 1389354 - RNA, 16 nt, Human
uucccuaaucuauggu

SEQ ID NO: 1389355 - RNA, 17 nt, Human
uucccuacccucuagag

SEQ ID NO: 1389356 - RNA, 16 nt, Human
uucccuacccucuaga

SEQ ID NO: 1389357 - RNA, 14 nt, Human
uucccuacccucua

SEQ ID NO: 1389358 - RNA, 20 nt, Human
uucccuacccucuagagaaa

SEQ ID NO: 1389359 - RNA, 19 nt, Human
uuccgcuuggagcagaggg

SEQ ID NO: 1389360 - RNA, 13 nt, Human
uuccgcuuggagc

SEQ ID NO: 1389361 - RNA, 18 nt, Human
uuccgccacuggggcuca

SEQ ID NO: 1389362 - RNA, 15 nt, Human
uuccgccacuggggc

SEQ ID NO: 1389363 - RNA, 17 nt, Human
uucccuacugaagcccu

SEQ ID NO: 1389364 - RNA, 15 nt, Human
uucccuuuuuuuaag

SEQ ID NO: 1389365 - RNA, 20 nt, Human
uucccaggacccugaagggg

SEQ ID NO: 1389366 - RNA, 19 nt, Human
uucccaggacccugaaggg

SEQ ID NO: 1389367 - RNA, 13 nt, Human
uucccaggacccu

SEQ ID NO: 1389368 - RNA, 12 nt, Human
uucccaggaccc

SEQ ID NO: 1389369 - RNA, 11 nt, Human
uucccaggacc

SEQ ID NO: 1389370 - RNA, 20 nt, Human
uuccagucuuccugacacuu

SEQ ID NO: 1389371 - RNA, 18 nt, Human
uucccagcucuacccugc

SEQ ID NO: 1389372 - RNA, 17 nt, Human
uuccagucuuccugaca

SEQ ID NO: 1389373 - RNA, 16 nt, Human
uucccaguuggagcuc

SEQ ID NO: 1389374 - RNA, 15 nt, Human
uucccaguuggagcu

SEQ ID NO: 1389375 - RNA, 15 nt, Human
uucccagucugucga

SEQ ID NO: 1389376 - RNA, 16 nt, Human
uucccaggugcuacac

SEQ ID NO: 1389377 - RNA, 12 nt, Human
uucccaggugcu

SEQ ID NO: 1389378 - RNA, 21 nt, Human
uucccagguaggccaaggugu

SEQ ID NO: 1389379 - RNA, 19 nt, Human
uucccaggcccacugugcc

SEQ ID NO: 1389380 - RNA, 22 nt, Human
uucccaggcccacugugccuca

SEQ ID NO: 1389381 - RNA, 12 nt, Human
uucccaggccca

SEQ ID NO: 1389382 - RNA, 18 nt, Human
uucccaguuggagcucca

SEQ ID NO: 1389383 - RNA, 14 nt, Human
auauguugaauacu

SEQ ID NO: 1389384 - RNA, 16 nt, Human
auauguucugacauaa

SEQ ID NO: 1389385 - RNA, 21 nt, Human
auauguuguaauauuucuuca

SEQ ID NO: 1389386 - RNA, 16 nt, Human
auauguuguaauauuu

SEQ ID NO: 1389387 - RNA, 18 nt, Human
auauguugaauacuuuuu

SEQ ID NO: 1389388 - RNA, 17 nt, Human
auauguugaauacuuuu

SEQ ID NO: 1389389 - RNA, 16 nt, Human
auauguugaauacuuu

SEQ ID NO: 1389390 - RNA, 15 nt, Human
auauguugaauacuu

SEQ ID NO: 1389391 - RNA, 13 nt, Human
auauuacaaugau

SEQ ID NO: 1389392 - RNA, 15 nt, Human
auauuacaaugauca

SEQ ID NO: 1389393 - RNA, 16 nt, Human
auauuacaaugaucac

SEQ ID NO: 1389394 - RNA, 17 nt, Human
auauuaccacagacaua

SEQ ID NO: 1389395 - RNA, 12 nt, Human
auauuacaauga

SEQ ID NO: 1389396 - RNA, 19 nt, Human
auauugugauucugccuuu

SEQ ID NO: 1389397 - RNA, 17 nt, Human
auauugugauucugccu

SEQ ID NO: 1389398 - RNA, 14 nt, Human
auauugugauucug

SEQ ID NO: 1389399 - RNA, 19 nt, Human
auauuguggguguuaauuu

SEQ ID NO: 1389400 - RNA, 14 nt, Human
auauuguuugcuaa

SEQ ID NO: 1389401 - RNA, 13 nt, Human
auauuuacaaaug

SEQ ID NO: 1389402 - RNA, 19 nt, Human
auauuuaacucucuuuaug

SEQ ID NO: 1389403 - RNA, 21 nt, Human
auauuuaaauguaaagacaaa

SEQ ID NO: 1389404 - RNA, 19 nt, Human
auauuuaaauguaaagaca

SEQ ID NO: 1389405 - RNA, 19 nt, Human
auauuguuuuacaauaguu

SEQ ID NO: 1389406 - RNA, 12 nt, Human
auauuguaaaua

SEQ ID NO: 1389407 - RNA, 17 nt, Human
auauuguaaaacaggua

SEQ ID NO: 1389408 - RNA, 16 nt, Human
auauuguaaaacaggu

SEQ ID NO: 1389409 - RNA, 17 nt, Human
auauuggccaaggaaag

SEQ ID NO: 1389410 - RNA, 21 nt, Human
auauuggccaaggaaaggcac

SEQ ID NO: 1389411 - RNA, 19 nt, Human
auauuggacaaagaaccuu

SEQ ID NO: 1389412 - RNA, 12 nt, Human
auauuggaacuu

SEQ ID NO: 1389413 - RNA, 18 nt, Human
auauugauaagaucuuuu

SEQ ID NO: 1389414 - RNA, 17 nt, Human
auauugagucaaauggu

SEQ ID NO: 1389415 - RNA, 19 nt, Human
auauugauaagaucuuuua

SEQ ID NO: 1389416 - RNA, 16 nt, Human
auauugacuuguauau

SEQ ID NO: 1389417 - RNA, 15 nt, Human
auauugacuuguaua

SEQ ID NO: 1389418 - RNA, 14 nt, Human
auauugacuuguau

SEQ ID NO: 1389419 - RNA, 21 nt, Human
auauucucacagcuccaagaa

SEQ ID NO: 1389420 - RNA, 15 nt, Human
auauuacacuacaca

SEQ ID NO: 1389421 - RNA, 19 nt, Human
auauuaccacagacauacu

SEQ ID NO: 1389422 - RNA, 22 nt, Human
auauucuauuacauuuucagug

SEQ ID NO: 1389423 - RNA, 23 nt, Human
auauucuaagacuuacucuaaga

SEQ ID NO: 1389424 - RNA, 14 nt, Human
auauucuaagacuu

SEQ ID NO: 1389425 - RNA, 13 nt, Human
auauucuaagacu

SEQ ID NO: 1389426 - RNA, 18 nt, Human
auauucucacagcuccaa

SEQ ID NO: 1389427 - RNA, 22 nt, Human
uuccaggcuucugcuggggccu

SEQ ID NO: 1389428 - RNA, 20 nt, Human
uuccaggcuucugcuggggc

SEQ ID NO: 1389429 - RNA, 18 nt, Human
uuccaggcuucugcuggg

SEQ ID NO: 1389430 - RNA, 17 nt, Human
uuccaggcuucugcugg

SEQ ID NO: 1389431 - RNA, 16 nt, Human
uuccaggcuucugcug

SEQ ID NO: 1389432 - RNA, 15 nt, Human
uuccaggcuucugcu

SEQ ID NO: 1389433 - RNA, 14 nt, Human
uuccaggcuucugc

SEQ ID NO: 1389434 - RNA, 19 nt, Human
uuccacguacugcagccuc

SEQ ID NO: 1389435 - RNA, 24 nt, Human
uuccacggagccacuccucugacu

SEQ ID NO: 1389436 - RNA, 21 nt, Human
uuccaccacagccagcaccug

SEQ ID NO: 1389437 - RNA, 16 nt, Human
uuccaccacagccagc

SEQ ID NO: 1389438 - RNA, 15 nt, Human
uuccaccacagccag

SEQ ID NO: 1389439 - RNA, 18 nt, Human
uuccacagggucccacag

SEQ ID NO: 1389440 - RNA, 22 nt, Human
uuccacagggucccacagccac

SEQ ID NO: 1389441 - RNA, 17 nt, Human
uuccacagggucccaca

SEQ ID NO: 1389442 - RNA, 21 nt, Human
uuccacagccugcaagucagu

SEQ ID NO: 1389443 - RNA, 22 nt, Human
uuccacagaggacacagagaag

SEQ ID NO: 1389444 - RNA, 14 nt, Human
uuccacagaggaca

SEQ ID NO: 1389445 - RNA, 22 nt, Human
uuccacggagccacuccucuga

SEQ ID NO: 1389446 - RNA, 21 nt, Human
uuccacggagccacuccucug

SEQ ID NO: 1389447 - RNA, 15 nt, Human
uuccacggagccacu

SEQ ID NO: 1389448 - RNA, 17 nt, Human
uuccaccaaaugugcuu

SEQ ID NO: 1389449 - RNA, 22 nt, Human
uuccaccacagccagcaccugg

SEQ ID NO: 1389450 - RNA, 21 nt, Human
uuccaagacaugucuguucua

SEQ ID NO: 1389451 - RNA, 16 nt, Human
uuccaagacaugucug

SEQ ID NO: 1389452 - RNA, 22 nt, Human
uuccaacuuggcugcaggaauc

SEQ ID NO: 1389453 - RNA, 17 nt, Human
uuccaacuuggcugcag

SEQ ID NO: 1389454 - RNA, 19 nt, Human
uuccaacucguauagcaug

SEQ ID NO: 1389455 - RNA, 18 nt, Human
uuccaacuacuaauagaa

SEQ ID NO: 1389456 - RNA, 22 nt, Human
uuccaacucguauagcaugcau

SEQ ID NO: 1389457 - RNA, 18 nt, Human
uucauugaguugguuacu

SEQ ID NO: 1389458 - RNA, 21 nt, Human
uucauugccuuaacuggagcc

SEQ ID NO: 1389459 - RNA, 19 nt, Human
uucauugcacuuugauuag

SEQ ID NO: 1389460 - RNA, 21 nt, Human
uuccaauuuucuggaauacau

SEQ ID NO: 1389461 - RNA, 17 nt, Human
uuccaaugucuggagac

SEQ ID NO: 1389462 - RNA, 16 nt, Human
uuccaaugucuggaga

SEQ ID NO: 1389463 - RNA, 22 nt, Human
uuccaagacucuagaguccaag

SEQ ID NO: 1389464 - RNA, 21 nt, Human
uuccaagacucuagaguccaa

SEQ ID NO: 1389465 - RNA, 18 nt, Human
uuccaaugucuggagacc

SEQ ID NO: 1389466 - RNA, 17 nt, Human
uuccaagacucuagagu

SEQ ID NO: 1389467 - RNA, 16 nt, Human
uuccaagacucuagag

SEQ ID NO: 1389468 - RNA, 15 nt, Human
uuccaagacucuaga

SEQ ID NO: 1389469 - RNA, 15 nt, Human
uucauuagucauguu

SEQ ID NO: 1389470 - RNA, 16 nt, Human
uucauuagucauguuu

SEQ ID NO: 1389471 - RNA, 20 nt, Human
uucauuagaaauauuuuaaa

SEQ ID NO: 1389472 - RNA, 13 nt, Human
uucauuaaauaaa

SEQ ID NO: 1389473 - RNA, 16 nt, Human
uucauuaauucuauaa

SEQ ID NO: 1389474 - RNA, 22 nt, Human
uucauugaguugguuacuucau

SEQ ID NO: 1389475 - RNA, 19 nt, Human
auauggggaugguaguuuu

SEQ ID NO: 1389476 - RNA, 20 nt, Human
auauggggaugguaguuuuu

SEQ ID NO: 1389477 - RNA, 21 nt, Human
auauguacccucugaaauaca

SEQ ID NO: 1389478 - RNA, 22 nt, Human
uucaugcuguucaugaaagauu

SEQ ID NO: 1389479 - RNA, 22 nt, Human
auauguguaugcacaguaaaaa

SEQ ID NO: 1389480 - RNA, 20 nt, Human
auauguacccucugaaauac

SEQ ID NO: 1389481 - RNA, 16 nt, Human
uucauuaacaaaaugu

SEQ ID NO: 1389482 - RNA, 14 nt, Human
uucauuaaauaaau

SEQ ID NO: 1389483 - RNA, 12 nt, Human
uucauuaaauaa

SEQ ID NO: 1389484 - RNA, 22 nt, Human
auaugacuguuuuucggacagu

SEQ ID NO: 1389485 - RNA, 21 nt, Human
auaugacuguuuuucggacag

SEQ ID NO: 1389486 - RNA, 23 nt, Human
auauggccacaguagucuugaug

SEQ ID NO: 1389487 - RNA, 16 nt, Human
auaugaagacauaaac

SEQ ID NO: 1389488 - RNA, 15 nt, Human
auaugaagacauaaa

SEQ ID NO: 1389489 - RNA, 14 nt, Human
auaugaagacauaa

SEQ ID NO: 1389490 - RNA, 19 nt, Human
auaugaacauauuguugaa

SEQ ID NO: 1389491 - RNA, 20 nt, Human
auaugaacauauuguugaaa

SEQ ID NO: 1389492 - RNA, 15 nt, Human
auaugaacauauugu

SEQ ID NO: 1389493 - RNA, 15 nt, Human
auauauuuucuguuu

SEQ ID NO: 1389494 - RNA, 18 nt, Human
auauauuuuacaauuuuu

SEQ ID NO: 1389495 - RNA, 17 nt, Human
auaugaaagcugauuuu

SEQ ID NO: 1389496 - RNA, 16 nt, Human
auauauuuuguuuaca

SEQ ID NO: 1389497 - RNA, 13 nt, Human
uucagguuuuucc

SEQ ID NO: 1389498 - RNA, 16 nt, Human
uucagguuuuuccuuu

SEQ ID NO: 1389499 - RNA, 14 nt, Human
uucagguccaggcu

SEQ ID NO: 1389500 - RNA, 17 nt, Human
uucauaguucagaauuu

SEQ ID NO: 1389501 - RNA, 16 nt, Human
uucauaguucagaauu

SEQ ID NO: 1389502 - RNA, 14 nt, Human
uucauaguucagaa

SEQ ID NO: 1389503 - RNA, 17 nt, Human
uucauaguaacuucuua

SEQ ID NO: 1389504 - RNA, 22 nt, Human
uucauaggucugaaauuuuucu

SEQ ID NO: 1389505 - RNA, 17 nt, Human
uucauaggucugaaauu

SEQ ID NO: 1389506 - RNA, 15 nt, Human
uucauaggucugaaa

SEQ ID NO: 1389507 - RNA, 13 nt, Human
uucauaggucuga

SEQ ID NO: 1389508 - RNA, 18 nt, Human
uucagucucuauaccaau

SEQ ID NO: 1389509 - RNA, 21 nt, Human
uucagucucuauaccaauaaa

SEQ ID NO: 1389510 - RNA, 22 nt, Human
uucagucucuauaccaauaaag

SEQ ID NO: 1389511 - RNA, 23 nt, Human
uucagucucuauaccaauaaagu

SEQ ID NO: 1389512 - RNA, 24 nt, Human
uucagucucuauaccaauaaagug

SEQ ID NO: 1389513 - RNA, 15 nt, Human
uucauaucauccaca

SEQ ID NO: 1389514 - RNA, 21 nt, Human
uucauauaguuagcuaauaaa

SEQ ID NO: 1389515 - RNA, 21 nt, Human
uucauauaugaggacuugugu

SEQ ID NO: 1389516 - RNA, 18 nt, Human
uucauauaugaggacuug

SEQ ID NO: 1389517 - RNA, 16 nt, Human
uucauauaaaguauca

SEQ ID NO: 1389518 - RNA, 14 nt, Human
uucauauaaaguau

SEQ ID NO: 1389519 - RNA, 20 nt, Human
uucauaguucagaauuuagu

SEQ ID NO: 1389520 - RNA, 19 nt, Human
uucauaguucagaauuuag

SEQ ID NO: 1389521 - RNA, 22 nt, Human
uucauauuuuaaacagaggaua

SEQ ID NO: 1389522 - RNA, 21 nt, Human
uucauauuuuucauagcuaaa

SEQ ID NO: 1389523 - RNA, 16 nt, Human
auauauuuuacaauuu

SEQ ID NO: 1389524 - RNA, 21 nt, Human
auauauggggaugguaguuuu

SEQ ID NO: 1389525 - RNA, 22 nt, Human
auauauggggaugguaguuuuu

SEQ ID NO: 1389526 - RNA, 20 nt, Human
auauauggggaugguaguuu

SEQ ID NO: 1389527 - RNA, 13 nt, Human
auauaugcuaagu

SEQ ID NO: 1389528 - RNA, 11 nt, Human
uucagcauuug

SEQ ID NO: 1389529 - RNA, 10 nt, Human
uucagccaag

SEQ ID NO: 1389530 - RNA, 12 nt, Human
uucagcaugcaa

SEQ ID NO: 1389531 - RNA, 20 nt, Human
uucagcuaagcuaggaauga

SEQ ID NO: 1389532 - RNA, 14 nt, Human
uucagcuaagcuag

SEQ ID NO: 1389533 - RNA, 17 nt, Human
uucagcgguuuauauaa

SEQ ID NO: 1389534 - RNA, 21 nt, Human
uucagcacugucccuugccuc

SEQ ID NO: 1389535 - RNA, 16 nt, Human
uucagcacugucccuu

SEQ ID NO: 1389536 - RNA, 15 nt, Human
uucagcacugucccu

SEQ ID NO: 1389537 - RNA, 14 nt, Human
uucagcacuguccc

SEQ ID NO: 1389538 - RNA, 12 nt, Human
uucagauuuggc

SEQ ID NO: 1389539 - RNA, 19 nt, Human
uucagcauccgcaggugcu

SEQ ID NO: 1389540 - RNA, 23 nt, Human
uucagcauccgcaggugcugguc

SEQ ID NO: 1389541 - RNA, 20 nt, Human
uucagcacugucccuugccu

SEQ ID NO: 1389542 - RNA, 22 nt, Human
uucagcacuuuagaauaugccu

SEQ ID NO: 1389543 - RNA, 23 nt, Human
uucagcacuuuagaauaugccuu

SEQ ID NO: 1389544 - RNA, 19 nt, Human
uucacuucauaauccagua

SEQ ID NO: 1389545 - RNA, 18 nt, Human
uuaucauucaaguguaaa

SEQ ID NO: 1389546 - RNA, 23 nt, Human
uucagaaccccaacuacuguguu

SEQ ID NO: 1389547 - RNA, 22 nt, Human
uucagaaccccaacuacugugu

SEQ ID NO: 1389548 - RNA, 20 nt, Human
uucacuuuugacaaaggcaa

SEQ ID NO: 1389549 - RNA, 17 nt, Human
uucacuuuugacaaagg

SEQ ID NO: 1389550 - RNA, 16 nt, Human
uucagaaauguguuau

SEQ ID NO: 1389551 - RNA, 22 nt, Human
uucagauucccagagcaaaaua

SEQ ID NO: 1389552 - RNA, 21 nt, Human
uucagauucccagagcaaaau

SEQ ID NO: 1389553 - RNA, 14 nt, Human
uucagauucccaga

SEQ ID NO: 1389554 - RNA, 22 nt, Human
uucagauaucuuggacaaauca

SEQ ID NO: 1389555 - RNA, 19 nt, Human
uucagauaugauucaaaug

SEQ ID NO: 1389556 - RNA, 12 nt, Human
uucagaagaaaa

SEQ ID NO: 1389557 - RNA, 14 nt, Human
uucagaagaaaaag

SEQ ID NO: 1389558 - RNA, 18 nt, Human
uucagauaugauucaaau

SEQ ID NO: 1389559 - RNA, 17 nt, Human
uucagauaugauucaaa

SEQ ID NO: 1389560 - RNA, 16 nt, Human
uucagauaugauucaa

SEQ ID NO: 1389561 - RNA, 20 nt, Human
uuuccuucccuuuucuguuc

SEQ ID NO: 1389562 - RNA, 19 nt, Human
uuuccuucccuuuucuguu

SEQ ID NO: 1389563 - RNA, 18 nt, Human
uuuccuucccuuuucugu

SEQ ID NO: 1389564 - RNA, 14 nt, Human
uuuccuucccuuuu

SEQ ID NO: 1389565 - RNA, 12 nt, Human
uuuccuuccaau

SEQ ID NO: 1389566 - RNA, 21 nt, Human
uuuccuuccaaugucuggaga

SEQ ID NO: 1389567 - RNA, 18 nt, Human
uuuccuucaaaguuuaau

SEQ ID NO: 1389568 - RNA, 21 nt, Human
uuuccuguccucuuucagcuc

SEQ ID NO: 1389569 - RNA, 20 nt, Human
uuuccuguccucuuucagcu

SEQ ID NO: 1389570 - RNA, 21 nt, Human
uuuccuuuaacugacaagcca

SEQ ID NO: 1389571 - RNA, 14 nt, Human
uuucgaaaaucaaa

SEQ ID NO: 1389572 - RNA, 17 nt, Human
uuuccuuuuuuguuauu

SEQ ID NO: 1389573 - RNA, 16 nt, Human
uuuccuuuuuuguuau

SEQ ID NO: 1389574 - RNA, 22 nt, Human
uuuccuuuuuaauaugcuuaaa

SEQ ID NO: 1389575 - RNA, 19 nt, Human
uuuccuuuuuaauaugcuu

SEQ ID NO: 1389576 - RNA, 13 nt, Human
uuuccuuuuuaau

SEQ ID NO: 1389577 - RNA, 21 nt, Human
uuucuaaaaucuuauaguucu

SEQ ID NO: 1389578 - RNA, 12 nt, Human
uuucuaaaaucu

SEQ ID NO: 1389579 - RNA, 12 nt, Human
uuucguuuguuu

SEQ ID NO: 1389580 - RNA, 14 nt, Human
uuucguuuguuugu

SEQ ID NO: 1389581 - RNA, 13 nt, Human
uuucguggggagg

SEQ ID NO: 1389582 - RNA, 16 nt, Human
uuucguaacacagcau

SEQ ID NO: 1389583 - RNA, 17 nt, Human
uuucggauuuuuuccaa

SEQ ID NO: 1389584 - RNA, 18 nt, Human
uuucggacaguuuauuug

SEQ ID NO: 1389585 - RNA, 13 nt, Human
augggcauggugu

SEQ ID NO: 1389586 - RNA, 20 nt, Human
augggcaucuuuuguauuaa

SEQ ID NO: 1389587 - RNA, 21 nt, Human
augggcaucuuuuguauuaag

SEQ ID NO: 1389588 - RNA, 17 nt, Human
augggcaucuuuuguau

SEQ ID NO: 1389589 - RNA, 16 nt, Human
augggcaucuuuugua

SEQ ID NO: 1389590 - RNA, 14 nt, Human
augggcccaggccu

SEQ ID NO: 1389591 - RNA, 14 nt, Human
augggcagagccca

SEQ ID NO: 1389592 - RNA, 23 nt, Human
augggagcugaggccacacucag

SEQ ID NO: 1389593 - RNA, 12 nt, Human
augggaccacaa

SEQ ID NO: 1389594 - RNA, 20 nt, Human
augggagccgggucugccuc

SEQ ID NO: 1389595 - RNA, 17 nt, Human
augggagccgggucugc

SEQ ID NO: 1389596 - RNA, 17 nt, Human
auggaauuuugcaaaga

SEQ ID NO: 1389597 - RNA, 19 nt, Human
auggaauugauuugcauug

SEQ ID NO: 1389598 - RNA, 18 nt, Human
auggaauugauuugcauu

SEQ ID NO: 1389599 - RNA, 13 nt, Human
auggccucaugug

SEQ ID NO: 1389600 - RNA, 18 nt, Human
auggaccugccugcauag

SEQ ID NO: 1389601 - RNA, 20 nt, Human
auggaccggagagugggggu

SEQ ID NO: 1389602 - RNA, 16 nt, Human
auggaccggagagugg

SEQ ID NO: 1389603 - RNA, 13 nt, Human
auggaccggagag

SEQ ID NO: 1389604 - RNA, 20 nt, Human
auggccucauguggcuggaa

SEQ ID NO: 1389605 - RNA, 19 nt, Human
auggccucauguggcugga

SEQ ID NO: 1389606 - RNA, 18 nt, Human
auggccucauguggcugg

SEQ ID NO: 1389607 - RNA, 17 nt, Human
auggccucauguggcug

SEQ ID NO: 1389608 - RNA, 18 nt, Human
auggccucuucagaucuc

SEQ ID NO: 1389609 - RNA, 21 nt, Human
augggacauuugcucauggaa

SEQ ID NO: 1389610 - RNA, 22 nt, Human
augggacauuugcucauggaau

SEQ ID NO: 1389611 - RNA, 13 nt, Human
uuucuuuaacugc

SEQ ID NO: 1389612 - RNA, 12 nt, Human
uuucuuuaacug

SEQ ID NO: 1389613 - RNA, 15 nt, Human
uuucuuuaaaaaaca

SEQ ID NO: 1389614 - RNA, 19 nt, Human
uuucuggccaguguuuaaa

SEQ ID NO: 1389615 - RNA, 11 nt, Human
uuucuggccag

SEQ ID NO: 1389616 - RNA, 23 nt, Human
uuucuggauuccccaucucaggc

SEQ ID NO: 1389617 - RNA, 15 nt, Human
uuucuggauuucaua

SEQ ID NO: 1389618 - RNA, 18 nt, Human
uuucuggaauguaaucaa

SEQ ID NO: 1389619 - RNA, 21 nt, Human
uuucuggaauacaugaaauau

SEQ ID NO: 1389620 - RNA, 20 nt, Human
uuucuggaauacaugaaaua

SEQ ID NO: 1389621 - RNA, 18 nt, Human
uuucuggaauacaugaaa

SEQ ID NO: 1389622 - RNA, 22 nt, Human
uuucugccuggaguguaugacu

SEQ ID NO: 1389623 - RNA, 14 nt, Human
uuucugccuggagu

SEQ ID NO: 1389624 - RNA, 13 nt, Human
uuucugcccugcc

SEQ ID NO: 1389625 - RNA, 15 nt, Human
uuucuuuacaaaaca

SEQ ID NO: 1389626 - RNA, 21 nt, Human
uuucuuuucccccauuaauca

SEQ ID NO: 1389627 - RNA, 9 nt, Human
uuucuuuuc

SEQ ID NO: 1389628 - RNA, 19 nt, Human
uuucuuuguuucuuucuuu

SEQ ID NO: 1389629 - RNA, 18 nt, Human
uuucuuuguuucuuucuu

SEQ ID NO: 1389630 - RNA, 15 nt, Human
uuucuuuguguagcu

SEQ ID NO: 1389631 - RNA, 23 nt, Human
uuucuuuugguaaagacuggcuu

SEQ ID NO: 1389632 - RNA, 13 nt, Human
uuucuuuucuuug

SEQ ID NO: 1389633 - RNA, 22 nt, Human
uuucuuuucuggaauguaauca

SEQ ID NO: 1389634 - RNA, 16 nt, Human
uuucuuuucucuggua

SEQ ID NO: 1389635 - RNA, 13 nt, Human
uuugaaaagcaga

SEQ ID NO: 1389636 - RNA, 16 nt, Human
uuugaaaagcagacau

SEQ ID NO: 1389637 - RNA, 18 nt, Human
uuugaaaagcagacauuu

SEQ ID NO: 1389638 - RNA, 11 nt, Human
auggggaggga

SEQ ID NO: 1389639 - RNA, 14 nt, Human
auggggaggaggag

SEQ ID NO: 1389640 - RNA, 17 nt, Human
auggggaggacaaaaug

SEQ ID NO: 1389641 - RNA, 13 nt, Human
auggggaggacaa

SEQ ID NO: 1389642 - RNA, 14 nt, Human
auggggaccagcag

SEQ ID NO: 1389643 - RNA, 16 nt, Human
uuugaaauauggucuu

SEQ ID NO: 1389644 - RNA, 16 nt, Human
uuugaaauaagcuauu

SEQ ID NO: 1389645 - RNA, 15 nt, Human
uuugaaauauugacu

SEQ ID NO: 1389646 - RNA, 14 nt, Human
uuugaaauauugac

SEQ ID NO: 1389647 - RNA, 19 nt, Human
uuugaaauaagcuauuuga

SEQ ID NO: 1389648 - RNA, 14 nt, Human
uuugaaauaagcua

SEQ ID NO: 1389649 - RNA, 12 nt, Human
uuugaaauaagc

SEQ ID NO: 1389650 - RNA, 19 nt, Human
uuugaaagucuguccuuga

SEQ ID NO: 1389651 - RNA, 17 nt, Human
uuugaaagucuguccuu

SEQ ID NO: 1389652 - RNA, 16 nt, Human
uuugaaagucuguccu

SEQ ID NO: 1389653 - RNA, 21 nt, Human
uuugaaaggagaugucuugga

SEQ ID NO: 1389654 - RNA, 21 nt, Human
uuugaaagaauagaacacagu

SEQ ID NO: 1389655 - RNA, 22 nt, Human
uuugaaaccccuguaggccuca

SEQ ID NO: 1389656 - RNA, 11 nt, Human
uuugaaaaugg

SEQ ID NO: 1389657 - RNA, 17 nt, Human
uuugaaacacuuugcau

SEQ ID NO: 1389658 - RNA, 19 nt, Human
uuugaaacacuuugcauaa

SEQ ID NO: 1389659 - RNA, 20 nt, Human
uuucucauccacauacccug

SEQ ID NO: 1389660 - RNA, 16 nt, Human
uuucucaguuuucaua

SEQ ID NO: 1389661 - RNA, 16 nt, Human
uuucucacuaaaucuu

SEQ ID NO: 1389662 - RNA, 13 nt, Human
uuucuauuuuuau

SEQ ID NO: 1389663 - RNA, 15 nt, Human
uuucuauuuuuaucu

SEQ ID NO: 1389664 - RNA, 19 nt, Human
uuucuauuucacuggagca

SEQ ID NO: 1389665 - RNA, 17 nt, Human
uuucuauuucuccucca

SEQ ID NO: 1389666 - RNA, 17 nt, Human
uuucuauuucacuggag

SEQ ID NO: 1389667 - RNA, 16 nt, Human
uuucuauuucacugga

SEQ ID NO: 1389668 - RNA, 12 nt, Human
uuucuccagcug

SEQ ID NO: 1389669 - RNA, 11 nt, Human
uuucuccagcu

SEQ ID NO: 1389670 - RNA, 15 nt, Human
uuucuccaagagcua

SEQ ID NO: 1389671 - RNA, 21 nt, Human
uuucuccaagagcuacauaau

SEQ ID NO: 1389672 - RNA, 13 nt, Human
uuucugcauaugu

SEQ ID NO: 1389673 - RNA, 17 nt, Human
uuucugcauauguugaa

SEQ ID NO: 1389674 - RNA, 12 nt, Human
uuucugcccugc

SEQ ID NO: 1389675 - RNA, 23 nt, Human
uuucuauuaaaagacucauccgu

SEQ ID NO: 1389676 - RNA, 19 nt, Human
uuucuauuaaaagacucau

SEQ ID NO: 1389677 - RNA, 18 nt, Human
uuucuauuaaaagacuca

SEQ ID NO: 1389678 - RNA, 17 nt, Human
uuucuauuaaaagacuc

SEQ ID NO: 1389679 - RNA, 16 nt, Human
uuucuauuaaaagacu

SEQ ID NO: 1389680 - RNA, 15 nt, Human
uuucuauuaaaagac

SEQ ID NO: 1389681 - RNA, 14 nt, Human
uuucuauuaaaaga

SEQ ID NO: 1389682 - RNA, 23 nt, Human
uuucuauggguguuaucaccuag

SEQ ID NO: 1389683 - RNA, 15 nt, Human
uuucuaugacacaug

SEQ ID NO: 1389684 - RNA, 21 nt, Human
uuucuaugacacaugcaaggu

SEQ ID NO: 1389685 - RNA, 20 nt, Human
uuucuaugaaauauuauguu

SEQ ID NO: 1389686 - RNA, 14 nt, Human
uuucuaugaaauau

SEQ ID NO: 1389687 - RNA, 20 nt, Human
uuucuaucguucucucuuug

SEQ ID NO: 1389688 - RNA, 19 nt, Human
uuucuaucguucucucuuu

SEQ ID NO: 1389689 - RNA, 17 nt, Human
uuucuaucguucucucu

SEQ ID NO: 1389690 - RNA, 15 nt, Human
uuucuauccucugua

SEQ ID NO: 1389691 - RNA, 22 nt, Human
uuucuauagccaaaaauagcua

SEQ ID NO: 1389692 - RNA, 13 nt, Human
uuucuaugaaaua

SEQ ID NO: 1389693 - RNA, 21 nt, Human
uuucuagguaggaaauguggu

SEQ ID NO: 1389694 - RNA, 17 nt, Human
uuucuagguaggaaaug

SEQ ID NO: 1389695 - RNA, 22 nt, Human
uuucuaggacugaauuaugaaa

SEQ ID NO: 1389696 - RNA, 20 nt, Human
uuucuaaacuggagacugug

SEQ ID NO: 1389697 - RNA, 19 nt, Human
uuucuaaacuggagacugu

SEQ ID NO: 1389698 - RNA, 17 nt, Human
uuucuaaacuggagacu

SEQ ID NO: 1389699 - RNA, 16 nt, Human
uuucuaaacuggagac

SEQ ID NO: 1389700 - RNA, 15 nt, Human
uuucuaaacuggaga

SEQ ID NO: 1389701 - RNA, 14 nt, Human
uuucuaaacuggag

SEQ ID NO: 1389702 - RNA, 17 nt, Human
uuucuaggacugaauua

SEQ ID NO: 1389703 - RNA, 21 nt, Human
uuucuaggacugaauuaugaa

SEQ ID NO: 1389704 - RNA, 13 nt, Human
uuucuaguugaaa

SEQ ID NO: 1389705 - RNA, 18 nt, Human
uuucuauagccaaaaaua

SEQ ID NO: 1389706 - RNA, 17 nt, Human
augcuuagauguuccag

SEQ ID NO: 1389707 - RNA, 23 nt, Human
augcuuacugauauauuuuacaa

SEQ ID NO: 1389708 - RNA, 22 nt, Human
augcuuacugauauauuuuaca

SEQ ID NO: 1389709 - RNA, 13 nt, Human
augcuuacugaua

SEQ ID NO: 1389710 - RNA, 22 nt, Human
augcugugagucuuugguucua

SEQ ID NO: 1389711 - RNA, 21 nt, Human
augcugugagucuuugguucu

SEQ ID NO: 1389712 - RNA, 22 nt, Human
augcugugcccuaaaguguauu

SEQ ID NO: 1389713 - RNA, 23 nt, Human
augcugugacacauggccccucc

SEQ ID NO: 1389714 - RNA, 19 nt, Human
augcugugcccuaaagugu

SEQ ID NO: 1389715 - RNA, 16 nt, Human
augcuguacccaguuu

SEQ ID NO: 1389716 - RNA, 13 nt, Human
augcuguacccag

SEQ ID NO: 1389717 - RNA, 19 nt, Human
augcuguauuuuaaaagaa

SEQ ID NO: 1389718 - RNA, 14 nt, Human
augcuguauuuuaa

SEQ ID NO: 1389719 - RNA, 23 nt, Human
augcuguacaucuauuuuggauu

SEQ ID NO: 1389720 - RNA, 14 nt, Human
augcuggugagcca

SEQ ID NO: 1389721 - RNA, 21 nt, Human
augcuggguccauaucacaca

SEQ ID NO: 1389722 - RNA, 16 nt, Human
augcugggacucagcc

SEQ ID NO: 1389723 - RNA, 15 nt, Human
augcugggacucagc

SEQ ID NO: 1389724 - RNA, 10 nt, Human
augcugggac

SEQ ID NO: 1389725 - RNA, 9 nt, Human
augcuggga

SEQ ID NO: 1389726 - RNA, 15 nt, Human
uuuauuaugaagaag

SEQ ID NO: 1389727 - RNA, 20 nt, Human
uuuauuaguauuguuguccu

SEQ ID NO: 1389728 - RNA, 13 nt, Human
uuuauuaugcaug

SEQ ID NO: 1389729 - RNA, 19 nt, Human
uuuauuacuguaagaaaau

SEQ ID NO: 1389730 - RNA, 14 nt, Human
auggaacacuucga

SEQ ID NO: 1389731 - RNA, 22 nt, Human
augcuuauuccaugacugcuug

SEQ ID NO: 1389732 - RNA, 23 nt, Human
augcuuauuccaugacugcuugc

SEQ ID NO: 1389733 - RNA, 17 nt, Human
augcuuauuccaugacu

SEQ ID NO: 1389734 - RNA, 15 nt, Human
augcuuauuccauga

SEQ ID NO: 1389735 - RNA, 21 nt, Human
augcuuagucccucaugcaaa

SEQ ID NO: 1389736 - RNA, 15 nt, Human
augcuuagucccuca

SEQ ID NO: 1389737 - RNA, 13 nt, Human
augcuuauuccau

SEQ ID NO: 1389738 - RNA, 23 nt, Human
augcuuagucccucaugcaaauc

SEQ ID NO: 1389739 - RNA, 16 nt, Human
uuuauuuuaauaaugu

SEQ ID NO: 1389740 - RNA, 14 nt, Human
uuuauuuugacaua

SEQ ID NO: 1389741 - RNA, 16 nt, Human
uuuauuuuguguuuag

SEQ ID NO: 1389742 - RNA, 22 nt, Human
uuucaccauuugauuauguagc

SEQ ID NO: 1389743 - RNA, 17 nt, Human
uuucaccagauuugcua

SEQ ID NO: 1389744 - RNA, 14 nt, Human
uuucacauuuuccu

SEQ ID NO: 1389745 - RNA, 13 nt, Human
uuucacauuuucc

SEQ ID NO: 1389746 - RNA, 17 nt, Human
uuuauuuuuuucugaau

SEQ ID NO: 1389747 - RNA, 24 nt, Human
uuucacuguagaaugauuucaugc

SEQ ID NO: 1389748 - RNA, 16 nt, Human
uuucacuggagcacaa

SEQ ID NO: 1389749 - RNA, 15 nt, Human
uuucacuggagcaca

SEQ ID NO: 1389750 - RNA, 16 nt, Human
uuucaccuagauuuuu

SEQ ID NO: 1389751 - RNA, 21 nt, Human
uuucacugucuuuaauucugu

SEQ ID NO: 1389752 - RNA, 12 nt, Human
uuucauaaagca

SEQ ID NO: 1389753 - RNA, 15 nt, Human
uuucauauaguuagc

SEQ ID NO: 1389754 - RNA, 13 nt, Human
uuucauauaaagu

SEQ ID NO: 1389755 - RNA, 14 nt, Human
uuucauagcuaaaa

SEQ ID NO: 1389756 - RNA, 15 nt, Human
uuucauagcuaaaaa

SEQ ID NO: 1389757 - RNA, 14 nt, Human
uuucauaguucaga

SEQ ID NO: 1389758 - RNA, 17 nt, Human
uuucauaggucugaaau

SEQ ID NO: 1389759 - RNA, 16 nt, Human
uuucauaggucugaaa

SEQ ID NO: 1389760 - RNA, 15 nt, Human
uuucauaguucagaa

SEQ ID NO: 1389761 - RNA, 18 nt, Human
uuucauauaaauggaauu

SEQ ID NO: 1389762 - RNA, 20 nt, Human
uuucauacauuuucuaagaa

SEQ ID NO: 1389763 - RNA, 16 nt, Human
uuucauacauuuucua

SEQ ID NO: 1389764 - RNA, 14 nt, Human
uuucauacacuuau

SEQ ID NO: 1389765 - RNA, 19 nt, Human
uuucauaaguauuucaaau

SEQ ID NO: 1389766 - RNA, 18 nt, Human
uuucauaaguauuucaaa

SEQ ID NO: 1389767 - RNA, 17 nt, Human
uuucauaaguauuucaa

SEQ ID NO: 1389768 - RNA, 14 nt, Human
uuucauaaguauuu

SEQ ID NO: 1389769 - RNA, 14 nt, Human
uuucauaaauuuga

SEQ ID NO: 1389770 - RNA, 15 nt, Human
uuucauaaaaggaga

SEQ ID NO: 1389771 - RNA, 21 nt, Human
uuucaguuuauuugaaccaau

SEQ ID NO: 1389772 - RNA, 12 nt, Human
uuucccacucca

SEQ ID NO: 1389773 - RNA, 22 nt, Human
uuucccaccccaaccugcucuc

SEQ ID NO: 1389774 - RNA, 23 nt, Human
uuucccaccccaaccugcucucc

SEQ ID NO: 1389775 - RNA, 21 nt, Human
uuucccaccccaaccugcucu

SEQ ID NO: 1389776 - RNA, 18 nt, Human
uuucccaggacccugaag

SEQ ID NO: 1389777 - RNA, 16 nt, Human
uuucccaggacccuga

SEQ ID NO: 1389778 - RNA, 14 nt, Human
uuucccaggacccu

SEQ ID NO: 1389779 - RNA, 11 nt, Human
uuucccaggac

SEQ ID NO: 1389780 - RNA, 21 nt, Human
uuucccacuguuuaaggaguu

SEQ ID NO: 1389781 - RNA, 16 nt, Human
uuucccacuccaagcc

SEQ ID NO: 1389782 - RNA, 22 nt, Human
uuucccaggcccacugugccuc

SEQ ID NO: 1389783 - RNA, 23 nt, Human
auggaauuggagcucgugggaca

SEQ ID NO: 1389784 - RNA, 20 nt, Human
uuuagcauuguagugcuuug

SEQ ID NO: 1389785 - RNA, 14 nt, Human
uuuagcauguuguu

SEQ ID NO: 1389786 - RNA, 15 nt, Human
uuuagaucucugaag

SEQ ID NO: 1389787 - RNA, 22 nt, Human
uuuagauagcccuguccuggug

SEQ ID NO: 1389788 - RNA, 23 nt, Human
uuuagauagcccuguccuggugg

SEQ ID NO: 1389789 - RNA, 20 nt, Human
uuuagauagcccuguccugg

SEQ ID NO: 1389790 - RNA, 18 nt, Human
uuuagauagcccuguccu

SEQ ID NO: 1389791 - RNA, 14 nt, Human
uuuagauagcccug

SEQ ID NO: 1389792 - RNA, 13 nt, Human
uuuagauagcccu

SEQ ID NO: 1389793 - RNA, 15 nt, Human
uuuagauaauacacc

SEQ ID NO: 1389794 - RNA, 18 nt, Human
uuuacuagggaucccuca

SEQ ID NO: 1389795 - RNA, 23 nt, Human
uuuacuagggaucccucaucugu

SEQ ID NO: 1389796 - RNA, 13 nt, Human
uuuagauaauaca

SEQ ID NO: 1389797 - RNA, 13 nt, Human
uuuaguaaaccaa

SEQ ID NO: 1389798 - RNA, 23 nt, Human
uuuagguucuuugcugcauucug

SEQ ID NO: 1389799 - RNA, 22 nt, Human
uuuagguuuuuguuuguuuccu

SEQ ID NO: 1389800 - RNA, 23 nt, Human
uuuagguucuaaaguucuaagau

SEQ ID NO: 1389801 - RNA, 18 nt, Human
uuuagguucuaaaguucu

SEQ ID NO: 1389802 - RNA, 16 nt, Human
uuuagguucuaaaguu

SEQ ID NO: 1389803 - RNA, 15 nt, Human
uuuagguucuaaagu

SEQ ID NO: 1389804 - RNA, 14 nt, Human
uuuagguucuaaag

SEQ ID NO: 1389805 - RNA, 13 nt, Human
uuuagguucuaaa

SEQ ID NO: 1389806 - RNA, 12 nt, Human
uuuagguucuaa

SEQ ID NO: 1389807 - RNA, 11 nt, Human
uuuagguucua

SEQ ID NO: 1389808 - RNA, 22 nt, Human
uuuaguaaaccaauccuaugca

SEQ ID NO: 1389809 - RNA, 11 nt, Human
uuuagcucuga

SEQ ID NO: 1389810 - RNA, 16 nt, Human
uuuagccuucucuguu

SEQ ID NO: 1389811 - RNA, 14 nt, Human
uuuagccuguccug

SEQ ID NO: 1389812 - RNA, 12 nt, Human
uuuagcauugua

SEQ ID NO: 1389813 - RNA, 15 nt, Human
uuuagguaagaaguu

SEQ ID NO: 1389814 - RNA, 14 nt, Human
uuuagcucugagaa

SEQ ID NO: 1389815 - RNA, 13 nt, Human
uuuagcucugaga

SEQ ID NO: 1389816 - RNA, 12 nt, Human
uuuagcucugag

SEQ ID NO: 1389817 - RNA, 20 nt, Human
uuuagcuggaaaaguauguu

SEQ ID NO: 1389818 - RNA, 16 nt, Human
uuuauuaaagaaaaaa

SEQ ID NO: 1389819 - RNA, 19 nt, Human
uuuauguauugugcaaugu

SEQ ID NO: 1389820 - RNA, 11 nt, Human
uuuauguauug

SEQ ID NO: 1389821 - RNA, 14 nt, Human
uuuaugugaaacau

SEQ ID NO: 1389822 - RNA, 14 nt, Human
uuuauuaaagaaaa

SEQ ID NO: 1389823 - RNA, 13 nt, Human
uuuauuaaagaaa

SEQ ID NO: 1389824 - RNA, 12 nt, Human
uuuauuaaagaa

SEQ ID NO: 1389825 - RNA, 11 nt, Human
uuuauuaaaga

SEQ ID NO: 1389826 - RNA, 19 nt, Human
uuuaugucuguggauuuuu

SEQ ID NO: 1389827 - RNA, 11 nt, Human
uuuaugucugg

SEQ ID NO: 1389828 - RNA, 15 nt, Human
uuuaugugaaacaug

SEQ ID NO: 1389829 - RNA, 17 nt, Human
uuuauauauuauaugga

SEQ ID NO: 1389830 - RNA, 15 nt, Human
uuuauaucacauguu

SEQ ID NO: 1389831 - RNA, 21 nt, Human
uuuauauauuuaaaaguguca

SEQ ID NO: 1389832 - RNA, 18 nt, Human
uuuauauauuauauggaa

SEQ ID NO: 1389833 - RNA, 15 nt, Human
uuuauauauuauaug

SEQ ID NO: 1389834 - RNA, 14 nt, Human
uuuauauauuauau

SEQ ID NO: 1389835 - RNA, 13 nt, Human
uuuauauauguau

SEQ ID NO: 1389836 - RNA, 19 nt, Human
uuuauauauauauauaaag

SEQ ID NO: 1389837 - RNA, 20 nt, Human
uuuauauauauauauaaaga

SEQ ID NO: 1389838 - RNA, 13 nt, Human
uuuauauauauau

SEQ ID NO: 1389839 - RNA, 19 nt, Human
uuuauguaguaauugacau

SEQ ID NO: 1389840 - RNA, 14 nt, Human
uuuauguaauuuca

SEQ ID NO: 1389841 - RNA, 20 nt, Human
uuuauaugcuuacugauaua

SEQ ID NO: 1389842 - RNA, 19 nt, Human
uuuauaugcuucuguuuua

SEQ ID NO: 1389843 - RNA, 21 nt, Human
uuuauaugaagaaaaucacuu

SEQ ID NO: 1389844 - RNA, 14 nt, Human
uuuauaugaagaaa

SEQ ID NO: 1389845 - RNA, 17 nt, Human
uuuauaugcuucuguuu

SEQ ID NO: 1389846 - RNA, 13 nt, Human
uuuaccuuguaua

SEQ ID NO: 1389847 - RNA, 14 nt, Human
uuuaccuuuuuuau

SEQ ID NO: 1389848 - RNA, 19 nt, Human
uuuaccuuuuuuauacaua

SEQ ID NO: 1389849 - RNA, 20 nt, Human
uuuaccuuuuuuauacauaa

SEQ ID NO: 1389850 - RNA, 17 nt, Human
augcuacacacugcaug

SEQ ID NO: 1389851 - RNA, 18 nt, Human
augcuacaggauuugaaa

SEQ ID NO: 1389852 - RNA, 18 nt, Human
augcuacacacugcaugu

SEQ ID NO: 1389853 - RNA, 18 nt, Human
uuuacgcuuugauucaua

SEQ ID NO: 1389854 - RNA, 13 nt, Human
uuuacgcuuugau

SEQ ID NO: 1389855 - RNA, 21 nt, Human
uuuaccuuuuuuauacauaaa

SEQ ID NO: 1389856 - RNA, 14 nt, Human
uuuacuaauagaca

SEQ ID NO: 1389857 - RNA, 17 nt, Human
uuuacuaauagacaauu

SEQ ID NO: 1389858 - RNA, 18 nt, Human
uuuacuaauagacaauuu

SEQ ID NO: 1389859 - RNA, 22 nt, Human
augccguggauugcacguggcc

SEQ ID NO: 1389860 - RNA, 16 nt, Human
augccucagaagugca

SEQ ID NO: 1389861 - RNA, 15 nt, Human
augccucagaagugc

SEQ ID NO: 1389862 - RNA, 21 nt, Human
augccuaugguggauccaaac

SEQ ID NO: 1389863 - RNA, 19 nt, Human
augccuaugguggauccaa

SEQ ID NO: 1389864 - RNA, 16 nt, Human
augccuaugguggauc

SEQ ID NO: 1389865 - RNA, 23 nt, Human
augccucagaagugcaucuggag

SEQ ID NO: 1389866 - RNA, 23 nt, Human
augccucagccacuugccugugc

SEQ ID NO: 1389867 - RNA, 23 nt, Human
augcgcucagggccaugcugagg

SEQ ID NO: 1389868 - RNA, 15 nt, Human
augcgcucagggcca

SEQ ID NO: 1389869 - RNA, 22 nt, Human
augcgcccccuccgcccugcca

SEQ ID NO: 1389870 - RNA, 18 nt, Human
augcgcccccuccgcccu

SEQ ID NO: 1389871 - RNA, 13 nt, Human
augcgcccccucc

SEQ ID NO: 1389872 - RNA, 16 nt, Human
augcggcccaggaugg

SEQ ID NO: 1389873 - RNA, 20 nt, Human
augcggcccaggauggcuuu

SEQ ID NO: 1389874 - RNA, 17 nt, Human
uuuaaagcguuugcaca

SEQ ID NO: 1389875 - RNA, 19 nt, Human
uuuaaagcagguucuuguu

SEQ ID NO: 1389876 - RNA, 15 nt, Human
uuuaaagcagguucu

SEQ ID NO: 1389877 - RNA, 12 nt, Human
uuuaaagaaagu

SEQ ID NO: 1389878 - RNA, 21 nt, Human
uuuaaagaaaaaaauugaaau

SEQ ID NO: 1389879 - RNA, 22 nt, Human
uuuaaagaaaaaaauugaaaug

SEQ ID NO: 1389880 - RNA, 19 nt, Human
uuuaaagaaaaaaauugaa

SEQ ID NO: 1389881 - RNA, 16 nt, Human
uuuaaagcagguucuu

SEQ ID NO: 1389882 - RNA, 16 nt, Human
uuuaaagcuuccauug

SEQ ID NO: 1389883 - RNA, 21 nt, Human
augagcauguuuagacuuuaa

SEQ ID NO: 1389884 - RNA, 14 nt, Human
augagcauguuuag

SEQ ID NO: 1389885 - RNA, 13 nt, Human
augagauugaauu

SEQ ID NO: 1389886 - RNA, 19 nt, Human
augagaugcuggcuugggc

SEQ ID NO: 1389887 - RNA, 22 nt, Human
augagaugcuggcuugggcagc

SEQ ID NO: 1389888 - RNA, 15 nt, Human
augagaugcuggcuu

SEQ ID NO: 1389889 - RNA, 14 nt, Human
augagaugcuggcu

SEQ ID NO: 1389890 - RNA, 24 nt, Human
augagaugauacauccaaagcaga

SEQ ID NO: 1389891 - RNA, 23 nt, Human
augagaugauacauccaaagcag

SEQ ID NO: 1389892 - RNA, 18 nt, Human
augagaguuuuggaugca

SEQ ID NO: 1389893 - RNA, 20 nt, Human
augagaguuuuggaugcagu

SEQ ID NO: 1389894 - RNA, 21 nt, Human
augagaguuuuggaugcagug

SEQ ID NO: 1389895 - RNA, 13 nt, Human
augagaggaggca

SEQ ID NO: 1389896 - RNA, 15 nt, Human
augagaguuuuggau

SEQ ID NO: 1389897 - RNA, 17 nt, Human
augagaguuuuggaugc

SEQ ID NO: 1389898 - RNA, 22 nt, Human
augacaugaauuuuagcuuuug

SEQ ID NO: 1389899 - RNA, 12 nt, Human
augacaugaauu

SEQ ID NO: 1389900 - RNA, 20 nt, Human
augacaucacuuguacaaaa

SEQ ID NO: 1389901 - RNA, 19 nt, Human
augacaucacuuguacaaa

SEQ ID NO: 1389902 - RNA, 18 nt, Human
augacaucacuuguacaa

SEQ ID NO: 1389903 - RNA, 14 nt, Human
augacaucacuugu

SEQ ID NO: 1389904 - RNA, 17 nt, Human
augacaguguuccccga

SEQ ID NO: 1389905 - RNA, 22 nt, Human
augacaguccgucaaaacagau

SEQ ID NO: 1389906 - RNA, 21 nt, Human
augacaguccgucaaaacaga

SEQ ID NO: 1389907 - RNA, 20 nt, Human
augacaguccgucaaaacag

SEQ ID NO: 1389908 - RNA, 22 nt, Human
augacauuaaagaaggguugag

SEQ ID NO: 1389909 - RNA, 21 nt, Human
augacaugaauuuuagcuuuu

SEQ ID NO: 1389910 - RNA, 15 nt, Human
augacaugaauuuua

SEQ ID NO: 1389911 - RNA, 14 nt, Human
uugucgcucaugug

SEQ ID NO: 1389912 - RNA, 14 nt, Human
uuguccuuuucaua

SEQ ID NO: 1389913 - RNA, 19 nt, Human
uuguccuuuugcaaagaaa

SEQ ID NO: 1389914 - RNA, 17 nt, Human
uuguccuuucccuucag

SEQ ID NO: 1389915 - RNA, 15 nt, Human
uuguccuuucccuuc

SEQ ID NO: 1389916 - RNA, 16 nt, Human
uuguccuuagccugga

SEQ ID NO: 1389917 - RNA, 16 nt, Human
uuguccgcuggguggu

SEQ ID NO: 1389918 - RNA, 15 nt, Human
uuguccuagcacaga

SEQ ID NO: 1389919 - RNA, 23 nt, Human
uuguccuagcacagauggccagc

SEQ ID NO: 1389920 - RNA, 22 nt, Human
uuguccucagccccgcguggaa

SEQ ID NO: 1389921 - RNA, 18 nt, Human
uugucccgauuguaacuc

SEQ ID NO: 1389922 - RNA, 14 nt, Human
uugucauguguaua

SEQ ID NO: 1389923 - RNA, 22 nt, Human
uugucauguguauaaaaauaaa

SEQ ID NO: 1389924 - RNA, 14 nt, Human
uugucauuagccug

SEQ ID NO: 1389925 - RNA, 15 nt, Human
uugucauuagccuga

SEQ ID NO: 1389926 - RNA, 17 nt, Human
uugucauuagccugagu

SEQ ID NO: 1389927 - RNA, 18 nt, Human
uugucauuagccugagua

SEQ ID NO: 1389928 - RNA, 19 nt, Human
uugucauuagccugaguag

SEQ ID NO: 1389929 - RNA, 20 nt, Human
uugucauuagccugaguaga

SEQ ID NO: 1389930 - RNA, 13 nt, Human
uugucauguguau

SEQ ID NO: 1389931 - RNA, 17 nt, Human
uugucaccagaucugau

SEQ ID NO: 1389932 - RNA, 16 nt, Human
uugucaccagaucuga

SEQ ID NO: 1389933 - RNA, 14 nt, Human
uugucaccagaucu

SEQ ID NO: 1389934 - RNA, 20 nt, Human
uugucacgccagacuuccca

SEQ ID NO: 1389935 - RNA, 13 nt, Human
uugucacgccaga

SEQ ID NO: 1389936 - RNA, 21 nt, Human
augaguggaaauuaagacuuu

SEQ ID NO: 1389937 - RNA, 19 nt, Human
augagugcguggugcgagu

SEQ ID NO: 1389938 - RNA, 17 nt, Human
augaguggcuuuaauga

SEQ ID NO: 1389939 - RNA, 22 nt, Human
augagugcguggugcgagugcg

SEQ ID NO: 1389940 - RNA, 17 nt, Human
augagugaauaaauguc

SEQ ID NO: 1389941 - RNA, 16 nt, Human
augagugaauaaaugu

SEQ ID NO: 1389942 - RNA, 15 nt, Human
augagugaauaaaug

SEQ ID NO: 1389943 - RNA, 17 nt, Human
augagucuagauguuua

SEQ ID NO: 1389944 - RNA, 13 nt, Human
augagucuagaug

SEQ ID NO: 1389945 - RNA, 12 nt, Human
augagucuagau

SEQ ID NO: 1389946 - RNA, 20 nt, Human
augauaaagagacagugaua

SEQ ID NO: 1389947 - RNA, 17 nt, Human
augauaaagagacagug

SEQ ID NO: 1389948 - RNA, 14 nt, Human
augauaaagagaca

SEQ ID NO: 1389949 - RNA, 14 nt, Human
augauaacuggaaa

SEQ ID NO: 1389950 - RNA, 19 nt, Human
uuguuuuucauucagucuu

SEQ ID NO: 1389951 - RNA, 19 nt, Human
uuguuuuuaaacuguacag

SEQ ID NO: 1389952 - RNA, 18 nt, Human
uuguuuuuaaacuguaca

SEQ ID NO: 1389953 - RNA, 16 nt, Human
uuguuuuuaaacugua

SEQ ID NO: 1389954 - RNA, 14 nt, Human
uuguuuuuaaacug

SEQ ID NO: 1389955 - RNA, 19 nt, Human
uuguuuugugucucuuaug

SEQ ID NO: 1389956 - RNA, 16 nt, Human
uuguuuugugcagaga

SEQ ID NO: 1389957 - RNA, 19 nt, Human
augcaccuggaauauauaa

SEQ ID NO: 1389958 - RNA, 20 nt, Human
uuuaaaaaagcuuaaaacuu

SEQ ID NO: 1389959 - RNA, 17 nt, Human
uuuaaaaaagcuuaaaa

SEQ ID NO: 1389960 - RNA, 14 nt, Human
uuuaaaaaagcuua

SEQ ID NO: 1389961 - RNA, 13 nt, Human
uuuaaaaaagcuu

SEQ ID NO: 1389962 - RNA, 21 nt, Human
uuuaaaaaagcuuaaaacuuu

SEQ ID NO: 1389963 - RNA, 23 nt, Human
uuuaaaaaagcuuaaaacuuuga

SEQ ID NO: 1389964 - RNA, 19 nt, Human
uuuaaaaaauagcagcuuu

SEQ ID NO: 1389965 - RNA, 22 nt, Human
uuuaaacuguguacauaacuga

SEQ ID NO: 1389966 - RNA, 21 nt, Human
uuuaaacuguguacauaacug

SEQ ID NO: 1389967 - RNA, 19 nt, Human
uuuaaacuguguacauaac

SEQ ID NO: 1389968 - RNA, 15 nt, Human
uuuaaacuguguaca

SEQ ID NO: 1389969 - RNA, 16 nt, Human
uuuaaaaaauggucac

SEQ ID NO: 1389970 - RNA, 22 nt, Human
augcaaacucuuuggucguuuu

SEQ ID NO: 1389971 - RNA, 22 nt, Human
augcaaggucauuuuuuuuaag

SEQ ID NO: 1389972 - RNA, 16 nt, Human
augcaccuggaauaua

SEQ ID NO: 1389973 - RNA, 14 nt, Human
augcaccuggaaua

SEQ ID NO: 1389974 - RNA, 16 nt, Human
augcaaacucuuuggu

SEQ ID NO: 1389975 - RNA, 13 nt, Human
augcaaacucuuu

SEQ ID NO: 1389976 - RNA, 12 nt, Human
augcaaacucuu

SEQ ID NO: 1389977 - RNA, 14 nt, Human
augcaaaccauagc

SEQ ID NO: 1389978 - RNA, 15 nt, Human
augaucugucugugg

SEQ ID NO: 1389979 - RNA, 22 nt, Human
augcaaacuuuauuuuguguuu

SEQ ID NO: 1389980 - RNA, 14 nt, Human
augcaaggucauuu

SEQ ID NO: 1389981 - RNA, 16 nt, Human
augcaaggucauuuuu

SEQ ID NO: 1389982 - RNA, 16 nt, Human
uuguugcguuccuuuc

SEQ ID NO: 1389983 - RNA, 23 nt, Human
uuguuggagucaaaaagaaccac

SEQ ID NO: 1389984 - RNA, 13 nt, Human
uuguuggaaugaa

SEQ ID NO: 1389985 - RNA, 17 nt, Human
augaucggcaggacacc

SEQ ID NO: 1389986 - RNA, 20 nt, Human
augauccuguauucagacag

SEQ ID NO: 1389987 - RNA, 20 nt, Human
augaucccuguguugucucu

SEQ ID NO: 1389988 - RNA, 18 nt, Human
augaucccuguguugucu

SEQ ID NO: 1389989 - RNA, 20 nt, Human
augaucaauuauaguuucug

SEQ ID NO: 1389990 - RNA, 18 nt, Human
augaucaccgacugaaaa

SEQ ID NO: 1389991 - RNA, 23 nt, Human
uuguucucagaaucccuuaacag

SEQ ID NO: 1389992 - RNA, 16 nt, Human
uuguucucagaauccc

SEQ ID NO: 1389993 - RNA, 17 nt, Human
uuguuccccacuggagc

SEQ ID NO: 1389994 - RNA, 13 nt, Human
uugugugucuuaa

SEQ ID NO: 1389995 - RNA, 14 nt, Human
uuguguguauuugc

SEQ ID NO: 1389996 - RNA, 16 nt, Human
uuguguguauuugcua

SEQ ID NO: 1389997 - RNA, 22 nt, Human
uuguguguaugcacaugaacuu

SEQ ID NO: 1389998 - RNA, 18 nt, Human
uuguuccccacuggagca

SEQ ID NO: 1389999 - RNA, 19 nt, Human
uugugugucuuaauuauua

SEQ ID NO: 1390000 - RNA, 13 nt, Human
uugugaaggcagg

SEQ ID NO: 1390001 - RNA, 22 nt, Human
uugugaagccaugaguuccaga

SEQ ID NO: 1390002 - RNA, 11 nt, Human
uugugaagagg

SEQ ID NO: 1390003 - RNA, 18 nt, Human
uugugaagcaaaauuuuu

SEQ ID NO: 1390004 - RNA, 14 nt, Human
uuguguguaugcac

SEQ ID NO: 1390005 - RNA, 13 nt, Human
uuguguguaugca

SEQ ID NO: 1390006 - RNA, 17 nt, Human
uugugaagguggaaaua

SEQ ID NO: 1390007 - RNA, 18 nt, Human
uugugaagguggaaauaa

SEQ ID NO: 1390008 - RNA, 21 nt, Human
uugguuuugcuacauaauuau

SEQ ID NO: 1390009 - RNA, 18 nt, Human
uugguucccccacugauc

SEQ ID NO: 1390010 - RNA, 20 nt, Human
uugguucauuaauucuauaa

SEQ ID NO: 1390011 - RNA, 14 nt, Human
uugguucauuaauu

SEQ ID NO: 1390012 - RNA, 17 nt, Human
uuggggucuggcagccu

SEQ ID NO: 1390013 - RNA, 15 nt, Human
uuggggucugacccc

SEQ ID NO: 1390014 - RNA, 14 nt, Human
uuggggucugaccc

SEQ ID NO: 1390015 - RNA, 14 nt, Human
uuggggaagaccca

SEQ ID NO: 1390016 - RNA, 23 nt, Human
uuggggaaacagcaucuccaagc

SEQ ID NO: 1390017 - RNA, 19 nt, Human
uuggggaaacagcaucucc

SEQ ID NO: 1390018 - RNA, 23 nt, Human
uugggcuugcuauucugucccua

SEQ ID NO: 1390019 - RNA, 18 nt, Human
uugggcuugcuauucugu

SEQ ID NO: 1390020 - RNA, 17 nt, Human
uugggcuugcuauucug

SEQ ID NO: 1390021 - RNA, 19 nt, Human
uugggcuucagcugccagu

SEQ ID NO: 1390022 - RNA, 22 nt, Human
uugguuuuuacugcucugagaa

SEQ ID NO: 1390023 - RNA, 18 nt, Human
uugguuuuuaaaacccag

SEQ ID NO: 1390024 - RNA, 21 nt, Human
uuguaacuaaaauaauuuugu

SEQ ID NO: 1390025 - RNA, 18 nt, Human
uuguaacuaaaauaauuu

SEQ ID NO: 1390026 - RNA, 17 nt, Human
uuguaacuaaaauaauu

SEQ ID NO: 1390027 - RNA, 23 nt, Human
uuguaacuaaaauaauuuuguaa

SEQ ID NO: 1390028 - RNA, 22 nt, Human
uuguaacuaaaauaauuuugua

SEQ ID NO: 1390029 - RNA, 21 nt, Human
augaacauauuguugaaaggu

SEQ ID NO: 1390030 - RNA, 21 nt, Human
augaacagaacauagacagaa

SEQ ID NO: 1390031 - RNA, 22 nt, Human
uugggcacccccagccugggcc

SEQ ID NO: 1390032 - RNA, 21 nt, Human
uugggcacccccagccugggc

SEQ ID NO: 1390033 - RNA, 20 nt, Human
uugggcacccccagccuggg

SEQ ID NO: 1390034 - RNA, 19 nt, Human
uugggcacccccagccugg

SEQ ID NO: 1390035 - RNA, 18 nt, Human
uugggcacccccagccug

SEQ ID NO: 1390036 - RNA, 14 nt, Human
augaacaucccuuu

SEQ ID NO: 1390037 - RNA, 22 nt, Human
augaauuacauuuguauaaaau

SEQ ID NO: 1390038 - RNA, 19 nt, Human
augaauuacauuuguauaa

SEQ ID NO: 1390039 - RNA, 18 nt, Human
augaauuacauuuguaua

SEQ ID NO: 1390040 - RNA, 18 nt, Human
uugggcuucagcugccag

SEQ ID NO: 1390041 - RNA, 13 nt, Human
uugggcucugaug

SEQ ID NO: 1390042 - RNA, 14 nt, Human
uugggcucugauga

SEQ ID NO: 1390043 - RNA, 12 nt, Human
uugggcucugau

SEQ ID NO: 1390044 - RNA, 21 nt, Human
uugggccagaaguaccagacu

SEQ ID NO: 1390045 - RNA, 12 nt, Human
uugggcagagcu

SEQ ID NO: 1390046 - RNA, 23 nt, Human
uugggcacccccagccugggccu

SEQ ID NO: 1390047 - RNA, 21 nt, Human
uugggcagagcuggcucugag

SEQ ID NO: 1390048 - RNA, 17 nt, Human
uugggcagagcuggcuc

SEQ ID NO: 1390049 - RNA, 22 nt, Human
uugggcagagcuggcucugagc

SEQ ID NO: 1390050 - RNA, 18 nt, Human
uugggcagcaauuuaaau

SEQ ID NO: 1390051 - RNA, 14 nt, Human
uugggccagacaug

SEQ ID NO: 1390052 - RNA, 13 nt, Human
uugggccagacau

SEQ ID NO: 1390053 - RNA, 14 nt, Human
uugggccagaagua

SEQ ID NO: 1390054 - RNA, 19 nt, Human
uugggcagcaauuuaaaug

SEQ ID NO: 1390055 - RNA, 16 nt, Human
augacacuguucagga

SEQ ID NO: 1390056 - RNA, 15 nt, Human
augacaggccugucc

SEQ ID NO: 1390057 - RNA, 17 nt, Human
augacaggauguuugcu

SEQ ID NO: 1390058 - RNA, 19 nt, Human
augacaguccgucaaaaca

SEQ ID NO: 1390059 - RNA, 23 nt, Human
augacacucauauaauuauaugu

SEQ ID NO: 1390060 - RNA, 15 nt, Human
augacaaucaugugu

SEQ ID NO: 1390061 - RNA, 20 nt, Human
augacaacuucuaauugcca

SEQ ID NO: 1390062 - RNA, 19 nt, Human
augacaacuucuaauugcc

SEQ ID NO: 1390063 - RNA, 18 nt, Human
augacaacuucuaauugc

SEQ ID NO: 1390064 - RNA, 16 nt, Human
augacaacuucuaauu

SEQ ID NO: 1390065 - RNA, 14 nt, Human
augacaacuucuaa

SEQ ID NO: 1390066 - RNA, 20 nt, Human
augacaaagcagauucagaa

SEQ ID NO: 1390067 - RNA, 17 nt, Human
augaauuauuacagugu

SEQ ID NO: 1390068 - RNA, 15 nt, Human
augaauuauuacagu

SEQ ID NO: 1390069 - RNA, 13 nt, Human
augaauugcauuu

SEQ ID NO: 1390070 - RNA, 23 nt, Human
augaauuaguuuuauaugcuucu

SEQ ID NO: 1390071 - RNA, 21 nt, Human
augaauuaguuuuauaugcuu

SEQ ID NO: 1390072 - RNA, 14 nt, Human
uuguauauucacuu

SEQ ID NO: 1390073 - RNA, 21 nt, Human
uuguauauauuauuauaaucu

SEQ ID NO: 1390074 - RNA, 19 nt, Human
uuguauauauuauuauaau

SEQ ID NO: 1390075 - RNA, 13 nt, Human
uuguauauuacaa

SEQ ID NO: 1390076 - RNA, 14 nt, Human
uuguauauuacaau

SEQ ID NO: 1390077 - RNA, 15 nt, Human
uuguauauuacaaug

SEQ ID NO: 1390078 - RNA, 16 nt, Human
uuguauauuacaauga

SEQ ID NO: 1390079 - RNA, 13 nt, Human
uuguauauucacu

SEQ ID NO: 1390080 - RNA, 13 nt, Human
uuguaaugaaaac

SEQ ID NO: 1390081 - RNA, 19 nt, Human
uuguaguuccacuuauagc

SEQ ID NO: 1390082 - RNA, 14 nt, Human
uuguaauuauggag

SEQ ID NO: 1390083 - RNA, 17 nt, Human
uuguaauuaaaagcaaa

SEQ ID NO: 1390084 - RNA, 11 nt, Human
uuguaauuaug

SEQ ID NO: 1390085 - RNA, 23 nt, Human
uuguaauuaaaagcaaaucauuu

SEQ ID NO: 1390086 - RNA, 15 nt, Human
uuguaauuauggagu

SEQ ID NO: 1390087 - RNA, 19 nt, Human
uuguaaugucuugagcucu

SEQ ID NO: 1390088 - RNA, 20 nt, Human
uuguaaugucuugagcucua

SEQ ID NO: 1390089 - RNA, 15 nt, Human
uuguaaugucuugag

SEQ ID NO: 1390090 - RNA, 21 nt, Human
uuguauaauuggauuuccuaa

SEQ ID NO: 1390091 - RNA, 20 nt, Human
uuguauaauuggauuuccua

SEQ ID NO: 1390092 - RNA, 12 nt, Human
uuguauaauugg

SEQ ID NO: 1390093 - RNA, 11 nt, Human
uuguauaauug

SEQ ID NO: 1390094 - RNA, 14 nt, Human
uuguauaaaauaga

SEQ ID NO: 1390095 - RNA, 12 nt, Human
uuguauaaaaua

SEQ ID NO: 1390096 - RNA, 15 nt, Human
uuguauaaaauaauu

SEQ ID NO: 1390097 - RNA, 16 nt, Human
uuguaguugaauauug

SEQ ID NO: 1390098 - RNA, 13 nt, Human
uuguaguugaaua

SEQ ID NO: 1390099 - RNA, 13 nt, Human
uuguaguuccacu

SEQ ID NO: 1390100 - RNA, 13 nt, Human
uuguauaaaauaa

SEQ ID NO: 1390101 - RNA, 17 nt, Human
uuggcgaugccagccaa

SEQ ID NO: 1390102 - RNA, 21 nt, Human
uuggcuagagguucaaagaua

SEQ ID NO: 1390103 - RNA, 22 nt, Human
uuggcuagagguucaaagauau

SEQ ID NO: 1390104 - RNA, 19 nt, Human
uuggccuguagaguugcug

SEQ ID NO: 1390105 - RNA, 16 nt, Human
uuggccuggagcacaa

SEQ ID NO: 1390106 - RNA, 14 nt, Human
uuggccuggagcac

SEQ ID NO: 1390107 - RNA, 21 nt, Human
uuggccugcuaaggucuugga

SEQ ID NO: 1390108 - RNA, 19 nt, Human
uuggccugaucagaccacg

SEQ ID NO: 1390109 - RNA, 12 nt, Human
uuggacuaugga

SEQ ID NO: 1390110 - RNA, 17 nt, Human
uuggaccuaauccaagc

SEQ ID NO: 1390111 - RNA, 23 nt, Human
uuggaccuaaauggccucaugug

SEQ ID NO: 1390112 - RNA, 21 nt, Human
uuggaccuaaauggccucaug

SEQ ID NO: 1390113 - RNA, 19 nt, Human
uuggaccuaaauggccuca

SEQ ID NO: 1390114 - RNA, 16 nt, Human
uuggacccuuccaugg

SEQ ID NO: 1390115 - RNA, 14 nt, Human
uuggacccuuccau

SEQ ID NO: 1390116 - RNA, 13 nt, Human
uuggacccuucca

SEQ ID NO: 1390117 - RNA, 22 nt, Human
aucuuuuacaacugccucgaaa

SEQ ID NO: 1390118 - RNA, 14 nt, Human
aucuuuuauuuugc

SEQ ID NO: 1390119 - RNA, 21 nt, Human
augaaauauuauguuaaaacu

SEQ ID NO: 1390120 - RNA, 22 nt, Human
uugcuuuucaugcaaacucuuu

SEQ ID NO: 1390121 - RNA, 18 nt, Human
uugcuuuucaugcaaacu

SEQ ID NO: 1390122 - RNA, 17 nt, Human
uugcuuuucaugcaaac

SEQ ID NO: 1390123 - RNA, 16 nt, Human
uugcuuuucaugcaaa

SEQ ID NO: 1390124 - RNA, 13 nt, Human
uugcuuuucaugc

SEQ ID NO: 1390125 - RNA, 12 nt, Human
uugcuuuucaug

SEQ ID NO: 1390126 - RNA, 15 nt, Human
uugcuuuucacaaau

SEQ ID NO: 1390127 - RNA, 23 nt, Human
uugcuuuaauauaaaugcaaaua

SEQ ID NO: 1390128 - RNA, 22 nt, Human
uugcuuuaauauaaaugcaaau

SEQ ID NO: 1390129 - RNA, 21 nt, Human
uugcuuuaauauaaaugcaaa

SEQ ID NO: 1390130 - RNA, 19 nt, Human
uugcuuuaauauaaaugca

SEQ ID NO: 1390131 - RNA, 18 nt, Human
uugcuuuaauauaaaugc

SEQ ID NO: 1390132 - RNA, 21 nt, Human
uugcuuuuugugauaugcaca

SEQ ID NO: 1390133 - RNA, 15 nt, Human
uugcuuuuugugaua

SEQ ID NO: 1390134 - RNA, 15 nt, Human
uugcuuuuucaccag

SEQ ID NO: 1390135 - RNA, 20 nt, Human
uugcuuuuggcaaaacucua

SEQ ID NO: 1390136 - RNA, 17 nt, Human
uugcuuuuuuuuccuuc

SEQ ID NO: 1390137 - RNA, 17 nt, Human
uugcuuuaauauaaaug

SEQ ID NO: 1390138 - RNA, 16 nt, Human
uugcuuuaauauaaau

SEQ ID NO: 1390139 - RNA, 14 nt, Human
uugcuuuaauauaa

SEQ ID NO: 1390140 - RNA, 18 nt, Human
uugcugaauaggcgauca

SEQ ID NO: 1390141 - RNA, 21 nt, Human
uugcugacuguagcuuuggaa

SEQ ID NO: 1390142 - RNA, 11 nt, Human
uugcugagacu

SEQ ID NO: 1390143 - RNA, 11 nt, Human
uugcugagccu

SEQ ID NO: 1390144 - RNA, 21 nt, Human
uugcuagagcuccucccucuc

SEQ ID NO: 1390145 - RNA, 18 nt, Human
uugcuagagcuccucccu

SEQ ID NO: 1390146 - RNA, 16 nt, Human
uugcuagagcuccucc

SEQ ID NO: 1390147 - RNA, 15 nt, Human
uugcuagagcuccuc

SEQ ID NO: 1390148 - RNA, 14 nt, Human
uugcuagagcuccu

SEQ ID NO: 1390149 - RNA, 13 nt, Human
uugcuacauaauu

SEQ ID NO: 1390150 - RNA, 23 nt, Human
uugcuaccaguauuuagaagcca

SEQ ID NO: 1390151 - RNA, 22 nt, Human
uugcuaccaguauuuagaagcc

SEQ ID NO: 1390152 - RNA, 20 nt, Human
uugcuaccaguauuuagaag

SEQ ID NO: 1390153 - RNA, 16 nt, Human
uugcuaccaguauuua

SEQ ID NO: 1390154 - RNA, 15 nt, Human
uugcuaccaguauuu

SEQ ID NO: 1390155 - RNA, 12 nt, Human
uugcuaccagua

SEQ ID NO: 1390156 - RNA, 16 nt, Human
uugcuacauaauuauc

SEQ ID NO: 1390157 - RNA, 17 nt, Human
uugcuaauuuuuauuaa

SEQ ID NO: 1390158 - RNA, 15 nt, Human
uugcuaauuuuuauu

SEQ ID NO: 1390159 - RNA, 19 nt, Human
aucuaaguuauaagacucu

SEQ ID NO: 1390160 - RNA, 13 nt, Human
aucuaaguuauaa

SEQ ID NO: 1390161 - RNA, 18 nt, Human
aucuaaguuaauuuaaag

SEQ ID NO: 1390162 - RNA, 16 nt, Human
uugcugaaauuuuaua

SEQ ID NO: 1390163 - RNA, 11 nt, Human
uugcugaaauu

SEQ ID NO: 1390164 - RNA, 17 nt, Human
uugcuccgccuggccug

SEQ ID NO: 1390165 - RNA, 16 nt, Human
uugcuccgccuggccu

SEQ ID NO: 1390166 - RNA, 19 nt, Human
uugcugaaauuuuauaugc

SEQ ID NO: 1390167 - RNA, 11 nt, Human
uugcugaauag

SEQ ID NO: 1390168 - RNA, 12 nt, Human
uugcucauggaa

SEQ ID NO: 1390169 - RNA, 11 nt, Human
uugcucaugga

SEQ ID NO: 1390170 - RNA, 20 nt, Human
auucuauuuauauguacaug

SEQ ID NO: 1390171 - RNA, 18 nt, Human
auucuauuacauuuucag

SEQ ID NO: 1390172 - RNA, 20 nt, Human
auucuauuacauuuucagug

SEQ ID NO: 1390173 - RNA, 15 nt, Human
auucuauuaaagugc

SEQ ID NO: 1390174 - RNA, 17 nt, Human
auucuauaguucuagac

SEQ ID NO: 1390175 - RNA, 16 nt, Human
auucuauaguucuaga

SEQ ID NO: 1390176 - RNA, 15 nt, Human
auucuauaguucuag

SEQ ID NO: 1390177 - RNA, 14 nt, Human
auucuauaguucua

SEQ ID NO: 1390178 - RNA, 13 nt, Human
auucuauaguucu

SEQ ID NO: 1390179 - RNA, 18 nt, Human
auucuauaaguuuuaugu

SEQ ID NO: 1390180 - RNA, 15 nt, Human
auucuauaaggccau

SEQ ID NO: 1390181 - RNA, 18 nt, Human
auucuaaaugaauguuua

SEQ ID NO: 1390182 - RNA, 17 nt, Human
auucuaaaugaauguuu

SEQ ID NO: 1390183 - RNA, 15 nt, Human
auucuaaaugaaugu

SEQ ID NO: 1390184 - RNA, 14 nt, Human
auucuaaaggucca

SEQ ID NO: 1390185 - RNA, 22 nt, Human
auucuaaagauucuauaguucu

SEQ ID NO: 1390186 - RNA, 20 nt, Human
auucuaaagauucuauaguu

SEQ ID NO: 1390187 - RNA, 19 nt, Human
auucuaaagauucuauagu

SEQ ID NO: 1390188 - RNA, 18 nt, Human
auucuaaagauucuauag

SEQ ID NO: 1390189 - RNA, 17 nt, Human
auucuaaagauucuaua

SEQ ID NO: 1390190 - RNA, 15 nt, Human
auucuaaagauucua

SEQ ID NO: 1390191 - RNA, 14 nt, Human
auucuaaagauucu

SEQ ID NO: 1390192 - RNA, 22 nt, Human
auucuaaaaugugauguucuaa

SEQ ID NO: 1390193 - RNA, 23 nt, Human
auucuaaaaugugauguucuaag

SEQ ID NO: 1390194 - RNA, 20 nt, Human
auucuaaaaugugauguucu

SEQ ID NO: 1390195 - RNA, 15 nt, Human
auucuaaaaugccuu

SEQ ID NO: 1390196 - RNA, 14 nt, Human
auucuaaaaugccu

SEQ ID NO: 1390197 - RNA, 20 nt, Human
auucuaaaaugauuguagua

SEQ ID NO: 1390198 - RNA, 17 nt, Human
auucucaaaggagcgag

SEQ ID NO: 1390199 - RNA, 15 nt, Human
auucucaagcccugc

SEQ ID NO: 1390200 - RNA, 22 nt, Human
auucuauuuauauguacaugag

SEQ ID NO: 1390201 - RNA, 16 nt, Human
auucucaagcccugca

SEQ ID NO: 1390202 - RNA, 17 nt, Human
auucuccuccucccucc

SEQ ID NO: 1390203 - RNA, 12 nt, Human
auucuccuccuc

SEQ ID NO: 1390204 - RNA, 11 nt, Human
auucuccuccu

SEQ ID NO: 1390205 - RNA, 15 nt, Human
auucucccuugcucu

SEQ ID NO: 1390206 - RNA, 23 nt, Human
auucuccagccaucaagagacug

SEQ ID NO: 1390207 - RNA, 11 nt, Human
auucuccugga

SEQ ID NO: 1390208 - RNA, 16 nt, Human
auucuccuuguguuac

SEQ ID NO: 1390209 - RNA, 20 nt, Human
auucuccugccucagccucc

SEQ ID NO: 1390210 - RNA, 16 nt, Human
auucuaaaaugauugu

SEQ ID NO: 1390211 - RNA, 14 nt, Human
auucuaaaaugauu

SEQ ID NO: 1390212 - RNA, 16 nt, Human
auucccucucccaggc

SEQ ID NO: 1390213 - RNA, 18 nt, Human
auucccucucccaggccc

SEQ ID NO: 1390214 - RNA, 15 nt, Human
auucccucucccagg

SEQ ID NO: 1390215 - RNA, 14 nt, Human
auucccucucccag

SEQ ID NO: 1390216 - RNA, 20 nt, Human
auucccucacucgucucccc

SEQ ID NO: 1390217 - RNA, 17 nt, Human
auucccucacucgucuc

SEQ ID NO: 1390218 - RNA, 11 nt, Human
auucccucacu

SEQ ID NO: 1390219 - RNA, 22 nt, Human
auuccaagacaugucuguucua

SEQ ID NO: 1390220 - RNA, 19 nt, Human
auuccaacucguauagcau

SEQ ID NO: 1390221 - RNA, 17 nt, Human
auuccagccccucuggu

SEQ ID NO: 1390222 - RNA, 23 nt, Human
auuccaacucguauagcaugcau

SEQ ID NO: 1390223 - RNA, 19 nt, Human
auuccaacaguuuaaugaa

SEQ ID NO: 1390224 - RNA, 20 nt, Human
auuccaacaguuuaaugaag

SEQ ID NO: 1390225 - RNA, 18 nt, Human
auuccaacaguuuaauga

SEQ ID NO: 1390226 - RNA, 17 nt, Human
auuccaacaguuuaaug

SEQ ID NO: 1390227 - RNA, 16 nt, Human
auuccaacaguuuaau

SEQ ID NO: 1390228 - RNA, 14 nt, Human
auuccaacaguuua

SEQ ID NO: 1390229 - RNA, 18 nt, Human
auuccaaagucucuaauu

SEQ ID NO: 1390230 - RNA, 19 nt, Human
auuccaaagucucuaauuc

SEQ ID NO: 1390231 - RNA, 13 nt, Human
auuccagcugucc

SEQ ID NO: 1390232 - RNA, 11 nt, Human
auuccauccuu

SEQ ID NO: 1390233 - RNA, 11 nt, Human
auucagacauc

SEQ ID NO: 1390234 - RNA, 15 nt, Human
auucagacaucugag

SEQ ID NO: 1390235 - RNA, 14 nt, Human
auucagacaggcaa

SEQ ID NO: 1390236 - RNA, 13 nt, Human
auucagacaggca

SEQ ID NO: 1390237 - RNA, 17 nt, Human
auucagaguugaugguu

SEQ ID NO: 1390238 - RNA, 16 nt, Human
auuccaaagucucuaa

SEQ ID NO: 1390239 - RNA, 23 nt, Human
auucagguuuuuccuuuuuuugu

SEQ ID NO: 1390240 - RNA, 16 nt, Human
auucagguuuuuccuu

SEQ ID NO: 1390241 - RNA, 15 nt, Human
auucagguuuuuccu

SEQ ID NO: 1390242 - RNA, 14 nt, Human
auucagguuuuucc

SEQ ID NO: 1390243 - RNA, 12 nt, Human
auucagguuuuu

SEQ ID NO: 1390244 - RNA, 18 nt, Human
auucagauaugauucaaa

SEQ ID NO: 1390245 - RNA, 20 nt, Human
auucagauaugauucaaaug

SEQ ID NO: 1390246 - RNA, 19 nt, Human
auuauauaacuguauuuga

SEQ ID NO: 1390247 - RNA, 17 nt, Human
auuauauaacuguauuu

SEQ ID NO: 1390248 - RNA, 15 nt, Human
auuauauaacuguau

SEQ ID NO: 1390249 - RNA, 19 nt, Human
auuauaguuucugaggcuu

SEQ ID NO: 1390250 - RNA, 16 nt, Human
auuauaguuucugagg

SEQ ID NO: 1390251 - RNA, 15 nt, Human
auuagugcuaagugu

SEQ ID NO: 1390252 - RNA, 17 nt, Human
auuagugcuaaguguga

SEQ ID NO: 1390253 - RNA, 23 nt, Human
auuauagugauguaaucuugaau

SEQ ID NO: 1390254 - RNA, 22 nt, Human
auuagugccacuuaauguaugu

SEQ ID NO: 1390255 - RNA, 21 nt, Human
auuagugccacuuaauguaug

SEQ ID NO: 1390256 - RNA, 13 nt, Human
auuagugcuaagu

SEQ ID NO: 1390257 - RNA, 20 nt, Human
auuagugccacuuaauguau

SEQ ID NO: 1390258 - RNA, 19 nt, Human
auuagugccacuuaaugua

SEQ ID NO: 1390259 - RNA, 18 nt, Human
auuagugccacuuaaugu

SEQ ID NO: 1390260 - RNA, 16 nt, Human
auuagugccacuuaau

SEQ ID NO: 1390261 - RNA, 20 nt, Human
auuagucucagugaagacua

SEQ ID NO: 1390262 - RNA, 15 nt, Human
auuagucauguuuau

SEQ ID NO: 1390263 - RNA, 17 nt, Human
auuaguauuguuguccu

SEQ ID NO: 1390264 - RNA, 23 nt, Human
auuaguauuguuguccuuuucau

SEQ ID NO: 1390265 - RNA, 15 nt, Human
auuaguauuguuguc

SEQ ID NO: 1390266 - RNA, 14 nt, Human
auuaguauuguugu

SEQ ID NO: 1390267 - RNA, 13 nt, Human
auuaguauuguug

SEQ ID NO: 1390268 - RNA, 17 nt, Human
auuacucaguaauuugu

SEQ ID NO: 1390269 - RNA, 19 nt, Human
auuacuuauuuuugacagu

SEQ ID NO: 1390270 - RNA, 18 nt, Human
auuacuuauuuuugacag

SEQ ID NO: 1390271 - RNA, 17 nt, Human
auuacuuauuuuugaca

SEQ ID NO: 1390272 - RNA, 16 nt, Human
auuacuuauuuuugac

SEQ ID NO: 1390273 - RNA, 15 nt, Human
auuacuuauuuuuga

SEQ ID NO: 1390274 - RNA, 15 nt, Human
auuacguaugucugg

SEQ ID NO: 1390275 - RNA, 21 nt, Human
auuacguaugucugguucuca

SEQ ID NO: 1390276 - RNA, 13 nt, Human
auuacgugcucug

SEQ ID NO: 1390277 - RNA, 14 nt, Human
uuuuuguaccauuu

SEQ ID NO: 1390278 - RNA, 23 nt, Human
uuuuuguaccauuuuaaaguuag

SEQ ID NO: 1390279 - RNA, 12 nt, Human
uuuuuguaccaa

SEQ ID NO: 1390280 - RNA, 13 nt, Human
uuuuuauuuaaaa

SEQ ID NO: 1390281 - RNA, 18 nt, Human
uuuuuauuaguauuguug

SEQ ID NO: 1390282 - RNA, 15 nt, Human
uuuuuauuaugcauu

SEQ ID NO: 1390283 - RNA, 14 nt, Human
uuuuuauuaugcau

SEQ ID NO: 1390284 - RNA, 17 nt, Human
uuuuuauuaguauuguu

SEQ ID NO: 1390285 - RNA, 23 nt, Human
uuuuuauuaauuuuaguuuuuca

SEQ ID NO: 1390286 - RNA, 14 nt, Human
uuuuuaucuuuuua

SEQ ID NO: 1390287 - RNA, 14 nt, Human
uuuuuaucuuuaua

SEQ ID NO: 1390288 - RNA, 22 nt, Human
uuuuuauggcuuuugugcauua

SEQ ID NO: 1390289 - RNA, 20 nt, Human
uuuuuauggcuuuugugcau

SEQ ID NO: 1390290 - RNA, 21 nt, Human
uuuuuauggcuuuugugcauu

SEQ ID NO: 1390291 - RNA, 19 nt, Human
uuuuugugaaaagcuccau

SEQ ID NO: 1390292 - RNA, 23 nt, Human
auuaaguaaugauaacuggaaac

SEQ ID NO: 1390293 - RNA, 15 nt, Human
uuuuuguguguauuu

SEQ ID NO: 1390294 - RNA, 18 nt, Human
uuuuuguguguauuugcu

SEQ ID NO: 1390295 - RNA, 16 nt, Human
uuuuuguuauuaaaca

SEQ ID NO: 1390296 - RNA, 17 nt, Human
uuuuuguguguauuugc

SEQ ID NO: 1390297 - RNA, 14 nt, Human
auuacaguguuuau

SEQ ID NO: 1390298 - RNA, 22 nt, Human
auuacaguguuuauccuuucau

SEQ ID NO: 1390299 - RNA, 17 nt, Human
auuaauagcagccuuuc

SEQ ID NO: 1390300 - RNA, 18 nt, Human
auuaauagcagccuuucu

SEQ ID NO: 1390301 - RNA, 21 nt, Human
auuacaguggggaaugaagau

SEQ ID NO: 1390302 - RNA, 14 nt, Human
auuaccauguaaug

SEQ ID NO: 1390303 - RNA, 15 nt, Human
auuaccauguaaugg

SEQ ID NO: 1390304 - RNA, 20 nt, Human
auuacauuuguauaaaauaa

SEQ ID NO: 1390305 - RNA, 18 nt, Human
auuacauuuguauaaaau

SEQ ID NO: 1390306 - RNA, 17 nt, Human
auuacauuuguauaaaa

SEQ ID NO: 1390307 - RNA, 18 nt, Human
uuuugauacuaagcauug

SEQ ID NO: 1390308 - RNA, 19 nt, Human
uuuugauaugcauauuugu

SEQ ID NO: 1390309 - RNA, 15 nt, Human
uuuugauagcaaagc

SEQ ID NO: 1390310 - RNA, 15 nt, Human
uuuugaggagcccca

SEQ ID NO: 1390311 - RNA, 23 nt, Human
uuuugagauauuaaugcccagac

SEQ ID NO: 1390312 - RNA, 13 nt, Human
uuuugagauauua

SEQ ID NO: 1390313 - RNA, 12 nt, Human
uuuugagauauu

SEQ ID NO: 1390314 - RNA, 18 nt, Human
uuuugaggcaaaagaagg

SEQ ID NO: 1390315 - RNA, 13 nt, Human
uuuugaggcaaaa

SEQ ID NO: 1390316 - RNA, 21 nt, Human
auuaaagaaggguugagcugg

SEQ ID NO: 1390317 - RNA, 20 nt, Human
auuaaagaaggguugagcug

SEQ ID NO: 1390318 - RNA, 22 nt, Human
auuaaagaagaccugagaaugu

SEQ ID NO: 1390319 - RNA, 21 nt, Human
auuaaagaagaccugagaaug

SEQ ID NO: 1390320 - RNA, 16 nt, Human
auuaaagaagaccuga

SEQ ID NO: 1390321 - RNA, 15 nt, Human
auuaaagaagaccug

SEQ ID NO: 1390322 - RNA, 14 nt, Human
auuaaagaagaccu

SEQ ID NO: 1390323 - RNA, 21 nt, Human
auuaaagaaaaaaauguauuu

SEQ ID NO: 1390324 - RNA, 22 nt, Human
auuaaagaaaaaaauguauuuu

SEQ ID NO: 1390325 - RNA, 19 nt, Human
auuaaagaaaaaaauguau

SEQ ID NO: 1390326 - RNA, 18 nt, Human
auuaaagaaaaaaaugua

SEQ ID NO: 1390327 - RNA, 17 nt, Human
auuaaagaaaaaaaugu

SEQ ID NO: 1390328 - RNA, 16 nt, Human
auuaaagaaaaaaaug

SEQ ID NO: 1390329 - RNA, 15 nt, Human
auuaaagacuccagu

SEQ ID NO: 1390330 - RNA, 15 nt, Human
auuaaagaauaugaa

SEQ ID NO: 1390331 - RNA, 15 nt, Human
auuaaagcauuuaga

SEQ ID NO: 1390332 - RNA, 12 nt, Human
auuaaagaauau

SEQ ID NO: 1390333 - RNA, 20 nt, Human
auuaagccacuuaaaauguu

SEQ ID NO: 1390334 - RNA, 17 nt, Human
auuaagccacuuaaaau

SEQ ID NO: 1390335 - RNA, 17 nt, Human
auuaagcaucagaaacu

SEQ ID NO: 1390336 - RNA, 14 nt, Human
auuaagcaucagaa

SEQ ID NO: 1390337 - RNA, 17 nt, Human
uuuugcacagccaaauu

SEQ ID NO: 1390338 - RNA, 20 nt, Human
uuuugcacauguuuccucua

SEQ ID NO: 1390339 - RNA, 18 nt, Human
uuuugcaaucccuuaaua

SEQ ID NO: 1390340 - RNA, 21 nt, Human
uuuugcaaccucgcuggacuc

SEQ ID NO: 1390341 - RNA, 17 nt, Human
uuuugcaaccucgcugg

SEQ ID NO: 1390342 - RNA, 21 nt, Human
uuuugcaaccaggaacagcaa

SEQ ID NO: 1390343 - RNA, 17 nt, Human
uuuugcaaagauuuaau

SEQ ID NO: 1390344 - RNA, 19 nt, Human
uuuugcaaagauuuaaucu

SEQ ID NO: 1390345 - RNA, 13 nt, Human
uuuugcaaagaaa

SEQ ID NO: 1390346 - RNA, 21 nt, Human
uuuugauuuguacugaaaaau

SEQ ID NO: 1390347 - RNA, 20 nt, Human
uuuugauuuguacugaaaaa

SEQ ID NO: 1390348 - RNA, 20 nt, Human
uuuugauuuaauguuuucag

SEQ ID NO: 1390349 - RNA, 18 nt, Human
uuuugauguaaagauguu

SEQ ID NO: 1390350 - RNA, 16 nt, Human
uuuugauguaaagaug

SEQ ID NO: 1390351 - RNA, 16 nt, Human
uuuugaugaguuguga

SEQ ID NO: 1390352 - RNA, 16 nt, Human
uuuugauauuucuagc

SEQ ID NO: 1390353 - RNA, 20 nt, Human
uuuugccacagcuuuugcaa

SEQ ID NO: 1390354 - RNA, 16 nt, Human
uuuugccacagcuuuu

SEQ ID NO: 1390355 - RNA, 14 nt, Human
uuuugccacagcuu

SEQ ID NO: 1390356 - RNA, 13 nt, Human
uuuugcccuuuga

SEQ ID NO: 1390357 - RNA, 19 nt, Human
uuuugcccauuuugaauca

SEQ ID NO: 1390358 - RNA, 15 nt, Human
uuuugccauuaaacu

SEQ ID NO: 1390359 - RNA, 18 nt, Human
uuuugcauuuaaaacaga

SEQ ID NO: 1390360 - RNA, 15 nt, Human
uuuugcaguaacugu

SEQ ID NO: 1390361 - RNA, 16 nt, Human
uuuugcaguaacuguu

SEQ ID NO: 1390362 - RNA, 14 nt, Human
uuuugcaguaacug

SEQ ID NO: 1390363 - RNA, 13 nt, Human
uuuugcaguaacu

SEQ ID NO: 1390364 - RNA, 9 nt, Human
uuuugcagu

SEQ ID NO: 1390365 - RNA, 12 nt, Human
uuuugcagcuuu

SEQ ID NO: 1390366 - RNA, 15 nt, Human
uuuuuacugcucuga

SEQ ID NO: 1390367 - RNA, 20 nt, Human
uuuuuagaaagcauuugaau

SEQ ID NO: 1390368 - RNA, 22 nt, Human
uuuuguuugcuucauguguccc

SEQ ID NO: 1390369 - RNA, 14 nt, Human
uuuuguuugguauu

SEQ ID NO: 1390370 - RNA, 19 nt, Human
uuuuguuugguauuguauu

SEQ ID NO: 1390371 - RNA, 22 nt, Human
uuuuguuugguauuguauuuau

SEQ ID NO: 1390372 - RNA, 11 nt, Human
uuuuuacuaau

SEQ ID NO: 1390373 - RNA, 15 nt, Human
uuuuuaguugaauuu

SEQ ID NO: 1390374 - RNA, 12 nt, Human
uuuuuaguugaa

SEQ ID NO: 1390375 - RNA, 20 nt, Human
uuuuuaggaagcaagcuuaa

SEQ ID NO: 1390376 - RNA, 13 nt, Human
uuuuuaggaaaug

SEQ ID NO: 1390377 - RNA, 12 nt, Human
uuuuuaggaaau

SEQ ID NO: 1390378 - RNA, 19 nt, Human
uuuuuauauuugaaauauu

SEQ ID NO: 1390379 - RNA, 23 nt, Human
uuuuuauacauaaacaagaccac

SEQ ID NO: 1390380 - RNA, 17 nt, Human
uuuuuaucaugcauguc

SEQ ID NO: 1390381 - RNA, 12 nt, Human
uuuuuauggcuu

SEQ ID NO: 1390382 - RNA, 12 nt, Human
uuuuuaucaugu

SEQ ID NO: 1390383 - RNA, 20 nt, Human
uuuuuaucgucacugcuuaa

SEQ ID NO: 1390384 - RNA, 13 nt, Human
uuuugcuggaaua

SEQ ID NO: 1390385 - RNA, 19 nt, Human
uuuugcugagacuaaucuu

SEQ ID NO: 1390386 - RNA, 21 nt, Human
uuuugcgguucaggaaaauug

SEQ ID NO: 1390387 - RNA, 15 nt, Human
uuuugccuuuugcaa

SEQ ID NO: 1390388 - RNA, 17 nt, Human
uuuugcccauuuugaau

SEQ ID NO: 1390389 - RNA, 22 nt, Human
uuuugcuguaauguuaauauug

SEQ ID NO: 1390390 - RNA, 13 nt, Human
uuuugcugagacu

SEQ ID NO: 1390391 - RNA, 19 nt, Human
uuuugugauggagugcugu

SEQ ID NO: 1390392 - RNA, 20 nt, Human
uuuugugaugcaaauaaaua

SEQ ID NO: 1390393 - RNA, 23 nt, Human
uuuugugcauuaucuagauacug

SEQ ID NO: 1390394 - RNA, 15 nt, Human
uuuuguuauuaaaca

SEQ ID NO: 1390395 - RNA, 18 nt, Human
uuuuguuaucagucaaua

SEQ ID NO: 1390396 - RNA, 17 nt, Human
uuuugugcauuaucuag

SEQ ID NO: 1390397 - RNA, 20 nt, Human
uuuugugcauuaucuagaua

SEQ ID NO: 1390398 - RNA, 16 nt, Human
uuuuguucaaagccag

SEQ ID NO: 1390399 - RNA, 16 nt, Human
uuuuguuuaccagaga

SEQ ID NO: 1390400 - RNA, 18 nt, Human
uuuuguuucaaugaggug

SEQ ID NO: 1390401 - RNA, 13 nt, Human
uuuuguuuccuuu

SEQ ID NO: 1390402 - RNA, 22 nt, Human
auuaaaccaucucccuggugcu

SEQ ID NO: 1390403 - RNA, 18 nt, Human
auuaaaccaucucccugg

SEQ ID NO: 1390404 - RNA, 17 nt, Human
auuaaaccaucucccug

SEQ ID NO: 1390405 - RNA, 16 nt, Human
auuaaaccaucucccu

SEQ ID NO: 1390406 - RNA, 14 nt, Human
auuaaaccaucucc

SEQ ID NO: 1390407 - RNA, 14 nt, Human
auuaaaagaauauc

SEQ ID NO: 1390408 - RNA, 16 nt, Human
auuaaaagaauaucug

SEQ ID NO: 1390409 - RNA, 19 nt, Human
auuaaacuuuuaauucauu

SEQ ID NO: 1390410 - RNA, 18 nt, Human
auuaaacuuuuaauucau

SEQ ID NO: 1390411 - RNA, 16 nt, Human
auuaaacuuaaucuaa

SEQ ID NO: 1390412 - RNA, 21 nt, Human
auuaaacgauuuuuaaaaugu

SEQ ID NO: 1390413 - RNA, 22 nt, Human
auuaaacgauuuuuaaaaugua

SEQ ID NO: 1390414 - RNA, 15 nt, Human
auuaaacgauuuuua

SEQ ID NO: 1390415 - RNA, 14 nt, Human
auuaaacgauuuuu

SEQ ID NO: 1390416 - RNA, 17 nt, Human
auuaaaccggaccaucu

SEQ ID NO: 1390417 - RNA, 15 nt, Human
auuaaaaaucucaaa

SEQ ID NO: 1390418 - RNA, 19 nt, Human
auuaaaaaucucaaauuuc

SEQ ID NO: 1390419 - RNA, 20 nt, Human
auuaaaaaucucaaauuucu

SEQ ID NO: 1390420 - RNA, 22 nt, Human
auuaaaaaucucaaauuucuaa

SEQ ID NO: 1390421 - RNA, 17 nt, Human
auguuuaguaaucauau

SEQ ID NO: 1390422 - RNA, 14 nt, Human
auguuguugaaagg

SEQ ID NO: 1390423 - RNA, 17 nt, Human
auguuguuauuuaaaga

SEQ ID NO: 1390424 - RNA, 15 nt, Human
auguuguuauuuaaa

SEQ ID NO: 1390425 - RNA, 14 nt, Human
auguuguuauuuaa

SEQ ID NO: 1390426 - RNA, 13 nt, Human
auguuguuauuua

SEQ ID NO: 1390427 - RNA, 12 nt, Human
auguuguuauuu

SEQ ID NO: 1390428 - RNA, 15 nt, Human
auguuguguuuuuaa

SEQ ID NO: 1390429 - RNA, 18 nt, Human
uuuucugugccugaauau

SEQ ID NO: 1390430 - RNA, 17 nt, Human
uuuucugugccugaaua

SEQ ID NO: 1390431 - RNA, 17 nt, Human
uuuucuguauaaauguc

SEQ ID NO: 1390432 - RNA, 21 nt, Human
uuuucuguaccaguuaauuuu

SEQ ID NO: 1390433 - RNA, 14 nt, Human
uuuucuguaccagu

SEQ ID NO: 1390434 - RNA, 14 nt, Human
uuuucuguaauuca

SEQ ID NO: 1390435 - RNA, 17 nt, Human
uuuucugguucuaacau

SEQ ID NO: 1390436 - RNA, 15 nt, Human
uuuucugguucuaac

SEQ ID NO: 1390437 - RNA, 14 nt, Human
uuuucugguucuaa

SEQ ID NO: 1390438 - RNA, 14 nt, Human
auguuuaucugcuu

SEQ ID NO: 1390439 - RNA, 23 nt, Human
auguuuuggccaaugcaccuaaa

SEQ ID NO: 1390440 - RNA, 21 nt, Human
auguuuucaggcuagauguau

SEQ ID NO: 1390441 - RNA, 17 nt, Human
auguuuucaggcuagau

SEQ ID NO: 1390442 - RNA, 15 nt, Human
uuuucaguuguucuu

SEQ ID NO: 1390443 - RNA, 13 nt, Human
uuuucaguuacuu

SEQ ID NO: 1390444 - RNA, 17 nt, Human
uuuuauuuucaaaacca

SEQ ID NO: 1390445 - RNA, 15 nt, Human
uuuuauuugcaugug

SEQ ID NO: 1390446 - RNA, 11 nt, Human
uuuuauuuuau

SEQ ID NO: 1390447 - RNA, 16 nt, Human
uuuucauaggucugaa

SEQ ID NO: 1390448 - RNA, 17 nt, Human
uuuucauaggucugaaa

SEQ ID NO: 1390449 - RNA, 15 nt, Human
uuuucauaggucuga

SEQ ID NO: 1390450 - RNA, 21 nt, Human
uuuucauacauuuucuaagaa

SEQ ID NO: 1390451 - RNA, 18 nt, Human
uuuucauacauuuucuaa

SEQ ID NO: 1390452 - RNA, 16 nt, Human
uuuucauacauuuucu

SEQ ID NO: 1390453 - RNA, 12 nt, Human
uuuucaguuguu

SEQ ID NO: 1390454 - RNA, 22 nt, Human
uuuucaguuuauuugaaccaau

SEQ ID NO: 1390455 - RNA, 13 nt, Human
uuuuauuuaaaaa

SEQ ID NO: 1390456 - RNA, 23 nt, Human
uuuuauuaguauuguuguccuuu

SEQ ID NO: 1390457 - RNA, 22 nt, Human
uuuuauuaguauuguuguccuu

SEQ ID NO: 1390458 - RNA, 20 nt, Human
uuuuauuaguauuguugucc

SEQ ID NO: 1390459 - RNA, 13 nt, Human
uuuuauuaugcau

SEQ ID NO: 1390460 - RNA, 13 nt, Human
uuuuagguucuaa

SEQ ID NO: 1390461 - RNA, 12 nt, Human
uuuuagguucua

SEQ ID NO: 1390462 - RNA, 14 nt, Human
uuuuauuaaugcac

SEQ ID NO: 1390463 - RNA, 23 nt, Human
uuuuagguucuaaaguucuaaga

SEQ ID NO: 1390464 - RNA, 18 nt, Human
uuuuagguucuaaaguuc

SEQ ID NO: 1390465 - RNA, 16 nt, Human
uuuuagguucuaaagu

SEQ ID NO: 1390466 - RNA, 15 nt, Human
uuuuagguucuaaag

SEQ ID NO: 1390467 - RNA, 14 nt, Human
uuuuagguucuaaa

SEQ ID NO: 1390468 - RNA, 15 nt, Human
uuuuauuaguauugu

SEQ ID NO: 1390469 - RNA, 19 nt, Human
uuuuauuaauuuuaguuuu

SEQ ID NO: 1390470 - RNA, 19 nt, Human
uuuuauuaaugcacuuucu

SEQ ID NO: 1390471 - RNA, 12 nt, Human
uuuuauuaugaa

SEQ ID NO: 1390472 - RNA, 21 nt, Human
uuuucuccucacuguauccag

SEQ ID NO: 1390473 - RNA, 13 nt, Human
uuuucauuuaucu

SEQ ID NO: 1390474 - RNA, 21 nt, Human
uuuucaucuucaguugucucu

SEQ ID NO: 1390475 - RNA, 16 nt, Human
uuuucaucuucaguug

SEQ ID NO: 1390476 - RNA, 14 nt, Human
uuuucaucuucagu

SEQ ID NO: 1390477 - RNA, 20 nt, Human
uuuucauccauaacugaaca

SEQ ID NO: 1390478 - RNA, 18 nt, Human
uuuucauccauaacugaa

SEQ ID NO: 1390479 - RNA, 17 nt, Human
uuuucaugcaaacucuu

SEQ ID NO: 1390480 - RNA, 19 nt, Human
uuuucaucuucaguugucu

SEQ ID NO: 1390481 - RNA, 16 nt, Human
uuuucucuaggaaaua

SEQ ID NO: 1390482 - RNA, 21 nt, Human
uuuucucgcuguccuuucuag

SEQ ID NO: 1390483 - RNA, 19 nt, Human
uuuucuccucccaggaacu

SEQ ID NO: 1390484 - RNA, 14 nt, Human
uuuucuccucccag

SEQ ID NO: 1390485 - RNA, 13 nt, Human
uuuucuccuccca

SEQ ID NO: 1390486 - RNA, 14 nt, Human
uuuucucuaggaaa

SEQ ID NO: 1390487 - RNA, 20 nt, Human
uuuucuggccaguguuuaaa

SEQ ID NO: 1390488 - RNA, 22 nt, Human
auguugccauccuaccgucuuu

SEQ ID NO: 1390489 - RNA, 22 nt, Human
auguucagcacugucccuugcc

SEQ ID NO: 1390490 - RNA, 19 nt, Human
auguucagcacugucccuu

SEQ ID NO: 1390491 - RNA, 16 nt, Human
auguucagcacugucc

SEQ ID NO: 1390492 - RNA, 17 nt, Human
auguugcauagaauaaa

SEQ ID NO: 1390493 - RNA, 18 nt, Human
auguugcauagaauaaaa

SEQ ID NO: 1390494 - RNA, 23 nt, Human
uuuuaggagcuaaggcucuauga

SEQ ID NO: 1390495 - RNA, 20 nt, Human
uuuuaggagcuaaggcucua

SEQ ID NO: 1390496 - RNA, 18 nt, Human
uuuuaggaagcaagcuua

SEQ ID NO: 1390497 - RNA, 11 nt, Human
uuuuaggaaau

SEQ ID NO: 1390498 - RNA, 12 nt, Human
uuuuaggaaaug

SEQ ID NO: 1390499 - RNA, 13 nt, Human
uuuuagcuuuugu

SEQ ID NO: 1390500 - RNA, 14 nt, Human
uuuuagaaagcauu

SEQ ID NO: 1390501 - RNA, 16 nt, Human
uuuuagaaagcauuug

SEQ ID NO: 1390502 - RNA, 18 nt, Human
uuuuagaaagcauuugaa

SEQ ID NO: 1390503 - RNA, 19 nt, Human
uuuuagaaagcauuugaau

SEQ ID NO: 1390504 - RNA, 20 nt, Human
uuuuagaaagcauuugaaug

SEQ ID NO: 1390505 - RNA, 21 nt, Human
uuuuagaaagcauuugaaugc

SEQ ID NO: 1390506 - RNA, 22 nt, Human
uuuuagaaagcauuugaaugca

SEQ ID NO: 1390507 - RNA, 23 nt, Human
uuuuagaaagcauuugaaugcau

SEQ ID NO: 1390508 - RNA, 12 nt, Human
uuuuacuuuugu

SEQ ID NO: 1390509 - RNA, 20 nt, Human
uuuuacuuuuaaacugugua

SEQ ID NO: 1390510 - RNA, 18 nt, Human
uuuuacuuuuaaacugug

SEQ ID NO: 1390511 - RNA, 17 nt, Human
uuuuacuuuuaaacugu

SEQ ID NO: 1390512 - RNA, 20 nt, Human
auguugcccuguugcugccu

SEQ ID NO: 1390513 - RNA, 15 nt, Human
auguuaaaauguguu

SEQ ID NO: 1390514 - RNA, 14 nt, Human
auguuaaaaugugu

SEQ ID NO: 1390515 - RNA, 21 nt, Human
auguuaaaaaaauaagaagaa

SEQ ID NO: 1390516 - RNA, 12 nt, Human
auguuaaaaugu

SEQ ID NO: 1390517 - RNA, 22 nt, Human
auguuaaaaaaauaagaagaau

SEQ ID NO: 1390518 - RNA, 19 nt, Human
auguuaaaaaaauaagaag

SEQ ID NO: 1390519 - RNA, 17 nt, Human
auguguuuacuuuaugu

SEQ ID NO: 1390520 - RNA, 22 nt, Human
auguguuggggaagggccugcc

SEQ ID NO: 1390521 - RNA, 23 nt, Human
auguguguuuugcuaaaggaaaa

SEQ ID NO: 1390522 - RNA, 16 nt, Human
auguuaaaauguguug

SEQ ID NO: 1390523 - RNA, 24 nt, Human
auguuaaacuagcauaucugccuu

SEQ ID NO: 1390524 - RNA, 21 nt, Human
auguuaaacuagcauaucugc

SEQ ID NO: 1390525 - RNA, 23 nt, Human
auguuaaacuagcauaucugccu

SEQ ID NO: 1390526 - RNA, 15 nt, Human
auguuaaacuagcau

SEQ ID NO: 1390527 - RNA, 19 nt, Human
auguuaaacuagcauaucu

SEQ ID NO: 1390528 - RNA, 17 nt, Human
auguuacuacaugcacu

SEQ ID NO: 1390529 - RNA, 14 nt, Human
auguuaaguuauau

SEQ ID NO: 1390530 - RNA, 15 nt, Human
auguuaauauugauu

SEQ ID NO: 1390531 - RNA, 20 nt, Human
auguuaagggaagaauucca

SEQ ID NO: 1390532 - RNA, 12 nt, Human
auguuagccagg

SEQ ID NO: 1390533 - RNA, 22 nt, Human
auguucacuuuugacaaaggca

SEQ ID NO: 1390534 - RNA, 20 nt, Human
auguucacuuuugacaaagg

SEQ ID NO: 1390535 - RNA, 23 nt, Human
auguucagaagguugcucuagau

SEQ ID NO: 1390536 - RNA, 16 nt, Human
auguucagauuauugg

SEQ ID NO: 1390537 - RNA, 20 nt, Human
uuuuaaguuucucugcagaa

SEQ ID NO: 1390538 - RNA, 19 nt, Human
uuuuaaguuucucugcaga

SEQ ID NO: 1390539 - RNA, 14 nt, Human
uuuuaauaaacacu

SEQ ID NO: 1390540 - RNA, 14 nt, Human
uuuuaauaauguuu

SEQ ID NO: 1390541 - RNA, 13 nt, Human
uuuuaauaauguu

SEQ ID NO: 1390542 - RNA, 14 nt, Human
uuuuaauaaauuuc

SEQ ID NO: 1390543 - RNA, 12 nt, Human
uuuuaauaaauu

SEQ ID NO: 1390544 - RNA, 15 nt, Human
uuuuaauaaaagaaa

SEQ ID NO: 1390545 - RNA, 19 nt, Human
uuuuaauaaaaauaauuuu

SEQ ID NO: 1390546 - RNA, 12 nt, Human
uuuuaauaaugu

SEQ ID NO: 1390547 - RNA, 16 nt, Human
uuuuaauaauguuuca

SEQ ID NO: 1390548 - RNA, 19 nt, Human
augugcccaguuaaucuug

SEQ ID NO: 1390549 - RNA, 20 nt, Human
uuuuaauaauguuucaaaca

SEQ ID NO: 1390550 - RNA, 20 nt, Human
augugccuauugcuagagcu

SEQ ID NO: 1390551 - RNA, 23 nt, Human
augugccuauugcuagagcuccu

SEQ ID NO: 1390552 - RNA, 19 nt, Human
augugccuauugcuagagc

SEQ ID NO: 1390553 - RNA, 11 nt, Human
augugccuauu

SEQ ID NO: 1390554 - RNA, 19 nt, Human
augugcuaguaauuggaaa

SEQ ID NO: 1390555 - RNA, 18 nt, Human
auguggccccugaacaag

SEQ ID NO: 1390556 - RNA, 13 nt, Human
auguggcaggggu

SEQ ID NO: 1390557 - RNA, 18 nt, Human
auguggcaaggaaaaaca

SEQ ID NO: 1390558 - RNA, 18 nt, Human
auguggaccuuagaauac

SEQ ID NO: 1390559 - RNA, 20 nt, Human
augugcuaguaauuggaaag

SEQ ID NO: 1390560 - RNA, 20 nt, Human
auguggcuggaagauccugc

SEQ ID NO: 1390561 - RNA, 14 nt, Human
auguggcuggaaga

SEQ ID NO: 1390562 - RNA, 13 nt, Human
auguggcuggaag

SEQ ID NO: 1390563 - RNA, 22 nt, Human
auguggccccugaacaagaauu

SEQ ID NO: 1390564 - RNA, 20 nt, Human
auguggccccugaacaagaa

SEQ ID NO: 1390565 - RNA, 16 nt, Human
auguguguuuugcuaa

SEQ ID NO: 1390566 - RNA, 23 nt, Human
auguguguuuuaaaaugagaaau

SEQ ID NO: 1390567 - RNA, 18 nt, Human
auuuugguccaaguugug

SEQ ID NO: 1390568 - RNA, 15 nt, Human
auuuuaaagaccccu

SEQ ID NO: 1390569 - RNA, 17 nt, Human
auuugugacaaaaaauu

SEQ ID NO: 1390570 - RNA, 15 nt, Human
auuugugacaaaaaa

SEQ ID NO: 1390571 - RNA, 14 nt, Human
auuugugacaaaaa

SEQ ID NO: 1390572 - RNA, 14 nt, Human
auuugugauacaau

SEQ ID NO: 1390573 - RNA, 15 nt, Human
auuugugauacaaug

SEQ ID NO: 1390574 - RNA, 17 nt, Human
auuuguuuuuaaacugu

SEQ ID NO: 1390575 - RNA, 16 nt, Human
auuuguuuuuaaacug

SEQ ID NO: 1390576 - RNA, 18 nt, Human
auuuguuuuguuuacaga

SEQ ID NO: 1390577 - RNA, 16 nt, Human
auuuguuuuguuuaca

SEQ ID NO: 1390578 - RNA, 15 nt, Human
auuuguuuuguuuac

SEQ ID NO: 1390579 - RNA, 16 nt, Human
auuuguuuuggauaua

SEQ ID NO: 1390580 - RNA, 15 nt, Human
auuuguuuuggauau

SEQ ID NO: 1390581 - RNA, 21 nt, Human
auuuguuuuuaaacuguacag

SEQ ID NO: 1390582 - RNA, 22 nt, Human
auuuguuuuuaaacuguacagu

SEQ ID NO: 1390583 - RNA, 20 nt, Human
auuuguuuuuaaacuguaca

SEQ ID NO: 1390584 - RNA, 18 nt, Human
auuuguuuuuaaacugua

SEQ ID NO: 1390585 - RNA, 17 nt, Human
auuuuaaaagaaugauu

SEQ ID NO: 1390586 - RNA, 23 nt, Human
auuugaaucagccuacaggccuc

SEQ ID NO: 1390587 - RNA, 14 nt, Human
auuugaaucuuguc

SEQ ID NO: 1390588 - RNA, 15 nt, Human
auuugaaucuugucu

SEQ ID NO: 1390589 - RNA, 16 nt, Human
auuugaaucuugucuc

SEQ ID NO: 1390590 - RNA, 18 nt, Human
auuugaaucuugucucaa

SEQ ID NO: 1390591 - RNA, 20 nt, Human
auuugaaucuugucucaaug

SEQ ID NO: 1390592 - RNA, 22 nt, Human
auuugaaucuugucucaaugcu

SEQ ID NO: 1390593 - RNA, 14 nt, Human
auuugaaucagccu

SEQ ID NO: 1390594 - RNA, 13 nt, Human
auuugaaguguaa

SEQ ID NO: 1390595 - RNA, 21 nt, Human
auuuguauaaaauaauuuuua

SEQ ID NO: 1390596 - RNA, 19 nt, Human
auuuguauaaaauaauuuu

SEQ ID NO: 1390597 - RNA, 18 nt, Human
auuuguauaaaauaauuu

SEQ ID NO: 1390598 - RNA, 23 nt, Human
auuuuaauuauuauucuucauaa

SEQ ID NO: 1390599 - RNA, 17 nt, Human
auuuuacauaaauuuag

SEQ ID NO: 1390600 - RNA, 16 nt, Human
auuuuacauaaauuua

SEQ ID NO: 1390601 - RNA, 13 nt, Human
auuuuacaugaag

SEQ ID NO: 1390602 - RNA, 19 nt, Human
auuuuacaugaaguauuuu

SEQ ID NO: 1390603 - RNA, 14 nt, Human
auuuuacaugaagu

SEQ ID NO: 1390604 - RNA, 12 nt, Human
auuuuacauuaa

SEQ ID NO: 1390605 - RNA, 15 nt, Human
auuuuacauuaaauu

SEQ ID NO: 1390606 - RNA, 17 nt, Human
auuuuaccuuugacaaa

SEQ ID NO: 1390607 - RNA, 19 nt, Human
auuuuaauuauuauucuuc

SEQ ID NO: 1390608 - RNA, 13 nt, Human
auuuuaauuauua

SEQ ID NO: 1390609 - RNA, 12 nt, Human
auuuuaaagaca

SEQ ID NO: 1390610 - RNA, 17 nt, Human
auuuuaaagaauugugu

SEQ ID NO: 1390611 - RNA, 13 nt, Human
auuuuaaagaauu

SEQ ID NO: 1390612 - RNA, 12 nt, Human
auuuuaaagaau

SEQ ID NO: 1390613 - RNA, 15 nt, Human
auuuuaaacagagga

SEQ ID NO: 1390614 - RNA, 23 nt, Human
auuuuaaacacauuaggaaaagu

SEQ ID NO: 1390615 - RNA, 14 nt, Human
auuuuaaacacauu

SEQ ID NO: 1390616 - RNA, 13 nt, Human
auuuuaaacacau

SEQ ID NO: 1390617 - RNA, 15 nt, Human
auuuuaaaauuuguu

SEQ ID NO: 1390618 - RNA, 22 nt, Human
auuuuaaacaaagguugagaug

SEQ ID NO: 1390619 - RNA, 13 nt, Human
auuuuaaacaaag

SEQ ID NO: 1390620 - RNA, 22 nt, Human
auuuuaaaagaaugauuaugaa

SEQ ID NO: 1390621 - RNA, 18 nt, Human
auuuuaaaagaaugauua

SEQ ID NO: 1390622 - RNA, 17 nt, Human
auuuuaaaauuuguucu

SEQ ID NO: 1390623 - RNA, 14 nt, Human
auuuuaaaauuugu

SEQ ID NO: 1390624 - RNA, 13 nt, Human
auuuuaaaauuug

SEQ ID NO: 1390625 - RNA, 16 nt, Human
auuuuaaaaaaugguc

SEQ ID NO: 1390626 - RNA, 17 nt, Human
auuuuaaaaaaugguca

SEQ ID NO: 1390627 - RNA, 19 nt, Human
auuuucagcaaacucuuuu

SEQ ID NO: 1390628 - RNA, 18 nt, Human
auuuucagcaaacucuuu

SEQ ID NO: 1390629 - RNA, 17 nt, Human
auuuucagcaaacucuu

SEQ ID NO: 1390630 - RNA, 22 nt, Human
auuuucauaaguauuucaaauu

SEQ ID NO: 1390631 - RNA, 21 nt, Human
auuuucauaaguauuucaaau

SEQ ID NO: 1390632 - RNA, 20 nt, Human
auuuucauaaguauuucaaa

SEQ ID NO: 1390633 - RNA, 22 nt, Human
auuuucaguuauuauauuuaca

SEQ ID NO: 1390634 - RNA, 14 nt, Human
auuuuccaaaugua

SEQ ID NO: 1390635 - RNA, 14 nt, Human
auuuuccaaagagu

SEQ ID NO: 1390636 - RNA, 17 nt, Human
auuuucauccuugucuu

SEQ ID NO: 1390637 - RNA, 20 nt, Human
auuuuccuauauuacgguuu

SEQ ID NO: 1390638 - RNA, 21 nt, Human
auuuuccuaauaaaguucugu

SEQ ID NO: 1390639 - RNA, 21 nt, Human
auuuuccaggcuucugcuggg

SEQ ID NO: 1390640 - RNA, 15 nt, Human
auuuuccaggcuucu

SEQ ID NO: 1390641 - RNA, 17 nt, Human
auuuuccaaauguaaua

SEQ ID NO: 1390642 - RNA, 17 nt, Human
auuuucaauagccacua

SEQ ID NO: 1390643 - RNA, 20 nt, Human
auuuucaauagccacuaacc

SEQ ID NO: 1390644 - RNA, 16 nt, Human
auuuucaauagccacu

SEQ ID NO: 1390645 - RNA, 13 nt, Human
auuuucacuguag

SEQ ID NO: 1390646 - RNA, 24 nt, Human
auuuucaagaauaaucacgcuuuc

SEQ ID NO: 1390647 - RNA, 23 nt, Human
auuuucaagaaacugaggaauuu

SEQ ID NO: 1390648 - RNA, 22 nt, Human
auuuucaagaaacugaggaauu

SEQ ID NO: 1390649 - RNA, 17 nt, Human
auuuucaagaaacugag

SEQ ID NO: 1390650 - RNA, 16 nt, Human
auuuucaagaaacuga

SEQ ID NO: 1390651 - RNA, 14 nt, Human
auuuucaagaaacu

SEQ ID NO: 1390652 - RNA, 13 nt, Human
auuuucaagaaac

SEQ ID NO: 1390653 - RNA, 22 nt, Human
auuuucaaagcuuuuuccagag

SEQ ID NO: 1390654 - RNA, 17 nt, Human
auuuucaaagacuuaag

SEQ ID NO: 1390655 - RNA, 16 nt, Human
auuuucaaagacuuaa

SEQ ID NO: 1390656 - RNA, 21 nt, Human
auuuuagccuucucuguucau

SEQ ID NO: 1390657 - RNA, 18 nt, Human
auuuuagccuucucuguu

SEQ ID NO: 1390658 - RNA, 17 nt, Human
auuuuagccuucucugu

SEQ ID NO: 1390659 - RNA, 13 nt, Human
auuuuagcagaga

SEQ ID NO: 1390660 - RNA, 15 nt, Human
auuuucaaagacuua

SEQ ID NO: 1390661 - RNA, 16 nt, Human
auuuucaaaaccaggu

SEQ ID NO: 1390662 - RNA, 17 nt, Human
auuuucaaaaccagguc

SEQ ID NO: 1390663 - RNA, 15 nt, Human
auuuucaaaaccagg

SEQ ID NO: 1390664 - RNA, 21 nt, Human
auuuuauuuuuuucugaauua

SEQ ID NO: 1390665 - RNA, 23 nt, Human
auuuagaagccaacuaugauuau

SEQ ID NO: 1390666 - RNA, 22 nt, Human
auuuagaagccaacuaugauua

SEQ ID NO: 1390667 - RNA, 21 nt, Human
auuuagaagccaacuaugauu

SEQ ID NO: 1390668 - RNA, 13 nt, Human
auuuagaagccaa

SEQ ID NO: 1390669 - RNA, 12 nt, Human
auuuagaagcca

SEQ ID NO: 1390670 - RNA, 18 nt, Human
auuuagaaaacuuuaaag

SEQ ID NO: 1390671 - RNA, 23 nt, Human
auuuaaaaauaagucaacaguaa

SEQ ID NO: 1390672 - RNA, 22 nt, Human
auuuaaaaauaagucaacagua

SEQ ID NO: 1390673 - RNA, 19 nt, Human
auuuaaaaauaagucaaca

SEQ ID NO: 1390674 - RNA, 18 nt, Human
auuuaaaaauaagucaac

SEQ ID NO: 1390675 - RNA, 12 nt, Human
auuuaaaaauaa

SEQ ID NO: 1390676 - RNA, 22 nt, Human
auuuaaaaaacuaaaaacuaga

SEQ ID NO: 1390677 - RNA, 17 nt, Human
auuuaaaaaacuaaaaa

SEQ ID NO: 1390678 - RNA, 13 nt, Human
auuuaaaaaacua

SEQ ID NO: 1390679 - RNA, 13 nt, Human
auuuaacagaaau

SEQ ID NO: 1390680 - RNA, 15 nt, Human
auuuaacagaaaugu

SEQ ID NO: 1390681 - RNA, 14 nt, Human
auuuaacagaaaug

SEQ ID NO: 1390682 - RNA, 13 nt, Human
auuuaacaagauc

SEQ ID NO: 1390683 - RNA, 17 nt, Human
auuuaaauuuuuuuccu

SEQ ID NO: 1390684 - RNA, 23 nt, Human
auuuaaauguuaugacuauguaa

SEQ ID NO: 1390685 - RNA, 12 nt, Human
auuuaacagaaa

SEQ ID NO: 1390686 - RNA, 16 nt, Human
auuuagucaugugacc

SEQ ID NO: 1390687 - RNA, 18 nt, Human
auuuaguauuuuguuuca

SEQ ID NO: 1390688 - RNA, 20 nt, Human
auuuaguaucuuuuuauuca

SEQ ID NO: 1390689 - RNA, 21 nt, Human
auuuagugaucaaauugugca

SEQ ID NO: 1390690 - RNA, 13 nt, Human
auuuagugagcau

SEQ ID NO: 1390691 - RNA, 14 nt, Human
auuuagucauguga

SEQ ID NO: 1390692 - RNA, 13 nt, Human
auuuaguguucau

SEQ ID NO: 1390693 - RNA, 14 nt, Human
auuuagauuugugu

SEQ ID NO: 1390694 - RNA, 17 nt, Human
auuuagaugauaaagag

SEQ ID NO: 1390695 - RNA, 23 nt, Human
auuuagacuuggauucuuuccau

SEQ ID NO: 1390696 - RNA, 19 nt, Human
auuuagacuuggauucuuu

SEQ ID NO: 1390697 - RNA, 13 nt, Human
auuuagauguaua

SEQ ID NO: 1390698 - RNA, 16 nt, Human
auuuauaaaaaggugu

SEQ ID NO: 1390699 - RNA, 23 nt, Human
auuuaguuucaguagauugcaga

SEQ ID NO: 1390700 - RNA, 22 nt, Human
auuuaguuugauuauucagugu

SEQ ID NO: 1390701 - RNA, 15 nt, Human
auuuaguuugauuau

SEQ ID NO: 1390702 - RNA, 20 nt, Human
auuuaguuucaguagauugc

SEQ ID NO: 1390703 - RNA, 14 nt, Human
auuuaguuucagua

SEQ ID NO: 1390704 - RNA, 12 nt, Human
auuuaguuucag

SEQ ID NO: 1390705 - RNA, 15 nt, Human
auuuaguguauccau

SEQ ID NO: 1390706 - RNA, 17 nt, Human
auuuauaaaaauaaaaa

SEQ ID NO: 1390707 - RNA, 22 nt, Human
auuuauaaaaauaaaaaacacu

SEQ ID NO: 1390708 - RNA, 20 nt, Human
auuuauuaauauauauuauc

SEQ ID NO: 1390709 - RNA, 12 nt, Human
auuuauuaauau

SEQ ID NO: 1390710 - RNA, 23 nt, Human
auuuauaaaaauaaaaaacacug

SEQ ID NO: 1390711 - RNA, 22 nt, Human
auuuauucaauaaaguauuuaa

SEQ ID NO: 1390712 - RNA, 11 nt, Human
auuuauucaau

SEQ ID NO: 1390713 - RNA, 13 nt, Human
auuuauucaauaa

SEQ ID NO: 1390714 - RNA, 14 nt, Human
auuuauucaauaaa

SEQ ID NO: 1390715 - RNA, 15 nt, Human
auuuauucaauaaag

SEQ ID NO: 1390716 - RNA, 16 nt, Human
auuuauucaauaaagu

SEQ ID NO: 1390717 - RNA, 17 nt, Human
auuuauucaauaaagua

SEQ ID NO: 1390718 - RNA, 18 nt, Human
auuuauucaauaaaguau

SEQ ID NO: 1390719 - RNA, 21 nt, Human
auuuauucaauaaaguauuua

SEQ ID NO: 1390720 - RNA, 13 nt, Human
auuuccacugugc

SEQ ID NO: 1390721 - RNA, 18 nt, Human
auuucauuucaacuguuu

SEQ ID NO: 1390722 - RNA, 17 nt, Human
auuucaaauuggagcuu

SEQ ID NO: 1390723 - RNA, 16 nt, Human
auuucaaaaugcuuuu

SEQ ID NO: 1390724 - RNA, 21 nt, Human
auuucaaaaugcuuuuuauua

SEQ ID NO: 1390725 - RNA, 15 nt, Human
auuucaaaaugcuuu

SEQ ID NO: 1390726 - RNA, 14 nt, Human
auuucaaaaugcuu

SEQ ID NO: 1390727 - RNA, 13 nt, Human
auuucaaaaugcu

SEQ ID NO: 1390728 - RNA, 21 nt, Human
auuuauuuuaauaauguuuca

SEQ ID NO: 1390729 - RNA, 20 nt, Human
auuuauuuuaauaauguuuc

SEQ ID NO: 1390730 - RNA, 19 nt, Human
auuuauuuuaauaauguuu

SEQ ID NO: 1390731 - RNA, 21 nt, Human
auuucuagcuuaucuacuucc

SEQ ID NO: 1390732 - RNA, 18 nt, Human
auuucuagcuuaucuacu

SEQ ID NO: 1390733 - RNA, 16 nt, Human
auuucuagcuuaucua

SEQ ID NO: 1390734 - RNA, 18 nt, Human
auuucuacuuugaaguca

SEQ ID NO: 1390735 - RNA, 18 nt, Human
auuucuaccauuucagag

SEQ ID NO: 1390736 - RNA, 17 nt, Human
auuucuaccauuucaga

SEQ ID NO: 1390737 - RNA, 22 nt, Human
auuucuaauuauguagcucuuu

SEQ ID NO: 1390738 - RNA, 21 nt, Human
auuucuaauuauguagcucuu

SEQ ID NO: 1390739 - RNA, 17 nt, Human
auuuccguuaaaauacc

SEQ ID NO: 1390740 - RNA, 16 nt, Human
auuuccccuccuuccc

SEQ ID NO: 1390741 - RNA, 15 nt, Human
auuuccccuccuucc

SEQ ID NO: 1390742 - RNA, 15 nt, Human
auuuccguuaaaaua

SEQ ID NO: 1390743 - RNA, 16 nt, Human
auuuccguuaaaauac

SEQ ID NO: 1390744 - RNA, 22 nt, Human
auuucuuuuuuaaaugaagaaa

SEQ ID NO: 1390745 - RNA, 18 nt, Human
auuucuuuuuuaaaugaa

SEQ ID NO: 1390746 - RNA, 21 nt, Human
auuucuuuuugggagagacuu

SEQ ID NO: 1390747 - RNA, 20 nt, Human
auuucuuuuugggagagacu

SEQ ID NO: 1390748 - RNA, 23 nt, Human
auuucuuuuugggagagacuugu

SEQ ID NO: 1390749 - RNA, 21 nt, Human
auuucuuuuuuaaaugaagaa

SEQ ID NO: 1390750 - RNA, 14 nt, Human
auuugaaaauuuug

SEQ ID NO: 1390751 - RNA, 14 nt, Human
auuugaaauauuga

SEQ ID NO: 1390752 - RNA, 15 nt, Human
auuugaaaauuuuga

SEQ ID NO: 1390753 - RNA, 16 nt, Human
auuugaaauaagaauu

SEQ ID NO: 1390754 - RNA, 15 nt, Human
auuugaaauaagaau

SEQ ID NO: 1390755 - RNA, 16 nt, Human
auuugaagaacaugug

SEQ ID NO: 1390756 - RNA, 20 nt, Human
auuugaacuuuuuauugauu

SEQ ID NO: 1390757 - RNA, 14 nt, Human
auuugaaccaauaa

SEQ ID NO: 1390758 - RNA, 22 nt, Human
auugaaaauguccaggaaagug

SEQ ID NO: 1390759 - RNA, 16 nt, Human
auugggccagcuuuuc

SEQ ID NO: 1390760 - RNA, 15 nt, Human
auuggguaucaccac

SEQ ID NO: 1390761 - RNA, 14 nt, Human
auugggguuauuuu

SEQ ID NO: 1390762 - RNA, 12 nt, Human
auugggguuauu

SEQ ID NO: 1390763 - RNA, 13 nt, Human
auugggguaguug

SEQ ID NO: 1390764 - RNA, 17 nt, Human
auugggggaggaaaagu

SEQ ID NO: 1390765 - RNA, 22 nt, Human
auucuuuuauacucagcuuucu

SEQ ID NO: 1390766 - RNA, 21 nt, Human
auucuucucuuccuuuuauca

SEQ ID NO: 1390767 - RNA, 15 nt, Human
auucuucucuuccuu

SEQ ID NO: 1390768 - RNA, 16 nt, Human
auucuucucuguuguc

SEQ ID NO: 1390769 - RNA, 15 nt, Human
auucuucucuguugu

SEQ ID NO: 1390770 - RNA, 14 nt, Human
auucuucuagaguu

SEQ ID NO: 1390771 - RNA, 13 nt, Human
auucuucuagagu

SEQ ID NO: 1390772 - RNA, 12 nt, Human
auucuucuagag

SEQ ID NO: 1390773 - RNA, 16 nt, Human
auucugguuccagggu

SEQ ID NO: 1390774 - RNA, 16 nt, Human
auucugggggcugcag

SEQ ID NO: 1390775 - RNA, 16 nt, Human
auucuggaccucuggg

SEQ ID NO: 1390776 - RNA, 12 nt, Human
auucuggaccuc

SEQ ID NO: 1390777 - RNA, 15 nt, Human
auucuggacaggaug

SEQ ID NO: 1390778 - RNA, 22 nt, Human
auucuggacaggauguguuugc

SEQ ID NO: 1390779 - RNA, 19 nt, Human
auucugcuggccucugcga

SEQ ID NO: 1390780 - RNA, 18 nt, Human
auucugcuggccucugcg

SEQ ID NO: 1390781 - RNA, 16 nt, Human
auucugcuggccucug

SEQ ID NO: 1390782 - RNA, 13 nt, Human
auucugcuggccu

SEQ ID NO: 1390783 - RNA, 13 nt, Human
auucugcuccuuc

SEQ ID NO: 1390784 - RNA, 23 nt, Human
auucugcaguaaaucuuuuacaa

SEQ ID NO: 1390785 - RNA, 21 nt, Human
auucugcaguaaaucuuuuac

SEQ ID NO: 1390786 - RNA, 20 nt, Human
auucugcaguaaaucuuuua

SEQ ID NO: 1390787 - RNA, 18 nt, Human
auucugcaguaaaucuuu

SEQ ID NO: 1390788 - RNA, 17 nt, Human
auucugcaguaaaucuu

SEQ ID NO: 1390789 - RNA, 14 nt, Human
auucugcaaguaua

SEQ ID NO: 1390790 - RNA, 17 nt, Human
auucuccuuguguuacu

SEQ ID NO: 1390791 - RNA, 18 nt, Human
auucugucccuagguguu

SEQ ID NO: 1390792 - RNA, 17 nt, Human
auucugggggcugcagu

SEQ ID NO: 1390793 - RNA, 19 nt, Human
auucugguuccaggguccc

SEQ ID NO: 1390794 - RNA, 20 nt, Human
auucugugccuuguuuuuug

SEQ ID NO: 1390795 - RNA, 14 nt, Human
auucugucuugaag

SEQ ID NO: 1390796 - RNA, 24 nt, Human
auucugucucuggauuauauuaug

SEQ ID NO: 1390797 - RNA, 14 nt, Human
auuuaaaacagaca

SEQ ID NO: 1390798 - RNA, 18 nt, Human
auugugcaauguaaauau

SEQ ID NO: 1390799 - RNA, 17 nt, Human
auugugcaauguaaaua

SEQ ID NO: 1390800 - RNA, 15 nt, Human
auugugcaauguaaa

SEQ ID NO: 1390801 - RNA, 16 nt, Human
auugugauuggccugu

SEQ ID NO: 1390802 - RNA, 15 nt, Human
auugugauuggccug

SEQ ID NO: 1390803 - RNA, 23 nt, Human
auugugauuagacagaacaccua

SEQ ID NO: 1390804 - RNA, 22 nt, Human
auugugcaauguguauaaacaa

SEQ ID NO: 1390805 - RNA, 21 nt, Human
auugugcaauguguauaaaca

SEQ ID NO: 1390806 - RNA, 18 nt, Human
auugugcaauguguauaa

SEQ ID NO: 1390807 - RNA, 17 nt, Human
auugugcaauguguaua

SEQ ID NO: 1390808 - RNA, 16 nt, Human
auugugcaauguguau

SEQ ID NO: 1390809 - RNA, 15 nt, Human
auugugcaaugugua

SEQ ID NO: 1390810 - RNA, 20 nt, Human
auugugcaauguaaauauuu

SEQ ID NO: 1390811 - RNA, 20 nt, Human
auugugcaguacuuugugca

SEQ ID NO: 1390812 - RNA, 17 nt, Human
auugugucagacuguuu

SEQ ID NO: 1390813 - RNA, 22 nt, Human
auuguguagccuuuuuguauaa

SEQ ID NO: 1390814 - RNA, 18 nt, Human
auuguguagccuuuuugu

SEQ ID NO: 1390815 - RNA, 16 nt, Human
auuguguagccuuuuu

SEQ ID NO: 1390816 - RNA, 15 nt, Human
auuguguagccuuuu

SEQ ID NO: 1390817 - RNA, 14 nt, Human
auuguguagccuuu

SEQ ID NO: 1390818 - RNA, 21 nt, Human
auugugguuuauauauuuaaa

SEQ ID NO: 1390819 - RNA, 20 nt, Human
auugugguuuauauauuuaa

SEQ ID NO: 1390820 - RNA, 23 nt, Human
auugugaucagaccauaauguua

SEQ ID NO: 1390821 - RNA, 18 nt, Human
auugugauucugccuuug

SEQ ID NO: 1390822 - RNA, 22 nt, Human
auugugauuagacagaacaccu

SEQ ID NO: 1390823 - RNA, 16 nt, Human
auugugauuagacaga

SEQ ID NO: 1390824 - RNA, 18 nt, Human
auuguccaauccuauguu

SEQ ID NO: 1390825 - RNA, 18 nt, Human
auugguguuuuuuucuau

SEQ ID NO: 1390826 - RNA, 23 nt, Human
auuguauuuauucaauaaaguau

SEQ ID NO: 1390827 - RNA, 16 nt, Human
auuguauuuauucaau

SEQ ID NO: 1390828 - RNA, 18 nt, Human
auuguauuuauucaauaa

SEQ ID NO: 1390829 - RNA, 19 nt, Human
auuguauuuauucaauaaa

SEQ ID NO: 1390830 - RNA, 20 nt, Human
auuguauuuauucaauaaag

SEQ ID NO: 1390831 - RNA, 12 nt, Human
auuguauucugg

SEQ ID NO: 1390832 - RNA, 11 nt, Human
auuguauuuau

SEQ ID NO: 1390833 - RNA, 14 nt, Human
auuguauuuauuca

SEQ ID NO: 1390834 - RNA, 13 nt, Human
auuguauucagag

SEQ ID NO: 1390835 - RNA, 19 nt, Human
auugguguaagguacuuuc

SEQ ID NO: 1390836 - RNA, 18 nt, Human
aaaaacagguauauacuu

SEQ ID NO: 1390837 - RNA, 12 nt, Human
aaaaacaggcac

SEQ ID NO: 1390838 - RNA, 19 nt, Human
aaaaacagguauauacuuu

SEQ ID NO: 1390839 - RNA, 21 nt, Human
aaaaacagguauauacuuuga

SEQ ID NO: 1390840 - RNA, 15 nt, Human
aaaaacugagugacu

SEQ ID NO: 1390841 - RNA, 18 nt, Human
aaaaagaagcaaccucag

SEQ ID NO: 1390842 - RNA, 21 nt, Human
aaaaacuuuggaaccagacuc

SEQ ID NO: 1390843 - RNA, 14 nt, Human
aaaaagaagugcug

SEQ ID NO: 1390844 - RNA, 20 nt, Human
aaaaacuuuggaaccagacu

SEQ ID NO: 1390845 - RNA, 17 nt, Human
aaaaagaaugaagccuc

SEQ ID NO: 1390846 - RNA, 14 nt, Human
aaaaagaucccaaa

SEQ ID NO: 1390847 - RNA, 11 nt, Human
aaaaagauccc

SEQ ID NO: 1390848 - RNA, 19 nt, Human
aaaaagauaaacacaagau

SEQ ID NO: 1390849 - RNA, 13 nt, Human
aaaaagauaaaca

SEQ ID NO: 1390850 - RNA, 15 nt, Human
aaaaauugcugacug

SEQ ID NO: 1390851 - RNA, 14 nt, Human
aaaaauugaaaugu

SEQ ID NO: 1390852 - RNA, 22 nt, Human
aaaaauugaaauguaaggcugu

SEQ ID NO: 1390853 - RNA, 13 nt, Human
aaaaauugaaaug

SEQ ID NO: 1390854 - RNA, 20 nt, Human
aaaaauucagcaaagugguu

SEQ ID NO: 1390855 - RNA, 21 nt, Human
aaaaauuguuaauuuuuccua

SEQ ID NO: 1390856 - RNA, 14 nt, Human
aaaaauugugauca

SEQ ID NO: 1390857 - RNA, 23 nt, Human
aaaaauugcugacuguagcuuug

SEQ ID NO: 1390858 - RNA, 21 nt, Human
aaaaauugcugacuguagcuu

SEQ ID NO: 1390859 - RNA, 22 nt, Human
aaaacaacuauggaucagaaua

SEQ ID NO: 1390860 - RNA, 17 nt, Human
aaaacaaggaugaauua

SEQ ID NO: 1390861 - RNA, 12 nt, Human
aaaacacauuuu

SEQ ID NO: 1390862 - RNA, 15 nt, Human
aaaacaaacucauuc

SEQ ID NO: 1390863 - RNA, 15 nt, Human
aaaacaaaacugcau

SEQ ID NO: 1390864 - RNA, 14 nt, Human
aaaacaaggaugaa

SEQ ID NO: 1390865 - RNA, 20 nt, Human
acagggggucuggcuggugu

SEQ ID NO: 1390866 - RNA, 19 nt, Human
acagggggucuggcuggug

SEQ ID NO: 1390867 - RNA, 18 nt, Human
acagggggucuggcuggu

SEQ ID NO: 1390868 - RNA, 17 nt, Human
acagggggucuggcugg

SEQ ID NO: 1390869 - RNA, 16 nt, Human
acagggggucuggcug

SEQ ID NO: 1390870 - RNA, 15 nt, Human
acagggggucuggcu

SEQ ID NO: 1390871 - RNA, 13 nt, Human
acagggggucugg

SEQ ID NO: 1390872 - RNA, 21 nt, Human
acagggggucuggcugguguu

SEQ ID NO: 1390873 - RNA, 14 nt, Human
acaggggcuugacu

SEQ ID NO: 1390874 - RNA, 13 nt, Human
acaggucccuccc

SEQ ID NO: 1390875 - RNA, 13 nt, Human
acaggucccaaau

SEQ ID NO: 1390876 - RNA, 19 nt, Human
acagguauauacuuugaaa

SEQ ID NO: 1390877 - RNA, 16 nt, Human
acagguauauacuuug

SEQ ID NO: 1390878 - RNA, 22 nt, Human
acagguagaauuaucuaauuua

SEQ ID NO: 1390879 - RNA, 15 nt, Human
acagguaauauaaaa

SEQ ID NO: 1390880 - RNA, 18 nt, Human
acagguaaacuaucuugg

SEQ ID NO: 1390881 - RNA, 18 nt, Human
acagggucccacagccac

SEQ ID NO: 1390882 - RNA, 13 nt, Human
acaggucuagacu

SEQ ID NO: 1390883 - RNA, 15 nt, Human
acaggucccuccccu

SEQ ID NO: 1390884 - RNA, 13 nt, Human
acagcucuagaca

SEQ ID NO: 1390885 - RNA, 16 nt, Human
acagccagcaccuggc

SEQ ID NO: 1390886 - RNA, 13 nt, Human
acagccagcaccu

SEQ ID NO: 1390887 - RNA, 22 nt, Human
acagcauguacggauuuucagu

SEQ ID NO: 1390888 - RNA, 21 nt, Human
acagcauguacggauuuucag

SEQ ID NO: 1390889 - RNA, 22 nt, Human
acagcaucuccaagcagcuuag

SEQ ID NO: 1390890 - RNA, 20 nt, Human
acagcaucuccaagcagcuu

SEQ ID NO: 1390891 - RNA, 15 nt, Human
acagcaucuccaagc

SEQ ID NO: 1390892 - RNA, 17 nt, Human
acagaaguuugcacuau

SEQ ID NO: 1390893 - RNA, 15 nt, Human
acagaaguuugcacu

SEQ ID NO: 1390894 - RNA, 14 nt, Human
acagcaucuccaag

SEQ ID NO: 1390895 - RNA, 11 nt, Human
acagcaucucc

SEQ ID NO: 1390896 - RNA, 22 nt, Human
acacugaugcuuagauguucca

SEQ ID NO: 1390897 - RNA, 20 nt, Human
acacugcucuaacagcccuc

SEQ ID NO: 1390898 - RNA, 19 nt, Human
acacugcucuaacagcccu

SEQ ID NO: 1390899 - RNA, 17 nt, Human
acacugcucuaacagcc

SEQ ID NO: 1390900 - RNA, 14 nt, Human
acacugcucuaaca

SEQ ID NO: 1390901 - RNA, 13 nt, Human
acacugcucuaac

SEQ ID NO: 1390902 - RNA, 18 nt, Human
acacugugcacaucugug

SEQ ID NO: 1390903 - RNA, 21 nt, Human
acacugugcacaucugugucu

SEQ ID NO: 1390904 - RNA, 20 nt, Human
acacugugcacaucuguguc

SEQ ID NO: 1390905 - RNA, 23 nt, Human
acagaaauuguauauuguaauuu

SEQ ID NO: 1390906 - RNA, 12 nt, Human
acagaaauuuaa

SEQ ID NO: 1390907 - RNA, 19 nt, Human
acagaaauuguauauugua

SEQ ID NO: 1390908 - RNA, 16 nt, Human
acagaaauuguauauu

SEQ ID NO: 1390909 - RNA, 15 nt, Human
acagaaauuguauau

SEQ ID NO: 1390910 - RNA, 14 nt, Human
acagaaauuguaua

SEQ ID NO: 1390911 - RNA, 12 nt, Human
acagaacacuua

SEQ ID NO: 1390912 - RNA, 13 nt, Human
acagaacacuuau

SEQ ID NO: 1390913 - RNA, 14 nt, Human
acagaagaaacaag

SEQ ID NO: 1390914 - RNA, 15 nt, Human
acagaagaaacuggg

SEQ ID NO: 1390915 - RNA, 23 nt, Human
acacuaaccaagcugaguuuccu

SEQ ID NO: 1390916 - RNA, 22 nt, Human
acacuaaccaagcugaguuucc

SEQ ID NO: 1390917 - RNA, 16 nt, Human
acacuaaccaagcuga

SEQ ID NO: 1390918 - RNA, 23 nt, Human
acacagacugcgauuugucccag

SEQ ID NO: 1390919 - RNA, 14 nt, Human
acacagacuauuuu

SEQ ID NO: 1390920 - RNA, 21 nt, Human
acacagaaaccuuuuuaaaaa

SEQ ID NO: 1390921 - RNA, 19 nt, Human
acacagaaaccuuuuuaaa

SEQ ID NO: 1390922 - RNA, 18 nt, Human
acacagaaaccuuuuuaa

SEQ ID NO: 1390923 - RNA, 13 nt, Human
acacagaaaccuu

SEQ ID NO: 1390924 - RNA, 14 nt, Human
acacagaaaccaau

SEQ ID NO: 1390925 - RNA, 23 nt, Human
acacagcuacucuccccacgagg

SEQ ID NO: 1390926 - RNA, 17 nt, Human
acacagcuacucucccc

SEQ ID NO: 1390927 - RNA, 20 nt, Human
acaccacucuggcagccaca

SEQ ID NO: 1390928 - RNA, 18 nt, Human
acaccacucuggcagcca

SEQ ID NO: 1390929 - RNA, 22 nt, Human
acaccacucuggcagccacacu

SEQ ID NO: 1390930 - RNA, 17 nt, Human
acaccacucuggcagcc

SEQ ID NO: 1390931 - RNA, 16 nt, Human
acaccacucuggcagc

SEQ ID NO: 1390932 - RNA, 13 nt, Human
acaccacucuggc

SEQ ID NO: 1390933 - RNA, 13 nt, Human
acaccacuagccu

SEQ ID NO: 1390934 - RNA, 14 nt, Human
acaccacuacauuc

SEQ ID NO: 1390935 - RNA, 17 nt, Human
acacgcuuuugugaugg

SEQ ID NO: 1390936 - RNA, 14 nt, Human
acacgcuuuuguga

SEQ ID NO: 1390937 - RNA, 12 nt, Human
acacgcuuuugu

SEQ ID NO: 1390938 - RNA, 14 nt, Human
acaaugugucugag

SEQ ID NO: 1390939 - RNA, 19 nt, Human
acaauuaaagcuguuauuu

SEQ ID NO: 1390940 - RNA, 16 nt, Human
acaauuaaagcuguua

SEQ ID NO: 1390941 - RNA, 17 nt, Human
acaauguuuaaaccuuu

SEQ ID NO: 1390942 - RNA, 15 nt, Human
acaauuuauuauggc

SEQ ID NO: 1390943 - RNA, 22 nt, Human
acaauuuggcaauuuugugguu

SEQ ID NO: 1390944 - RNA, 20 nt, Human
acaauuuggcaauuuugugg

SEQ ID NO: 1390945 - RNA, 18 nt, Human
acaauuuggcaauuuugu

SEQ ID NO: 1390946 - RNA, 14 nt, Human
acaauuuggcaauu

SEQ ID NO: 1390947 - RNA, 16 nt, Human
acaauuuauuauggca

SEQ ID NO: 1390948 - RNA, 19 nt, Human
acacaaacuguaaauaaaa

SEQ ID NO: 1390949 - RNA, 16 nt, Human
acacaaacuguaaaua

SEQ ID NO: 1390950 - RNA, 15 nt, Human
acacaaacuguaaau

SEQ ID NO: 1390951 - RNA, 14 nt, Human
acacaaacuguaaa

SEQ ID NO: 1390952 - RNA, 14 nt, Human
acacaaacacacac

SEQ ID NO: 1390953 - RNA, 12 nt, Human
acaaagaaccuu

SEQ ID NO: 1390954 - RNA, 15 nt, Human
acaaagacccuggcu

SEQ ID NO: 1390955 - RNA, 13 nt, Human
acaaagacugagu

SEQ ID NO: 1390956 - RNA, 16 nt, Human
acaaagaguucaagaa

SEQ ID NO: 1390957 - RNA, 13 nt, Human
acaacuauauugu

SEQ ID NO: 1390958 - RNA, 14 nt, Human
acaaaccaugcaaa

SEQ ID NO: 1390959 - RNA, 20 nt, Human
acaaaauggaauacucuuau

SEQ ID NO: 1390960 - RNA, 20 nt, Human
aauuuugaagugcuguuuau

SEQ ID NO: 1390961 - RNA, 19 nt, Human
aauuuugaagugcuguuua

SEQ ID NO: 1390962 - RNA, 14 nt, Human
aauuuugaagugcu

SEQ ID NO: 1390963 - RNA, 12 nt, Human
aauuuucuuuca

SEQ ID NO: 1390964 - RNA, 17 nt, Human
aauuuugaguugccaca

SEQ ID NO: 1390965 - RNA, 19 nt, Human
acaaaauggaauacucuua

SEQ ID NO: 1390966 - RNA, 16 nt, Human
aauuauaauauacuau

SEQ ID NO: 1390967 - RNA, 20 nt, Human
aauuauaacuguaaagaugu

SEQ ID NO: 1390968 - RNA, 19 nt, Human
aauuauaacuggaaagaag

SEQ ID NO: 1390969 - RNA, 18 nt, Human
aauuauaacuggaaagaa

SEQ ID NO: 1390970 - RNA, 13 nt, Human
aauuauaaaugac

SEQ ID NO: 1390971 - RNA, 15 nt, Human
aauuuuaguuuuuca

SEQ ID NO: 1390972 - RNA, 14 nt, Human
aauuuuaguuuuuc

SEQ ID NO: 1390973 - RNA, 14 nt, Human
aauuuuagcuuuug

SEQ ID NO: 1390974 - RNA, 19 nt, Human
aauuuuaguagagacaggg

SEQ ID NO: 1390975 - RNA, 15 nt, Human
aauuuuagcuuuugu

SEQ ID NO: 1390976 - RNA, 20 nt, Human
aauuuuaucccucaccugua

SEQ ID NO: 1390977 - RNA, 14 nt, Human
aauuuuaucccuca

SEQ ID NO: 1390978 - RNA, 21 nt, Human
aauuuuauacuuucccuaccc

SEQ ID NO: 1390979 - RNA, 20 nt, Human
aauuuuauacuuucccuacc

SEQ ID NO: 1390980 - RNA, 15 nt, Human
aauuuuauaaucugc

SEQ ID NO: 1390981 - RNA, 16 nt, Human
aauuuuaguuuuucau

SEQ ID NO: 1390982 - RNA, 18 nt, Human
aauuuuaguuuuucauua

SEQ ID NO: 1390983 - RNA, 13 nt, Human
aauuuugaaaaac

SEQ ID NO: 1390984 - RNA, 15 nt, Human
acaaguaacaaaaau

SEQ ID NO: 1390985 - RNA, 14 nt, Human
acaaguaacaaaaa

SEQ ID NO: 1390986 - RNA, 13 nt, Human
acaaguaacaaaa

SEQ ID NO: 1390987 - RNA, 22 nt, Human
acaacuugucuauuaccuguua

SEQ ID NO: 1390988 - RNA, 17 nt, Human
acaacuucuaauugcca

SEQ ID NO: 1390989 - RNA, 17 nt, Human
acaacucacuccuuuua

SEQ ID NO: 1390990 - RNA, 16 nt, Human
acaacucacuccuuuu

SEQ ID NO: 1390991 - RNA, 16 nt, Human
acaacuauuuucagau

SEQ ID NO: 1390992 - RNA, 20 nt, Human
acaacuauuuucagauguga

SEQ ID NO: 1390993 - RNA, 15 nt, Human
acaacuauuuucaga

SEQ ID NO: 1390994 - RNA, 13 nt, Human
acaacuauuuuca

SEQ ID NO: 1390995 - RNA, 18 nt, Human
acaaagaguucaagaaau

SEQ ID NO: 1390996 - RNA, 17 nt, Human
acaacuauggaucagaa

SEQ ID NO: 1390997 - RNA, 23 nt, Human
acaagucauagguuaauauuuaa

SEQ ID NO: 1390998 - RNA, 15 nt, Human
acaaguauuuuuaau

SEQ ID NO: 1390999 - RNA, 12 nt, Human
acaaguauuuuu

SEQ ID NO: 1391000 - RNA, 22 nt, Human
acaaguauuuguuaauuuagaa

SEQ ID NO: 1391001 - RNA, 20 nt, Human
acaaguauuuguuaauuuag

SEQ ID NO: 1391002 - RNA, 17 nt, Human
acaaguauuuguuaauu

SEQ ID NO: 1391003 - RNA, 14 nt, Human
acaaguauuuguua

SEQ ID NO: 1391004 - RNA, 20 nt, Human
acaagucagucauucagaua

SEQ ID NO: 1391005 - RNA, 18 nt, Human
accacgccucuugaccag

SEQ ID NO: 1391006 - RNA, 23 nt, Human
accacgcccguccugccuguggc

SEQ ID NO: 1391007 - RNA, 21 nt, Human
accacgcccguccugccugug

SEQ ID NO: 1391008 - RNA, 20 nt, Human
accacgcccguccugccugu

SEQ ID NO: 1391009 - RNA, 19 nt, Human
accacgcccguccugccug

SEQ ID NO: 1391010 - RNA, 18 nt, Human
accacgcccguccugccu

SEQ ID NO: 1391011 - RNA, 19 nt, Human
accaagcugaguuuccuau

SEQ ID NO: 1391012 - RNA, 14 nt, Human
accaagcugcugug

SEQ ID NO: 1391013 - RNA, 18 nt, Human
accaagcugaguuuccua

SEQ ID NO: 1391014 - RNA, 17 nt, Human
accaagcugaguuuccu

SEQ ID NO: 1391015 - RNA, 14 nt, Human
accaagcugaguuu

SEQ ID NO: 1391016 - RNA, 22 nt, Human
accacgccucuugaccaggcug

SEQ ID NO: 1391017 - RNA, 13 nt, Human
accacgccuggcu

SEQ ID NO: 1391018 - RNA, 20 nt, Human
accacgccuggcuaauuuuu

SEQ ID NO: 1391019 - RNA, 14 nt, Human
accacuacauucug

SEQ ID NO: 1391020 - RNA, 15 nt, Human
accacguuucuaaag

SEQ ID NO: 1391021 - RNA, 19 nt, Human
accacguuucuaaaggcua

SEQ ID NO: 1391022 - RNA, 15 nt, Human
accacuacauucugu

SEQ ID NO: 1391023 - RNA, 21 nt, Human
acauuugggaguuuuuaugag

SEQ ID NO: 1391024 - RNA, 20 nt, Human
acauuugggaguuuuuauga

SEQ ID NO: 1391025 - RNA, 21 nt, Human
acauuugggagacaugugaca

SEQ ID NO: 1391026 - RNA, 20 nt, Human
acauuugggagacaugugac

SEQ ID NO: 1391027 - RNA, 19 nt, Human
acauuugggagacauguga

SEQ ID NO: 1391028 - RNA, 21 nt, Human
acauuuguagcauccucuuua

SEQ ID NO: 1391029 - RNA, 17 nt, Human
acauuugggagacaugu

SEQ ID NO: 1391030 - RNA, 20 nt, Human
acauuuggaguguuccccuu

SEQ ID NO: 1391031 - RNA, 15 nt, Human
acauuuggaguguuc

SEQ ID NO: 1391032 - RNA, 19 nt, Human
acauuugcuuuuugugaua

SEQ ID NO: 1391033 - RNA, 18 nt, Human
acauuuggaauacuuuuu

SEQ ID NO: 1391034 - RNA, 17 nt, Human
acauuuggaauacuuuu

SEQ ID NO: 1391035 - RNA, 16 nt, Human
acauuuggaauacuuu

SEQ ID NO: 1391036 - RNA, 15 nt, Human
acauuuggaauacuu

SEQ ID NO: 1391037 - RNA, 22 nt, Human
accaacuccuaguucuagaaaa

SEQ ID NO: 1391038 - RNA, 23 nt, Human
accaacuccuaguucuagaaaaa

SEQ ID NO: 1391039 - RNA, 17 nt, Human
accaacuccuaguucua

SEQ ID NO: 1391040 - RNA, 14 nt, Human
acauuuguauaaaa

SEQ ID NO: 1391041 - RNA, 12 nt, Human
acauuuggaaua

SEQ ID NO: 1391042 - RNA, 23 nt, Human
acauuugcuuuuugugauaugca

SEQ ID NO: 1391043 - RNA, 23 nt, Human
acauuugcuguuuuaaacauuaa

SEQ ID NO: 1391044 - RNA, 22 nt, Human
acauuugcuguuuuaaacauua

SEQ ID NO: 1391045 - RNA, 18 nt, Human
acauuugcucauggaauu

SEQ ID NO: 1391046 - RNA, 22 nt, Human
acauuaaagaaggguugagcug

SEQ ID NO: 1391047 - RNA, 11 nt, Human
acauuaaagaa

SEQ ID NO: 1391048 - RNA, 20 nt, Human
acauguuguaagcacugacu

SEQ ID NO: 1391049 - RNA, 20 nt, Human
acauguugggaaacuuggcu

SEQ ID NO: 1391050 - RNA, 14 nt, Human
acauguuauuugua

SEQ ID NO: 1391051 - RNA, 19 nt, Human
acaugcaaggucauuuuuu

SEQ ID NO: 1391052 - RNA, 20 nt, Human
acauaaauuuaguauuuugu

SEQ ID NO: 1391053 - RNA, 20 nt, Human
acauaaaggaaaagacacau

SEQ ID NO: 1391054 - RNA, 22 nt, Human
acauaaaggaaaagacacauuu

SEQ ID NO: 1391055 - RNA, 18 nt, Human
acauaaaggaaaagacac

SEQ ID NO: 1391056 - RNA, 17 nt, Human
acauaaaggaaaagaca

SEQ ID NO: 1391057 - RNA, 16 nt, Human
acauaaaggaaaagac

SEQ ID NO: 1391058 - RNA, 14 nt, Human
acauaaaggaaaag

SEQ ID NO: 1391059 - RNA, 15 nt, Human
acauaaaguugauaa

SEQ ID NO: 1391060 - RNA, 12 nt, Human
acauaaaguuga

SEQ ID NO: 1391061 - RNA, 20 nt, Human
acaucagcacgauuucuguu

SEQ ID NO: 1391062 - RNA, 21 nt, Human
acaucagcacgauuucuguuu

SEQ ID NO: 1391063 - RNA, 22 nt, Human
acaucagcacgauuucuguuua

SEQ ID NO: 1391064 - RNA, 17 nt, Human
acaucuaaccucaucuu

SEQ ID NO: 1391065 - RNA, 16 nt, Human
acaucuaaccucaucu

SEQ ID NO: 1391066 - RNA, 15 nt, Human
acaucggaaaaauaa

SEQ ID NO: 1391067 - RNA, 14 nt, Human
acaucggaaaaaua

SEQ ID NO: 1391068 - RNA, 14 nt, Human
acaucccacugcca

SEQ ID NO: 1391069 - RNA, 20 nt, Human
acaucccacucacaacagcu

SEQ ID NO: 1391070 - RNA, 12 nt, Human
acauccagcaga

SEQ ID NO: 1391071 - RNA, 18 nt, Human
acagguuauaacaguguu

SEQ ID NO: 1391072 - RNA, 15 nt, Human
acagguuauaacagu

SEQ ID NO: 1391073 - RNA, 15 nt, Human
acagguuagcugcuc

SEQ ID NO: 1391074 - RNA, 12 nt, Human
acauaaaggaaa

SEQ ID NO: 1391075 - RNA, 19 nt, Human
acauaaaaaugaucuaaac

SEQ ID NO: 1391076 - RNA, 20 nt, Human
acauaaaaaggacaucagca

SEQ ID NO: 1391077 - RNA, 21 nt, Human
acauaaaaaggacaucagcaa

SEQ ID NO: 1391078 - RNA, 22 nt, Human
acauaaaaaggacaucagcaaa

SEQ ID NO: 1391079 - RNA, 23 nt, Human
acauaaacaagaccacguuucua

SEQ ID NO: 1391080 - RNA, 15 nt, Human
acauaaaaaggacau

SEQ ID NO: 1391081 - RNA, 16 nt, Human
accccuacaugaaaca

SEQ ID NO: 1391082 - RNA, 14 nt, Human
acccaauccaaaug

SEQ ID NO: 1391083 - RNA, 13 nt, Human
acccaauccaaau

SEQ ID NO: 1391084 - RNA, 18 nt, Human
acccaagguaccauccua

SEQ ID NO: 1391085 - RNA, 23 nt, Human
acccaaggggauuuuuaugucug

SEQ ID NO: 1391086 - RNA, 21 nt, Human
acccaugaguuggggucuggc

SEQ ID NO: 1391087 - RNA, 20 nt, Human
acccaugaguuggggucugg

SEQ ID NO: 1391088 - RNA, 23 nt, Human
accccaaacaccuuccagcuccu

SEQ ID NO: 1391089 - RNA, 20 nt, Human
accccaaacaccuuccagcu

SEQ ID NO: 1391090 - RNA, 18 nt, Human
accccaaacaccuuccag

SEQ ID NO: 1391091 - RNA, 16 nt, Human
accccaaacaccuucc

SEQ ID NO: 1391092 - RNA, 17 nt, Human
acccauuuuuccuuuug

SEQ ID NO: 1391093 - RNA, 15 nt, Human
accccaaccugcucu

SEQ ID NO: 1391094 - RNA, 14 nt, Human
accccaaccugcuc

SEQ ID NO: 1391095 - RNA, 13 nt, Human
accccaaccugcu

SEQ ID NO: 1391096 - RNA, 18 nt, Human
accccaaagcuuuccugc

SEQ ID NO: 1391097 - RNA, 17 nt, Human
accccaaagcuuuccug

SEQ ID NO: 1391098 - RNA, 15 nt, Human
accccaaagcuuucc

SEQ ID NO: 1391099 - RNA, 14 nt, Human
accccgccugcccu

SEQ ID NO: 1391100 - RNA, 20 nt, Human
accccgcagacaccuuggac

SEQ ID NO: 1391101 - RNA, 18 nt, Human
accccgcagacaccuugg

SEQ ID NO: 1391102 - RNA, 17 nt, Human
accccgcagacaccuug

SEQ ID NO: 1391103 - RNA, 15 nt, Human
accccgcagacaccu

SEQ ID NO: 1391104 - RNA, 15 nt, Human
accccgacuuuuguu

SEQ ID NO: 1391105 - RNA, 12 nt, Human
accccgacuuuu

SEQ ID NO: 1391106 - RNA, 19 nt, Human
accccgccugcccucaugg

SEQ ID NO: 1391107 - RNA, 13 nt, Human
accccggggugag

SEQ ID NO: 1391108 - RNA, 23 nt, Human
accccggggugcccacaggccgc

SEQ ID NO: 1391109 - RNA, 21 nt, Human
accccggggugcccacaggcc

SEQ ID NO: 1391110 - RNA, 20 nt, Human
accccggggugcccacaggc

SEQ ID NO: 1391111 - RNA, 12 nt, Human
accccuaggacu

SEQ ID NO: 1391112 - RNA, 21 nt, Human
accccuaaaagaaacccugca

SEQ ID NO: 1391113 - RNA, 22 nt, Human
accccuaaaagaaacccugcac

SEQ ID NO: 1391114 - RNA, 19 nt, Human
agaaaggacuccugaaaaa

SEQ ID NO: 1391115 - RNA, 22 nt, Human
agaaaggaagcauuguaaaaua

SEQ ID NO: 1391116 - RNA, 21 nt, Human
agaaaggaagcauuguaaaau

SEQ ID NO: 1391117 - RNA, 19 nt, Human
agaaaggaagcauuguaaa

SEQ ID NO: 1391118 - RNA, 17 nt, Human
agaaacaacucuuugag

SEQ ID NO: 1391119 - RNA, 16 nt, Human
agaaacaacacuguag

SEQ ID NO: 1391120 - RNA, 15 nt, Human
agaaacaacacugua

SEQ ID NO: 1391121 - RNA, 14 nt, Human
agaaacaacacugu

SEQ ID NO: 1391122 - RNA, 17 nt, Human
agaaacaaagauguuau

SEQ ID NO: 1391123 - RNA, 20 nt, Human
agaaauaaaaggaagccaaa

SEQ ID NO: 1391124 - RNA, 19 nt, Human
agaaauaaaaggaagccaa

SEQ ID NO: 1391125 - RNA, 16 nt, Human
agaaaggauaaaguug

SEQ ID NO: 1391126 - RNA, 13 nt, Human
acuuuuaaacugu

SEQ ID NO: 1391127 - RNA, 15 nt, Human
acuuuuaaacaguga

SEQ ID NO: 1391128 - RNA, 12 nt, Human
acuuuuaaacag

SEQ ID NO: 1391129 - RNA, 14 nt, Human
acuuuguuuuauuu

SEQ ID NO: 1391130 - RNA, 20 nt, Human
acuuuguuucguggggaggu

SEQ ID NO: 1391131 - RNA, 14 nt, Human
acuuuccugcaacu

SEQ ID NO: 1391132 - RNA, 13 nt, Human
acuuuccauuaca

SEQ ID NO: 1391133 - RNA, 18 nt, Human
acuuucauuccuucagau

SEQ ID NO: 1391134 - RNA, 15 nt, Human
acuuucauuccuuca

SEQ ID NO: 1391135 - RNA, 20 nt, Human
acuuucauuccuucagauuu

SEQ ID NO: 1391136 - RNA, 22 nt, Human
acuuucauauuuuaaacagagg

SEQ ID NO: 1391137 - RNA, 18 nt, Human
acuuuauaacuaacaugu

SEQ ID NO: 1391138 - RNA, 16 nt, Human
acuuuauaacuaacau

SEQ ID NO: 1391139 - RNA, 23 nt, Human
acuuuagggaaguacuuuuggca

SEQ ID NO: 1391140 - RNA, 19 nt, Human
acuuuagggggugggauuc

SEQ ID NO: 1391141 - RNA, 14 nt, Human
agaaaauaacaaua

SEQ ID NO: 1391142 - RNA, 18 nt, Human
agaaaauguucuguuugc

SEQ ID NO: 1391143 - RNA, 14 nt, Human
agaaaauguucugu

SEQ ID NO: 1391144 - RNA, 23 nt, Human
agaaaauucugugccuuguuuuu

SEQ ID NO: 1391145 - RNA, 15 nt, Human
agaaaauuagacugu

SEQ ID NO: 1391146 - RNA, 17 nt, Human
agaaaauguugagaauc

SEQ ID NO: 1391147 - RNA, 16 nt, Human
agaaaauguugagaau

SEQ ID NO: 1391148 - RNA, 18 nt, Human
agaaacaacaauuucuac

SEQ ID NO: 1391149 - RNA, 13 nt, Human
agaaacaaagaug

SEQ ID NO: 1391150 - RNA, 16 nt, Human
agaaaauucugugccu

SEQ ID NO: 1391151 - RNA, 16 nt, Human
agaaaauuuuuguagu

SEQ ID NO: 1391152 - RNA, 20 nt, Human
agaaaauuuuuguaguagcg

SEQ ID NO: 1391153 - RNA, 22 nt, Human
agaaaauuuuuguaguagcguu

SEQ ID NO: 1391154 - RNA, 17 nt, Human
acuuuguuuuauuuuca

SEQ ID NO: 1391155 - RNA, 17 nt, Human
acuuuuaaacuguguac

SEQ ID NO: 1391156 - RNA, 15 nt, Human
acuuuuaaacugugu

SEQ ID NO: 1391157 - RNA, 14 nt, Human
acuuuuaaacugug

SEQ ID NO: 1391158 - RNA, 22 nt, Human
acuuuuauaaacuuuaccuuuu

SEQ ID NO: 1391159 - RNA, 19 nt, Human
acuuuuauaaacuuuaccu

SEQ ID NO: 1391160 - RNA, 17 nt, Human
acuuuuccucccucagu

SEQ ID NO: 1391161 - RNA, 23 nt, Human
acuuuuauacucuuucuguauau

SEQ ID NO: 1391162 - RNA, 19 nt, Human
acuuuuccuuugaauccuc

SEQ ID NO: 1391163 - RNA, 18 nt, Human
acuuuuccuuugaauccu

SEQ ID NO: 1391164 - RNA, 11 nt, Human
acuuuucugua

SEQ ID NO: 1391165 - RNA, 17 nt, Human
acuuuucuauuaaaagu

SEQ ID NO: 1391166 - RNA, 17 nt, Human
agaaaaguauguucuaa

SEQ ID NO: 1391167 - RNA, 17 nt, Human
acuuuucuuaaaaaguu

SEQ ID NO: 1391168 - RNA, 24 nt, Human
acuuuucuuaaaccuucaguuaug

SEQ ID NO: 1391169 - RNA, 16 nt, Human
acuuuucuuaaaccuu

SEQ ID NO: 1391170 - RNA, 20 nt, Human
acuuuucuguaauucagguu

SEQ ID NO: 1391171 - RNA, 17 nt, Human
acuuuucuguaauucag

SEQ ID NO: 1391172 - RNA, 21 nt, Human
agaaaaguauguucuaaccuu

SEQ ID NO: 1391173 - RNA, 15 nt, Human
agaaaaguauguucu

SEQ ID NO: 1391174 - RNA, 21 nt, Human
agaaaaguugaauuuuacaug

SEQ ID NO: 1391175 - RNA, 18 nt, Human
agaaaaguugaauuuuac

SEQ ID NO: 1391176 - RNA, 20 nt, Human
acugucuggggagcgggucu

SEQ ID NO: 1391177 - RNA, 22 nt, Human
acugucuggggagcgggucugc

SEQ ID NO: 1391178 - RNA, 22 nt, Human
acugucuggccccccugguccc

SEQ ID NO: 1391179 - RNA, 19 nt, Human
acugucuggccccccuggu

SEQ ID NO: 1391180 - RNA, 21 nt, Human
acugugcacaucugugucuug

SEQ ID NO: 1391181 - RNA, 20 nt, Human
acugugcacaucugugucuu

SEQ ID NO: 1391182 - RNA, 19 nt, Human
acugugcacaucugugucu

SEQ ID NO: 1391183 - RNA, 15 nt, Human
acugugcacaucugu

SEQ ID NO: 1391184 - RNA, 22 nt, Human
acugugauucagaaaauguucu

SEQ ID NO: 1391185 - RNA, 18 nt, Human
acugugcaccaagcagga

SEQ ID NO: 1391186 - RNA, 17 nt, Human
acugucgcugcuucgug

SEQ ID NO: 1391187 - RNA, 19 nt, Human
acuguccugggccugcaga

SEQ ID NO: 1391188 - RNA, 14 nt, Human
acugucgcugcuuc

SEQ ID NO: 1391189 - RNA, 13 nt, Human
acugucgcugcuu

SEQ ID NO: 1391190 - RNA, 17 nt, Human
acuguccugggccugca

SEQ ID NO: 1391191 - RNA, 22 nt, Human
acugguguuaucaccgugggcu

SEQ ID NO: 1391192 - RNA, 21 nt, Human
acugguguuaucaccgugggc

SEQ ID NO: 1391193 - RNA, 22 nt, Human
acugguggggauaggccagccg

SEQ ID NO: 1391194 - RNA, 20 nt, Human
acugccaagacugcuguggc

SEQ ID NO: 1391195 - RNA, 19 nt, Human
acugccaagacugcugugg

SEQ ID NO: 1391196 - RNA, 18 nt, Human
acugccaagacugcugug

SEQ ID NO: 1391197 - RNA, 16 nt, Human
acugccaagacugcug

SEQ ID NO: 1391198 - RNA, 14 nt, Human
acugaagcuuuuua

SEQ ID NO: 1391199 - RNA, 13 nt, Human
acugaagcuuuuu

SEQ ID NO: 1391200 - RNA, 17 nt, Human
acugaagugcuuagugu

SEQ ID NO: 1391201 - RNA, 13 nt, Human
acugaagugcuua

SEQ ID NO: 1391202 - RNA, 18 nt, Human
acugcccccugcugccau

SEQ ID NO: 1391203 - RNA, 19 nt, Human
acugcccccugcugccaug

SEQ ID NO: 1391204 - RNA, 17 nt, Human
acugcccccugcugcca

SEQ ID NO: 1391205 - RNA, 16 nt, Human
acugcccccugcugcc

SEQ ID NO: 1391206 - RNA, 18 nt, Human
acuggaacuugaacugau

SEQ ID NO: 1391207 - RNA, 17 nt, Human
acuggaacuugaacuga

SEQ ID NO: 1391208 - RNA, 16 nt, Human
acuggacccuguugcu

SEQ ID NO: 1391209 - RNA, 17 nt, Human
acuggacccuguugcua

SEQ ID NO: 1391210 - RNA, 18 nt, Human
acuggacccuguugcuaa

SEQ ID NO: 1391211 - RNA, 19 nt, Human
acuggacccuguugcuaag

SEQ ID NO: 1391212 - RNA, 20 nt, Human
acuggacccuguugcuaagc

SEQ ID NO: 1391213 - RNA, 18 nt, Human
acugggugguggccuggu

SEQ ID NO: 1391214 - RNA, 22 nt, Human
acugggugguggccuggucccu

SEQ ID NO: 1391215 - RNA, 15 nt, Human
acuggguaggaaaga

SEQ ID NO: 1391216 - RNA, 19 nt, Human
acuuguaaauauaaagacg

SEQ ID NO: 1391217 - RNA, 18 nt, Human
acuuguaaauauaaagac

SEQ ID NO: 1391218 - RNA, 17 nt, Human
acuuguaaauauaaaga

SEQ ID NO: 1391219 - RNA, 16 nt, Human
acuuguaaauauaaag

SEQ ID NO: 1391220 - RNA, 15 nt, Human
acuuguaaauauaaa

SEQ ID NO: 1391221 - RNA, 14 nt, Human
acuuguaaauauaa

SEQ ID NO: 1391222 - RNA, 13 nt, Human
acuuguaaauaua

SEQ ID NO: 1391223 - RNA, 12 nt, Human
acuuguaaauau

SEQ ID NO: 1391224 - RNA, 19 nt, Human
acuucuuuugcucuuagcu

SEQ ID NO: 1391225 - RNA, 20 nt, Human
acuucugagaucuguugauu

SEQ ID NO: 1391226 - RNA, 12 nt, Human
acuucugagauc

SEQ ID NO: 1391227 - RNA, 23 nt, Human
acuucacauauugauuuccguua

SEQ ID NO: 1391228 - RNA, 22 nt, Human
acuucugccagcauaauacuug

SEQ ID NO: 1391229 - RNA, 20 nt, Human
acuucuuuugcucuuagcug

SEQ ID NO: 1391230 - RNA, 19 nt, Human
acuuguaaaggaauuuaaa

SEQ ID NO: 1391231 - RNA, 20 nt, Human
acuuguaaaggaauuuaaaa

SEQ ID NO: 1391232 - RNA, 19 nt, Human
acuguuuguuuacaaaauc

SEQ ID NO: 1391233 - RNA, 20 nt, Human
acuguuuguuuacaaaauca

SEQ ID NO: 1391234 - RNA, 18 nt, Human
acuguuuauacacugugu

SEQ ID NO: 1391235 - RNA, 19 nt, Human
acuguuuauacacugugua

SEQ ID NO: 1391236 - RNA, 17 nt, Human
acuguuuauacacugug

SEQ ID NO: 1391237 - RNA, 14 nt, Human
acuguuuauacacu

SEQ ID NO: 1391238 - RNA, 13 nt, Human
acuguuucaaacu

SEQ ID NO: 1391239 - RNA, 13 nt, Human
acuuauuuaaugc

SEQ ID NO: 1391240 - RNA, 15 nt, Human
acuuauuuaaacucu

SEQ ID NO: 1391241 - RNA, 19 nt, Human
acuucacauauugauuucc

SEQ ID NO: 1391242 - RNA, 23 nt, Human
acuguuuucucucggcuccccau

SEQ ID NO: 1391243 - RNA, 22 nt, Human
acuguuuucucucggcucccca

SEQ ID NO: 1391244 - RNA, 21 nt, Human
acuuauuggaacucugcuuga

SEQ ID NO: 1391245 - RNA, 23 nt, Human
acuuauuguagcauccuggaaua

SEQ ID NO: 1391246 - RNA, 20 nt, Human
acuuauuggaacucugcuug

SEQ ID NO: 1391247 - RNA, 20 nt, Human
acuuauuguagcauccugga

SEQ ID NO: 1391248 - RNA, 18 nt, Human
accucuucagaggcccuc

SEQ ID NO: 1391249 - RNA, 17 nt, Human
accucuucagaggcccu

SEQ ID NO: 1391250 - RNA, 15 nt, Human
accucuucagaggcc

SEQ ID NO: 1391251 - RNA, 21 nt, Human
accucugcacuacugacaugu

SEQ ID NO: 1391252 - RNA, 15 nt, Human
accucugcagcaaua

SEQ ID NO: 1391253 - RNA, 22 nt, Human
accugccccacuuguccuuagc

SEQ ID NO: 1391254 - RNA, 19 nt, Human
accugccccacuuguccuu

SEQ ID NO: 1391255 - RNA, 17 nt, Human
accugccccacuugucc

SEQ ID NO: 1391256 - RNA, 17 nt, Human
accugccccaacucucc

SEQ ID NO: 1391257 - RNA, 16 nt, Human
accugcccccaaucca

SEQ ID NO: 1391258 - RNA, 23 nt, Human
accugccccacuuguccuuagcc

SEQ ID NO: 1391259 - RNA, 16 nt, Human
accuuguuacuucuga

SEQ ID NO: 1391260 - RNA, 15 nt, Human
accuuguuacuucug

SEQ ID NO: 1391261 - RNA, 17 nt, Human
accuuguuacuucugag

SEQ ID NO: 1391262 - RNA, 23 nt, Human
accuuuauuccuucauuucaucu

SEQ ID NO: 1391263 - RNA, 21 nt, Human
accuuuauuccuucauuucau

SEQ ID NO: 1391264 - RNA, 20 nt, Human
accuguaaugacaggccugu

SEQ ID NO: 1391265 - RNA, 15 nt, Human
accuguaaugacagg

SEQ ID NO: 1391266 - RNA, 17 nt, Human
accuguaugucuccagu

SEQ ID NO: 1391267 - RNA, 14 nt, Human
acgaugacaguguu

SEQ ID NO: 1391268 - RNA, 12 nt, Human
acgauuucuguu

SEQ ID NO: 1391269 - RNA, 13 nt, Human
acgauuucuguuu

SEQ ID NO: 1391270 - RNA, 14 nt, Human
acgauuucuguuua

SEQ ID NO: 1391271 - RNA, 17 nt, Human
acgauuucuguuuagau

SEQ ID NO: 1391272 - RNA, 19 nt, Human
acgauuucuguuuagauaa

SEQ ID NO: 1391273 - RNA, 20 nt, Human
acuaauagaauaaaggcagu

SEQ ID NO: 1391274 - RNA, 16 nt, Human
acuaauagaaaaguau

SEQ ID NO: 1391275 - RNA, 17 nt, Human
acuaauagaauaaaggc

SEQ ID NO: 1391276 - RNA, 16 nt, Human
acuaauagaauaaagg

SEQ ID NO: 1391277 - RNA, 14 nt, Human
acuaauagaaaagu

SEQ ID NO: 1391278 - RNA, 14 nt, Human
acuaauaauugcag

SEQ ID NO: 1391279 - RNA, 13 nt, Human
acuaauaauugca

SEQ ID NO: 1391280 - RNA, 11 nt, Human
acuaauaauug

SEQ ID NO: 1391281 - RNA, 19 nt, Human
acuaauaaacuaauaauug

SEQ ID NO: 1391282 - RNA, 22 nt, Human
acuaaguuuuuauggcuuuugu

SEQ ID NO: 1391283 - RNA, 22 nt, Human
acgccagacuucccacggcucc

SEQ ID NO: 1391284 - RNA, 16 nt, Human
acgccagacuucccac

SEQ ID NO: 1391285 - RNA, 16 nt, Human
acgugcacgcacacug

SEQ ID NO: 1391286 - RNA, 16 nt, Human
acuaagagagaaugag

SEQ ID NO: 1391287 - RNA, 22 nt, Human
acgugcauugugcuucuuucuu

SEQ ID NO: 1391288 - RNA, 12 nt, Human
acgugcauugug

SEQ ID NO: 1391289 - RNA, 14 nt, Human
acgugcauugugcu

SEQ ID NO: 1391290 - RNA, 15 nt, Human
acgugcauugugcuu

SEQ ID NO: 1391291 - RNA, 16 nt, Human
acgugcauugugcuuc

SEQ ID NO: 1391292 - RNA, 14 nt, Human
acucccuugggcuc

SEQ ID NO: 1391293 - RNA, 18 nt, Human
acucccuccuaaccuaga

SEQ ID NO: 1391294 - RNA, 15 nt, Human
acucccucacaagug

SEQ ID NO: 1391295 - RNA, 20 nt, Human
acucuagucaaugacaugaa

SEQ ID NO: 1391296 - RNA, 19 nt, Human
acucuagucaaugacauga

SEQ ID NO: 1391297 - RNA, 16 nt, Human
acucugugccagagcc

SEQ ID NO: 1391298 - RNA, 15 nt, Human
acucugugccagagc

SEQ ID NO: 1391299 - RNA, 16 nt, Human
acucuauauuguucag

SEQ ID NO: 1391300 - RNA, 22 nt, Human
acucuauauagcugaucaguuu

SEQ ID NO: 1391301 - RNA, 21 nt, Human
acucuaucaaguauuauaccu

SEQ ID NO: 1391302 - RNA, 16 nt, Human
acucuaucaaguauua

SEQ ID NO: 1391303 - RNA, 22 nt, Human
acucuagucaaugacaugaauu

SEQ ID NO: 1391304 - RNA, 23 nt, Human
acucuagucaaugacaugaauuu

SEQ ID NO: 1391305 - RNA, 14 nt, Human
acucuaucaaguau

SEQ ID NO: 1391306 - RNA, 15 nt, Human
acucugugcuggcca

SEQ ID NO: 1391307 - RNA, 23 nt, Human
acucugugccagagccuggggcu

SEQ ID NO: 1391308 - RNA, 22 nt, Human
acucugugccagagccuggggc

SEQ ID NO: 1391309 - RNA, 21 nt, Human
acucugugccagagccugggg

SEQ ID NO: 1391310 - RNA, 20 nt, Human
acucugugccagagccuggg

SEQ ID NO: 1391311 - RNA, 19 nt, Human
acucugugccagagccugg

SEQ ID NO: 1391312 - RNA, 18 nt, Human
acucugugccagagccug

SEQ ID NO: 1391313 - RNA, 17 nt, Human
acucugugccagagccu

SEQ ID NO: 1391314 - RNA, 17 nt, Human
acucugugcuggccagc

SEQ ID NO: 1391315 - RNA, 20 nt, Human
acucuguugcaagugcaaua

SEQ ID NO: 1391316 - RNA, 16 nt, Human
acucugugcuggccag

SEQ ID NO: 1391317 - RNA, 14 nt, Human
acucugugccagag

SEQ ID NO: 1391318 - RNA, 21 nt, Human
acucuguucauuccuccaggu

SEQ ID NO: 1391319 - RNA, 17 nt, Human
acucagcacuuggcccu

SEQ ID NO: 1391320 - RNA, 15 nt, Human
acucagcacaaggcc

SEQ ID NO: 1391321 - RNA, 17 nt, Human
acucagauccuccucau

SEQ ID NO: 1391322 - RNA, 16 nt, Human
acucagauccuccuca

SEQ ID NO: 1391323 - RNA, 19 nt, Human
acucagauccagggacaga

SEQ ID NO: 1391324 - RNA, 17 nt, Human
acucagauccagggaca

SEQ ID NO: 1391325 - RNA, 16 nt, Human
acucagauccagggac

SEQ ID NO: 1391326 - RNA, 14 nt, Human
acucagauccaggg

SEQ ID NO: 1391327 - RNA, 12 nt, Human
acucagauccag

SEQ ID NO: 1391328 - RNA, 11 nt, Human
acucagaucca

SEQ ID NO: 1391329 - RNA, 17 nt, Human
acucaaaggguggaaua

SEQ ID NO: 1391330 - RNA, 22 nt, Human
acucaaagcaugggauuauuag

SEQ ID NO: 1391331 - RNA, 23 nt, Human
acucaaacugaggaauuucaccu

SEQ ID NO: 1391332 - RNA, 14 nt, Human
acuauaagaacuuu

SEQ ID NO: 1391333 - RNA, 13 nt, Human
acuauaagaacuu

SEQ ID NO: 1391334 - RNA, 20 nt, Human
acuaguugugucuggcaguu

SEQ ID NO: 1391335 - RNA, 15 nt, Human
acucaaaauauuugu

SEQ ID NO: 1391336 - RNA, 19 nt, Human
acuauaagaacuuugagcu

SEQ ID NO: 1391337 - RNA, 18 nt, Human
acuauaagaacuuugagc

SEQ ID NO: 1391338 - RNA, 20 nt, Human
acuauaagcaagaaggcaaa

SEQ ID NO: 1391339 - RNA, 20 nt, Human
acucaaaauauuuguacaua

SEQ ID NO: 1391340 - RNA, 19 nt, Human
acucaaaauauuuguacau

SEQ ID NO: 1391341 - RNA, 17 nt, Human
acucaaaauauuuguac

SEQ ID NO: 1391342 - RNA, 21 nt, Human
acucaaacugaggaauuucac

SEQ ID NO: 1391343 - RNA, 14 nt, Human
acucaaacugagga

SEQ ID NO: 1391344 - RNA, 19 nt, Human
acucaaaccaaaucacuga

SEQ ID NO: 1391345 - RNA, 20 nt, Human
acucaaaccaaaucacugaa

SEQ ID NO: 1391346 - RNA, 19 nt, Human
acucagcucugacauucug

SEQ ID NO: 1391347 - RNA, 23 nt, Human
acucagccuucagacagagagga

SEQ ID NO: 1391348 - RNA, 11 nt, Human
acucagccuuc

SEQ ID NO: 1391349 - RNA, 23 nt, Human
acucaggcccccaccuggcucac

SEQ ID NO: 1391350 - RNA, 22 nt, Human
acucaggcccccaccuggcuca

SEQ ID NO: 1391351 - RNA, 11 nt, Human
acucagcucug

SEQ ID NO: 1391352 - RNA, 23 nt, Human
acucagucucucuucucuccagc

SEQ ID NO: 1391353 - RNA, 19 nt, Human
acucagucucucuucucuc

SEQ ID NO: 1391354 - RNA, 22 nt, Human
acucagggcagcgccaggcuga

SEQ ID NO: 1391355 - RNA, 21 nt, Human
acucagggcagcgccaggcug

SEQ ID NO: 1391356 - RNA, 20 nt, Human
acucagggcagcgccaggcu

SEQ ID NO: 1391357 - RNA, 17 nt, Human
acucagggcagcgccag

SEQ ID NO: 1391358 - RNA, 20 nt, Human
acuccccacaucccaucguc

SEQ ID NO: 1391359 - RNA, 16 nt, Human
acuccccgaagucuuu

SEQ ID NO: 1391360 - RNA, 14 nt, Human
acuccccgaagucu

SEQ ID NO: 1391361 - RNA, 17 nt, Human
acuccccgaagucuuuu

SEQ ID NO: 1391362 - RNA, 12 nt, Human
acuccccuccuu

SEQ ID NO: 1391363 - RNA, 20 nt, Human
acuagggaucccucaucugu

SEQ ID NO: 1391364 - RNA, 19 nt, Human
acuagggaucccucaucug

SEQ ID NO: 1391365 - RNA, 22 nt, Human
acuaggcccccacuugccucuu

SEQ ID NO: 1391366 - RNA, 20 nt, Human
acuaggcccccacuugccuc

SEQ ID NO: 1391367 - RNA, 18 nt, Human
acuaggcccccacuugcc

SEQ ID NO: 1391368 - RNA, 22 nt, Human
acuaggagcuuugacucaggag

SEQ ID NO: 1391369 - RNA, 23 nt, Human
acuaggagcuuugacucaggagc

SEQ ID NO: 1391370 - RNA, 21 nt, Human
acuaggagcuuugacucagga

SEQ ID NO: 1391371 - RNA, 18 nt, Human
acuaggagaaccaaaucu

SEQ ID NO: 1391372 - RNA, 18 nt, Human
acuaggaaauccauucac

SEQ ID NO: 1391373 - RNA, 24 nt, Human
acuagcucuuguugagccgugggc

SEQ ID NO: 1391374 - RNA, 13 nt, Human
acuagcucuuguu

SEQ ID NO: 1391375 - RNA, 11 nt, Human
acuagcucuug

SEQ ID NO: 1391376 - RNA, 16 nt, Human
acuagggccaagccca

SEQ ID NO: 1391377 - RNA, 22 nt, Human
acuagccaaaccucaccaacuc

SEQ ID NO: 1391378 - RNA, 19 nt, Human
acuagccaaaccucaccaa

SEQ ID NO: 1391379 - RNA, 18 nt, Human
acuagccaaaccucacca

SEQ ID NO: 1391380 - RNA, 17 nt, Human
acuagccaaaccucacc

SEQ ID NO: 1391381 - RNA, 18 nt, Human
acuagcccuccuuuuucc

SEQ ID NO: 1391382 - RNA, 17 nt, Human
acuagcccaaugaaaug

SEQ ID NO: 1391383 - RNA, 15 nt, Human
acuagcccaaugaaa

SEQ ID NO: 1391384 - RNA, 14 nt, Human
acuagcuauggugu

SEQ ID NO: 1391385 - RNA, 14 nt, Human
aacacgcaccugcc

SEQ ID NO: 1391386 - RNA, 19 nt, Human
aacacgcaccugccucagg

SEQ ID NO: 1391387 - RNA, 15 nt, Human
aacacgcaccugccu

SEQ ID NO: 1391388 - RNA, 18 nt, Human
aacaagaaaaauaaagaa

SEQ ID NO: 1391389 - RNA, 17 nt, Human
aacaagaaaaauaaaga

SEQ ID NO: 1391390 - RNA, 12 nt, Human
aacaagaaaaau

SEQ ID NO: 1391391 - RNA, 19 nt, Human
aacaagaaaaauaaagaaa

SEQ ID NO: 1391392 - RNA, 11 nt, Human
aacaagaaaaa

SEQ ID NO: 1391393 - RNA, 15 nt, Human
aacaacucuuugaga

SEQ ID NO: 1391394 - RNA, 21 nt, Human
aacaaagaugccacauucaaa

SEQ ID NO: 1391395 - RNA, 19 nt, Human
aacaaagaguucaagaaau

SEQ ID NO: 1391396 - RNA, 23 nt, Human
aacaaagaguucaagaaauaagu

SEQ ID NO: 1391397 - RNA, 17 nt, Human
aacaaagaguucaagaa

SEQ ID NO: 1391398 - RNA, 11 nt, Human
aacaaagaaac

SEQ ID NO: 1391399 - RNA, 14 nt, Human
aacaaagcagccac

SEQ ID NO: 1391400 - RNA, 15 nt, Human
aacaaagcagccacg

SEQ ID NO: 1391401 - RNA, 17 nt, Human
aacaccuuccagcuccu

SEQ ID NO: 1391402 - RNA, 21 nt, Human
aacaccaagcacagcagccug

SEQ ID NO: 1391403 - RNA, 19 nt, Human
aacaccaagcacagcagcc

SEQ ID NO: 1391404 - RNA, 18 nt, Human
aacaccaagcacagcagc

SEQ ID NO: 1391405 - RNA, 17 nt, Human
aacaccaagcacagcag

SEQ ID NO: 1391406 - RNA, 14 nt, Human
aacaccaagcacag

SEQ ID NO: 1391407 - RNA, 15 nt, Human
aacaccaacauaaaa

SEQ ID NO: 1391408 - RNA, 21 nt, Human
aacacauuugcuuuuugugau

SEQ ID NO: 1391409 - RNA, 12 nt, Human
aacaagaauugg

SEQ ID NO: 1391410 - RNA, 19 nt, Human
aacaagaagggacugagag

SEQ ID NO: 1391411 - RNA, 21 nt, Human
aacaagaagccacagaccuag

SEQ ID NO: 1391412 - RNA, 19 nt, Human
aacacauuuuucuuaggga

SEQ ID NO: 1391413 - RNA, 19 nt, Human
aaauugcaaaucuugaaau

SEQ ID NO: 1391414 - RNA, 14 nt, Human
aaauugcaaaucuu

SEQ ID NO: 1391415 - RNA, 13 nt, Human
aaauugcaaaucu

SEQ ID NO: 1391416 - RNA, 14 nt, Human
aaauugauuuugaa

SEQ ID NO: 1391417 - RNA, 23 nt, Human
aaauuggcauggaaauuuaaagc

SEQ ID NO: 1391418 - RNA, 21 nt, Human
aaauuggcauggaaauuuaaa

SEQ ID NO: 1391419 - RNA, 20 nt, Human
aaauuggcauggaaauuuaa

SEQ ID NO: 1391420 - RNA, 16 nt, Human
aaauuggaaagcaggu

SEQ ID NO: 1391421 - RNA, 16 nt, Human
aaauuggcauggaaau

SEQ ID NO: 1391422 - RNA, 14 nt, Human
aaauugccauauug

SEQ ID NO: 1391423 - RNA, 15 nt, Human
aaauugauuuugaac

SEQ ID NO: 1391424 - RNA, 18 nt, Human
aaauugcuuuguauugua

SEQ ID NO: 1391425 - RNA, 22 nt, Human
aacaaaagaagcccggcuccug

SEQ ID NO: 1391426 - RNA, 17 nt, Human
aacaaaacugcauuuca

SEQ ID NO: 1391427 - RNA, 13 nt, Human
aacaaaaauuguc

SEQ ID NO: 1391428 - RNA, 20 nt, Human
aacaaacuguguaacugccc

SEQ ID NO: 1391429 - RNA, 17 nt, Human
aacaaacuguguaacug

SEQ ID NO: 1391430 - RNA, 17 nt, Human
aacaaaauguaugucug

SEQ ID NO: 1391431 - RNA, 14 nt, Human
aacaaaauguaugu

SEQ ID NO: 1391432 - RNA, 15 nt, Human
aacaaagaaauuaug

SEQ ID NO: 1391433 - RNA, 17 nt, Human
aacaaagaaauuaugug

SEQ ID NO: 1391434 - RNA, 22 nt, Human
aacccugucuggauccuauccu

SEQ ID NO: 1391435 - RNA, 17 nt, Human
aacaugaugagguagua

SEQ ID NO: 1391436 - RNA, 14 nt, Human
aacaugcacugaug

SEQ ID NO: 1391437 - RNA, 21 nt, Human
aacaugaugagguaguaccuu

SEQ ID NO: 1391438 - RNA, 19 nt, Human
aacaugcacugauguugug

SEQ ID NO: 1391439 - RNA, 16 nt, Human
aacaugcacugauguu

SEQ ID NO: 1391440 - RNA, 22 nt, Human
aacaugcuacacacugcauguu

SEQ ID NO: 1391441 - RNA, 13 nt, Human
aacaucacagccc

SEQ ID NO: 1391442 - RNA, 19 nt, Human
aacaucauuacuauaagaa

SEQ ID NO: 1391443 - RNA, 13 nt, Human
aacaugauuuggg

SEQ ID NO: 1391444 - RNA, 23 nt, Human
aacagcuggacccugaccagcuc

SEQ ID NO: 1391445 - RNA, 11 nt, Human
aacagcuggug

SEQ ID NO: 1391446 - RNA, 20 nt, Human
aaccacugaaaaaauauaug

SEQ ID NO: 1391447 - RNA, 16 nt, Human
aaccacugaaaaaaua

SEQ ID NO: 1391448 - RNA, 15 nt, Human
aaccacugaaaaaau

SEQ ID NO: 1391449 - RNA, 13 nt, Human
aaccacugaaaaa

SEQ ID NO: 1391450 - RNA, 22 nt, Human
aaccacuggaaaguuuaugguu

SEQ ID NO: 1391451 - RNA, 14 nt, Human
aaccagaucauugu

SEQ ID NO: 1391452 - RNA, 22 nt, Human
aaccacucuaucaaguauuaua

SEQ ID NO: 1391453 - RNA, 22 nt, Human
aaccaguccccccacccucauu

SEQ ID NO: 1391454 - RNA, 18 nt, Human
aaccaguccccccacccu

SEQ ID NO: 1391455 - RNA, 17 nt, Human
aaccaguguuguggauu

SEQ ID NO: 1391456 - RNA, 13 nt, Human
aaccagcuuccuu

SEQ ID NO: 1391457 - RNA, 17 nt, Human
aaccagcucagcacugc

SEQ ID NO: 1391458 - RNA, 22 nt, Human
aaccagcucagcacugccugcu

SEQ ID NO: 1391459 - RNA, 14 nt, Human
aaccagcucagcac

SEQ ID NO: 1391460 - RNA, 23 nt, Human
aaccagaucuagucaaucaaguc

SEQ ID NO: 1391461 - RNA, 23 nt, Human
aaccagcacagcuuagauuucau

SEQ ID NO: 1391462 - RNA, 20 nt, Human
aaccacugcuuccauuuaau

SEQ ID NO: 1391463 - RNA, 13 nt, Human
aaccacugcuucc

SEQ ID NO: 1391464 - RNA, 12 nt, Human
aaccacugcuuc

SEQ ID NO: 1391465 - RNA, 19 nt, Human
aaccacugaaaaaauauau

SEQ ID NO: 1391466 - RNA, 22 nt, Human
aaccagcuuccuucagagagca

SEQ ID NO: 1391467 - RNA, 21 nt, Human
aaccagcuuccuucagagagc

SEQ ID NO: 1391468 - RNA, 20 nt, Human
aaccagcuuccuucagagag

SEQ ID NO: 1391469 - RNA, 19 nt, Human
aaccagcuuccuucagaga

SEQ ID NO: 1391470 - RNA, 17 nt, Human
aaccagcuuccuucaga

SEQ ID NO: 1391471 - RNA, 16 nt, Human
aaccagcuuccuucag

SEQ ID NO: 1391472 - RNA, 20 nt, Human
aacugaagcagccucucccc

SEQ ID NO: 1391473 - RNA, 18 nt, Human
aacugaagcagccucucc

SEQ ID NO: 1391474 - RNA, 18 nt, Human
aacugaagaguaaucaau

SEQ ID NO: 1391475 - RNA, 23 nt, Human
aacucauacacucguaugauacu

SEQ ID NO: 1391476 - RNA, 19 nt, Human
aacuuaaauaaugugaaac

SEQ ID NO: 1391477 - RNA, 17 nt, Human
aacuuaaauaaugugaa

SEQ ID NO: 1391478 - RNA, 13 nt, Human
aacuguuuuuuaa

SEQ ID NO: 1391479 - RNA, 15 nt, Human
aacuguuuuuuaagu

SEQ ID NO: 1391480 - RNA, 19 nt, Human
aacugauucacaucucauu

SEQ ID NO: 1391481 - RNA, 17 nt, Human
aacugauucacaucuca

SEQ ID NO: 1391482 - RNA, 21 nt, Human
aacugauccaguauaagacua

SEQ ID NO: 1391483 - RNA, 17 nt, Human
aacugacaagccaucuu

SEQ ID NO: 1391484 - RNA, 16 nt, Human
aacugacaagccaucu

SEQ ID NO: 1391485 - RNA, 10 nt, Human
aacugacaag

SEQ ID NO: 1391486 - RNA, 23 nt, Human
aacugacacaugcugaacaucac

SEQ ID NO: 1391487 - RNA, 17 nt, Human
aacugauccagcaauua

SEQ ID NO: 1391488 - RNA, 13 nt, Human
aacuucacauauu

SEQ ID NO: 1391489 - RNA, 23 nt, Human
aacuuuuuuuuuucuuuauaaga

SEQ ID NO: 1391490 - RNA, 18 nt, Human
aacuuuuuuuuuucuuua

SEQ ID NO: 1391491 - RNA, 22 nt, Human
aacuuuuuuucuguaccaguua

SEQ ID NO: 1391492 - RNA, 21 nt, Human
aacuuuuuuucuguaccaguu

SEQ ID NO: 1391493 - RNA, 23 nt, Human
aacuuuuuuauuuaaaaaacuaa

SEQ ID NO: 1391494 - RNA, 15 nt, Human
aacuuuuuguucugg

SEQ ID NO: 1391495 - RNA, 23 nt, Human
aacuuuuuguucugguccuuuuu

SEQ ID NO: 1391496 - RNA, 17 nt, Human
aacuuuuaguaaaguca

SEQ ID NO: 1391497 - RNA, 12 nt, Human
aacuuuguuuua

SEQ ID NO: 1391498 - RNA, 18 nt, Human
aacuuuucuauuaaaagu

SEQ ID NO: 1391499 - RNA, 19 nt, Human
aacuuuucuaacagaaagc

SEQ ID NO: 1391500 - RNA, 16 nt, Human
aacuuuucuaacagaa

SEQ ID NO: 1391501 - RNA, 16 nt, Human
aacuuuuauaaacuuu

SEQ ID NO: 1391502 - RNA, 19 nt, Human
aacuuuuauaaacuuuacc

SEQ ID NO: 1391503 - RNA, 20 nt, Human
aacuuuuuauugauuuuugg

SEQ ID NO: 1391504 - RNA, 21 nt, Human
aacuuuucuuaaaaaguuaua

SEQ ID NO: 1391505 - RNA, 19 nt, Human
aacuuuugugaauuaggcu

SEQ ID NO: 1391506 - RNA, 13 nt, Human
aacuuuugugaau

SEQ ID NO: 1391507 - RNA, 21 nt, Human
aacuuuuguaagacaaagguu

SEQ ID NO: 1391508 - RNA, 11 nt, Human
aacuuuuguaa

SEQ ID NO: 1391509 - RNA, 11 nt, Human
aacuuuuaauu

SEQ ID NO: 1391510 - RNA, 24 nt, Human
aacuuuggaaccagacucuugccu

SEQ ID NO: 1391511 - RNA, 18 nt, Human
aacuuuggaguccccuca

SEQ ID NO: 1391512 - RNA, 12 nt, Human
aacuuuuauaaa

SEQ ID NO: 1391513 - RNA, 15 nt, Human
aacuuuuauaaacuu

SEQ ID NO: 1391514 - RNA, 19 nt, Human
aacuuuggaaccagacucu

SEQ ID NO: 1391515 - RNA, 15 nt, Human
aacuuuggaaccaga

SEQ ID NO: 1391516 - RNA, 15 nt, Human
aacuuugaaguuagc

SEQ ID NO: 1391517 - RNA, 15 nt, Human
aacuuugcugagccu

SEQ ID NO: 1391518 - RNA, 19 nt, Human
aacuuugaccucugcagca

SEQ ID NO: 1391519 - RNA, 20 nt, Human
aacuuugaccucugcagcaa

SEQ ID NO: 1391520 - RNA, 13 nt, Human
aacuuugaccucu

SEQ ID NO: 1391521 - RNA, 14 nt, Human
aacuuugaccucug

SEQ ID NO: 1391522 - RNA, 17 nt, Human
aacuuugaccucugcag

SEQ ID NO: 1391523 - RNA, 17 nt, Human
aaagaugaaagagcagu

SEQ ID NO: 1391524 - RNA, 21 nt, Human
aaagaucuguuuugaaggcaa

SEQ ID NO: 1391525 - RNA, 20 nt, Human
aaagauaucucaucucuucu

SEQ ID NO: 1391526 - RNA, 18 nt, Human
aaagauauaagugcugua

SEQ ID NO: 1391527 - RNA, 20 nt, Human
aaagauauaagugcuguaua

SEQ ID NO: 1391528 - RNA, 21 nt, Human
aaagauauaagugcuguauaa

SEQ ID NO: 1391529 - RNA, 22 nt, Human
aaagauauaagugcuguauaaa

SEQ ID NO: 1391530 - RNA, 15 nt, Human
aaagauauaagugcu

SEQ ID NO: 1391531 - RNA, 16 nt, Human
aaagauauaagugcug

SEQ ID NO: 1391532 - RNA, 17 nt, Human
aaagauauaagugcugu

SEQ ID NO: 1391533 - RNA, 18 nt, Human
aaagaguagaauugcauu

SEQ ID NO: 1391534 - RNA, 13 nt, Human
aaagaguagaauu

SEQ ID NO: 1391535 - RNA, 17 nt, Human
aaagaguacucuuguuu

SEQ ID NO: 1391536 - RNA, 12 nt, Human
aaagaguacucu

SEQ ID NO: 1391537 - RNA, 13 nt, Human
aaagaaaguguau

SEQ ID NO: 1391538 - RNA, 12 nt, Human
aaagaaagugua

SEQ ID NO: 1391539 - RNA, 10 nt, Human
aaagaaagug

SEQ ID NO: 1391540 - RNA, 16 nt, Human
aaagaaaguguauuug

SEQ ID NO: 1391541 - RNA, 13 nt, Human
aaagaaauuaugu

SEQ ID NO: 1391542 - RNA, 15 nt, Human
aaagaaauuaugugc

SEQ ID NO: 1391543 - RNA, 15 nt, Human
aaagaaauauaccua

SEQ ID NO: 1391544 - RNA, 11 nt, Human
aaagaacaucc

SEQ ID NO: 1391545 - RNA, 16 nt, Human
aaacugcaugcccaga

SEQ ID NO: 1391546 - RNA, 17 nt, Human
aaacugacucuuaagaa

SEQ ID NO: 1391547 - RNA, 16 nt, Human
aaacugacucuuaaga

SEQ ID NO: 1391548 - RNA, 20 nt, Human
aaagaaaagaugcacuuugc

SEQ ID NO: 1391549 - RNA, 17 nt, Human
aaagaaaagaugcacuu

SEQ ID NO: 1391550 - RNA, 15 nt, Human
aaagaaaagaugcac

SEQ ID NO: 1391551 - RNA, 14 nt, Human
aaagaaaagaugca

SEQ ID NO: 1391552 - RNA, 13 nt, Human
aaagaaaagaugc

SEQ ID NO: 1391553 - RNA, 13 nt, Human
aaagaaaaccuuu

SEQ ID NO: 1391554 - RNA, 16 nt, Human
aaagaaaagaaaauuu

SEQ ID NO: 1391555 - RNA, 13 nt, Human
aaagaaaaacaaa

SEQ ID NO: 1391556 - RNA, 12 nt, Human
aaagaaaacuug

SEQ ID NO: 1391557 - RNA, 20 nt, Human
aaagaaaacuuguauuaugu

SEQ ID NO: 1391558 - RNA, 17 nt, Human
aaacagauuuggaaaga

SEQ ID NO: 1391559 - RNA, 16 nt, Human
aaacagauuguuugca

SEQ ID NO: 1391560 - RNA, 15 nt, Human
aaacacuugcaaccu

SEQ ID NO: 1391561 - RNA, 24 nt, Human
aaacacuugcggauauucuggacu

SEQ ID NO: 1391562 - RNA, 12 nt, Human
aaaauucauuuu

SEQ ID NO: 1391563 - RNA, 13 nt, Human
aaaauugccauau

SEQ ID NO: 1391564 - RNA, 14 nt, Human
aaaauugccauauu

SEQ ID NO: 1391565 - RNA, 16 nt, Human
aaaauugccauauugc

SEQ ID NO: 1391566 - RNA, 17 nt, Human
aaaauugccauauugca

SEQ ID NO: 1391567 - RNA, 18 nt, Human
aaaauugccauauugcac

SEQ ID NO: 1391568 - RNA, 19 nt, Human
aaaauucagcaaagugguu

SEQ ID NO: 1391569 - RNA, 14 nt, Human
aaaauucagcaaag

SEQ ID NO: 1391570 - RNA, 13 nt, Human
aaaauucagcaaa

SEQ ID NO: 1391571 - RNA, 18 nt, Human
aaaauucaacaaacauuu

SEQ ID NO: 1391572 - RNA, 13 nt, Human
aaaacacacaggu

SEQ ID NO: 1391573 - RNA, 13 nt, Human
aaaacacauuuuu

SEQ ID NO: 1391574 - RNA, 15 nt, Human
aaaacacauuuuucu

SEQ ID NO: 1391575 - RNA, 14 nt, Human
aaacacucuugaaa

SEQ ID NO: 1391576 - RNA, 17 nt, Human
aaacacucuugaaaaau

SEQ ID NO: 1391577 - RNA, 20 nt, Human
aaaauugcugacuguagcuu

SEQ ID NO: 1391578 - RNA, 19 nt, Human
aaaauugccauauugcaca

SEQ ID NO: 1391579 - RNA, 21 nt, Human
aaaauugccauauugcacaug

SEQ ID NO: 1391580 - RNA, 13 nt, Human
aaacacucuugaa

SEQ ID NO: 1391581 - RNA, 24 nt, Human
aaauauaaagacguuuuauaagca

SEQ ID NO: 1391582 - RNA, 12 nt, Human
aaauauaaagac

SEQ ID NO: 1391583 - RNA, 10 nt, Human
aaauauaaag

SEQ ID NO: 1391584 - RNA, 13 nt, Human
aaauauaaaauau

SEQ ID NO: 1391585 - RNA, 21 nt, Human
aaauaguuuggauauguaaaa

SEQ ID NO: 1391586 - RNA, 20 nt, Human
aaauaguuuggauauguaaa

SEQ ID NO: 1391587 - RNA, 23 nt, Human
aaauagucucuuuaaaaggaaag

SEQ ID NO: 1391588 - RNA, 19 nt, Human
aaauaguggugugauuugg

SEQ ID NO: 1391589 - RNA, 13 nt, Human
aaauauaaagacg

SEQ ID NO: 1391590 - RNA, 19 nt, Human
aaauauuuuaaagaauugu

SEQ ID NO: 1391591 - RNA, 23 nt, Human
aaauauuuuaaagaauuguguca

SEQ ID NO: 1391592 - RNA, 15 nt, Human
aaauagaaaaugguc

SEQ ID NO: 1391593 - RNA, 14 nt, Human
aaauagaaaauggu

SEQ ID NO: 1391594 - RNA, 17 nt, Human
aaauacuuuuacucugc

SEQ ID NO: 1391595 - RNA, 19 nt, Human
aaauacuuuuacucugccu

SEQ ID NO: 1391596 - RNA, 12 nt, Human
aaauaguauuuc

SEQ ID NO: 1391597 - RNA, 17 nt, Human
aaauagacagcaugaga

SEQ ID NO: 1391598 - RNA, 15 nt, Human
aaauagacaaauaga

SEQ ID NO: 1391599 - RNA, 16 nt, Human
aaauagaagagagagg

SEQ ID NO: 1391600 - RNA, 21 nt, Human
aaauauuuugaaucaauaaua

SEQ ID NO: 1391601 - RNA, 15 nt, Human
aaauauuuugaauca

SEQ ID NO: 1391602 - RNA, 18 nt, Human
aaaucaacuugcuuauca

SEQ ID NO: 1391603 - RNA, 13 nt, Human
aaaucaaaugaau

SEQ ID NO: 1391604 - RNA, 20 nt, Human
aaaucaaaugguaucuuuug

SEQ ID NO: 1391605 - RNA, 18 nt, Human
aaaucuugucauguguau

SEQ ID NO: 1391606 - RNA, 17 nt, Human
aaaucuugucaugugua

SEQ ID NO: 1391607 - RNA, 16 nt, Human
aaaucuugucaugugu

SEQ ID NO: 1391608 - RNA, 14 nt, Human
aaaucuugucaugu

SEQ ID NO: 1391609 - RNA, 22 nt, Human
aaaucuugguugaugccaaaaa

SEQ ID NO: 1391610 - RNA, 20 nt, Human
aaaucuugguugaugccaaa

SEQ ID NO: 1391611 - RNA, 14 nt, Human
aaaucuugaucagu

SEQ ID NO: 1391612 - RNA, 13 nt, Human
aaaucuugaaauu

SEQ ID NO: 1391613 - RNA, 21 nt, Human
aaaucuugucauguguauaaa

SEQ ID NO: 1391614 - RNA, 20 nt, Human
aaaucuugucauguguauaa

SEQ ID NO: 1391615 - RNA, 19 nt, Human
aaaucuugucauguguaua

SEQ ID NO: 1391616 - RNA, 16 nt, Human
aaaucuuucuuucuua

SEQ ID NO: 1391617 - RNA, 18 nt, Human
aaaucuuucuuucuuaga

SEQ ID NO: 1391618 - RNA, 20 nt, Human
aaaugcuuuuuauuucugca

SEQ ID NO: 1391619 - RNA, 13 nt, Human
aaauggaaacuau

SEQ ID NO: 1391620 - RNA, 20 nt, Human
aaaucuuucuuucuuagaaa

SEQ ID NO: 1391621 - RNA, 22 nt, Human
aaaucuuucuuucuuagaaauu

SEQ ID NO: 1391622 - RNA, 17 nt, Human
aaauggaauacucuuau

SEQ ID NO: 1391623 - RNA, 18 nt, Human
aaauggcuuccuggcaau

SEQ ID NO: 1391624 - RNA, 22 nt, Human
aaauggccucauguggcuggaa

SEQ ID NO: 1391625 - RNA, 21 nt, Human
aaauggccucauguggcugga

SEQ ID NO: 1391626 - RNA, 21 nt, Human
aaauggcgucuggaaguccaa

SEQ ID NO: 1391627 - RNA, 15 nt, Human
aaauggccucaugug

SEQ ID NO: 1391628 - RNA, 11 nt, Human
aaauggccuca

SEQ ID NO: 1391629 - RNA, 23 nt, Human
aaauggccauuugcuuuuucacc

SEQ ID NO: 1391630 - RNA, 22 nt, Human
aaauggccauuugcuuuuucac

SEQ ID NO: 1391631 - RNA, 19 nt, Human
aaauggccauuugcuuuuu

SEQ ID NO: 1391632 - RNA, 17 nt, Human
aaauaacaaugugcucu

SEQ ID NO: 1391633 - RNA, 14 nt, Human
aaauaacaaugugc

SEQ ID NO: 1391634 - RNA, 20 nt, Human
aaauaacaaaugccaaauua

SEQ ID NO: 1391635 - RNA, 14 nt, Human
aaauaaauuugacu

SEQ ID NO: 1391636 - RNA, 18 nt, Human
aaauaaaaggaagccaaa

SEQ ID NO: 1391637 - RNA, 13 nt, Human
aaagugcugagau

SEQ ID NO: 1391638 - RNA, 23 nt, Human
aaagugcuaagguucuaaggccu

SEQ ID NO: 1391639 - RNA, 21 nt, Human
aaagugcuaagguucuaaggc

SEQ ID NO: 1391640 - RNA, 20 nt, Human
aaagugcuaagguucuaagg

SEQ ID NO: 1391641 - RNA, 18 nt, Human
aaagugcuaagguucuaa

SEQ ID NO: 1391642 - RNA, 17 nt, Human
aaagugcuaagguucua

SEQ ID NO: 1391643 - RNA, 16 nt, Human
aaagugcuaagguucu

SEQ ID NO: 1391644 - RNA, 14 nt, Human
aaagugagagcacg

SEQ ID NO: 1391645 - RNA, 19 nt, Human
aaagugacuaauggcauga

SEQ ID NO: 1391646 - RNA, 14 nt, Human
aaagugacccuguu

SEQ ID NO: 1391647 - RNA, 16 nt, Human
aaauaaagaauggaaa

SEQ ID NO: 1391648 - RNA, 13 nt, Human
aaauaaagaaugg

SEQ ID NO: 1391649 - RNA, 15 nt, Human
aaauaaagaaaagau

SEQ ID NO: 1391650 - RNA, 13 nt, Human
aaauaaagaaaua

SEQ ID NO: 1391651 - RNA, 17 nt, Human
aaauaaaauuuguugca

SEQ ID NO: 1391652 - RNA, 16 nt, Human
aaauaaaauuuguugc

SEQ ID NO: 1391653 - RNA, 15 nt, Human
aaauaaaauuuguug

SEQ ID NO: 1391654 - RNA, 17 nt, Human
aaauaaaaugcuagguu

SEQ ID NO: 1391655 - RNA, 14 nt, Human
aaauaaaaugcuag

SEQ ID NO: 1391656 - RNA, 13 nt, Human
aaauaaaaugcua

SEQ ID NO: 1391657 - RNA, 20 nt, Human
aaauaaagcuugcaacaaaa

SEQ ID NO: 1391658 - RNA, 15 nt, Human
aaauaaagcaucuca

SEQ ID NO: 1391659 - RNA, 14 nt, Human
aaauaaagaaugga

SEQ ID NO: 1391660 - RNA, 23 nt, Human
aaauaaaggaugugauuguggaa

SEQ ID NO: 1391661 - RNA, 12 nt, Human
aaauaacaauga

SEQ ID NO: 1391662 - RNA, 20 nt, Human
aaaggcuguuaaauacagga

SEQ ID NO: 1391663 - RNA, 22 nt, Human
aaaggcuguuaaauacaggaaa

SEQ ID NO: 1391664 - RNA, 19 nt, Human
aaaggcuguuaaauacagg

SEQ ID NO: 1391665 - RNA, 18 nt, Human
aaaggcuguuaaauacag

SEQ ID NO: 1391666 - RNA, 20 nt, Human
aaagggacugagaaauuuau

SEQ ID NO: 1391667 - RNA, 16 nt, Human
aaagggacugagaaau

SEQ ID NO: 1391668 - RNA, 18 nt, Human
aaagucucuaauucuauu

SEQ ID NO: 1391669 - RNA, 15 nt, Human
aaagucucuaauucu

SEQ ID NO: 1391670 - RNA, 19 nt, Human
aaagucucuggaauuugaa

SEQ ID NO: 1391671 - RNA, 15 nt, Human
aaagugaaauaaugu

SEQ ID NO: 1391672 - RNA, 17 nt, Human
aaagugaaauaaugugu

SEQ ID NO: 1391673 - RNA, 20 nt, Human
aaagucuguugauuaaagau

SEQ ID NO: 1391674 - RNA, 19 nt, Human
aaagucuguugauuaaaga

SEQ ID NO: 1391675 - RNA, 18 nt, Human
aaagucuguugauuaaag

SEQ ID NO: 1391676 - RNA, 22 nt, Human
aaagucuguccuugaaggacua

SEQ ID NO: 1391677 - RNA, 19 nt, Human
aaagucuguccuugaagga

SEQ ID NO: 1391678 - RNA, 14 nt, Human
aaagucuguccuug

SEQ ID NO: 1391679 - RNA, 12 nt, Human
aaagucucuugu

SEQ ID NO: 1391680 - RNA, 20 nt, Human
aaagucucuggaauuugaaa

SEQ ID NO: 1391681 - RNA, 22 nt, Human
aaagucucuggaauuugaaaca

SEQ ID NO: 1391682 - RNA, 22 nt, Human
aagcaggaaaugaaaaugucuu

SEQ ID NO: 1391683 - RNA, 15 nt, Human
aagcagcuuagaguu

SEQ ID NO: 1391684 - RNA, 21 nt, Human
aagcagaccacugauaaaacc

SEQ ID NO: 1391685 - RNA, 15 nt, Human
aagcagacagcucca

SEQ ID NO: 1391686 - RNA, 14 nt, Human
aagcagacagcucc

SEQ ID NO: 1391687 - RNA, 12 nt, Human
aagcagacagcu

SEQ ID NO: 1391688 - RNA, 22 nt, Human
aagauuuguuuuuaaacuguac

SEQ ID NO: 1391689 - RNA, 16 nt, Human
aagcagacauuuuaaa

SEQ ID NO: 1391690 - RNA, 22 nt, Human
aagccaggaauuucccaggacc

SEQ ID NO: 1391691 - RNA, 21 nt, Human
aagccaggaauuucccaggac

SEQ ID NO: 1391692 - RNA, 20 nt, Human
aagccaggaauuucccagga

SEQ ID NO: 1391693 - RNA, 23 nt, Human
aagccagcuuucccugccucuca

SEQ ID NO: 1391694 - RNA, 17 nt, Human
aagccagcuuucccugc

SEQ ID NO: 1391695 - RNA, 15 nt, Human
aagccagcuuucccu

SEQ ID NO: 1391696 - RNA, 14 nt, Human
aagccagcuuuccc

SEQ ID NO: 1391697 - RNA, 12 nt, Human
aagccagcuuuc

SEQ ID NO: 1391698 - RNA, 21 nt, Human
aagccagcuuguuuacaugcu

SEQ ID NO: 1391699 - RNA, 14 nt, Human
aagccagcuuguuu

SEQ ID NO: 1391700 - RNA, 12 nt, Human
aagccagcuugu

SEQ ID NO: 1391701 - RNA, 11 nt, Human
aagccagcuug

SEQ ID NO: 1391702 - RNA, 20 nt, Human
aagccagcguccuccucugu

SEQ ID NO: 1391703 - RNA, 14 nt, Human
aagccagaggcugg

SEQ ID NO: 1391704 - RNA, 18 nt, Human
aagccacuuaaaauguuc

SEQ ID NO: 1391705 - RNA, 16 nt, Human
aagccagaggcugggu

SEQ ID NO: 1391706 - RNA, 15 nt, Human
aagccagaggcuggg

SEQ ID NO: 1391707 - RNA, 19 nt, Human
aagccagauuuuccugaaa

SEQ ID NO: 1391708 - RNA, 13 nt, Human
aagccagauuuuc

SEQ ID NO: 1391709 - RNA, 23 nt, Human
aagauuuguuuuuaaacuguaca

SEQ ID NO: 1391710 - RNA, 20 nt, Human
aagauuuguuuuuaaacugu

SEQ ID NO: 1391711 - RNA, 19 nt, Human
aagauuuguuuuuaaacug

SEQ ID NO: 1391712 - RNA, 17 nt, Human
aagauuuguuuuuaaac

SEQ ID NO: 1391713 - RNA, 16 nt, Human
aagauuuguuuuuaaa

SEQ ID NO: 1391714 - RNA, 14 nt, Human
aagauuuguuuuua

SEQ ID NO: 1391715 - RNA, 22 nt, Human
aagauuuccuucuuuuuuucuu

SEQ ID NO: 1391716 - RNA, 15 nt, Human
aagauuguuccugcu

SEQ ID NO: 1391717 - RNA, 21 nt, Human
aagauugguguuuuuuucuau

SEQ ID NO: 1391718 - RNA, 16 nt, Human
aagauuuaccacuugu

SEQ ID NO: 1391719 - RNA, 16 nt, Human
aagauugcugaaauuu

SEQ ID NO: 1391720 - RNA, 23 nt, Human
aagauugguguuuuuuucuaugg

SEQ ID NO: 1391721 - RNA, 20 nt, Human
aagauugguguuuuuuucua

SEQ ID NO: 1391722 - RNA, 19 nt, Human
aagauugguguuuuuuucu

SEQ ID NO: 1391723 - RNA, 17 nt, Human
aagauugguguuuuuuu

SEQ ID NO: 1391724 - RNA, 19 nt, Human
aagauugcuuaauaaauug

SEQ ID NO: 1391725 - RNA, 21 nt, Human
aagaacacccuauauuuugca

SEQ ID NO: 1391726 - RNA, 19 nt, Human
aagaacacccuauauuuug

SEQ ID NO: 1391727 - RNA, 15 nt, Human
aagaaauuucacaua

SEQ ID NO: 1391728 - RNA, 22 nt, Human
aagaaauugaauacuuugaaug

SEQ ID NO: 1391729 - RNA, 13 nt, Human
aagaaauggugaa

SEQ ID NO: 1391730 - RNA, 13 nt, Human
aagaaauuaugug

SEQ ID NO: 1391731 - RNA, 19 nt, Human
aagaaauugaauacuuuga

SEQ ID NO: 1391732 - RNA, 18 nt, Human
aagaaauugaauacuuug

SEQ ID NO: 1391733 - RNA, 17 nt, Human
aagaaauugaauacuuu

SEQ ID NO: 1391734 - RNA, 22 nt, Human
aagaaauuaugugccagauuua

SEQ ID NO: 1391735 - RNA, 20 nt, Human
aagccauggagauucucaua

SEQ ID NO: 1391736 - RNA, 21 nt, Human
aagccaugcuggaaaauaaua

SEQ ID NO: 1391737 - RNA, 15 nt, Human
aagccaugcuggaaa

SEQ ID NO: 1391738 - RNA, 13 nt, Human
aagccaugcugga

SEQ ID NO: 1391739 - RNA, 23 nt, Human
aagccaugaguuccagaaaguaa

SEQ ID NO: 1391740 - RNA, 22 nt, Human
aagccaugaguuccagaaagua

SEQ ID NO: 1391741 - RNA, 23 nt, Human
aagccaucaccucagauggcagc

SEQ ID NO: 1391742 - RNA, 20 nt, Human
aagccaucuugaguggucau

SEQ ID NO: 1391743 - RNA, 16 nt, Human
aagccaucaccucaga

SEQ ID NO: 1391744 - RNA, 23 nt, Human
aagccagcuuguuuacaugcuua

SEQ ID NO: 1391745 - RNA, 22 nt, Human
aaggcacccaucugucugccaa

SEQ ID NO: 1391746 - RNA, 19 nt, Human
aaggcacccccgucaagag

SEQ ID NO: 1391747 - RNA, 19 nt, Human
aaggcacccaucugucugc

SEQ ID NO: 1391748 - RNA, 16 nt, Human
aaggcacaugucaccu

SEQ ID NO: 1391749 - RNA, 14 nt, Human
aaggcaaaaaugua

SEQ ID NO: 1391750 - RNA, 15 nt, Human
aaggcaaaaauguaa

SEQ ID NO: 1391751 - RNA, 20 nt, Human
aagcugccugguauauccaa

SEQ ID NO: 1391752 - RNA, 15 nt, Human
aagcugccugguaua

SEQ ID NO: 1391753 - RNA, 23 nt, Human
aagcugccuccccucuccuuccu

SEQ ID NO: 1391754 - RNA, 23 nt, Human
aagcuaacagggaaggcaggcag

SEQ ID NO: 1391755 - RNA, 17 nt, Human
aagcuaagguuuagaua

SEQ ID NO: 1391756 - RNA, 22 nt, Human
aagcuaacagggaaggcaggca

SEQ ID NO: 1391757 - RNA, 21 nt, Human
aagcuaacagggaaggcaggc

SEQ ID NO: 1391758 - RNA, 20 nt, Human
aagcuaacagggaaggcagg

SEQ ID NO: 1391759 - RNA, 15 nt, Human
aagcuaaaauaaaga

SEQ ID NO: 1391760 - RNA, 21 nt, Human
aagcuaaauccuuuacuguua

SEQ ID NO: 1391761 - RNA, 16 nt, Human
aagcuaaaauaaagaa

SEQ ID NO: 1391762 - RNA, 13 nt, Human
aagcuaaaauaaa

SEQ ID NO: 1391763 - RNA, 22 nt, Human
aagcgugagcuuaaaauacaag

SEQ ID NO: 1391764 - RNA, 23 nt, Human
aagcuggcggcuggggucccagc

SEQ ID NO: 1391765 - RNA, 20 nt, Human
aagcuggagugcaguggcau

SEQ ID NO: 1391766 - RNA, 15 nt, Human
aaggacuccugaaaa

SEQ ID NO: 1391767 - RNA, 22 nt, Human
aaggacuccuccuuuuuccaug

SEQ ID NO: 1391768 - RNA, 16 nt, Human
aaggacuauaagaaua

SEQ ID NO: 1391769 - RNA, 21 nt, Human
aaggacuaugaaaagcuagaa

SEQ ID NO: 1391770 - RNA, 21 nt, Human
aaggcaaaaauaguuuggaua

SEQ ID NO: 1391771 - RNA, 13 nt, Human
aaggcaaaaauag

SEQ ID NO: 1391772 - RNA, 14 nt, Human
aaggacuguaaucu

SEQ ID NO: 1391773 - RNA, 18 nt, Human
aagucucuaauucuauua

SEQ ID NO: 1391774 - RNA, 15 nt, Human
aagucucuaauucua

SEQ ID NO: 1391775 - RNA, 19 nt, Human
aagucucuggaauuugaaa

SEQ ID NO: 1391776 - RNA, 21 nt, Human
aagguuuaaagagucuagauu

SEQ ID NO: 1391777 - RNA, 20 nt, Human
aagguuuaaagagucuagau

SEQ ID NO: 1391778 - RNA, 16 nt, Human
aagguugggcagggug

SEQ ID NO: 1391779 - RNA, 17 nt, Human
aagguucuuacugcuug

SEQ ID NO: 1391780 - RNA, 19 nt, Human
aagguggauggccccagca

SEQ ID NO: 1391781 - RNA, 18 nt, Human
aaggugcugacggccagg

SEQ ID NO: 1391782 - RNA, 19 nt, Human
aaggugcucucuuucuguc

SEQ ID NO: 1391783 - RNA, 19 nt, Human
aaguaucaucaguguagaa

SEQ ID NO: 1391784 - RNA, 13 nt, Human
aaguagaaaucau

SEQ ID NO: 1391785 - RNA, 18 nt, Human
aaguagaaacaaaauaca

SEQ ID NO: 1391786 - RNA, 15 nt, Human
aaguagaaaucauag

SEQ ID NO: 1391787 - RNA, 16 nt, Human
aaguagaaacaaaaua

SEQ ID NO: 1391788 - RNA, 17 nt, Human
aaguacuuguaguucca

SEQ ID NO: 1391789 - RNA, 21 nt, Human
aagguuuaaaugaacaagaga

SEQ ID NO: 1391790 - RNA, 16 nt, Human
aagguuuaaaugaaca

SEQ ID NO: 1391791 - RNA, 14 nt, Human
aagguuuaaaugaa

SEQ ID NO: 1391792 - RNA, 14 nt, Human
aaguacuuuuggca

SEQ ID NO: 1391793 - RNA, 15 nt, Human
aaguacuuuuggcau

SEQ ID NO: 1391794 - RNA, 21 nt, Human
aaguauguauuauuuacauuu

SEQ ID NO: 1391795 - RNA, 14 nt, Human
aaguauguauuauu

SEQ ID NO: 1391796 - RNA, 23 nt, Human
aaguccaggcuuuuuuaucaugu

SEQ ID NO: 1391797 - RNA, 15 nt, Human
aaguccagguccugg

SEQ ID NO: 1391798 - RNA, 13 nt, Human
aaguccagguccu

SEQ ID NO: 1391799 - RNA, 21 nt, Human
aaguccagguccugguggggc

SEQ ID NO: 1391800 - RNA, 18 nt, Human
aaguccagguccuggugg

SEQ ID NO: 1391801 - RNA, 17 nt, Human
aaguccagguccuggug

SEQ ID NO: 1391802 - RNA, 20 nt, Human
aaguccaguccaguccuauc

SEQ ID NO: 1391803 - RNA, 19 nt, Human
aaguccagguccugguggg

SEQ ID NO: 1391804 - RNA, 20 nt, Human
aaguccaguguuucuuuuuu

SEQ ID NO: 1391805 - RNA, 16 nt, Human
aaguaucccuacugua

SEQ ID NO: 1391806 - RNA, 17 nt, Human
aaguaucccuacuguaa

SEQ ID NO: 1391807 - RNA, 20 nt, Human
aagugcuguuuauuaaucuu

SEQ ID NO: 1391808 - RNA, 18 nt, Human
aagugcuguuuauuaauc

SEQ ID NO: 1391809 - RNA, 17 nt, Human
aagugcuguuuauuaau

SEQ ID NO: 1391810 - RNA, 16 nt, Human
aagugcuguuuauuaa

SEQ ID NO: 1391811 - RNA, 14 nt, Human
aagugcuguuuauu

SEQ ID NO: 1391812 - RNA, 23 nt, Human
aagugcuguauaaaaucagccaa

SEQ ID NO: 1391813 - RNA, 19 nt, Human
aagugcuguauaaaaucag

SEQ ID NO: 1391814 - RNA, 22 nt, Human
aagugcuguauaaaaucagcca

SEQ ID NO: 1391815 - RNA, 12 nt, Human
aagugcuguaua

SEQ ID NO: 1391816 - RNA, 13 nt, Human
aagugcuguauaa

SEQ ID NO: 1391817 - RNA, 15 nt, Human
aagugcuguauaaaa

SEQ ID NO: 1391818 - RNA, 16 nt, Human
aagugcuguauaaaau

SEQ ID NO: 1391819 - RNA, 17 nt, Human
aagugcuguauaaaauc

SEQ ID NO: 1391820 - RNA, 15 nt, Human
aauaaugcuuugaaa

SEQ ID NO: 1391821 - RNA, 13 nt, Human
aauaaugcuuuga

SEQ ID NO: 1391822 - RNA, 12 nt, Human
aauaaugcuuug

SEQ ID NO: 1391823 - RNA, 12 nt, Human
aauaauguaaga

SEQ ID NO: 1391824 - RNA, 19 nt, Human
aauaauguaagacaaauau

SEQ ID NO: 1391825 - RNA, 16 nt, Human
aauaaugugaaacugg

SEQ ID NO: 1391826 - RNA, 12 nt, Human
aauaauaaagaa

SEQ ID NO: 1391827 - RNA, 20 nt, Human
aauaaguuuuuguuucacag

SEQ ID NO: 1391828 - RNA, 22 nt, Human
aauaaguucaaauucuucugaa

SEQ ID NO: 1391829 - RNA, 21 nt, Human
aauaaguucaaauucuucuga

SEQ ID NO: 1391830 - RNA, 18 nt, Human
aauaaguuauugcaguuu

SEQ ID NO: 1391831 - RNA, 14 nt, Human
aauaaguuauugca

SEQ ID NO: 1391832 - RNA, 13 nt, Human
aauaaguuauugc

SEQ ID NO: 1391833 - RNA, 20 nt, Human
aauaauaaagaauagcuuua

SEQ ID NO: 1391834 - RNA, 21 nt, Human
aauaaucacgcuuuccugaau

SEQ ID NO: 1391835 - RNA, 20 nt, Human
aauaaucacgcuuuccugaa

SEQ ID NO: 1391836 - RNA, 21 nt, Human
aauaauccuaaacauaugaau

SEQ ID NO: 1391837 - RNA, 22 nt, Human
aaguguaaaauauuuugaauca

SEQ ID NO: 1391838 - RNA, 18 nt, Human
aagugguucccucucuua

SEQ ID NO: 1391839 - RNA, 17 nt, Human
aaguggguuuuuuaguu

SEQ ID NO: 1391840 - RNA, 21 nt, Human
aaguggguuuuuuaguugaau

SEQ ID NO: 1391841 - RNA, 22 nt, Human
aagugcuguuuauuaaucuuag

SEQ ID NO: 1391842 - RNA, 21 nt, Human
aagugcuguuuauuaaucuua

SEQ ID NO: 1391843 - RNA, 18 nt, Human
aaguuguuguaaccugcu

SEQ ID NO: 1391844 - RNA, 20 nt, Human
aaguuguuccuuaagucaga

SEQ ID NO: 1391845 - RNA, 11 nt, Human
aauaaguuauu

SEQ ID NO: 1391846 - RNA, 18 nt, Human
aauaagugcccucuccca

SEQ ID NO: 1391847 - RNA, 17 nt, Human
aauaagugcccucuccc

SEQ ID NO: 1391848 - RNA, 16 nt, Human
aauaagugcccucucc

SEQ ID NO: 1391849 - RNA, 19 nt, Human
aauaaacuauuuguaaagu

SEQ ID NO: 1391850 - RNA, 22 nt, Human
aauaaaauucaacaaacauuug

SEQ ID NO: 1391851 - RNA, 18 nt, Human
aauaaaauucaacaaaca

SEQ ID NO: 1391852 - RNA, 16 nt, Human
aauaaacgucuuaaau

SEQ ID NO: 1391853 - RNA, 18 nt, Human
aauaaacuaauaauugca

SEQ ID NO: 1391854 - RNA, 19 nt, Human
aauaaaauucaacaaacau

SEQ ID NO: 1391855 - RNA, 17 nt, Human
aauaaacgucuuaaaua

SEQ ID NO: 1391856 - RNA, 15 nt, Human
aauauaauuguuuua

SEQ ID NO: 1391857 - RNA, 21 nt, Human
aauauggacacuuaauacuac

SEQ ID NO: 1391858 - RNA, 17 nt, Human
aauauggacacuuaaua

SEQ ID NO: 1391859 - RNA, 20 nt, Human
aauauaggaacuuaaauaau

SEQ ID NO: 1391860 - RNA, 21 nt, Human
aauauaggaacuuaaauaaug

SEQ ID NO: 1391861 - RNA, 18 nt, Human
aauauaggaacuuaaaua

SEQ ID NO: 1391862 - RNA, 22 nt, Human
aauauuaugagaugcuggcuug

SEQ ID NO: 1391863 - RNA, 15 nt, Human
aauauguaccaagaa

SEQ ID NO: 1391864 - RNA, 19 nt, Human
aauauguaccaagaaucuu

SEQ ID NO: 1391865 - RNA, 12 nt, Human
aauauguaccaa

SEQ ID NO: 1391866 - RNA, 21 nt, Human
aauaugggggccuuuugggaa

SEQ ID NO: 1391867 - RNA, 18 nt, Human
aauaugguguacauucuu

SEQ ID NO: 1391868 - RNA, 18 nt, Human
aauauggucuuuugguua

SEQ ID NO: 1391869 - RNA, 15 nt, Human
aauauggacugcuca

SEQ ID NO: 1391870 - RNA, 16 nt, Human
aauauuauuccucaaa

SEQ ID NO: 1391871 - RNA, 16 nt, Human
aauauuaugagaugcu

SEQ ID NO: 1391872 - RNA, 14 nt, Human
aauauuaugagaug

SEQ ID NO: 1391873 - RNA, 16 nt, Human
aauauuauguuaaaac

SEQ ID NO: 1391874 - RNA, 22 nt, Human
aaucaaauuuguaggguuucua

SEQ ID NO: 1391875 - RNA, 18 nt, Human
aauauuaugagaugcugg

SEQ ID NO: 1391876 - RNA, 20 nt, Human
aaucaaauuuguaggguuuc

SEQ ID NO: 1391877 - RNA, 14 nt, Human
aauauucaauaaag

SEQ ID NO: 1391878 - RNA, 15 nt, Human
aauauucaauaaagc

SEQ ID NO: 1391879 - RNA, 16 nt, Human
aauauucaauaaagcu

SEQ ID NO: 1391880 - RNA, 18 nt, Human
aaucaacuugcuuaucaa

SEQ ID NO: 1391881 - RNA, 20 nt, Human
aaucaauuacugguccaaaa

SEQ ID NO: 1391882 - RNA, 23 nt, Human
aaucacauauuuuaaaauuuguu

SEQ ID NO: 1391883 - RNA, 22 nt, Human
aaucacauauuuuaaaauuugu

SEQ ID NO: 1391884 - RNA, 13 nt, Human
aaucaacuugcuu

SEQ ID NO: 1391885 - RNA, 17 nt, Human
aaucaacuugcuuauca

SEQ ID NO: 1391886 - RNA, 15 nt, Human
aaucaacuugcuuau

SEQ ID NO: 1391887 - RNA, 14 nt, Human
aaucaauuaaaagu

SEQ ID NO: 1391888 - RNA, 21 nt, Human
aaucaacuugcuuaucaacuu

SEQ ID NO: 1391889 - RNA, 13 nt, Human
aaucacaauacau

SEQ ID NO: 1391890 - RNA, 23 nt, Human
aaugaugaucaauuauaguuucu

SEQ ID NO: 1391891 - RNA, 21 nt, Human
aaugaugaucaauuauaguuu

SEQ ID NO: 1391892 - RNA, 18 nt, Human
aaucccaaauuugauuga

SEQ ID NO: 1391893 - RNA, 13 nt, Human
aaucuccaaaaua

SEQ ID NO: 1391894 - RNA, 14 nt, Human
aaucuccaaaauaa

SEQ ID NO: 1391895 - RNA, 18 nt, Human
aaucuccaaaauaaaacu

SEQ ID NO: 1391896 - RNA, 16 nt, Human
aaucccaaauuugauu

SEQ ID NO: 1391897 - RNA, 11 nt, Human
aaucccaaauu

SEQ ID NO: 1391898 - RNA, 22 nt, Human
aauccaggcagauccaggacua

SEQ ID NO: 1391899 - RNA, 21 nt, Human
aauccaggcagauccaggacu

SEQ ID NO: 1391900 - RNA, 20 nt, Human
aauccaggcagauccaggac

SEQ ID NO: 1391901 - RNA, 14 nt, Human
aauccauacauuug

SEQ ID NO: 1391902 - RNA, 13 nt, Human
aauccauacauuu

SEQ ID NO: 1391903 - RNA, 21 nt, Human
aaugaacaucccuuuuucaau

SEQ ID NO: 1391904 - RNA, 15 nt, Human
aaugaacagaacaua

SEQ ID NO: 1391905 - RNA, 14 nt, Human
aaugaacagaacau

SEQ ID NO: 1391906 - RNA, 17 nt, Human
aaucugcauuauuggaa

SEQ ID NO: 1391907 - RNA, 16 nt, Human
aaucugcauuauugga

SEQ ID NO: 1391908 - RNA, 19 nt, Human
aaucugcaauucaaaaguu

SEQ ID NO: 1391909 - RNA, 15 nt, Human
aaucugcaauucaaa

SEQ ID NO: 1391910 - RNA, 17 nt, Human
aaucucaucucagugaa

SEQ ID NO: 1391911 - RNA, 17 nt, Human
aaucucauugcuuacaa

SEQ ID NO: 1391912 - RNA, 19 nt, Human
aaucugcuaccaaaacagu

SEQ ID NO: 1391913 - RNA, 18 nt, Human
aaucugcauuauuggaau

SEQ ID NO: 1391914 - RNA, 17 nt, Human
aaugaagauacugaaau

SEQ ID NO: 1391915 - RNA, 20 nt, Human
aaugauaacuggaaacuuca

SEQ ID NO: 1391916 - RNA, 11 nt, Human
aaugaagaaag

SEQ ID NO: 1391917 - RNA, 22 nt, Human
aaugaacagaacauagacagaa

SEQ ID NO: 1391918 - RNA, 12 nt, Human
aaugaagauacu

SEQ ID NO: 1391919 - RNA, 20 nt, Human
aauuaguuuuauaugcuucu

SEQ ID NO: 1391920 - RNA, 17 nt, Human
aauuaguuuuauaugcu

SEQ ID NO: 1391921 - RNA, 23 nt, Human
aauuaguuuccuuuuuaauaugc

SEQ ID NO: 1391922 - RNA, 15 nt, Human
aauuaguuuccuuuu

SEQ ID NO: 1391923 - RNA, 14 nt, Human
aauuaguuuccuuu

SEQ ID NO: 1391924 - RNA, 13 nt, Human
aauuaguuuccuu

SEQ ID NO: 1391925 - RNA, 12 nt, Human
aauuaguuuccu

SEQ ID NO: 1391926 - RNA, 14 nt, Human
aauuaguuauauau

SEQ ID NO: 1391927 - RNA, 22 nt, Human
aauuagugcuaagugugaacug

SEQ ID NO: 1391928 - RNA, 14 nt, Human
aauuaguuuuauau

SEQ ID NO: 1391929 - RNA, 16 nt, Human
aauuaaaguacuuuaa

SEQ ID NO: 1391930 - RNA, 14 nt, Human
aauuaaaguacuuu

SEQ ID NO: 1391931 - RNA, 15 nt, Human
aauuaaagcuguuau

SEQ ID NO: 1391932 - RNA, 19 nt, Human
aauuaaacuuuuaauucau

SEQ ID NO: 1391933 - RNA, 15 nt, Human
aauguuuuuugccac

SEQ ID NO: 1391934 - RNA, 13 nt, Human
aauguuuuuugcc

SEQ ID NO: 1391935 - RNA, 23 nt, Human
aauguuuuuugccacagcuuuug

SEQ ID NO: 1391936 - RNA, 15 nt, Human
aauguuuuucuaaag

SEQ ID NO: 1391937 - RNA, 14 nt, Human
aauguuuuucuaaa

SEQ ID NO: 1391938 - RNA, 22 nt, Human
aauguuuuuaauaaaagaaaau

SEQ ID NO: 1391939 - RNA, 14 nt, Human
aauuaaacuuuuaa

SEQ ID NO: 1391940 - RNA, 20 nt, Human
aauuaaaagcaaaucauuug

SEQ ID NO: 1391941 - RNA, 21 nt, Human
aauuaaaagcaaaucauuugu

SEQ ID NO: 1391942 - RNA, 18 nt, Human
aauuaaaagcaaaucauu

SEQ ID NO: 1391943 - RNA, 16 nt, Human
aauuaaaagcaaauca

SEQ ID NO: 1391944 - RNA, 19 nt, Human
aaugucuugagcucuauua

SEQ ID NO: 1391945 - RNA, 17 nt, Human
aaugucuugagcucuau

SEQ ID NO: 1391946 - RNA, 15 nt, Human
aaugucuugagcucu

SEQ ID NO: 1391947 - RNA, 14 nt, Human
aaugucuugagcuc

SEQ ID NO: 1391948 - RNA, 13 nt, Human
aaugucuugagcu

SEQ ID NO: 1391949 - RNA, 13 nt, Human
aaugucuuguguu

SEQ ID NO: 1391950 - RNA, 11 nt, Human
aaugucuugug

SEQ ID NO: 1391951 - RNA, 20 nt, Human
aaugucuugaugcaugcacu

SEQ ID NO: 1391952 - RNA, 16 nt, Human
aauggugccuucauuu

SEQ ID NO: 1391953 - RNA, 20 nt, Human
aaugucuggagaccaccagg

SEQ ID NO: 1391954 - RNA, 14 nt, Human
aaugucuggagacc

SEQ ID NO: 1391955 - RNA, 13 nt, Human
aaugucuggagac

SEQ ID NO: 1391956 - RNA, 18 nt, Human
aaugguaggcauuuccua

SEQ ID NO: 1391957 - RNA, 17 nt, Human
aaugguaggcauuuccu

SEQ ID NO: 1391958 - RNA, 18 nt, Human
aaugguacugacuuugcu

SEQ ID NO: 1391959 - RNA, 20 nt, Human
aaugguacuccacauauuuc

SEQ ID NO: 1391960 - RNA, 14 nt, Human
aauggggccagauc

SEQ ID NO: 1391961 - RNA, 13 nt, Human
aauggggccagau

SEQ ID NO: 1391962 - RNA, 12 nt, Human
aauggggccaga

SEQ ID NO: 1391963 - RNA, 14 nt, Human
aaugggcucaaacu

SEQ ID NO: 1391964 - RNA, 16 nt, Human
aaugggcucaaccaga

SEQ ID NO: 1391965 - RNA, 19 nt, Human
aauggcugauaauuuuaaa

SEQ ID NO: 1391966 - RNA, 18 nt, Human
aauggcugauaauuuuaa

SEQ ID NO: 1391967 - RNA, 17 nt, Human
aauggcugauaauuuua

SEQ ID NO: 1391968 - RNA, 16 nt, Human
aauggcugauaauuuu

SEQ ID NO: 1391969 - RNA, 18 nt, Human
aauggcuuuggucucuug

SEQ ID NO: 1391970 - RNA, 21 nt, Human
aauggcuuuggucucuugcuu

SEQ ID NO: 1391971 - RNA, 21 nt, Human
agaucuguuuugaaggcaaaa

SEQ ID NO: 1391972 - RNA, 14 nt, Human
agaucuguuuugaa

SEQ ID NO: 1391973 - RNA, 23 nt, Human
agaucuguccucagccuugccag

SEQ ID NO: 1391974 - RNA, 19 nt, Human
agaucuguccucagccuug

SEQ ID NO: 1391975 - RNA, 14 nt, Human
agaugacuugaggc

SEQ ID NO: 1391976 - RNA, 14 nt, Human
agaugacugagggu

SEQ ID NO: 1391977 - RNA, 14 nt, Human
agaucuuagauucu

SEQ ID NO: 1391978 - RNA, 18 nt, Human
agaucuguuuugaaggca

SEQ ID NO: 1391979 - RNA, 15 nt, Human
agaucuuagauucuc

SEQ ID NO: 1391980 - RNA, 22 nt, Human
agaugaggccagaccauggaca

SEQ ID NO: 1391981 - RNA, 13 nt, Human
agaugaggccaga

SEQ ID NO: 1391982 - RNA, 14 nt, Human
agaugaggccagac

SEQ ID NO: 1391983 - RNA, 16 nt, Human
agaugaggccagacca

SEQ ID NO: 1391984 - RNA, 21 nt, Human
agaugaggccagaccauggac

SEQ ID NO: 1391985 - RNA, 14 nt, Human
agauaguuuucauc

SEQ ID NO: 1391986 - RNA, 13 nt, Human
agauaguuuucau

SEQ ID NO: 1391987 - RNA, 17 nt, Human
agauaguuuucauccau

SEQ ID NO: 1391988 - RNA, 21 nt, Human
agauaggucagugcaaauacu

SEQ ID NO: 1391989 - RNA, 21 nt, Human
agaggauggucuuacagcagg

SEQ ID NO: 1391990 - RNA, 23 nt, Human
agaggagcccccacccuguuccu

SEQ ID NO: 1391991 - RNA, 17 nt, Human
agaggagccaccaguuc

SEQ ID NO: 1391992 - RNA, 16 nt, Human
agauacuuaagugcug

SEQ ID NO: 1391993 - RNA, 11 nt, Human
agaguuacagu

SEQ ID NO: 1391994 - RNA, 22 nt, Human
agaguuacaguucugugguuuc

SEQ ID NO: 1391995 - RNA, 17 nt, Human
agaguuacaguucugug

SEQ ID NO: 1391996 - RNA, 16 nt, Human
agaguuacaguucugu

SEQ ID NO: 1391997 - RNA, 15 nt, Human
agaguuacaguucug

SEQ ID NO: 1391998 - RNA, 21 nt, Human
agaggggcugaauagcagaag

SEQ ID NO: 1391999 - RNA, 23 nt, Human
agaggggccugccaccuggaccc

SEQ ID NO: 1392000 - RNA, 22 nt, Human
agaggggccugccaccuggacc

SEQ ID NO: 1392001 - RNA, 21 nt, Human
agaggggccugccaccuggac

SEQ ID NO: 1392002 - RNA, 20 nt, Human
agaggggccugccaccugga

SEQ ID NO: 1392003 - RNA, 17 nt, Human
agaggggccugccaccu

SEQ ID NO: 1392004 - RNA, 14 nt, Human
agaggggccugcca

SEQ ID NO: 1392005 - RNA, 13 nt, Human
agaggggccugcc

SEQ ID NO: 1392006 - RNA, 20 nt, Human
agaggggccgaugcccagag

SEQ ID NO: 1392007 - RNA, 16 nt, Human
agaggguguccugcac

SEQ ID NO: 1392008 - RNA, 21 nt, Human
agagcccgaggaggugucuca

SEQ ID NO: 1392009 - RNA, 22 nt, Human
agagcccgaggaggugucucag

SEQ ID NO: 1392010 - RNA, 22 nt, Human
agagagguuugcagucccaagc

SEQ ID NO: 1392011 - RNA, 17 nt, Human
agagccuuccacccagg

SEQ ID NO: 1392012 - RNA, 16 nt, Human
agagccuuccacccag

SEQ ID NO: 1392013 - RNA, 13 nt, Human
agagccuuccacc

SEQ ID NO: 1392014 - RNA, 22 nt, Human
agagccuuccacccaggggcag

SEQ ID NO: 1392015 - RNA, 20 nt, Human
agagccuuccacccaggggc

SEQ ID NO: 1392016 - RNA, 16 nt, Human
agagccuguaaacuuu

SEQ ID NO: 1392017 - RNA, 23 nt, Human
agagccuggggcucuaacgccug

SEQ ID NO: 1392018 - RNA, 16 nt, Human
agagccuggggcucua

SEQ ID NO: 1392019 - RNA, 13 nt, Human
agagccuggggcu

SEQ ID NO: 1392020 - RNA, 12 nt, Human
agagccuggggc

SEQ ID NO: 1392021 - RNA, 10 nt, Human
agagccuggg

SEQ ID NO: 1392022 - RNA, 19 nt, Human
agagcccugucaguagagu

SEQ ID NO: 1392023 - RNA, 13 nt, Human
agagcccugggac

SEQ ID NO: 1392024 - RNA, 12 nt, Human
agagcccuggga

SEQ ID NO: 1392025 - RNA, 17 nt, Human
agagcccugggaccgcu

SEQ ID NO: 1392026 - RNA, 15 nt, Human
agagcccugggaccg

SEQ ID NO: 1392027 - RNA, 23 nt, Human
agagaaaggggagcccacugucc

SEQ ID NO: 1392028 - RNA, 21 nt, Human
agagaaaggggagcccacugu

SEQ ID NO: 1392029 - RNA, 19 nt, Human
agagaaaggggagcccacu

SEQ ID NO: 1392030 - RNA, 18 nt, Human
agagaaaggggagcccac

SEQ ID NO: 1392031 - RNA, 21 nt, Human
agacugcauuauauuuauuac

SEQ ID NO: 1392032 - RNA, 17 nt, Human
agacugcauuauauuua

SEQ ID NO: 1392033 - RNA, 16 nt, Human
agagaaguagaaauca

SEQ ID NO: 1392034 - RNA, 22 nt, Human
agagaagccaucaccucagaug

SEQ ID NO: 1392035 - RNA, 16 nt, Human
agagaagccaucaccu

SEQ ID NO: 1392036 - RNA, 13 nt, Human
agagaagccauca

SEQ ID NO: 1392037 - RNA, 16 nt, Human
agagaagccagcuugu

SEQ ID NO: 1392038 - RNA, 14 nt, Human
agagaagccagcuu

SEQ ID NO: 1392039 - RNA, 13 nt, Human
agagaagccagcu

SEQ ID NO: 1392040 - RNA, 12 nt, Human
agagaagccagc

SEQ ID NO: 1392041 - RNA, 11 nt, Human
agagaagccag

SEQ ID NO: 1392042 - RNA, 23 nt, Human
agagaagcauucucauuggaaau

SEQ ID NO: 1392043 - RNA, 22 nt, Human
agagaagcauucucauuggaaa

SEQ ID NO: 1392044 - RNA, 15 nt, Human
agagaagcaaguaaa

SEQ ID NO: 1392045 - RNA, 22 nt, Human
agagaagccuucaagcucugag

SEQ ID NO: 1392046 - RNA, 21 nt, Human
agagaagccuucaagcucuga

SEQ ID NO: 1392047 - RNA, 17 nt, Human
agagaagccuucaagcu

SEQ ID NO: 1392048 - RNA, 14 nt, Human
agagaagccuucaa

SEQ ID NO: 1392049 - RNA, 13 nt, Human
agagaagccuuca

SEQ ID NO: 1392050 - RNA, 12 nt, Human
agagaagccuuc

SEQ ID NO: 1392051 - RNA, 23 nt, Human
agagaagccuucaagcucugagg

SEQ ID NO: 1392052 - RNA, 13 nt, Human
agagaaggagcag

SEQ ID NO: 1392053 - RNA, 16 nt, Human
agaccagggcuccagc

SEQ ID NO: 1392054 - RNA, 18 nt, Human
agaccagggcuccagccc

SEQ ID NO: 1392055 - RNA, 12 nt, Human
agaccagggcuc

SEQ ID NO: 1392056 - RNA, 17 nt, Human
agaccauccaccaggcc

SEQ ID NO: 1392057 - RNA, 13 nt, Human
agaccauaauguu

SEQ ID NO: 1392058 - RNA, 14 nt, Human
agaccacaugcccc

SEQ ID NO: 1392059 - RNA, 19 nt, Human
agaccaaggcuuucucuac

SEQ ID NO: 1392060 - RNA, 11 nt, Human
agaccaauaaa

SEQ ID NO: 1392061 - RNA, 21 nt, Human
agaccaagauggcccauccug

SEQ ID NO: 1392062 - RNA, 13 nt, Human
agaccaagcuugu

SEQ ID NO: 1392063 - RNA, 16 nt, Human
agaccaagcuugucca

SEQ ID NO: 1392064 - RNA, 14 nt, Human
agacgggcccuggu

SEQ ID NO: 1392065 - RNA, 16 nt, Human
agacuaagccagcacc

SEQ ID NO: 1392066 - RNA, 15 nt, Human
agacuaagccagcac

SEQ ID NO: 1392067 - RNA, 13 nt, Human
agacuaagccagc

SEQ ID NO: 1392068 - RNA, 16 nt, Human
agacguuuuauaagca

SEQ ID NO: 1392069 - RNA, 22 nt, Human
agacguuuuauaagcaucauua

SEQ ID NO: 1392070 - RNA, 21 nt, Human
agacuacagcuggggugcagg

SEQ ID NO: 1392071 - RNA, 16 nt, Human
agacuacagcuggggu

SEQ ID NO: 1392072 - RNA, 23 nt, Human
agacuacaggcacacaccaccac

SEQ ID NO: 1392073 - RNA, 13 nt, Human
agacaaugacuua

SEQ ID NO: 1392074 - RNA, 17 nt, Human
agacaaugacuuacugu

SEQ ID NO: 1392075 - RNA, 19 nt, Human
agacaaugacuuacuguac

SEQ ID NO: 1392076 - RNA, 15 nt, Human
agacaauuuauuaug

SEQ ID NO: 1392077 - RNA, 21 nt, Human
agacaauuuauuauggcacau

SEQ ID NO: 1392078 - RNA, 15 nt, Human
agccgagcaggaggc

SEQ ID NO: 1392079 - RNA, 14 nt, Human
agccgagcaggagg

SEQ ID NO: 1392080 - RNA, 16 nt, Human
agccgggucugccucu

SEQ ID NO: 1392081 - RNA, 24 nt, Human
agccggggugggguggcugcagcc

SEQ ID NO: 1392082 - RNA, 23 nt, Human
agccggggugggguggcugcagc

SEQ ID NO: 1392083 - RNA, 20 nt, Human
agccggggugggguggcugc

SEQ ID NO: 1392084 - RNA, 19 nt, Human
agccggggugggguggcug

SEQ ID NO: 1392085 - RNA, 16 nt, Human
agccgggguggggugg

SEQ ID NO: 1392086 - RNA, 16 nt, Human
agccggcacagggucu

SEQ ID NO: 1392087 - RNA, 15 nt, Human
agccggcacaggguc

SEQ ID NO: 1392088 - RNA, 14 nt, Human
agccggcacagggu

SEQ ID NO: 1392089 - RNA, 21 nt, Human
agccgcuuggcgaugccagcc

SEQ ID NO: 1392090 - RNA, 20 nt, Human
agccgcuuggcgaugccagc

SEQ ID NO: 1392091 - RNA, 16 nt, Human
agccggguguccccaa

SEQ ID NO: 1392092 - RNA, 22 nt, Human
agccgggucugccucuucuggg

SEQ ID NO: 1392093 - RNA, 21 nt, Human
agccgggucugccucuucugg

SEQ ID NO: 1392094 - RNA, 20 nt, Human
agccgggucugccucuucug

SEQ ID NO: 1392095 - RNA, 16 nt, Human
agccucccugaagccu

SEQ ID NO: 1392096 - RNA, 15 nt, Human
agccucccugaagcc

SEQ ID NO: 1392097 - RNA, 14 nt, Human
agccucccugaagc

SEQ ID NO: 1392098 - RNA, 17 nt, Human
agccucccugaagacca

SEQ ID NO: 1392099 - RNA, 13 nt, Human
agccuccucucuc

SEQ ID NO: 1392100 - RNA, 13 nt, Human
agccucccugaag

SEQ ID NO: 1392101 - RNA, 22 nt, Human
agccuccccugccagggcaggg

SEQ ID NO: 1392102 - RNA, 20 nt, Human
agccuccccugccagggcag

SEQ ID NO: 1392103 - RNA, 19 nt, Human
agccuccccugccagggca

SEQ ID NO: 1392104 - RNA, 18 nt, Human
agccuccccugccagggc

SEQ ID NO: 1392105 - RNA, 17 nt, Human
agccuccccugccaggg

SEQ ID NO: 1392106 - RNA, 16 nt, Human
agccuccccugccagg

SEQ ID NO: 1392107 - RNA, 15 nt, Human
agccuccccugccag

SEQ ID NO: 1392108 - RNA, 14 nt, Human
agccuccccugcca

SEQ ID NO: 1392109 - RNA, 23 nt, Human
agcccaaguucaugcagcugugg

SEQ ID NO: 1392110 - RNA, 21 nt, Human
agcccaaguucaugcagcugu

SEQ ID NO: 1392111 - RNA, 13 nt, Human
agccccacuccuc

SEQ ID NO: 1392112 - RNA, 17 nt, Human
agccccacccuggccua

SEQ ID NO: 1392113 - RNA, 16 nt, Human
agccccacccuggccu

SEQ ID NO: 1392114 - RNA, 23 nt, Human
agccccaccccagggcagccagg

SEQ ID NO: 1392115 - RNA, 19 nt, Human
agccccacccucagaugca

SEQ ID NO: 1392116 - RNA, 22 nt, Human
agccccaccccagggcagccag

SEQ ID NO: 1392117 - RNA, 18 nt, Human
agccccaccccagggcag

SEQ ID NO: 1392118 - RNA, 20 nt, Human
agccccacccaggccaggca

SEQ ID NO: 1392119 - RNA, 16 nt, Human
agccccacccaggcca

SEQ ID NO: 1392120 - RNA, 14 nt, Human
agccccacccaggc

SEQ ID NO: 1392121 - RNA, 19 nt, Human
agccccagcccagccccac

SEQ ID NO: 1392122 - RNA, 21 nt, Human
agccccagcccagccccacuc

SEQ ID NO: 1392123 - RNA, 14 nt, Human
agccccagccaggg

SEQ ID NO: 1392124 - RNA, 13 nt, Human
agccccagccagg

SEQ ID NO: 1392125 - RNA, 20 nt, Human
agcccuaggguggagagcca

SEQ ID NO: 1392126 - RNA, 17 nt, Human
agcccuaggguggagag

SEQ ID NO: 1392127 - RNA, 16 nt, Human
agcccuaggguggaga

SEQ ID NO: 1392128 - RNA, 23 nt, Human
agcccugaggacagaugccuccu

SEQ ID NO: 1392129 - RNA, 22 nt, Human
agcccugaggacagaugccucc

SEQ ID NO: 1392130 - RNA, 19 nt, Human
agcccugaggacagaugcc

SEQ ID NO: 1392131 - RNA, 17 nt, Human
agccccaucagcuccag

SEQ ID NO: 1392132 - RNA, 13 nt, Human
agauguaauuuug

SEQ ID NO: 1392133 - RNA, 19 nt, Human
agauguaauuuuguguaag

SEQ ID NO: 1392134 - RNA, 17 nt, Human
agauguaauuuugugua

SEQ ID NO: 1392135 - RNA, 15 nt, Human
agauguaauuuugug

SEQ ID NO: 1392136 - RNA, 14 nt, Human
agauguaauuuugu

SEQ ID NO: 1392137 - RNA, 20 nt, Human
agcagcccccagcucccacc

SEQ ID NO: 1392138 - RNA, 19 nt, Human
agcagcccccagcucccac

SEQ ID NO: 1392139 - RNA, 17 nt, Human
agcagcccccagcuccc

SEQ ID NO: 1392140 - RNA, 14 nt, Human
agcagcccccagcu

SEQ ID NO: 1392141 - RNA, 23 nt, Human
agcagccccacaccagggccagc

SEQ ID NO: 1392142 - RNA, 22 nt, Human
agcagccagcccugccuggagg

SEQ ID NO: 1392143 - RNA, 23 nt, Human
agcagccagcccugccuggagga

SEQ ID NO: 1392144 - RNA, 21 nt, Human
agcagccagcccugccuggag

SEQ ID NO: 1392145 - RNA, 20 nt, Human
agcagccagcccugccugga

SEQ ID NO: 1392146 - RNA, 19 nt, Human
agcagccagcccugccugg

SEQ ID NO: 1392147 - RNA, 18 nt, Human
agcagccagcccugccug

SEQ ID NO: 1392148 - RNA, 17 nt, Human
agcagccagcccugccu

SEQ ID NO: 1392149 - RNA, 16 nt, Human
agcagccagcccugcc

SEQ ID NO: 1392150 - RNA, 15 nt, Human
agcagccagcccugc

SEQ ID NO: 1392151 - RNA, 14 nt, Human
agcagccagcccug

SEQ ID NO: 1392152 - RNA, 13 nt, Human
agcagccagcccu

SEQ ID NO: 1392153 - RNA, 12 nt, Human
agcagccagccc

SEQ ID NO: 1392154 - RNA, 20 nt, Human
agcagccaccccaugcuggc

SEQ ID NO: 1392155 - RNA, 22 nt, Human
agcagccaccccaugcuggccu

SEQ ID NO: 1392156 - RNA, 11 nt, Human
agcagccagcc

SEQ ID NO: 1392157 - RNA, 13 nt, Human
agcagccacgagg

SEQ ID NO: 1392158 - RNA, 10 nt, Human
agcagccacg

SEQ ID NO: 1392159 - RNA, 20 nt, Human
agcagugaaugauucagugu

SEQ ID NO: 1392160 - RNA, 21 nt, Human
agcagucgugccuguguccau

SEQ ID NO: 1392161 - RNA, 19 nt, Human
agcagucgugccugugucc

SEQ ID NO: 1392162 - RNA, 22 nt, Human
agcagugaaugauucaguguua

SEQ ID NO: 1392163 - RNA, 21 nt, Human
agcagugaaugauucaguguu

SEQ ID NO: 1392164 - RNA, 17 nt, Human
agcacgugguaaaacac

SEQ ID NO: 1392165 - RNA, 20 nt, Human
agcacugccugcucccaucc

SEQ ID NO: 1392166 - RNA, 19 nt, Human
agcacugccugcucccauc

SEQ ID NO: 1392167 - RNA, 16 nt, Human
agcacugccugcuccc

SEQ ID NO: 1392168 - RNA, 15 nt, Human
agcacugccugcucc

SEQ ID NO: 1392169 - RNA, 13 nt, Human
agcacugccugcu

SEQ ID NO: 1392170 - RNA, 16 nt, Human
agcacugccaggaggg

SEQ ID NO: 1392171 - RNA, 17 nt, Human
agcacugccaggaggga

SEQ ID NO: 1392172 - RNA, 15 nt, Human
agcacugccaggagg

SEQ ID NO: 1392173 - RNA, 14 nt, Human
agcacugccaggag

SEQ ID NO: 1392174 - RNA, 21 nt, Human
agcacugccugcucccauccu

SEQ ID NO: 1392175 - RNA, 17 nt, Human
agcacugcuugaggaaa

SEQ ID NO: 1392176 - RNA, 12 nt, Human
agcacugcucca

SEQ ID NO: 1392177 - RNA, 20 nt, Human
agcaguugagacaagaaaau

SEQ ID NO: 1392178 - RNA, 22 nt, Human
agcaguugagacaagaaaauaa

SEQ ID NO: 1392179 - RNA, 19 nt, Human
agcaguugagacaagaaaa

SEQ ID NO: 1392180 - RNA, 23 nt, Human
agcaucuuggggggguggccgcu

SEQ ID NO: 1392181 - RNA, 21 nt, Human
agcaucuuggggggguggccg

SEQ ID NO: 1392182 - RNA, 19 nt, Human
agcaucuuggggggguggc

SEQ ID NO: 1392183 - RNA, 15 nt, Human
agcaucuugcauuau

SEQ ID NO: 1392184 - RNA, 18 nt, Human
agcaugcaauacauacca

SEQ ID NO: 1392185 - RNA, 12 nt, Human
agcaugaagaca

SEQ ID NO: 1392186 - RNA, 15 nt, Human
agcaugaagacagag

SEQ ID NO: 1392187 - RNA, 14 nt, Human
agcaugcacaaauu

SEQ ID NO: 1392188 - RNA, 18 nt, Human
agccagaggcuggguuca

SEQ ID NO: 1392189 - RNA, 15 nt, Human
agccagaggcugggu

SEQ ID NO: 1392190 - RNA, 14 nt, Human
agccagaggcuggg

SEQ ID NO: 1392191 - RNA, 11 nt, Human
agccagaggcu

SEQ ID NO: 1392192 - RNA, 15 nt, Human
agcaugcaucuguuu

SEQ ID NO: 1392193 - RNA, 12 nt, Human
agccauuugaga

SEQ ID NO: 1392194 - RNA, 22 nt, Human
agccauuggcuauuuaaaacuu

SEQ ID NO: 1392195 - RNA, 21 nt, Human
agccauuggcuauuuaaaacu

SEQ ID NO: 1392196 - RNA, 15 nt, Human
agccauguuucacaa

SEQ ID NO: 1392197 - RNA, 19 nt, Human
agccagauuuuccugaaaa

SEQ ID NO: 1392198 - RNA, 15 nt, Human
agccagauuuuccug

SEQ ID NO: 1392199 - RNA, 13 nt, Human
agccagcacacag

SEQ ID NO: 1392200 - RNA, 22 nt, Human
agccagauuuuuuaaaauuuau

SEQ ID NO: 1392201 - RNA, 23 nt, Human
agccagauuuuuuaaaauuuaua

SEQ ID NO: 1392202 - RNA, 18 nt, Human
agccagauuuuuuaaaau

SEQ ID NO: 1392203 - RNA, 17 nt, Human
aggggccgggggcaguc

SEQ ID NO: 1392204 - RNA, 22 nt, Human
agguaagaaguuuuaaaaagcc

SEQ ID NO: 1392205 - RNA, 15 nt, Human
agguaagaaguuuua

SEQ ID NO: 1392206 - RNA, 18 nt, Human
agguaauauaaaaagcuu

SEQ ID NO: 1392207 - RNA, 13 nt, Human
agguaaguuuuuu

SEQ ID NO: 1392208 - RNA, 23 nt, Human
aggucccuaauaaagcugugugg

SEQ ID NO: 1392209 - RNA, 20 nt, Human
aggucccuaauaaagcugug

SEQ ID NO: 1392210 - RNA, 18 nt, Human
aggucccuaauaaagcug

SEQ ID NO: 1392211 - RNA, 19 nt, Human
aggucccuaauaaagcugu

SEQ ID NO: 1392212 - RNA, 12 nt, Human
agguaccauccu

SEQ ID NO: 1392213 - RNA, 21 nt, Human
agguaauccaagauauuuuaa

SEQ ID NO: 1392214 - RNA, 17 nt, Human
aggucccuaauaaagcu

SEQ ID NO: 1392215 - RNA, 20 nt, Human
agguucuaaaguucuaagau

SEQ ID NO: 1392216 - RNA, 19 nt, Human
agguucuaaaguucuaaga

SEQ ID NO: 1392217 - RNA, 18 nt, Human
agguucuaaaguucuaag

SEQ ID NO: 1392218 - RNA, 17 nt, Human
agguucuaaaguucuaa

SEQ ID NO: 1392219 - RNA, 16 nt, Human
agguucuaaaguucua

SEQ ID NO: 1392220 - RNA, 15 nt, Human
agguucuaaaguucu

SEQ ID NO: 1392221 - RNA, 14 nt, Human
agguucuaaaguuc

SEQ ID NO: 1392222 - RNA, 13 nt, Human
agguucuaaaguu

SEQ ID NO: 1392223 - RNA, 13 nt, Human
agguucuaaggcc

SEQ ID NO: 1392224 - RNA, 12 nt, Human
agguucuaaggc

SEQ ID NO: 1392225 - RNA, 14 nt, Human
agguucuaacccua

SEQ ID NO: 1392226 - RNA, 23 nt, Human
agguucuaaaguucuaagauucu

SEQ ID NO: 1392227 - RNA, 19 nt, Human
agguucuaaggccuaggau

SEQ ID NO: 1392228 - RNA, 15 nt, Human
agguucuaaggccua

SEQ ID NO: 1392229 - RNA, 22 nt, Human
agguucuaaggccuaggauucu

SEQ ID NO: 1392230 - RNA, 13 nt, Human
agguuaauauuua

SEQ ID NO: 1392231 - RNA, 14 nt, Human
agguucaacuuauu

SEQ ID NO: 1392232 - RNA, 16 nt, Human
agguuaauauuuaaga

SEQ ID NO: 1392233 - RNA, 17 nt, Human
agguucaaagauauuuu

SEQ ID NO: 1392234 - RNA, 14 nt, Human
agguucccucccag

SEQ ID NO: 1392235 - RNA, 13 nt, Human
agguucccacuua

SEQ ID NO: 1392236 - RNA, 16 nt, Human
agguucccaagcucag

SEQ ID NO: 1392237 - RNA, 15 nt, Human
agguucccaagcuca

SEQ ID NO: 1392238 - RNA, 14 nt, Human
agguucccaagcuc

SEQ ID NO: 1392239 - RNA, 18 nt, Human
agguuccacagaggacac

SEQ ID NO: 1392240 - RNA, 12 nt, Human
agguucuaaagu

SEQ ID NO: 1392241 - RNA, 11 nt, Human
agguucuaaag

SEQ ID NO: 1392242 - RNA, 11 nt, Human
agguucuaaaa

SEQ ID NO: 1392243 - RNA, 13 nt, Human
agguucagccaag

SEQ ID NO: 1392244 - RNA, 19 nt, Human
agguucaagcaauccuccc

SEQ ID NO: 1392245 - RNA, 19 nt, Human
agguucagccaagguuuua

SEQ ID NO: 1392246 - RNA, 15 nt, Human
agguucagccaaggu

SEQ ID NO: 1392247 - RNA, 17 nt, Human
agguucaugcaaacuuu

SEQ ID NO: 1392248 - RNA, 18 nt, Human
aggugcucucuuucuguc

SEQ ID NO: 1392249 - RNA, 20 nt, Human
aggugcugacggccagggag

SEQ ID NO: 1392250 - RNA, 17 nt, Human
aggugcugacggccagg

SEQ ID NO: 1392251 - RNA, 16 nt, Human
aggugcugacggccag

SEQ ID NO: 1392252 - RNA, 22 nt, Human
agguccugguggggcagcuccu

SEQ ID NO: 1392253 - RNA, 19 nt, Human
agguccugguggggcagcu

SEQ ID NO: 1392254 - RNA, 17 nt, Human
agguccugguggggcag

SEQ ID NO: 1392255 - RNA, 14 nt, Human
agguccuggugggg

SEQ ID NO: 1392256 - RNA, 23 nt, Human
agguccugagcacugccaggagg

SEQ ID NO: 1392257 - RNA, 22 nt, Human
agguccugagcacugccaggag

SEQ ID NO: 1392258 - RNA, 21 nt, Human
agguccugagcacugccagga

SEQ ID NO: 1392259 - RNA, 20 nt, Human
agguccugagcacugccagg

SEQ ID NO: 1392260 - RNA, 20 nt, Human
aggucgcuugggaauuuuau

SEQ ID NO: 1392261 - RNA, 20 nt, Human
agguccugguggggcagcuc

SEQ ID NO: 1392262 - RNA, 23 nt, Human
agguggauggccccagcacagcu

SEQ ID NO: 1392263 - RNA, 16 nt, Human
agguggauggccccag

SEQ ID NO: 1392264 - RNA, 23 nt, Human
aggugcuucuaguucugccagga

SEQ ID NO: 1392265 - RNA, 19 nt, Human
agguccugagcacugccag

SEQ ID NO: 1392266 - RNA, 21 nt, Human
aggugcuucaggauaccauau

SEQ ID NO: 1392267 - RNA, 17 nt, Human
aggugcuggggccuggu

SEQ ID NO: 1392268 - RNA, 22 nt, Human
aggugcuucuaguucugccagg

SEQ ID NO: 1392269 - RNA, 21 nt, Human
aggugcuucuaguucugccag

SEQ ID NO: 1392270 - RNA, 15 nt, Human
agguggaaauaaacu

SEQ ID NO: 1392271 - RNA, 20 nt, Human
aggcagacucuuuaugcuug

SEQ ID NO: 1392272 - RNA, 21 nt, Human
aggcagacucuuuaugcuugc

SEQ ID NO: 1392273 - RNA, 21 nt, Human
aggcugacaccuaacucuucu

SEQ ID NO: 1392274 - RNA, 18 nt, Human
aggcugaggcuggcacag

SEQ ID NO: 1392275 - RNA, 15 nt, Human
aggcugauuucuagg

SEQ ID NO: 1392276 - RNA, 21 nt, Human
aggcugaugucaauuucugug

SEQ ID NO: 1392277 - RNA, 22 nt, Human
aggcuauggacagggcaugcca

SEQ ID NO: 1392278 - RNA, 19 nt, Human
aggcuguuaaauacaggaa

SEQ ID NO: 1392279 - RNA, 22 nt, Human
aggcuguguuuggcuuucaggg

SEQ ID NO: 1392280 - RNA, 21 nt, Human
aggcuguguuuggcuuucagg

SEQ ID NO: 1392281 - RNA, 20 nt, Human
aggcuguguuuggcuuucag

SEQ ID NO: 1392282 - RNA, 18 nt, Human
aggcuguguuuggcuuuc

SEQ ID NO: 1392283 - RNA, 19 nt, Human
aggcuguguaagauuuguu

SEQ ID NO: 1392284 - RNA, 17 nt, Human
aggcuguguaagauuug

SEQ ID NO: 1392285 - RNA, 19 nt, Human
aggcuguggugagggaaga

SEQ ID NO: 1392286 - RNA, 16 nt, Human
aggcuguggucacagc

SEQ ID NO: 1392287 - RNA, 18 nt, Human
aggcuguggaccauggag

SEQ ID NO: 1392288 - RNA, 16 nt, Human
aggcugccguccccua

SEQ ID NO: 1392289 - RNA, 16 nt, Human
aggcugucuguuguau

SEQ ID NO: 1392290 - RNA, 17 nt, Human
aggcugccccucucacc

SEQ ID NO: 1392291 - RNA, 15 nt, Human
aggcugccccucuca

SEQ ID NO: 1392292 - RNA, 12 nt, Human
aggcugccccuc

SEQ ID NO: 1392293 - RNA, 12 nt, Human
aggcugccugag

SEQ ID NO: 1392294 - RNA, 22 nt, Human
aggcugccguccccuagagucc

SEQ ID NO: 1392295 - RNA, 22 nt, Human
aggcugcccuccugugcucagc

SEQ ID NO: 1392296 - RNA, 14 nt, Human
aggcugcccuccug

SEQ ID NO: 1392297 - RNA, 13 nt, Human
aggcugcccuccu

SEQ ID NO: 1392298 - RNA, 12 nt, Human
aggcugcccucc

SEQ ID NO: 1392299 - RNA, 22 nt, Human
agggacagaggccccagccucc

SEQ ID NO: 1392300 - RNA, 21 nt, Human
agggacagaggccccagccuc

SEQ ID NO: 1392301 - RNA, 20 nt, Human
agggacagaggccccagccu

SEQ ID NO: 1392302 - RNA, 17 nt, Human
agggacagaggccccag

SEQ ID NO: 1392303 - RNA, 20 nt, Human
agggacucaucauuuccauu

SEQ ID NO: 1392304 - RNA, 22 nt, Human
agggcacaggagcuaccugugu

SEQ ID NO: 1392305 - RNA, 23 nt, Human
agggcacaggagcuaccugugug

SEQ ID NO: 1392306 - RNA, 20 nt, Human
agggcacaggagcuaccugu

SEQ ID NO: 1392307 - RNA, 19 nt, Human
agggcacaggagcuaccug

SEQ ID NO: 1392308 - RNA, 18 nt, Human
agggcacaggagcuaccu

SEQ ID NO: 1392309 - RNA, 17 nt, Human
agggcacaggagcuacc

SEQ ID NO: 1392310 - RNA, 15 nt, Human
agggcacaggagcua

SEQ ID NO: 1392311 - RNA, 14 nt, Human
agggcacaggagcu

SEQ ID NO: 1392312 - RNA, 13 nt, Human
agggcacaggagc

SEQ ID NO: 1392313 - RNA, 12 nt, Human
agggcacaggag

SEQ ID NO: 1392314 - RNA, 19 nt, Human
agggcaauuaauuccuuca

SEQ ID NO: 1392315 - RNA, 22 nt, Human
agggcaauuaauuccuucagca

SEQ ID NO: 1392316 - RNA, 18 nt, Human
agggcaauuaauuccuuc

SEQ ID NO: 1392317 - RNA, 18 nt, Human
aggggauuuuuaugucug

SEQ ID NO: 1392318 - RNA, 17 nt, Human
agggcggggguggcggc

SEQ ID NO: 1392319 - RNA, 20 nt, Human
agggcgggcagagggcugga

SEQ ID NO: 1392320 - RNA, 19 nt, Human
agggcgggcagagggcugg

SEQ ID NO: 1392321 - RNA, 18 nt, Human
agggcgggcagagggcug

SEQ ID NO: 1392322 - RNA, 17 nt, Human
agggcgggcagagggcu

SEQ ID NO: 1392323 - RNA, 17 nt, Human
agggcggccuccuucug

SEQ ID NO: 1392324 - RNA, 23 nt, Human
agggcggcaggggccuggagauc

SEQ ID NO: 1392325 - RNA, 19 nt, Human
agggcggcaggggccugga

SEQ ID NO: 1392326 - RNA, 18 nt, Human
agggcggcaggggccugg

SEQ ID NO: 1392327 - RNA, 16 nt, Human
agggcggcaggggccu

SEQ ID NO: 1392328 - RNA, 15 nt, Human
agggcggcaggggcc

SEQ ID NO: 1392329 - RNA, 13 nt, Human
agggcggcagggg

SEQ ID NO: 1392330 - RNA, 19 nt, Human
aggggccgaugcccagaga

SEQ ID NO: 1392331 - RNA, 18 nt, Human
aggggccgaugcccagag

SEQ ID NO: 1392332 - RNA, 17 nt, Human
aggggccgaugcccaga

SEQ ID NO: 1392333 - RNA, 15 nt, Human
aggggcccuggagca

SEQ ID NO: 1392334 - RNA, 17 nt, Human
aggggcccuggagcagc

SEQ ID NO: 1392335 - RNA, 13 nt, Human
aggggcagagcca

SEQ ID NO: 1392336 - RNA, 12 nt, Human
aggggcagcccc

SEQ ID NO: 1392337 - RNA, 13 nt, Human
aggggcagaggcc

SEQ ID NO: 1392338 - RNA, 14 nt, Human
aggggcagagccag

SEQ ID NO: 1392339 - RNA, 15 nt, Human
aggggcagagccagg

SEQ ID NO: 1392340 - RNA, 16 nt, Human
aggggcagagccagga

SEQ ID NO: 1392341 - RNA, 17 nt, Human
aggggcagagccaggaa

SEQ ID NO: 1392342 - RNA, 15 nt, Human
agcuccucccucuca

SEQ ID NO: 1392343 - RNA, 14 nt, Human
agcuccucccucuc

SEQ ID NO: 1392344 - RNA, 13 nt, Human
agcuccucccucu

SEQ ID NO: 1392345 - RNA, 17 nt, Human
agcuccuccccuggagg

SEQ ID NO: 1392346 - RNA, 14 nt, Human
agcuccuccccugg

SEQ ID NO: 1392347 - RNA, 11 nt, Human
agcuccucccc

SEQ ID NO: 1392348 - RNA, 12 nt, Human
agcuccucccac

SEQ ID NO: 1392349 - RNA, 14 nt, Human
agcuccuguccccu

SEQ ID NO: 1392350 - RNA, 11 nt, Human
agcuccuguaa

SEQ ID NO: 1392351 - RNA, 24 nt, Human
agcuccugaccaguugcagucacu

SEQ ID NO: 1392352 - RNA, 19 nt, Human
agcuccugaccaguugcag

SEQ ID NO: 1392353 - RNA, 16 nt, Human
agcuccugaccaguug

SEQ ID NO: 1392354 - RNA, 15 nt, Human
agcuccugaccaguu

SEQ ID NO: 1392355 - RNA, 14 nt, Human
agcuccugaccagu

SEQ ID NO: 1392356 - RNA, 18 nt, Human
agcuccugacacugcugg

SEQ ID NO: 1392357 - RNA, 10 nt, Human
agcuccugac

SEQ ID NO: 1392358 - RNA, 18 nt, Human
agcuccucuuccaugcug

SEQ ID NO: 1392359 - RNA, 15 nt, Human
agcuccucuuccaug

SEQ ID NO: 1392360 - RNA, 14 nt, Human
agcuccucuuccau

SEQ ID NO: 1392361 - RNA, 13 nt, Human
agcuccucuucca

SEQ ID NO: 1392362 - RNA, 24 nt, Human
agcuccucugucucgagcgcccug

SEQ ID NO: 1392363 - RNA, 18 nt, Human
agcuccucugucucgagc

SEQ ID NO: 1392364 - RNA, 12 nt, Human
agcuccucuguc

SEQ ID NO: 1392365 - RNA, 20 nt, Human
agcuccuguccccugcuaca

SEQ ID NO: 1392366 - RNA, 18 nt, Human
agcuccuguccccugcua

SEQ ID NO: 1392367 - RNA, 17 nt, Human
agcuccuguccccugcu

SEQ ID NO: 1392368 - RNA, 16 nt, Human
agcuccuguccccugc

SEQ ID NO: 1392369 - RNA, 24 nt, Human
agcuccuguccccugcuacaccua

SEQ ID NO: 1392370 - RNA, 22 nt, Human
agcugaauguuuuucuaaagga

SEQ ID NO: 1392371 - RNA, 22 nt, Human
agcugcuccgaggacccaggaa

SEQ ID NO: 1392372 - RNA, 20 nt, Human
agcugcuccgaggacccagg

SEQ ID NO: 1392373 - RNA, 19 nt, Human
agcugcuccgaggacccag

SEQ ID NO: 1392374 - RNA, 18 nt, Human
agcugcuccgaggaccca

SEQ ID NO: 1392375 - RNA, 14 nt, Human
agcugaguuuccua

SEQ ID NO: 1392376 - RNA, 13 nt, Human
agcugaucaguuu

SEQ ID NO: 1392377 - RNA, 20 nt, Human
agcugauacuuugacagugu

SEQ ID NO: 1392378 - RNA, 21 nt, Human
agcugaguuuccuaugggaac

SEQ ID NO: 1392379 - RNA, 13 nt, Human
agcugaguuuccu

SEQ ID NO: 1392380 - RNA, 21 nt, Human
agcugaguuaggugucugucc

SEQ ID NO: 1392381 - RNA, 22 nt, Human
agcugaguauuaaaauguaugc

SEQ ID NO: 1392382 - RNA, 19 nt, Human
agcugaguauuaaaaugua

SEQ ID NO: 1392383 - RNA, 22 nt, Human
agcugaggugcccaggagaaga

SEQ ID NO: 1392384 - RNA, 19 nt, Human
agcugaggugcccaggaga

SEQ ID NO: 1392385 - RNA, 18 nt, Human
agcugaggugcccaggag

SEQ ID NO: 1392386 - RNA, 17 nt, Human
agcugaggugcccagga

SEQ ID NO: 1392387 - RNA, 16 nt, Human
agcugaggugcccagg

SEQ ID NO: 1392388 - RNA, 15 nt, Human
agcugaggugcccag

SEQ ID NO: 1392389 - RNA, 12 nt, Human
agcugaggugcc

SEQ ID NO: 1392390 - RNA, 22 nt, Human
agcugaggccacacucagcaca

SEQ ID NO: 1392391 - RNA, 20 nt, Human
agcugaauguuuuucuaaag

SEQ ID NO: 1392392 - RNA, 22 nt, Human
agcugaccagccgugagcaugu

SEQ ID NO: 1392393 - RNA, 19 nt, Human
agcugaccagccgugagca

SEQ ID NO: 1392394 - RNA, 16 nt, Human
agcugaccagccguga

SEQ ID NO: 1392395 - RNA, 17 nt, Human
agcugggucaggcaggg

SEQ ID NO: 1392396 - RNA, 16 nt, Human
agcugggucaggcagg

SEQ ID NO: 1392397 - RNA, 16 nt, Human
agcugcucugucuucu

SEQ ID NO: 1392398 - RNA, 15 nt, Human
agcugggucaggcag

SEQ ID NO: 1392399 - RNA, 23 nt, Human
agcuuccuucagagagcagugcu

SEQ ID NO: 1392400 - RNA, 20 nt, Human
agcuuccuucagagagcagu

SEQ ID NO: 1392401 - RNA, 19 nt, Human
agcuuccuucagagagcag

SEQ ID NO: 1392402 - RNA, 18 nt, Human
agcuuccuucagagagca

SEQ ID NO: 1392403 - RNA, 17 nt, Human
agcuuccuucagagagc

SEQ ID NO: 1392404 - RNA, 16 nt, Human
agcuuccuucagagag

SEQ ID NO: 1392405 - RNA, 17 nt, Human
agcuucagugcugccga

SEQ ID NO: 1392406 - RNA, 17 nt, Human
agcuucagccaggagcu

SEQ ID NO: 1392407 - RNA, 19 nt, Human
agcuucagccaggagcugg

SEQ ID NO: 1392408 - RNA, 20 nt, Human
agcuucagccaggagcuggg

SEQ ID NO: 1392409 - RNA, 20 nt, Human
agcuucguuuauuuucaaga

SEQ ID NO: 1392410 - RNA, 21 nt, Human
agcuuccuucagagagcagug

SEQ ID NO: 1392411 - RNA, 12 nt, Human
agcuucuccaac

SEQ ID NO: 1392412 - RNA, 19 nt, Human
agcuucucauccugcaggc

SEQ ID NO: 1392413 - RNA, 15 nt, Human
agcuucagccaggag

SEQ ID NO: 1392414 - RNA, 14 nt, Human
aggaaaaacagguc

SEQ ID NO: 1392415 - RNA, 15 nt, Human
agcuuuucccuuuuu

SEQ ID NO: 1392416 - RNA, 22 nt, Human
aggaaauguuuuuaauaaaaga

SEQ ID NO: 1392417 - RNA, 20 nt, Human
aggaaauguuuuuaauaaaa

SEQ ID NO: 1392418 - RNA, 23 nt, Human
aggaaaugugguagccucacuuu

SEQ ID NO: 1392419 - RNA, 19 nt, Human
aggaaaugaaaaugucuug

SEQ ID NO: 1392420 - RNA, 22 nt, Human
aggaaaucccuucauacuugaa

SEQ ID NO: 1392421 - RNA, 18 nt, Human
aggaaaucccuucauacu

SEQ ID NO: 1392422 - RNA, 16 nt, Human
aggaaaucccuucaua

SEQ ID NO: 1392423 - RNA, 14 nt, Human
aggaaaucccuuca

SEQ ID NO: 1392424 - RNA, 13 nt, Human
aggaaaucccuuc

SEQ ID NO: 1392425 - RNA, 22 nt, Human
aggaaaaagcaaguucgucugu

SEQ ID NO: 1392426 - RNA, 18 nt, Human
agcuuuucccaaaagccc

SEQ ID NO: 1392427 - RNA, 21 nt, Human
agcuguauagcugcuuccagu

SEQ ID NO: 1392428 - RNA, 14 nt, Human
agcuguaugauucc

SEQ ID NO: 1392429 - RNA, 22 nt, Human
aggcacugcccugguggcccuc

SEQ ID NO: 1392430 - RNA, 15 nt, Human
aggcacugcccuggu

SEQ ID NO: 1392431 - RNA, 14 nt, Human
aggcacugcccugg

SEQ ID NO: 1392432 - RNA, 13 nt, Human
aggcacugcccug

SEQ ID NO: 1392433 - RNA, 19 nt, Human
aggcacugcaaaccgccac

SEQ ID NO: 1392434 - RNA, 21 nt, Human
aggcacuguaguucuaagacu

SEQ ID NO: 1392435 - RNA, 19 nt, Human
aggcacuguaguucuaaga

SEQ ID NO: 1392436 - RNA, 17 nt, Human
aggcacuguaguucuaa

SEQ ID NO: 1392437 - RNA, 16 nt, Human
aggcacuguaguucua

SEQ ID NO: 1392438 - RNA, 14 nt, Human
aggcacugggcucc

SEQ ID NO: 1392439 - RNA, 16 nt, Human
aggcacugggcaugag

SEQ ID NO: 1392440 - RNA, 13 nt, Human
aggcacugggcau

SEQ ID NO: 1392441 - RNA, 21 nt, Human
aggcacugcccugguggcccu

SEQ ID NO: 1392442 - RNA, 21 nt, Human
aggagggggucguggagagcu

SEQ ID NO: 1392443 - RNA, 20 nt, Human
aggagggggucguggagagc

SEQ ID NO: 1392444 - RNA, 23 nt, Human
aggaggggggagggaagggagcc

SEQ ID NO: 1392445 - RNA, 21 nt, Human
aggaggggggagggaagggag

SEQ ID NO: 1392446 - RNA, 17 nt, Human
aggaggggggagggaag

SEQ ID NO: 1392447 - RNA, 16 nt, Human
aggaggggggagggaa

SEQ ID NO: 1392448 - RNA, 14 nt, Human
aggaggggggaggg

SEQ ID NO: 1392449 - RNA, 16 nt, Human
aggaggggcuguaaaa

SEQ ID NO: 1392450 - RNA, 18 nt, Human
aggaggggaagaggccug

SEQ ID NO: 1392451 - RNA, 16 nt, Human
aggaggggaagaggcc

SEQ ID NO: 1392452 - RNA, 15 nt, Human
aggaggggaagaggc

SEQ ID NO: 1392453 - RNA, 12 nt, Human
aggaggggaaga

SEQ ID NO: 1392454 - RNA, 13 nt, Human
aggauucugcugg

SEQ ID NO: 1392455 - RNA, 14 nt, Human
aggauucuaaaaug

SEQ ID NO: 1392456 - RNA, 12 nt, Human
aggauucuaaaa

SEQ ID NO: 1392457 - RNA, 21 nt, Human
aggauucugcuggccucugcg

SEQ ID NO: 1392458 - RNA, 20 nt, Human
aggauucugcuggccucugc

SEQ ID NO: 1392459 - RNA, 22 nt, Human
aggauucugcuggccucugcga

SEQ ID NO: 1392460 - RNA, 12 nt, Human
aggaccagcuca

SEQ ID NO: 1392461 - RNA, 22 nt, Human
aggaccagaagcucccccagca

SEQ ID NO: 1392462 - RNA, 16 nt, Human
aggaccagaagcuccc

SEQ ID NO: 1392463 - RNA, 12 nt, Human
aggaccagaagc

SEQ ID NO: 1392464 - RNA, 17 nt, Human
aggaccacaggcucagg

SEQ ID NO: 1392465 - RNA, 14 nt, Human
aggaccacaggcuc

SEQ ID NO: 1392466 - RNA, 20 nt, Human
aggaccacaggcucaggcag

SEQ ID NO: 1392467 - RNA, 19 nt, Human
aggaccaagcaucuugggg

SEQ ID NO: 1392468 - RNA, 17 nt, Human
aggaccaagcaucuugg

SEQ ID NO: 1392469 - RNA, 23 nt, Human
aggaccagcucaggacagaugcc

SEQ ID NO: 1392470 - RNA, 18 nt, Human
aggaccagcucaggacag

SEQ ID NO: 1392471 - RNA, 15 nt, Human
aggaccagcucagga

SEQ ID NO: 1392472 - RNA, 14 nt, Human
aggaccagcucagg

SEQ ID NO: 1392473 - RNA, 13 nt, Human
aggaccagcucag

SEQ ID NO: 1392474 - RNA, 19 nt, Human
aggagaagcucagcugcau

SEQ ID NO: 1392475 - RNA, 15 nt, Human
aggagaagcucagcu

SEQ ID NO: 1392476 - RNA, 14 nt, Human
aggagaagcucagc

SEQ ID NO: 1392477 - RNA, 13 nt, Human
aggagaagcucag

SEQ ID NO: 1392478 - RNA, 12 nt, Human
aggagaagcuca

SEQ ID NO: 1392479 - RNA, 15 nt, Human
aggagaagccaggaa

SEQ ID NO: 1392480 - RNA, 14 nt, Human
aggagaagccagga

SEQ ID NO: 1392481 - RNA, 13 nt, Human
aggagaagccagg

SEQ ID NO: 1392482 - RNA, 12 nt, Human
aggagaagccag

SEQ ID NO: 1392483 - RNA, 11 nt, Human
aggagaagcca

SEQ ID NO: 1392484 - RNA, 22 nt, Human
aggagaaccaaaucuggaagcc

SEQ ID NO: 1392485 - RNA, 19 nt, Human
aggagaaccaaaucuggaa

SEQ ID NO: 1392486 - RNA, 16 nt, Human
aggagaaccaaaucug

SEQ ID NO: 1392487 - RNA, 15 nt, Human
aggaacuacugagga

SEQ ID NO: 1392488 - RNA, 20 nt, Human
aucgcagaccuuuuuuagga

SEQ ID NO: 1392489 - RNA, 20 nt, Human
aucgcaccacuguguauuua

SEQ ID NO: 1392490 - RNA, 18 nt, Human
aucgcaccauucugacuc

SEQ ID NO: 1392491 - RNA, 17 nt, Human
aucgcaccauucugacu

SEQ ID NO: 1392492 - RNA, 15 nt, Human
auccucccuuccucc

SEQ ID NO: 1392493 - RNA, 16 nt, Human
auccucccuguaacuu

SEQ ID NO: 1392494 - RNA, 15 nt, Human
auccucccuguaacu

SEQ ID NO: 1392495 - RNA, 11 nt, Human
auccucccugu

SEQ ID NO: 1392496 - RNA, 18 nt, Human
aucccucaccuucugagu

SEQ ID NO: 1392497 - RNA, 17 nt, Human
aucccucaccuucugag

SEQ ID NO: 1392498 - RNA, 16 nt, Human
aucccucaccuucuga

SEQ ID NO: 1392499 - RNA, 20 nt, Human
auccuccuaccuccaaagcu

SEQ ID NO: 1392500 - RNA, 17 nt, Human
aucccucaccuguagca

SEQ ID NO: 1392501 - RNA, 14 nt, Human
aucccucaccugua

SEQ ID NO: 1392502 - RNA, 15 nt, Human
aucccuacuguaauu

SEQ ID NO: 1392503 - RNA, 14 nt, Human
aucccuagcuguga

SEQ ID NO: 1392504 - RNA, 12 nt, Human
aucccucaccca

SEQ ID NO: 1392505 - RNA, 13 nt, Human
aucccucaccugu

SEQ ID NO: 1392506 - RNA, 19 nt, Human
aucccucacccauccuaga

SEQ ID NO: 1392507 - RNA, 19 nt, Human
aucccgagcaccuccacau

SEQ ID NO: 1392508 - RNA, 15 nt, Human
aucccgauucacccu

SEQ ID NO: 1392509 - RNA, 20 nt, Human
aucccgauucacccugucca

SEQ ID NO: 1392510 - RNA, 17 nt, Human
aucccgagcaccuccac

SEQ ID NO: 1392511 - RNA, 14 nt, Human
aucccgagcaccuc

SEQ ID NO: 1392512 - RNA, 22 nt, Human
auccccuugaggucucagcccc

SEQ ID NO: 1392513 - RNA, 21 nt, Human
auccccuugaggucucagccc

SEQ ID NO: 1392514 - RNA, 16 nt, Human
auccccuugaacucuu

SEQ ID NO: 1392515 - RNA, 12 nt, Human
auccccuugaac

SEQ ID NO: 1392516 - RNA, 23 nt, Human
auccccuucuccccugcacugua

SEQ ID NO: 1392517 - RNA, 22 nt, Human
auccccuucuccccugcacugu

SEQ ID NO: 1392518 - RNA, 21 nt, Human
auccccuucuccccugcacug

SEQ ID NO: 1392519 - RNA, 20 nt, Human
auccccuucuccccugcacu

SEQ ID NO: 1392520 - RNA, 15 nt, Human
auccccuucuccccu

SEQ ID NO: 1392521 - RNA, 23 nt, Human
auccaccccaauccucccagaaa

SEQ ID NO: 1392522 - RNA, 20 nt, Human
auccacccgccucagccucc

SEQ ID NO: 1392523 - RNA, 16 nt, Human
aucagcccuugggggu

SEQ ID NO: 1392524 - RNA, 16 nt, Human
aucagccuacaggccu

SEQ ID NO: 1392525 - RNA, 19 nt, Human
aucagccccacccuggccu

SEQ ID NO: 1392526 - RNA, 17 nt, Human
aucagccccacccuggc

SEQ ID NO: 1392527 - RNA, 16 nt, Human
aucagccccacccugg

SEQ ID NO: 1392528 - RNA, 15 nt, Human
aucagccccacccug

SEQ ID NO: 1392529 - RNA, 13 nt, Human
aucagccagugac

SEQ ID NO: 1392530 - RNA, 19 nt, Human
aucagccaauuauguuaaa

SEQ ID NO: 1392531 - RNA, 16 nt, Human
aucagccaauuauguu

SEQ ID NO: 1392532 - RNA, 18 nt, Human
aucagccaauuauguuaa

SEQ ID NO: 1392533 - RNA, 15 nt, Human
aucagccaauuaugu

SEQ ID NO: 1392534 - RNA, 15 nt, Human
aucauggcuaucugu

SEQ ID NO: 1392535 - RNA, 19 nt, Human
aucauggccagcuggaggc

SEQ ID NO: 1392536 - RNA, 17 nt, Human
aucauggccagcuggag

SEQ ID NO: 1392537 - RNA, 14 nt, Human
aucauggccagcug

SEQ ID NO: 1392538 - RNA, 13 nt, Human
aucauggccagcu

SEQ ID NO: 1392539 - RNA, 12 nt, Human
aucauggccagc

SEQ ID NO: 1392540 - RNA, 15 nt, Human
aucaucuauagaaag

SEQ ID NO: 1392541 - RNA, 18 nt, Human
aucaucuuggaacugcau

SEQ ID NO: 1392542 - RNA, 19 nt, Human
aucaucuauagaaagcuau

SEQ ID NO: 1392543 - RNA, 13 nt, Human
aucaucucagcuc

SEQ ID NO: 1392544 - RNA, 23 nt, Human
aucaucuccugccuuccuccugg

SEQ ID NO: 1392545 - RNA, 20 nt, Human
aucaucuccugccuuccucc

SEQ ID NO: 1392546 - RNA, 14 nt, Human
aucaucucagcuca

SEQ ID NO: 1392547 - RNA, 19 nt, Human
aucaucucagcucacugca

SEQ ID NO: 1392548 - RNA, 12 nt, Human
aucuugaaauua

SEQ ID NO: 1392549 - RNA, 22 nt, Human
aucuugaaauuaagaaggcaaa

SEQ ID NO: 1392550 - RNA, 21 nt, Human
aucuugaaauuaagaaggcaa

SEQ ID NO: 1392551 - RNA, 23 nt, Human
aucuugaaauuaagaaggcaaaa

SEQ ID NO: 1392552 - RNA, 18 nt, Human
aucuggaaccucagccug

SEQ ID NO: 1392553 - RNA, 17 nt, Human
aucuggaaccucagccu

SEQ ID NO: 1392554 - RNA, 16 nt, Human
aucuggaaccucagcc

SEQ ID NO: 1392555 - RNA, 11 nt, Human
aucuggaaccu

SEQ ID NO: 1392556 - RNA, 23 nt, Human
aucuggaacccagacucagacau

SEQ ID NO: 1392557 - RNA, 19 nt, Human
aucuggaacccagacucag

SEQ ID NO: 1392558 - RNA, 18 nt, Human
aucugcuggaguuucaug

SEQ ID NO: 1392559 - RNA, 14 nt, Human
aucugcuggaguuu

SEQ ID NO: 1392560 - RNA, 14 nt, Human
aucucucugcccaa

SEQ ID NO: 1392561 - RNA, 15 nt, Human
aucucucuucuuuuc

SEQ ID NO: 1392562 - RNA, 22 nt, Human
aucucuaccuucuccccagcuc

SEQ ID NO: 1392563 - RNA, 20 nt, Human
aucucuaccuucuccccagc

SEQ ID NO: 1392564 - RNA, 19 nt, Human
aucucuaccuucuccccag

SEQ ID NO: 1392565 - RNA, 17 nt, Human
aucucuaccuucucccc

SEQ ID NO: 1392566 - RNA, 17 nt, Human
aucuuauaguucuaggc

SEQ ID NO: 1392567 - RNA, 15 nt, Human
aucuuauaguucuag

SEQ ID NO: 1392568 - RNA, 20 nt, Human
aucugggcuuccuggagcag

SEQ ID NO: 1392569 - RNA, 18 nt, Human
aucugggcuuccuggagc

SEQ ID NO: 1392570 - RNA, 16 nt, Human
aucugggcuuccugga

SEQ ID NO: 1392571 - RNA, 23 nt, Human
aucuucucaaguucuaagauucu

SEQ ID NO: 1392572 - RNA, 20 nt, Human
aucuucucaaguucuaagau

SEQ ID NO: 1392573 - RNA, 19 nt, Human
aucuucucaaguucuaaga

SEQ ID NO: 1392574 - RNA, 18 nt, Human
aucuucucaaguucuaag

SEQ ID NO: 1392575 - RNA, 16 nt, Human
aucuucucaaguucua

SEQ ID NO: 1392576 - RNA, 15 nt, Human
aucuucucaaguucu

SEQ ID NO: 1392577 - RNA, 19 nt, Human
aucuucaguugucucugau

SEQ ID NO: 1392578 - RNA, 18 nt, Human
aucuucaguugucucuga

SEQ ID NO: 1392579 - RNA, 17 nt, Human
aucuucaguugucucug

SEQ ID NO: 1392580 - RNA, 16 nt, Human
aucuucaguugucucu

SEQ ID NO: 1392581 - RNA, 14 nt, Human
aucuucaguugucu

SEQ ID NO: 1392582 - RNA, 21 nt, Human
aucuggaagccaaaauguagg

SEQ ID NO: 1392583 - RNA, 22 nt, Human
aucuggaaccucagccuggcca

SEQ ID NO: 1392584 - RNA, 21 nt, Human
aucuggaaccucagccuggcc

SEQ ID NO: 1392585 - RNA, 20 nt, Human
aucuggaaccucagccuggc

SEQ ID NO: 1392586 - RNA, 19 nt, Human
aucuggaaccucagccugg

SEQ ID NO: 1392587 - RNA, 15 nt, Human
aucugggcuuccugg

SEQ ID NO: 1392588 - RNA, 14 nt, Human
aucugggcuuccug

SEQ ID NO: 1392589 - RNA, 13 nt, Human
aucugggcuuccu

SEQ ID NO: 1392590 - RNA, 10 nt, Human
aucugggcuu

SEQ ID NO: 1392591 - RNA, 19 nt, Human
aucugggccuuggccugga

SEQ ID NO: 1392592 - RNA, 21 nt, Human
aucugggccuuggccuggagc

SEQ ID NO: 1392593 - RNA, 16 nt, Human
aucugggccuuggccu

SEQ ID NO: 1392594 - RNA, 15 nt, Human
aucugggccuuggcc

SEQ ID NO: 1392595 - RNA, 22 nt, Human
aucuuauaauuuaaaauaugcu

SEQ ID NO: 1392596 - RNA, 21 nt, Human
augaccuccagcuuuccugua

SEQ ID NO: 1392597 - RNA, 19 nt, Human
augaccuccagcuuuccug

SEQ ID NO: 1392598 - RNA, 13 nt, Human
augaccuccagcu

SEQ ID NO: 1392599 - RNA, 12 nt, Human
augaccuccagc

SEQ ID NO: 1392600 - RNA, 14 nt, Human
augacccuuuucau

SEQ ID NO: 1392601 - RNA, 18 nt, Human
augaccuaguuuuccaug

SEQ ID NO: 1392602 - RNA, 23 nt, Human
augacccugccucucccaggcag

SEQ ID NO: 1392603 - RNA, 20 nt, Human
augacccugccucucccagg

SEQ ID NO: 1392604 - RNA, 18 nt, Human
augacccugccucuccca

SEQ ID NO: 1392605 - RNA, 14 nt, Human
augacccugccucu

SEQ ID NO: 1392606 - RNA, 18 nt, Human
augaagcuuuuaugugaa

SEQ ID NO: 1392607 - RNA, 19 nt, Human
augaagcuuuuaugugaaa

SEQ ID NO: 1392608 - RNA, 20 nt, Human
augaagcuuuuaugugaaac

SEQ ID NO: 1392609 - RNA, 21 nt, Human
augaagcuuuuaugugaaaca

SEQ ID NO: 1392610 - RNA, 16 nt, Human
augacucggggguggg

SEQ ID NO: 1392611 - RNA, 15 nt, Human
augacuauguaaacu

SEQ ID NO: 1392612 - RNA, 16 nt, Human
augacuauguaaacua

SEQ ID NO: 1392613 - RNA, 13 nt, Human
augaaacagaaac

SEQ ID NO: 1392614 - RNA, 22 nt, Human
augaaacagaaacaaaaacacu

SEQ ID NO: 1392615 - RNA, 18 nt, Human
augaaacagaaacaaaaa

SEQ ID NO: 1392616 - RNA, 18 nt, Human
augaaaagcuagaauuga

SEQ ID NO: 1392617 - RNA, 13 nt, Human
augaaaagcuaga

SEQ ID NO: 1392618 - RNA, 16 nt, Human
augaaaacucuuugcu

SEQ ID NO: 1392619 - RNA, 15 nt, Human
augaaaauaaagaau

SEQ ID NO: 1392620 - RNA, 17 nt, Human
augaaaauaaagaaugg

SEQ ID NO: 1392621 - RNA, 14 nt, Human
augaaaauaaagaa

SEQ ID NO: 1392622 - RNA, 16 nt, Human
augaaaaguauauuga

SEQ ID NO: 1392623 - RNA, 16 nt, Human
augaaaaugucuugug

SEQ ID NO: 1392624 - RNA, 14 nt, Human
augaaaaaauauau

SEQ ID NO: 1392625 - RNA, 17 nt, Human
augaaaaaauauauauc

SEQ ID NO: 1392626 - RNA, 22 nt, Human
augaaaaaauauauaucaaaua

SEQ ID NO: 1392627 - RNA, 23 nt, Human
augaaaaaauauauaucaaauau

SEQ ID NO: 1392628 - RNA, 21 nt, Human
augcaauauacuggaaagcuu

SEQ ID NO: 1392629 - RNA, 15 nt, Human
augcacaguauuugu

SEQ ID NO: 1392630 - RNA, 14 nt, Human
augcacaguauuug

SEQ ID NO: 1392631 - RNA, 17 nt, Human
augcacaguaaaaaugg

SEQ ID NO: 1392632 - RNA, 23 nt, Human
augcacacauuuuuuaaaugcac

SEQ ID NO: 1392633 - RNA, 17 nt, Human
augcacacauuuuuuaa

SEQ ID NO: 1392634 - RNA, 19 nt, Human
augcacacauuuuuuaaau

SEQ ID NO: 1392635 - RNA, 22 nt, Human
augcacacauuuuuuaaaugca

SEQ ID NO: 1392636 - RNA, 18 nt, Human
augcacaguauuuguaau

SEQ ID NO: 1392637 - RNA, 21 nt, Human
augcacaguauuuguaauuaa

SEQ ID NO: 1392638 - RNA, 23 nt, Human
augcaugaaguaauaugcacaca

SEQ ID NO: 1392639 - RNA, 17 nt, Human
augcaugcacuguuccc

SEQ ID NO: 1392640 - RNA, 12 nt, Human
augcauggaaau

SEQ ID NO: 1392641 - RNA, 18 nt, Human
augcauuugaaaauuuug

SEQ ID NO: 1392642 - RNA, 10 nt, Human
augcauuuga

SEQ ID NO: 1392643 - RNA, 12 nt, Human
augcauuugaaa

SEQ ID NO: 1392644 - RNA, 14 nt, Human
augccuuuucccaa

SEQ ID NO: 1392645 - RNA, 21 nt, Human
augccuuuguacuuuagggaa

SEQ ID NO: 1392646 - RNA, 19 nt, Human
augcuugcaaaaacuacaa

SEQ ID NO: 1392647 - RNA, 16 nt, Human
augcuugcaaaaacua

SEQ ID NO: 1392648 - RNA, 23 nt, Human
augcuuuuuauuucugcauaugu

SEQ ID NO: 1392649 - RNA, 19 nt, Human
augcuuuuuauuucugcau

SEQ ID NO: 1392650 - RNA, 16 nt, Human
augcuuuuuauuucug

SEQ ID NO: 1392651 - RNA, 22 nt, Human
augcuuuuuauuauuauuauuu

SEQ ID NO: 1392652 - RNA, 17 nt, Human
auggaaauuuaaagcag

SEQ ID NO: 1392653 - RNA, 18 nt, Human
auggaaauucugcucaga

SEQ ID NO: 1392654 - RNA, 20 nt, Human
auggaaauucccuucaucug

SEQ ID NO: 1392655 - RNA, 12 nt, Human
auggauucuaaa

SEQ ID NO: 1392656 - RNA, 18 nt, Human
auggauguccccagcaga

SEQ ID NO: 1392657 - RNA, 17 nt, Human
auggauguccccagcag

SEQ ID NO: 1392658 - RNA, 19 nt, Human
auggaugggggaacucaga

SEQ ID NO: 1392659 - RNA, 23 nt, Human
auggaugccaauauuaaaucugc

SEQ ID NO: 1392660 - RNA, 22 nt, Human
auggaugccaauauuaaaucug

SEQ ID NO: 1392661 - RNA, 13 nt, Human
auggaugccaaua

SEQ ID NO: 1392662 - RNA, 14 nt, Human
auggagcugggcua

SEQ ID NO: 1392663 - RNA, 15 nt, Human
auggaaauuuaaagc

SEQ ID NO: 1392664 - RNA, 21 nt, Human
auggagccagcucugcauuau

SEQ ID NO: 1392665 - RNA, 20 nt, Human
auggcugauaauuuuaaauu

SEQ ID NO: 1392666 - RNA, 18 nt, Human
auggcuggagcuagaauu

SEQ ID NO: 1392667 - RNA, 20 nt, Human
augucuuggaacauuggaau

SEQ ID NO: 1392668 - RNA, 16 nt, Human
augucuugagcucuau

SEQ ID NO: 1392669 - RNA, 15 nt, Human
augucuugagcucua

SEQ ID NO: 1392670 - RNA, 23 nt, Human
augucuugaugcaugcacuguuc

SEQ ID NO: 1392671 - RNA, 15 nt, Human
augucuucucccugg

SEQ ID NO: 1392672 - RNA, 21 nt, Human
augucuugagcucuauuauga

SEQ ID NO: 1392673 - RNA, 21 nt, Human
augucacuuuuugaggcaaaa

SEQ ID NO: 1392674 - RNA, 20 nt, Human
augucacuuuuugaggcaaa

SEQ ID NO: 1392675 - RNA, 10 nt, Human
augucacuuu

SEQ ID NO: 1392676 - RNA, 22 nt, Human
augucacuaaagcaggccuuuu

SEQ ID NO: 1392677 - RNA, 16 nt, Human
augucacuaaagcagg

SEQ ID NO: 1392678 - RNA, 23 nt, Human
augucaaauauuuagauguaauu

SEQ ID NO: 1392679 - RNA, 19 nt, Human
augucaaauauuuagaugu

SEQ ID NO: 1392680 - RNA, 15 nt, Human
auguacaugagaagg

SEQ ID NO: 1392681 - RNA, 22 nt, Human
augucaaggguucaagauuguu

SEQ ID NO: 1392682 - RNA, 16 nt, Human
augucaaucagccuag

SEQ ID NO: 1392683 - RNA, 14 nt, Human
auguacaagaugaa

SEQ ID NO: 1392684 - RNA, 19 nt, Human
auguaaucuugaauuguaa

SEQ ID NO: 1392685 - RNA, 21 nt, Human
auguaauacuucuugugugua

SEQ ID NO: 1392686 - RNA, 17 nt, Human
auguacauguacugauu

SEQ ID NO: 1392687 - RNA, 17 nt, Human
auggucuuacagcaggc

SEQ ID NO: 1392688 - RNA, 16 nt, Human
auggucuuacagcagg

SEQ ID NO: 1392689 - RNA, 15 nt, Human
auggucuuacagcag

SEQ ID NO: 1392690 - RNA, 16 nt, Human
auggucugcccucugc

SEQ ID NO: 1392691 - RNA, 22 nt, Human
auguaagauuauagauucuaaa

SEQ ID NO: 1392692 - RNA, 21 nt, Human
auguaagauuauagauucuaa

SEQ ID NO: 1392693 - RNA, 20 nt, Human
auguaagauuauagauucua

SEQ ID NO: 1392694 - RNA, 19 nt, Human
auguaagauuauagauucu

SEQ ID NO: 1392695 - RNA, 17 nt, Human
auguaagauuauagauu

SEQ ID NO: 1392696 - RNA, 15 nt, Human
auguaagauuauaga

SEQ ID NO: 1392697 - RNA, 18 nt, Human
auguaacuuuuguaagac

SEQ ID NO: 1392698 - RNA, 17 nt, Human
auguaacuuuuguaaga

SEQ ID NO: 1392699 - RNA, 16 nt, Human
auguaacuuuuguaag

SEQ ID NO: 1392700 - RNA, 16 nt, Human
auguaaucaauguuuc

SEQ ID NO: 1392701 - RNA, 15 nt, Human
auguaaucaauguuu

SEQ ID NO: 1392702 - RNA, 12 nt, Human
auguaauacuuc

SEQ ID NO: 1392703 - RNA, 16 nt, Human
auguaauaaacuuuaa

SEQ ID NO: 1392704 - RNA, 15 nt, Human
auguaauaaacuuua

SEQ ID NO: 1392705 - RNA, 14 nt, Human
auguaauaaacuuu

SEQ ID NO: 1392706 - RNA, 24 nt, Human
auguaagauuauagauucuaaaga

SEQ ID NO: 1392707 - RNA, 16 nt, Human
auguaaguaaacgguc

SEQ ID NO: 1392708 - RNA, 19 nt, Human
auguggucacagcuguaua

SEQ ID NO: 1392709 - RNA, 22 nt, Human
auguggucacagcuguauagcu

SEQ ID NO: 1392710 - RNA, 17 nt, Human
auguggucacagcugua

SEQ ID NO: 1392711 - RNA, 16 nt, Human
auguggucacagcugu

SEQ ID NO: 1392712 - RNA, 15 nt, Human
auguggucacagcug

SEQ ID NO: 1392713 - RNA, 17 nt, Human
auguggguuccacagac

SEQ ID NO: 1392714 - RNA, 22 nt, Human
augugguggcacaggcccccuu

SEQ ID NO: 1392715 - RNA, 18 nt, Human
augugguggcacaggccc

SEQ ID NO: 1392716 - RNA, 16 nt, Human
auguggguuccacaga

SEQ ID NO: 1392717 - RNA, 15 nt, Human
auguggguuccacag

SEQ ID NO: 1392718 - RNA, 16 nt, Human
auguggggccagguca

SEQ ID NO: 1392719 - RNA, 13 nt, Human
auguggggccagg

SEQ ID NO: 1392720 - RNA, 18 nt, Human
auuaaauucacaaacuuu

SEQ ID NO: 1392721 - RNA, 17 nt, Human
auuaaauucacaaacuu

SEQ ID NO: 1392722 - RNA, 16 nt, Human
auuaaauucacaaacu

SEQ ID NO: 1392723 - RNA, 14 nt, Human
auuaaauucacaaa

SEQ ID NO: 1392724 - RNA, 13 nt, Human
auuaaauucuugc

SEQ ID NO: 1392725 - RNA, 13 nt, Human
auuaaauucacaa

SEQ ID NO: 1392726 - RNA, 19 nt, Human
auuaaauaagauucuaacg

SEQ ID NO: 1392727 - RNA, 16 nt, Human
auuaaauaagauucua

SEQ ID NO: 1392728 - RNA, 15 nt, Human
auuaaauaagauucu

SEQ ID NO: 1392729 - RNA, 13 nt, Human
auuaaauaaauuu

SEQ ID NO: 1392730 - RNA, 23 nt, Human
auuaaagugcuaagguucuaagg

SEQ ID NO: 1392731 - RNA, 22 nt, Human
auuaaagugcuaagguucuaag

SEQ ID NO: 1392732 - RNA, 21 nt, Human
auuaaagugcuaagguucuaa

SEQ ID NO: 1392733 - RNA, 20 nt, Human
auuaaagugcuaagguucua

SEQ ID NO: 1392734 - RNA, 19 nt, Human
auuaaagugcuaagguucu

SEQ ID NO: 1392735 - RNA, 18 nt, Human
auuaaagugcuaagguuc

SEQ ID NO: 1392736 - RNA, 17 nt, Human
auuaaagugcuaagguu

SEQ ID NO: 1392737 - RNA, 22 nt, Human
auguuugcaccuuucuaguuga

SEQ ID NO: 1392738 - RNA, 19 nt, Human
auguuugcaccuuucuagu

SEQ ID NO: 1392739 - RNA, 17 nt, Human
auguuugcaccuuucua

SEQ ID NO: 1392740 - RNA, 21 nt, Human
auguuugauagauuuucugcu

SEQ ID NO: 1392741 - RNA, 21 nt, Human
auguuugcaccuuucuaguug

SEQ ID NO: 1392742 - RNA, 13 nt, Human
auguguccugguu

SEQ ID NO: 1392743 - RNA, 17 nt, Human
auguguccugacacugc

SEQ ID NO: 1392744 - RNA, 14 nt, Human
auguguccugacac

SEQ ID NO: 1392745 - RNA, 16 nt, Human
augugucccagaagau

SEQ ID NO: 1392746 - RNA, 14 nt, Human
augugucccagaag

SEQ ID NO: 1392747 - RNA, 12 nt, Human
augugucccaga

SEQ ID NO: 1392748 - RNA, 11 nt, Human
augugucccag

SEQ ID NO: 1392749 - RNA, 21 nt, Human
augugucuuuagauagcccug

SEQ ID NO: 1392750 - RNA, 13 nt, Human
augugucuuuaga

SEQ ID NO: 1392751 - RNA, 18 nt, Human
auguuucuuuguaaugaa

SEQ ID NO: 1392752 - RNA, 15 nt, Human
auguucuuaauucuu

SEQ ID NO: 1392753 - RNA, 19 nt, Human
auacuuauauggaaauucu

SEQ ID NO: 1392754 - RNA, 15 nt, Human
auaccuaagaaguac

SEQ ID NO: 1392755 - RNA, 14 nt, Human
auaccuaacugaau

SEQ ID NO: 1392756 - RNA, 21 nt, Human
auaccuaagaaguacauuguu

SEQ ID NO: 1392757 - RNA, 19 nt, Human
auacccuggccgcccccug

SEQ ID NO: 1392758 - RNA, 15 nt, Human
auacccugaccuggc

SEQ ID NO: 1392759 - RNA, 20 nt, Human
auaccugauuuuuuuuccuu

SEQ ID NO: 1392760 - RNA, 17 nt, Human
auaccugggauacugug

SEQ ID NO: 1392761 - RNA, 20 nt, Human
auaccugggauacugugccc

SEQ ID NO: 1392762 - RNA, 16 nt, Human
auaauuauaauauacu

SEQ ID NO: 1392763 - RNA, 11 nt, Human
auacacaaauu

SEQ ID NO: 1392764 - RNA, 17 nt, Human
auacaauuuuuuuuauu

SEQ ID NO: 1392765 - RNA, 20 nt, Human
auacaauuuuuuuuauuagu

SEQ ID NO: 1392766 - RNA, 18 nt, Human
auaccccuuacaaaugaa

SEQ ID NO: 1392767 - RNA, 14 nt, Human
auacccucccuccc

SEQ ID NO: 1392768 - RNA, 16 nt, Human
auacccucccucccua

SEQ ID NO: 1392769 - RNA, 22 nt, Human
auacccucccucccuacccuaa

SEQ ID NO: 1392770 - RNA, 23 nt, Human
auaacagaaagccugggugacau

SEQ ID NO: 1392771 - RNA, 16 nt, Human
auaaugugaaaauggu

SEQ ID NO: 1392772 - RNA, 13 nt, Human
auaaugugaaaau

SEQ ID NO: 1392773 - RNA, 17 nt, Human
auaaguguucugucuga

SEQ ID NO: 1392774 - RNA, 18 nt, Human
auaaugugaaacuggauu

SEQ ID NO: 1392775 - RNA, 19 nt, Human
auaaguguguguuuuucau

SEQ ID NO: 1392776 - RNA, 22 nt, Human
auaaguguguguuuuucauaaa

SEQ ID NO: 1392777 - RNA, 19 nt, Human
auaaugugaaacuggauua

SEQ ID NO: 1392778 - RNA, 21 nt, Human
auaaugugaaacuggauuaaa

SEQ ID NO: 1392779 - RNA, 20 nt, Human
auaaguguacauaugugcug

SEQ ID NO: 1392780 - RNA, 19 nt, Human
auaaguguacauaugugcu

SEQ ID NO: 1392781 - RNA, 14 nt, Human
auaaguguacauau

SEQ ID NO: 1392782 - RNA, 13 nt, Human
auaaguguacaua

SEQ ID NO: 1392783 - RNA, 17 nt, Human
auaagucaacaguaaac

SEQ ID NO: 1392784 - RNA, 18 nt, Human
auaagucaacaguaaacc

SEQ ID NO: 1392785 - RNA, 16 nt, Human
auaagucaacaguaaa

SEQ ID NO: 1392786 - RNA, 15 nt, Human
auaagucaacaguaa

SEQ ID NO: 1392787 - RNA, 14 nt, Human
auaagucaacagua

SEQ ID NO: 1392788 - RNA, 19 nt, Human
auaaguauuucaaauugga

SEQ ID NO: 1392789 - RNA, 18 nt, Human
auaaguauuucaaauugg

SEQ ID NO: 1392790 - RNA, 16 nt, Human
auaaguauuucaaauu

SEQ ID NO: 1392791 - RNA, 19 nt, Human
auaaguauuuaauucaugu

SEQ ID NO: 1392792 - RNA, 20 nt, Human
auacuucuuguguguaugca

SEQ ID NO: 1392793 - RNA, 18 nt, Human
auacuucuuguguguaug

SEQ ID NO: 1392794 - RNA, 16 nt, Human
auacuucuugugugua

SEQ ID NO: 1392795 - RNA, 15 nt, Human
auacuucuugugugu

SEQ ID NO: 1392796 - RNA, 16 nt, Human
auacuucucauuuuuu

SEQ ID NO: 1392797 - RNA, 19 nt, Human
auacuugaaaauuaacaug

SEQ ID NO: 1392798 - RNA, 19 nt, Human
auacuucgacacuguucuu

SEQ ID NO: 1392799 - RNA, 15 nt, Human
auacuucgacacugu

SEQ ID NO: 1392800 - RNA, 18 nt, Human
auacuuauuuguauaugg

SEQ ID NO: 1392801 - RNA, 15 nt, Human
auacuugaaaauuaa

SEQ ID NO: 1392802 - RNA, 16 nt, Human
auacuugaaaauuaac

SEQ ID NO: 1392803 - RNA, 14 nt, Human
auauaaguguacau

SEQ ID NO: 1392804 - RNA, 20 nt, Human
auauaagugcuguauaaaau

SEQ ID NO: 1392805 - RNA, 17 nt, Human
auauaagugcuguauaa

SEQ ID NO: 1392806 - RNA, 18 nt, Human
auauaagugcuguauaaa

SEQ ID NO: 1392807 - RNA, 13 nt, Human
auauaagugcugu

SEQ ID NO: 1392808 - RNA, 15 nt, Human
auauaagugcuguau

SEQ ID NO: 1392809 - RNA, 15 nt, Human
auauaagugauugcu

SEQ ID NO: 1392810 - RNA, 14 nt, Human
auauaauuauaugu

SEQ ID NO: 1392811 - RNA, 15 nt, Human
auauaauuauauguu

SEQ ID NO: 1392812 - RNA, 22 nt, Human
auauaauguuguuauuuaaaga

SEQ ID NO: 1392813 - RNA, 21 nt, Human
auauaauguuguuauuuaaag

SEQ ID NO: 1392814 - RNA, 18 nt, Human
auauaaguguacauaugu

SEQ ID NO: 1392815 - RNA, 15 nt, Human
auauaaguguacaua

SEQ ID NO: 1392816 - RNA, 15 nt, Human
auauaaguguguguu

SEQ ID NO: 1392817 - RNA, 18 nt, Human
auauagcugaucaguuuu

SEQ ID NO: 1392818 - RNA, 17 nt, Human
auauagcugaucaguuu

SEQ ID NO: 1392819 - RNA, 12 nt, Human
auauaccaaagc

SEQ ID NO: 1392820 - RNA, 22 nt, Human
auauacuauuaaaaagguuuac

SEQ ID NO: 1392821 - RNA, 17 nt, Human
auauaccaaagcacauu

SEQ ID NO: 1392822 - RNA, 18 nt, Human
auauaauuguuuuaucug

SEQ ID NO: 1392823 - RNA, 15 nt, Human
auauaauugccaaaa

SEQ ID NO: 1392824 - RNA, 12 nt, Human
auauaauucuua

SEQ ID NO: 1392825 - RNA, 16 nt, Human
auauaggaacuuaaau

SEQ ID NO: 1392826 - RNA, 22 nt, Human
auauuuagauguaauuuugugu

SEQ ID NO: 1392827 - RNA, 20 nt, Human
auauuuagauguaauuuugu

SEQ ID NO: 1392828 - RNA, 19 nt, Human
auauuauacuuguaauuau

SEQ ID NO: 1392829 - RNA, 16 nt, Human
auauuauacuuguaau

SEQ ID NO: 1392830 - RNA, 14 nt, Human
auauuauacuugua

SEQ ID NO: 1392831 - RNA, 21 nt, Human
auauuuauuuucuuucuguaa

SEQ ID NO: 1392832 - RNA, 22 nt, Human
auauuuauuacuguaagaaaau

SEQ ID NO: 1392833 - RNA, 18 nt, Human
auauuuauuuuaauaaug

SEQ ID NO: 1392834 - RNA, 19 nt, Human
auauuuauuacuguaagaa

SEQ ID NO: 1392835 - RNA, 14 nt, Human
auauuuauuacugu

SEQ ID NO: 1392836 - RNA, 22 nt, Human
auauuauacuuguaauuaugga

SEQ ID NO: 1392837 - RNA, 18 nt, Human
auauuuaguguucauaaa

SEQ ID NO: 1392838 - RNA, 16 nt, Human
auauuuauaaaaauaa

SEQ ID NO: 1392839 - RNA, 19 nt, Human
auauuuauuuuuuuuaagu

SEQ ID NO: 1392840 - RNA, 23 nt, Human
auauuucagauaaucacaauaca

SEQ ID NO: 1392841 - RNA, 19 nt, Human
auauggaauuuugcaaaga

SEQ ID NO: 1392842 - RNA, 20 nt, Human
auauggacacuuaauacuac

SEQ ID NO: 1392843 - RNA, 15 nt, Human
auauggacacuuaau

SEQ ID NO: 1392844 - RNA, 22 nt, Human
auauggacaaaacaagaaagac

SEQ ID NO: 1392845 - RNA, 15 nt, Human
auauggaauuuugca

SEQ ID NO: 1392846 - RNA, 23 nt, Human
auauggaaauauauauuauacuu

SEQ ID NO: 1392847 - RNA, 18 nt, Human
auauggaaauauauauua

SEQ ID NO: 1392848 - RNA, 16 nt, Human
auauggaaauauauau

SEQ ID NO: 1392849 - RNA, 15 nt, Human
auauggaaauauaua

SEQ ID NO: 1392850 - RNA, 19 nt, Human
auaugcuuguaacuaaaau

SEQ ID NO: 1392851 - RNA, 13 nt, Human
auauccugcuuga

SEQ ID NO: 1392852 - RNA, 20 nt, Human
auaucccuccuguugggaga

SEQ ID NO: 1392853 - RNA, 14 nt, Human
auaugcauauuugu

SEQ ID NO: 1392854 - RNA, 21 nt, Human
auaugcuaccaccagcugugu

SEQ ID NO: 1392855 - RNA, 19 nt, Human
auaugcuaccaccagcugu

SEQ ID NO: 1392856 - RNA, 17 nt, Human
auaugcuaccaccagcu

SEQ ID NO: 1392857 - RNA, 16 nt, Human
auaugcuaccaccagc

SEQ ID NO: 1392858 - RNA, 15 nt, Human
auaugcguauuauac

SEQ ID NO: 1392859 - RNA, 14 nt, Human
auaugcuuacugau

SEQ ID NO: 1392860 - RNA, 17 nt, Human
auaucccuacauguauu

SEQ ID NO: 1392861 - RNA, 16 nt, Human
auaucccuacauguau

SEQ ID NO: 1392862 - RNA, 15 nt, Human
auaucccuacaugua

SEQ ID NO: 1392863 - RNA, 13 nt, Human
auaucccacuggg

SEQ ID NO: 1392864 - RNA, 21 nt, Human
auauccaugaccuaguuuucc

SEQ ID NO: 1392865 - RNA, 20 nt, Human
auaucacccagacauaaagg

SEQ ID NO: 1392866 - RNA, 19 nt, Human
auaucacccagacauaaag

SEQ ID NO: 1392867 - RNA, 16 nt, Human
auaucacccagacaua

SEQ ID NO: 1392868 - RNA, 14 nt, Human
auaucacccagaca

SEQ ID NO: 1392869 - RNA, 13 nt, Human
auaucacagaaaa

SEQ ID NO: 1392870 - RNA, 18 nt, Human
auaucacauguuuucucu

SEQ ID NO: 1392871 - RNA, 14 nt, Human
auaucacacacauu

SEQ ID NO: 1392872 - RNA, 21 nt, Human
auaucacccagacauaaagga

SEQ ID NO: 1392873 - RNA, 22 nt, Human
auaucacccagacauaaaggaa

SEQ ID NO: 1392874 - RNA, 18 nt, Human
auaucacuugucaauaaa

SEQ ID NO: 1392875 - RNA, 14 nt, Human
aguccacuuuguuu

SEQ ID NO: 1392876 - RNA, 15 nt, Human
aguccaccugaggaa

SEQ ID NO: 1392877 - RNA, 18 nt, Human
aguccacccuugguuccu

SEQ ID NO: 1392878 - RNA, 19 nt, Human
aguccuggaugauacuaau

SEQ ID NO: 1392879 - RNA, 17 nt, Human
aguccuggaugauacua

SEQ ID NO: 1392880 - RNA, 23 nt, Human
aguccuggaagccagcuuucccu

SEQ ID NO: 1392881 - RNA, 22 nt, Human
aguccuggaagccagcuuuccc

SEQ ID NO: 1392882 - RNA, 20 nt, Human
aguccuggaagccagcuuuc

SEQ ID NO: 1392883 - RNA, 14 nt, Human
aguccuggaagcca

SEQ ID NO: 1392884 - RNA, 20 nt, Human
aguccacuucugacagccuc

SEQ ID NO: 1392885 - RNA, 22 nt, Human
aguccugcgaaaacccccaaac

SEQ ID NO: 1392886 - RNA, 22 nt, Human
aguccuggaugauacuaauaaa

SEQ ID NO: 1392887 - RNA, 17 nt, Human
agugacagacaggcucu

SEQ ID NO: 1392888 - RNA, 16 nt, Human
agugacagacaggcuc

SEQ ID NO: 1392889 - RNA, 15 nt, Human
agugauauuggaacu

SEQ ID NO: 1392890 - RNA, 14 nt, Human
agugaucaaacuac

SEQ ID NO: 1392891 - RNA, 12 nt, Human
agucaauacaua

SEQ ID NO: 1392892 - RNA, 10 nt, Human
agucaauaca

SEQ ID NO: 1392893 - RNA, 20 nt, Human
agucaagugcguccacgagc

SEQ ID NO: 1392894 - RNA, 17 nt, Human
agucaauauuuuuagau

SEQ ID NO: 1392895 - RNA, 21 nt, Human
agucaauacauagugcugcug

SEQ ID NO: 1392896 - RNA, 13 nt, Human
agucaaauugugu

SEQ ID NO: 1392897 - RNA, 17 nt, Human
agucaaauugugugaaa

SEQ ID NO: 1392898 - RNA, 15 nt, Human
agucaaauuguguga

SEQ ID NO: 1392899 - RNA, 15 nt, Human
agucaaccugggcaa

SEQ ID NO: 1392900 - RNA, 14 nt, Human
agucaaccugggca

SEQ ID NO: 1392901 - RNA, 15 nt, Human
agucaaccugccuga

SEQ ID NO: 1392902 - RNA, 19 nt, Human
agucaaauugugugaaagg

SEQ ID NO: 1392903 - RNA, 23 nt, Human
agucauucagauaugauucaaau

SEQ ID NO: 1392904 - RNA, 20 nt, Human
agucauucagauaugauuca

SEQ ID NO: 1392905 - RNA, 15 nt, Human
agucauucagauaug

SEQ ID NO: 1392906 - RNA, 14 nt, Human
aguccacaaaauaa

SEQ ID NO: 1392907 - RNA, 14 nt, Human
aguccaauguggca

SEQ ID NO: 1392908 - RNA, 16 nt, Human
aguccaagguuuaaag

SEQ ID NO: 1392909 - RNA, 13 nt, Human
aguccaagguuua

SEQ ID NO: 1392910 - RNA, 16 nt, Human
aguccaagcugggaga

SEQ ID NO: 1392911 - RNA, 14 nt, Human
aguccaagcuggga

SEQ ID NO: 1392912 - RNA, 11 nt, Human
aguccaagcug

SEQ ID NO: 1392913 - RNA, 21 nt, Human
aguccaagcauuuagauguau

SEQ ID NO: 1392914 - RNA, 15 nt, Human
agucauuggcugucu

SEQ ID NO: 1392915 - RNA, 14 nt, Human
agucauuggcuuua

SEQ ID NO: 1392916 - RNA, 15 nt, Human
agucauuggcuuuau

SEQ ID NO: 1392917 - RNA, 18 nt, Human
agucauuggcuuuauccu

SEQ ID NO: 1392918 - RNA, 17 nt, Human
agucauucguucugugg

SEQ ID NO: 1392919 - RNA, 16 nt, Human
aguccaagcauuuaga

SEQ ID NO: 1392920 - RNA, 20 nt, Human
agucauuggcuuuauccucu

SEQ ID NO: 1392921 - RNA, 21 nt, Human
agucauuggcuuuauccucuu

SEQ ID NO: 1392922 - RNA, 22 nt, Human
agucauuggcuuuauccucuuu

SEQ ID NO: 1392923 - RNA, 20 nt, Human
aguuaagacaugauuuccuu

SEQ ID NO: 1392924 - RNA, 19 nt, Human
aguuaagacaugauuuccu

SEQ ID NO: 1392925 - RNA, 22 nt, Human
agugucuuuuuuuguauaguua

SEQ ID NO: 1392926 - RNA, 20 nt, Human
agugucuuuuuuuguauagu

SEQ ID NO: 1392927 - RNA, 19 nt, Human
agugucuuuuuuuguauag

SEQ ID NO: 1392928 - RNA, 17 nt, Human
agugucuuuuuuuguau

SEQ ID NO: 1392929 - RNA, 16 nt, Human
agugucuuuuuuugua

SEQ ID NO: 1392930 - RNA, 15 nt, Human
agugucuuuuuuugu

SEQ ID NO: 1392931 - RNA, 14 nt, Human
agugugaacuggac

SEQ ID NO: 1392932 - RNA, 22 nt, Human
agugugaacuggacccuguugc

SEQ ID NO: 1392933 - RNA, 23 nt, Human
agugugaacuggacccuguugcu

SEQ ID NO: 1392934 - RNA, 13 nt, Human
agugucuuuccac

SEQ ID NO: 1392935 - RNA, 23 nt, Human
agugucuuuccacggagccacuc

SEQ ID NO: 1392936 - RNA, 20 nt, Human
agugugaauugcaaaaccca

SEQ ID NO: 1392937 - RNA, 23 nt, Human
aguuguauuuaacagaaauugua

SEQ ID NO: 1392938 - RNA, 19 nt, Human
aguuguuacauuuuuaagu

SEQ ID NO: 1392939 - RNA, 16 nt, Human
aguuguuacauuuuua

SEQ ID NO: 1392940 - RNA, 13 nt, Human
aguuguuacauuu

SEQ ID NO: 1392941 - RNA, 15 nt, Human
aguuguuacauuuuu

SEQ ID NO: 1392942 - RNA, 14 nt, Human
aguuacaguucugu

SEQ ID NO: 1392943 - RNA, 13 nt, Human
aguuacaguucug

SEQ ID NO: 1392944 - RNA, 17 nt, Human
aguuaagaccuggcagc

SEQ ID NO: 1392945 - RNA, 16 nt, Human
aguuaagaccuggcag

SEQ ID NO: 1392946 - RNA, 13 nt, Human
aguuaagaccugg

SEQ ID NO: 1392947 - RNA, 15 nt, Human
aguuacauguuugca

SEQ ID NO: 1392948 - RNA, 22 nt, Human
aguuacauaauucacucugagu

SEQ ID NO: 1392949 - RNA, 16 nt, Human
aguuacaguucugugg

SEQ ID NO: 1392950 - RNA, 15 nt, Human
aguuacaguucugug

SEQ ID NO: 1392951 - RNA, 22 nt, Human
aguuguauuuaacagaaauugu

SEQ ID NO: 1392952 - RNA, 20 nt, Human
aguuguauuuaacagaaauu

SEQ ID NO: 1392953 - RNA, 19 nt, Human
aguuguauuuaacagaaau

SEQ ID NO: 1392954 - RNA, 10 nt, Human
aguugaauuu

SEQ ID NO: 1392955 - RNA, 12 nt, Human
aguugaauuuuu

SEQ ID NO: 1392956 - RNA, 15 nt, Human
aguugaauuuuacau

SEQ ID NO: 1392957 - RNA, 20 nt, Human
cacauagcccacuuacauuu

SEQ ID NO: 1392958 - RNA, 21 nt, Human
cacauagcccacuuacauuua

SEQ ID NO: 1392959 - RNA, 19 nt, Human
cacauacucauuuuucaug

SEQ ID NO: 1392960 - RNA, 18 nt, Human
cacauacucauuuuucau

SEQ ID NO: 1392961 - RNA, 16 nt, Human
cacauacccugaccug

SEQ ID NO: 1392962 - RNA, 18 nt, Human
cacauacccugaccuggc

SEQ ID NO: 1392963 - RNA, 22 nt, Human
cacauacccucuucauggaugg

SEQ ID NO: 1392964 - RNA, 19 nt, Human
cacauacccucuucaugga

SEQ ID NO: 1392965 - RNA, 17 nt, Human
cacauagcccacuuaca

SEQ ID NO: 1392966 - RNA, 21 nt, Human
cacaguucuuugggccagaca

SEQ ID NO: 1392967 - RNA, 19 nt, Human
cacagcuuagauuucauag

SEQ ID NO: 1392968 - RNA, 14 nt, Human
cacagcuucagcca

SEQ ID NO: 1392969 - RNA, 17 nt, Human
cacagcuucagccagga

SEQ ID NO: 1392970 - RNA, 16 nt, Human
cacagcuuagauuuca

SEQ ID NO: 1392971 - RNA, 15 nt, Human
cacagcuuagauuuc

SEQ ID NO: 1392972 - RNA, 20 nt, Human
cacagcuguauagcugcuuc

SEQ ID NO: 1392973 - RNA, 17 nt, Human
cacagcuguauagcugc

SEQ ID NO: 1392974 - RNA, 18 nt, Human
cacaggagcuaccugugu

SEQ ID NO: 1392975 - RNA, 16 nt, Human
cacaggagcuaccugu

SEQ ID NO: 1392976 - RNA, 15 nt, Human
cacaggagcuaccug

SEQ ID NO: 1392977 - RNA, 14 nt, Human
cacaggagcuaccu

SEQ ID NO: 1392978 - RNA, 17 nt, Human
cacagcuuagauuucau

SEQ ID NO: 1392979 - RNA, 22 nt, Human
cacagcuucagccaggagcugg

SEQ ID NO: 1392980 - RNA, 18 nt, Human
cacagcuucagccaggag

SEQ ID NO: 1392981 - RNA, 19 nt, Human
cacagcuucagccaggagc

SEQ ID NO: 1392982 - RNA, 20 nt, Human
cacaggagcuaccugugugg

SEQ ID NO: 1392983 - RNA, 23 nt, Human
cacaggagggggucguggagagc

SEQ ID NO: 1392984 - RNA, 22 nt, Human
cacaggagggggucguggagag

SEQ ID NO: 1392985 - RNA, 12 nt, Human
cacaggaggggg

SEQ ID NO: 1392986 - RNA, 22 nt, Human
cacaggagggcggccuccuucu

SEQ ID NO: 1392987 - RNA, 19 nt, Human
cacaggagggcggccuccu

SEQ ID NO: 1392988 - RNA, 17 nt, Human
cacagugucaggcacug

SEQ ID NO: 1392989 - RNA, 16 nt, Human
cacaguguaugaaggg

SEQ ID NO: 1392990 - RNA, 14 nt, Human
cacagugggagcca

SEQ ID NO: 1392991 - RNA, 18 nt, Human
cacagugggagccagggc

SEQ ID NO: 1392992 - RNA, 19 nt, Human
cacagugggagccagggcu

SEQ ID NO: 1392993 - RNA, 20 nt, Human
cacaguucuuugggccagac

SEQ ID NO: 1392994 - RNA, 19 nt, Human
cacaguucuuugggccaga

SEQ ID NO: 1392995 - RNA, 18 nt, Human
cacaguucuuugggccag

SEQ ID NO: 1392996 - RNA, 19 nt, Human
cacagugaucaaguuauuu

SEQ ID NO: 1392997 - RNA, 19 nt, Human
auuuuguaaacucaaaaua

SEQ ID NO: 1392998 - RNA, 22 nt, Human
auuuugguaaaauacuucuuga

SEQ ID NO: 1392999 - RNA, 20 nt, Human
auuuuggagaguuuccugaa

SEQ ID NO: 1393000 - RNA, 21 nt, Human
auuuucuaccuggucucuccu

SEQ ID NO: 1393001 - RNA, 22 nt, Human
auuuucuaagaaacauuuauau

SEQ ID NO: 1393002 - RNA, 17 nt, Human
auuuuggauuuugcaag

SEQ ID NO: 1393003 - RNA, 21 nt, Human
auuuuggagaguuuccugaaa

SEQ ID NO: 1393004 - RNA, 22 nt, Human
auuuuggagaguuuccugaaac

SEQ ID NO: 1393005 - RNA, 17 nt, Human
auuuucuaagaaacauu

SEQ ID NO: 1393006 - RNA, 16 nt, Human
auuuucuaagaaacau

SEQ ID NO: 1393007 - RNA, 14 nt, Human
auuuuccuuuucaa

SEQ ID NO: 1393008 - RNA, 14 nt, Human
auuuuccugaaaac

SEQ ID NO: 1393009 - RNA, 13 nt, Human
auuuuccugaaaa

SEQ ID NO: 1393010 - RNA, 18 nt, Human
caaaaaauuaaagcauuu

SEQ ID NO: 1393011 - RNA, 15 nt, Human
caaaaaauuaaagca

SEQ ID NO: 1393012 - RNA, 19 nt, Human
caaaaaauuaaagcauuua

SEQ ID NO: 1393013 - RNA, 17 nt, Human
auuuuguaaacucaaaa

SEQ ID NO: 1393014 - RNA, 10 nt, Human
auuuuguaaa

SEQ ID NO: 1393015 - RNA, 14 nt, Human
caaaaacaaaaaga

SEQ ID NO: 1393016 - RNA, 17 nt, Human
caaaaagaaccacuugu

SEQ ID NO: 1393017 - RNA, 14 nt, Human
caaaaagaaccacu

SEQ ID NO: 1393018 - RNA, 18 nt, Human
caaaaagcuaauaccagu

SEQ ID NO: 1393019 - RNA, 20 nt, Human
caaaaacagguauauacuuu

SEQ ID NO: 1393020 - RNA, 22 nt, Human
caaaaacagguauauacuuuga

SEQ ID NO: 1393021 - RNA, 14 nt, Human
caaaaacuauuugg

SEQ ID NO: 1393022 - RNA, 16 nt, Human
caaaaacuauuuggga

SEQ ID NO: 1393023 - RNA, 23 nt, Human
caaaaacuuuggaguccccucac

SEQ ID NO: 1393024 - RNA, 20 nt, Human
caaaaagaaaagaaaauuuu

SEQ ID NO: 1393025 - RNA, 20 nt, Human
caaaaccgccagcucuguuc

SEQ ID NO: 1393026 - RNA, 18 nt, Human
caaaaccgccagcucugu

SEQ ID NO: 1393027 - RNA, 17 nt, Human
caaaaccgccagcucug

SEQ ID NO: 1393028 - RNA, 14 nt, Human
caaaaccgccagcu

SEQ ID NO: 1393029 - RNA, 12 nt, Human
caaaaccgccag

SEQ ID NO: 1393030 - RNA, 21 nt, Human
caaaaccccccagauaucauc

SEQ ID NO: 1393031 - RNA, 19 nt, Human
caaaaccccccagauauca

SEQ ID NO: 1393032 - RNA, 15 nt, Human
caaaaccccccagau

SEQ ID NO: 1393033 - RNA, 15 nt, Human
caaaacccagaccug

SEQ ID NO: 1393034 - RNA, 13 nt, Human
caaaacccagacc

SEQ ID NO: 1393035 - RNA, 23 nt, Human
caaaaccagguccaaugagcuuu

SEQ ID NO: 1393036 - RNA, 22 nt, Human
caaaaccagguccaaugagcuu

SEQ ID NO: 1393037 - RNA, 16 nt, Human
caaaaccagguccaau

SEQ ID NO: 1393038 - RNA, 21 nt, Human
caaaacaguauugacuuguau

SEQ ID NO: 1393039 - RNA, 18 nt, Human
caaaacagauuguuugca

SEQ ID NO: 1393040 - RNA, 13 nt, Human
caaaacagauugu

SEQ ID NO: 1393041 - RNA, 18 nt, Human
caaaacacuuguaauuuu

SEQ ID NO: 1393042 - RNA, 16 nt, Human
caaaacacuuguaauu

SEQ ID NO: 1393043 - RNA, 16 nt, Human
caaaacaauguuuaaa

SEQ ID NO: 1393044 - RNA, 18 nt, Human
caaaacaauguuuaaacc

SEQ ID NO: 1393045 - RNA, 14 nt, Human
caaaacaauguuua

SEQ ID NO: 1393046 - RNA, 14 nt, Human
caaaacaaacucau

SEQ ID NO: 1393047 - RNA, 22 nt, Human
caaaacaaaggccuaauucuau

SEQ ID NO: 1393048 - RNA, 12 nt, Human
caaaacugcucc

SEQ ID NO: 1393049 - RNA, 22 nt, Human
caaaacugccucaggaggcagg

SEQ ID NO: 1393050 - RNA, 20 nt, Human
caaaagaagaaguuucauca

SEQ ID NO: 1393051 - RNA, 15 nt, Human
caaaagaagaaguuu

SEQ ID NO: 1393052 - RNA, 14 nt, Human
caaaagaagaaguu

SEQ ID NO: 1393053 - RNA, 16 nt, Human
caaaacaaaggccuaa

SEQ ID NO: 1393054 - RNA, 15 nt, Human
caaaacaaaggccua

SEQ ID NO: 1393055 - RNA, 12 nt, Human
caaaacaaaggc

SEQ ID NO: 1393056 - RNA, 22 nt, Human
caaaaauuucuguaaaacaggu

SEQ ID NO: 1393057 - RNA, 21 nt, Human
caaaaauuucuguaaaacagg

SEQ ID NO: 1393058 - RNA, 19 nt, Human
caaaaauuaucuauagcua

SEQ ID NO: 1393059 - RNA, 23 nt, Human
caaaaauauaaaauaugaagaca

SEQ ID NO: 1393060 - RNA, 12 nt, Human
caaaaauauaaa

SEQ ID NO: 1393061 - RNA, 14 nt, Human
caaaaauagcuaaa

SEQ ID NO: 1393062 - RNA, 15 nt, Human
caaaaagugaaauaa

SEQ ID NO: 1393063 - RNA, 19 nt, Human
caaaaaucucaauauuuca

SEQ ID NO: 1393064 - RNA, 16 nt, Human
caaaauguaugucugg

SEQ ID NO: 1393065 - RNA, 23 nt, Human
caaaauguaggcuuaguuugugu

SEQ ID NO: 1393066 - RNA, 23 nt, Human
caaaaugcuuuuuauuucugcau

SEQ ID NO: 1393067 - RNA, 20 nt, Human
caaaaugcuuuuuauuucug

SEQ ID NO: 1393068 - RNA, 18 nt, Human
caaaaugcuuuuuauuuc

SEQ ID NO: 1393069 - RNA, 12 nt, Human
caaaauaaaacu

SEQ ID NO: 1393070 - RNA, 14 nt, Human
caaaauaaaacuuu

SEQ ID NO: 1393071 - RNA, 21 nt, Human
caaaauguuggucauuuuaug

SEQ ID NO: 1393072 - RNA, 18 nt, Human
caaaauguuggucauuuu

SEQ ID NO: 1393073 - RNA, 17 nt, Human
caaaauguuggucauuu

SEQ ID NO: 1393074 - RNA, 22 nt, Human
caaaauguuaucuucucaaguu

SEQ ID NO: 1393075 - RNA, 21 nt, Human
caaaauguuaucuucucaagu

SEQ ID NO: 1393076 - RNA, 20 nt, Human
caaaauguuaucuucucaag

SEQ ID NO: 1393077 - RNA, 19 nt, Human
caaaauguuaucuucucaa

SEQ ID NO: 1393078 - RNA, 22 nt, Human
caaaauguugaaauaugauguu

SEQ ID NO: 1393079 - RNA, 21 nt, Human
caaaauuauagaaguuuagau

SEQ ID NO: 1393080 - RNA, 17 nt, Human
caaaauugcaaaucuug

SEQ ID NO: 1393081 - RNA, 16 nt, Human
caaaauugcaaaucuu

SEQ ID NO: 1393082 - RNA, 16 nt, Human
caaaauuguuacaaau

SEQ ID NO: 1393083 - RNA, 23 nt, Human
caaacgcccuuuccuccucaggc

SEQ ID NO: 1393084 - RNA, 22 nt, Human
caaacgcccuuuccuccucagg

SEQ ID NO: 1393085 - RNA, 20 nt, Human
caaacgcccuuuccuccuca

SEQ ID NO: 1393086 - RNA, 13 nt, Human
caaaccucaccaa

SEQ ID NO: 1393087 - RNA, 16 nt, Human
caaacaccaacauaaa

SEQ ID NO: 1393088 - RNA, 18 nt, Human
caaacaccaacauaaaaa

SEQ ID NO: 1393089 - RNA, 19 nt, Human
caaacaaugacaaagcaga

SEQ ID NO: 1393090 - RNA, 17 nt, Human
caaacaaugacaaagca

SEQ ID NO: 1393091 - RNA, 16 nt, Human
caaacacacacaaaag

SEQ ID NO: 1393092 - RNA, 22 nt, Human
caaaauuuuuucucuaggaaau

SEQ ID NO: 1393093 - RNA, 21 nt, Human
caaaauuuuuucucuaggaaa

SEQ ID NO: 1393094 - RNA, 22 nt, Human
caaaauugcaaaucuugaaauu

SEQ ID NO: 1393095 - RNA, 16 nt, Human
caaaauuuuuucucua

SEQ ID NO: 1393096 - RNA, 19 nt, Human
caaagccaggucccucuca

SEQ ID NO: 1393097 - RNA, 18 nt, Human
caaagccaggucccucuc

SEQ ID NO: 1393098 - RNA, 17 nt, Human
caaagccaggucccucu

SEQ ID NO: 1393099 - RNA, 14 nt, Human
caaagccagguccc

SEQ ID NO: 1393100 - RNA, 22 nt, Human
caaagccagcguccuccucugu

SEQ ID NO: 1393101 - RNA, 23 nt, Human
caaagccagcguccuccucugug

SEQ ID NO: 1393102 - RNA, 21 nt, Human
caaagccagcguccuccucug

SEQ ID NO: 1393103 - RNA, 20 nt, Human
caaagccagcguccuccucu

SEQ ID NO: 1393104 - RNA, 18 nt, Human
caaacuguguaacugccc

SEQ ID NO: 1393105 - RNA, 22 nt, Human
caaagccuguucauggcagaug

SEQ ID NO: 1393106 - RNA, 21 nt, Human
caaagccuguucauggcagau

SEQ ID NO: 1393107 - RNA, 20 nt, Human
caaagccuguucauggcaga

SEQ ID NO: 1393108 - RNA, 19 nt, Human
caaagccuguucauggcag

SEQ ID NO: 1393109 - RNA, 15 nt, Human
caaagcccuuuuaua

SEQ ID NO: 1393110 - RNA, 20 nt, Human
caaacuguguaacugcccaa

SEQ ID NO: 1393111 - RNA, 15 nt, Human
caaacuguguaacug

SEQ ID NO: 1393112 - RNA, 14 nt, Human
caaacuguaauaca

SEQ ID NO: 1393113 - RNA, 21 nt, Human
caaacuguaaauaaaaagaaa

SEQ ID NO: 1393114 - RNA, 20 nt, Human
caaacuguaaauaaaaagaa

SEQ ID NO: 1393115 - RNA, 14 nt, Human
caaacuguaaauaa

SEQ ID NO: 1393116 - RNA, 12 nt, Human
caaacuguaaau

SEQ ID NO: 1393117 - RNA, 17 nt, Human
caaacuggggccucccu

SEQ ID NO: 1393118 - RNA, 13 nt, Human
caaacuagggcca

SEQ ID NO: 1393119 - RNA, 20 nt, Human
caaacuacuuugcugcuaau

SEQ ID NO: 1393120 - RNA, 19 nt, Human
caaacuagggccaagccca

SEQ ID NO: 1393121 - RNA, 21 nt, Human
caaagcugccugucccuaccc

SEQ ID NO: 1393122 - RNA, 23 nt, Human
caaaggccuaauucuaugccugu

SEQ ID NO: 1393123 - RNA, 17 nt, Human
caaaggaagguggaugg

SEQ ID NO: 1393124 - RNA, 11 nt, Human
caaagcugccu

SEQ ID NO: 1393125 - RNA, 12 nt, Human
caaagcugccug

SEQ ID NO: 1393126 - RNA, 21 nt, Human
caaaggcauuauaaaaagaau

SEQ ID NO: 1393127 - RNA, 18 nt, Human
caaauugugcaguacuuu

SEQ ID NO: 1393128 - RNA, 15 nt, Human
caaauugugugaaag

SEQ ID NO: 1393129 - RNA, 15 nt, Human
caaauucaguuucau

SEQ ID NO: 1393130 - RNA, 14 nt, Human
caaauucaguuuca

SEQ ID NO: 1393131 - RNA, 12 nt, Human
caaauucaguuu

SEQ ID NO: 1393132 - RNA, 21 nt, Human
caaauuguaagcaugcacaaa

SEQ ID NO: 1393133 - RNA, 11 nt, Human
caaauuucuaa

SEQ ID NO: 1393134 - RNA, 12 nt, Human
caaauuucuaaa

SEQ ID NO: 1393135 - RNA, 14 nt, Human
caaauuucuaaauc

SEQ ID NO: 1393136 - RNA, 16 nt, Human
caaauucaguuucaua

SEQ ID NO: 1393137 - RNA, 14 nt, Human
caaauucaaauaaa

SEQ ID NO: 1393138 - RNA, 17 nt, Human
caaauuauuaaugaaaa

SEQ ID NO: 1393139 - RNA, 15 nt, Human
caaauuauuaaugaa

SEQ ID NO: 1393140 - RNA, 14 nt, Human
caaauuaucuuaaa

SEQ ID NO: 1393141 - RNA, 23 nt, Human
caaauguaguauggccuguguca

SEQ ID NO: 1393142 - RNA, 22 nt, Human
caaauguaguauggccuguguc

SEQ ID NO: 1393143 - RNA, 13 nt, Human
caaaugguaucuu

SEQ ID NO: 1393144 - RNA, 19 nt, Human
caaaugucaugcugccuua

SEQ ID NO: 1393145 - RNA, 17 nt, Human
caaaugucaugcugccu

SEQ ID NO: 1393146 - RNA, 16 nt, Human
caaaugucaugcugcc

SEQ ID NO: 1393147 - RNA, 14 nt, Human
caaaugucuauaaa

SEQ ID NO: 1393148 - RNA, 18 nt, Human
caaaugucaugcugccuu

SEQ ID NO: 1393149 - RNA, 15 nt, Human
caaaugucuauaaac

SEQ ID NO: 1393150 - RNA, 15 nt, Human
caaaugguaucuuuu

SEQ ID NO: 1393151 - RNA, 20 nt, Human
caaaugguaggcauuuccua

SEQ ID NO: 1393152 - RNA, 15 nt, Human
caaaugguaggcauu

SEQ ID NO: 1393153 - RNA, 13 nt, Human
caaaugguaggca

SEQ ID NO: 1393154 - RNA, 23 nt, Human
caaauggggccagauccagccug

SEQ ID NO: 1393155 - RNA, 20 nt, Human
caaauggggccagauccagc

SEQ ID NO: 1393156 - RNA, 19 nt, Human
caaauggggccagauccag

SEQ ID NO: 1393157 - RNA, 18 nt, Human
caaauggggccagaucca

SEQ ID NO: 1393158 - RNA, 17 nt, Human
caaauggggccagaucc

SEQ ID NO: 1393159 - RNA, 16 nt, Human
caaauggggccagauc

SEQ ID NO: 1393160 - RNA, 15 nt, Human
caaauggggccagau

SEQ ID NO: 1393161 - RNA, 14 nt, Human
caaauggggccaga

SEQ ID NO: 1393162 - RNA, 17 nt, Human
caaauauguccuggggu

SEQ ID NO: 1393163 - RNA, 15 nt, Human
caaauauguccuggg

SEQ ID NO: 1393164 - RNA, 14 nt, Human
caaauauguccugg

SEQ ID NO: 1393165 - RNA, 13 nt, Human
caaauauguccug

SEQ ID NO: 1393166 - RNA, 19 nt, Human
caaagugcugggauuacag

SEQ ID NO: 1393167 - RNA, 22 nt, Human
caaagggggaggcuaaagccca

SEQ ID NO: 1393168 - RNA, 18 nt, Human
caaauacuguauauucag

SEQ ID NO: 1393169 - RNA, 17 nt, Human
caaauacuaaugaaaac

SEQ ID NO: 1393170 - RNA, 16 nt, Human
caaauacuaaugaaaa

SEQ ID NO: 1393171 - RNA, 21 nt, Human
caaauacuaaaaagaagugcu

SEQ ID NO: 1393172 - RNA, 16 nt, Human
caaauacuaaaaagaa

SEQ ID NO: 1393173 - RNA, 15 nt, Human
caaauacuaaaaaga

SEQ ID NO: 1393174 - RNA, 20 nt, Human
caaauacgugggcauucaaa

SEQ ID NO: 1393175 - RNA, 15 nt, Human
caaaguggaacgaaa

SEQ ID NO: 1393176 - RNA, 14 nt, Human
caaaguggaacgaa

SEQ ID NO: 1393177 - RNA, 11 nt, Human
caaaguggaac

SEQ ID NO: 1393178 - RNA, 22 nt, Human
caaauacgugggcauucaaaug

SEQ ID NO: 1393179 - RNA, 21 nt, Human
caaauacgugggcauucaaau

SEQ ID NO: 1393180 - RNA, 17 nt, Human
caaaaauuaucuauagc

SEQ ID NO: 1393181 - RNA, 18 nt, Human
caauaauauauuuucugu

SEQ ID NO: 1393182 - RNA, 20 nt, Human
caauaauauauuuucuguuu

SEQ ID NO: 1393183 - RNA, 17 nt, Human
caauaauauauuuucug

SEQ ID NO: 1393184 - RNA, 16 nt, Human
caauaauauauuuucu

SEQ ID NO: 1393185 - RNA, 14 nt, Human
caauaauauauuuu

SEQ ID NO: 1393186 - RNA, 13 nt, Human
caauaauauauuu

SEQ ID NO: 1393187 - RNA, 13 nt, Human
caaguuauuaauu

SEQ ID NO: 1393188 - RNA, 16 nt, Human
caaguuagaaaacaua

SEQ ID NO: 1393189 - RNA, 14 nt, Human
caaguuaaauguag

SEQ ID NO: 1393190 - RNA, 13 nt, Human
caaguuaaaugua

SEQ ID NO: 1393191 - RNA, 12 nt, Human
caaguuaaaugu

SEQ ID NO: 1393192 - RNA, 24 nt, Human
caauagccacuaaccuugccuggu

SEQ ID NO: 1393193 - RNA, 22 nt, Human
caauagccacuaaccuugccug

SEQ ID NO: 1393194 - RNA, 18 nt, Human
caauagccacuaaccuug

SEQ ID NO: 1393195 - RNA, 17 nt, Human
caauagccacuaaccuu

SEQ ID NO: 1393196 - RNA, 16 nt, Human
caauacaaauggauuu

SEQ ID NO: 1393197 - RNA, 15 nt, Human
caauacaaauggauu

SEQ ID NO: 1393198 - RNA, 14 nt, Human
caauacaaauggau

SEQ ID NO: 1393199 - RNA, 13 nt, Human
caauacaaaugga

SEQ ID NO: 1393200 - RNA, 14 nt, Human
caauaauuuucuac

SEQ ID NO: 1393201 - RNA, 13 nt, Human
caauaauuuucua

SEQ ID NO: 1393202 - RNA, 15 nt, Human
caauacagauauauu

SEQ ID NO: 1393203 - RNA, 13 nt, Human
caauacagauaua

SEQ ID NO: 1393204 - RNA, 21 nt, Human
caauacaaauggauuuuggga

SEQ ID NO: 1393205 - RNA, 16 nt, Human
caauacagauauauuu

SEQ ID NO: 1393206 - RNA, 23 nt, Human
caauacaucccuuaccugggaaa

SEQ ID NO: 1393207 - RNA, 20 nt, Human
caauauacuggaaagcuuuu

SEQ ID NO: 1393208 - RNA, 16 nt, Human
caauauaagcuuuucu

SEQ ID NO: 1393209 - RNA, 14 nt, Human
caauaucagacuuu

SEQ ID NO: 1393210 - RNA, 18 nt, Human
caaucuguaaacugugua

SEQ ID NO: 1393211 - RNA, 14 nt, Human
caaucugucaguuc

SEQ ID NO: 1393212 - RNA, 17 nt, Human
caaucuguaaacugugu

SEQ ID NO: 1393213 - RNA, 16 nt, Human
caaucuguaaacugug

SEQ ID NO: 1393214 - RNA, 15 nt, Human
caaucuguaaacugu

SEQ ID NO: 1393215 - RNA, 12 nt, Human
caaucuguaaac

SEQ ID NO: 1393216 - RNA, 18 nt, Human
caaucuguaaaacuaaga

SEQ ID NO: 1393217 - RNA, 15 nt, Human
caaugacuuacugua

SEQ ID NO: 1393218 - RNA, 17 nt, Human
caaugacuuacuguaca

SEQ ID NO: 1393219 - RNA, 18 nt, Human
caaugacuuacuguacau

SEQ ID NO: 1393220 - RNA, 23 nt, Human
caauguaauuauuuauguauggu

SEQ ID NO: 1393221 - RNA, 22 nt, Human
caauguaauuauuuauguaugg

SEQ ID NO: 1393222 - RNA, 14 nt, Human
caauguaauuauuu

SEQ ID NO: 1393223 - RNA, 13 nt, Human
caauguaauuauu

SEQ ID NO: 1393224 - RNA, 12 nt, Human
caauguaauuau

SEQ ID NO: 1393225 - RNA, 23 nt, Human
caauggguuuuucccuguacagu

SEQ ID NO: 1393226 - RNA, 15 nt, Human
caauggggccaguca

SEQ ID NO: 1393227 - RNA, 22 nt, Human
caaugagcuuucugaacagcug

SEQ ID NO: 1393228 - RNA, 21 nt, Human
caaugggagcugaggccacac

SEQ ID NO: 1393229 - RNA, 21 nt, Human
caauguagauaaguguucugu

SEQ ID NO: 1393230 - RNA, 20 nt, Human
caauguagauaaguguucug

SEQ ID NO: 1393231 - RNA, 16 nt, Human
caauguagauaagugu

SEQ ID NO: 1393232 - RNA, 22 nt, Human
caauguacccaccgggccacuc

SEQ ID NO: 1393233 - RNA, 19 nt, Human
caauguacccaccgggcca

SEQ ID NO: 1393234 - RNA, 17 nt, Human
caauguacccaccgggc

SEQ ID NO: 1393235 - RNA, 23 nt, Human
caaugggagcugaggccacacuc

SEQ ID NO: 1393236 - RNA, 19 nt, Human
caaugggagcugaggccac

SEQ ID NO: 1393237 - RNA, 13 nt, Human
caaugagcuuucu

SEQ ID NO: 1393238 - RNA, 12 nt, Human
caaugagcuuuc

SEQ ID NO: 1393239 - RNA, 20 nt, Human
caaugagcauguuuagacuu

SEQ ID NO: 1393240 - RNA, 18 nt, Human
caaugagcauguuuagac

SEQ ID NO: 1393241 - RNA, 14 nt, Human
caaugagcauguuu

SEQ ID NO: 1393242 - RNA, 13 nt, Human
caaugagcauguu

SEQ ID NO: 1393243 - RNA, 12 nt, Human
caaugagcaugu

SEQ ID NO: 1393244 - RNA, 23 nt, Human
caaugagcuuucugaacagcugg

SEQ ID NO: 1393245 - RNA, 21 nt, Human
caaugagcuuucugaacagcu

SEQ ID NO: 1393246 - RNA, 20 nt, Human
caaugagcuuucugaacagc

SEQ ID NO: 1393247 - RNA, 17 nt, Human
caaugagcuuucugaac

SEQ ID NO: 1393248 - RNA, 16 nt, Human
caaugagcuuucugaa

SEQ ID NO: 1393249 - RNA, 15 nt, Human
caaugagcuuucuga

SEQ ID NO: 1393250 - RNA, 14 nt, Human
caaugagcuuucug

SEQ ID NO: 1393251 - RNA, 19 nt, Human
caauuuggcaauuuugugg

SEQ ID NO: 1393252 - RNA, 18 nt, Human
caauuuggcaauuuugug

SEQ ID NO: 1393253 - RNA, 23 nt, Human
caauuuggauuuaaaagccugcu

SEQ ID NO: 1393254 - RNA, 21 nt, Human
caauuuggauuuaaaagccug

SEQ ID NO: 1393255 - RNA, 19 nt, Human
caauuacaacggagucaaa

SEQ ID NO: 1393256 - RNA, 22 nt, Human
caauguuagccucaauuucuga

SEQ ID NO: 1393257 - RNA, 15 nt, Human
caauguuagccucaa

SEQ ID NO: 1393258 - RNA, 18 nt, Human
caauuaauuccuucagca

SEQ ID NO: 1393259 - RNA, 15 nt, Human
caauuaauuccuuca

SEQ ID NO: 1393260 - RNA, 14 nt, Human
caauuaauuuuaga

SEQ ID NO: 1393261 - RNA, 19 nt, Human
caagugaggugugucacaa

SEQ ID NO: 1393262 - RNA, 16 nt, Human
caaguggacucagggc

SEQ ID NO: 1393263 - RNA, 15 nt, Human
caaguggacucaggg

SEQ ID NO: 1393264 - RNA, 19 nt, Human
caagugaucugcccaccuc

SEQ ID NO: 1393265 - RNA, 18 nt, Human
caagugagucucucuggg

SEQ ID NO: 1393266 - RNA, 23 nt, Human
caaguggacucagggcagcgcca

SEQ ID NO: 1393267 - RNA, 18 nt, Human
caaguggacucagggcag

SEQ ID NO: 1393268 - RNA, 23 nt, Human
caaguguaaaauauuuugaauca

SEQ ID NO: 1393269 - RNA, 15 nt, Human
caaggcuguggacca

SEQ ID NO: 1393270 - RNA, 15 nt, Human
caaggggccugagca

SEQ ID NO: 1393271 - RNA, 14 nt, Human
caaggggccugagc

SEQ ID NO: 1393272 - RNA, 20 nt, Human
caaggcuguggaccauggag

SEQ ID NO: 1393273 - RNA, 22 nt, Human
caaggggcuucagguccaggcu

SEQ ID NO: 1393274 - RNA, 21 nt, Human
caaggggccugagcaguccuu

SEQ ID NO: 1393275 - RNA, 16 nt, Human
caaggggccugagcag

SEQ ID NO: 1393276 - RNA, 14 nt, Human
caaggucauuuuuu

SEQ ID NO: 1393277 - RNA, 20 nt, Human
caaggucauuuuuuuuaaga

SEQ ID NO: 1393278 - RNA, 22 nt, Human
caagguccucugucagucacag

SEQ ID NO: 1393279 - RNA, 21 nt, Human
caagguccucugucagucaca

SEQ ID NO: 1393280 - RNA, 20 nt, Human
caagguccucugucagucac

SEQ ID NO: 1393281 - RNA, 19 nt, Human
caaggucguuuuuuucauu

SEQ ID NO: 1393282 - RNA, 13 nt, Human
caaggucugcuuu

SEQ ID NO: 1393283 - RNA, 15 nt, Human
caaggacuuuguaca

SEQ ID NO: 1393284 - RNA, 16 nt, Human
caaggacuuugcagcc

SEQ ID NO: 1393285 - RNA, 15 nt, Human
caaggacuuugcagc

SEQ ID NO: 1393286 - RNA, 23 nt, Human
caaggacuuccuguccagcucca

SEQ ID NO: 1393287 - RNA, 22 nt, Human
caaggacuuccuguccagcucc

SEQ ID NO: 1393288 - RNA, 21 nt, Human
caaggacuuccuguccagcuc

SEQ ID NO: 1393289 - RNA, 19 nt, Human
caaggacuuccuguccagc

SEQ ID NO: 1393290 - RNA, 14 nt, Human
caaggacuuccugu

SEQ ID NO: 1393291 - RNA, 18 nt, Human
caaggaggggcuguaaaa

SEQ ID NO: 1393292 - RNA, 18 nt, Human
caaggaguaugcagggag

SEQ ID NO: 1393293 - RNA, 16 nt, Human
caaggagucacugaga

SEQ ID NO: 1393294 - RNA, 19 nt, Human
caaggaaguagaaacaaaa

SEQ ID NO: 1393295 - RNA, 23 nt, Human
caaggaauuucuuaacuucuugc

SEQ ID NO: 1393296 - RNA, 21 nt, Human
caaggaauuucuuaacuucuu

SEQ ID NO: 1393297 - RNA, 18 nt, Human
caaggaauuucuuaacuu

SEQ ID NO: 1393298 - RNA, 16 nt, Human
caaggaauuucuuaac

SEQ ID NO: 1393299 - RNA, 15 nt, Human
caaggaauuucuuaa

SEQ ID NO: 1393300 - RNA, 12 nt, Human
caaggaauuucu

SEQ ID NO: 1393301 - RNA, 12 nt, Human
caaggaagucaa

SEQ ID NO: 1393302 - RNA, 16 nt, Human
caaggaaguagaaaca

SEQ ID NO: 1393303 - RNA, 23 nt, Human
caagccugcacaauaaaaauguu

SEQ ID NO: 1393304 - RNA, 22 nt, Human
caagccugagggaaaggccagc

SEQ ID NO: 1393305 - RNA, 21 nt, Human
caagccugagggaaaggccag

SEQ ID NO: 1393306 - RNA, 18 nt, Human
caagccugagggaaaggc

SEQ ID NO: 1393307 - RNA, 17 nt, Human
caagccugagggaaagg

SEQ ID NO: 1393308 - RNA, 13 nt, Human
caagccugaggga

SEQ ID NO: 1393309 - RNA, 11 nt, Human
caagccugagg

SEQ ID NO: 1393310 - RNA, 18 nt, Human
caagccucugcccaggca

SEQ ID NO: 1393311 - RNA, 16 nt, Human
caagccagaggcuggg

SEQ ID NO: 1393312 - RNA, 15 nt, Human
caagccagaggcugg

SEQ ID NO: 1393313 - RNA, 13 nt, Human
caagccagaggcu

SEQ ID NO: 1393314 - RNA, 13 nt, Human
caagccagaacuu

SEQ ID NO: 1393315 - RNA, 15 nt, Human
caagccagauuuuuu

SEQ ID NO: 1393316 - RNA, 21 nt, Human
caagccagauuuuccugaaaa

SEQ ID NO: 1393317 - RNA, 13 nt, Human
caacuuuucuauu

SEQ ID NO: 1393318 - RNA, 20 nt, Human
caacuuuuccuuugaauccu

SEQ ID NO: 1393319 - RNA, 23 nt, Human
caagaaaaauaaagaaaagaugc

SEQ ID NO: 1393320 - RNA, 18 nt, Human
caagaaaaauaaagaaaa

SEQ ID NO: 1393321 - RNA, 17 nt, Human
caagaaaaauaaagaaa

SEQ ID NO: 1393322 - RNA, 16 nt, Human
caagaaaaauaaagaa

SEQ ID NO: 1393323 - RNA, 14 nt, Human
caagaaaaauaaag

SEQ ID NO: 1393324 - RNA, 20 nt, Human
caagaaaaauaaagaaaaga

SEQ ID NO: 1393325 - RNA, 19 nt, Human
caagaaaaauaaagaaaag

SEQ ID NO: 1393326 - RNA, 22 nt, Human
caagaaaaauaaagaaaagaug

SEQ ID NO: 1393327 - RNA, 20 nt, Human
caagaacacagcccugcuuc

SEQ ID NO: 1393328 - RNA, 16 nt, Human
caagacugacgccagg

SEQ ID NO: 1393329 - RNA, 20 nt, Human
caagaggcuguucccaccag

SEQ ID NO: 1393330 - RNA, 22 nt, Human
caagacucuuuaugaucuggcc

SEQ ID NO: 1393331 - RNA, 19 nt, Human
caagagggacgccuggggg

SEQ ID NO: 1393332 - RNA, 17 nt, Human
caagagggacgccuggg

SEQ ID NO: 1393333 - RNA, 21 nt, Human
caagacucuagaguccaaggu

SEQ ID NO: 1393334 - RNA, 17 nt, Human
caagacucuagagucca

SEQ ID NO: 1393335 - RNA, 14 nt, Human
caagacucuagagu

SEQ ID NO: 1393336 - RNA, 19 nt, Human
caagaagaagggcacccua

SEQ ID NO: 1393337 - RNA, 19 nt, Human
caagacugcacaucaaaau

SEQ ID NO: 1393338 - RNA, 17 nt, Human
caacccgugccaagucc

SEQ ID NO: 1393339 - RNA, 16 nt, Human
caacccgugccaaguc

SEQ ID NO: 1393340 - RNA, 22 nt, Human
caacccgucuggcccaccaggg

SEQ ID NO: 1393341 - RNA, 21 nt, Human
caacccgucuggcccaccagg

SEQ ID NO: 1393342 - RNA, 20 nt, Human
caacccgucuggcccaccag

SEQ ID NO: 1393343 - RNA, 22 nt, Human
caacacuguaguaaauaaugcu

SEQ ID NO: 1393344 - RNA, 16 nt, Human
caacccgaggcccgca

SEQ ID NO: 1393345 - RNA, 21 nt, Human
caacccguggaggcugcucgg

SEQ ID NO: 1393346 - RNA, 18 nt, Human
caacccguggaggcugcu

SEQ ID NO: 1393347 - RNA, 17 nt, Human
caacccguggaggcugc

SEQ ID NO: 1393348 - RNA, 16 nt, Human
caacccguggaggcug

SEQ ID NO: 1393349 - RNA, 23 nt, Human
caacccgugccaaguccaggucc

SEQ ID NO: 1393350 - RNA, 18 nt, Human
caacacuggucugcuguu

SEQ ID NO: 1393351 - RNA, 22 nt, Human
caacacuggucugcuguuccag

SEQ ID NO: 1393352 - RNA, 14 nt, Human
caacacugccagca

SEQ ID NO: 1393353 - RNA, 13 nt, Human
caacacugccagc

SEQ ID NO: 1393354 - RNA, 12 nt, Human
caacacugccag

SEQ ID NO: 1393355 - RNA, 17 nt, Human
caaauuucaugaccagu

SEQ ID NO: 1393356 - RNA, 13 nt, Human
caacgugcauugu

SEQ ID NO: 1393357 - RNA, 16 nt, Human
caacgugcauugugcu

SEQ ID NO: 1393358 - RNA, 17 nt, Human
caacgugcauugugcuu

SEQ ID NO: 1393359 - RNA, 23 nt, Human
caaccuguuaccuacuuugacuu

SEQ ID NO: 1393360 - RNA, 22 nt, Human
caaccuguuaccuacuuugacu

SEQ ID NO: 1393361 - RNA, 20 nt, Human
caaccuguuaccuacuuuga

SEQ ID NO: 1393362 - RNA, 18 nt, Human
caaccuguagaguggcca

SEQ ID NO: 1393363 - RNA, 18 nt, Human
caaccuuagauguucuaa

SEQ ID NO: 1393364 - RNA, 17 nt, Human
caaccuuagauguucua

SEQ ID NO: 1393365 - RNA, 20 nt, Human
caacggaaagugcugucuua

SEQ ID NO: 1393366 - RNA, 13 nt, Human
caacggagucaaa

SEQ ID NO: 1393367 - RNA, 15 nt, Human
caaccguggcccuuc

SEQ ID NO: 1393368 - RNA, 22 nt, Human
caaccggcuuuguggcacuggg

SEQ ID NO: 1393369 - RNA, 13 nt, Human
caaccggcuuugu

SEQ ID NO: 1393370 - RNA, 22 nt, Human
caaccguggcccuuccuggaca

SEQ ID NO: 1393371 - RNA, 23 nt, Human
caaccguggcccuuccuggacag

SEQ ID NO: 1393372 - RNA, 21 nt, Human
caaccguggcccuuccuggac

SEQ ID NO: 1393373 - RNA, 20 nt, Human
caaccguggcccuuccugga

SEQ ID NO: 1393374 - RNA, 19 nt, Human
caaccguggcccuuccugg

SEQ ID NO: 1393375 - RNA, 18 nt, Human
caaccguggcccuuccug

SEQ ID NO: 1393376 - RNA, 20 nt, Human
caaccucugccucccagguu

SEQ ID NO: 1393377 - RNA, 13 nt, Human
caccccugcacag

SEQ ID NO: 1393378 - RNA, 12 nt, Human
caccccuaggac

SEQ ID NO: 1393379 - RNA, 13 nt, Human
cacauauugauuu

SEQ ID NO: 1393380 - RNA, 16 nt, Human
cacccuaccugugccu

SEQ ID NO: 1393381 - RNA, 21 nt, Human
cacccggcugcagaggccaga

SEQ ID NO: 1393382 - RNA, 15 nt, Human
cacccggcugcagag

SEQ ID NO: 1393383 - RNA, 21 nt, Human
cacccucacuggcucuccugg

SEQ ID NO: 1393384 - RNA, 20 nt, Human
cacccucagaugcacaugag

SEQ ID NO: 1393385 - RNA, 14 nt, Human
cacccugucugccc

SEQ ID NO: 1393386 - RNA, 20 nt, Human
cacccucacuggcucuccug

SEQ ID NO: 1393387 - RNA, 12 nt, Human
cacccucacacu

SEQ ID NO: 1393388 - RNA, 21 nt, Human
cacccuucucccacucuccua

SEQ ID NO: 1393389 - RNA, 23 nt, Human
cacccuucucccacucuccuagg

SEQ ID NO: 1393390 - RNA, 19 nt, Human
cacccuucucccacucucc

SEQ ID NO: 1393391 - RNA, 18 nt, Human
cacccuucucccacucuc

SEQ ID NO: 1393392 - RNA, 17 nt, Human
cacccuucucccacucu

SEQ ID NO: 1393393 - RNA, 16 nt, Human
cacccuucucccacuc

SEQ ID NO: 1393394 - RNA, 15 nt, Human
cacccuucucccacu

SEQ ID NO: 1393395 - RNA, 13 nt, Human
cacccuucuccca

SEQ ID NO: 1393396 - RNA, 17 nt, Human
cacccuguuccugcugc

SEQ ID NO: 1393397 - RNA, 18 nt, Human
cacccuguuccugcugcu

SEQ ID NO: 1393398 - RNA, 16 nt, Human
cacccuguuccugcug

SEQ ID NO: 1393399 - RNA, 15 nt, Human
cacccuguuccugcu

SEQ ID NO: 1393400 - RNA, 14 nt, Human
cacccuguuccugc

SEQ ID NO: 1393401 - RNA, 18 nt, Human
cacccuguggucuuccuc

SEQ ID NO: 1393402 - RNA, 19 nt, Human
cacccugucugccccgccc

SEQ ID NO: 1393403 - RNA, 21 nt, Human
caccgaagcccagagggucug

SEQ ID NO: 1393404 - RNA, 15 nt, Human
caccgaagcccagag

SEQ ID NO: 1393405 - RNA, 14 nt, Human
caccgaagcccaga

SEQ ID NO: 1393406 - RNA, 21 nt, Human
cacccuuuuccagcuggauga

SEQ ID NO: 1393407 - RNA, 17 nt, Human
cacccuuuuccagcugg

SEQ ID NO: 1393408 - RNA, 15 nt, Human
cacccuuuuccagcu

SEQ ID NO: 1393409 - RNA, 22 nt, Human
cacccuuugcugugaggcuguc

SEQ ID NO: 1393410 - RNA, 20 nt, Human
cacccuuugcugugaggcug

SEQ ID NO: 1393411 - RNA, 18 nt, Human
cacccuugguuccuaacu

SEQ ID NO: 1393412 - RNA, 15 nt, Human
caccgacugaaaaua

SEQ ID NO: 1393413 - RNA, 12 nt, Human
caccgagugggg

SEQ ID NO: 1393414 - RNA, 13 nt, Human
caccgcagaagga

SEQ ID NO: 1393415 - RNA, 20 nt, Human
cacauauugauuuccguuaa

SEQ ID NO: 1393416 - RNA, 21 nt, Human
caccugcacuaacagaguggc

SEQ ID NO: 1393417 - RNA, 16 nt, Human
caccugcacuaacaga

SEQ ID NO: 1393418 - RNA, 15 nt, Human
caccugcacuaacag

SEQ ID NO: 1393419 - RNA, 23 nt, Human
caccugagucacccuaccugugc

SEQ ID NO: 1393420 - RNA, 19 nt, Human
caccugagucacccuaccu

SEQ ID NO: 1393421 - RNA, 11 nt, Human
caccugaggaa

SEQ ID NO: 1393422 - RNA, 14 nt, Human
caccugaggaacug

SEQ ID NO: 1393423 - RNA, 20 nt, Human
caccugacacaccaggcgcu

SEQ ID NO: 1393424 - RNA, 22 nt, Human
caccuggaagcauuuguuucua

SEQ ID NO: 1393425 - RNA, 21 nt, Human
caccuggaagcauuuguuucu

SEQ ID NO: 1393426 - RNA, 23 nt, Human
caccugcugucuggguggcucac

SEQ ID NO: 1393427 - RNA, 20 nt, Human
caccuggaauauauaaccag

SEQ ID NO: 1393428 - RNA, 23 nt, Human
caccugcugagaaaacaugccuc

SEQ ID NO: 1393429 - RNA, 13 nt, Human
caccugaacugaa

SEQ ID NO: 1393430 - RNA, 12 nt, Human
caccucugcugc

SEQ ID NO: 1393431 - RNA, 17 nt, Human
caccugacacaccaggc

SEQ ID NO: 1393432 - RNA, 16 nt, Human
caccugacacaccagg

SEQ ID NO: 1393433 - RNA, 19 nt, Human
caccugaacugaacaccau

SEQ ID NO: 1393434 - RNA, 17 nt, Human
caccugaacugaacacc

SEQ ID NO: 1393435 - RNA, 16 nt, Human
caccuggcccugcuuc

SEQ ID NO: 1393436 - RNA, 15 nt, Human
caccuggcccugcuu

SEQ ID NO: 1393437 - RNA, 13 nt, Human
caccuggcccugc

SEQ ID NO: 1393438 - RNA, 23 nt, Human
caccuggcaucgcaccauucuga

SEQ ID NO: 1393439 - RNA, 19 nt, Human
caccuggaccccugcauug

SEQ ID NO: 1393440 - RNA, 18 nt, Human
caccuggaccccugcauu

SEQ ID NO: 1393441 - RNA, 17 nt, Human
caccuggaccccugcau

SEQ ID NO: 1393442 - RNA, 16 nt, Human
caccuggaccccugca

SEQ ID NO: 1393443 - RNA, 15 nt, Human
caccuggaccccugc

SEQ ID NO: 1393444 - RNA, 12 nt, Human
caccuggacccc

SEQ ID NO: 1393445 - RNA, 11 nt, Human
caccuggaccc

SEQ ID NO: 1393446 - RNA, 19 nt, Human
caccuggcucucaccucua

SEQ ID NO: 1393447 - RNA, 18 nt, Human
caccuggcucucaccucu

SEQ ID NO: 1393448 - RNA, 17 nt, Human
caccuggcucucaccuc

SEQ ID NO: 1393449 - RNA, 16 nt, Human
caccuggcucucaccu

SEQ ID NO: 1393450 - RNA, 20 nt, Human
caccuggcccugcuuccugc

SEQ ID NO: 1393451 - RNA, 22 nt, Human
caccuggcccugcuuccugcuu

SEQ ID NO: 1393452 - RNA, 20 nt, Human
caccugggauuacaagcaug

SEQ ID NO: 1393453 - RNA, 20 nt, Human
caccuguaaugugcgaggga

SEQ ID NO: 1393454 - RNA, 16 nt, Human
caccuguaaaccugag

SEQ ID NO: 1393455 - RNA, 15 nt, Human
caccuguaaaccuga

SEQ ID NO: 1393456 - RNA, 14 nt, Human
caccuguaaaccug

SEQ ID NO: 1393457 - RNA, 17 nt, Human
caccugguggccaugcu

SEQ ID NO: 1393458 - RNA, 21 nt, Human
caccugguggccaugcuccuc

SEQ ID NO: 1393459 - RNA, 16 nt, Human
caccugguggccaugc

SEQ ID NO: 1393460 - RNA, 15 nt, Human
caccugguggccaug

SEQ ID NO: 1393461 - RNA, 20 nt, Human
caccugguacucccucucag

SEQ ID NO: 1393462 - RNA, 23 nt, Human
caccugggcccuggggccuguac

SEQ ID NO: 1393463 - RNA, 22 nt, Human
caccugggcccuggggccugua

SEQ ID NO: 1393464 - RNA, 21 nt, Human
caccugggcccuggggccugu

SEQ ID NO: 1393465 - RNA, 20 nt, Human
caccugggcccuggggccug

SEQ ID NO: 1393466 - RNA, 19 nt, Human
caccugggcccuggggccu

SEQ ID NO: 1393467 - RNA, 18 nt, Human
caccugggcccuggggcc

SEQ ID NO: 1393468 - RNA, 17 nt, Human
caccugggcccuggggc

SEQ ID NO: 1393469 - RNA, 14 nt, Human
caccugggcccugg

SEQ ID NO: 1393470 - RNA, 17 nt, Human
caccugggagaaaucug

SEQ ID NO: 1393471 - RNA, 16 nt, Human
caccugggagaaaucu

SEQ ID NO: 1393472 - RNA, 15 nt, Human
caccuguagcagcca

SEQ ID NO: 1393473 - RNA, 22 nt, Human
caccuguagcacuuacugguag

SEQ ID NO: 1393474 - RNA, 18 nt, Human
caccuguagcacuuacug

SEQ ID NO: 1393475 - RNA, 14 nt, Human
caccugucccagaa

SEQ ID NO: 1393476 - RNA, 15 nt, Human
caccugucccagaaa

SEQ ID NO: 1393477 - RNA, 11 nt, Human
caccugucugu

SEQ ID NO: 1393478 - RNA, 12 nt, Human
caccugucuguc

SEQ ID NO: 1393479 - RNA, 13 nt, Human
caccugucugucu

SEQ ID NO: 1393480 - RNA, 14 nt, Human
caccugucugucug

SEQ ID NO: 1393481 - RNA, 13 nt, Human
caccuccugccuc

SEQ ID NO: 1393482 - RNA, 15 nt, Human
caccuccugccucag

SEQ ID NO: 1393483 - RNA, 16 nt, Human
caccuccucagccuga

SEQ ID NO: 1393484 - RNA, 14 nt, Human
caccuccucaugua

SEQ ID NO: 1393485 - RNA, 14 nt, Human
caccuccucagccu

SEQ ID NO: 1393486 - RNA, 21 nt, Human
caccucccucaaccucauccu

SEQ ID NO: 1393487 - RNA, 17 nt, Human
caccuccuucccucucu

SEQ ID NO: 1393488 - RNA, 13 nt, Human
caccuccuucccu

SEQ ID NO: 1393489 - RNA, 22 nt, Human
caccuccuggguucaagcgauu

SEQ ID NO: 1393490 - RNA, 20 nt, Human
caccuccuggguucaagcga

SEQ ID NO: 1393491 - RNA, 19 nt, Human
caccuccugacacccuucu

SEQ ID NO: 1393492 - RNA, 22 nt, Human
caccuccuucccucucuggaga

SEQ ID NO: 1393493 - RNA, 16 nt, Human
caccucuaacagcacc

SEQ ID NO: 1393494 - RNA, 19 nt, Human
caccucgcagguucaagca

SEQ ID NO: 1393495 - RNA, 22 nt, Human
caccucuaacagcaccaaauca

SEQ ID NO: 1393496 - RNA, 20 nt, Human
caccucuaacagcaccaaau

SEQ ID NO: 1393497 - RNA, 17 nt, Human
caccucuaacagcacca

SEQ ID NO: 1393498 - RNA, 22 nt, Human
caccucuagguccccauacucc

SEQ ID NO: 1393499 - RNA, 21 nt, Human
caccucucaauauucaauaaa

SEQ ID NO: 1393500 - RNA, 22 nt, Human
caccucucaauauucaauaaag

SEQ ID NO: 1393501 - RNA, 23 nt, Human
caccucucaauauucaauaaagc

SEQ ID NO: 1393502 - RNA, 16 nt, Human
caccuccccagcauuc

SEQ ID NO: 1393503 - RNA, 14 nt, Human
caccuccccagcau

SEQ ID NO: 1393504 - RNA, 12 nt, Human
caccucccagga

SEQ ID NO: 1393505 - RNA, 11 nt, Human
caccucccagg

SEQ ID NO: 1393506 - RNA, 10 nt, Human
caccucccag

SEQ ID NO: 1393507 - RNA, 15 nt, Human
caccuccaucccaga

SEQ ID NO: 1393508 - RNA, 16 nt, Human
caccuccacauccucc

SEQ ID NO: 1393509 - RNA, 17 nt, Human
caccuccacauccucca

SEQ ID NO: 1393510 - RNA, 14 nt, Human
caccucauggaauu

SEQ ID NO: 1393511 - RNA, 12 nt, Human
caccucauggaa

SEQ ID NO: 1393512 - RNA, 11 nt, Human
caccucaugga

SEQ ID NO: 1393513 - RNA, 23 nt, Human
caccuccccccacaagugcccuc

SEQ ID NO: 1393514 - RNA, 20 nt, Human
caccucccuauacugcuugg

SEQ ID NO: 1393515 - RNA, 14 nt, Human
caccuccccuuggg

SEQ ID NO: 1393516 - RNA, 21 nt, Human
caccucccuauacugcuugga

SEQ ID NO: 1393517 - RNA, 15 nt, Human
caccucccucaaccu

SEQ ID NO: 1393518 - RNA, 17 nt, Human
caccucccucaaccuca

SEQ ID NO: 1393519 - RNA, 19 nt, Human
caccucccucaaccucauc

SEQ ID NO: 1393520 - RNA, 18 nt, Human
caccgugggcucccugac

SEQ ID NO: 1393521 - RNA, 17 nt, Human
caccgugggcucccuga

SEQ ID NO: 1393522 - RNA, 13 nt, Human
caccgugggcucc

SEQ ID NO: 1393523 - RNA, 15 nt, Human
caccgugggcaggga

SEQ ID NO: 1393524 - RNA, 24 nt, Human
caccgugcccagcccuaaacauca

SEQ ID NO: 1393525 - RNA, 23 nt, Human
caccgggccacuccuuccugccc

SEQ ID NO: 1393526 - RNA, 21 nt, Human
caccgggccacuccuuccugc

SEQ ID NO: 1393527 - RNA, 19 nt, Human
caccgggccacuccuuccu

SEQ ID NO: 1393528 - RNA, 14 nt, Human
caccgggccacucc

SEQ ID NO: 1393529 - RNA, 12 nt, Human
caccgggccacu

SEQ ID NO: 1393530 - RNA, 22 nt, Human
caccggggccugggcaggaggg

SEQ ID NO: 1393531 - RNA, 21 nt, Human
caccggggccugggcaggagg

SEQ ID NO: 1393532 - RNA, 14 nt, Human
caccggggccuggg

SEQ ID NO: 1393533 - RNA, 17 nt, Human
caccggaccagccuggc

SEQ ID NO: 1393534 - RNA, 21 nt, Human
caccggcucucaccuggcccu

SEQ ID NO: 1393535 - RNA, 16 nt, Human
caccggcucucaccug

SEQ ID NO: 1393536 - RNA, 19 nt, Human
caccggaccagccuggccc

SEQ ID NO: 1393537 - RNA, 14 nt, Human
caccgcagaaggaa

SEQ ID NO: 1393538 - RNA, 15 nt, Human
caccgcagaaggaag

SEQ ID NO: 1393539 - RNA, 13 nt, Human
caccucucaauau

SEQ ID NO: 1393540 - RNA, 20 nt, Human
cacuuggggguucaggcccg

SEQ ID NO: 1393541 - RNA, 22 nt, Human
cacuuggggcaccuugcuccuc

SEQ ID NO: 1393542 - RNA, 20 nt, Human
cacuuggggcaccuugcucc

SEQ ID NO: 1393543 - RNA, 23 nt, Human
cacuuggcugcauaaauguggua

SEQ ID NO: 1393544 - RNA, 16 nt, Human
cacuuggcagccuugu

SEQ ID NO: 1393545 - RNA, 18 nt, Human
cacuuggcagccuuguga

SEQ ID NO: 1393546 - RNA, 15 nt, Human
cacuuggcagccuug

SEQ ID NO: 1393547 - RNA, 14 nt, Human
cacuuggcagccuu

SEQ ID NO: 1393548 - RNA, 12 nt, Human
cacuuggcagcc

SEQ ID NO: 1393549 - RNA, 16 nt, Human
cacuugcuggaagacg

SEQ ID NO: 1393550 - RNA, 22 nt, Human
cacuugcggauauucuggacug

SEQ ID NO: 1393551 - RNA, 21 nt, Human
cacuugccucuuccuugaaga

SEQ ID NO: 1393552 - RNA, 17 nt, Human
cacuugccucuuccuug

SEQ ID NO: 1393553 - RNA, 14 nt, Human
cacuugccucuucc

SEQ ID NO: 1393554 - RNA, 13 nt, Human
cacuugccucuuc

SEQ ID NO: 1393555 - RNA, 12 nt, Human
cacuugccucuu

SEQ ID NO: 1393556 - RNA, 16 nt, Human
cacuugccaaaaucca

SEQ ID NO: 1393557 - RNA, 19 nt, Human
cacuucuuacaauaauucu

SEQ ID NO: 1393558 - RNA, 20 nt, Human
cacuucugggcuucaucugg

SEQ ID NO: 1393559 - RNA, 12 nt, Human
cacuugcaaccu

SEQ ID NO: 1393560 - RNA, 17 nt, Human
cacuucugacagccuca

SEQ ID NO: 1393561 - RNA, 22 nt, Human
cacuucucaggacacaggccug

SEQ ID NO: 1393562 - RNA, 21 nt, Human
cacuucucaggacacaggccu

SEQ ID NO: 1393563 - RNA, 23 nt, Human
cacuucucaggacacaggccugu

SEQ ID NO: 1393564 - RNA, 19 nt, Human
cacuucucaggacacaggc

SEQ ID NO: 1393565 - RNA, 15 nt, Human
cacuucucaggacac

SEQ ID NO: 1393566 - RNA, 14 nt, Human
cacuucucaggaca

SEQ ID NO: 1393567 - RNA, 13 nt, Human
cacuucucaggac

SEQ ID NO: 1393568 - RNA, 18 nt, Human
cacuucugggcuucaucu

SEQ ID NO: 1393569 - RNA, 11 nt, Human
cacuucugcac

SEQ ID NO: 1393570 - RNA, 14 nt, Human
cacuucugcacuug

SEQ ID NO: 1393571 - RNA, 21 nt, Human
cacuuccucucgcggcccuca

SEQ ID NO: 1393572 - RNA, 18 nt, Human
cacuucccugcuuaaauu

SEQ ID NO: 1393573 - RNA, 13 nt, Human
cacuuccauggga

SEQ ID NO: 1393574 - RNA, 16 nt, Human
cacuucaaacuacuuu

SEQ ID NO: 1393575 - RNA, 18 nt, Human
cacuucaaauucaaauaa

SEQ ID NO: 1393576 - RNA, 21 nt, Human
cacuucaagugaccaccagga

SEQ ID NO: 1393577 - RNA, 21 nt, Human
cacuguucuuagcucaaugag

SEQ ID NO: 1393578 - RNA, 23 nt, Human
cacuguucuuagcucaaugagca

SEQ ID NO: 1393579 - RNA, 16 nt, Human
cacuguucuuagcuca

SEQ ID NO: 1393580 - RNA, 14 nt, Human
cacuucaaacuacu

SEQ ID NO: 1393581 - RNA, 12 nt, Human
cacuucaaacua

SEQ ID NO: 1393582 - RNA, 11 nt, Human
cacuucaaacu

SEQ ID NO: 1393583 - RNA, 20 nt, Human
cacuuauuuaugaaccugcc

SEQ ID NO: 1393584 - RNA, 22 nt, Human
cacuuauuggaacucugcuuga

SEQ ID NO: 1393585 - RNA, 15 nt, Human
cacuucauaauccag

SEQ ID NO: 1393586 - RNA, 14 nt, Human
cacuucauaaucca

SEQ ID NO: 1393587 - RNA, 20 nt, Human
cacuucagguauaccucacu

SEQ ID NO: 1393588 - RNA, 19 nt, Human
cacuucagguauaccucac

SEQ ID NO: 1393589 - RNA, 18 nt, Human
cacuucagguauaccuca

SEQ ID NO: 1393590 - RNA, 19 nt, Human
cacuucagggcuuuacucc

SEQ ID NO: 1393591 - RNA, 22 nt, Human
cacugugccucagagaccaggg

SEQ ID NO: 1393592 - RNA, 21 nt, Human
cacugugccucagagaccagg

SEQ ID NO: 1393593 - RNA, 20 nt, Human
cacugugccucagagaccag

SEQ ID NO: 1393594 - RNA, 17 nt, Human
cacugugccucagagac

SEQ ID NO: 1393595 - RNA, 13 nt, Human
cacugugccucag

SEQ ID NO: 1393596 - RNA, 22 nt, Human
cacugugcacaucugugucuug

SEQ ID NO: 1393597 - RNA, 20 nt, Human
cacugugcacaucugugucu

SEQ ID NO: 1393598 - RNA, 19 nt, Human
cacuguggguagacacaca

SEQ ID NO: 1393599 - RNA, 19 nt, Human
cacuguucccccugugcag

SEQ ID NO: 1393600 - RNA, 17 nt, Human
cacuguucccccugugc

SEQ ID NO: 1393601 - RNA, 15 nt, Human
cacuguguuccuucc

SEQ ID NO: 1393602 - RNA, 15 nt, Human
cacuguuaucaaaac

SEQ ID NO: 1393603 - RNA, 17 nt, Human
cacuguguuccuuccgc

SEQ ID NO: 1393604 - RNA, 15 nt, Human
cacuguguauuuaac

SEQ ID NO: 1393605 - RNA, 24 nt, Human
cacuguggguagacacacaugaag

SEQ ID NO: 1393606 - RNA, 22 nt, Human
cacuguggguagacacacauga

SEQ ID NO: 1393607 - RNA, 18 nt, Human
cacuguccugggccugca

SEQ ID NO: 1393608 - RNA, 15 nt, Human
cacuguccugggccu

SEQ ID NO: 1393609 - RNA, 18 nt, Human
cacugucccuugccucaa

SEQ ID NO: 1393610 - RNA, 17 nt, Human
cacugucccuugccuca

SEQ ID NO: 1393611 - RNA, 12 nt, Human
cacugucccuug

SEQ ID NO: 1393612 - RNA, 22 nt, Human
cacugucagcagggacuguaaa

SEQ ID NO: 1393613 - RNA, 21 nt, Human
cacugucaccacccugcucau

SEQ ID NO: 1393614 - RNA, 22 nt, Human
cacugugacccccagcuccggc

SEQ ID NO: 1393615 - RNA, 20 nt, Human
cacugugacccccagcuccg

SEQ ID NO: 1393616 - RNA, 19 nt, Human
cacugugacccccagcucc

SEQ ID NO: 1393617 - RNA, 15 nt, Human
cacugugacccccag

SEQ ID NO: 1393618 - RNA, 14 nt, Human
cacugugaccccca

SEQ ID NO: 1393619 - RNA, 15 nt, Human
cacugugaaggaccc

SEQ ID NO: 1393620 - RNA, 17 nt, Human
cacugugaaggacccuu

SEQ ID NO: 1393621 - RNA, 23 nt, Human
cacugugacccccagcuccggcc

SEQ ID NO: 1393622 - RNA, 14 nt, Human
cacugugaaggacc

SEQ ID NO: 1393623 - RNA, 13 nt, Human
cacugugaaggac

SEQ ID NO: 1393624 - RNA, 18 nt, Human
cacugucuuuaauucugu

SEQ ID NO: 1393625 - RNA, 19 nt, Human
cacugucuuuaauucugua

SEQ ID NO: 1393626 - RNA, 13 nt, Human
cacuguaaaaugu

SEQ ID NO: 1393627 - RNA, 12 nt, Human
cacuguaaaaug

SEQ ID NO: 1393628 - RNA, 17 nt, Human
cacuggcucuccuggcc

SEQ ID NO: 1393629 - RNA, 21 nt, Human
cacuggcucuccuggcccugg

SEQ ID NO: 1393630 - RNA, 15 nt, Human
cacuggcucuccugg

SEQ ID NO: 1393631 - RNA, 14 nt, Human
cacuggcucuccug

SEQ ID NO: 1393632 - RNA, 24 nt, Human
cacuggccccucaaaucguccagc

SEQ ID NO: 1393633 - RNA, 13 nt, Human
cacuggccccuca

SEQ ID NO: 1393634 - RNA, 13 nt, Human
cacuggccccacc

SEQ ID NO: 1393635 - RNA, 14 nt, Human
cacuggccccaccc

SEQ ID NO: 1393636 - RNA, 16 nt, Human
cacuggccccacccuc

SEQ ID NO: 1393637 - RNA, 13 nt, Human
cacuggcgaggag

SEQ ID NO: 1393638 - RNA, 15 nt, Human
cacuguaugagugga

SEQ ID NO: 1393639 - RNA, 14 nt, Human
cacuguauccaggu

SEQ ID NO: 1393640 - RNA, 20 nt, Human
cacuguaguucuaagacuca

SEQ ID NO: 1393641 - RNA, 18 nt, Human
cacuguaguucuaagacu

SEQ ID NO: 1393642 - RNA, 17 nt, Human
cacuguaguucuaagac

SEQ ID NO: 1393643 - RNA, 16 nt, Human
cacuguaguucuaaga

SEQ ID NO: 1393644 - RNA, 15 nt, Human
cacuguaguucuaag

SEQ ID NO: 1393645 - RNA, 14 nt, Human
cacuguaguucuaa

SEQ ID NO: 1393646 - RNA, 23 nt, Human
cacuguaguaaauaaugcuuuga

SEQ ID NO: 1393647 - RNA, 22 nt, Human
cacuguaguaaauaaugcuuug

SEQ ID NO: 1393648 - RNA, 21 nt, Human
cacuguaguaaauaaugcuuu

SEQ ID NO: 1393649 - RNA, 20 nt, Human
cacuguaguaaauaaugcuu

SEQ ID NO: 1393650 - RNA, 19 nt, Human
cacuguaguaaauaaugcu

SEQ ID NO: 1393651 - RNA, 15 nt, Human
cacuguacuugcucu

SEQ ID NO: 1393652 - RNA, 18 nt, Human
cacuguacuugcucuuga

SEQ ID NO: 1393653 - RNA, 18 nt, Human
cacuguagaaugauuuca

SEQ ID NO: 1393654 - RNA, 19 nt, Human
cacuguacuugcucuugau

SEQ ID NO: 1393655 - RNA, 19 nt, Human
cacuggagcagaaggggag

SEQ ID NO: 1393656 - RNA, 23 nt, Human
cacuggagcagaaggggagaugg

SEQ ID NO: 1393657 - RNA, 14 nt, Human
cacuggagcagaag

SEQ ID NO: 1393658 - RNA, 12 nt, Human
cacuggagcaca

SEQ ID NO: 1393659 - RNA, 13 nt, Human
cacuggagcacaa

SEQ ID NO: 1393660 - RNA, 10 nt, Human
cacuggagca

SEQ ID NO: 1393661 - RNA, 19 nt, Human
cacuggagacgcauaugag

SEQ ID NO: 1393662 - RNA, 16 nt, Human
cacuggaccacugggc

SEQ ID NO: 1393663 - RNA, 21 nt, Human
cacugcuuuucccuuugugag

SEQ ID NO: 1393664 - RNA, 13 nt, Human
cacugcuuuuccc

SEQ ID NO: 1393665 - RNA, 15 nt, Human
cacugcuugaggaaa

SEQ ID NO: 1393666 - RNA, 20 nt, Human
cacugcuugaggaaaacaag

SEQ ID NO: 1393667 - RNA, 14 nt, Human
cacugcuugaggaa

SEQ ID NO: 1393668 - RNA, 13 nt, Human
cacugcuugagga

SEQ ID NO: 1393669 - RNA, 17 nt, Human
cacugcuuccauuuaau

SEQ ID NO: 1393670 - RNA, 13 nt, Human
cacugcuuaacuu

SEQ ID NO: 1393671 - RNA, 19 nt, Human
cacugcccugguggcccuc

SEQ ID NO: 1393672 - RNA, 20 nt, Human
cacugcccccugcugccaug

SEQ ID NO: 1393673 - RNA, 19 nt, Human
cacugcccccugcugccau

SEQ ID NO: 1393674 - RNA, 17 nt, Human
cacugcccccugcugcc

SEQ ID NO: 1393675 - RNA, 18 nt, Human
cacugcccauggacaggc

SEQ ID NO: 1393676 - RNA, 17 nt, Human
cacugcccauggacagg

SEQ ID NO: 1393677 - RNA, 21 nt, Human
cacugccauuaaagaauauga

SEQ ID NO: 1393678 - RNA, 19 nt, Human
cacugcucuaacagcccuc

SEQ ID NO: 1393679 - RNA, 18 nt, Human
cacugcucuaacagcccu

SEQ ID NO: 1393680 - RNA, 15 nt, Human
cacugcucuaacagc

SEQ ID NO: 1393681 - RNA, 13 nt, Human
cacugcucacacu

SEQ ID NO: 1393682 - RNA, 17 nt, Human
cacugcuggagaggccc

SEQ ID NO: 1393683 - RNA, 20 nt, Human
cacugcugauauuuucucua

SEQ ID NO: 1393684 - RNA, 14 nt, Human
cacugccugcuccc

SEQ ID NO: 1393685 - RNA, 13 nt, Human
cacugccugcucc

SEQ ID NO: 1393686 - RNA, 21 nt, Human
cacugccugcucccauccugu

SEQ ID NO: 1393687 - RNA, 20 nt, Human
cacugccugcucccauccug

SEQ ID NO: 1393688 - RNA, 19 nt, Human
cacugccugcucccauccu

SEQ ID NO: 1393689 - RNA, 12 nt, Human
cacugccuuuga

SEQ ID NO: 1393690 - RNA, 23 nt, Human
cacugccuucgcuucuugccucu

SEQ ID NO: 1393691 - RNA, 21 nt, Human
cacugccuucgcuucuugccu

SEQ ID NO: 1393692 - RNA, 19 nt, Human
cacugccuucgcuucuugc

SEQ ID NO: 1393693 - RNA, 18 nt, Human
cacugccuucgcuucuug

SEQ ID NO: 1393694 - RNA, 20 nt, Human
cacugccuucucaacuccaa

SEQ ID NO: 1393695 - RNA, 20 nt, Human
cacugacugggaccaggcac

SEQ ID NO: 1393696 - RNA, 17 nt, Human
cacucuguaauugcaaa

SEQ ID NO: 1393697 - RNA, 15 nt, Human
cacugaccagaacua

SEQ ID NO: 1393698 - RNA, 14 nt, Human
cacugaccagaacu

SEQ ID NO: 1393699 - RNA, 13 nt, Human
cacugaccagaac

SEQ ID NO: 1393700 - RNA, 14 nt, Human
cacugacugggacc

SEQ ID NO: 1393701 - RNA, 20 nt, Human
cacucuguaauugcaaaaaa

SEQ ID NO: 1393702 - RNA, 23 nt, Human
cacucuguaauugaauauuauuc

SEQ ID NO: 1393703 - RNA, 14 nt, Human
cacucuguaauuga

SEQ ID NO: 1393704 - RNA, 13 nt, Human
cacucuguaauug

SEQ ID NO: 1393705 - RNA, 18 nt, Human
cacucuggcagccacacu

SEQ ID NO: 1393706 - RNA, 22 nt, Human
cacugaguuuuccauggcagga

SEQ ID NO: 1393707 - RNA, 20 nt, Human
cacugauauaucaugaguga

SEQ ID NO: 1393708 - RNA, 21 nt, Human
cacugaguuuuccauggcagg

SEQ ID NO: 1393709 - RNA, 15 nt, Human
cacugaguuuuccau

SEQ ID NO: 1393710 - RNA, 20 nt, Human
cacugaggggggauccaguu

SEQ ID NO: 1393711 - RNA, 14 nt, Human
cacugagggcaguc

SEQ ID NO: 1393712 - RNA, 17 nt, Human
cacugaugcugccccuc

SEQ ID NO: 1393713 - RNA, 12 nt, Human
cacugaugcugc

SEQ ID NO: 1393714 - RNA, 15 nt, Human
cacugaugcuuagau

SEQ ID NO: 1393715 - RNA, 19 nt, Human
cacugaugcugccccucau

SEQ ID NO: 1393716 - RNA, 16 nt, Human
cacugaugcuuagaug

SEQ ID NO: 1393717 - RNA, 20 nt, Human
cacugagcaacgcuauucca

SEQ ID NO: 1393718 - RNA, 23 nt, Human
cacugagauaccagcgaggaggc

SEQ ID NO: 1393719 - RNA, 19 nt, Human
cacugagauaccagcgagg

SEQ ID NO: 1393720 - RNA, 18 nt, Human
cacugagauaccagcgag

SEQ ID NO: 1393721 - RNA, 22 nt, Human
cacugagaggacagagagaaau

SEQ ID NO: 1393722 - RNA, 21 nt, Human
cacugagaggacagagagaaa

SEQ ID NO: 1393723 - RNA, 17 nt, Human
cacugagaccaaggcuu

SEQ ID NO: 1393724 - RNA, 23 nt, Human
cacugagaccccaggcuguuagg

SEQ ID NO: 1393725 - RNA, 15 nt, Human
cacugagaccaaggc

SEQ ID NO: 1393726 - RNA, 23 nt, Human
cacugcacaauaacuccucccag

SEQ ID NO: 1393727 - RNA, 22 nt, Human
cacugcacaauaacuccuccca

SEQ ID NO: 1393728 - RNA, 18 nt, Human
cacugcacaauaacuccu

SEQ ID NO: 1393729 - RNA, 20 nt, Human
cacugcaauuggcaccgaag

SEQ ID NO: 1393730 - RNA, 20 nt, Human
cacugcaaucuccaccuccc

SEQ ID NO: 1393731 - RNA, 19 nt, Human
cacugcaaccuccaccucc

SEQ ID NO: 1393732 - RNA, 13 nt, Human
cacugcaacauga

SEQ ID NO: 1393733 - RNA, 20 nt, Human
cacugcaaaccgccaccucc

SEQ ID NO: 1393734 - RNA, 21 nt, Human
cacugcaaaccgccaccuccc

SEQ ID NO: 1393735 - RNA, 13 nt, Human
cacugcaaccucc

SEQ ID NO: 1393736 - RNA, 19 nt, Human
cacugauguuguguuuuua

SEQ ID NO: 1393737 - RNA, 14 nt, Human
cacugcaaccuccg

SEQ ID NO: 1393738 - RNA, 14 nt, Human
cacugcaaccucca

SEQ ID NO: 1393739 - RNA, 17 nt, Human
cacugcaaccuccaccu

SEQ ID NO: 1393740 - RNA, 19 nt, Human
cacugcaaccuccaccucg

SEQ ID NO: 1393741 - RNA, 14 nt, Human
cacugcaaccucug

SEQ ID NO: 1393742 - RNA, 16 nt, Human
cacgacugucuccaug

SEQ ID NO: 1393743 - RNA, 13 nt, Human
cacgacugucucc

SEQ ID NO: 1393744 - RNA, 16 nt, Human
cacgacuggccagggc

SEQ ID NO: 1393745 - RNA, 14 nt, Human
cacgacaguggaug

SEQ ID NO: 1393746 - RNA, 15 nt, Human
cacgaccgccccagu

SEQ ID NO: 1393747 - RNA, 15 nt, Human
cacgacacugcagcc

SEQ ID NO: 1393748 - RNA, 12 nt, Human
caccuucugagu

SEQ ID NO: 1393749 - RNA, 18 nt, Human
caccuucccacuuuccca

SEQ ID NO: 1393750 - RNA, 18 nt, Human
caccuuccagcuccugua

SEQ ID NO: 1393751 - RNA, 16 nt, Human
caccuuccagcuccug

SEQ ID NO: 1393752 - RNA, 15 nt, Human
caccuuccagcuccu

SEQ ID NO: 1393753 - RNA, 14 nt, Human
caccuuccagcucc

SEQ ID NO: 1393754 - RNA, 19 nt, Human
caccuucaccuucauccau

SEQ ID NO: 1393755 - RNA, 13 nt, Human
caccuuagcuggc

SEQ ID NO: 1393756 - RNA, 16 nt, Human
caccugucugucuguc

SEQ ID NO: 1393757 - RNA, 22 nt, Human
caccugucugucugucuguccc

SEQ ID NO: 1393758 - RNA, 19 nt, Human
caccugugcuucgggcccu

SEQ ID NO: 1393759 - RNA, 22 nt, Human
caccuguggaacauaaaaagga

SEQ ID NO: 1393760 - RNA, 22 nt, Human
cacgagggcuggcuggccucac

SEQ ID NO: 1393761 - RNA, 21 nt, Human
cacgagggcuggcuggccuca

SEQ ID NO: 1393762 - RNA, 17 nt, Human
cacgagggcuggcuggc

SEQ ID NO: 1393763 - RNA, 13 nt, Human
cacgagggcuggc

SEQ ID NO: 1393764 - RNA, 12 nt, Human
cacgagggcugg

SEQ ID NO: 1393765 - RNA, 11 nt, Human
cacgagggcug

SEQ ID NO: 1393766 - RNA, 23 nt, Human
cacgaggaaucugugggucuggg

SEQ ID NO: 1393767 - RNA, 22 nt, Human
cacgaggaaucugugggucugg

SEQ ID NO: 1393768 - RNA, 20 nt, Human
cacgagcuguuuacuaggga

SEQ ID NO: 1393769 - RNA, 17 nt, Human
cacgacuggccagggcc

SEQ ID NO: 1393770 - RNA, 15 nt, Human
cacgcaccugccuca

SEQ ID NO: 1393771 - RNA, 12 nt, Human
cacgcaccugcc

SEQ ID NO: 1393772 - RNA, 15 nt, Human
cacgcacacugucug

SEQ ID NO: 1393773 - RNA, 16 nt, Human
cacgcaccugccucag

SEQ ID NO: 1393774 - RNA, 12 nt, Human
cacgauuucugu

SEQ ID NO: 1393775 - RNA, 14 nt, Human
cacgauuucuguuu

SEQ ID NO: 1393776 - RNA, 16 nt, Human
cacgauuucuguuuag

SEQ ID NO: 1393777 - RNA, 21 nt, Human
cacgcccguccugccuguggc

SEQ ID NO: 1393778 - RNA, 20 nt, Human
cacgcccguccugccugugg

SEQ ID NO: 1393779 - RNA, 19 nt, Human
cacgcccguccugccugug

SEQ ID NO: 1393780 - RNA, 16 nt, Human
cacgcccguccugccu

SEQ ID NO: 1393781 - RNA, 15 nt, Human
cacgcccguccugcc

SEQ ID NO: 1393782 - RNA, 14 nt, Human
cacgcccguccugc

SEQ ID NO: 1393783 - RNA, 15 nt, Human
cacgcaugcaguguu

SEQ ID NO: 1393784 - RNA, 13 nt, Human
cacgcacggcagc

SEQ ID NO: 1393785 - RNA, 18 nt, Human
cacgcuccagcugccccg

SEQ ID NO: 1393786 - RNA, 19 nt, Human
cacgcuccagcugccccgg

SEQ ID NO: 1393787 - RNA, 15 nt, Human
cacgcuccagcugcc

SEQ ID NO: 1393788 - RNA, 14 nt, Human
cacgcuccagcugc

SEQ ID NO: 1393789 - RNA, 13 nt, Human
cacgcuccagcug

SEQ ID NO: 1393790 - RNA, 12 nt, Human
cacgcuccagcu

SEQ ID NO: 1393791 - RNA, 16 nt, Human
cacgcuagggcuggcu

SEQ ID NO: 1393792 - RNA, 22 nt, Human
cacgcuaaucccgauucacccu

SEQ ID NO: 1393793 - RNA, 16 nt, Human
cacgccuggcuaauuu

SEQ ID NO: 1393794 - RNA, 23 nt, Human
cacgcucucuccaggcaggucug

SEQ ID NO: 1393795 - RNA, 19 nt, Human
cacgcucucuccaggcagg

SEQ ID NO: 1393796 - RNA, 24 nt, Human
cacgggccuguccacaggcuucug

SEQ ID NO: 1393797 - RNA, 18 nt, Human
cacgggccuguccacagg

SEQ ID NO: 1393798 - RNA, 17 nt, Human
cacgggccuguccacag

SEQ ID NO: 1393799 - RNA, 14 nt, Human
cacgggccugucca

SEQ ID NO: 1393800 - RNA, 16 nt, Human
cacggcugcgcacugu

SEQ ID NO: 1393801 - RNA, 17 nt, Human
cacggcugcgcacugug

SEQ ID NO: 1393802 - RNA, 21 nt, Human
cacggcucuguccccagccug

SEQ ID NO: 1393803 - RNA, 20 nt, Human
cacggcucuguccccagccu

SEQ ID NO: 1393804 - RNA, 19 nt, Human
cacggcucuguccccagcc

SEQ ID NO: 1393805 - RNA, 18 nt, Human
cacggcucuguccccagc

SEQ ID NO: 1393806 - RNA, 17 nt, Human
cacggcucuguccccag

SEQ ID NO: 1393807 - RNA, 22 nt, Human
cacggcuccucgagaucccaac

SEQ ID NO: 1393808 - RNA, 20 nt, Human
cacggcuccucgagauccca

SEQ ID NO: 1393809 - RNA, 22 nt, Human
cacggucggggcaucuggccug

SEQ ID NO: 1393810 - RNA, 23 nt, Human
cacguggccucuugagcaguggc

SEQ ID NO: 1393811 - RNA, 20 nt, Human
cacguggccucuugagcagu

SEQ ID NO: 1393812 - RNA, 18 nt, Human
cacguggccucuugagca

SEQ ID NO: 1393813 - RNA, 17 nt, Human
cacguggccucuugagc

SEQ ID NO: 1393814 - RNA, 13 nt, Human
cacguggccucuu

SEQ ID NO: 1393815 - RNA, 12 nt, Human
cacguggccucu

SEQ ID NO: 1393816 - RNA, 17 nt, Human
cacgugacacaaacaca

SEQ ID NO: 1393817 - RNA, 14 nt, Human
cacgugacacaaac

SEQ ID NO: 1393818 - RNA, 19 nt, Human
cacguccugagaaagcuca

SEQ ID NO: 1393819 - RNA, 13 nt, Human
cacguccugagaa

SEQ ID NO: 1393820 - RNA, 20 nt, Human
cacgucaaaugcauacaagu

SEQ ID NO: 1393821 - RNA, 23 nt, Human
cacguguguuuuucuauuaaaag

SEQ ID NO: 1393822 - RNA, 16 nt, Human
cacguguuugugcugu

SEQ ID NO: 1393823 - RNA, 22 nt, Human
cacguguguuuuucuauuaaaa

SEQ ID NO: 1393824 - RNA, 20 nt, Human
cacguguguuuuucuauuaa

SEQ ID NO: 1393825 - RNA, 19 nt, Human
cacguguguuuuucuauua

SEQ ID NO: 1393826 - RNA, 18 nt, Human
cacguguguuuuucuauu

SEQ ID NO: 1393827 - RNA, 17 nt, Human
cacguguguuuuucuau

SEQ ID NO: 1393828 - RNA, 15 nt, Human
cacguguguuuuucu

SEQ ID NO: 1393829 - RNA, 18 nt, Human
cacgugguaaaacacuug

SEQ ID NO: 1393830 - RNA, 16 nt, Human
cacgugggcucauaug

SEQ ID NO: 1393831 - RNA, 21 nt, Human
cacuaaagcaggccuuuugau

SEQ ID NO: 1393832 - RNA, 19 nt, Human
cacuaaaacacacaggugc

SEQ ID NO: 1393833 - RNA, 13 nt, Human
cacuaaacaaaga

SEQ ID NO: 1393834 - RNA, 12 nt, Human
cacguuucuaaa

SEQ ID NO: 1393835 - RNA, 14 nt, Human
cacguuucuaaagg

SEQ ID NO: 1393836 - RNA, 23 nt, Human
cacguuucuaaaggcuaccuuug

SEQ ID NO: 1393837 - RNA, 17 nt, Human
cacucagccacccugag

SEQ ID NO: 1393838 - RNA, 16 nt, Human
cacucagccacccuga

SEQ ID NO: 1393839 - RNA, 17 nt, Human
cacucagcacuuggccc

SEQ ID NO: 1393840 - RNA, 18 nt, Human
cacucagauccuccucau

SEQ ID NO: 1393841 - RNA, 22 nt, Human
cacucagcacaaggccaucugg

SEQ ID NO: 1393842 - RNA, 15 nt, Human
cacucagcacaaggc

SEQ ID NO: 1393843 - RNA, 13 nt, Human
cacucagcacaag

SEQ ID NO: 1393844 - RNA, 12 nt, Human
cacucagcacaa

SEQ ID NO: 1393845 - RNA, 20 nt, Human
cacucagagacaugcagaga

SEQ ID NO: 1393846 - RNA, 18 nt, Human
cacucagagacaugcaga

SEQ ID NO: 1393847 - RNA, 16 nt, Human
cacucagagacaugca

SEQ ID NO: 1393848 - RNA, 15 nt, Human
cacucagagacaugc

SEQ ID NO: 1393849 - RNA, 23 nt, Human
cacucagaagccugggggccugg

SEQ ID NO: 1393850 - RNA, 12 nt, Human
cacucagaccug

SEQ ID NO: 1393851 - RNA, 22 nt, Human
cacucagaagccugggggccug

SEQ ID NO: 1393852 - RNA, 19 nt, Human
cacucagaagccugggggc

SEQ ID NO: 1393853 - RNA, 17 nt, Human
cacucagaagccugggg

SEQ ID NO: 1393854 - RNA, 16 nt, Human
cacucagaagccuggg

SEQ ID NO: 1393855 - RNA, 15 nt, Human
cacucagaagccugg

SEQ ID NO: 1393856 - RNA, 14 nt, Human
cacucagaagccug

SEQ ID NO: 1393857 - RNA, 13 nt, Human
cacucagaagccu

SEQ ID NO: 1393858 - RNA, 22 nt, Human
cacucacuaggcccccacuugc

SEQ ID NO: 1393859 - RNA, 17 nt, Human
cacucacuaggccccca

SEQ ID NO: 1393860 - RNA, 16 nt, Human
cacucacuaggccccc

SEQ ID NO: 1393861 - RNA, 12 nt, Human
cacucaccugca

SEQ ID NO: 1393862 - RNA, 17 nt, Human
cacucacaacagcugcc

SEQ ID NO: 1393863 - RNA, 19 nt, Human
cacucaaggcggugcuuga

SEQ ID NO: 1393864 - RNA, 17 nt, Human
cacucaaggcggugcuu

SEQ ID NO: 1393865 - RNA, 11 nt, Human
cacucaaggcg

SEQ ID NO: 1393866 - RNA, 21 nt, Human
cacucaaggcggugcuugaua

SEQ ID NO: 1393867 - RNA, 14 nt, Human
cacuaucuuucagc

SEQ ID NO: 1393868 - RNA, 19 nt, Human
cacuaguauuucuaugaaa

SEQ ID NO: 1393869 - RNA, 23 nt, Human
cacuaaccaagcugaguuuccua

SEQ ID NO: 1393870 - RNA, 22 nt, Human
cacuaaccaagcugaguuuccu

SEQ ID NO: 1393871 - RNA, 14 nt, Human
cacuaacagagugg

SEQ ID NO: 1393872 - RNA, 16 nt, Human
cacuaacaugauuugg

SEQ ID NO: 1393873 - RNA, 20 nt, Human
cacuaacguugagccccugg

SEQ ID NO: 1393874 - RNA, 21 nt, Human
cacuaacgguugaguuuugac

SEQ ID NO: 1393875 - RNA, 23 nt, Human
cacuaaccuugccugguacagua

SEQ ID NO: 1393876 - RNA, 14 nt, Human
cacuaaccuugccu

SEQ ID NO: 1393877 - RNA, 17 nt, Human
cacuaagagagaaugag

SEQ ID NO: 1393878 - RNA, 20 nt, Human
cacucaucaauggggccagu

SEQ ID NO: 1393879 - RNA, 16 nt, Human
cacucaugugacucuu

SEQ ID NO: 1393880 - RNA, 22 nt, Human
cacucaugugacucuuuccaac

SEQ ID NO: 1393881 - RNA, 18 nt, Human
cacucagccacccugagu

SEQ ID NO: 1393882 - RNA, 18 nt, Human
cacucagucucucuucuc

SEQ ID NO: 1393883 - RNA, 22 nt, Human
cacuccucugcugaccugcuga

SEQ ID NO: 1393884 - RNA, 21 nt, Human
cacuccucugcugaccugcug

SEQ ID NO: 1393885 - RNA, 18 nt, Human
cacuccucugcugaccug

SEQ ID NO: 1393886 - RNA, 16 nt, Human
cacuccucugcugacc

SEQ ID NO: 1393887 - RNA, 14 nt, Human
cacuccucugcuga

SEQ ID NO: 1393888 - RNA, 13 nt, Human
cacuccucugcug

SEQ ID NO: 1393889 - RNA, 23 nt, Human
cacuccucugacucagggcuccu

SEQ ID NO: 1393890 - RNA, 21 nt, Human
cacuccucugacucagggcuc

SEQ ID NO: 1393891 - RNA, 20 nt, Human
cacuccucugacucagggcu

SEQ ID NO: 1393892 - RNA, 13 nt, Human
cacuccucugacu

SEQ ID NO: 1393893 - RNA, 12 nt, Human
cacuccucugac

SEQ ID NO: 1393894 - RNA, 19 nt, Human
cacuccgagaggugggcca

SEQ ID NO: 1393895 - RNA, 20 nt, Human
cacucccuugggcucccugu

SEQ ID NO: 1393896 - RNA, 16 nt, Human
cacucccuugggcucc

SEQ ID NO: 1393897 - RNA, 13 nt, Human
cacucccuugggc

SEQ ID NO: 1393898 - RNA, 14 nt, Human
cacucccuccuaac

SEQ ID NO: 1393899 - RNA, 13 nt, Human
cacucccucacaa

SEQ ID NO: 1393900 - RNA, 16 nt, Human
cacucugcuuguuauu

SEQ ID NO: 1393901 - RNA, 21 nt, Human
cacucugcuucucugacuucu

SEQ ID NO: 1393902 - RNA, 19 nt, Human
cacucugcuucucugacuu

SEQ ID NO: 1393903 - RNA, 18 nt, Human
cacucugcuucucugacu

SEQ ID NO: 1393904 - RNA, 17 nt, Human
cacucugcuucucugac

SEQ ID NO: 1393905 - RNA, 16 nt, Human
cacucugcuucucuga

SEQ ID NO: 1393906 - RNA, 15 nt, Human
cacucugcuucucug

SEQ ID NO: 1393907 - RNA, 14 nt, Human
cacucugcuucucu

SEQ ID NO: 1393908 - RNA, 13 nt, Human
cacucugcuucuc

SEQ ID NO: 1393909 - RNA, 12 nt, Human
cacucugcuucu

SEQ ID NO: 1393910 - RNA, 12 nt, Human
cacucugcuguu

SEQ ID NO: 1393911 - RNA, 17 nt, Human
cacucugcucugaugca

SEQ ID NO: 1393912 - RNA, 16 nt, Human
cacucuggcagccaca

SEQ ID NO: 1393913 - RNA, 15 nt, Human
cacucuggcagccac

SEQ ID NO: 1393914 - RNA, 14 nt, Human
cacucuggcagcca

SEQ ID NO: 1393915 - RNA, 13 nt, Human
cacucuggcagcc

SEQ ID NO: 1393916 - RNA, 12 nt, Human
cacucuggcagc

SEQ ID NO: 1393917 - RNA, 16 nt, Human
cacucugcucugaugc

SEQ ID NO: 1393918 - RNA, 15 nt, Human
cacucugcucugaug

SEQ ID NO: 1393919 - RNA, 14 nt, Human
cacucugcucugau

SEQ ID NO: 1393920 - RNA, 13 nt, Human
cacucugcucuga

SEQ ID NO: 1393921 - RNA, 12 nt, Human
cacucugcucug

SEQ ID NO: 1393922 - RNA, 16 nt, Human
cacucugaguguuuua

SEQ ID NO: 1393923 - RNA, 20 nt, Human
cacucuagucaaugacauga

SEQ ID NO: 1393924 - RNA, 18 nt, Human
cacucuagucaaugacau

SEQ ID NO: 1393925 - RNA, 14 nt, Human
cacucuagauucca

SEQ ID NO: 1393926 - RNA, 11 nt, Human
cacucuagauu

SEQ ID NO: 1393927 - RNA, 19 nt, Human
cacucuagucaaugacaug

SEQ ID NO: 1393928 - RNA, 14 nt, Human
cacuccuuccugcc

SEQ ID NO: 1393929 - RNA, 13 nt, Human
cacuccuuccugc

SEQ ID NO: 1393930 - RNA, 12 nt, Human
cacuccuuccug

SEQ ID NO: 1393931 - RNA, 21 nt, Human
cacucgcuagcaguggcaggc

SEQ ID NO: 1393932 - RNA, 16 nt, Human
cacucgcuagcagugg

SEQ ID NO: 1393933 - RNA, 21 nt, Human
cacuccuuccugccccaacuc

SEQ ID NO: 1393934 - RNA, 17 nt, Human
cacuccuuccugcccca

SEQ ID NO: 1393935 - RNA, 15 nt, Human
cacuccuuccugccc

SEQ ID NO: 1393936 - RNA, 13 nt, Human
cacucgacaugaa

SEQ ID NO: 1393937 - RNA, 15 nt, Human
cacuccuuuuaaaga

SEQ ID NO: 1393938 - RNA, 16 nt, Human
cacucgucucccccaa

SEQ ID NO: 1393939 - RNA, 14 nt, Human
cacucgucuccccc

SEQ ID NO: 1393940 - RNA, 13 nt, Human
cacucgucucccc

SEQ ID NO: 1393941 - RNA, 20 nt, Human
cacucgcuagcaguggcagg

SEQ ID NO: 1393942 - RNA, 13 nt, Human
cacucuaaagcaa

SEQ ID NO: 1393943 - RNA, 15 nt, Human
cacucguguguuucu

SEQ ID NO: 1393944 - RNA, 16 nt, Human
cacucguguguuucua

SEQ ID NO: 1393945 - RNA, 15 nt, Human
cagaaaacaaaacug

SEQ ID NO: 1393946 - RNA, 23 nt, Human
cagaagguugcucuagauugaga

SEQ ID NO: 1393947 - RNA, 15 nt, Human
cagaagggggucucu

SEQ ID NO: 1393948 - RNA, 17 nt, Human
cagaaggggagauggac

SEQ ID NO: 1393949 - RNA, 23 nt, Human
cagaagggagggcagagcuggug

SEQ ID NO: 1393950 - RNA, 22 nt, Human
cagaagggagggcagagcuggu

SEQ ID NO: 1393951 - RNA, 21 nt, Human
cagaagggagggcagagcugg

SEQ ID NO: 1393952 - RNA, 19 nt, Human
cagaagggagggcagagcu

SEQ ID NO: 1393953 - RNA, 17 nt, Human
cagaagggagggcagag

SEQ ID NO: 1393954 - RNA, 16 nt, Human
cagaagggagggcaga

SEQ ID NO: 1393955 - RNA, 15 nt, Human
cagaagggagggcag

SEQ ID NO: 1393956 - RNA, 13 nt, Human
cagaagggagggc

SEQ ID NO: 1393957 - RNA, 22 nt, Human
cagaagucaucuugcuaccagu

SEQ ID NO: 1393958 - RNA, 20 nt, Human
cagaagucaucuugcuacca

SEQ ID NO: 1393959 - RNA, 17 nt, Human
cagaagucaucuugcua

SEQ ID NO: 1393960 - RNA, 16 nt, Human
cagaagucaucuugcu

SEQ ID NO: 1393961 - RNA, 14 nt, Human
cagaagucaucuug

SEQ ID NO: 1393962 - RNA, 20 nt, Human
cagaaguaccagacuagaug

SEQ ID NO: 1393963 - RNA, 16 nt, Human
cagaaguaccagacua

SEQ ID NO: 1393964 - RNA, 15 nt, Human
cagaaguaccagacu

SEQ ID NO: 1393965 - RNA, 23 nt, Human
cagaaucgcuccaccuugcagcu

SEQ ID NO: 1393966 - RNA, 19 nt, Human
cagaagcucccccagcaaa

SEQ ID NO: 1393967 - RNA, 18 nt, Human
cagaagcucccccagcaa

SEQ ID NO: 1393968 - RNA, 17 nt, Human
cagaagcucccccagca

SEQ ID NO: 1393969 - RNA, 16 nt, Human
cagaagcucccccagc

SEQ ID NO: 1393970 - RNA, 15 nt, Human
cagaagcucccccag

SEQ ID NO: 1393971 - RNA, 24 nt, Human
cagaagccugggggccuggcuggc

SEQ ID NO: 1393972 - RNA, 23 nt, Human
cagaagccugggggccuggcugg

SEQ ID NO: 1393973 - RNA, 22 nt, Human
cagaagccugggggccuggcug

SEQ ID NO: 1393974 - RNA, 21 nt, Human
cagaagccugggggccuggcu

SEQ ID NO: 1393975 - RNA, 20 nt, Human
cagaagccugggggccuggc

SEQ ID NO: 1393976 - RNA, 19 nt, Human
cagaagccugggggccugg

SEQ ID NO: 1393977 - RNA, 14 nt, Human
cagaagccuggggg

SEQ ID NO: 1393978 - RNA, 13 nt, Human
cagaagccugggg

SEQ ID NO: 1393979 - RNA, 12 nt, Human
cagaagccuggg

SEQ ID NO: 1393980 - RNA, 18 nt, Human
cagaagccugaugcugac

SEQ ID NO: 1393981 - RNA, 23 nt, Human
cagaagcucccccagcaaagccc

SEQ ID NO: 1393982 - RNA, 21 nt, Human
cagaagcucccccagcaaagc

SEQ ID NO: 1393983 - RNA, 18 nt, Human
cagaaggcaaacccauca

SEQ ID NO: 1393984 - RNA, 13 nt, Human
cagaaggccaaga

SEQ ID NO: 1393985 - RNA, 14 nt, Human
cagaaggccaagag

SEQ ID NO: 1393986 - RNA, 18 nt, Human
cagaaggccaagaggcug

SEQ ID NO: 1393987 - RNA, 11 nt, Human
cagaaggaagg

SEQ ID NO: 1393988 - RNA, 15 nt, Human
cagaaggaaggcagg

SEQ ID NO: 1393989 - RNA, 20 nt, Human
cagaaggaaggcagggagga

SEQ ID NO: 1393990 - RNA, 22 nt, Human
cagaaggaaggcagggaggagg

SEQ ID NO: 1393991 - RNA, 14 nt, Human
cagaagaugacuga

SEQ ID NO: 1393992 - RNA, 14 nt, Human
cagaagaaacaagg

SEQ ID NO: 1393993 - RNA, 19 nt, Human
cagaacuugugcccucccu

SEQ ID NO: 1393994 - RNA, 21 nt, Human
cagaacuugacccugagcuga

SEQ ID NO: 1393995 - RNA, 20 nt, Human
cagaacuucagaaagacuug

SEQ ID NO: 1393996 - RNA, 19 nt, Human
cagaacuucagaaagacuu

SEQ ID NO: 1393997 - RNA, 17 nt, Human
cagaacuucagaaagac

SEQ ID NO: 1393998 - RNA, 16 nt, Human
cagaacuucagaaaga

SEQ ID NO: 1393999 - RNA, 13 nt, Human
cagaacuucagaa

SEQ ID NO: 1394000 - RNA, 16 nt, Human
cagaacucuuucaaaa

SEQ ID NO: 1394001 - RNA, 15 nt, Human
cagaacucuuucaaa

SEQ ID NO: 1394002 - RNA, 14 nt, Human
cagaacucuuucaa

SEQ ID NO: 1394003 - RNA, 22 nt, Human
cagaacucaaauggggccagau

SEQ ID NO: 1394004 - RNA, 21 nt, Human
cagaacucaaauggggccaga

SEQ ID NO: 1394005 - RNA, 20 nt, Human
cagaacucaaauggggccag

SEQ ID NO: 1394006 - RNA, 15 nt, Human
cagaacuagaauuug

SEQ ID NO: 1394007 - RNA, 19 nt, Human
cagaaccggagagccagcu

SEQ ID NO: 1394008 - RNA, 23 nt, Human
cagaaccccuacaugaaacagaa

SEQ ID NO: 1394009 - RNA, 18 nt, Human
cagaaccggagagccagc

SEQ ID NO: 1394010 - RNA, 19 nt, Human
cagaacuagaauuugauua

SEQ ID NO: 1394011 - RNA, 13 nt, Human
cagaacuagaauu

SEQ ID NO: 1394012 - RNA, 13 nt, Human
cagaacuacuucu

SEQ ID NO: 1394013 - RNA, 17 nt, Human
cacuuuuaaugaacaaa

SEQ ID NO: 1394014 - RNA, 21 nt, Human
cacuuuguuucguggggaggu

SEQ ID NO: 1394015 - RNA, 20 nt, Human
cacuuuguuucguggggagg

SEQ ID NO: 1394016 - RNA, 20 nt, Human
cacuuugucgcccaggcugg

SEQ ID NO: 1394017 - RNA, 22 nt, Human
cacuuugguaccagauaacuuu

SEQ ID NO: 1394018 - RNA, 19 nt, Human
cacuuuucccacuccaagc

SEQ ID NO: 1394019 - RNA, 15 nt, Human
cacuuuucccacucc

SEQ ID NO: 1394020 - RNA, 14 nt, Human
cacuuuucccacuc

SEQ ID NO: 1394021 - RNA, 13 nt, Human
cacuuuucccacu

SEQ ID NO: 1394022 - RNA, 12 nt, Human
cacuuuucccac

SEQ ID NO: 1394023 - RNA, 18 nt, Human
cacuuuugacaaaggcaa

SEQ ID NO: 1394024 - RNA, 17 nt, Human
cacuuuugacaaaggca

SEQ ID NO: 1394025 - RNA, 16 nt, Human
cacuuuuccucccuca

SEQ ID NO: 1394026 - RNA, 14 nt, Human
cacuuuuguucuug

SEQ ID NO: 1394027 - RNA, 22 nt, Human
cacuuuuguucuugguuuguaa

SEQ ID NO: 1394028 - RNA, 22 nt, Human
cagaaaacccuugggccagaag

SEQ ID NO: 1394029 - RNA, 20 nt, Human
cagaaaacccuugggccaga

SEQ ID NO: 1394030 - RNA, 19 nt, Human
cagaaaacccuugggccag

SEQ ID NO: 1394031 - RNA, 17 nt, Human
cagaaaacccuugggcc

SEQ ID NO: 1394032 - RNA, 16 nt, Human
cagaaaacauguuucc

SEQ ID NO: 1394033 - RNA, 14 nt, Human
cagaaaacaaaacu

SEQ ID NO: 1394034 - RNA, 13 nt, Human
cagaaaacaaaac

SEQ ID NO: 1394035 - RNA, 22 nt, Human
cagaaaaauauguaccaagaau

SEQ ID NO: 1394036 - RNA, 18 nt, Human
cagaaaaauauguaccaa

SEQ ID NO: 1394037 - RNA, 15 nt, Human
cagaaaaaccuuggg

SEQ ID NO: 1394038 - RNA, 20 nt, Human
cacuuuuugaggcaaaagaa

SEQ ID NO: 1394039 - RNA, 17 nt, Human
cacuuuuucucuuucca

SEQ ID NO: 1394040 - RNA, 16 nt, Human
cacuuuuugaggcaaa

SEQ ID NO: 1394041 - RNA, 14 nt, Human
cacuuuuugaggca

SEQ ID NO: 1394042 - RNA, 14 nt, Human
cacuuuuugcagcu

SEQ ID NO: 1394043 - RNA, 18 nt, Human
cacuuuuugcagcuuucu

SEQ ID NO: 1394044 - RNA, 15 nt, Human
cacuuuuugcagcuu

SEQ ID NO: 1394045 - RNA, 23 nt, Human
cacuuuggcuuauaauucuuuca

SEQ ID NO: 1394046 - RNA, 11 nt, Human
cacuuucuuau

SEQ ID NO: 1394047 - RNA, 23 nt, Human
cacuuucuuuuuuuucuauuuca

SEQ ID NO: 1394048 - RNA, 19 nt, Human
cacuuucucaguuuucaua

SEQ ID NO: 1394049 - RNA, 20 nt, Human
cacuuucuauccucuguaaa

SEQ ID NO: 1394050 - RNA, 15 nt, Human
cacuugguaauugua

SEQ ID NO: 1394051 - RNA, 19 nt, Human
cacuugguaauuguacuaa

SEQ ID NO: 1394052 - RNA, 16 nt, Human
cacuugggucuucccu

SEQ ID NO: 1394053 - RNA, 18 nt, Human
cacuuuggcuuauaauuc

SEQ ID NO: 1394054 - RNA, 20 nt, Human
cacuuugcuuuaauauaaau

SEQ ID NO: 1394055 - RNA, 19 nt, Human
cacuuugcuuuaauauaaa

SEQ ID NO: 1394056 - RNA, 18 nt, Human
cacuuugcuuuaauauaa

SEQ ID NO: 1394057 - RNA, 17 nt, Human
cacuuugcuuuaauaua

SEQ ID NO: 1394058 - RNA, 12 nt, Human
cacuuugcuuua

SEQ ID NO: 1394059 - RNA, 22 nt, Human
cacuuugcacugauauaucaug

SEQ ID NO: 1394060 - RNA, 19 nt, Human
cacuuugcacugauauauc

SEQ ID NO: 1394061 - RNA, 14 nt, Human
cacuuugcacagcu

SEQ ID NO: 1394062 - RNA, 17 nt, Human
cacuuugcacagcucuc

SEQ ID NO: 1394063 - RNA, 12 nt, Human
cacuuugcauaa

SEQ ID NO: 1394064 - RNA, 17 nt, Human
cagaaaauucugugccu

SEQ ID NO: 1394065 - RNA, 20 nt, Human
cagaaacaaaaacacuaaaa

SEQ ID NO: 1394066 - RNA, 18 nt, Human
cagaaacaaaaacacuaa

SEQ ID NO: 1394067 - RNA, 23 nt, Human
cagaaaauucugugccuuguuuu

SEQ ID NO: 1394068 - RNA, 15 nt, Human
cagaaaauucugugc

SEQ ID NO: 1394069 - RNA, 14 nt, Human
cagaaaauucugug

SEQ ID NO: 1394070 - RNA, 13 nt, Human
cagaaaauucugu

SEQ ID NO: 1394071 - RNA, 23 nt, Human
cagaaaauguugagaaucccaaa

SEQ ID NO: 1394072 - RNA, 18 nt, Human
cagaaaauguugagaauc

SEQ ID NO: 1394073 - RNA, 14 nt, Human
cagaaaauguugag

SEQ ID NO: 1394074 - RNA, 19 nt, Human
cagaaaaugaacacagcag

SEQ ID NO: 1394075 - RNA, 21 nt, Human
cagaaaauaaggcacccaucu

SEQ ID NO: 1394076 - RNA, 12 nt, Human
cagaaaauaagg

SEQ ID NO: 1394077 - RNA, 23 nt, Human
cagaaaauaaggcacccaucugu

SEQ ID NO: 1394078 - RNA, 19 nt, Human
cagaaaauaucccuccugu

SEQ ID NO: 1394079 - RNA, 22 nt, Human
cagaaaaguugaauuuuacaug

SEQ ID NO: 1394080 - RNA, 20 nt, Human
cagaaaaguugaauuuuaca

SEQ ID NO: 1394081 - RNA, 17 nt, Human
cagaaaaguugaauuuu

SEQ ID NO: 1394082 - RNA, 23 nt, Human
cagaaaacccuugggccagaagu

SEQ ID NO: 1394083 - RNA, 23 nt, Human
cagaaaagaaagcuacagaagaa

SEQ ID NO: 1394084 - RNA, 14 nt, Human
cagaaccacagggc

SEQ ID NO: 1394085 - RNA, 20 nt, Human
cagaaccacagggcuauuuu

SEQ ID NO: 1394086 - RNA, 12 nt, Human
cagaaccacagg

SEQ ID NO: 1394087 - RNA, 17 nt, Human
cagaaccaauuauuuuc

SEQ ID NO: 1394088 - RNA, 20 nt, Human
cagaaccaauuauuuucauc

SEQ ID NO: 1394089 - RNA, 15 nt, Human
cagaaccaauuauuu

SEQ ID NO: 1394090 - RNA, 19 nt, Human
cagaacauagacagaagaa

SEQ ID NO: 1394091 - RNA, 21 nt, Human
cagaacauagacagaagaaac

SEQ ID NO: 1394092 - RNA, 16 nt, Human
cagaacauagacagaa

SEQ ID NO: 1394093 - RNA, 15 nt, Human
cagaaagcugccugg

SEQ ID NO: 1394094 - RNA, 14 nt, Human
cagaaagcugccug

SEQ ID NO: 1394095 - RNA, 22 nt, Human
cagaaagccugggugacauuug

SEQ ID NO: 1394096 - RNA, 19 nt, Human
cagaaagccugggugacau

SEQ ID NO: 1394097 - RNA, 23 nt, Human
cagaaagccccacccaggccagg

SEQ ID NO: 1394098 - RNA, 22 nt, Human
cagaaagccccacccaggccag

SEQ ID NO: 1394099 - RNA, 21 nt, Human
cagaaagccccacccaggcca

SEQ ID NO: 1394100 - RNA, 20 nt, Human
cagaaagccccacccaggcc

SEQ ID NO: 1394101 - RNA, 22 nt, Human
cagaaagcaguugagacaagaa

SEQ ID NO: 1394102 - RNA, 23 nt, Human
cagaaagcaguugagacaagaaa

SEQ ID NO: 1394103 - RNA, 22 nt, Human
cagaaagcaucccucacccauc

SEQ ID NO: 1394104 - RNA, 18 nt, Human
cagaaacacccucacacu

SEQ ID NO: 1394105 - RNA, 20 nt, Human
cagaaacacccucacacugg

SEQ ID NO: 1394106 - RNA, 21 nt, Human
cagaaacacccucacacuggg

SEQ ID NO: 1394107 - RNA, 22 nt, Human
cagaaacacccucacacuggga

SEQ ID NO: 1394108 - RNA, 23 nt, Human
cagaaacacccucacacugggac

SEQ ID NO: 1394109 - RNA, 20 nt, Human
cagacaucugagguuuuauu

SEQ ID NO: 1394110 - RNA, 18 nt, Human
cagacaugccacaaggac

SEQ ID NO: 1394111 - RNA, 22 nt, Human
cagacauccaaacuaaaaggaa

SEQ ID NO: 1394112 - RNA, 17 nt, Human
cagacauccaaacuaaa

SEQ ID NO: 1394113 - RNA, 20 nt, Human
cagacauaaaggaaaagaca

SEQ ID NO: 1394114 - RNA, 22 nt, Human
cagacauaaaggaaaagacaca

SEQ ID NO: 1394115 - RNA, 19 nt, Human
cagacauaaaggaaaagac

SEQ ID NO: 1394116 - RNA, 17 nt, Human
cagacauaaaggaaaag

SEQ ID NO: 1394117 - RNA, 15 nt, Human
cagacauaaaggaaa

SEQ ID NO: 1394118 - RNA, 14 nt, Human
cagacauaaaggaa

SEQ ID NO: 1394119 - RNA, 19 nt, Human
cagacauacuaaccagcag

SEQ ID NO: 1394120 - RNA, 14 nt, Human
cagacaccuuggac

SEQ ID NO: 1394121 - RNA, 18 nt, Human
cagacaccuuggacaucc

SEQ ID NO: 1394122 - RNA, 22 nt, Human
cagacacugguuugaagaaugu

SEQ ID NO: 1394123 - RNA, 17 nt, Human
cagacacccaggacuua

SEQ ID NO: 1394124 - RNA, 15 nt, Human
cagacacccaggacu

SEQ ID NO: 1394125 - RNA, 14 nt, Human
cagacacccaggac

SEQ ID NO: 1394126 - RNA, 13 nt, Human
cagacacccagga

SEQ ID NO: 1394127 - RNA, 12 nt, Human
cagacacccagg

SEQ ID NO: 1394128 - RNA, 18 nt, Human
cagacacaggcccucccu

SEQ ID NO: 1394129 - RNA, 15 nt, Human
cagacacaggcccuc

SEQ ID NO: 1394130 - RNA, 14 nt, Human
cagacacaggcccu

SEQ ID NO: 1394131 - RNA, 17 nt, Human
cagacaacacguuacua

SEQ ID NO: 1394132 - RNA, 23 nt, Human
cagaauuuuauacuuucccuacc

SEQ ID NO: 1394133 - RNA, 22 nt, Human
cagaauuuuauacuuucccuac

SEQ ID NO: 1394134 - RNA, 21 nt, Human
cagaauuuuauacuuucccua

SEQ ID NO: 1394135 - RNA, 20 nt, Human
cagaauuuuauacuuucccu

SEQ ID NO: 1394136 - RNA, 19 nt, Human
cagaauuuggguucugccu

SEQ ID NO: 1394137 - RNA, 18 nt, Human
cagaauuuaguguaucca

SEQ ID NO: 1394138 - RNA, 22 nt, Human
cagaauuacuguaacugauuac

SEQ ID NO: 1394139 - RNA, 14 nt, Human
cagaauuacuguaa

SEQ ID NO: 1394140 - RNA, 19 nt, Human
cagaauuaaacuuuuaauu

SEQ ID NO: 1394141 - RNA, 23 nt, Human
cagaauuacuguaacugauuaca

SEQ ID NO: 1394142 - RNA, 23 nt, Human
cagaauuaaacuuuuaauucauu

SEQ ID NO: 1394143 - RNA, 17 nt, Human
cagaauuaaacuuuuaa

SEQ ID NO: 1394144 - RNA, 16 nt, Human
cagaauuaaacuuuua

SEQ ID NO: 1394145 - RNA, 15 nt, Human
cagaauucucuaguu

SEQ ID NO: 1394146 - RNA, 18 nt, Human
cagaauucucuaguuuga

SEQ ID NO: 1394147 - RNA, 15 nt, Human
cagaauuaaacuuuu

SEQ ID NO: 1394148 - RNA, 14 nt, Human
cagaauuaaacuuu

SEQ ID NO: 1394149 - RNA, 22 nt, Human
cagaauguugauuacagugcag

SEQ ID NO: 1394150 - RNA, 16 nt, Human
cagaauguugauuaca

SEQ ID NO: 1394151 - RNA, 21 nt, Human
cagaaugucauuuugguacuu

SEQ ID NO: 1394152 - RNA, 21 nt, Human
cagaaugugauaaggaaauca

SEQ ID NO: 1394153 - RNA, 14 nt, Human
cagaauguauauua

SEQ ID NO: 1394154 - RNA, 21 nt, Human
cagaaugcuguacaucuauuu

SEQ ID NO: 1394155 - RNA, 18 nt, Human
cagaaugcuguacaucua

SEQ ID NO: 1394156 - RNA, 17 nt, Human
cagaaugcuguacaucu

SEQ ID NO: 1394157 - RNA, 16 nt, Human
cagaaugcuguacauc

SEQ ID NO: 1394158 - RNA, 11 nt, Human
cagaaugcugu

SEQ ID NO: 1394159 - RNA, 21 nt, Human
cagaaugagacauccagcaga

SEQ ID NO: 1394160 - RNA, 22 nt, Human
cagacuauuuuuagauuuucuu

SEQ ID NO: 1394161 - RNA, 20 nt, Human
cagacuauuuuuagauuuuc

SEQ ID NO: 1394162 - RNA, 15 nt, Human
cagacuauuuuuaga

SEQ ID NO: 1394163 - RNA, 21 nt, Human
cagacuagauguaguauuuuu

SEQ ID NO: 1394164 - RNA, 20 nt, Human
cagacuagauguaguauuuu

SEQ ID NO: 1394165 - RNA, 19 nt, Human
cagacuagauguaguauuu

SEQ ID NO: 1394166 - RNA, 15 nt, Human
cagacuagauguagu

SEQ ID NO: 1394167 - RNA, 14 nt, Human
cagacuagauguag

SEQ ID NO: 1394168 - RNA, 23 nt, Human
cagacuagauggaccugccugca

SEQ ID NO: 1394169 - RNA, 22 nt, Human
cagacuagauggaccugccugc

SEQ ID NO: 1394170 - RNA, 21 nt, Human
cagacuagauggaccugccug

SEQ ID NO: 1394171 - RNA, 12 nt, Human
cagacuacagcu

SEQ ID NO: 1394172 - RNA, 21 nt, Human
cagacuacagcuggggugcag

SEQ ID NO: 1394173 - RNA, 23 nt, Human
cagacuaagccagcaccggacca

SEQ ID NO: 1394174 - RNA, 22 nt, Human
cagacuaagccagcaccggacc

SEQ ID NO: 1394175 - RNA, 21 nt, Human
cagacuaagccagcaccggac

SEQ ID NO: 1394176 - RNA, 18 nt, Human
cagacuaagccagcaccg

SEQ ID NO: 1394177 - RNA, 15 nt, Human
cagacuaagccagca

SEQ ID NO: 1394178 - RNA, 14 nt, Human
cagacuaagccagc

SEQ ID NO: 1394179 - RNA, 22 nt, Human
cagacggaaggguaaacaauau

SEQ ID NO: 1394180 - RNA, 20 nt, Human
cagacggaaggguaaacaau

SEQ ID NO: 1394181 - RNA, 19 nt, Human
cagacggaaggguaaacaa

SEQ ID NO: 1394182 - RNA, 18 nt, Human
cagacgcugcugucacaa

SEQ ID NO: 1394183 - RNA, 17 nt, Human
cagacgcugcugucaca

SEQ ID NO: 1394184 - RNA, 23 nt, Human
cagacgccuggcugcugaucgcc

SEQ ID NO: 1394185 - RNA, 17 nt, Human
cagacgccuggcugcug

SEQ ID NO: 1394186 - RNA, 16 nt, Human
cagacgccuggcugcu

SEQ ID NO: 1394187 - RNA, 15 nt, Human
cagacgccuggcugc

SEQ ID NO: 1394188 - RNA, 14 nt, Human
cagacgccuggcug

SEQ ID NO: 1394189 - RNA, 13 nt, Human
cagacgccuggcu

SEQ ID NO: 1394190 - RNA, 16 nt, Human
cagacgccugaggaac

SEQ ID NO: 1394191 - RNA, 15 nt, Human
cagaccuuuuuuagg

SEQ ID NO: 1394192 - RNA, 20 nt, Human
cagaccuguuagcagacagg

SEQ ID NO: 1394193 - RNA, 19 nt, Human
cagaccuguuagcagacag

SEQ ID NO: 1394194 - RNA, 23 nt, Human
cagaccugauccuggaggcccag

SEQ ID NO: 1394195 - RNA, 22 nt, Human
cagaccugauccuggaggccca

SEQ ID NO: 1394196 - RNA, 20 nt, Human
cagaccugauccuggaggcc

SEQ ID NO: 1394197 - RNA, 17 nt, Human
cagaccugauccuggag

SEQ ID NO: 1394198 - RNA, 14 nt, Human
cagaccugauccug

SEQ ID NO: 1394199 - RNA, 13 nt, Human
cagaccugauccu

SEQ ID NO: 1394200 - RNA, 11 nt, Human
cagacuuguug

SEQ ID NO: 1394201 - RNA, 20 nt, Human
cagacuucccagcuaggaag

SEQ ID NO: 1394202 - RNA, 15 nt, Human
cagacuucccagcua

SEQ ID NO: 1394203 - RNA, 14 nt, Human
cagacuucccagcu

SEQ ID NO: 1394204 - RNA, 15 nt, Human
cagacucagcucuga

SEQ ID NO: 1394205 - RNA, 14 nt, Human
cagacucagcucug

SEQ ID NO: 1394206 - RNA, 14 nt, Human
cagacucagacauu

SEQ ID NO: 1394207 - RNA, 18 nt, Human
cagacucccauuccugaa

SEQ ID NO: 1394208 - RNA, 17 nt, Human
cagacucccauuccuga

SEQ ID NO: 1394209 - RNA, 14 nt, Human
cagacucccauucc

SEQ ID NO: 1394210 - RNA, 22 nt, Human
cagacuucccacggcuccucga

SEQ ID NO: 1394211 - RNA, 12 nt, Human
cagacuucccac

SEQ ID NO: 1394212 - RNA, 22 nt, Human
cagagaaaccagcuuccuucag

SEQ ID NO: 1394213 - RNA, 23 nt, Human
cagagaaaccagcuuccuucaga

SEQ ID NO: 1394214 - RNA, 21 nt, Human
cagagaaaccagcuuccuuca

SEQ ID NO: 1394215 - RNA, 19 nt, Human
cagagaaaccagcuuccuu

SEQ ID NO: 1394216 - RNA, 18 nt, Human
cagagaaaccagcuuccu

SEQ ID NO: 1394217 - RNA, 17 nt, Human
cagagaaaccagcuucc

SEQ ID NO: 1394218 - RNA, 16 nt, Human
cagagaaaccagcuuc

SEQ ID NO: 1394219 - RNA, 15 nt, Human
cagagaaaccagcuu

SEQ ID NO: 1394220 - RNA, 14 nt, Human
cagagaaaccagcu

SEQ ID NO: 1394221 - RNA, 13 nt, Human
cagagaaaccagc

SEQ ID NO: 1394222 - RNA, 18 nt, Human
cagagaaaaagggagggg

SEQ ID NO: 1394223 - RNA, 17 nt, Human
cagagaaaaagggaggg

SEQ ID NO: 1394224 - RNA, 12 nt, Human
cagagaaaaagg

SEQ ID NO: 1394225 - RNA, 18 nt, Human
cagagaaaggggagccca

SEQ ID NO: 1394226 - RNA, 22 nt, Human
cagaccuaggauuucaugauuu

SEQ ID NO: 1394227 - RNA, 22 nt, Human
cagacccuggaggccccaaccc

SEQ ID NO: 1394228 - RNA, 19 nt, Human
cagacccuggaggccccaa

SEQ ID NO: 1394229 - RNA, 18 nt, Human
cagacccuggaggcccca

SEQ ID NO: 1394230 - RNA, 14 nt, Human
cagacccuggaggc

SEQ ID NO: 1394231 - RNA, 11 nt, Human
cagacccugga

SEQ ID NO: 1394232 - RNA, 13 nt, Human
cagacccuggagg

SEQ ID NO: 1394233 - RNA, 15 nt, Human
cagacccugcccuug

SEQ ID NO: 1394234 - RNA, 13 nt, Human
cagacccugcccu

SEQ ID NO: 1394235 - RNA, 14 nt, Human
cagacauuggcacc

SEQ ID NO: 1394236 - RNA, 13 nt, Human
cagacauuuuaaa

SEQ ID NO: 1394237 - RNA, 22 nt, Human
cagaccacgcccguccugccug

SEQ ID NO: 1394238 - RNA, 22 nt, Human
cagaccaccccgccugcccuca

SEQ ID NO: 1394239 - RNA, 19 nt, Human
cagaccaccccgccugccc

SEQ ID NO: 1394240 - RNA, 15 nt, Human
cagaccaccccgccu

SEQ ID NO: 1394241 - RNA, 13 nt, Human
cagaccaccccgc

SEQ ID NO: 1394242 - RNA, 16 nt, Human
cagaccacauugcuuu

SEQ ID NO: 1394243 - RNA, 16 nt, Human
cagaccacaugcccca

SEQ ID NO: 1394244 - RNA, 15 nt, Human
cagaccacaugcccc

SEQ ID NO: 1394245 - RNA, 13 nt, Human
cagaccacggcuc

SEQ ID NO: 1394246 - RNA, 24 nt, Human
cagaccacgcccguccugccugug

SEQ ID NO: 1394247 - RNA, 23 nt, Human
cagaccacgcccguccugccugu

SEQ ID NO: 1394248 - RNA, 16 nt, Human
cagaccauaauguuac

SEQ ID NO: 1394249 - RNA, 14 nt, Human
cagaccauggacac

SEQ ID NO: 1394250 - RNA, 17 nt, Human
cagaccauugucucaga

SEQ ID NO: 1394251 - RNA, 22 nt, Human
cagaccauggacacuacaccca

SEQ ID NO: 1394252 - RNA, 21 nt, Human
cagaccauggacacuacaccc

SEQ ID NO: 1394253 - RNA, 17 nt, Human
cagaugaaugccgugga

SEQ ID NO: 1394254 - RNA, 14 nt, Human
cagaugagucacac

SEQ ID NO: 1394255 - RNA, 16 nt, Human
cagaugaggcuuucca

SEQ ID NO: 1394256 - RNA, 14 nt, Human
cagaugcagggcag

SEQ ID NO: 1394257 - RNA, 13 nt, Human
cagaugcagggca

SEQ ID NO: 1394258 - RNA, 16 nt, Human
cagaugcagcucaaga

SEQ ID NO: 1394259 - RNA, 17 nt, Human
cagaugcacaugagcug

SEQ ID NO: 1394260 - RNA, 21 nt, Human
cagaucuagucaaucaagucu

SEQ ID NO: 1394261 - RNA, 20 nt, Human
cagaucucuaacuucaccau

SEQ ID NO: 1394262 - RNA, 14 nt, Human
cagauccuggaaau

SEQ ID NO: 1394263 - RNA, 23 nt, Human
cagaucuggaaccucagccuggc

SEQ ID NO: 1394264 - RNA, 22 nt, Human
cagaucuggaaccucagccugg

SEQ ID NO: 1394265 - RNA, 21 nt, Human
cagaucuggaaccucagccug

SEQ ID NO: 1394266 - RNA, 20 nt, Human
cagaucuggaaccucagccu

SEQ ID NO: 1394267 - RNA, 19 nt, Human
cagaucuggaaccucagcc

SEQ ID NO: 1394268 - RNA, 18 nt, Human
cagaucuggaaccucagc

SEQ ID NO: 1394269 - RNA, 15 nt, Human
cagaucuggaaccuc

SEQ ID NO: 1394270 - RNA, 14 nt, Human
cagaucuggaaccu

SEQ ID NO: 1394271 - RNA, 23 nt, Human
cagaucugauuuguaacccacug

SEQ ID NO: 1394272 - RNA, 20 nt, Human
cagaguugcugcaaaccuga

SEQ ID NO: 1394273 - RNA, 23 nt, Human
cagaguucuuuuugaaguauuua

SEQ ID NO: 1394274 - RNA, 14 nt, Human
cagaguuguuacau

SEQ ID NO: 1394275 - RNA, 19 nt, Human
cagaguuacaguucugugg

SEQ ID NO: 1394276 - RNA, 18 nt, Human
cagaguuacaguucugug

SEQ ID NO: 1394277 - RNA, 17 nt, Human
cagaguuacaguucugu

SEQ ID NO: 1394278 - RNA, 16 nt, Human
cagaguuacaguucug

SEQ ID NO: 1394279 - RNA, 15 nt, Human
cagaguuacaguucu

SEQ ID NO: 1394280 - RNA, 14 nt, Human
cagaguuacaguuc

SEQ ID NO: 1394281 - RNA, 13 nt, Human
cagaguuacaguu

SEQ ID NO: 1394282 - RNA, 12 nt, Human
cagaguuacagu

SEQ ID NO: 1394283 - RNA, 18 nt, Human
cagaguguggacucuggu

SEQ ID NO: 1394284 - RNA, 22 nt, Human
cagauaaagguucaugcaaacu

SEQ ID NO: 1394285 - RNA, 15 nt, Human
cagaguuguuacauu

SEQ ID NO: 1394286 - RNA, 18 nt, Human
cagaguuguuacauuuuu

SEQ ID NO: 1394287 - RNA, 19 nt, Human
cagaguuguuacauuuuua

SEQ ID NO: 1394288 - RNA, 22 nt, Human
cagauaagguaaaaugccauga

SEQ ID NO: 1394289 - RNA, 20 nt, Human
cagauaagguaaaaugccau

SEQ ID NO: 1394290 - RNA, 20 nt, Human
cagauaacuuuuuuuuuucu

SEQ ID NO: 1394291 - RNA, 13 nt, Human
cagauaacuuuuu

SEQ ID NO: 1394292 - RNA, 12 nt, Human
cagauaacuuuu

SEQ ID NO: 1394293 - RNA, 19 nt, Human
cagauaacugaaaauuauu

SEQ ID NO: 1394294 - RNA, 22 nt, Human
cagauaacugaaaauuauuuaa

SEQ ID NO: 1394295 - RNA, 16 nt, Human
cagauaaugugaaaau

SEQ ID NO: 1394296 - RNA, 14 nt, Human
cagauaaugugaaa

SEQ ID NO: 1394297 - RNA, 13 nt, Human
cagauaaugugaa

SEQ ID NO: 1394298 - RNA, 15 nt, Human
cagauaaucccugua

SEQ ID NO: 1394299 - RNA, 14 nt, Human
cagauaaucacaau

SEQ ID NO: 1394300 - RNA, 14 nt, Human
cagagucccugccu

SEQ ID NO: 1394301 - RNA, 16 nt, Human
cagaguccuuaaaaug

SEQ ID NO: 1394302 - RNA, 18 nt, Human
cagagucccugccuggac

SEQ ID NO: 1394303 - RNA, 14 nt, Human
cagagggcacucug

SEQ ID NO: 1394304 - RNA, 20 nt, Human
cagagugagacccagcccuc

SEQ ID NO: 1394305 - RNA, 17 nt, Human
cagagugagacccagcc

SEQ ID NO: 1394306 - RNA, 15 nt, Human
cagagugagacccag

SEQ ID NO: 1394307 - RNA, 14 nt, Human
cagagugagaccca

SEQ ID NO: 1394308 - RNA, 20 nt, Human
cagagugacauccaggagga

SEQ ID NO: 1394309 - RNA, 20 nt, Human
cagagucuggugaagcucac

SEQ ID NO: 1394310 - RNA, 18 nt, Human
cagaggcccaggcugccg

SEQ ID NO: 1394311 - RNA, 19 nt, Human
cagaggcccaggcugccgu

SEQ ID NO: 1394312 - RNA, 17 nt, Human
cagaggcccaggcugcc

SEQ ID NO: 1394313 - RNA, 16 nt, Human
cagaggcccaggcugc

SEQ ID NO: 1394314 - RNA, 15 nt, Human
cagaggcccaggcug

SEQ ID NO: 1394315 - RNA, 14 nt, Human
cagaggcccaggcu

SEQ ID NO: 1394316 - RNA, 20 nt, Human
cagaggcccacauuggaaga

SEQ ID NO: 1394317 - RNA, 14 nt, Human
cagaggccaaggag

SEQ ID NO: 1394318 - RNA, 20 nt, Human
cagaggccagaggcccccag

SEQ ID NO: 1394319 - RNA, 21 nt, Human
cagaggcaguaccugggcaag

SEQ ID NO: 1394320 - RNA, 17 nt, Human
cagaggcaguaccuggg

SEQ ID NO: 1394321 - RNA, 21 nt, Human
cagaggcagcccgcacaccug

SEQ ID NO: 1394322 - RNA, 21 nt, Human
cagaggauugcugccccauca

SEQ ID NO: 1394323 - RNA, 14 nt, Human
cagaggcuggguuc

SEQ ID NO: 1394324 - RNA, 13 nt, Human
cagaggcuggguu

SEQ ID NO: 1394325 - RNA, 12 nt, Human
cagaggcugggu

SEQ ID NO: 1394326 - RNA, 21 nt, Human
cagaggcccucaagucuuucu

SEQ ID NO: 1394327 - RNA, 20 nt, Human
cagaggcccucgcugccagc

SEQ ID NO: 1394328 - RNA, 19 nt, Human
cagaggcccucgcugccag

SEQ ID NO: 1394329 - RNA, 12 nt, Human
cagaggcccuca

SEQ ID NO: 1394330 - RNA, 24 nt, Human
cagaggcccccagcccagggcucc

SEQ ID NO: 1394331 - RNA, 23 nt, Human
cagaggcccccagcccagggcuc

SEQ ID NO: 1394332 - RNA, 22 nt, Human
cagaggcccccagcccagggcu

SEQ ID NO: 1394333 - RNA, 19 nt, Human
cagaggcccccagcccagg

SEQ ID NO: 1394334 - RNA, 17 nt, Human
cagaggcccccagccca

SEQ ID NO: 1394335 - RNA, 16 nt, Human
cagaggcccccagccc

SEQ ID NO: 1394336 - RNA, 17 nt, Human
cagaggccccagccucc

SEQ ID NO: 1394337 - RNA, 16 nt, Human
cagaggccccagccuc

SEQ ID NO: 1394338 - RNA, 14 nt, Human
cagaggccccagcc

SEQ ID NO: 1394339 - RNA, 13 nt, Human
cagaggccccagc

SEQ ID NO: 1394340 - RNA, 21 nt, Human
cagaggcucagauuguaauau

SEQ ID NO: 1394341 - RNA, 20 nt, Human
cagaggcuauuauuuucacu

SEQ ID NO: 1394342 - RNA, 19 nt, Human
cagaggccugggcugggaa

SEQ ID NO: 1394343 - RNA, 18 nt, Human
cagaggcgcacugugacc

SEQ ID NO: 1394344 - RNA, 17 nt, Human
cagaggcgcacugugac

SEQ ID NO: 1394345 - RNA, 16 nt, Human
cagaggccugggcugg

SEQ ID NO: 1394346 - RNA, 14 nt, Human
cagaggccugggcu

SEQ ID NO: 1394347 - RNA, 23 nt, Human
cagaggcgcaugaauuugugaag

SEQ ID NO: 1394348 - RNA, 17 nt, Human
cagagaccuuccagaaa

SEQ ID NO: 1394349 - RNA, 15 nt, Human
cagagacccagcgga

SEQ ID NO: 1394350 - RNA, 22 nt, Human
cagagacccagcggacacacgc

SEQ ID NO: 1394351 - RNA, 13 nt, Human
cagagacccagcg

SEQ ID NO: 1394352 - RNA, 12 nt, Human
cagagacccagc

SEQ ID NO: 1394353 - RNA, 21 nt, Human
cagagaccagggcuccagccc

SEQ ID NO: 1394354 - RNA, 15 nt, Human
cagagaccagggcuc

SEQ ID NO: 1394355 - RNA, 13 nt, Human
cagagaccagggc

SEQ ID NO: 1394356 - RNA, 16 nt, Human
cagagaugccucccug

SEQ ID NO: 1394357 - RNA, 23 nt, Human
cagagaugccucccugagcuaga

SEQ ID NO: 1394358 - RNA, 15 nt, Human
cagagaugccucccu

SEQ ID NO: 1394359 - RNA, 14 nt, Human
cagagaugccuccc

SEQ ID NO: 1394360 - RNA, 23 nt, Human
cagagagugagagacauuaacuc

SEQ ID NO: 1394361 - RNA, 21 nt, Human
cagagaugcaccaccaagcca

SEQ ID NO: 1394362 - RNA, 20 nt, Human
cagagaugcaccaccaagcc

SEQ ID NO: 1394363 - RNA, 23 nt, Human
cagagauccaaaagaagccccca

SEQ ID NO: 1394364 - RNA, 21 nt, Human
cagagauccaaaagaagcccc

SEQ ID NO: 1394365 - RNA, 20 nt, Human
cagagauccaaaagaagccc

SEQ ID NO: 1394366 - RNA, 19 nt, Human
cagagauccaaaagaagcc

SEQ ID NO: 1394367 - RNA, 16 nt, Human
cagagauaaagaccuu

SEQ ID NO: 1394368 - RNA, 19 nt, Human
cagagcaccugcugucugg

SEQ ID NO: 1394369 - RNA, 18 nt, Human
cagagcaccugcugucug

SEQ ID NO: 1394370 - RNA, 16 nt, Human
cagagcaccugcuguc

SEQ ID NO: 1394371 - RNA, 24 nt, Human
cagagauuggguuuuuggacuucu

SEQ ID NO: 1394372 - RNA, 16 nt, Human
cagagcaaaauaauuu

SEQ ID NO: 1394373 - RNA, 14 nt, Human
cagagcaaaauaau

SEQ ID NO: 1394374 - RNA, 16 nt, Human
cagagauucugaacua

SEQ ID NO: 1394375 - RNA, 17 nt, Human
cagagcaagaccccauc

SEQ ID NO: 1394376 - RNA, 17 nt, Human
cagagacaugcagagau

SEQ ID NO: 1394377 - RNA, 16 nt, Human
cagagacaugcagaga

SEQ ID NO: 1394378 - RNA, 14 nt, Human
cagagacaugcaga

SEQ ID NO: 1394379 - RNA, 23 nt, Human
cagagacaucagcccuugggggu

SEQ ID NO: 1394380 - RNA, 17 nt, Human
cagagacaucagcccuu

SEQ ID NO: 1394381 - RNA, 23 nt, Human
cagagacauacuugaagggccag

SEQ ID NO: 1394382 - RNA, 21 nt, Human
cagagacauacuugaagggcc

SEQ ID NO: 1394383 - RNA, 20 nt, Human
cagagacauacuugaagggc

SEQ ID NO: 1394384 - RNA, 19 nt, Human
cagagacauacuugaaggg

SEQ ID NO: 1394385 - RNA, 17 nt, Human
cagagacauacuugaag

SEQ ID NO: 1394386 - RNA, 16 nt, Human
cagagacauacuugaa

SEQ ID NO: 1394387 - RNA, 15 nt, Human
cagagacauacuuga

SEQ ID NO: 1394388 - RNA, 12 nt, Human
cagagaccaggg

SEQ ID NO: 1394389 - RNA, 18 nt, Human
cagagacaugcagagauu

SEQ ID NO: 1394390 - RNA, 23 nt, Human
cagagaccaagauggcccauccu

SEQ ID NO: 1394391 - RNA, 23 nt, Human
cagagaauuucuaccauuucaga

SEQ ID NO: 1394392 - RNA, 22 nt, Human
cagagaauuucuaccauuucag

SEQ ID NO: 1394393 - RNA, 16 nt, Human
cagagaauuucuacca

SEQ ID NO: 1394394 - RNA, 15 nt, Human
cagagaauuucuacc

SEQ ID NO: 1394395 - RNA, 13 nt, Human
cagagaauuucua

SEQ ID NO: 1394396 - RNA, 19 nt, Human
cagagaagucacagggcag

SEQ ID NO: 1394397 - RNA, 20 nt, Human
cagagaagucacagggcagu

SEQ ID NO: 1394398 - RNA, 18 nt, Human
cagagaagucacagggca

SEQ ID NO: 1394399 - RNA, 16 nt, Human
cagagaagucacaggg

SEQ ID NO: 1394400 - RNA, 13 nt, Human
cagagaagucaca

SEQ ID NO: 1394401 - RNA, 23 nt, Human
cagagaagccuucaagcucugag

SEQ ID NO: 1394402 - RNA, 22 nt, Human
cagagaagccuucaagcucuga

SEQ ID NO: 1394403 - RNA, 21 nt, Human
cagagaagccuucaagcucug

SEQ ID NO: 1394404 - RNA, 20 nt, Human
cagagaagccuucaagcucu

SEQ ID NO: 1394405 - RNA, 19 nt, Human
cagagaagccuucaagcuc

SEQ ID NO: 1394406 - RNA, 18 nt, Human
cagagaagccuucaagcu

SEQ ID NO: 1394407 - RNA, 17 nt, Human
cagagaagccuucaagc

SEQ ID NO: 1394408 - RNA, 16 nt, Human
cagagaagccuucaag

SEQ ID NO: 1394409 - RNA, 15 nt, Human
cagagaagccuucaa

SEQ ID NO: 1394410 - RNA, 14 nt, Human
cagagaagccuuca

SEQ ID NO: 1394411 - RNA, 13 nt, Human
cagagaagccuuc

SEQ ID NO: 1394412 - RNA, 12 nt, Human
cagagaagccuu

SEQ ID NO: 1394413 - RNA, 11 nt, Human
cagagaagccu

SEQ ID NO: 1394414 - RNA, 22 nt, Human
cagagaagccaucaccucagau

SEQ ID NO: 1394415 - RNA, 21 nt, Human
cagagaagccaucaccucaga

SEQ ID NO: 1394416 - RNA, 19 nt, Human
cagagaagccaucaccuca

SEQ ID NO: 1394417 - RNA, 18 nt, Human
cagagaagccaucaccuc

SEQ ID NO: 1394418 - RNA, 14 nt, Human
cagagaagccauca

SEQ ID NO: 1394419 - RNA, 13 nt, Human
cagagaagccauc

SEQ ID NO: 1394420 - RNA, 12 nt, Human
cagagaagccau

SEQ ID NO: 1394421 - RNA, 21 nt, Human
cagagaagccagcuuguuuac

SEQ ID NO: 1394422 - RNA, 20 nt, Human
cagagaagccagcuuguuua

SEQ ID NO: 1394423 - RNA, 19 nt, Human
cagagaagccagcuuguuu

SEQ ID NO: 1394424 - RNA, 18 nt, Human
cagagaagccagcuuguu

SEQ ID NO: 1394425 - RNA, 22 nt, Human
cagagaacccagcccacccccg

SEQ ID NO: 1394426 - RNA, 11 nt, Human
cagagaaccca

SEQ ID NO: 1394427 - RNA, 14 nt, Human
cagagaaccaggcu

SEQ ID NO: 1394428 - RNA, 19 nt, Human
cagagaaaggggagcccac

SEQ ID NO: 1394429 - RNA, 16 nt, Human
cagagaacccagccca

SEQ ID NO: 1394430 - RNA, 13 nt, Human
cagagaagaaaga

SEQ ID NO: 1394431 - RNA, 17 nt, Human
cagagaagccagcuugu

SEQ ID NO: 1394432 - RNA, 16 nt, Human
cagagaagccagcuug

SEQ ID NO: 1394433 - RNA, 15 nt, Human
cagagaagccagcuu

SEQ ID NO: 1394434 - RNA, 14 nt, Human
cagagaagccagcu

SEQ ID NO: 1394435 - RNA, 13 nt, Human
cagagaagccagc

SEQ ID NO: 1394436 - RNA, 12 nt, Human
cagagaagccag

SEQ ID NO: 1394437 - RNA, 11 nt, Human
cagagaagcca

SEQ ID NO: 1394438 - RNA, 20 nt, Human
cagagaagccaaaagauugg

SEQ ID NO: 1394439 - RNA, 14 nt, Human
cagagaagaaagaa

SEQ ID NO: 1394440 - RNA, 18 nt, Human
cagagaagaaagaacgga

SEQ ID NO: 1394441 - RNA, 19 nt, Human
cagagaagaaagaacggaa

SEQ ID NO: 1394442 - RNA, 21 nt, Human
cagaggaaggggccagaggcu

SEQ ID NO: 1394443 - RNA, 20 nt, Human
cagaggaaggggccagaggc

SEQ ID NO: 1394444 - RNA, 19 nt, Human
cagaggaaggggccagagg

SEQ ID NO: 1394445 - RNA, 18 nt, Human
cagaggaaggggccagag

SEQ ID NO: 1394446 - RNA, 17 nt, Human
cagaggacacagagaag

SEQ ID NO: 1394447 - RNA, 15 nt, Human
cagaggacacagaga

SEQ ID NO: 1394448 - RNA, 20 nt, Human
cagaggagccaccaguucuc

SEQ ID NO: 1394449 - RNA, 19 nt, Human
cagaggagccaccaguucu

SEQ ID NO: 1394450 - RNA, 18 nt, Human
cagaggagccaccaguuc

SEQ ID NO: 1394451 - RNA, 16 nt, Human
cagaggaaggggccag

SEQ ID NO: 1394452 - RNA, 23 nt, Human
cagagccggggugggguggcugc

SEQ ID NO: 1394453 - RNA, 23 nt, Human
cagagcccugugaggcugggucc

SEQ ID NO: 1394454 - RNA, 20 nt, Human
cagagccccacccucagaug

SEQ ID NO: 1394455 - RNA, 20 nt, Human
cagagccuccuuucuggcuu

SEQ ID NO: 1394456 - RNA, 20 nt, Human
cagagccgugguccuuuggg

SEQ ID NO: 1394457 - RNA, 19 nt, Human
cagagccgugguccuuugg

SEQ ID NO: 1394458 - RNA, 22 nt, Human
cagagccggggugggguggcug

SEQ ID NO: 1394459 - RNA, 19 nt, Human
cagagcccaggcucggccu

SEQ ID NO: 1394460 - RNA, 23 nt, Human
cagagcccaggcucggccugccc

SEQ ID NO: 1394461 - RNA, 17 nt, Human
cagagcccaggcucggc

SEQ ID NO: 1394462 - RNA, 14 nt, Human
cagagcccaggcuc

SEQ ID NO: 1394463 - RNA, 13 nt, Human
cagagcccaggcu

SEQ ID NO: 1394464 - RNA, 14 nt, Human
cagagcccagcucc

SEQ ID NO: 1394465 - RNA, 13 nt, Human
cagagcccagcuc

SEQ ID NO: 1394466 - RNA, 11 nt, Human
cagagcccagc

SEQ ID NO: 1394467 - RNA, 19 nt, Human
cagagcccacuccaucugg

SEQ ID NO: 1394468 - RNA, 18 nt, Human
cagagcccacuccaucug

SEQ ID NO: 1394469 - RNA, 13 nt, Human
cagagcccacucc

SEQ ID NO: 1394470 - RNA, 13 nt, Human
cagagcacugcuc

SEQ ID NO: 1394471 - RNA, 21 nt, Human
cagagcaccugcugucugggu

SEQ ID NO: 1394472 - RNA, 15 nt, Human
cagagcacugcucca

SEQ ID NO: 1394473 - RNA, 21 nt, Human
cagagccaugucuucucccug

SEQ ID NO: 1394474 - RNA, 20 nt, Human
cagagccaugucuucucccu

SEQ ID NO: 1394475 - RNA, 18 nt, Human
cagagccaugucuucucc

SEQ ID NO: 1394476 - RNA, 23 nt, Human
cagagccaggggggugaggagcu

SEQ ID NO: 1394477 - RNA, 14 nt, Human
cagagccaggaaga

SEQ ID NO: 1394478 - RNA, 15 nt, Human
cagagccaggaagau

SEQ ID NO: 1394479 - RNA, 17 nt, Human
cagagccaggaagaucc

SEQ ID NO: 1394480 - RNA, 21 nt, Human
cagagccaggaagauccccca

SEQ ID NO: 1394481 - RNA, 23 nt, Human
cagagccaggagaagcucagcug

SEQ ID NO: 1394482 - RNA, 20 nt, Human
cagagccaggagaagcucag

SEQ ID NO: 1394483 - RNA, 17 nt, Human
cagagccaggagaagcu

SEQ ID NO: 1394484 - RNA, 16 nt, Human
cagagccaggagaagc

SEQ ID NO: 1394485 - RNA, 13 nt, Human
cagagccaggaga

SEQ ID NO: 1394486 - RNA, 12 nt, Human
cagagccaggag

SEQ ID NO: 1394487 - RNA, 23 nt, Human
cagagccaggaagaucccccaga

SEQ ID NO: 1394488 - RNA, 21 nt, Human
cagagccaaggggcuucaggu

SEQ ID NO: 1394489 - RNA, 20 nt, Human
cagagccaaggggcuucagg

SEQ ID NO: 1394490 - RNA, 13 nt, Human
cagagccaggaag

SEQ ID NO: 1394491 - RNA, 14 nt, Human
cagaugccuccuuc

SEQ ID NO: 1394492 - RNA, 17 nt, Human
cagaugccuccuuccuc

SEQ ID NO: 1394493 - RNA, 12 nt, Human
cagaugccuccu

SEQ ID NO: 1394494 - RNA, 17 nt, Human
cagaugccccuuucugg

SEQ ID NO: 1394495 - RNA, 15 nt, Human
cagaugccccuuucu

SEQ ID NO: 1394496 - RNA, 17 nt, Human
cagaugcagggcaguca

SEQ ID NO: 1394497 - RNA, 23 nt, Human
cagaugcuccaagauucuagaug

SEQ ID NO: 1394498 - RNA, 22 nt, Human
cagaugcuccaagauucuagau

SEQ ID NO: 1394499 - RNA, 21 nt, Human
cagaugcuccaagauucuaga

SEQ ID NO: 1394500 - RNA, 20 nt, Human
cagaugcuccaagauucuag

SEQ ID NO: 1394501 - RNA, 19 nt, Human
cagaugcuccaagauucua

SEQ ID NO: 1394502 - RNA, 18 nt, Human
cagaugcuccaagauucu

SEQ ID NO: 1394503 - RNA, 16 nt, Human
cagaugcuccaagauu

SEQ ID NO: 1394504 - RNA, 15 nt, Human
cagaugcuccaagau

SEQ ID NO: 1394505 - RNA, 14 nt, Human
cagaugcuccaaga

SEQ ID NO: 1394506 - RNA, 21 nt, Human
cagauggaaaauucauuuuuu

SEQ ID NO: 1394507 - RNA, 19 nt, Human
cagauggaaaauucauuuu

SEQ ID NO: 1394508 - RNA, 21 nt, Human
cagaugcuuuccugcacauua

SEQ ID NO: 1394509 - RNA, 14 nt, Human
cagaugcuuuccug

SEQ ID NO: 1394510 - RNA, 16 nt, Human
cagauggcauguguuu

SEQ ID NO: 1394511 - RNA, 16 nt, Human
cagauggcagcuuuua

SEQ ID NO: 1394512 - RNA, 15 nt, Human
cagauggcagcuuuu

SEQ ID NO: 1394513 - RNA, 13 nt, Human
cagauggcagcuu

SEQ ID NO: 1394514 - RNA, 12 nt, Human
cagauggcacuu

SEQ ID NO: 1394515 - RNA, 19 nt, Human
cagauggcagcuuuuaaaa

SEQ ID NO: 1394516 - RNA, 22 nt, Human
cagauggcauguguuuacuuua

SEQ ID NO: 1394517 - RNA, 16 nt, Human
cagauggccagccccu

SEQ ID NO: 1394518 - RNA, 17 nt, Human
cagaugugaaccauuaa

SEQ ID NO: 1394519 - RNA, 14 nt, Human
cagaugugaaccau

SEQ ID NO: 1394520 - RNA, 17 nt, Human
cagauguaggagggacu

SEQ ID NO: 1394521 - RNA, 15 nt, Human
cagauguaggaggga

SEQ ID NO: 1394522 - RNA, 24 nt, Human
cagauguaggagggacugucgcug

SEQ ID NO: 1394523 - RNA, 18 nt, Human
cagauguaggagggacug

SEQ ID NO: 1394524 - RNA, 17 nt, Human
cagauucccagagcaaa

SEQ ID NO: 1394525 - RNA, 14 nt, Human
cagauucccagagc

SEQ ID NO: 1394526 - RNA, 21 nt, Human
cagauucagaaaugaggccau

SEQ ID NO: 1394527 - RNA, 17 nt, Human
cagauucagaaaugagg

SEQ ID NO: 1394528 - RNA, 15 nt, Human
cagauucagaaauga

SEQ ID NO: 1394529 - RNA, 12 nt, Human
cagauuccuucc

SEQ ID NO: 1394530 - RNA, 21 nt, Human
cagauucccagagcaaaauaa

SEQ ID NO: 1394531 - RNA, 19 nt, Human
cagauucccagagcaaaau

SEQ ID NO: 1394532 - RNA, 18 nt, Human
cagauucccagagcaaaa

SEQ ID NO: 1394533 - RNA, 13 nt, Human
cagauuccuuccc

SEQ ID NO: 1394534 - RNA, 14 nt, Human
cagauuccuuccca

SEQ ID NO: 1394535 - RNA, 15 nt, Human
cagauuuucagcaaa

SEQ ID NO: 1394536 - RNA, 13 nt, Human
cagauuuucagca

SEQ ID NO: 1394537 - RNA, 22 nt, Human
cagauuuucagcaaacucuuuu

SEQ ID NO: 1394538 - RNA, 19 nt, Human
cagauuuucagcaaacucu

SEQ ID NO: 1394539 - RNA, 16 nt, Human
cagauuuugauagcaa

SEQ ID NO: 1394540 - RNA, 18 nt, Human
cagauuuugauagcaaag

SEQ ID NO: 1394541 - RNA, 19 nt, Human
cagauuuugauagcaaagc

SEQ ID NO: 1394542 - RNA, 20 nt, Human
cagauuuugauagcaaagcg

SEQ ID NO: 1394543 - RNA, 15 nt, Human
cagauuuuccugaaa

SEQ ID NO: 1394544 - RNA, 14 nt, Human
cagauuuuccugaa

SEQ ID NO: 1394545 - RNA, 23 nt, Human
cagauuuuguuggcauagcucug

SEQ ID NO: 1394546 - RNA, 16 nt, Human
cagauuuuuacacaug

SEQ ID NO: 1394547 - RNA, 23 nt, Human
cagcaacuuguccuagcacagau

SEQ ID NO: 1394548 - RNA, 22 nt, Human
cagcaacuuguccuagcacaga

SEQ ID NO: 1394549 - RNA, 17 nt, Human
cagcaacuuguccuagc

SEQ ID NO: 1394550 - RNA, 23 nt, Human
cagcaacuaucagacuaagccag

SEQ ID NO: 1394551 - RNA, 21 nt, Human
cagcaacuaucagacuaagcc

SEQ ID NO: 1394552 - RNA, 20 nt, Human
cagcaacuaucagacuaagc

SEQ ID NO: 1394553 - RNA, 20 nt, Human
cagcaacggcacagcuaauu

SEQ ID NO: 1394554 - RNA, 17 nt, Human
cagcaaccccaggcuga

SEQ ID NO: 1394555 - RNA, 16 nt, Human
cagcaaccccaggcug

SEQ ID NO: 1394556 - RNA, 13 nt, Human
cagcaaccccagg

SEQ ID NO: 1394557 - RNA, 12 nt, Human
cagcaaccccag

SEQ ID NO: 1394558 - RNA, 20 nt, Human
cagcaaacucuuuucccacu

SEQ ID NO: 1394559 - RNA, 16 nt, Human
cagcaaaccggggccu

SEQ ID NO: 1394560 - RNA, 14 nt, Human
cagcaaaccggggc

SEQ ID NO: 1394561 - RNA, 14 nt, Human
cagcaaacaggugc

SEQ ID NO: 1394562 - RNA, 22 nt, Human
cagcaaagcccccagagcccag

SEQ ID NO: 1394563 - RNA, 18 nt, Human
cagcaaagcccccagagc

SEQ ID NO: 1394564 - RNA, 17 nt, Human
cagcaaagcccccagag

SEQ ID NO: 1394565 - RNA, 15 nt, Human
cagcaaagcccccag

SEQ ID NO: 1394566 - RNA, 14 nt, Human
cagcaaagccccca

SEQ ID NO: 1394567 - RNA, 13 nt, Human
cagcaaagccccc

SEQ ID NO: 1394568 - RNA, 23 nt, Human
cagcaaagcccccagagcccagg

SEQ ID NO: 1394569 - RNA, 14 nt, Human
cagcaaagugguuc

SEQ ID NO: 1394570 - RNA, 22 nt, Human
cagcaaaugcaaaaacucuuug

SEQ ID NO: 1394571 - RNA, 13 nt, Human
cagcaaaugcaaa

SEQ ID NO: 1394572 - RNA, 14 nt, Human
cagcaacaauaaau

SEQ ID NO: 1394573 - RNA, 19 nt, Human
cagcaacaauaaauagaca

SEQ ID NO: 1394574 - RNA, 20 nt, Human
cagcaacaauaaauagacac

SEQ ID NO: 1394575 - RNA, 22 nt, Human
cagcaaggcccgagcagcugag

SEQ ID NO: 1394576 - RNA, 23 nt, Human
cagcaaggcccgagcagcugagc

SEQ ID NO: 1394577 - RNA, 21 nt, Human
cagcaaggcccgagcagcuga

SEQ ID NO: 1394578 - RNA, 20 nt, Human
cagcaaggcccgagcagcug

SEQ ID NO: 1394579 - RNA, 19 nt, Human
cagcaaggcccgagcagcu

SEQ ID NO: 1394580 - RNA, 16 nt, Human
cagcaaggcccgagca

SEQ ID NO: 1394581 - RNA, 15 nt, Human
cagcaaggcccgagc

SEQ ID NO: 1394582 - RNA, 14 nt, Human
cagcaaggcccgag

SEQ ID NO: 1394583 - RNA, 20 nt, Human
cagcaagacuucucuuugcc

SEQ ID NO: 1394584 - RNA, 23 nt, Human
cagcaagacuucucuuugccuca

SEQ ID NO: 1394585 - RNA, 17 nt, Human
cagcaaggagauuuaca

SEQ ID NO: 1394586 - RNA, 18 nt, Human
cagcaaggagauuuacaa

SEQ ID NO: 1394587 - RNA, 15 nt, Human
cagcaagucaggguu

SEQ ID NO: 1394588 - RNA, 17 nt, Human
cagcaauagagacggga

SEQ ID NO: 1394589 - RNA, 22 nt, Human
cagcaauaaagcagcguuucua

SEQ ID NO: 1394590 - RNA, 15 nt, Human
cagcaauagagacgg

SEQ ID NO: 1394591 - RNA, 22 nt, Human
cagcaauuacaacggagucaaa

SEQ ID NO: 1394592 - RNA, 13 nt, Human
cagcaauaaagca

SEQ ID NO: 1394593 - RNA, 21 nt, Human
cagcaauaaagcagcguuucu

SEQ ID NO: 1394594 - RNA, 23 nt, Human
cagcaauuucuaauuuuuaagaa

SEQ ID NO: 1394595 - RNA, 14 nt, Human
cagcaauuuaaaug

SEQ ID NO: 1394596 - RNA, 15 nt, Human
cagcaauuuaaaugu

SEQ ID NO: 1394597 - RNA, 18 nt, Human
cagcacacagggcaguga

SEQ ID NO: 1394598 - RNA, 20 nt, Human
cagcacugucccuugccuca

SEQ ID NO: 1394599 - RNA, 18 nt, Human
cagcacugucccuugccu

SEQ ID NO: 1394600 - RNA, 16 nt, Human
cagcacugucccuugc

SEQ ID NO: 1394601 - RNA, 14 nt, Human
cagcacugucccuu

SEQ ID NO: 1394602 - RNA, 13 nt, Human
cagcacugucccu

SEQ ID NO: 1394603 - RNA, 12 nt, Human
cagcacuguccc

SEQ ID NO: 1394604 - RNA, 15 nt, Human
cagcacacagggcag

SEQ ID NO: 1394605 - RNA, 14 nt, Human
cagcacacagggca

SEQ ID NO: 1394606 - RNA, 13 nt, Human
cagcacacagggc

SEQ ID NO: 1394607 - RNA, 16 nt, Human
cagcacaaggccaucu

SEQ ID NO: 1394608 - RNA, 13 nt, Human
cagcacaaggcca

SEQ ID NO: 1394609 - RNA, 13 nt, Human
cagcaauuucuaa

SEQ ID NO: 1394610 - RNA, 20 nt, Human
cagcacaaauuaguuauaua

SEQ ID NO: 1394611 - RNA, 16 nt, Human
cagcaauuuaaauguu

SEQ ID NO: 1394612 - RNA, 23 nt, Human
cagcagacucagcucugacauuc

SEQ ID NO: 1394613 - RNA, 21 nt, Human
cagcagacucagcucugacau

SEQ ID NO: 1394614 - RNA, 18 nt, Human
cagcagacucagcucuga

SEQ ID NO: 1394615 - RNA, 17 nt, Human
cagcagacucagcucug

SEQ ID NO: 1394616 - RNA, 15 nt, Human
cagcagacucagcuc

SEQ ID NO: 1394617 - RNA, 21 nt, Human
cagcagacagagccaggagaa

SEQ ID NO: 1394618 - RNA, 20 nt, Human
cagcagacagagccaggaga

SEQ ID NO: 1394619 - RNA, 18 nt, Human
cagcagacagagccagga

SEQ ID NO: 1394620 - RNA, 17 nt, Human
cagcagacagagccagg

SEQ ID NO: 1394621 - RNA, 16 nt, Human
cagcagacagagccag

SEQ ID NO: 1394622 - RNA, 15 nt, Human
cagcagacagagcca

SEQ ID NO: 1394623 - RNA, 14 nt, Human
cagcagacagagcc

SEQ ID NO: 1394624 - RNA, 12 nt, Human
cagcagacagag

SEQ ID NO: 1394625 - RNA, 19 nt, Human
cagcagaaaugccuuaccc

SEQ ID NO: 1394626 - RNA, 22 nt, Human
cagcagaaaugccuuacccuca

SEQ ID NO: 1394627 - RNA, 17 nt, Human
cagcacuuguccagcug

SEQ ID NO: 1394628 - RNA, 15 nt, Human
cagcacuuguccagc

SEQ ID NO: 1394629 - RNA, 23 nt, Human
cagcacuuggggguucaggcccg

SEQ ID NO: 1394630 - RNA, 16 nt, Human
cagcacuuggcccuuc

SEQ ID NO: 1394631 - RNA, 15 nt, Human
cagcacuuggcccuu

SEQ ID NO: 1394632 - RNA, 14 nt, Human
cagcacuuggcccu

SEQ ID NO: 1394633 - RNA, 12 nt, Human
cagcacuuccau

SEQ ID NO: 1394634 - RNA, 13 nt, Human
cagcacuuccaug

SEQ ID NO: 1394635 - RNA, 13 nt, Human
cagcacuuauuua

SEQ ID NO: 1394636 - RNA, 19 nt, Human
cagcacuuguccagcugag

SEQ ID NO: 1394637 - RNA, 18 nt, Human
cagcacuuguccagcuga

SEQ ID NO: 1394638 - RNA, 14 nt, Human
cagcacuuuagaau

SEQ ID NO: 1394639 - RNA, 19 nt, Human
cagcacuuggcccuucuac

SEQ ID NO: 1394640 - RNA, 22 nt, Human
cagcacuuuagaauaugccuug

SEQ ID NO: 1394641 - RNA, 15 nt, Human
cagcagaaaugccuu

SEQ ID NO: 1394642 - RNA, 17 nt, Human
cagcagaaaugccuuac

SEQ ID NO: 1394643 - RNA, 23 nt, Human
cagcagcccccagcucccaccuc

SEQ ID NO: 1394644 - RNA, 20 nt, Human
cagcagcccccagcucccac

SEQ ID NO: 1394645 - RNA, 13 nt, Human
cagcagcccccag

SEQ ID NO: 1394646 - RNA, 12 nt, Human
cagcagccccca

SEQ ID NO: 1394647 - RNA, 18 nt, Human
cagcagccccacaccagg

SEQ ID NO: 1394648 - RNA, 16 nt, Human
cagcagccccacacca

SEQ ID NO: 1394649 - RNA, 15 nt, Human
cagcagccccacacc

SEQ ID NO: 1394650 - RNA, 23 nt, Human
cagcagccagcccugccuggagg

SEQ ID NO: 1394651 - RNA, 22 nt, Human
cagcagccagcccugccuggag

SEQ ID NO: 1394652 - RNA, 21 nt, Human
cagcagccagcccugccugga

SEQ ID NO: 1394653 - RNA, 20 nt, Human
cagcagccagcccugccugg

SEQ ID NO: 1394654 - RNA, 19 nt, Human
cagcagccagcccugccug

SEQ ID NO: 1394655 - RNA, 23 nt, Human
cagcagccucgccccuggcagag

SEQ ID NO: 1394656 - RNA, 19 nt, Human
cagcagccucgccccuggc

SEQ ID NO: 1394657 - RNA, 18 nt, Human
cagcagccucgccccugg

SEQ ID NO: 1394658 - RNA, 18 nt, Human
cagcagccagcccugccu

SEQ ID NO: 1394659 - RNA, 17 nt, Human
cagcagccagcccugcc

SEQ ID NO: 1394660 - RNA, 16 nt, Human
cagcagccagcccugc

SEQ ID NO: 1394661 - RNA, 15 nt, Human
cagcagccagcccug

SEQ ID NO: 1394662 - RNA, 14 nt, Human
cagcagccagcccu

SEQ ID NO: 1394663 - RNA, 13 nt, Human
cagcagccagccc

SEQ ID NO: 1394664 - RNA, 12 nt, Human
cagcagccagcc

SEQ ID NO: 1394665 - RNA, 11 nt, Human
cagcagccagc

SEQ ID NO: 1394666 - RNA, 10 nt, Human
cagcagccag

SEQ ID NO: 1394667 - RNA, 22 nt, Human
cagcagcaucucuaccuucucc

SEQ ID NO: 1394668 - RNA, 12 nt, Human
cagcagcaucuc

SEQ ID NO: 1394669 - RNA, 22 nt, Human
cagcagcaccugcccuaccugc

SEQ ID NO: 1394670 - RNA, 23 nt, Human
cagcagagagguuugcaguccca

SEQ ID NO: 1394671 - RNA, 16 nt, Human
cagccacccugaguug

SEQ ID NO: 1394672 - RNA, 18 nt, Human
cagccacgaggugcaaca

SEQ ID NO: 1394673 - RNA, 21 nt, Human
cagccaccgaagccgccugug

SEQ ID NO: 1394674 - RNA, 14 nt, Human
cagccacccugagu

SEQ ID NO: 1394675 - RNA, 22 nt, Human
cagccacccugaggagucugag

SEQ ID NO: 1394676 - RNA, 21 nt, Human
cagccacccugaggagucuga

SEQ ID NO: 1394677 - RNA, 20 nt, Human
cagccacccugaggagucug

SEQ ID NO: 1394678 - RNA, 19 nt, Human
cagccacccugaggagucu

SEQ ID NO: 1394679 - RNA, 18 nt, Human
cagccacccugaggaguc

SEQ ID NO: 1394680 - RNA, 16 nt, Human
cagccacccugaggag

SEQ ID NO: 1394681 - RNA, 15 nt, Human
cagccacccugagga

SEQ ID NO: 1394682 - RNA, 14 nt, Human
cagccacccugagg

SEQ ID NO: 1394683 - RNA, 12 nt, Human
cagccacccuga

SEQ ID NO: 1394684 - RNA, 21 nt, Human
cagccacacuucucaggacac

SEQ ID NO: 1394685 - RNA, 20 nt, Human
cagccacacuucucaggaca

SEQ ID NO: 1394686 - RNA, 19 nt, Human
cagccacacuucucaggac

SEQ ID NO: 1394687 - RNA, 18 nt, Human
cagccacacuucucagga

SEQ ID NO: 1394688 - RNA, 15 nt, Human
cagccaccccaugcu

SEQ ID NO: 1394689 - RNA, 18 nt, Human
cagccaccccaugcuggc

SEQ ID NO: 1394690 - RNA, 19 nt, Human
cagccaccccaugcuggcc

SEQ ID NO: 1394691 - RNA, 20 nt, Human
cagccaccccaugcuggccu

SEQ ID NO: 1394692 - RNA, 22 nt, Human
cagccaagucgguuaguggaag

SEQ ID NO: 1394693 - RNA, 23 nt, Human
cagccaagguuuuauaaggcuga

SEQ ID NO: 1394694 - RNA, 14 nt, Human
cagccaagcucugc

SEQ ID NO: 1394695 - RNA, 18 nt, Human
cagccaauuauguuaaac

SEQ ID NO: 1394696 - RNA, 17 nt, Human
cagccaauuauguuaaa

SEQ ID NO: 1394697 - RNA, 17 nt, Human
cagccacacuucucagg

SEQ ID NO: 1394698 - RNA, 16 nt, Human
cagccacacuucucag

SEQ ID NO: 1394699 - RNA, 14 nt, Human
cagccacacuucuc

SEQ ID NO: 1394700 - RNA, 13 nt, Human
cagccaucaaaau

SEQ ID NO: 1394701 - RNA, 21 nt, Human
cagccagugcccugagccagg

SEQ ID NO: 1394702 - RNA, 19 nt, Human
cagccagugcccugagcca

SEQ ID NO: 1394703 - RNA, 18 nt, Human
cagccagugcccugagcc

SEQ ID NO: 1394704 - RNA, 17 nt, Human
cagccagugcccugagc

SEQ ID NO: 1394705 - RNA, 22 nt, Human
cagccagucccguuucauuuag

SEQ ID NO: 1394706 - RNA, 22 nt, Human
cagccaguaaaugggggugcau

SEQ ID NO: 1394707 - RNA, 21 nt, Human
cagccacggggacucagcccu

SEQ ID NO: 1394708 - RNA, 22 nt, Human
cagcccauggagauugaccugg

SEQ ID NO: 1394709 - RNA, 21 nt, Human
cagcccauggagauugaccug

SEQ ID NO: 1394710 - RNA, 13 nt, Human
cagcccauggaga

SEQ ID NO: 1394711 - RNA, 16 nt, Human
cagccccacaccaggg

SEQ ID NO: 1394712 - RNA, 14 nt, Human
cagccccacaccag

SEQ ID NO: 1394713 - RNA, 13 nt, Human
cagccccacacca

SEQ ID NO: 1394714 - RNA, 21 nt, Human
cagcccagggcuccugcacuu

SEQ ID NO: 1394715 - RNA, 19 nt, Human
cagcccagggcuccugcac

SEQ ID NO: 1394716 - RNA, 18 nt, Human
cagcccagggcuccugca

SEQ ID NO: 1394717 - RNA, 17 nt, Human
cagcccagggcuccugc

SEQ ID NO: 1394718 - RNA, 16 nt, Human
cagcccagggcuccug

SEQ ID NO: 1394719 - RNA, 23 nt, Human
cagcccaggaagucucaucuggg

SEQ ID NO: 1394720 - RNA, 22 nt, Human
cagcccaggaagucucaucugg

SEQ ID NO: 1394721 - RNA, 20 nt, Human
cagcccaggaagucucaucu

SEQ ID NO: 1394722 - RNA, 12 nt, Human
cagcccaggaag

SEQ ID NO: 1394723 - RNA, 16 nt, Human
cagcccagccccacuc

SEQ ID NO: 1394724 - RNA, 20 nt, Human
cagcccagcccgcccacugg

SEQ ID NO: 1394725 - RNA, 15 nt, Human
cagcccagccagcgu

SEQ ID NO: 1394726 - RNA, 14 nt, Human
cagcccagccagcg

SEQ ID NO: 1394727 - RNA, 13 nt, Human
cagcccagccagc

SEQ ID NO: 1394728 - RNA, 12 nt, Human
cagcccagccag

SEQ ID NO: 1394729 - RNA, 22 nt, Human
cagcccagagacauacuugaag

SEQ ID NO: 1394730 - RNA, 21 nt, Human
cagcccagagacauacuugaa

SEQ ID NO: 1394731 - RNA, 13 nt, Human
cagcccagagaca

SEQ ID NO: 1394732 - RNA, 12 nt, Human
cagcccagagac

SEQ ID NO: 1394733 - RNA, 11 nt, Human
cagcccagaga

SEQ ID NO: 1394734 - RNA, 22 nt, Human
cagcccacccccggcagcagcc

SEQ ID NO: 1394735 - RNA, 20 nt, Human
cagcccacccccggcagcag

SEQ ID NO: 1394736 - RNA, 22 nt, Human
cagccauuggcuauuuaaaacu

SEQ ID NO: 1394737 - RNA, 12 nt, Human
cagcccaccccc

SEQ ID NO: 1394738 - RNA, 18 nt, Human
cagcccacccccggcagc

SEQ ID NO: 1394739 - RNA, 17 nt, Human
cagcccacccccggcag

SEQ ID NO: 1394740 - RNA, 16 nt, Human
cagcccacccccggca

SEQ ID NO: 1394741 - RNA, 20 nt, Human
cagccauuggcuauuuaaaa

SEQ ID NO: 1394742 - RNA, 19 nt, Human
cagccauuggcuauuuaaa

SEQ ID NO: 1394743 - RNA, 21 nt, Human
cagccaucaagagacugaguc

SEQ ID NO: 1394744 - RNA, 18 nt, Human
cagccaucaagagacuga

SEQ ID NO: 1394745 - RNA, 17 nt, Human
cagccaucaaaaugcuu

SEQ ID NO: 1394746 - RNA, 16 nt, Human
cagccaucaaaaugcu

SEQ ID NO: 1394747 - RNA, 23 nt, Human
cagccauccagggggcaagagga

SEQ ID NO: 1394748 - RNA, 21 nt, Human
cagcagggcuacccugagcug

SEQ ID NO: 1394749 - RNA, 19 nt, Human
cagcagggcuacccugagc

SEQ ID NO: 1394750 - RNA, 11 nt, Human
cagcagggcua

SEQ ID NO: 1394751 - RNA, 22 nt, Human
cagcagggacuguaaacacaga

SEQ ID NO: 1394752 - RNA, 21 nt, Human
cagcagggacuguaaacacag

SEQ ID NO: 1394753 - RNA, 18 nt, Human
cagcaggaggggggaggg

SEQ ID NO: 1394754 - RNA, 15 nt, Human
cagcaggagggggga

SEQ ID NO: 1394755 - RNA, 14 nt, Human
cagcaggacugucc

SEQ ID NO: 1394756 - RNA, 21 nt, Human
cagcagcuuuagaaucccagc

SEQ ID NO: 1394757 - RNA, 21 nt, Human
cagcaggccagguccagagag

SEQ ID NO: 1394758 - RNA, 23 nt, Human
cagcaggccagguccagagagac

SEQ ID NO: 1394759 - RNA, 21 nt, Human
cagcagccuggggcuggccuc

SEQ ID NO: 1394760 - RNA, 20 nt, Human
cagcagccuggggcuggccu

SEQ ID NO: 1394761 - RNA, 22 nt, Human
cagcagccucgccccuggcaga

SEQ ID NO: 1394762 - RNA, 21 nt, Human
cagcagccucgccccuggcag

SEQ ID NO: 1394763 - RNA, 18 nt, Human
cagcaugucuauucagcu

SEQ ID NO: 1394764 - RNA, 22 nt, Human
cagcauguacggauuuucaguu

SEQ ID NO: 1394765 - RNA, 21 nt, Human
cagcauguacggauuuucagu

SEQ ID NO: 1394766 - RNA, 20 nt, Human
cagcauguacggauuuucag

SEQ ID NO: 1394767 - RNA, 22 nt, Human
cagcauggcauccaagacucuu

SEQ ID NO: 1394768 - RNA, 15 nt, Human
cagcauggcauccaa

SEQ ID NO: 1394769 - RNA, 16 nt, Human
cagcaugcaauacaua

SEQ ID NO: 1394770 - RNA, 17 nt, Human
cagcaugaauuuguaau

SEQ ID NO: 1394771 - RNA, 18 nt, Human
cagcaugaauuuguaaug

SEQ ID NO: 1394772 - RNA, 23 nt, Human
cagcauucccagguaggccaagg

SEQ ID NO: 1394773 - RNA, 20 nt, Human
cagcauucccagguaggcca

SEQ ID NO: 1394774 - RNA, 18 nt, Human
cagcauucccagguaggc

SEQ ID NO: 1394775 - RNA, 21 nt, Human
cagcauuccagccccucuggu

SEQ ID NO: 1394776 - RNA, 20 nt, Human
cagcauuccagccccucugg

SEQ ID NO: 1394777 - RNA, 16 nt, Human
cagcauuccagccccu

SEQ ID NO: 1394778 - RNA, 14 nt, Human
cagcauuccagccc

SEQ ID NO: 1394779 - RNA, 17 nt, Human
cagcauucccagguagg

SEQ ID NO: 1394780 - RNA, 14 nt, Human
cagcauucccaggu

SEQ ID NO: 1394781 - RNA, 13 nt, Human
cagcauucccagg

SEQ ID NO: 1394782 - RNA, 12 nt, Human
cagcauucccag

SEQ ID NO: 1394783 - RNA, 14 nt, Human
cagcaugaauuugu

SEQ ID NO: 1394784 - RNA, 12 nt, Human
cagcaugaauuu

SEQ ID NO: 1394785 - RNA, 22 nt, Human
cagcaucugggccuuggccugg

SEQ ID NO: 1394786 - RNA, 20 nt, Human
cagcaucugggccuuggccu

SEQ ID NO: 1394787 - RNA, 19 nt, Human
cagcaucugggccuuggcc

SEQ ID NO: 1394788 - RNA, 16 nt, Human
cagcaucugggccuug

SEQ ID NO: 1394789 - RNA, 15 nt, Human
cagcaucugggccuu

SEQ ID NO: 1394790 - RNA, 14 nt, Human
cagcaucugggccu

SEQ ID NO: 1394791 - RNA, 13 nt, Human
cagcaucugggcc

SEQ ID NO: 1394792 - RNA, 21 nt, Human
cagcaucucuaccuucucccc

SEQ ID NO: 1394793 - RNA, 23 nt, Human
cagcaucucuaccuucuccccag

SEQ ID NO: 1394794 - RNA, 20 nt, Human
cagcaucucuaccuucuccc

SEQ ID NO: 1394795 - RNA, 17 nt, Human
cagcaucucuaccuucu

SEQ ID NO: 1394796 - RNA, 22 nt, Human
cagcaucuccaagcagcuuaga

SEQ ID NO: 1394797 - RNA, 21 nt, Human
cagcaucuccaagcagcuuag

SEQ ID NO: 1394798 - RNA, 18 nt, Human
cagcaucuccaagcagcu

SEQ ID NO: 1394799 - RNA, 17 nt, Human
cagcaucuccaagcagc

SEQ ID NO: 1394800 - RNA, 16 nt, Human
cagcaucuccaagcag

SEQ ID NO: 1394801 - RNA, 23 nt, Human
cagcauccgcaggugcugguccc

SEQ ID NO: 1394802 - RNA, 22 nt, Human
cagcaucggacaagacccccag

SEQ ID NO: 1394803 - RNA, 21 nt, Human
cagcaucggacaagaccccca

SEQ ID NO: 1394804 - RNA, 20 nt, Human
cagcagggguuggggaaaca

SEQ ID NO: 1394805 - RNA, 20 nt, Human
cagcauccgcaggugcuggu

SEQ ID NO: 1394806 - RNA, 16 nt, Human
cagcauuguauaugug

SEQ ID NO: 1394807 - RNA, 15 nt, Human
cagcauuucccuucc

SEQ ID NO: 1394808 - RNA, 23 nt, Human
cagccaacacgcaccugccucag

SEQ ID NO: 1394809 - RNA, 22 nt, Human
cagccaacacgcaccugccuca

SEQ ID NO: 1394810 - RNA, 20 nt, Human
cagccaacacgcaccugccu

SEQ ID NO: 1394811 - RNA, 19 nt, Human
cagccaacacgcaccugcc

SEQ ID NO: 1394812 - RNA, 14 nt, Human
cagccaaauuuaaa

SEQ ID NO: 1394813 - RNA, 17 nt, Human
cagccaacuagccccug

SEQ ID NO: 1394814 - RNA, 16 nt, Human
cagccaacuagccccu

SEQ ID NO: 1394815 - RNA, 14 nt, Human
cagccaacuagccc

SEQ ID NO: 1394816 - RNA, 22 nt, Human
cagccaaauuuaaaacuguugg

SEQ ID NO: 1394817 - RNA, 22 nt, Human
cagccaacuagccccuggggug

SEQ ID NO: 1394818 - RNA, 20 nt, Human
cagccaacuagccccugggg

SEQ ID NO: 1394819 - RNA, 19 nt, Human
cagccaacuagccccuggg

SEQ ID NO: 1394820 - RNA, 18 nt, Human
cagccaacuagccccugg

SEQ ID NO: 1394821 - RNA, 18 nt, Human
cagccaacuauggccugu

SEQ ID NO: 1394822 - RNA, 19 nt, Human
cagcccucacacacccugu

SEQ ID NO: 1394823 - RNA, 17 nt, Human
cagcccucacacacccu

SEQ ID NO: 1394824 - RNA, 16 nt, Human
cagcccucacacaccc

SEQ ID NO: 1394825 - RNA, 18 nt, Human
cagcccuaggguggagag

SEQ ID NO: 1394826 - RNA, 17 nt, Human
cagcccucaucccgagc

SEQ ID NO: 1394827 - RNA, 14 nt, Human
cagcccucaucccg

SEQ ID NO: 1394828 - RNA, 13 nt, Human
cagcccucauccc

SEQ ID NO: 1394829 - RNA, 13 nt, Human
cagcccucagaau

SEQ ID NO: 1394830 - RNA, 14 nt, Human
cagcccuaaacauc

SEQ ID NO: 1394831 - RNA, 16 nt, Human
cagcccuaaacaucau

SEQ ID NO: 1394832 - RNA, 19 nt, Human
cagcccgcccacuggguaa

SEQ ID NO: 1394833 - RNA, 15 nt, Human
cagcccgcacaccug

SEQ ID NO: 1394834 - RNA, 16 nt, Human
cagcccgcacaccugc

SEQ ID NO: 1394835 - RNA, 14 nt, Human
cagcccgcacaccu

SEQ ID NO: 1394836 - RNA, 23 nt, Human
cagccccuuucccuuguagcucc

SEQ ID NO: 1394837 - RNA, 15 nt, Human
cagccccuuucccuu

SEQ ID NO: 1394838 - RNA, 13 nt, Human
cagccccuuuccc

SEQ ID NO: 1394839 - RNA, 12 nt, Human
cagccccuuucc

SEQ ID NO: 1394840 - RNA, 18 nt, Human
cagccccuuagacagagg

SEQ ID NO: 1394841 - RNA, 21 nt, Human
cagccccuuagacagaggccc

SEQ ID NO: 1394842 - RNA, 17 nt, Human
cagccccuuagacagag

SEQ ID NO: 1394843 - RNA, 21 nt, Human
cagccccuggccccaggaccu

SEQ ID NO: 1394844 - RNA, 13 nt, Human
cagccccuggccc

SEQ ID NO: 1394845 - RNA, 15 nt, Human
cagccccagccaggg

SEQ ID NO: 1394846 - RNA, 18 nt, Human
cagccccacuccucugcu

SEQ ID NO: 1394847 - RNA, 21 nt, Human
cagccccacuccucugcugac

SEQ ID NO: 1394848 - RNA, 16 nt, Human
cagccccacuccucug

SEQ ID NO: 1394849 - RNA, 15 nt, Human
cagccccacuccucu

SEQ ID NO: 1394850 - RNA, 17 nt, Human
cagccccacccuggccu

SEQ ID NO: 1394851 - RNA, 18 nt, Human
cagccccacccuggccua

SEQ ID NO: 1394852 - RNA, 15 nt, Human
cagccccacccuggc

SEQ ID NO: 1394853 - RNA, 23 nt, Human
cagccccaccccagggcagccag

SEQ ID NO: 1394854 - RNA, 22 nt, Human
cagccccaccccagggcagcca

SEQ ID NO: 1394855 - RNA, 21 nt, Human
cagccccaccccagggcagcc

SEQ ID NO: 1394856 - RNA, 20 nt, Human
cagccccaccccagggcagc

SEQ ID NO: 1394857 - RNA, 18 nt, Human
cagccccaccccagggca

SEQ ID NO: 1394858 - RNA, 14 nt, Human
cagccccaccccag

SEQ ID NO: 1394859 - RNA, 21 nt, Human
cagccccacaccagggccagc

SEQ ID NO: 1394860 - RNA, 23 nt, Human
cagccccacaccagggccagccu

SEQ ID NO: 1394861 - RNA, 20 nt, Human
cagccggggcgaguggcacg

SEQ ID NO: 1394862 - RNA, 17 nt, Human
cagccggggcgaguggc

SEQ ID NO: 1394863 - RNA, 15 nt, Human
cagccggggcgagug

SEQ ID NO: 1394864 - RNA, 13 nt, Human
cagccgugggccc

SEQ ID NO: 1394865 - RNA, 14 nt, Human
cagccgugagcaug

SEQ ID NO: 1394866 - RNA, 17 nt, Human
cagccgugagcauguuu

SEQ ID NO: 1394867 - RNA, 16 nt, Human
cagccuacaggccuca

SEQ ID NO: 1394868 - RNA, 14 nt, Human
cagccuacaggccu

SEQ ID NO: 1394869 - RNA, 17 nt, Human
cagccgugggccccacc

SEQ ID NO: 1394870 - RNA, 15 nt, Human
cagccgugggcccca

SEQ ID NO: 1394871 - RNA, 23 nt, Human
cagcccugaggacagaugccucc

SEQ ID NO: 1394872 - RNA, 18 nt, Human
cagcccuccucugcacuc

SEQ ID NO: 1394873 - RNA, 17 nt, Human
cagcccuccucugcacu

SEQ ID NO: 1394874 - RNA, 23 nt, Human
cagcccugcaccaugcugcuggg

SEQ ID NO: 1394875 - RNA, 17 nt, Human
cagcccugcaccaugcu

SEQ ID NO: 1394876 - RNA, 15 nt, Human
cagcccugcaccaug

SEQ ID NO: 1394877 - RNA, 13 nt, Human
cagcccugcacca

SEQ ID NO: 1394878 - RNA, 20 nt, Human
cagcccugccuggaggaccu

SEQ ID NO: 1394879 - RNA, 19 nt, Human
cagcccugccuggaggacc

SEQ ID NO: 1394880 - RNA, 17 nt, Human
cagcccugccuggagga

SEQ ID NO: 1394881 - RNA, 16 nt, Human
cagcccugccuggagg

SEQ ID NO: 1394882 - RNA, 15 nt, Human
cagcccugccuggag

SEQ ID NO: 1394883 - RNA, 14 nt, Human
cagcccugccugga

SEQ ID NO: 1394884 - RNA, 13 nt, Human
cagcccugccugg

SEQ ID NO: 1394885 - RNA, 21 nt, Human
cagcccugccuggaggaccug

SEQ ID NO: 1394886 - RNA, 20 nt, Human
cagcccugcugcugccugcc

SEQ ID NO: 1394887 - RNA, 14 nt, Human
cagccucccaaagu

SEQ ID NO: 1394888 - RNA, 18 nt, Human
cagccuccauccuacccc

SEQ ID NO: 1394889 - RNA, 21 nt, Human
cagccuccauccuacccccug

SEQ ID NO: 1394890 - RNA, 17 nt, Human
cagccuccccugccagg

SEQ ID NO: 1394891 - RNA, 16 nt, Human
cagccuccccugccag

SEQ ID NO: 1394892 - RNA, 23 nt, Human
cagccucccccuguccccucuau

SEQ ID NO: 1394893 - RNA, 23 nt, Human
cagccucccauccagggccccca

SEQ ID NO: 1394894 - RNA, 20 nt, Human
cagccucccauccagggccc

SEQ ID NO: 1394895 - RNA, 19 nt, Human
cagccucccauccagggcc

SEQ ID NO: 1394896 - RNA, 18 nt, Human
cagccucccauccagggc

SEQ ID NO: 1394897 - RNA, 16 nt, Human
cagccucccauccagg

SEQ ID NO: 1394898 - RNA, 14 nt, Human
cagccucccaucca

SEQ ID NO: 1394899 - RNA, 22 nt, Human
cagccucccaaagugcugagau

SEQ ID NO: 1394900 - RNA, 21 nt, Human
cagccucccaaagugcugaga

SEQ ID NO: 1394901 - RNA, 15 nt, Human
cagccucccaaagug

SEQ ID NO: 1394902 - RNA, 22 nt, Human
cagccuccccugccagggcagg

SEQ ID NO: 1394903 - RNA, 20 nt, Human
cagccuccccugccagggca

SEQ ID NO: 1394904 - RNA, 19 nt, Human
cagccuccccugccagggc

SEQ ID NO: 1394905 - RNA, 18 nt, Human
cagccuccccugccaggg

SEQ ID NO: 1394906 - RNA, 23 nt, Human
cagccucaggacugggagccccc

SEQ ID NO: 1394907 - RNA, 21 nt, Human
cagccucaggacugggagccc

SEQ ID NO: 1394908 - RNA, 20 nt, Human
cagccucaggacugggagcc

SEQ ID NO: 1394909 - RNA, 19 nt, Human
cagccucaggacugggagc

SEQ ID NO: 1394910 - RNA, 18 nt, Human
cagccucaggacugggag

SEQ ID NO: 1394911 - RNA, 17 nt, Human
cagccucaggacuggga

SEQ ID NO: 1394912 - RNA, 16 nt, Human
cagccucaggacuggg

SEQ ID NO: 1394913 - RNA, 14 nt, Human
cagccucaggacug

SEQ ID NO: 1394914 - RNA, 12 nt, Human
cagccucagaga

SEQ ID NO: 1394915 - RNA, 21 nt, Human
cagccucagagacaucagccc

SEQ ID NO: 1394916 - RNA, 12 nt, Human
cagccuccagag

SEQ ID NO: 1394917 - RNA, 21 nt, Human
cagccucagugacccuggcuc

SEQ ID NO: 1394918 - RNA, 21 nt, Human
cagccuagggcugagcugggg

SEQ ID NO: 1394919 - RNA, 16 nt, Human
cagccuaguugaucag

SEQ ID NO: 1394920 - RNA, 24 nt, Human
cagcuacccuuuuucuccagcugg

SEQ ID NO: 1394921 - RNA, 21 nt, Human
cagcuacccuuuuucuccagc

SEQ ID NO: 1394922 - RNA, 22 nt, Human
cagcuaauucuacucacagugc

SEQ ID NO: 1394923 - RNA, 14 nt, Human
cagcuaauucuacu

SEQ ID NO: 1394924 - RNA, 23 nt, Human
cagcuacucuccccacgagggcu

SEQ ID NO: 1394925 - RNA, 15 nt, Human
cagcuacucucccca

SEQ ID NO: 1394926 - RNA, 13 nt, Human
cagcuacucuccc

SEQ ID NO: 1394927 - RNA, 21 nt, Human
cagcuacuuccuccuccccac

SEQ ID NO: 1394928 - RNA, 17 nt, Human
cagcuacuuccuccucc

SEQ ID NO: 1394929 - RNA, 15 nt, Human
cagcuacuuccuccu

SEQ ID NO: 1394930 - RNA, 14 nt, Human
cagcuaagcucacg

SEQ ID NO: 1394931 - RNA, 13 nt, Human
cagcuaagcucac

SEQ ID NO: 1394932 - RNA, 18 nt, Human
cagcuaagcuaggaauga

SEQ ID NO: 1394933 - RNA, 15 nt, Human
cagcuaagcuaggaa

SEQ ID NO: 1394934 - RNA, 23 nt, Human
cagcuaagaaccuggaacuuggg

SEQ ID NO: 1394935 - RNA, 19 nt, Human
cagcuaagaaccuggaacu

SEQ ID NO: 1394936 - RNA, 18 nt, Human
cagcuaagaaccuggaac

SEQ ID NO: 1394937 - RNA, 16 nt, Human
cagcuaagaaccugga

SEQ ID NO: 1394938 - RNA, 14 nt, Human
cagcuaagaaccug

SEQ ID NO: 1394939 - RNA, 13 nt, Human
cagcuaagaaccu

SEQ ID NO: 1394940 - RNA, 12 nt, Human
cagcgccaggcu

SEQ ID NO: 1394941 - RNA, 21 nt, Human
cagcuaauaacugaucucguu

SEQ ID NO: 1394942 - RNA, 21 nt, Human
cagcuaagggguggggcugcg

SEQ ID NO: 1394943 - RNA, 19 nt, Human
cagcuaagggguggggcug

SEQ ID NO: 1394944 - RNA, 20 nt, Human
cagcuaagcucacguccuga

SEQ ID NO: 1394945 - RNA, 18 nt, Human
cagcgaccgcccccuccu

SEQ ID NO: 1394946 - RNA, 17 nt, Human
cagcgaccgcccccucc

SEQ ID NO: 1394947 - RNA, 16 nt, Human
cagcgaccgcccccuc

SEQ ID NO: 1394948 - RNA, 18 nt, Human
cagccuuuuuguuucaau

SEQ ID NO: 1394949 - RNA, 22 nt, Human
cagcgacuccguuggccacucc

SEQ ID NO: 1394950 - RNA, 21 nt, Human
cagcgacuccguuggccacuc

SEQ ID NO: 1394951 - RNA, 17 nt, Human
cagcgacuccguuggcc

SEQ ID NO: 1394952 - RNA, 18 nt, Human
cagcgaccuuccucaucc

SEQ ID NO: 1394953 - RNA, 23 nt, Human
cagcgauucccucucccaggccc

SEQ ID NO: 1394954 - RNA, 22 nt, Human
cagcgauucccucucccaggcc

SEQ ID NO: 1394955 - RNA, 21 nt, Human
cagcgauucccucucccaggc

SEQ ID NO: 1394956 - RNA, 20 nt, Human
cagcgauucccucucccagg

SEQ ID NO: 1394957 - RNA, 21 nt, Human
cagcgagcgcccagcuccuga

SEQ ID NO: 1394958 - RNA, 18 nt, Human
cagcgaggaggcuccaga

SEQ ID NO: 1394959 - RNA, 17 nt, Human
cagcgaggaggcuccag

SEQ ID NO: 1394960 - RNA, 16 nt, Human
cagcgaggaggcucca

SEQ ID NO: 1394961 - RNA, 20 nt, Human
cagcgagcgcccagcuccug

SEQ ID NO: 1394962 - RNA, 14 nt, Human
cagcgagccugcua

SEQ ID NO: 1394963 - RNA, 12 nt, Human
cagcgacuggca

SEQ ID NO: 1394964 - RNA, 13 nt, Human
cagcgagccugcu

SEQ ID NO: 1394965 - RNA, 12 nt, Human
cagcgagccugc

SEQ ID NO: 1394966 - RNA, 21 nt, Human
cagcgagauaccccaccuccc

SEQ ID NO: 1394967 - RNA, 22 nt, Human
cagcuagugacccacaugccau

SEQ ID NO: 1394968 - RNA, 21 nt, Human
cagcuagugacccacaugcca

SEQ ID NO: 1394969 - RNA, 20 nt, Human
cagcuagugacccacaugcc

SEQ ID NO: 1394970 - RNA, 19 nt, Human
cagcuagugacccacaugc

SEQ ID NO: 1394971 - RNA, 18 nt, Human
cagcuagugacccacaug

SEQ ID NO: 1394972 - RNA, 15 nt, Human
cagcuagugacccac

SEQ ID NO: 1394973 - RNA, 13 nt, Human
cagcuagugaccc

SEQ ID NO: 1394974 - RNA, 21 nt, Human
cagcuaggaagagcaggacuc

SEQ ID NO: 1394975 - RNA, 20 nt, Human
cagcuaggaagagcaggacu

SEQ ID NO: 1394976 - RNA, 16 nt, Human
cagcuaggaagagcag

SEQ ID NO: 1394977 - RNA, 15 nt, Human
cagcucaagagaucc

SEQ ID NO: 1394978 - RNA, 15 nt, Human
cagcuauuuugugaa

SEQ ID NO: 1394979 - RNA, 14 nt, Human
cagcuauuuuguga

SEQ ID NO: 1394980 - RNA, 21 nt, Human
cagcuauguuauauugaaaaa

SEQ ID NO: 1394981 - RNA, 20 nt, Human
cagcuauguuauauugaaaa

SEQ ID NO: 1394982 - RNA, 16 nt, Human
cagcucaauggacugg

SEQ ID NO: 1394983 - RNA, 22 nt, Human
cagcucaagagaucccaaguag

SEQ ID NO: 1394984 - RNA, 20 nt, Human
cagcucaauggacuggaagg

SEQ ID NO: 1394985 - RNA, 13 nt, Human
cagcucacugcaa

SEQ ID NO: 1394986 - RNA, 22 nt, Human
cagcucagaaguuucuucuuua

SEQ ID NO: 1394987 - RNA, 21 nt, Human
cagcucagaaguuucuucuuu

SEQ ID NO: 1394988 - RNA, 15 nt, Human
cagcucacugcaacc

SEQ ID NO: 1394989 - RNA, 14 nt, Human
cagccuggccuccu

SEQ ID NO: 1394990 - RNA, 13 nt, Human
cagccuggccucc

SEQ ID NO: 1394991 - RNA, 12 nt, Human
cagccuggccuc

SEQ ID NO: 1394992 - RNA, 11 nt, Human
cagccuggccu

SEQ ID NO: 1394993 - RNA, 20 nt, Human
cagccuggcccaccccaccc

SEQ ID NO: 1394994 - RNA, 12 nt, Human
cagccuggccca

SEQ ID NO: 1394995 - RNA, 20 nt, Human
cagccuggccagacacaggc

SEQ ID NO: 1394996 - RNA, 18 nt, Human
cagccuggccagacacag

SEQ ID NO: 1394997 - RNA, 17 nt, Human
cagccuggccagacaca

SEQ ID NO: 1394998 - RNA, 15 nt, Human
cagccuggccagaca

SEQ ID NO: 1394999 - RNA, 14 nt, Human
cagccuggccagac

SEQ ID NO: 1395000 - RNA, 13 nt, Human
cagccuggccaga

SEQ ID NO: 1395001 - RNA, 20 nt, Human
cagccuggccuccugccucu

SEQ ID NO: 1395002 - RNA, 21 nt, Human
cagccuggccuccugccucua

SEQ ID NO: 1395003 - RNA, 18 nt, Human
cagccuggccuccugccu

SEQ ID NO: 1395004 - RNA, 17 nt, Human
cagccuggccuccugcc

SEQ ID NO: 1395005 - RNA, 16 nt, Human
cagccuggccuccugc

SEQ ID NO: 1395006 - RNA, 15 nt, Human
cagccuggccuccug

SEQ ID NO: 1395007 - RNA, 23 nt, Human
cagccuggcuguggccuaaccug

SEQ ID NO: 1395008 - RNA, 14 nt, Human
cagccuggagcccu

SEQ ID NO: 1395009 - RNA, 19 nt, Human
cagccuggagcccuggaga

SEQ ID NO: 1395010 - RNA, 23 nt, Human
cagccucuccacucaugugacuc

SEQ ID NO: 1395011 - RNA, 18 nt, Human
cagccucccugaagccuu

SEQ ID NO: 1395012 - RNA, 17 nt, Human
cagccucccugaagccu

SEQ ID NO: 1395013 - RNA, 16 nt, Human
cagccucccugaagcc

SEQ ID NO: 1395014 - RNA, 14 nt, Human
cagccucccugaag

SEQ ID NO: 1395015 - RNA, 12 nt, Human
cagccucccuga

SEQ ID NO: 1395016 - RNA, 20 nt, Human
cagccucgccccuggcagag

SEQ ID NO: 1395017 - RNA, 19 nt, Human
cagccucgccccuggcaga

SEQ ID NO: 1395018 - RNA, 21 nt, Human
cagccucgccccuggcagaga

SEQ ID NO: 1395019 - RNA, 23 nt, Human
cagccugucagauccaggagcuc

SEQ ID NO: 1395020 - RNA, 22 nt, Human
cagccugucagauccaggagcu

SEQ ID NO: 1395021 - RNA, 21 nt, Human
cagccugucagauccaggagc

SEQ ID NO: 1395022 - RNA, 17 nt, Human
cagccugucagauccag

SEQ ID NO: 1395023 - RNA, 16 nt, Human
cagccugucagaucca

SEQ ID NO: 1395024 - RNA, 19 nt, Human
cagccuggggucuggaguu

SEQ ID NO: 1395025 - RNA, 15 nt, Human
cagccuggggucugg

SEQ ID NO: 1395026 - RNA, 21 nt, Human
cagccuggggcuggccuccca

SEQ ID NO: 1395027 - RNA, 18 nt, Human
cagccuggggcuggccuc

SEQ ID NO: 1395028 - RNA, 17 nt, Human
cagccuggggcuggccu

SEQ ID NO: 1395029 - RNA, 23 nt, Human
cagccugggcgcugguccuuucu

SEQ ID NO: 1395030 - RNA, 20 nt, Human
cagccugggcgcugguccuu

SEQ ID NO: 1395031 - RNA, 19 nt, Human
cagccugggcgcugguccu

SEQ ID NO: 1395032 - RNA, 16 nt, Human
cagccugggcgcuggu

SEQ ID NO: 1395033 - RNA, 15 nt, Human
cagccugggcgcugg

SEQ ID NO: 1395034 - RNA, 14 nt, Human
cagccugggcgcug

SEQ ID NO: 1395035 - RNA, 22 nt, Human
cagccugggccuauggagagcc

SEQ ID NO: 1395036 - RNA, 23 nt, Human
cagccugggccuauggagagccc

SEQ ID NO: 1395037 - RNA, 21 nt, Human
cagccugggccuauggagagc

SEQ ID NO: 1395038 - RNA, 20 nt, Human
cagccugggccuauggagag

SEQ ID NO: 1395039 - RNA, 18 nt, Human
cagccugggccuauggag

SEQ ID NO: 1395040 - RNA, 17 nt, Human
cagccugggccuaugga

SEQ ID NO: 1395041 - RNA, 16 nt, Human
cagccugggccuaugg

SEQ ID NO: 1395042 - RNA, 13 nt, Human
cagccugggccua

SEQ ID NO: 1395043 - RNA, 12 nt, Human
cagccugggccu

SEQ ID NO: 1395044 - RNA, 11 nt, Human
cagccugggcc

SEQ ID NO: 1395045 - RNA, 20 nt, Human
cagccugggaaagccccugc

SEQ ID NO: 1395046 - RNA, 12 nt, Human
cagccugggaaa

SEQ ID NO: 1395047 - RNA, 20 nt, Human
cagccuuuuuguuucaauga

SEQ ID NO: 1395048 - RNA, 23 nt, Human
cagccuuuguuccccacuggagc

SEQ ID NO: 1395049 - RNA, 22 nt, Human
cagccuuuguuccccacuggag

SEQ ID NO: 1395050 - RNA, 21 nt, Human
cagccuuuguuccccacugga

SEQ ID NO: 1395051 - RNA, 20 nt, Human
cagccuuuguuccccacugg

SEQ ID NO: 1395052 - RNA, 18 nt, Human
cagccuuuguuccccacu

SEQ ID NO: 1395053 - RNA, 16 nt, Human
cagccuuuguucccca

SEQ ID NO: 1395054 - RNA, 15 nt, Human
cagccuuuguucccc

SEQ ID NO: 1395055 - RNA, 14 nt, Human
cagccuuuguuccc

SEQ ID NO: 1395056 - RNA, 16 nt, Human
cagccuugccagagau

SEQ ID NO: 1395057 - RNA, 15 nt, Human
cagccuugccagaga

SEQ ID NO: 1395058 - RNA, 14 nt, Human
cagccuugccagag

SEQ ID NO: 1395059 - RNA, 13 nt, Human
cagccuugccaga

SEQ ID NO: 1395060 - RNA, 21 nt, Human
cagccuuagcucucccaacuc

SEQ ID NO: 1395061 - RNA, 23 nt, Human
cagccuucagacagagaggacug

SEQ ID NO: 1395062 - RNA, 19 nt, Human
cagccuuagcucucccaac

SEQ ID NO: 1395063 - RNA, 16 nt, Human
cagccuucuacugcuc

SEQ ID NO: 1395064 - RNA, 18 nt, Human
cagcugacuaaacuuuuu

SEQ ID NO: 1395065 - RNA, 13 nt, Human
cagcugacuaaac

SEQ ID NO: 1395066 - RNA, 23 nt, Human
cagcugcuccgaggacccaggaa

SEQ ID NO: 1395067 - RNA, 23 nt, Human
cagcuggaggcaggggcuuccug

SEQ ID NO: 1395068 - RNA, 22 nt, Human
cagcuggaggcaggggcuuccu

SEQ ID NO: 1395069 - RNA, 15 nt, Human
cagcuggaggcaggg

SEQ ID NO: 1395070 - RNA, 14 nt, Human
cagcuggaggcagg

SEQ ID NO: 1395071 - RNA, 13 nt, Human
cagcuggaggcag

SEQ ID NO: 1395072 - RNA, 18 nt, Human
cagcuggacccugaccag

SEQ ID NO: 1395073 - RNA, 16 nt, Human
cagcuggagaagaccc

SEQ ID NO: 1395074 - RNA, 23 nt, Human
cagcuggacccugaccagcuccc

SEQ ID NO: 1395075 - RNA, 17 nt, Human
cagcuggacccugacca

SEQ ID NO: 1395076 - RNA, 16 nt, Human
cagcuggacccugacc

SEQ ID NO: 1395077 - RNA, 23 nt, Human
cagcuggaugagaauuugagugc

SEQ ID NO: 1395078 - RNA, 18 nt, Human
cagcuggcucuacuuccc

SEQ ID NO: 1395079 - RNA, 22 nt, Human
cagcuggcucuacuuccccaug

SEQ ID NO: 1395080 - RNA, 16 nt, Human
cagcuggcucuacuuc

SEQ ID NO: 1395081 - RNA, 12 nt, Human
cagcuggcucua

SEQ ID NO: 1395082 - RNA, 16 nt, Human
cagcugggcucugcaa

SEQ ID NO: 1395083 - RNA, 15 nt, Human
cagcugggcucugca

SEQ ID NO: 1395084 - RNA, 17 nt, Human
cagcugggcucugcaau

SEQ ID NO: 1395085 - RNA, 18 nt, Human
cagcuggggccaggcugg

SEQ ID NO: 1395086 - RNA, 19 nt, Human
cagcuggggccaggcuggg

SEQ ID NO: 1395087 - RNA, 20 nt, Human
cagcuggggccaggcugggu

SEQ ID NO: 1395088 - RNA, 19 nt, Human
cagcugguguagcuacaga

SEQ ID NO: 1395089 - RNA, 15 nt, Human
cagcugguguagcua

SEQ ID NO: 1395090 - RNA, 14 nt, Human
cagcugguguagcu

SEQ ID NO: 1395091 - RNA, 11 nt, Human
cagcuggugua

SEQ ID NO: 1395092 - RNA, 23 nt, Human
cagcugguguagcuacagagaaa

SEQ ID NO: 1395093 - RNA, 22 nt, Human
cagcugguguagcuacagagaa

SEQ ID NO: 1395094 - RNA, 21 nt, Human
cagcugguguagcuacagaga

SEQ ID NO: 1395095 - RNA, 20 nt, Human
cagcugguguagcuacagag

SEQ ID NO: 1395096 - RNA, 18 nt, Human
cagcuguaugauucccag

SEQ ID NO: 1395097 - RNA, 23 nt, Human
cagcuggggugcagggauguggg

SEQ ID NO: 1395098 - RNA, 20 nt, Human
cagcugggucaggcagggug

SEQ ID NO: 1395099 - RNA, 18 nt, Human
cagcugggucaggcaggg

SEQ ID NO: 1395100 - RNA, 16 nt, Human
cagcugggucaggcag

SEQ ID NO: 1395101 - RNA, 15 nt, Human
cagcugggucaggca

SEQ ID NO: 1395102 - RNA, 14 nt, Human
cagcugggucaggc

SEQ ID NO: 1395103 - RNA, 19 nt, Human
cagcuggggugcagggaug

SEQ ID NO: 1395104 - RNA, 18 nt, Human
cagcuggggugcagggau

SEQ ID NO: 1395105 - RNA, 17 nt, Human
cagcuggggugcaggga

SEQ ID NO: 1395106 - RNA, 16 nt, Human
cagcuggggugcaggg

SEQ ID NO: 1395107 - RNA, 15 nt, Human
cagcuggggugcagg

SEQ ID NO: 1395108 - RNA, 14 nt, Human
cagcuggggugcag

SEQ ID NO: 1395109 - RNA, 21 nt, Human
cagcuggggccaggcuggguc

SEQ ID NO: 1395110 - RNA, 22 nt, Human
cagcuggggccaggcugggucg

SEQ ID NO: 1395111 - RNA, 23 nt, Human
cagcucuguucuuccucagccag

SEQ ID NO: 1395112 - RNA, 22 nt, Human
cagcucuguucuuccucagcca

SEQ ID NO: 1395113 - RNA, 21 nt, Human
cagcucuguucuuccucagcc

SEQ ID NO: 1395114 - RNA, 20 nt, Human
cagcucuguucuuccucagc

SEQ ID NO: 1395115 - RNA, 16 nt, Human
cagcucuguucuuccu

SEQ ID NO: 1395116 - RNA, 23 nt, Human
cagcucugggccauucuccacag

SEQ ID NO: 1395117 - RNA, 22 nt, Human
cagcucugggccauucuccaca

SEQ ID NO: 1395118 - RNA, 19 nt, Human
cagcucugggccauucucc

SEQ ID NO: 1395119 - RNA, 12 nt, Human
cagcucugggcc

SEQ ID NO: 1395120 - RNA, 18 nt, Human
cagcucuggaggggaggg

SEQ ID NO: 1395121 - RNA, 15 nt, Human
cagcuccuguaacau

SEQ ID NO: 1395122 - RNA, 22 nt, Human
cagcuccugaccaguugcaguc

SEQ ID NO: 1395123 - RNA, 20 nt, Human
cagcuccugaccaguugcag

SEQ ID NO: 1395124 - RNA, 19 nt, Human
cagcuccugaccaguugca

SEQ ID NO: 1395125 - RNA, 15 nt, Human
cagcuccugaccagu

SEQ ID NO: 1395126 - RNA, 19 nt, Human
cagcuccucugucucgagc

SEQ ID NO: 1395127 - RNA, 18 nt, Human
cagcuccucugucucgag

SEQ ID NO: 1395128 - RNA, 15 nt, Human
cagcuccucugucuc

SEQ ID NO: 1395129 - RNA, 14 nt, Human
cagcuccucugucu

SEQ ID NO: 1395130 - RNA, 14 nt, Human
cagcuccaaccugc

SEQ ID NO: 1395131 - RNA, 21 nt, Human
cagcucauccaugccucagaa

SEQ ID NO: 1395132 - RNA, 22 nt, Human
cagcucauccaugccucagaag

SEQ ID NO: 1395133 - RNA, 22 nt, Human
cagcucaggacagaugccacac

SEQ ID NO: 1395134 - RNA, 19 nt, Human
cagcucaggacagaugcca

SEQ ID NO: 1395135 - RNA, 18 nt, Human
cagcucaggacagaugcc

SEQ ID NO: 1395136 - RNA, 16 nt, Human
cagcucaggacagaug

SEQ ID NO: 1395137 - RNA, 13 nt, Human
cagcucaggacag

SEQ ID NO: 1395138 - RNA, 12 nt, Human
cagcucaggaca

SEQ ID NO: 1395139 - RNA, 21 nt, Human
cagcucagcacugccugcucc

SEQ ID NO: 1395140 - RNA, 20 nt, Human
cagcucagcacugccugcuc

SEQ ID NO: 1395141 - RNA, 15 nt, Human
cagcucagcacugcc

SEQ ID NO: 1395142 - RNA, 14 nt, Human
cagcucagcacugc

SEQ ID NO: 1395143 - RNA, 12 nt, Human
cagcucagcacu

SEQ ID NO: 1395144 - RNA, 11 nt, Human
cagcucuggag

SEQ ID NO: 1395145 - RNA, 23 nt, Human
cagcucuggacagccccacccug

SEQ ID NO: 1395146 - RNA, 21 nt, Human
cagcucuggacagccccaccc

SEQ ID NO: 1395147 - RNA, 18 nt, Human
cagcucuggacagcccca

SEQ ID NO: 1395148 - RNA, 17 nt, Human
cagcucuggacagcccc

SEQ ID NO: 1395149 - RNA, 21 nt, Human
cagcucugacauucugauucg

SEQ ID NO: 1395150 - RNA, 20 nt, Human
cagcucugacauucugauuc

SEQ ID NO: 1395151 - RNA, 14 nt, Human
cagcucugacauuc

SEQ ID NO: 1395152 - RNA, 16 nt, Human
cagcucugaaagagaa

SEQ ID NO: 1395153 - RNA, 12 nt, Human
cagcucugaaag

SEQ ID NO: 1395154 - RNA, 19 nt, Human
cagcucugaaaccaguguu

SEQ ID NO: 1395155 - RNA, 18 nt, Human
cagcucugaaaccagugu

SEQ ID NO: 1395156 - RNA, 13 nt, Human
cagcuccuuuggg

SEQ ID NO: 1395157 - RNA, 16 nt, Human
cagcuccuuccuggag

SEQ ID NO: 1395158 - RNA, 14 nt, Human
cagcuccuuccugg

SEQ ID NO: 1395159 - RNA, 13 nt, Human
cagcuccuuccug

SEQ ID NO: 1395160 - RNA, 15 nt, Human
cagcucuacccugca

SEQ ID NO: 1395161 - RNA, 19 nt, Human
cagcucuacccugcauggc

SEQ ID NO: 1395162 - RNA, 20 nt, Human
cagcucuagacacugccaca

SEQ ID NO: 1395163 - RNA, 15 nt, Human
cagcucuacuggucu

SEQ ID NO: 1395164 - RNA, 18 nt, Human
cagcucucaguugcagcc

SEQ ID NO: 1395165 - RNA, 16 nt, Human
cagcucuccccuucuc

SEQ ID NO: 1395166 - RNA, 19 nt, Human
cagcuuguagccagccggg

SEQ ID NO: 1395167 - RNA, 21 nt, Human
cagcuuguagccagccggggc

SEQ ID NO: 1395168 - RNA, 18 nt, Human
cagcuuguagccagccgg

SEQ ID NO: 1395169 - RNA, 17 nt, Human
cagcuuguagccagccg

SEQ ID NO: 1395170 - RNA, 16 nt, Human
cagcuuguagccagcc

SEQ ID NO: 1395171 - RNA, 15 nt, Human
cagcuuguagccagc

SEQ ID NO: 1395172 - RNA, 12 nt, Human
cagcuuguagcc

SEQ ID NO: 1395173 - RNA, 14 nt, Human
cagcuuuccuguau

SEQ ID NO: 1395174 - RNA, 19 nt, Human
cagcuuucccugccucuca

SEQ ID NO: 1395175 - RNA, 17 nt, Human
cagcuuucccugccucu

SEQ ID NO: 1395176 - RNA, 18 nt, Human
cagcuuuagaaucccagc

SEQ ID NO: 1395177 - RNA, 21 nt, Human
cagcuuuauggagauauaauu

SEQ ID NO: 1395178 - RNA, 13 nt, Human
cagcuuguuuaca

SEQ ID NO: 1395179 - RNA, 21 nt, Human
cagcuuguggcaagugaauuu

SEQ ID NO: 1395180 - RNA, 20 nt, Human
cagcuuguggcaagugaauu

SEQ ID NO: 1395181 - RNA, 18 nt, Human
cagcuuguggcaagugaa

SEQ ID NO: 1395182 - RNA, 21 nt, Human
cagcuuguuuacaugcuuauu

SEQ ID NO: 1395183 - RNA, 15 nt, Human
cagcuuguuuacaug

SEQ ID NO: 1395184 - RNA, 14 nt, Human
cagcuuguuuacau

SEQ ID NO: 1395185 - RNA, 18 nt, Human
cagcuuguuuacaugcuu

SEQ ID NO: 1395186 - RNA, 14 nt, Human
cagcuuuagccaag

SEQ ID NO: 1395187 - RNA, 11 nt, Human
cagcuuugcua

SEQ ID NO: 1395188 - RNA, 22 nt, Human
cagcuuugcuaccaaagcaccu

SEQ ID NO: 1395189 - RNA, 18 nt, Human
caggaaccacaagacugc

SEQ ID NO: 1395190 - RNA, 12 nt, Human
cagcuuuugcaa

SEQ ID NO: 1395191 - RNA, 11 nt, Human
cagcuuuucaa

SEQ ID NO: 1395192 - RNA, 18 nt, Human
cagcuuuuaaaagauuuu

SEQ ID NO: 1395193 - RNA, 13 nt, Human
cagcuuuucaaac

SEQ ID NO: 1395194 - RNA, 18 nt, Human
cagcuuuucccaaaagcc

SEQ ID NO: 1395195 - RNA, 20 nt, Human
cagcuuuucccaaaagccca

SEQ ID NO: 1395196 - RNA, 23 nt, Human
cagcuugaccugaggcugugguc

SEQ ID NO: 1395197 - RNA, 22 nt, Human
cagcuugaccugaggcuguggu

SEQ ID NO: 1395198 - RNA, 21 nt, Human
cagcuugaccugaggcugugg

SEQ ID NO: 1395199 - RNA, 20 nt, Human
cagcuugaccugaggcugug

SEQ ID NO: 1395200 - RNA, 19 nt, Human
cagcuugaccugaggcugu

SEQ ID NO: 1395201 - RNA, 17 nt, Human
cagcuugaccugaggcu

SEQ ID NO: 1395202 - RNA, 16 nt, Human
cagcuugaccugaggc

SEQ ID NO: 1395203 - RNA, 15 nt, Human
cagcuugaccugagg

SEQ ID NO: 1395204 - RNA, 19 nt, Human
cagcuugaucaaaggcaca

SEQ ID NO: 1395205 - RNA, 23 nt, Human
cagcuugaucaaaggcacacagc

SEQ ID NO: 1395206 - RNA, 19 nt, Human
cagcuucugcccccugcag

SEQ ID NO: 1395207 - RNA, 20 nt, Human
cagcuucugcccccugcaga

SEQ ID NO: 1395208 - RNA, 16 nt, Human
cagcuucugcccccug

SEQ ID NO: 1395209 - RNA, 14 nt, Human
cagcuucugccccc

SEQ ID NO: 1395210 - RNA, 21 nt, Human
cagcuuccuucagagagcagu

SEQ ID NO: 1395211 - RNA, 21 nt, Human
cagcuucucauccugcaggca

SEQ ID NO: 1395212 - RNA, 20 nt, Human
cagcuucucauccugcaggc

SEQ ID NO: 1395213 - RNA, 19 nt, Human
cagcuucucauccugcagg

SEQ ID NO: 1395214 - RNA, 18 nt, Human
cagcuucucauccugcag

SEQ ID NO: 1395215 - RNA, 22 nt, Human
cagcuucguuuauuuucaagaa

SEQ ID NO: 1395216 - RNA, 20 nt, Human
cagcuucguuuauuuucaag

SEQ ID NO: 1395217 - RNA, 20 nt, Human
cagcuuccuucagagagcag

SEQ ID NO: 1395218 - RNA, 19 nt, Human
cagcuuccuucagagagca

SEQ ID NO: 1395219 - RNA, 16 nt, Human
cagcuuccuucagaga

SEQ ID NO: 1395220 - RNA, 15 nt, Human
cagcuuccuucagag

SEQ ID NO: 1395221 - RNA, 14 nt, Human
cagcuuccuucaga

SEQ ID NO: 1395222 - RNA, 13 nt, Human
cagcuuccuucag

SEQ ID NO: 1395223 - RNA, 14 nt, Human
cagcuguauagcug

SEQ ID NO: 1395224 - RNA, 16 nt, Human
cagcuguaaucuauga

SEQ ID NO: 1395225 - RNA, 19 nt, Human
cagcuguaugauucccagc

SEQ ID NO: 1395226 - RNA, 17 nt, Human
caggaauauuuuccaaa

SEQ ID NO: 1395227 - RNA, 22 nt, Human
caggaaggcuuguugugcuuuu

SEQ ID NO: 1395228 - RNA, 19 nt, Human
caggaaggagcugccugga

SEQ ID NO: 1395229 - RNA, 18 nt, Human
caggaaggagcugccugg

SEQ ID NO: 1395230 - RNA, 17 nt, Human
caggaaggagcugccug

SEQ ID NO: 1395231 - RNA, 16 nt, Human
caggaaggagcugccu

SEQ ID NO: 1395232 - RNA, 15 nt, Human
caggaaggagcugcc

SEQ ID NO: 1395233 - RNA, 14 nt, Human
caggaaggagcugc

SEQ ID NO: 1395234 - RNA, 13 nt, Human
caggaaggagcug

SEQ ID NO: 1395235 - RNA, 12 nt, Human
caggaaggagcu

SEQ ID NO: 1395236 - RNA, 13 nt, Human
caggaaggcuugu

SEQ ID NO: 1395237 - RNA, 22 nt, Human
caggaaggagcugccuggaccc

SEQ ID NO: 1395238 - RNA, 21 nt, Human
caggaaggagcugccuggacc

SEQ ID NO: 1395239 - RNA, 20 nt, Human
caggaaggagcugccuggac

SEQ ID NO: 1395240 - RNA, 22 nt, Human
caggaccuucgggcugugcccg

SEQ ID NO: 1395241 - RNA, 21 nt, Human
caggaccuucgggcugugccc

SEQ ID NO: 1395242 - RNA, 20 nt, Human
caggaccuucgggcugugcc

SEQ ID NO: 1395243 - RNA, 18 nt, Human
caggaccuggcugccaua

SEQ ID NO: 1395244 - RNA, 17 nt, Human
caggaccuggcugccau

SEQ ID NO: 1395245 - RNA, 16 nt, Human
caggaccuggcugcca

SEQ ID NO: 1395246 - RNA, 14 nt, Human
caggaccuggcugc

SEQ ID NO: 1395247 - RNA, 22 nt, Human
caggacacaggccuguguagcu

SEQ ID NO: 1395248 - RNA, 20 nt, Human
caggacacaggccuguguag

SEQ ID NO: 1395249 - RNA, 19 nt, Human
caggacacaggccugugua

SEQ ID NO: 1395250 - RNA, 18 nt, Human
caggacacaggccugugu

SEQ ID NO: 1395251 - RNA, 17 nt, Human
caggacacaggccugug

SEQ ID NO: 1395252 - RNA, 16 nt, Human
caggacacaggccugu

SEQ ID NO: 1395253 - RNA, 15 nt, Human
caggacacaggccug

SEQ ID NO: 1395254 - RNA, 14 nt, Human
caggacacaggccu

SEQ ID NO: 1395255 - RNA, 13 nt, Human
caggacacaggcc

SEQ ID NO: 1395256 - RNA, 12 nt, Human
caggacacaggc

SEQ ID NO: 1395257 - RNA, 14 nt, Human
caggacaagcaugg

SEQ ID NO: 1395258 - RNA, 21 nt, Human
caggaauucuuggagaaaaug

SEQ ID NO: 1395259 - RNA, 21 nt, Human
caggaauuucccaggacccug

SEQ ID NO: 1395260 - RNA, 20 nt, Human
caggaauuucccaggacccu

SEQ ID NO: 1395261 - RNA, 19 nt, Human
caggaauuucccaggaccc

SEQ ID NO: 1395262 - RNA, 18 nt, Human
caggaauuucccaggacc

SEQ ID NO: 1395263 - RNA, 17 nt, Human
caggaauuucccaggac

SEQ ID NO: 1395264 - RNA, 16 nt, Human
caggaauuucccagga

SEQ ID NO: 1395265 - RNA, 15 nt, Human
caggaaucuuaaggu

SEQ ID NO: 1395266 - RNA, 14 nt, Human
caggaaucuuaagg

SEQ ID NO: 1395267 - RNA, 16 nt, Human
caggaaucaguuuaaa

SEQ ID NO: 1395268 - RNA, 21 nt, Human
caggaaucaguuuaaaagcac

SEQ ID NO: 1395269 - RNA, 19 nt, Human
caggaaggacuaugaaaag

SEQ ID NO: 1395270 - RNA, 16 nt, Human
caggaaggacuaugaa

SEQ ID NO: 1395271 - RNA, 22 nt, Human
caggaagcuuuggugagaaccu

SEQ ID NO: 1395272 - RNA, 23 nt, Human
caggaagcuuuggugagaaccug

SEQ ID NO: 1395273 - RNA, 21 nt, Human
caggaagcuuuggugagaacc

SEQ ID NO: 1395274 - RNA, 22 nt, Human
caggaagcugugagagcaguuu

SEQ ID NO: 1395275 - RNA, 13 nt, Human
caggaagcuguga

SEQ ID NO: 1395276 - RNA, 14 nt, Human
caggaagcugugag

SEQ ID NO: 1395277 - RNA, 14 nt, Human
caggaagccuuccc

SEQ ID NO: 1395278 - RNA, 21 nt, Human
caggaagccugcaguccugga

SEQ ID NO: 1395279 - RNA, 19 nt, Human
caggaagccugcaguccug

SEQ ID NO: 1395280 - RNA, 13 nt, Human
caggaagccugca

SEQ ID NO: 1395281 - RNA, 18 nt, Human
caggaagccguccuggcg

SEQ ID NO: 1395282 - RNA, 15 nt, Human
caggaagccguccug

SEQ ID NO: 1395283 - RNA, 18 nt, Human
caggaagcccaauugcug

SEQ ID NO: 1395284 - RNA, 16 nt, Human
caggaagcccaauugc

SEQ ID NO: 1395285 - RNA, 13 nt, Human
caggaacugggcc

SEQ ID NO: 1395286 - RNA, 12 nt, Human
caggaacugggc

SEQ ID NO: 1395287 - RNA, 18 nt, Human
caggaaccgaggcaggga

SEQ ID NO: 1395288 - RNA, 17 nt, Human
caggaaccgaggcaggg

SEQ ID NO: 1395289 - RNA, 15 nt, Human
caggaaccgaggcag

SEQ ID NO: 1395290 - RNA, 19 nt, Human
caggaagaucccccagaaa

SEQ ID NO: 1395291 - RNA, 14 nt, Human
caggaagagaagga

SEQ ID NO: 1395292 - RNA, 15 nt, Human
caggaagagaaggag

SEQ ID NO: 1395293 - RNA, 17 nt, Human
caggaagagaaggagca

SEQ ID NO: 1395294 - RNA, 17 nt, Human
caggaagaucccccaga

SEQ ID NO: 1395295 - RNA, 18 nt, Human
caggaagaucccccagaa

SEQ ID NO: 1395296 - RNA, 19 nt, Human
caggaucucaccaggcagc

SEQ ID NO: 1395297 - RNA, 19 nt, Human
caggauagagacuggaaca

SEQ ID NO: 1395298 - RNA, 13 nt, Human
caggagugugugu

SEQ ID NO: 1395299 - RNA, 21 nt, Human
caggaguguccucuucccucu

SEQ ID NO: 1395300 - RNA, 19 nt, Human
caggaguguccucuucccu

SEQ ID NO: 1395301 - RNA, 17 nt, Human
caggaguguccucuucc

SEQ ID NO: 1395302 - RNA, 17 nt, Human
caggaguggguggggag

SEQ ID NO: 1395303 - RNA, 16 nt, Human
caggagugggugggga

SEQ ID NO: 1395304 - RNA, 14 nt, Human
caggaguggguggg

SEQ ID NO: 1395305 - RNA, 18 nt, Human
caggaguggguggggagu

SEQ ID NO: 1395306 - RNA, 19 nt, Human
caggaguuucguuuucaaa

SEQ ID NO: 1395307 - RNA, 19 nt, Human
caggacuccaggcccaagg

SEQ ID NO: 1395308 - RNA, 21 nt, Human
caggacuccaggcccaaggcu

SEQ ID NO: 1395309 - RNA, 18 nt, Human
caggacuccaggcccaag

SEQ ID NO: 1395310 - RNA, 17 nt, Human
caggacuccaggcccaa

SEQ ID NO: 1395311 - RNA, 16 nt, Human
caggacuccaggccca

SEQ ID NO: 1395312 - RNA, 20 nt, Human
caggacuauauuugggccug

SEQ ID NO: 1395313 - RNA, 23 nt, Human
caggacuaacacucagaagccug

SEQ ID NO: 1395314 - RNA, 22 nt, Human
caggacuaacacucagaagccu

SEQ ID NO: 1395315 - RNA, 21 nt, Human
caggacuaacacucagaagcc

SEQ ID NO: 1395316 - RNA, 20 nt, Human
caggacuaacacucagaagc

SEQ ID NO: 1395317 - RNA, 19 nt, Human
caggacuaacacucagaag

SEQ ID NO: 1395318 - RNA, 17 nt, Human
caggacuaacacucaga

SEQ ID NO: 1395319 - RNA, 23 nt, Human
caggacugggagcccccagccug

SEQ ID NO: 1395320 - RNA, 21 nt, Human
caggacugggagcccccagcc

SEQ ID NO: 1395321 - RNA, 18 nt, Human
caggacugggagccccca

SEQ ID NO: 1395322 - RNA, 14 nt, Human
caggacugggagcc

SEQ ID NO: 1395323 - RNA, 13 nt, Human
caggacugggagc

SEQ ID NO: 1395324 - RNA, 14 nt, Human
caggacuguccccu

SEQ ID NO: 1395325 - RNA, 22 nt, Human
caggacuguccccuugaaggag

SEQ ID NO: 1395326 - RNA, 23 nt, Human
caggacuguccccuugaaggaga

SEQ ID NO: 1395327 - RNA, 18 nt, Human
caggacugaugucuccua

SEQ ID NO: 1395328 - RNA, 23 nt, Human
caggacugaugucuccuaagcac

SEQ ID NO: 1395329 - RNA, 17 nt, Human
caggacugaugucuccu

SEQ ID NO: 1395330 - RNA, 12 nt, Human
caggacugaugu

SEQ ID NO: 1395331 - RNA, 21 nt, Human
caggacucugcagccucagag

SEQ ID NO: 1395332 - RNA, 20 nt, Human
caggacucugcagccucaga

SEQ ID NO: 1395333 - RNA, 19 nt, Human
caggacucugcagccucag

SEQ ID NO: 1395334 - RNA, 18 nt, Human
caggacucugcagccuca

SEQ ID NO: 1395335 - RNA, 17 nt, Human
caggacucugcagccuc

SEQ ID NO: 1395336 - RNA, 16 nt, Human
caggacucugcagccu

SEQ ID NO: 1395337 - RNA, 15 nt, Human
caggacucugcagcc

SEQ ID NO: 1395338 - RNA, 14 nt, Human
caggacucugcagc

SEQ ID NO: 1395339 - RNA, 13 nt, Human
caggacucugcag

SEQ ID NO: 1395340 - RNA, 11 nt, Human
caggacucugc

SEQ ID NO: 1395341 - RNA, 17 nt, Human
caggagcacggcucugu

SEQ ID NO: 1395342 - RNA, 16 nt, Human
caggagcacggcucug

SEQ ID NO: 1395343 - RNA, 16 nt, Human
caggagaagcucagcu

SEQ ID NO: 1395344 - RNA, 15 nt, Human
caggagaagcucagc

SEQ ID NO: 1395345 - RNA, 14 nt, Human
caggagaagcucag

SEQ ID NO: 1395346 - RNA, 13 nt, Human
caggagaagcuca

SEQ ID NO: 1395347 - RNA, 21 nt, Human
caggagaagaaagaggugacc

SEQ ID NO: 1395348 - RNA, 20 nt, Human
caggagaagaaagaggugac

SEQ ID NO: 1395349 - RNA, 14 nt, Human
caggagaagaaaga

SEQ ID NO: 1395350 - RNA, 16 nt, Human
caggacuugaaagaaa

SEQ ID NO: 1395351 - RNA, 22 nt, Human
caggacugggagcccccagccu

SEQ ID NO: 1395352 - RNA, 19 nt, Human
caggagagaguugaaccua

SEQ ID NO: 1395353 - RNA, 22 nt, Human
caggagaaggccaauuccuaua

SEQ ID NO: 1395354 - RNA, 21 nt, Human
caggagaaggccaauuccuau

SEQ ID NO: 1395355 - RNA, 19 nt, Human
caggagaaggccaauuccu

SEQ ID NO: 1395356 - RNA, 19 nt, Human
caggagaagcucagcugca

SEQ ID NO: 1395357 - RNA, 17 nt, Human
caggagaagcucagcug

SEQ ID NO: 1395358 - RNA, 20 nt, Human
caggagaagcucagcugcau

SEQ ID NO: 1395359 - RNA, 23 nt, Human
caggagacagguuagcugcuccc

SEQ ID NO: 1395360 - RNA, 19 nt, Human
caggagcacggcucugucc

SEQ ID NO: 1395361 - RNA, 11 nt, Human
caggagcccug

SEQ ID NO: 1395362 - RNA, 14 nt, Human
caggagcccuggga

SEQ ID NO: 1395363 - RNA, 16 nt, Human
caggagcccugggagg

SEQ ID NO: 1395364 - RNA, 18 nt, Human
caggagcccugggaggcu

SEQ ID NO: 1395365 - RNA, 19 nt, Human
caggagcccugggaggcuc

SEQ ID NO: 1395366 - RNA, 18 nt, Human
caggaguccacuuuguuu

SEQ ID NO: 1395367 - RNA, 14 nt, Human
caggaguccacuuu

SEQ ID NO: 1395368 - RNA, 18 nt, Human
caggaguagcugagcuca

SEQ ID NO: 1395369 - RNA, 20 nt, Human
caggaguagcugagcucaca

SEQ ID NO: 1395370 - RNA, 17 nt, Human
caggaguagcugagcuc

SEQ ID NO: 1395371 - RNA, 16 nt, Human
caggaguagcugagcu

SEQ ID NO: 1395372 - RNA, 15 nt, Human
caggaguagcugagc

SEQ ID NO: 1395373 - RNA, 14 nt, Human
caggaguagcugag

SEQ ID NO: 1395374 - RNA, 13 nt, Human
caggaguagcuga

SEQ ID NO: 1395375 - RNA, 21 nt, Human
caggagcuccccuccccaacu

SEQ ID NO: 1395376 - RNA, 18 nt, Human
caggagcuccccucccca

SEQ ID NO: 1395377 - RNA, 16 nt, Human
caggagcuccccuccc

SEQ ID NO: 1395378 - RNA, 14 nt, Human
caggagcuccccuc

SEQ ID NO: 1395379 - RNA, 13 nt, Human
caggagcuccccu

SEQ ID NO: 1395380 - RNA, 22 nt, Human
caggagcuccaguguccugagc

SEQ ID NO: 1395381 - RNA, 23 nt, Human
caggagcuccaguguccugagcu

SEQ ID NO: 1395382 - RNA, 21 nt, Human
caggagcuccaguguccugag

SEQ ID NO: 1395383 - RNA, 23 nt, Human
caggagcuaccuguguggacagg

SEQ ID NO: 1395384 - RNA, 22 nt, Human
caggagcuaccuguguggacag

SEQ ID NO: 1395385 - RNA, 18 nt, Human
caggagcuaccugugugg

SEQ ID NO: 1395386 - RNA, 17 nt, Human
caggagcuaccugugug

SEQ ID NO: 1395387 - RNA, 14 nt, Human
caggagccugugac

SEQ ID NO: 1395388 - RNA, 16 nt, Human
caggagccugugccuc

SEQ ID NO: 1395389 - RNA, 15 nt, Human
caggagccugugccu

SEQ ID NO: 1395390 - RNA, 11 nt, Human
caggagccugu

SEQ ID NO: 1395391 - RNA, 12 nt, Human
caggagccuggc

SEQ ID NO: 1395392 - RNA, 11 nt, Human
caggagccugg

SEQ ID NO: 1395393 - RNA, 21 nt, Human
caggagcccugggaggcucug

SEQ ID NO: 1395394 - RNA, 12 nt, Human
caggccaggucc

SEQ ID NO: 1395395 - RNA, 16 nt, Human
caggccagguccagag

SEQ ID NO: 1395396 - RNA, 18 nt, Human
caggccacacuucaaacu

SEQ ID NO: 1395397 - RNA, 21 nt, Human
caggccacacuucaaacuacu

SEQ ID NO: 1395398 - RNA, 16 nt, Human
caggccacacuucaaa

SEQ ID NO: 1395399 - RNA, 17 nt, Human
caggccaagaaacgucu

SEQ ID NO: 1395400 - RNA, 22 nt, Human
caggccaaaggggaccuggaag

SEQ ID NO: 1395401 - RNA, 21 nt, Human
caggccaaaggggaccuggaa

SEQ ID NO: 1395402 - RNA, 19 nt, Human
caggccaaaggggaccugg

SEQ ID NO: 1395403 - RNA, 22 nt, Human
caggccaaagagucuccaguuu

SEQ ID NO: 1395404 - RNA, 19 nt, Human
caggcauuuccuggguggc

SEQ ID NO: 1395405 - RNA, 18 nt, Human
caggcauuuccugggugg

SEQ ID NO: 1395406 - RNA, 17 nt, Human
caggcauuuccugggug

SEQ ID NO: 1395407 - RNA, 22 nt, Human
caggccccaugaccuccagcuu

SEQ ID NO: 1395408 - RNA, 20 nt, Human
caggccccaugaccuccagc

SEQ ID NO: 1395409 - RNA, 19 nt, Human
caggccccaugaccuccag

SEQ ID NO: 1395410 - RNA, 18 nt, Human
caggccccaugaccucca

SEQ ID NO: 1395411 - RNA, 17 nt, Human
caggccccaugaccucc

SEQ ID NO: 1395412 - RNA, 16 nt, Human
caggccccaugaccuc

SEQ ID NO: 1395413 - RNA, 14 nt, Human
caggccccaugacc

SEQ ID NO: 1395414 - RNA, 15 nt, Human
caggccccaggaaag

SEQ ID NO: 1395415 - RNA, 21 nt, Human
caggcccagccgacccccucu

SEQ ID NO: 1395416 - RNA, 22 nt, Human
caggcccagccgacccccucuc

SEQ ID NO: 1395417 - RNA, 20 nt, Human
caggcccagccgacccccuc

SEQ ID NO: 1395418 - RNA, 19 nt, Human
caggcccagccgacccccu

SEQ ID NO: 1395419 - RNA, 16 nt, Human
caggcccagccgaccc

SEQ ID NO: 1395420 - RNA, 17 nt, Human
caggcccacugugccuc

SEQ ID NO: 1395421 - RNA, 19 nt, Human
caggcccacugugccucag

SEQ ID NO: 1395422 - RNA, 16 nt, Human
caggcccacugugccu

SEQ ID NO: 1395423 - RNA, 15 nt, Human
caggcccacugugcc

SEQ ID NO: 1395424 - RNA, 17 nt, Human
caggcccaaggcucccg

SEQ ID NO: 1395425 - RNA, 16 nt, Human
caggcccaaggcuccc

SEQ ID NO: 1395426 - RNA, 19 nt, Human
caggcccccaccuggcuca

SEQ ID NO: 1395427 - RNA, 18 nt, Human
caggcccccaccuggcuc

SEQ ID NO: 1395428 - RNA, 17 nt, Human
caggcccccaccuggcu

SEQ ID NO: 1395429 - RNA, 21 nt, Human
caggcccccgccuuggccugu

SEQ ID NO: 1395430 - RNA, 20 nt, Human
caggcccccgccuuggccug

SEQ ID NO: 1395431 - RNA, 17 nt, Human
caggcccccgccuuggc

SEQ ID NO: 1395432 - RNA, 16 nt, Human
caggcccccgccuugg

SEQ ID NO: 1395433 - RNA, 21 nt, Human
caggccccgugaggcaauggg

SEQ ID NO: 1395434 - RNA, 20 nt, Human
caggauguguuugcuuucug

SEQ ID NO: 1395435 - RNA, 18 nt, Human
caggauguguuugcuuuc

SEQ ID NO: 1395436 - RNA, 15 nt, Human
caggauguguuugcu

SEQ ID NO: 1395437 - RNA, 23 nt, Human
caggaugguucccuugaugaaga

SEQ ID NO: 1395438 - RNA, 21 nt, Human
caggaugguucccuugaugaa

SEQ ID NO: 1395439 - RNA, 21 nt, Human
caggauggcaaccagaccauu

SEQ ID NO: 1395440 - RNA, 23 nt, Human
caggaugggguauggauucuaaa

SEQ ID NO: 1395441 - RNA, 18 nt, Human
caggauggucuccaucuc

SEQ ID NO: 1395442 - RNA, 23 nt, Human
caggaugcuaacaucuaaaaaua

SEQ ID NO: 1395443 - RNA, 22 nt, Human
caggaugaugacuauggaaaga

SEQ ID NO: 1395444 - RNA, 22 nt, Human
caggaugagggaaaagaaaaag

SEQ ID NO: 1395445 - RNA, 18 nt, Human
caggaugagggaaaagaa

SEQ ID NO: 1395446 - RNA, 18 nt, Human
caggaugaugacuaugga

SEQ ID NO: 1395447 - RNA, 20 nt, Human
caggaugaugacuauggaaa

SEQ ID NO: 1395448 - RNA, 15 nt, Human
caggaucaguuaacu

SEQ ID NO: 1395449 - RNA, 16 nt, Human
caggauagagacugga

SEQ ID NO: 1395450 - RNA, 14 nt, Human
caggauagagacug

SEQ ID NO: 1395451 - RNA, 21 nt, Human
caggauauucucacagcucca

SEQ ID NO: 1395452 - RNA, 22 nt, Human
caggaucucaccaggcagccuc

SEQ ID NO: 1395453 - RNA, 18 nt, Human
caggaucucaccaggcag

SEQ ID NO: 1395454 - RNA, 17 nt, Human
caggaucucaccaggca

SEQ ID NO: 1395455 - RNA, 21 nt, Human
caggaucuauuuuuggagguu

SEQ ID NO: 1395456 - RNA, 20 nt, Human
caggaucuauuuuuggaggu

SEQ ID NO: 1395457 - RNA, 19 nt, Human
caggaucuauuuuuggagg

SEQ ID NO: 1395458 - RNA, 18 nt, Human
caggaucuauuuuuggag

SEQ ID NO: 1395459 - RNA, 12 nt, Human
caggaucuauuu

SEQ ID NO: 1395460 - RNA, 22 nt, Human
caggauccccaaggcacuugag

SEQ ID NO: 1395461 - RNA, 17 nt, Human
caggaucaguuaacuau

SEQ ID NO: 1395462 - RNA, 17 nt, Human
caggauccaagcuaagc

SEQ ID NO: 1395463 - RNA, 13 nt, Human
caggauccaggcc

SEQ ID NO: 1395464 - RNA, 20 nt, Human
caggcaggucugaagcucaa

SEQ ID NO: 1395465 - RNA, 15 nt, Human
caggcagggugcagu

SEQ ID NO: 1395466 - RNA, 12 nt, Human
caggcauccucc

SEQ ID NO: 1395467 - RNA, 18 nt, Human
caggcagccagcaucugg

SEQ ID NO: 1395468 - RNA, 21 nt, Human
caggcaucggggagccgggag

SEQ ID NO: 1395469 - RNA, 20 nt, Human
caggcaucggggagccggga

SEQ ID NO: 1395470 - RNA, 16 nt, Human
caggcauuuccugggu

SEQ ID NO: 1395471 - RNA, 15 nt, Human
caggcauuuccuggg

SEQ ID NO: 1395472 - RNA, 14 nt, Human
caggcauuuccugg

SEQ ID NO: 1395473 - RNA, 15 nt, Human
caggcauuggauauu

SEQ ID NO: 1395474 - RNA, 19 nt, Human
caggcauugccaagggcuu

SEQ ID NO: 1395475 - RNA, 14 nt, Human
caggcaaggcugug

SEQ ID NO: 1395476 - RNA, 13 nt, Human
caggcaaggcugu

SEQ ID NO: 1395477 - RNA, 17 nt, Human
caggcaaggcuguggac

SEQ ID NO: 1395478 - RNA, 21 nt, Human
caggcagccagcaucugggcc

SEQ ID NO: 1395479 - RNA, 22 nt, Human
caggcaacgcacaaaacagaaa

SEQ ID NO: 1395480 - RNA, 18 nt, Human
caggcaaaauccuugcuu

SEQ ID NO: 1395481 - RNA, 14 nt, Human
caggcaaaauccuu

SEQ ID NO: 1395482 - RNA, 24 nt, Human
caggauuggggaagagagccugca

SEQ ID NO: 1395483 - RNA, 20 nt, Human
caggauuggggaagagagcc

SEQ ID NO: 1395484 - RNA, 15 nt, Human
caggauuggggaaga

SEQ ID NO: 1395485 - RNA, 14 nt, Human
caggauuggggaag

SEQ ID NO: 1395486 - RNA, 23 nt, Human
caggauugcgagagauguguguu

SEQ ID NO: 1395487 - RNA, 22 nt, Human
caggauugcgagagaugugugu

SEQ ID NO: 1395488 - RNA, 21 nt, Human
caggauugcgagagaugugug

SEQ ID NO: 1395489 - RNA, 20 nt, Human
caggauugcgagagaugugu

SEQ ID NO: 1395490 - RNA, 19 nt, Human
caggauugcgagagaugug

SEQ ID NO: 1395491 - RNA, 18 nt, Human
caggauugcgagagaugu

SEQ ID NO: 1395492 - RNA, 17 nt, Human
caggauugcgagagaug

SEQ ID NO: 1395493 - RNA, 16 nt, Human
caggauugcgagagau

SEQ ID NO: 1395494 - RNA, 13 nt, Human
caggauugcgaga

SEQ ID NO: 1395495 - RNA, 22 nt, Human
caggcagcuuuuucucucccac

SEQ ID NO: 1395496 - RNA, 19 nt, Human
caggcagcuuuuucucucc

SEQ ID NO: 1395497 - RNA, 19 nt, Human
caggcagccucuggggggu

SEQ ID NO: 1395498 - RNA, 16 nt, Human
caggcagccucugggg

SEQ ID NO: 1395499 - RNA, 15 nt, Human
caggcagccucuggg

SEQ ID NO: 1395500 - RNA, 14 nt, Human
caggcagccucugg

SEQ ID NO: 1395501 - RNA, 23 nt, Human
caggcagccagugcccugagcca

SEQ ID NO: 1395502 - RNA, 13 nt, Human
caggcagccucug

SEQ ID NO: 1395503 - RNA, 24 nt, Human
caggcagccagugcccugagccag

SEQ ID NO: 1395504 - RNA, 20 nt, Human
caggcagccagugcccugag

SEQ ID NO: 1395505 - RNA, 19 nt, Human
caggcagccagugcccuga

SEQ ID NO: 1395506 - RNA, 15 nt, Human
caggcagccagugcc

SEQ ID NO: 1395507 - RNA, 12 nt, Human
caggcagccagu

SEQ ID NO: 1395508 - RNA, 16 nt, Human
caggcaggggccucca

SEQ ID NO: 1395509 - RNA, 15 nt, Human
caggcaggggccucc

SEQ ID NO: 1395510 - RNA, 13 nt, Human
caggcaggggccu

SEQ ID NO: 1395511 - RNA, 21 nt, Human
caggcagggcucuccuggcuu

SEQ ID NO: 1395512 - RNA, 23 nt, Human
caggcagggcucuccuggcuucc

SEQ ID NO: 1395513 - RNA, 20 nt, Human
caggcagggcucuccuggcu

SEQ ID NO: 1395514 - RNA, 19 nt, Human
caggcagggcucuccuggc

SEQ ID NO: 1395515 - RNA, 18 nt, Human
caggcaggggccuccaug

SEQ ID NO: 1395516 - RNA, 21 nt, Human
caggcaggggccuccaugggc

SEQ ID NO: 1395517 - RNA, 18 nt, Human
caggcagggcucuccugg

SEQ ID NO: 1395518 - RNA, 17 nt, Human
caggcagggcucuccug

SEQ ID NO: 1395519 - RNA, 16 nt, Human
caggcagggcucuccu

SEQ ID NO: 1395520 - RNA, 15 nt, Human
caggcagggcucucc

SEQ ID NO: 1395521 - RNA, 14 nt, Human
caggcagggcucuc

SEQ ID NO: 1395522 - RNA, 13 nt, Human
caggcagggcucu

SEQ ID NO: 1395523 - RNA, 12 nt, Human
caggcagggcuc

SEQ ID NO: 1395524 - RNA, 11 nt, Human
caggcagggcu

SEQ ID NO: 1395525 - RNA, 16 nt, Human
caggcaggcucccagg

SEQ ID NO: 1395526 - RNA, 18 nt, Human
caggcaggcucccaggga

SEQ ID NO: 1395527 - RNA, 14 nt, Human
caggcaggagcccu

SEQ ID NO: 1395528 - RNA, 22 nt, Human
caggcuguguuuggcuuucagg

SEQ ID NO: 1395529 - RNA, 21 nt, Human
caggcuguaggaaaucuaguu

SEQ ID NO: 1395530 - RNA, 18 nt, Human
caggcuggucuaaaacuc

SEQ ID NO: 1395531 - RNA, 17 nt, Human
caggcuggucuaaaacu

SEQ ID NO: 1395532 - RNA, 19 nt, Human
caggcuucugcuggggccu

SEQ ID NO: 1395533 - RNA, 17 nt, Human
caggcuucugcuggggc

SEQ ID NO: 1395534 - RNA, 14 nt, Human
caggcuucugcugg

SEQ ID NO: 1395535 - RNA, 23 nt, Human
caggcuucugagcagcgagccug

SEQ ID NO: 1395536 - RNA, 21 nt, Human
caggcuucugagcagcgagcc

SEQ ID NO: 1395537 - RNA, 16 nt, Human
caggcuucugagcagc

SEQ ID NO: 1395538 - RNA, 18 nt, Human
caggcuugccugcaggca

SEQ ID NO: 1395539 - RNA, 17 nt, Human
caggcuugccugcaggc

SEQ ID NO: 1395540 - RNA, 16 nt, Human
caggcuugccugcagg

SEQ ID NO: 1395541 - RNA, 15 nt, Human
caggcuugccugcag

SEQ ID NO: 1395542 - RNA, 23 nt, Human
caggcuuuuuuaucaugugaaau

SEQ ID NO: 1395543 - RNA, 15 nt, Human
caggcugccugaguc

SEQ ID NO: 1395544 - RNA, 14 nt, Human
caggcugccugagu

SEQ ID NO: 1395545 - RNA, 13 nt, Human
caggcugccugag

SEQ ID NO: 1395546 - RNA, 12 nt, Human
caggcugccuga

SEQ ID NO: 1395547 - RNA, 11 nt, Human
caggcugccug

SEQ ID NO: 1395548 - RNA, 16 nt, Human
caggcugccucccuug

SEQ ID NO: 1395549 - RNA, 16 nt, Human
caggcugccguggggc

SEQ ID NO: 1395550 - RNA, 16 nt, Human
caggcugauuucuagg

SEQ ID NO: 1395551 - RNA, 17 nt, Human
caggcugauuucuaggu

SEQ ID NO: 1395552 - RNA, 22 nt, Human
caggcugagguccugaucagcu

SEQ ID NO: 1395553 - RNA, 21 nt, Human
caggcugaccacagcacagcc

SEQ ID NO: 1395554 - RNA, 20 nt, Human
caggcugaccacagcacagc

SEQ ID NO: 1395555 - RNA, 17 nt, Human
caggcugaccacagcac

SEQ ID NO: 1395556 - RNA, 15 nt, Human
caggcugaccacagc

SEQ ID NO: 1395557 - RNA, 22 nt, Human
caggcugaccacagcacagcca

SEQ ID NO: 1395558 - RNA, 14 nt, Human
caggcugaccacag

SEQ ID NO: 1395559 - RNA, 18 nt, Human
caggcugaagcagguucc

SEQ ID NO: 1395560 - RNA, 18 nt, Human
caggcucuuagcagcuuc

SEQ ID NO: 1395561 - RNA, 15 nt, Human
caggcucuuagcagc

SEQ ID NO: 1395562 - RNA, 12 nt, Human
caggcucuuagc

SEQ ID NO: 1395563 - RNA, 22 nt, Human
caggcucuuagcagcuuccaga

SEQ ID NO: 1395564 - RNA, 21 nt, Human
caggcucuuagcagcuuccag

SEQ ID NO: 1395565 - RNA, 17 nt, Human
caggcugcucagggcug

SEQ ID NO: 1395566 - RNA, 18 nt, Human
caggcugcucagggcugg

SEQ ID NO: 1395567 - RNA, 12 nt, Human
caggcuggccag

SEQ ID NO: 1395568 - RNA, 19 nt, Human
caggcuggaagauagcugu

SEQ ID NO: 1395569 - RNA, 20 nt, Human
caggcuggaagauagcugug

SEQ ID NO: 1395570 - RNA, 16 nt, Human
caggcuggagugcagu

SEQ ID NO: 1395571 - RNA, 19 nt, Human
caggcuggccaguccaggc

SEQ ID NO: 1395572 - RNA, 18 nt, Human
caggcuggccaguccagg

SEQ ID NO: 1395573 - RNA, 16 nt, Human
caggcuggccagucca

SEQ ID NO: 1395574 - RNA, 14 nt, Human
caggcuggccaguc

SEQ ID NO: 1395575 - RNA, 16 nt, Human
caggcuggucuaaaac

SEQ ID NO: 1395576 - RNA, 21 nt, Human
caggcuggccaguccaggcug

SEQ ID NO: 1395577 - RNA, 23 nt, Human
caggcugggucgcccuggacugu

SEQ ID NO: 1395578 - RNA, 21 nt, Human
caggcugggucgcccuggacu

SEQ ID NO: 1395579 - RNA, 23 nt, Human
caggcccucccuguuccccagag

SEQ ID NO: 1395580 - RNA, 22 nt, Human
caggcccucccuguuccccaga

SEQ ID NO: 1395581 - RNA, 16 nt, Human
caggcccggcagggcg

SEQ ID NO: 1395582 - RNA, 20 nt, Human
caggcccuggccuccccugc

SEQ ID NO: 1395583 - RNA, 18 nt, Human
caggcccuggccuccccu

SEQ ID NO: 1395584 - RNA, 17 nt, Human
caggcccuggccucccc

SEQ ID NO: 1395585 - RNA, 15 nt, Human
caggcccuggccucc

SEQ ID NO: 1395586 - RNA, 14 nt, Human
caggcccuggccuc

SEQ ID NO: 1395587 - RNA, 21 nt, Human
caggcccuuauuuucaagaaa

SEQ ID NO: 1395588 - RNA, 22 nt, Human
caggcccuggccuccccugcca

SEQ ID NO: 1395589 - RNA, 12 nt, Human
caggcucucuuu

SEQ ID NO: 1395590 - RNA, 21 nt, Human
caggcucguggacugaguggg

SEQ ID NO: 1395591 - RNA, 23 nt, Human
caggcucggccugcccccacccc

SEQ ID NO: 1395592 - RNA, 20 nt, Human
caggcucggccugcccccac

SEQ ID NO: 1395593 - RNA, 19 nt, Human
caggcucggccugccccca

SEQ ID NO: 1395594 - RNA, 16 nt, Human
caggcucggccugccc

SEQ ID NO: 1395595 - RNA, 15 nt, Human
caggcucggccugcc

SEQ ID NO: 1395596 - RNA, 14 nt, Human
caggcucggccugc

SEQ ID NO: 1395597 - RNA, 23 nt, Human
caggcucccagggacaccuggga

SEQ ID NO: 1395598 - RNA, 22 nt, Human
caggcucccagggacaccuggg

SEQ ID NO: 1395599 - RNA, 19 nt, Human
caggcucccagggacaccu

SEQ ID NO: 1395600 - RNA, 16 nt, Human
caggcucccagggaca

SEQ ID NO: 1395601 - RNA, 14 nt, Human
caggcucccaggga

SEQ ID NO: 1395602 - RNA, 21 nt, Human
caggcucaggcaggggccucc

SEQ ID NO: 1395603 - RNA, 18 nt, Human
caggcucaaacaaugaca

SEQ ID NO: 1395604 - RNA, 19 nt, Human
caggcucaggcaggggccu

SEQ ID NO: 1395605 - RNA, 15 nt, Human
caggcucaggcaggg

SEQ ID NO: 1395606 - RNA, 14 nt, Human
caggcucaggcagg

SEQ ID NO: 1395607 - RNA, 15 nt, Human
caggcucagagggug

SEQ ID NO: 1395608 - RNA, 11 nt, Human
caggcucagag

SEQ ID NO: 1395609 - RNA, 14 nt, Human
caggccgcccugcg

SEQ ID NO: 1395610 - RNA, 19 nt, Human
caggcuagauguauguacu

SEQ ID NO: 1395611 - RNA, 13 nt, Human
caggcuagaugua

SEQ ID NO: 1395612 - RNA, 23 nt, Human
cagggaaggcaggcagggcucuc

SEQ ID NO: 1395613 - RNA, 22 nt, Human
cagggaaggcaggcagggcucu

SEQ ID NO: 1395614 - RNA, 21 nt, Human
cagggaaggcaggcagggcuc

SEQ ID NO: 1395615 - RNA, 20 nt, Human
cagggaaggcaggcagggcu

SEQ ID NO: 1395616 - RNA, 18 nt, Human
cagggaaggcaggcaggg

SEQ ID NO: 1395617 - RNA, 17 nt, Human
cagggaaggcaggcagg

SEQ ID NO: 1395618 - RNA, 16 nt, Human
cagggaaggcaggcag

SEQ ID NO: 1395619 - RNA, 18 nt, Human
cagggaaggaggagccug

SEQ ID NO: 1395620 - RNA, 16 nt, Human
cagggaaggaggagcc

SEQ ID NO: 1395621 - RNA, 15 nt, Human
cagggaaggaggagc

SEQ ID NO: 1395622 - RNA, 14 nt, Human
cagggaaggaggag

SEQ ID NO: 1395623 - RNA, 15 nt, Human
cagggaaggcaggca

SEQ ID NO: 1395624 - RNA, 14 nt, Human
cagggaaggcaggc

SEQ ID NO: 1395625 - RNA, 13 nt, Human
cagggaaggcagg

SEQ ID NO: 1395626 - RNA, 12 nt, Human
cagggaaggcag

SEQ ID NO: 1395627 - RNA, 18 nt, Human
cagggaaggaucccauga

SEQ ID NO: 1395628 - RNA, 23 nt, Human
cagggaaggaggagccuguccug

SEQ ID NO: 1395629 - RNA, 22 nt, Human
cagggaaggaggagccuguccu

SEQ ID NO: 1395630 - RNA, 21 nt, Human
cagggaaggaggagccugucc

SEQ ID NO: 1395631 - RNA, 20 nt, Human
cagggaaggaggagccuguc

SEQ ID NO: 1395632 - RNA, 13 nt, Human
cagggaaggaucc

SEQ ID NO: 1395633 - RNA, 17 nt, Human
cagggacaccugggaga

SEQ ID NO: 1395634 - RNA, 22 nt, Human
cagggacaccugggagaaaucu

SEQ ID NO: 1395635 - RNA, 18 nt, Human
cagggaauuaggccccca

SEQ ID NO: 1395636 - RNA, 18 nt, Human
cagggacagaggccccag

SEQ ID NO: 1395637 - RNA, 16 nt, Human
cagggacagaggcccc

SEQ ID NO: 1395638 - RNA, 14 nt, Human
cagggacagaggcc

SEQ ID NO: 1395639 - RNA, 20 nt, Human
cagggaaaauuauuugcaua

SEQ ID NO: 1395640 - RNA, 18 nt, Human
cagggaacauggggagga

SEQ ID NO: 1395641 - RNA, 20 nt, Human
cagggaacauggggaggagg

SEQ ID NO: 1395642 - RNA, 17 nt, Human
cagggaagcagcagccu

SEQ ID NO: 1395643 - RNA, 15 nt, Human
cagggaagcagcagc

SEQ ID NO: 1395644 - RNA, 18 nt, Human
cagggaaaauaggcagga

SEQ ID NO: 1395645 - RNA, 15 nt, Human
cagggaaaauaggca

SEQ ID NO: 1395646 - RNA, 14 nt, Human
caggcuuuuguuuc

SEQ ID NO: 1395647 - RNA, 24 nt, Human
cagggccggggaacuggccaagcu

SEQ ID NO: 1395648 - RNA, 23 nt, Human
cagggccggggaacuggccaagc

SEQ ID NO: 1395649 - RNA, 22 nt, Human
cagggccggggaacuggccaag

SEQ ID NO: 1395650 - RNA, 20 nt, Human
cagggccggggaacuggcca

SEQ ID NO: 1395651 - RNA, 12 nt, Human
cagggccgggga

SEQ ID NO: 1395652 - RNA, 22 nt, Human
cagggccccucuccccagggaa

SEQ ID NO: 1395653 - RNA, 15 nt, Human
cagggccccucuccc

SEQ ID NO: 1395654 - RNA, 22 nt, Human
cagggccccucacccugccuua

SEQ ID NO: 1395655 - RNA, 21 nt, Human
cagggccccucacccugccuu

SEQ ID NO: 1395656 - RNA, 18 nt, Human
cagggccccucacccugc

SEQ ID NO: 1395657 - RNA, 21 nt, Human
cagggcccccaucucaugccc

SEQ ID NO: 1395658 - RNA, 16 nt, Human
cagggcccccaucuca

SEQ ID NO: 1395659 - RNA, 15 nt, Human
cagggcccccaucuc

SEQ ID NO: 1395660 - RNA, 20 nt, Human
cagggccccaggcauugcca

SEQ ID NO: 1395661 - RNA, 22 nt, Human
cagggcccagagcccagcucca

SEQ ID NO: 1395662 - RNA, 21 nt, Human
cagggcccagagcccagcucc

SEQ ID NO: 1395663 - RNA, 19 nt, Human
cagggcccagagcccagcu

SEQ ID NO: 1395664 - RNA, 18 nt, Human
cagggcccagagcccagc

SEQ ID NO: 1395665 - RNA, 16 nt, Human
cagggcccagagccca

SEQ ID NO: 1395666 - RNA, 15 nt, Human
cagggcccagagccc

SEQ ID NO: 1395667 - RNA, 14 nt, Human
cagggcccagagcc

SEQ ID NO: 1395668 - RNA, 13 nt, Human
cagggcccagagc

SEQ ID NO: 1395669 - RNA, 12 nt, Human
cagggcccagag

SEQ ID NO: 1395670 - RNA, 22 nt, Human
cagggccaugcugaggccuggg

SEQ ID NO: 1395671 - RNA, 23 nt, Human
cagggccaugcugaggccugggc

SEQ ID NO: 1395672 - RNA, 21 nt, Human
cagggccaugcugaggccugg

SEQ ID NO: 1395673 - RNA, 18 nt, Human
cagggccaugcugaggcc

SEQ ID NO: 1395674 - RNA, 17 nt, Human
cagggccaugcugaggc

SEQ ID NO: 1395675 - RNA, 16 nt, Human
cagggccaugcugagg

SEQ ID NO: 1395676 - RNA, 14 nt, Human
cagggccaugcuga

SEQ ID NO: 1395677 - RNA, 17 nt, Human
cagggccaggccucucc

SEQ ID NO: 1395678 - RNA, 15 nt, Human
cagggccagccucua

SEQ ID NO: 1395679 - RNA, 19 nt, Human
cagggccagccucuagagc

SEQ ID NO: 1395680 - RNA, 14 nt, Human
cagggccagccucu

SEQ ID NO: 1395681 - RNA, 23 nt, Human
cagggccacgcuccagcugcccc

SEQ ID NO: 1395682 - RNA, 22 nt, Human
cagggccacgcuccagcugccc

SEQ ID NO: 1395683 - RNA, 20 nt, Human
cagggccacgcuccagcugc

SEQ ID NO: 1395684 - RNA, 18 nt, Human
cagggccacgcuccagcu

SEQ ID NO: 1395685 - RNA, 17 nt, Human
cagggccacgcuccagc

SEQ ID NO: 1395686 - RNA, 16 nt, Human
cagggccacgcuccag

SEQ ID NO: 1395687 - RNA, 16 nt, Human
cagggcaucucugggc

SEQ ID NO: 1395688 - RNA, 23 nt, Human
cagggcaguaccugagggucugu

SEQ ID NO: 1395689 - RNA, 21 nt, Human
cagggcagucauuggcugucu

SEQ ID NO: 1395690 - RNA, 19 nt, Human
cagggcaguaccugagggu

SEQ ID NO: 1395691 - RNA, 15 nt, Human
cagggcaguaccuga

SEQ ID NO: 1395692 - RNA, 14 nt, Human
cagggcaguaccug

SEQ ID NO: 1395693 - RNA, 13 nt, Human
cagggcagggccc

SEQ ID NO: 1395694 - RNA, 15 nt, Human
cagggcaugccacgu

SEQ ID NO: 1395695 - RNA, 24 nt, Human
cagggcaucucugggcuggaugag

SEQ ID NO: 1395696 - RNA, 20 nt, Human
cagggcaucucugggcugga

SEQ ID NO: 1395697 - RNA, 19 nt, Human
cagggcaucucugggcugg

SEQ ID NO: 1395698 - RNA, 18 nt, Human
cagggcaucucugggcug

SEQ ID NO: 1395699 - RNA, 17 nt, Human
cagggcaucucugggcu

SEQ ID NO: 1395700 - RNA, 22 nt, Human
cagggcagcgccaggcugacca

SEQ ID NO: 1395701 - RNA, 19 nt, Human
cagggcagcgccaggcuga

SEQ ID NO: 1395702 - RNA, 18 nt, Human
cagggcagcgccaggcug

SEQ ID NO: 1395703 - RNA, 17 nt, Human
cagggcagcgccaggcu

SEQ ID NO: 1395704 - RNA, 16 nt, Human
cagggcagcgccaggc

SEQ ID NO: 1395705 - RNA, 15 nt, Human
cagggcagcgccagg

SEQ ID NO: 1395706 - RNA, 14 nt, Human
cagggcagcgccag

SEQ ID NO: 1395707 - RNA, 13 nt, Human
cagggcagcgcca

SEQ ID NO: 1395708 - RNA, 23 nt, Human
cagggcagccagggagagcccag

SEQ ID NO: 1395709 - RNA, 22 nt, Human
cagggcagccagggagagccca

SEQ ID NO: 1395710 - RNA, 20 nt, Human
cagggcagccagggagagcc

SEQ ID NO: 1395711 - RNA, 18 nt, Human
cagggcagccagggagag

SEQ ID NO: 1395712 - RNA, 17 nt, Human
cagggcagccagggaga

SEQ ID NO: 1395713 - RNA, 16 nt, Human
cagggcagccagggag

SEQ ID NO: 1395714 - RNA, 15 nt, Human
cagggcagccaggga

SEQ ID NO: 1395715 - RNA, 14 nt, Human
cagggcagccaggg

SEQ ID NO: 1395716 - RNA, 13 nt, Human
cagggcagccagg

SEQ ID NO: 1395717 - RNA, 12 nt, Human
cagggcagccag

SEQ ID NO: 1395718 - RNA, 19 nt, Human
cagggcagagugagaccca

SEQ ID NO: 1395719 - RNA, 13 nt, Human
cagggcagaguga

SEQ ID NO: 1395720 - RNA, 21 nt, Human
cagggcacaggagcuaccugu

SEQ ID NO: 1395721 - RNA, 22 nt, Human
cagggcacaggagcuaccugug

SEQ ID NO: 1395722 - RNA, 20 nt, Human
cagggcacaggagcuaccug

SEQ ID NO: 1395723 - RNA, 19 nt, Human
cagggcacaggagcuaccu

SEQ ID NO: 1395724 - RNA, 18 nt, Human
cagggcacaggagcuacc

SEQ ID NO: 1395725 - RNA, 16 nt, Human
cagggcacaggagcua

SEQ ID NO: 1395726 - RNA, 15 nt, Human
cagggcacaggagcu

SEQ ID NO: 1395727 - RNA, 14 nt, Human
cagggcacaggagc

SEQ ID NO: 1395728 - RNA, 13 nt, Human
cagggcacaggag

SEQ ID NO: 1395729 - RNA, 12 nt, Human
cagggcacagga

SEQ ID NO: 1395730 - RNA, 22 nt, Human
cagggauguggguuccacagac

SEQ ID NO: 1395731 - RNA, 20 nt, Human
cagggauuaaccucugcacu

SEQ ID NO: 1395732 - RNA, 19 nt, Human
cagggauuaaccucugcac

SEQ ID NO: 1395733 - RNA, 18 nt, Human
cagggauuaaccucugca

SEQ ID NO: 1395734 - RNA, 17 nt, Human
cagggauuaaccucugc

SEQ ID NO: 1395735 - RNA, 21 nt, Human
cagggauguggguuccacaga

SEQ ID NO: 1395736 - RNA, 20 nt, Human
cagggauguggguuccacag

SEQ ID NO: 1395737 - RNA, 13 nt, Human
cagggaugugggu

SEQ ID NO: 1395738 - RNA, 12 nt, Human
cagggauguggg

SEQ ID NO: 1395739 - RNA, 13 nt, Human
cagggagaagcuc

SEQ ID NO: 1395740 - RNA, 12 nt, Human
cagggagaagcu

SEQ ID NO: 1395741 - RNA, 21 nt, Human
cagggacuucaggaucaaguc

SEQ ID NO: 1395742 - RNA, 23 nt, Human
cagggcaaagccaggucccucuc

SEQ ID NO: 1395743 - RNA, 22 nt, Human
cagggcaaagccaggucccucu

SEQ ID NO: 1395744 - RNA, 20 nt, Human
cagggcaaagccaggucccu

SEQ ID NO: 1395745 - RNA, 18 nt, Human
cagggcaaagccaggucc

SEQ ID NO: 1395746 - RNA, 17 nt, Human
cagggcaaagccagguc

SEQ ID NO: 1395747 - RNA, 16 nt, Human
cagggcaaagccaggu

SEQ ID NO: 1395748 - RNA, 14 nt, Human
cagggcaaagccag

SEQ ID NO: 1395749 - RNA, 13 nt, Human
cagggcaaagcca

SEQ ID NO: 1395750 - RNA, 12 nt, Human
cagggcaaagcc

SEQ ID NO: 1395751 - RNA, 18 nt, Human
cagggcaaugaugaauga

SEQ ID NO: 1395752 - RNA, 15 nt, Human
cagggcaaggccauu

SEQ ID NO: 1395753 - RNA, 22 nt, Human
cagggaccacacccuguacugu

SEQ ID NO: 1395754 - RNA, 16 nt, Human
cagggaccacacccug

SEQ ID NO: 1395755 - RNA, 14 nt, Human
cagggacagcaacu

SEQ ID NO: 1395756 - RNA, 23 nt, Human
cagggacagaggccccagccucc

SEQ ID NO: 1395757 - RNA, 21 nt, Human
cagggacagaggccccagccu

SEQ ID NO: 1395758 - RNA, 19 nt, Human
cagggacagaggccccagc

SEQ ID NO: 1395759 - RNA, 12 nt, Human
cagggacucagg

SEQ ID NO: 1395760 - RNA, 14 nt, Human
cagggaccauggcu

SEQ ID NO: 1395761 - RNA, 21 nt, Human
cagggaccgcccccugucucu

SEQ ID NO: 1395762 - RNA, 23 nt, Human
cagggaccggcggaccccagcca

SEQ ID NO: 1395763 - RNA, 22 nt, Human
caggggcugcuuccuccuggaa

SEQ ID NO: 1395764 - RNA, 20 nt, Human
caggggcugcuuccuccugg

SEQ ID NO: 1395765 - RNA, 19 nt, Human
caggggcugcuuccuccug

SEQ ID NO: 1395766 - RNA, 18 nt, Human
caggggcugcuuccuccu

SEQ ID NO: 1395767 - RNA, 16 nt, Human
caggggcugcuuccuc

SEQ ID NO: 1395768 - RNA, 13 nt, Human
caggggcugcuuc

SEQ ID NO: 1395769 - RNA, 18 nt, Human
caggggcucccuccgccc

SEQ ID NO: 1395770 - RNA, 21 nt, Human
caggggcucccuccgccccca

SEQ ID NO: 1395771 - RNA, 14 nt, Human
caggggcucccucc

SEQ ID NO: 1395772 - RNA, 16 nt, Human
caggggccugcccagu

SEQ ID NO: 1395773 - RNA, 23 nt, Human
caggggccuggagauccuccugc

SEQ ID NO: 1395774 - RNA, 22 nt, Human
caggggccuggagauccuccug

SEQ ID NO: 1395775 - RNA, 15 nt, Human
caggggccuggagau

SEQ ID NO: 1395776 - RNA, 14 nt, Human
caggggccuggaga

SEQ ID NO: 1395777 - RNA, 13 nt, Human
caggggccuggag

SEQ ID NO: 1395778 - RNA, 12 nt, Human
caggggccugga

SEQ ID NO: 1395779 - RNA, 15 nt, Human
caggggcccuggagc

SEQ ID NO: 1395780 - RNA, 17 nt, Human
caggggcccuggagcag

SEQ ID NO: 1395781 - RNA, 18 nt, Human
caggggcccuggagcagc

SEQ ID NO: 1395782 - RNA, 20 nt, Human
caggggcccuggagcagcca

SEQ ID NO: 1395783 - RNA, 22 nt, Human
caggggcccgcgauguggaacu

SEQ ID NO: 1395784 - RNA, 18 nt, Human
caggggcagccccaggcc

SEQ ID NO: 1395785 - RNA, 14 nt, Human
caggggcagcccca

SEQ ID NO: 1395786 - RNA, 14 nt, Human
cagggccugucuca

SEQ ID NO: 1395787 - RNA, 22 nt, Human
cagggccuggggagauggagga

SEQ ID NO: 1395788 - RNA, 22 nt, Human
caggggagcagaggggcagagg

SEQ ID NO: 1395789 - RNA, 21 nt, Human
caggggagcagaggggcagag

SEQ ID NO: 1395790 - RNA, 20 nt, Human
caggggagcagaggggcaga

SEQ ID NO: 1395791 - RNA, 16 nt, Human
caggggagcagagggg

SEQ ID NO: 1395792 - RNA, 22 nt, Human
caggggacaggaguccacuuug

SEQ ID NO: 1395793 - RNA, 16 nt, Human
caggggacaggagucc

SEQ ID NO: 1395794 - RNA, 15 nt, Human
cagggcggggguggc

SEQ ID NO: 1395795 - RNA, 22 nt, Human
cagggcgggcagagggcuggag

SEQ ID NO: 1395796 - RNA, 21 nt, Human
cagggcgggcagagggcugga

SEQ ID NO: 1395797 - RNA, 20 nt, Human
cagggcgggcagagggcugg

SEQ ID NO: 1395798 - RNA, 19 nt, Human
cagggcgggcagagggcug

SEQ ID NO: 1395799 - RNA, 17 nt, Human
cagggcgggcagagggc

SEQ ID NO: 1395800 - RNA, 16 nt, Human
cagggcgggcagaggg

SEQ ID NO: 1395801 - RNA, 16 nt, Human
caggggacaggauggu

SEQ ID NO: 1395802 - RNA, 11 nt, Human
caggggacagg

SEQ ID NO: 1395803 - RNA, 19 nt, Human
cagggggucuggcuggugu

SEQ ID NO: 1395804 - RNA, 18 nt, Human
cagggggucuggcuggug

SEQ ID NO: 1395805 - RNA, 17 nt, Human
cagggggucuggcuggu

SEQ ID NO: 1395806 - RNA, 16 nt, Human
cagggggucuggcugg

SEQ ID NO: 1395807 - RNA, 14 nt, Human
cagggggucuggcu

SEQ ID NO: 1395808 - RNA, 13 nt, Human
cagggggucuggc

SEQ ID NO: 1395809 - RNA, 19 nt, Human
caggggggugaggagcugg

SEQ ID NO: 1395810 - RNA, 18 nt, Human
caggggggugaggagcug

SEQ ID NO: 1395811 - RNA, 15 nt, Human
caggggggugaggag

SEQ ID NO: 1395812 - RNA, 21 nt, Human
cagggggcugcugcugggcuc

SEQ ID NO: 1395813 - RNA, 23 nt, Human
cagggggcugcugcugggcucag

SEQ ID NO: 1395814 - RNA, 20 nt, Human
cagggggcugcugcugggcu

SEQ ID NO: 1395815 - RNA, 18 nt, Human
cagggggcugcugcuggg

SEQ ID NO: 1395816 - RNA, 15 nt, Human
cagggggcugcugcu

SEQ ID NO: 1395817 - RNA, 14 nt, Human
cagggggcugcugc

SEQ ID NO: 1395818 - RNA, 13 nt, Human
cagggggcugcug

SEQ ID NO: 1395819 - RNA, 12 nt, Human
cagggggcugcu

SEQ ID NO: 1395820 - RNA, 22 nt, Human
cagggggagcugggccuggucu

SEQ ID NO: 1395821 - RNA, 19 nt, Human
cagggggaagguggggucc

SEQ ID NO: 1395822 - RNA, 16 nt, Human
caggggcuugacuuuu

SEQ ID NO: 1395823 - RNA, 13 nt, Human
caggggcuugacu

SEQ ID NO: 1395824 - RNA, 20 nt, Human
caggggcuuccuggugcugg

SEQ ID NO: 1395825 - RNA, 17 nt, Human
caggggcuuccuggugc

SEQ ID NO: 1395826 - RNA, 16 nt, Human
caggggcuuccuggug

SEQ ID NO: 1395827 - RNA, 15 nt, Human
caggggcuuccuggu

SEQ ID NO: 1395828 - RNA, 18 nt, Human
caggggcugucccggagg

SEQ ID NO: 1395829 - RNA, 19 nt, Human
cagggggagcugggccugg

SEQ ID NO: 1395830 - RNA, 18 nt, Human
cagggggagcugggccug

SEQ ID NO: 1395831 - RNA, 15 nt, Human
cagggggcaagagga

SEQ ID NO: 1395832 - RNA, 14 nt, Human
cagugcucccucac

SEQ ID NO: 1395833 - RNA, 14 nt, Human
cagugcucgcuguu

SEQ ID NO: 1395834 - RNA, 15 nt, Human
cagugcucgcuguug

SEQ ID NO: 1395835 - RNA, 16 nt, Human
cagugcucgcuguugc

SEQ ID NO: 1395836 - RNA, 17 nt, Human
cagugcucgcuguugcu

SEQ ID NO: 1395837 - RNA, 18 nt, Human
cagugcucgcuguugcug

SEQ ID NO: 1395838 - RNA, 19 nt, Human
cagugcucgcuguugcuga

SEQ ID NO: 1395839 - RNA, 20 nt, Human
cagugcucgcuguugcugaa

SEQ ID NO: 1395840 - RNA, 21 nt, Human
cagugcucgcuguugcugaau

SEQ ID NO: 1395841 - RNA, 22 nt, Human
cagugcucgcuguugcugaaua

SEQ ID NO: 1395842 - RNA, 23 nt, Human
cagugccuuucuucucuccagug

SEQ ID NO: 1395843 - RNA, 22 nt, Human
cagugccuuccuguuuuucaca

SEQ ID NO: 1395844 - RNA, 16 nt, Human
cagugcccugagccag

SEQ ID NO: 1395845 - RNA, 15 nt, Human
cagugcccugauccc

SEQ ID NO: 1395846 - RNA, 23 nt, Human
cagugcccccacugaccagaacu

SEQ ID NO: 1395847 - RNA, 22 nt, Human
cagugcccccacugaccagaac

SEQ ID NO: 1395848 - RNA, 21 nt, Human
cagugcccccacugaccagaa

SEQ ID NO: 1395849 - RNA, 20 nt, Human
cagugcccccacugaccaga

SEQ ID NO: 1395850 - RNA, 17 nt, Human
cagugcccccacugacc

SEQ ID NO: 1395851 - RNA, 15 nt, Human
cagugcccccacuga

SEQ ID NO: 1395852 - RNA, 12 nt, Human
cagugcccccac

SEQ ID NO: 1395853 - RNA, 15 nt, Human
cagugcccugagcca

SEQ ID NO: 1395854 - RNA, 14 nt, Human
cagugcccugagcc

SEQ ID NO: 1395855 - RNA, 13 nt, Human
cagugcccugagc

SEQ ID NO: 1395856 - RNA, 22 nt, Human
cagugcccucuccccucagccu

SEQ ID NO: 1395857 - RNA, 13 nt, Human
cagugcccucucc

SEQ ID NO: 1395858 - RNA, 19 nt, Human
cagugcccucauuuuaugu

SEQ ID NO: 1395859 - RNA, 17 nt, Human
cagugcccucauuuuau

SEQ ID NO: 1395860 - RNA, 18 nt, Human
cagugacagacaggcucu

SEQ ID NO: 1395861 - RNA, 17 nt, Human
cagugacagacaggcuc

SEQ ID NO: 1395862 - RNA, 16 nt, Human
cagugacagacaggcu

SEQ ID NO: 1395863 - RNA, 15 nt, Human
cagugacagacaggc

SEQ ID NO: 1395864 - RNA, 20 nt, Human
cagugaauuguguaggagag

SEQ ID NO: 1395865 - RNA, 20 nt, Human
cagugaaugauucaguguua

SEQ ID NO: 1395866 - RNA, 18 nt, Human
cagugaaugauucagugu

SEQ ID NO: 1395867 - RNA, 17 nt, Human
cagugaaugauucagug

SEQ ID NO: 1395868 - RNA, 23 nt, Human
cagugaaguugcugcuucuccca

SEQ ID NO: 1395869 - RNA, 19 nt, Human
cagugaaguugcugcuucu

SEQ ID NO: 1395870 - RNA, 18 nt, Human
cagugaaguugcugcuuc

SEQ ID NO: 1395871 - RNA, 17 nt, Human
cagugaaguugcugcuu

SEQ ID NO: 1395872 - RNA, 16 nt, Human
cagugaaguugcugcu

SEQ ID NO: 1395873 - RNA, 15 nt, Human
cagugaaguugcugc

SEQ ID NO: 1395874 - RNA, 14 nt, Human
cagugaaguugcug

SEQ ID NO: 1395875 - RNA, 21 nt, Human
cagugaagagccacugccauu

SEQ ID NO: 1395876 - RNA, 15 nt, Human
cagugaagacuauga

SEQ ID NO: 1395877 - RNA, 16 nt, Human
cagugaagacagaagu

SEQ ID NO: 1395878 - RNA, 15 nt, Human
cagugaagacagaag

SEQ ID NO: 1395879 - RNA, 14 nt, Human
cagugaagacagaa

SEQ ID NO: 1395880 - RNA, 13 nt, Human
cagugaagacaga

SEQ ID NO: 1395881 - RNA, 17 nt, Human
cagugacccuggcuccu

SEQ ID NO: 1395882 - RNA, 16 nt, Human
cagugacccuggcucc

SEQ ID NO: 1395883 - RNA, 13 nt, Human
cagugacccuggc

SEQ ID NO: 1395884 - RNA, 12 nt, Human
cagugacagcua

SEQ ID NO: 1395885 - RNA, 15 nt, Human
cagugacagcuagga

SEQ ID NO: 1395886 - RNA, 17 nt, Human
cagugacuucugagauc

SEQ ID NO: 1395887 - RNA, 16 nt, Human
cagugacuucugagau

SEQ ID NO: 1395888 - RNA, 15 nt, Human
cagugacuucugaga

SEQ ID NO: 1395889 - RNA, 13 nt, Human
cagugacuucuga

SEQ ID NO: 1395890 - RNA, 23 nt, Human
cagugaggguaaguauuuuccug

SEQ ID NO: 1395891 - RNA, 21 nt, Human
cagugagggagggcugucauc

SEQ ID NO: 1395892 - RNA, 12 nt, Human
cagugagccuga

SEQ ID NO: 1395893 - RNA, 19 nt, Human
cagugagcagccuggagcc

SEQ ID NO: 1395894 - RNA, 22 nt, Human
cagugagcuuggaaaggaccag

SEQ ID NO: 1395895 - RNA, 22 nt, Human
caguccuggaagccagcuuucc

SEQ ID NO: 1395896 - RNA, 17 nt, Human
caguccuggaagccagc

SEQ ID NO: 1395897 - RNA, 22 nt, Human
caguccugaucagagccguggu

SEQ ID NO: 1395898 - RNA, 21 nt, Human
cagucuuccugacacuuuaau

SEQ ID NO: 1395899 - RNA, 18 nt, Human
cagucuuccugacacuuu

SEQ ID NO: 1395900 - RNA, 17 nt, Human
cagucuuccugacacuu

SEQ ID NO: 1395901 - RNA, 16 nt, Human
cagucuuccugacacu

SEQ ID NO: 1395902 - RNA, 13 nt, Human
cagucuuccugac

SEQ ID NO: 1395903 - RNA, 21 nt, Human
cagucuuccauuugcaaggga

SEQ ID NO: 1395904 - RNA, 18 nt, Human
cagucuuccauuugcaag

SEQ ID NO: 1395905 - RNA, 17 nt, Human
cagucuuccauuugcaa

SEQ ID NO: 1395906 - RNA, 15 nt, Human
cagucuuccauuugc

SEQ ID NO: 1395907 - RNA, 15 nt, Human
cagucuguggaucag

SEQ ID NO: 1395908 - RNA, 21 nt, Human
cagucuguuccccauggccac

SEQ ID NO: 1395909 - RNA, 12 nt, Human
caguccuguccu

SEQ ID NO: 1395910 - RNA, 17 nt, Human
cagugaaaaacuauuaa

SEQ ID NO: 1395911 - RNA, 14 nt, Human
cagugaaaaacuau

SEQ ID NO: 1395912 - RNA, 16 nt, Human
cagugaaagaaaauaa

SEQ ID NO: 1395913 - RNA, 20 nt, Human
cagugaaagaaaauaacaau

SEQ ID NO: 1395914 - RNA, 20 nt, Human
caguccccccacccucauuc

SEQ ID NO: 1395915 - RNA, 14 nt, Human
caguccccccaccc

SEQ ID NO: 1395916 - RNA, 13 nt, Human
caguccccuuccc

SEQ ID NO: 1395917 - RNA, 19 nt, Human
caguccccuucccuccaag

SEQ ID NO: 1395918 - RNA, 14 nt, Human
caguccccuucccu

SEQ ID NO: 1395919 - RNA, 22 nt, Human
caguccuaucugggcuuccugg

SEQ ID NO: 1395920 - RNA, 21 nt, Human
caguccuaucugggcuuccug

SEQ ID NO: 1395921 - RNA, 20 nt, Human
caguccuaucugggcuuccu

SEQ ID NO: 1395922 - RNA, 17 nt, Human
caguccuaucugggcuu

SEQ ID NO: 1395923 - RNA, 16 nt, Human
caguccuaucugggcu

SEQ ID NO: 1395924 - RNA, 15 nt, Human
caguccuaucugggc

SEQ ID NO: 1395925 - RNA, 19 nt, Human
caguccgucaaaacagauu

SEQ ID NO: 1395926 - RNA, 13 nt, Human
cagucccuccaca

SEQ ID NO: 1395927 - RNA, 16 nt, Human
caguaucaugcccugu

SEQ ID NO: 1395928 - RNA, 13 nt, Human
caguaucaugccc

SEQ ID NO: 1395929 - RNA, 23 nt, Human
caguauaauugaguuuucagugg

SEQ ID NO: 1395930 - RNA, 16 nt, Human
caguauccacuuugca

SEQ ID NO: 1395931 - RNA, 20 nt, Human
caguaucaugcccugugcaa

SEQ ID NO: 1395932 - RNA, 19 nt, Human
caguaucaugcccugugca

SEQ ID NO: 1395933 - RNA, 17 nt, Human
caguaucaugcccugug

SEQ ID NO: 1395934 - RNA, 14 nt, Human
caguaucucuucag

SEQ ID NO: 1395935 - RNA, 15 nt, Human
caguaucucuucagu

SEQ ID NO: 1395936 - RNA, 16 nt, Human
caguaucucuucaguc

SEQ ID NO: 1395937 - RNA, 17 nt, Human
caguaucucuucagucu

SEQ ID NO: 1395938 - RNA, 18 nt, Human
caguauggggguuguaaa

SEQ ID NO: 1395939 - RNA, 19 nt, Human
caguaugaauuauucaauu

SEQ ID NO: 1395940 - RNA, 19 nt, Human
caguaucucuucagucucu

SEQ ID NO: 1395941 - RNA, 22 nt, Human
caguaucucuucagucucuaua

SEQ ID NO: 1395942 - RNA, 21 nt, Human
caguaggagcccagcucugaa

SEQ ID NO: 1395943 - RNA, 15 nt, Human
caguaggagcccagc

SEQ ID NO: 1395944 - RNA, 14 nt, Human
caguaggagcccag

SEQ ID NO: 1395945 - RNA, 12 nt, Human
caguaggagccc

SEQ ID NO: 1395946 - RNA, 23 nt, Human
caguagcacaaguuauuuaaauc

SEQ ID NO: 1395947 - RNA, 21 nt, Human
caguagcacaaguuauuuaaa

SEQ ID NO: 1395948 - RNA, 18 nt, Human
caguagcacaaguuauuu

SEQ ID NO: 1395949 - RNA, 18 nt, Human
caguagauuuuccaaaug

SEQ ID NO: 1395950 - RNA, 16 nt, Human
caguagauuuuccaaa

SEQ ID NO: 1395951 - RNA, 18 nt, Human
caguagauugcagaaaau

SEQ ID NO: 1395952 - RNA, 16 nt, Human
caguagauugcagaaa

SEQ ID NO: 1395953 - RNA, 15 nt, Human
caguagauugcagaa

SEQ ID NO: 1395954 - RNA, 23 nt, Human
caguagaggcuauggacagggca

SEQ ID NO: 1395955 - RNA, 20 nt, Human
caguagaccuuguuacuucu

SEQ ID NO: 1395956 - RNA, 18 nt, Human
caguacuuugugcauucu

SEQ ID NO: 1395957 - RNA, 16 nt, Human
caguacuuugugcauu

SEQ ID NO: 1395958 - RNA, 22 nt, Human
caguaguucacauacaaaucau

SEQ ID NO: 1395959 - RNA, 14 nt, Human
caguaguucacaua

SEQ ID NO: 1395960 - RNA, 23 nt, Human
caguagucuugaugaccaaaguc

SEQ ID NO: 1395961 - RNA, 22 nt, Human
caguagguuauuuagcuuggga

SEQ ID NO: 1395962 - RNA, 20 nt, Human
caguagguuauuuagcuugg

SEQ ID NO: 1395963 - RNA, 22 nt, Human
caguaggagcccagcucugaaa

SEQ ID NO: 1395964 - RNA, 19 nt, Human
caguaggggcuuauaauaa

SEQ ID NO: 1395965 - RNA, 22 nt, Human
caguaggugcccagaauaaguu

SEQ ID NO: 1395966 - RNA, 22 nt, Human
caguaggggcuuauaauaaagg

SEQ ID NO: 1395967 - RNA, 20 nt, Human
cagucccagcggugggaccu

SEQ ID NO: 1395968 - RNA, 14 nt, Human
cagucccagagcag

SEQ ID NO: 1395969 - RNA, 15 nt, Human
cagucccagagcagg

SEQ ID NO: 1395970 - RNA, 21 nt, Human
cagucccaagcggugucucuc

SEQ ID NO: 1395971 - RNA, 19 nt, Human
cagucccaagcggugucuc

SEQ ID NO: 1395972 - RNA, 23 nt, Human
caguccaguccuaucugggcuuc

SEQ ID NO: 1395973 - RNA, 22 nt, Human
caguccaguccuaucugggcuu

SEQ ID NO: 1395974 - RNA, 21 nt, Human
caguccaguccuaucugggcu

SEQ ID NO: 1395975 - RNA, 20 nt, Human
caguccaguccuaucugggc

SEQ ID NO: 1395976 - RNA, 18 nt, Human
caguccaguccuaucugg

SEQ ID NO: 1395977 - RNA, 18 nt, Human
caguccaggcugccgugg

SEQ ID NO: 1395978 - RNA, 15 nt, Human
caguccaggcugccg

SEQ ID NO: 1395979 - RNA, 23 nt, Human
caguccaggaugcuaacaucuaa

SEQ ID NO: 1395980 - RNA, 21 nt, Human
caguccacuucugacagccuc

SEQ ID NO: 1395981 - RNA, 20 nt, Human
caguccacuucugacagccu

SEQ ID NO: 1395982 - RNA, 18 nt, Human
caguccacuucugacagc

SEQ ID NO: 1395983 - RNA, 23 nt, Human
caguccaccugaggaacugucuc

SEQ ID NO: 1395984 - RNA, 20 nt, Human
caguccaccugaggaacugu

SEQ ID NO: 1395985 - RNA, 13 nt, Human
caguccacaaaau

SEQ ID NO: 1395986 - RNA, 21 nt, Human
cagucauuggcugucuccuag

SEQ ID NO: 1395987 - RNA, 17 nt, Human
cagucauuggcugucuc

SEQ ID NO: 1395988 - RNA, 13 nt, Human
cagucauuggcug

SEQ ID NO: 1395989 - RNA, 20 nt, Human
cagucauucagauaugauuc

SEQ ID NO: 1395990 - RNA, 17 nt, Human
cagucauucagauauga

SEQ ID NO: 1395991 - RNA, 12 nt, Human
cagucacugcuc

SEQ ID NO: 1395992 - RNA, 19 nt, Human
caguauguucaaagucaaa

SEQ ID NO: 1395993 - RNA, 23 nt, Human
caguauggguuagggaaaacauu

SEQ ID NO: 1395994 - RNA, 23 nt, Human
caguauggggguuguaaauuggc

SEQ ID NO: 1395995 - RNA, 21 nt, Human
caguauggggguuguaaauug

SEQ ID NO: 1395996 - RNA, 20 nt, Human
caguauggggguuguaaauu

SEQ ID NO: 1395997 - RNA, 19 nt, Human
caguauggggguuguaaau

SEQ ID NO: 1395998 - RNA, 16 nt, Human
caguauggguuaggga

SEQ ID NO: 1395999 - RNA, 21 nt, Human
caguauggguuagggaaaaca

SEQ ID NO: 1396000 - RNA, 15 nt, Human
cagucauaacuaaau

SEQ ID NO: 1396001 - RNA, 14 nt, Human
cagucaggcccagg

SEQ ID NO: 1396002 - RNA, 21 nt, Human
cagucaggaaaggaaucauuu

SEQ ID NO: 1396003 - RNA, 22 nt, Human
cagucaggaaagagaacuucca

SEQ ID NO: 1396004 - RNA, 18 nt, Human
cagucaggaaagagaacu

SEQ ID NO: 1396005 - RNA, 15 nt, Human
cagucaggaaagaga

SEQ ID NO: 1396006 - RNA, 14 nt, Human
cagguuaagaaaau

SEQ ID NO: 1396007 - RNA, 14 nt, Human
cagguguugccaaa

SEQ ID NO: 1396008 - RNA, 13 nt, Human
cagguguugccaa

SEQ ID NO: 1396009 - RNA, 22 nt, Human
cagguguuacuguaauuccuca

SEQ ID NO: 1396010 - RNA, 20 nt, Human
cagguguuaacauuccaaga

SEQ ID NO: 1396011 - RNA, 19 nt, Human
cagguguuaacauuccaag

SEQ ID NO: 1396012 - RNA, 18 nt, Human
cagguguuaacauuccaa

SEQ ID NO: 1396013 - RNA, 17 nt, Human
cagguguuaacauucca

SEQ ID NO: 1396014 - RNA, 10 nt, Human
caguaacugu

SEQ ID NO: 1396015 - RNA, 9 nt, Human
caguaacug

SEQ ID NO: 1396016 - RNA, 18 nt, Human
caguaacuguuuuuuaag

SEQ ID NO: 1396017 - RNA, 16 nt, Human
caguaacucaucuguc

SEQ ID NO: 1396018 - RNA, 14 nt, Human
caguaacucaucug

SEQ ID NO: 1396019 - RNA, 21 nt, Human
caguaacgcgucuuccugagu

SEQ ID NO: 1396020 - RNA, 20 nt, Human
caguaacgcgucuuccugag

SEQ ID NO: 1396021 - RNA, 19 nt, Human
caguaacgcgucuuccuga

SEQ ID NO: 1396022 - RNA, 18 nt, Human
caguaacgcgucuuccug

SEQ ID NO: 1396023 - RNA, 15 nt, Human
caguaacaggcucaa

SEQ ID NO: 1396024 - RNA, 20 nt, Human
cagguucuccguuagcuccu

SEQ ID NO: 1396025 - RNA, 22 nt, Human
caguaaaugggggugcauuuga

SEQ ID NO: 1396026 - RNA, 21 nt, Human
caguaaaugggggugcauuug

SEQ ID NO: 1396027 - RNA, 23 nt, Human
cagguucccucccagaggagcca

SEQ ID NO: 1396028 - RNA, 18 nt, Human
cagguucccucccagagg

SEQ ID NO: 1396029 - RNA, 16 nt, Human
cagguucccucccaga

SEQ ID NO: 1396030 - RNA, 15 nt, Human
cagguucccucccag

SEQ ID NO: 1396031 - RNA, 14 nt, Human
cagguucccacuua

SEQ ID NO: 1396032 - RNA, 17 nt, Human
cagguucccaagcucag

SEQ ID NO: 1396033 - RNA, 15 nt, Human
cagguucccaagcuc

SEQ ID NO: 1396034 - RNA, 14 nt, Human
cagguucccaagcu

SEQ ID NO: 1396035 - RNA, 19 nt, Human
cagguuccacagaggacac

SEQ ID NO: 1396036 - RNA, 15 nt, Human
cagguuccacagagg

SEQ ID NO: 1396037 - RNA, 17 nt, Human
cagguuauaacaguguu

SEQ ID NO: 1396038 - RNA, 16 nt, Human
cagguuauaacagugu

SEQ ID NO: 1396039 - RNA, 15 nt, Human
cagguuauaacagug

SEQ ID NO: 1396040 - RNA, 23 nt, Human
caguaccuucaaacuagggccaa

SEQ ID NO: 1396041 - RNA, 22 nt, Human
caguaccugagggucuguaggu

SEQ ID NO: 1396042 - RNA, 23 nt, Human
caguaccugagggucuguagguu

SEQ ID NO: 1396043 - RNA, 21 nt, Human
caguaccugagggucuguagg

SEQ ID NO: 1396044 - RNA, 15 nt, Human
caguaccugaggguc

SEQ ID NO: 1396045 - RNA, 14 nt, Human
caguaccugagggu

SEQ ID NO: 1396046 - RNA, 24 nt, Human
caguacccucucagcuccaggugg

SEQ ID NO: 1396047 - RNA, 22 nt, Human
caguacccucucagcuccaggu

SEQ ID NO: 1396048 - RNA, 20 nt, Human
caguacccucucagcuccag

SEQ ID NO: 1396049 - RNA, 19 nt, Human
caguacccucucagcucca

SEQ ID NO: 1396050 - RNA, 16 nt, Human
caguacccucucagcu

SEQ ID NO: 1396051 - RNA, 15 nt, Human
caguacccucucagc

SEQ ID NO: 1396052 - RNA, 14 nt, Human
caguacccucucag

SEQ ID NO: 1396053 - RNA, 23 nt, Human
caguaccccauggagcugggcua

SEQ ID NO: 1396054 - RNA, 17 nt, Human
caguaccccauggagcu

SEQ ID NO: 1396055 - RNA, 23 nt, Human
caguaccauuuaauggggaggac

SEQ ID NO: 1396056 - RNA, 12 nt, Human
caguaccacaug

SEQ ID NO: 1396057 - RNA, 21 nt, Human
caguaauugguccgaucuuug

SEQ ID NO: 1396058 - RNA, 23 nt, Human
caguacacugucagcagggacug

SEQ ID NO: 1396059 - RNA, 14 nt, Human
caguaauuuagaaa

SEQ ID NO: 1396060 - RNA, 17 nt, Human
caguaauuugaggacaa

SEQ ID NO: 1396061 - RNA, 23 nt, Human
cagguggggagacugggcugagg

SEQ ID NO: 1396062 - RNA, 22 nt, Human
cagguggggagacugggcugag

SEQ ID NO: 1396063 - RNA, 20 nt, Human
cagguggggagacugggcug

SEQ ID NO: 1396064 - RNA, 19 nt, Human
cagguggggagacugggcu

SEQ ID NO: 1396065 - RNA, 21 nt, Human
caggggucugagcuccagcuc

SEQ ID NO: 1396066 - RNA, 19 nt, Human
caggggucugagcuccagc

SEQ ID NO: 1396067 - RNA, 23 nt, Human
caggggucugagcuccagcuccu

SEQ ID NO: 1396068 - RNA, 20 nt, Human
cagggggucuggcugguguu

SEQ ID NO: 1396069 - RNA, 16 nt, Human
cagggggugugucugc

SEQ ID NO: 1396070 - RNA, 14 nt, Human
caggguccugggag

SEQ ID NO: 1396071 - RNA, 17 nt, Human
caggguuuuaacuuugu

SEQ ID NO: 1396072 - RNA, 23 nt, Human
caggguccuuuugacacugcucu

SEQ ID NO: 1396073 - RNA, 22 nt, Human
caggguccuuuugacacugcuc

SEQ ID NO: 1396074 - RNA, 21 nt, Human
caggguccuuuugacacugcu

SEQ ID NO: 1396075 - RNA, 19 nt, Human
caggguccuuuugacacug

SEQ ID NO: 1396076 - RNA, 14 nt, Human
caggguccuuuuga

SEQ ID NO: 1396077 - RNA, 13 nt, Human
caggguccuggga

SEQ ID NO: 1396078 - RNA, 20 nt, Human
caggguccucuucugggccu

SEQ ID NO: 1396079 - RNA, 16 nt, Human
cagggucccucugugu

SEQ ID NO: 1396080 - RNA, 15 nt, Human
cagggucccucugug

SEQ ID NO: 1396081 - RNA, 13 nt, Human
cagggucccucug

SEQ ID NO: 1396082 - RNA, 19 nt, Human
cagggucccacagccacgu

SEQ ID NO: 1396083 - RNA, 18 nt, Human
cagggucccacagccacg

SEQ ID NO: 1396084 - RNA, 17 nt, Human
cagggucccacagccac

SEQ ID NO: 1396085 - RNA, 13 nt, Human
cagggucccacag

SEQ ID NO: 1396086 - RNA, 21 nt, Human
caggguccaacauagagccgg

SEQ ID NO: 1396087 - RNA, 13 nt, Human
cagggguuucucg

SEQ ID NO: 1396088 - RNA, 15 nt, Human
cagggguuagagcag

SEQ ID NO: 1396089 - RNA, 23 nt, Human
cagggucaaaguguuuucucuga

SEQ ID NO: 1396090 - RNA, 21 nt, Human
cagggucaaaguguuuucucu

SEQ ID NO: 1396091 - RNA, 23 nt, Human
caggguauggacuaucugucugg

SEQ ID NO: 1396092 - RNA, 18 nt, Human
caggguauggacuaucug

SEQ ID NO: 1396093 - RNA, 17 nt, Human
caggguaugaagagugu

SEQ ID NO: 1396094 - RNA, 13 nt, Human
caggguaugaaga

SEQ ID NO: 1396095 - RNA, 16 nt, Human
caggguaggcuggagu

SEQ ID NO: 1396096 - RNA, 15 nt, Human
cagguggcccuacug

SEQ ID NO: 1396097 - RNA, 22 nt, Human
cagguggcucugaggugccugu

SEQ ID NO: 1396098 - RNA, 20 nt, Human
cagguggccaaguuccucua

SEQ ID NO: 1396099 - RNA, 19 nt, Human
cagguggccaaguuccucu

SEQ ID NO: 1396100 - RNA, 18 nt, Human
cagguggccaaguuccuc

SEQ ID NO: 1396101 - RNA, 15 nt, Human
caggugcuggucccg

SEQ ID NO: 1396102 - RNA, 14 nt, Human
caggugcugguccc

SEQ ID NO: 1396103 - RNA, 18 nt, Human
caggugcuggggccuggu

SEQ ID NO: 1396104 - RNA, 17 nt, Human
caggugcuggggccugg

SEQ ID NO: 1396105 - RNA, 13 nt, Human
caggugcuggggc

SEQ ID NO: 1396106 - RNA, 22 nt, Human
cagguggaucuauuucauguuu

SEQ ID NO: 1396107 - RNA, 17 nt, Human
cagguggccaaguuccu

SEQ ID NO: 1396108 - RNA, 17 nt, Human
caggugaaaggaaauua

SEQ ID NO: 1396109 - RNA, 20 nt, Human
caggucuucaucgaaucuac

SEQ ID NO: 1396110 - RNA, 18 nt, Human
caggugaggucagcacau

SEQ ID NO: 1396111 - RNA, 19 nt, Human
caggugacugucuggggag

SEQ ID NO: 1396112 - RNA, 21 nt, Human
caggucugaagcucaacucuc

SEQ ID NO: 1396113 - RNA, 12 nt, Human
caggucuagacu

SEQ ID NO: 1396114 - RNA, 23 nt, Human
cagguccugguggggcagcuccu

SEQ ID NO: 1396115 - RNA, 21 nt, Human
cagguccugguggggcagcuc

SEQ ID NO: 1396116 - RNA, 20 nt, Human
cagguccugguggggcagcu

SEQ ID NO: 1396117 - RNA, 19 nt, Human
cagguccugguggggcagc

SEQ ID NO: 1396118 - RNA, 18 nt, Human
cagguccugguggggcag

SEQ ID NO: 1396119 - RNA, 14 nt, Human
cagguccugguggg

SEQ ID NO: 1396120 - RNA, 13 nt, Human
cagguccuggugg

SEQ ID NO: 1396121 - RNA, 20 nt, Human
cagguccucaguguccucag

SEQ ID NO: 1396122 - RNA, 20 nt, Human
cagguccucagagaauuucu

SEQ ID NO: 1396123 - RNA, 15 nt, Human
cagguccucagagaa

SEQ ID NO: 1396124 - RNA, 16 nt, Human
caggucccucucauuu

SEQ ID NO: 1396125 - RNA, 14 nt, Human
caggucccucucau

SEQ ID NO: 1396126 - RNA, 16 nt, Human
caggucccuccccuuc

SEQ ID NO: 1396127 - RNA, 16 nt, Human
cagguccaggcugugu

SEQ ID NO: 1396128 - RNA, 21 nt, Human
caggucccaaauggcccuggg

SEQ ID NO: 1396129 - RNA, 19 nt, Human
caggucccuaauaaagcug

SEQ ID NO: 1396130 - RNA, 20 nt, Human
caggucccuaauaaagcugu

SEQ ID NO: 1396131 - RNA, 21 nt, Human
caggucccuaauaaagcugug

SEQ ID NO: 1396132 - RNA, 22 nt, Human
caggucccuaauaaagcugugu

SEQ ID NO: 1396133 - RNA, 22 nt, Human
cagguauauacuuugaaaggag

SEQ ID NO: 1396134 - RNA, 18 nt, Human
cagguauauacuuugaaa

SEQ ID NO: 1396135 - RNA, 15 nt, Human
cagguauauacuuug

SEQ ID NO: 1396136 - RNA, 16 nt, Human
cagguauaccucacuu

SEQ ID NO: 1396137 - RNA, 15 nt, Human
cagguauaccucacu

SEQ ID NO: 1396138 - RNA, 14 nt, Human
cagguauaccucac

SEQ ID NO: 1396139 - RNA, 23 nt, Human
cagguaggggccccucucagccc

SEQ ID NO: 1396140 - RNA, 22 nt, Human
cagguaggggccccucucagcc

SEQ ID NO: 1396141 - RNA, 19 nt, Human
cagguaggggccccucuca

SEQ ID NO: 1396142 - RNA, 18 nt, Human
cagguaggggccccucuc

SEQ ID NO: 1396143 - RNA, 22 nt, Human
cagguaggccaagguguccuac

SEQ ID NO: 1396144 - RNA, 14 nt, Human
cagguaggccaagg

SEQ ID NO: 1396145 - RNA, 23 nt, Human
cagguaggaggcaaauaucuuga

SEQ ID NO: 1396146 - RNA, 14 nt, Human
cagguaggaggcaa

SEQ ID NO: 1396147 - RNA, 18 nt, Human
cagguagcugaaagggga

SEQ ID NO: 1396148 - RNA, 23 nt, Human
cagguagaauuaucuaauuuaua

SEQ ID NO: 1396149 - RNA, 22 nt, Human
cagguagaauuaucuaauuuau

SEQ ID NO: 1396150 - RNA, 20 nt, Human
cagguagaauuaucuaauuu

SEQ ID NO: 1396151 - RNA, 21 nt, Human
cagguacuuguaaauuauuaa

SEQ ID NO: 1396152 - RNA, 15 nt, Human
cagguaauacaaacu

SEQ ID NO: 1396153 - RNA, 14 nt, Human
cagguccaaugagc

SEQ ID NO: 1396154 - RNA, 15 nt, Human
caggucagccacugu

SEQ ID NO: 1396155 - RNA, 16 nt, Human
caggucagccacuguu

SEQ ID NO: 1396156 - RNA, 19 nt, Human
cagguccagcucuggaggg

SEQ ID NO: 1396157 - RNA, 17 nt, Human
cagguccagcucuggag

SEQ ID NO: 1396158 - RNA, 16 nt, Human
cagguccagcucugga

SEQ ID NO: 1396159 - RNA, 14 nt, Human
cagguccagcucug

SEQ ID NO: 1396160 - RNA, 13 nt, Human
cagguccagcucu

SEQ ID NO: 1396161 - RNA, 22 nt, Human
cagguccaaugagcuuucugaa

SEQ ID NO: 1396162 - RNA, 21 nt, Human
cagguccaaugagcuuucuga

SEQ ID NO: 1396163 - RNA, 19 nt, Human
cagguccaaugagcuuucu

SEQ ID NO: 1396164 - RNA, 18 nt, Human
cagguccaaugagcuuuc

SEQ ID NO: 1396165 - RNA, 17 nt, Human
cagguccaaugagcuuu

SEQ ID NO: 1396166 - RNA, 13 nt, Human
cagguccaggcug

SEQ ID NO: 1396167 - RNA, 16 nt, Human
cagguccagagagacc

SEQ ID NO: 1396168 - RNA, 23 nt, Human
cagguccagcucuggaggggagg

SEQ ID NO: 1396169 - RNA, 11 nt, Human
caggucccuaa

SEQ ID NO: 1396170 - RNA, 12 nt, Human
caggucccuaau

SEQ ID NO: 1396171 - RNA, 13 nt, Human
caggucccuaaua

SEQ ID NO: 1396172 - RNA, 14 nt, Human
caggucccuaauaa

SEQ ID NO: 1396173 - RNA, 15 nt, Human
caggucccuaauaaa

SEQ ID NO: 1396174 - RNA, 16 nt, Human
caggucccuaauaaag

SEQ ID NO: 1396175 - RNA, 17 nt, Human
caggucccuaauaaagc

SEQ ID NO: 1396176 - RNA, 18 nt, Human
caggucccuaauaaagcu

SEQ ID NO: 1396177 - RNA, 18 nt, Human
cauauuuuaaacagagga

SEQ ID NO: 1396178 - RNA, 15 nt, Human
caucaacaaaaauug

SEQ ID NO: 1396179 - RNA, 13 nt, Human
caucaacaaaaau

SEQ ID NO: 1396180 - RNA, 17 nt, Human
cauauuuuaaacagagg

SEQ ID NO: 1396181 - RNA, 16 nt, Human
cauauuuuaaacagag

SEQ ID NO: 1396182 - RNA, 19 nt, Human
cauauuuuaaaauuuguuc

SEQ ID NO: 1396183 - RNA, 13 nt, Human
cauauuuuaaaau

SEQ ID NO: 1396184 - RNA, 23 nt, Human
cauauuuguuuaugguaaaaaau

SEQ ID NO: 1396185 - RNA, 12 nt, Human
caucaacugaau

SEQ ID NO: 1396186 - RNA, 10 nt, Human
caucaacuga

SEQ ID NO: 1396187 - RNA, 15 nt, Human
cagugcuucccgagu

SEQ ID NO: 1396188 - RNA, 22 nt, Human
cagugcugugcugugcuauggu

SEQ ID NO: 1396189 - RNA, 19 nt, Human
cagugcugugcugugcuau

SEQ ID NO: 1396190 - RNA, 16 nt, Human
cagugcugugcugugc

SEQ ID NO: 1396191 - RNA, 12 nt, Human
cagugcugugcu

SEQ ID NO: 1396192 - RNA, 19 nt, Human
cagugcugauguagcaugc

SEQ ID NO: 1396193 - RNA, 23 nt, Human
cagugcugaccagacagccuccc

SEQ ID NO: 1396194 - RNA, 23 nt, Human
cagugcucuuuucuccucacugu

SEQ ID NO: 1396195 - RNA, 14 nt, Human
cagugcucuuuucu

SEQ ID NO: 1396196 - RNA, 18 nt, Human
cauaguauucaugacuau

SEQ ID NO: 1396197 - RNA, 16 nt, Human
cauaguagaacgcuau

SEQ ID NO: 1396198 - RNA, 18 nt, Human
cauaguaccaaucauuuu

SEQ ID NO: 1396199 - RNA, 16 nt, Human
cauaguaccaaucauu

SEQ ID NO: 1396200 - RNA, 24 nt, Human
cauaguaacuucuuauggaauuga

SEQ ID NO: 1396201 - RNA, 23 nt, Human
cauaguaacuucuuauggaauug

SEQ ID NO: 1396202 - RNA, 22 nt, Human
cauaguaacuucuuauggaauu

SEQ ID NO: 1396203 - RNA, 21 nt, Human
cauaguaacuucuuauggaau

SEQ ID NO: 1396204 - RNA, 22 nt, Human
cauaguaccaaucauuuuaauu

SEQ ID NO: 1396205 - RNA, 16 nt, Human
cauauaagugauugcu

SEQ ID NO: 1396206 - RNA, 13 nt, Human
cauauauaacaau

SEQ ID NO: 1396207 - RNA, 20 nt, Human
cauauauaacaaugcuguau

SEQ ID NO: 1396208 - RNA, 15 nt, Human
cauauauaacaaugc

SEQ ID NO: 1396209 - RNA, 17 nt, Human
cauauaugaggacuugu

SEQ ID NO: 1396210 - RNA, 20 nt, Human
cauauugugauucugccuuu

SEQ ID NO: 1396211 - RNA, 18 nt, Human
cauauugugauucugccu

SEQ ID NO: 1396212 - RNA, 19 nt, Human
cauauuguaaaacagguag

SEQ ID NO: 1396213 - RNA, 17 nt, Human
cauauuguaaaacaggu

SEQ ID NO: 1396214 - RNA, 16 nt, Human
cauauuguaaaacagg

SEQ ID NO: 1396215 - RNA, 13 nt, Human
cauauuguaaaac

SEQ ID NO: 1396216 - RNA, 21 nt, Human
cauauugauuuccguuaaaau

SEQ ID NO: 1396217 - RNA, 14 nt, Human
cauauugcacaugu

SEQ ID NO: 1396218 - RNA, 15 nt, Human
cauauugcacauguc

SEQ ID NO: 1396219 - RNA, 16 nt, Human
cauauugcacaugucu

SEQ ID NO: 1396220 - RNA, 17 nt, Human
cauauugcacaugucuu

SEQ ID NO: 1396221 - RNA, 18 nt, Human
cauauugcacaugucuua

SEQ ID NO: 1396222 - RNA, 19 nt, Human
cauauugcacaugucuuaa

SEQ ID NO: 1396223 - RNA, 20 nt, Human
cauauugcacaugucuuaau

SEQ ID NO: 1396224 - RNA, 21 nt, Human
cauauugcacaugucuuaaug

SEQ ID NO: 1396225 - RNA, 23 nt, Human
cauauugcacaugucuuaaugaa

SEQ ID NO: 1396226 - RNA, 22 nt, Human
cauauugcacaugucuuaauga

SEQ ID NO: 1396227 - RNA, 17 nt, Human
cauauugauuuccguua

SEQ ID NO: 1396228 - RNA, 11 nt, Human
cauaucugccu

SEQ ID NO: 1396229 - RNA, 12 nt, Human
cauaucugccuu

SEQ ID NO: 1396230 - RNA, 13 nt, Human
cauaucugccuuu

SEQ ID NO: 1396231 - RNA, 15 nt, Human
cauaucugccuuuau

SEQ ID NO: 1396232 - RNA, 18 nt, Human
cauaucugccuuuauugu

SEQ ID NO: 1396233 - RNA, 20 nt, Human
cauaucugccuuuauugugu

SEQ ID NO: 1396234 - RNA, 19 nt, Human
cauauuuguaaaaugacaa

SEQ ID NO: 1396235 - RNA, 18 nt, Human
cauauuuguaaaaugaca

SEQ ID NO: 1396236 - RNA, 16 nt, Human
cauauuuguaaaauga

SEQ ID NO: 1396237 - RNA, 15 nt, Human
cauauuuguaaaaug

SEQ ID NO: 1396238 - RNA, 14 nt, Human
cauauuuguaaaau

SEQ ID NO: 1396239 - RNA, 13 nt, Human
cauauuuguaaaa

SEQ ID NO: 1396240 - RNA, 16 nt, Human
cauauuguugaaaggu

SEQ ID NO: 1396241 - RNA, 13 nt, Human
cauauuguugaaa

SEQ ID NO: 1396242 - RNA, 13 nt, Human
cauauuguuacug

SEQ ID NO: 1396243 - RNA, 19 nt, Human
cauauuguugcauugcuuu

SEQ ID NO: 1396244 - RNA, 19 nt, Human
cauauuguuacugguacca

SEQ ID NO: 1396245 - RNA, 20 nt, Human
cauccagagucccugccugg

SEQ ID NO: 1396246 - RNA, 18 nt, Human
cauccagagucccugccu

SEQ ID NO: 1396247 - RNA, 17 nt, Human
cauccagagucccugcc

SEQ ID NO: 1396248 - RNA, 13 nt, Human
cauccagaguccc

SEQ ID NO: 1396249 - RNA, 14 nt, Human
cauccaugccucag

SEQ ID NO: 1396250 - RNA, 14 nt, Human
cauccaucaucaug

SEQ ID NO: 1396251 - RNA, 13 nt, Human
cauccaucaucau

SEQ ID NO: 1396252 - RNA, 13 nt, Human
cauccaguucaug

SEQ ID NO: 1396253 - RNA, 14 nt, Human
cauccagucuauuc

SEQ ID NO: 1396254 - RNA, 21 nt, Human
cauccagagucccugccugga

SEQ ID NO: 1396255 - RNA, 14 nt, Human
caucauuauuuaug

SEQ ID NO: 1396256 - RNA, 19 nt, Human
caucauuauuuauguauug

SEQ ID NO: 1396257 - RNA, 15 nt, Human
caucauuauuuaugu

SEQ ID NO: 1396258 - RNA, 14 nt, Human
caucauucucuguc

SEQ ID NO: 1396259 - RNA, 12 nt, Human
caucauucucug

SEQ ID NO: 1396260 - RNA, 17 nt, Human
caucauucucugucuca

SEQ ID NO: 1396261 - RNA, 16 nt, Human
caucauucucugucuc

SEQ ID NO: 1396262 - RNA, 15 nt, Human
caucauucucugucu

SEQ ID NO: 1396263 - RNA, 21 nt, Human
caucccugggccuugggcucc

SEQ ID NO: 1396264 - RNA, 17 nt, Human
caucccugggccuuggg

SEQ ID NO: 1396265 - RNA, 23 nt, Human
caucccugggccugcugcugaga

SEQ ID NO: 1396266 - RNA, 22 nt, Human
caucccugggccugcugcugag

SEQ ID NO: 1396267 - RNA, 21 nt, Human
caucccugggccugcugcuga

SEQ ID NO: 1396268 - RNA, 20 nt, Human
caucccugggccugcugcug

SEQ ID NO: 1396269 - RNA, 19 nt, Human
caucccugggccugcugcu

SEQ ID NO: 1396270 - RNA, 18 nt, Human
caucccugggccugcugc

SEQ ID NO: 1396271 - RNA, 17 nt, Human
caucccugggccugcug

SEQ ID NO: 1396272 - RNA, 16 nt, Human
caucccugggccugcu

SEQ ID NO: 1396273 - RNA, 15 nt, Human
caucccugggccugc

SEQ ID NO: 1396274 - RNA, 14 nt, Human
caucccugggccug

SEQ ID NO: 1396275 - RNA, 13 nt, Human
caucccugggccu

SEQ ID NO: 1396276 - RNA, 12 nt, Human
caucccugggcc

SEQ ID NO: 1396277 - RNA, 11 nt, Human
caucccugggc

SEQ ID NO: 1396278 - RNA, 23 nt, Human
caucccuggcccccucccuggau

SEQ ID NO: 1396279 - RNA, 22 nt, Human
caucccuggcccccucccugga

SEQ ID NO: 1396280 - RNA, 21 nt, Human
caucccuggcccccucccugg

SEQ ID NO: 1396281 - RNA, 20 nt, Human
caucccuggcccccucccug

SEQ ID NO: 1396282 - RNA, 13 nt, Human
caucccuggcccc

SEQ ID NO: 1396283 - RNA, 12 nt, Human
caucccuggccc

SEQ ID NO: 1396284 - RNA, 15 nt, Human
cauccaugccucaga

SEQ ID NO: 1396285 - RNA, 13 nt, Human
caucccuccuggg

SEQ ID NO: 1396286 - RNA, 14 nt, Human
cauccgcaggugcu

SEQ ID NO: 1396287 - RNA, 13 nt, Human
cauccgcaggugc

SEQ ID NO: 1396288 - RNA, 15 nt, Human
caucccuuuuucaau

SEQ ID NO: 1396289 - RNA, 16 nt, Human
caucccuuugcccaga

SEQ ID NO: 1396290 - RNA, 22 nt, Human
caucccugggccuugggcuccg

SEQ ID NO: 1396291 - RNA, 18 nt, Human
caucccuuaccugggaaa

SEQ ID NO: 1396292 - RNA, 24 nt, Human
caucagugcucccucacaugucag

SEQ ID NO: 1396293 - RNA, 16 nt, Human
caucagugcucccuca

SEQ ID NO: 1396294 - RNA, 15 nt, Human
caucagugcucccuc

SEQ ID NO: 1396295 - RNA, 19 nt, Human
caucaggguaggcuggagu

SEQ ID NO: 1396296 - RNA, 15 nt, Human
caucaggcuuucuua

SEQ ID NO: 1396297 - RNA, 15 nt, Human
caucaggcuuucuuu

SEQ ID NO: 1396298 - RNA, 11 nt, Human
caucaggcuuu

SEQ ID NO: 1396299 - RNA, 17 nt, Human
caucacugaguuuucca

SEQ ID NO: 1396300 - RNA, 23 nt, Human
caucacugaguuuuccauggcag

SEQ ID NO: 1396301 - RNA, 16 nt, Human
caucacugaguuuucc

SEQ ID NO: 1396302 - RNA, 19 nt, Human
caucacguuagcuguccca

SEQ ID NO: 1396303 - RNA, 20 nt, Human
caucaccucagauggcagcu

SEQ ID NO: 1396304 - RNA, 22 nt, Human
caucaccucagauggcagcuuu

SEQ ID NO: 1396305 - RNA, 17 nt, Human
caucaccucagauggca

SEQ ID NO: 1396306 - RNA, 16 nt, Human
caucaccucagauggc

SEQ ID NO: 1396307 - RNA, 21 nt, Human
caucaccuacucacacaggca

SEQ ID NO: 1396308 - RNA, 20 nt, Human
caucaccuacucacacaggc

SEQ ID NO: 1396309 - RNA, 14 nt, Human
caucaacugaauga

SEQ ID NO: 1396310 - RNA, 14 nt, Human
caucaccuacucac

SEQ ID NO: 1396311 - RNA, 23 nt, Human
caucaugccucugaggccagccu

SEQ ID NO: 1396312 - RNA, 22 nt, Human
caucaugccucugaggccagcc

SEQ ID NO: 1396313 - RNA, 20 nt, Human
caucaugccucugaggccag

SEQ ID NO: 1396314 - RNA, 19 nt, Human
caucaugccucugaggcca

SEQ ID NO: 1396315 - RNA, 18 nt, Human
caucaugccucugaggcc

SEQ ID NO: 1396316 - RNA, 17 nt, Human
caucaugccucugaggc

SEQ ID NO: 1396317 - RNA, 16 nt, Human
caucaugccucugagg

SEQ ID NO: 1396318 - RNA, 15 nt, Human
caucaugccucugag

SEQ ID NO: 1396319 - RNA, 14 nt, Human
caucaugccucuga

SEQ ID NO: 1396320 - RNA, 13 nt, Human
caucaugccucug

SEQ ID NO: 1396321 - RNA, 15 nt, Human
caucauggcuaucug

SEQ ID NO: 1396322 - RNA, 21 nt, Human
caucauggccagcuggaggca

SEQ ID NO: 1396323 - RNA, 15 nt, Human
caucauggccagcug

SEQ ID NO: 1396324 - RNA, 14 nt, Human
caucauggccagcu

SEQ ID NO: 1396325 - RNA, 13 nt, Human
caucauggccagc

SEQ ID NO: 1396326 - RNA, 24 nt, Human
caucaucauggccagcuggaggca

SEQ ID NO: 1396327 - RNA, 18 nt, Human
caucaucauggccagcug

SEQ ID NO: 1396328 - RNA, 15 nt, Human
caucaucauggccag

SEQ ID NO: 1396329 - RNA, 15 nt, Human
caucauccucuggcu

SEQ ID NO: 1396330 - RNA, 14 nt, Human
caucauccucuggc

SEQ ID NO: 1396331 - RNA, 13 nt, Human
caucauccucugg

SEQ ID NO: 1396332 - RNA, 21 nt, Human
caucaucuccugccuuccucc

SEQ ID NO: 1396333 - RNA, 20 nt, Human
caucaucuccugccuuccuc

SEQ ID NO: 1396334 - RNA, 13 nt, Human
caucaucuccugc

SEQ ID NO: 1396335 - RNA, 14 nt, Human
caucaucucagcuc

SEQ ID NO: 1396336 - RNA, 15 nt, Human
caucaucucagcuca

SEQ ID NO: 1396337 - RNA, 20 nt, Human
cauccgcaggugcugguccc

SEQ ID NO: 1396338 - RNA, 21 nt, Human
cauccuaccacaaugcagugc

SEQ ID NO: 1396339 - RNA, 15 nt, Human
cauccuacccccugu

SEQ ID NO: 1396340 - RNA, 16 nt, Human
caucuccugccuuccu

SEQ ID NO: 1396341 - RNA, 17 nt, Human
caucucccuuuuccaug

SEQ ID NO: 1396342 - RNA, 23 nt, Human
caucucccuggugcuuaugcucu

SEQ ID NO: 1396343 - RNA, 19 nt, Human
caucucccuggugcuuaug

SEQ ID NO: 1396344 - RNA, 16 nt, Human
caucucccuggugcuu

SEQ ID NO: 1396345 - RNA, 15 nt, Human
caucucccuggugcu

SEQ ID NO: 1396346 - RNA, 14 nt, Human
caucucccuggugc

SEQ ID NO: 1396347 - RNA, 23 nt, Human
cauccuaccacaaugcagugccu

SEQ ID NO: 1396348 - RNA, 18 nt, Human
cauccuacccccugugcc

SEQ ID NO: 1396349 - RNA, 20 nt, Human
caucucccuggugcuuaugc

SEQ ID NO: 1396350 - RNA, 22 nt, Human
caucuccugccuuccuccuggg

SEQ ID NO: 1396351 - RNA, 19 nt, Human
caucuccugccuuccuccu

SEQ ID NO: 1396352 - RNA, 22 nt, Human
caucucugggcuggaugagcuc

SEQ ID NO: 1396353 - RNA, 19 nt, Human
caucucugggcuggaugag

SEQ ID NO: 1396354 - RNA, 18 nt, Human
caucucugggcuggauga

SEQ ID NO: 1396355 - RNA, 14 nt, Human
caucucugggcugg

SEQ ID NO: 1396356 - RNA, 12 nt, Human
caucucugggcu

SEQ ID NO: 1396357 - RNA, 18 nt, Human
caucucucugcccaaccc

SEQ ID NO: 1396358 - RNA, 16 nt, Human
caucucucugcccaac

SEQ ID NO: 1396359 - RNA, 15 nt, Human
caucucucugcccaa

SEQ ID NO: 1396360 - RNA, 13 nt, Human
caucucucugccc

SEQ ID NO: 1396361 - RNA, 20 nt, Human
caucucuaccuucuccccag

SEQ ID NO: 1396362 - RNA, 21 nt, Human
caucucuaccuucuccccagc

SEQ ID NO: 1396363 - RNA, 19 nt, Human
caucucuaccuucucccca

SEQ ID NO: 1396364 - RNA, 18 nt, Human
caucucuaccuucucccc

SEQ ID NO: 1396365 - RNA, 13 nt, Human
caucucuaccuuc

SEQ ID NO: 1396366 - RNA, 19 nt, Human
caucuucuucaccauuugg

SEQ ID NO: 1396367 - RNA, 14 nt, Human
caucuucuucacca

SEQ ID NO: 1396368 - RNA, 17 nt, Human
caucuucugccuuaguc

SEQ ID NO: 1396369 - RNA, 10 nt, Human
caucuuuaag

SEQ ID NO: 1396370 - RNA, 22 nt, Human
caucuuugaaauuauguaaauu

SEQ ID NO: 1396371 - RNA, 21 nt, Human
caucuuugaaauuauguaaau

SEQ ID NO: 1396372 - RNA, 18 nt, Human
caucuuugaaauuaugua

SEQ ID NO: 1396373 - RNA, 12 nt, Human
caucuuugaaau

SEQ ID NO: 1396374 - RNA, 11 nt, Human
caucuuugaaa

SEQ ID NO: 1396375 - RNA, 22 nt, Human
caucuuuacaaaacuacaugag

SEQ ID NO: 1396376 - RNA, 22 nt, Human
caucuuuuguauuaagaaagga

SEQ ID NO: 1396377 - RNA, 18 nt, Human
caucuuuuguauuaagaa

SEQ ID NO: 1396378 - RNA, 15 nt, Human
caucuuuuguauuaa

SEQ ID NO: 1396379 - RNA, 14 nt, Human
caucuuuuguauua

SEQ ID NO: 1396380 - RNA, 13 nt, Human
caucuuuuguauu

SEQ ID NO: 1396381 - RNA, 19 nt, Human
caucuuuuguauuaagaaa

SEQ ID NO: 1396382 - RNA, 13 nt, Human
caugaaaacacau

SEQ ID NO: 1396383 - RNA, 14 nt, Human
caugaaaacacauu

SEQ ID NO: 1396384 - RNA, 15 nt, Human
caugaaaacacauuu

SEQ ID NO: 1396385 - RNA, 16 nt, Human
caugaaaacacauuuu

SEQ ID NO: 1396386 - RNA, 17 nt, Human
caugaaaacacauuuuu

SEQ ID NO: 1396387 - RNA, 19 nt, Human
caugaaccucaagcugcau

SEQ ID NO: 1396388 - RNA, 20 nt, Human
caugaacuuagauuuuacau

SEQ ID NO: 1396389 - RNA, 17 nt, Human
caugaacuuagauuuua

SEQ ID NO: 1396390 - RNA, 20 nt, Human
caugaaccucaagcugcauc

SEQ ID NO: 1396391 - RNA, 15 nt, Human
caugaaacagaaaca

SEQ ID NO: 1396392 - RNA, 13 nt, Human
caugaaacagaaa

SEQ ID NO: 1396393 - RNA, 15 nt, Human
caugaaaauucagaa

SEQ ID NO: 1396394 - RNA, 19 nt, Human
caugaaacagaaacaaaaa

SEQ ID NO: 1396395 - RNA, 22 nt, Human
caugaaauauagaucaguuaua

SEQ ID NO: 1396396 - RNA, 14 nt, Human
caugaaagauucaa

SEQ ID NO: 1396397 - RNA, 19 nt, Human
caugaaaacacauuuuucu

SEQ ID NO: 1396398 - RNA, 21 nt, Human
caugaaaacacauuuuucuua

SEQ ID NO: 1396399 - RNA, 22 nt, Human
caugaccuccagcuuuccugua

SEQ ID NO: 1396400 - RNA, 21 nt, Human
caugaccuccagcuuuccugu

SEQ ID NO: 1396401 - RNA, 20 nt, Human
caugaccuccagcuuuccug

SEQ ID NO: 1396402 - RNA, 17 nt, Human
caugaccuccagcuuuc

SEQ ID NO: 1396403 - RNA, 15 nt, Human
caugaccuccagcuu

SEQ ID NO: 1396404 - RNA, 14 nt, Human
caugaccuccagcu

SEQ ID NO: 1396405 - RNA, 13 nt, Human
caugaccuccagc

SEQ ID NO: 1396406 - RNA, 22 nt, Human
caugaagccacgggugccagaa

SEQ ID NO: 1396407 - RNA, 17 nt, Human
caugacucggggguggg

SEQ ID NO: 1396408 - RNA, 14 nt, Human
caugacuauggaua

SEQ ID NO: 1396409 - RNA, 21 nt, Human
caugaagccacgggugccaga

SEQ ID NO: 1396410 - RNA, 18 nt, Human
caugaagauucuuuccca

SEQ ID NO: 1396411 - RNA, 19 nt, Human
caugagaaucuauauuuaa

SEQ ID NO: 1396412 - RNA, 12 nt, Human
caugagaaucua

SEQ ID NO: 1396413 - RNA, 16 nt, Human
caugagaacaaacaga

SEQ ID NO: 1396414 - RNA, 22 nt, Human
caugagaaauacaaaaauacuc

SEQ ID NO: 1396415 - RNA, 18 nt, Human
caugagaaauacaaaaau

SEQ ID NO: 1396416 - RNA, 13 nt, Human
caugagaaauaca

SEQ ID NO: 1396417 - RNA, 18 nt, Human
caugacugcuugcccuaa

SEQ ID NO: 1396418 - RNA, 21 nt, Human
caugacugcuugcccuaagca

SEQ ID NO: 1396419 - RNA, 16 nt, Human
caugacugcuugcccu

SEQ ID NO: 1396420 - RNA, 14 nt, Human
caugacugcuugcc

SEQ ID NO: 1396421 - RNA, 13 nt, Human
caugacugcuugc

SEQ ID NO: 1396422 - RNA, 12 nt, Human
caugacugcuug

SEQ ID NO: 1396423 - RNA, 17 nt, Human
caugagaccacuguuau

SEQ ID NO: 1396424 - RNA, 19 nt, Human
caugagaccacuguuauca

SEQ ID NO: 1396425 - RNA, 14 nt, Human
caugagaggaggca

SEQ ID NO: 1396426 - RNA, 15 nt, Human
caugagaggaggcag

SEQ ID NO: 1396427 - RNA, 16 nt, Human
caugagaggaggcagc

SEQ ID NO: 1396428 - RNA, 20 nt, Human
caugagaggaggcagcagga

SEQ ID NO: 1396429 - RNA, 21 nt, Human
caugagaggaggcagcaggac

SEQ ID NO: 1396430 - RNA, 22 nt, Human
caugagaugauacauccaaagc

SEQ ID NO: 1396431 - RNA, 18 nt, Human
caugaggccacuggagac

SEQ ID NO: 1396432 - RNA, 23 nt, Human
caugaggagauucugccuuugcc

SEQ ID NO: 1396433 - RNA, 21 nt, Human
caugaggagauucugccuuug

SEQ ID NO: 1396434 - RNA, 20 nt, Human
caugaggagauucugccuuu

SEQ ID NO: 1396435 - RNA, 19 nt, Human
caugaggagauucugccuu

SEQ ID NO: 1396436 - RNA, 21 nt, Human
caugaggacucuauucuuuaa

SEQ ID NO: 1396437 - RNA, 20 nt, Human
caugaggacucuauucuuua

SEQ ID NO: 1396438 - RNA, 23 nt, Human
caugagcuccuuaaggcucuuuu

SEQ ID NO: 1396439 - RNA, 14 nt, Human
caugagugaauaaa

SEQ ID NO: 1396440 - RNA, 22 nt, Human
caugagggguuccuccccucca

SEQ ID NO: 1396441 - RNA, 21 nt, Human
caugagggguuccuccccucc

SEQ ID NO: 1396442 - RNA, 18 nt, Human
caugagggguuccucccc

SEQ ID NO: 1396443 - RNA, 15 nt, Human
caugagggguuccuc

SEQ ID NO: 1396444 - RNA, 18 nt, Human
caugagucacuacgccug

SEQ ID NO: 1396445 - RNA, 14 nt, Human
caugcacugauguu

SEQ ID NO: 1396446 - RNA, 18 nt, Human
caugauaaugaacagaac

SEQ ID NO: 1396447 - RNA, 22 nt, Human
caugaucccuguguugucucua

SEQ ID NO: 1396448 - RNA, 21 nt, Human
caugaucccuguguugucucu

SEQ ID NO: 1396449 - RNA, 20 nt, Human
caugaguuccagaaaguaaa

SEQ ID NO: 1396450 - RNA, 19 nt, Human
caugaguuccagaaaguaa

SEQ ID NO: 1396451 - RNA, 18 nt, Human
caugaguuccagaaagua

SEQ ID NO: 1396452 - RNA, 23 nt, Human
caugaguuggggucuggcagccu

SEQ ID NO: 1396453 - RNA, 21 nt, Human
caugaguuggggucuggcagc

SEQ ID NO: 1396454 - RNA, 13 nt, Human
caugauaaaugau

SEQ ID NO: 1396455 - RNA, 16 nt, Human
cauggucacacacuga

SEQ ID NO: 1396456 - RNA, 20 nt, Human
cauggguauaguucaugucu

SEQ ID NO: 1396457 - RNA, 18 nt, Human
cauggggaggaggagggu

SEQ ID NO: 1396458 - RNA, 19 nt, Human
cauggggaggaggaggguc

SEQ ID NO: 1396459 - RNA, 15 nt, Human
cauggggaggaggag

SEQ ID NO: 1396460 - RNA, 12 nt, Human
cauggggaggag

SEQ ID NO: 1396461 - RNA, 21 nt, Human
caugggagcugguuagaaaug

SEQ ID NO: 1396462 - RNA, 22 nt, Human
caugggagccgggucugccucu

SEQ ID NO: 1396463 - RNA, 13 nt, Human
caugggagccggg

SEQ ID NO: 1396464 - RNA, 17 nt, Human
caugggaccacaacuau

SEQ ID NO: 1396465 - RNA, 23 nt, Human
cauggcagugggaaaaauguagg

SEQ ID NO: 1396466 - RNA, 12 nt, Human
cauggcaguggg

SEQ ID NO: 1396467 - RNA, 20 nt, Human
cauggcagggggcugcugcu

SEQ ID NO: 1396468 - RNA, 19 nt, Human
cauggcagggggcugcugc

SEQ ID NO: 1396469 - RNA, 18 nt, Human
cauggcagggggcugcug

SEQ ID NO: 1396470 - RNA, 17 nt, Human
cauggcagggggcugcu

SEQ ID NO: 1396471 - RNA, 14 nt, Human
cauggcagggggcu

SEQ ID NO: 1396472 - RNA, 13 nt, Human
cauggcagggggc

SEQ ID NO: 1396473 - RNA, 21 nt, Human
cauggcagauguaggagggac

SEQ ID NO: 1396474 - RNA, 23 nt, Human
cauggcagauguaggagggacug

SEQ ID NO: 1396475 - RNA, 20 nt, Human
cauggcagauguaggaggga

SEQ ID NO: 1396476 - RNA, 19 nt, Human
cauggcagauguaggaggg

SEQ ID NO: 1396477 - RNA, 16 nt, Human
cauggagguucuaagg

SEQ ID NO: 1396478 - RNA, 15 nt, Human
cauggagguucuaag

SEQ ID NO: 1396479 - RNA, 13 nt, Human
cauggagguucua

SEQ ID NO: 1396480 - RNA, 22 nt, Human
cauggagggagggagugguuug

SEQ ID NO: 1396481 - RNA, 18 nt, Human
cauggagggagggagugg

SEQ ID NO: 1396482 - RNA, 17 nt, Human
caugggcagagcccaag

SEQ ID NO: 1396483 - RNA, 15 nt, Human
caugggcagagccca

SEQ ID NO: 1396484 - RNA, 14 nt, Human
caugggaggcucac

SEQ ID NO: 1396485 - RNA, 16 nt, Human
caugggauuauuagaa

SEQ ID NO: 1396486 - RNA, 15 nt, Human
cauggagcugggcua

SEQ ID NO: 1396487 - RNA, 19 nt, Human
cauggacucuguccugaag

SEQ ID NO: 1396488 - RNA, 22 nt, Human
cauggacuucugccagcauaau

SEQ ID NO: 1396489 - RNA, 23 nt, Human
cauggacucuguccugaaggccu

SEQ ID NO: 1396490 - RNA, 17 nt, Human
cauggacucuguccuga

SEQ ID NO: 1396491 - RNA, 16 nt, Human
cauggacucuguccug

SEQ ID NO: 1396492 - RNA, 23 nt, Human
cauggacaauggaccggagagug

SEQ ID NO: 1396493 - RNA, 16 nt, Human
cauggacacuacaccc

SEQ ID NO: 1396494 - RNA, 17 nt, Human
cauggacacuacaccca

SEQ ID NO: 1396495 - RNA, 18 nt, Human
cauggacacuacacccag

SEQ ID NO: 1396496 - RNA, 19 nt, Human
cauggacacuacacccagc

SEQ ID NO: 1396497 - RNA, 20 nt, Human
cauggacacuacacccagca

SEQ ID NO: 1396498 - RNA, 20 nt, Human
caugcuguucaugaaagauu

SEQ ID NO: 1396499 - RNA, 22 nt, Human
caugcugugugacucaaaccaa

SEQ ID NO: 1396500 - RNA, 18 nt, Human
caugcuguucaugaaaga

SEQ ID NO: 1396501 - RNA, 16 nt, Human
caugcuguucaugaaa

SEQ ID NO: 1396502 - RNA, 20 nt, Human
cauggacaauggaccggaga

SEQ ID NO: 1396503 - RNA, 18 nt, Human
cauggacaauggaccgga

SEQ ID NO: 1396504 - RNA, 17 nt, Human
cauggacaauggaccgg

SEQ ID NO: 1396505 - RNA, 15 nt, Human
cauggacaauggacc

SEQ ID NO: 1396506 - RNA, 14 nt, Human
cauggacaauggac

SEQ ID NO: 1396507 - RNA, 19 nt, Human
cauggaaauuuaaagcagg

SEQ ID NO: 1396508 - RNA, 20 nt, Human
cauggaauuggagcucgugg

SEQ ID NO: 1396509 - RNA, 21 nt, Human
cauggaaauuuaaagcagguu

SEQ ID NO: 1396510 - RNA, 18 nt, Human
cauggaaauuuaaagcag

SEQ ID NO: 1396511 - RNA, 17 nt, Human
cauggaaauuuaaagca

SEQ ID NO: 1396512 - RNA, 16 nt, Human
cauggaaauuuaaagc

SEQ ID NO: 1396513 - RNA, 15 nt, Human
cauggaaauuuaaag

SEQ ID NO: 1396514 - RNA, 21 nt, Human
cauggaaauucccuucaucug

SEQ ID NO: 1396515 - RNA, 14 nt, Human
caugcugugugacu

SEQ ID NO: 1396516 - RNA, 20 nt, Human
caugcugugcgcccagggcu

SEQ ID NO: 1396517 - RNA, 15 nt, Human
caugcuguucaugaa

SEQ ID NO: 1396518 - RNA, 17 nt, Human
caugcugugugacucaa

SEQ ID NO: 1396519 - RNA, 21 nt, Human
caugcugugugacucaaacca

SEQ ID NO: 1396520 - RNA, 16 nt, Human
caugcggcccaggaug

SEQ ID NO: 1396521 - RNA, 23 nt, Human
caugcgcucagggccaugcugag

SEQ ID NO: 1396522 - RNA, 20 nt, Human
caugcacugugaaggacccu

SEQ ID NO: 1396523 - RNA, 18 nt, Human
caugcacugugaaggacc

SEQ ID NO: 1396524 - RNA, 17 nt, Human
caugcacugugaaggac

SEQ ID NO: 1396525 - RNA, 16 nt, Human
caugcacugugaagga

SEQ ID NO: 1396526 - RNA, 14 nt, Human
caugcacugugaag

SEQ ID NO: 1396527 - RNA, 13 nt, Human
caugcacugugaa

SEQ ID NO: 1396528 - RNA, 10 nt, Human
caugcacugu

SEQ ID NO: 1396529 - RNA, 20 nt, Human
caugcacugauguuguguuu

SEQ ID NO: 1396530 - RNA, 15 nt, Human
caugcacugauguug

SEQ ID NO: 1396531 - RNA, 23 nt, Human
caugcacuguucccccugugcag

SEQ ID NO: 1396532 - RNA, 19 nt, Human
caugcacuguucccccugu

SEQ ID NO: 1396533 - RNA, 22 nt, Human
caugcacugugaaggacccuug

SEQ ID NO: 1396534 - RNA, 17 nt, Human
caugcacuuggcugcau

SEQ ID NO: 1396535 - RNA, 14 nt, Human
caugcagaaagcau

SEQ ID NO: 1396536 - RNA, 14 nt, Human
cauuaaaauauaau

SEQ ID NO: 1396537 - RNA, 11 nt, Human
cauuaaaauau

SEQ ID NO: 1396538 - RNA, 13 nt, Human
cauuaaaagaaua

SEQ ID NO: 1396539 - RNA, 22 nt, Human
cauuaaaaaugcauauacuuua

SEQ ID NO: 1396540 - RNA, 23 nt, Human
cauuaaaccaucucccuggugcu

SEQ ID NO: 1396541 - RNA, 22 nt, Human
cauguuuggaaggggucuguag

SEQ ID NO: 1396542 - RNA, 15 nt, Human
cauguuugugauuga

SEQ ID NO: 1396543 - RNA, 21 nt, Human
cauguuugcaccuuucuaguu

SEQ ID NO: 1396544 - RNA, 22 nt, Human
cauguuugcaccuuucuaguug

SEQ ID NO: 1396545 - RNA, 20 nt, Human
cauguuugcaccuuucuagu

SEQ ID NO: 1396546 - RNA, 20 nt, Human
cauguuucuuuguaaugaaa

SEQ ID NO: 1396547 - RNA, 12 nt, Human
cauguuugugau

SEQ ID NO: 1396548 - RNA, 14 nt, Human
cauguuugugauug

SEQ ID NO: 1396549 - RNA, 20 nt, Human
cauguacaugaagaagcuaa

SEQ ID NO: 1396550 - RNA, 14 nt, Human
cauguaaauaauac

SEQ ID NO: 1396551 - RNA, 16 nt, Human
cauguaaacugugcac

SEQ ID NO: 1396552 - RNA, 15 nt, Human
cauguaaacugugca

SEQ ID NO: 1396553 - RNA, 17 nt, Human
caugucuauucagcuuc

SEQ ID NO: 1396554 - RNA, 16 nt, Human
caugucuauucagcuu

SEQ ID NO: 1396555 - RNA, 21 nt, Human
caugucguggacacacacaga

SEQ ID NO: 1396556 - RNA, 22 nt, Human
cauguacugagccuuguaauuc

SEQ ID NO: 1396557 - RNA, 19 nt, Human
cauguacugagccuuguaa

SEQ ID NO: 1396558 - RNA, 23 nt, Human
cauguacugagccuuguaauucu

SEQ ID NO: 1396559 - RNA, 16 nt, Human
caugguuucagcacua

SEQ ID NO: 1396560 - RNA, 15 nt, Human
caugguuucagcacu

SEQ ID NO: 1396561 - RNA, 13 nt, Human
caugguuucagca

SEQ ID NO: 1396562 - RNA, 22 nt, Human
caugguggguccaugggcagag

SEQ ID NO: 1396563 - RNA, 21 nt, Human
caugguggguccaugggcaga

SEQ ID NO: 1396564 - RNA, 15 nt, Human
cauggugcugggaga

SEQ ID NO: 1396565 - RNA, 22 nt, Human
cauggugcugggagaggcagcc

SEQ ID NO: 1396566 - RNA, 22 nt, Human
cauggugcuaggaagaggagug

SEQ ID NO: 1396567 - RNA, 17 nt, Human
cauggugcuaggaagag

SEQ ID NO: 1396568 - RNA, 13 nt, Human
cauggugcuagga

SEQ ID NO: 1396569 - RNA, 15 nt, Human
cauggucugcccucu

SEQ ID NO: 1396570 - RNA, 16 nt, Human
cauggucugcccucug

SEQ ID NO: 1396571 - RNA, 13 nt, Human
cauggucugcccu

SEQ ID NO: 1396572 - RNA, 15 nt, Human
cauggucacacacug

SEQ ID NO: 1396573 - RNA, 14 nt, Human
cauggucacacacu

SEQ ID NO: 1396574 - RNA, 23 nt, Human
cauggucggaaaacaugcuacac

SEQ ID NO: 1396575 - RNA, 19 nt, Human
cauggucggaaaacaugcu

SEQ ID NO: 1396576 - RNA, 15 nt, Human
caugucuucucccug

SEQ ID NO: 1396577 - RNA, 21 nt, Human
caugucuuaaugaaguuugaa

SEQ ID NO: 1396578 - RNA, 22 nt, Human
caugucuuaaugaaguuugaau

SEQ ID NO: 1396579 - RNA, 23 nt, Human
caugucuuaaugaaguuugaaug

SEQ ID NO: 1396580 - RNA, 17 nt, Human
caugugacucuuuccaa

SEQ ID NO: 1396581 - RNA, 16 nt, Human
caugugacucuuucca

SEQ ID NO: 1396582 - RNA, 14 nt, Human
caugucuucucccu

SEQ ID NO: 1396583 - RNA, 14 nt, Human
caugugacucuuuc

SEQ ID NO: 1396584 - RNA, 13 nt, Human
caugucuuaauga

SEQ ID NO: 1396585 - RNA, 14 nt, Human
caugucuuaaugaa

SEQ ID NO: 1396586 - RNA, 15 nt, Human
caugucuuaaugaag

SEQ ID NO: 1396587 - RNA, 16 nt, Human
caugucuuaaugaagu

SEQ ID NO: 1396588 - RNA, 17 nt, Human
caugucuuaaugaaguu

SEQ ID NO: 1396589 - RNA, 18 nt, Human
caugucuuaaugaaguuu

SEQ ID NO: 1396590 - RNA, 20 nt, Human
caugucuuaaugaaguuuga

SEQ ID NO: 1396591 - RNA, 20 nt, Human
caugugagcaugucacuucc

SEQ ID NO: 1396592 - RNA, 14 nt, Human
caugugcccaguua

SEQ ID NO: 1396593 - RNA, 13 nt, Human
caugugucccaga

SEQ ID NO: 1396594 - RNA, 17 nt, Human
cauguguauaaaaauaa

SEQ ID NO: 1396595 - RNA, 14 nt, Human
cauguguauaaaaa

SEQ ID NO: 1396596 - RNA, 13 nt, Human
cauguguauaaaa

SEQ ID NO: 1396597 - RNA, 18 nt, Human
caugugcugcccuacagc

SEQ ID NO: 1396598 - RNA, 20 nt, Human
caugugcuaguaauuggaaa

SEQ ID NO: 1396599 - RNA, 16 nt, Human
cauguguuauguuuuc

SEQ ID NO: 1396600 - RNA, 16 nt, Human
cauguguuaaguauuu

SEQ ID NO: 1396601 - RNA, 22 nt, Human
cauguguguuaacccagugcuu

SEQ ID NO: 1396602 - RNA, 21 nt, Human
caugugucccagaagaugacu

SEQ ID NO: 1396603 - RNA, 21 nt, Human
cauguguccugguucccguuu

SEQ ID NO: 1396604 - RNA, 15 nt, Human
cauguguccugguuc

SEQ ID NO: 1396605 - RNA, 17 nt, Human
caugugucccagaagau

SEQ ID NO: 1396606 - RNA, 14 nt, Human
caugugucccagaa

SEQ ID NO: 1396607 - RNA, 18 nt, Human
cauguguuuacuuuaugu

SEQ ID NO: 1396608 - RNA, 15 nt, Human
cauguguuauguuuu

SEQ ID NO: 1396609 - RNA, 23 nt, Human
cauguguguuaacccagugcuuu

SEQ ID NO: 1396610 - RNA, 14 nt, Human
cauguguuuauccu

SEQ ID NO: 1396611 - RNA, 21 nt, Human
cauguuuccucuaguucuuug

SEQ ID NO: 1396612 - RNA, 13 nt, Human
cauguuuccucua

SEQ ID NO: 1396613 - RNA, 22 nt, Human
cauguuuccagcauucccaggu

SEQ ID NO: 1396614 - RNA, 20 nt, Human
cauguuuccagcauucccag

SEQ ID NO: 1396615 - RNA, 17 nt, Human
cauguuuccagcauucc

SEQ ID NO: 1396616 - RNA, 16 nt, Human
cauguuuccagcauuc

SEQ ID NO: 1396617 - RNA, 15 nt, Human
cauguuuccagcauu

SEQ ID NO: 1396618 - RNA, 13 nt, Human
cauguuuccagca

SEQ ID NO: 1396619 - RNA, 12 nt, Human
cauguuuccagc

SEQ ID NO: 1396620 - RNA, 20 nt, Human
cauguuuauuuuucuugucu

SEQ ID NO: 1396621 - RNA, 19 nt, Human
cauguuuauuuuucuuguc

SEQ ID NO: 1396622 - RNA, 18 nt, Human
cauguuuauuuuucuugu

SEQ ID NO: 1396623 - RNA, 15 nt, Human
cauguuuauuuuucu

SEQ ID NO: 1396624 - RNA, 21 nt, Human
cauguuaaccccuccacucuu

SEQ ID NO: 1396625 - RNA, 16 nt, Human
cauuuacauguuuuaa

SEQ ID NO: 1396626 - RNA, 22 nt, Human
cauuuacccuucuuuucugacu

SEQ ID NO: 1396627 - RNA, 19 nt, Human
cauuuacaaacugaagagu

SEQ ID NO: 1396628 - RNA, 16 nt, Human
cauuuacaaacugaag

SEQ ID NO: 1396629 - RNA, 15 nt, Human
cauuuacaaacugaa

SEQ ID NO: 1396630 - RNA, 17 nt, Human
cauuuaauaauauacuu

SEQ ID NO: 1396631 - RNA, 20 nt, Human
cauuuaauaauauacuugug

SEQ ID NO: 1396632 - RNA, 22 nt, Human
cauuuaauaauauacuugugga

SEQ ID NO: 1396633 - RNA, 17 nt, Human
cauuugaaaauuuugau

SEQ ID NO: 1396634 - RNA, 19 nt, Human
cauuugaaaauuuugaugu

SEQ ID NO: 1396635 - RNA, 23 nt, Human
cauuuaaccccccuguacacaac

SEQ ID NO: 1396636 - RNA, 20 nt, Human
cauuuaaccccccuguacac

SEQ ID NO: 1396637 - RNA, 19 nt, Human
cauuuaaccccccuguaca

SEQ ID NO: 1396638 - RNA, 12 nt, Human
cauuuaauaaua

SEQ ID NO: 1396639 - RNA, 13 nt, Human
cauuuaauaauau

SEQ ID NO: 1396640 - RNA, 14 nt, Human
cauuuaauaauaua

SEQ ID NO: 1396641 - RNA, 18 nt, Human
cauuuaaauuuuuuuccu

SEQ ID NO: 1396642 - RNA, 20 nt, Human
cauuuaaauacagucuucca

SEQ ID NO: 1396643 - RNA, 18 nt, Human
cauuuaaauacagucuuc

SEQ ID NO: 1396644 - RNA, 19 nt, Human
cauuuaaaacauuaaaaua

SEQ ID NO: 1396645 - RNA, 17 nt, Human
cauuguuauauaaucau

SEQ ID NO: 1396646 - RNA, 18 nt, Human
cauuguuaccucuauaua

SEQ ID NO: 1396647 - RNA, 23 nt, Human
cauuuaaaacagacacuggcaug

SEQ ID NO: 1396648 - RNA, 18 nt, Human
cauuuaaaacagacacug

SEQ ID NO: 1396649 - RNA, 17 nt, Human
cauuuaaaacagacacu

SEQ ID NO: 1396650 - RNA, 13 nt, Human
cauuuaaaacaga

SEQ ID NO: 1396651 - RNA, 21 nt, Human
cauuguuauauaaucauuauu

SEQ ID NO: 1396652 - RNA, 14 nt, Human
cauuguuaccucua

SEQ ID NO: 1396653 - RNA, 14 nt, Human
cauuguguuaccug

SEQ ID NO: 1396654 - RNA, 22 nt, Human
cauugugggauguucagcacug

SEQ ID NO: 1396655 - RNA, 21 nt, Human
cauugugggauguucagcacu

SEQ ID NO: 1396656 - RNA, 22 nt, Human
cauugaauggcuauguuuuuaa

SEQ ID NO: 1396657 - RNA, 14 nt, Human
cauugaaggcuuaa

SEQ ID NO: 1396658 - RNA, 13 nt, Human
cauugaaggcuua

SEQ ID NO: 1396659 - RNA, 22 nt, Human
cauugaacacaaacuguaaaua

SEQ ID NO: 1396660 - RNA, 15 nt, Human
cauugaaaagagcug

SEQ ID NO: 1396661 - RNA, 16 nt, Human
cauugaguugguuacu

SEQ ID NO: 1396662 - RNA, 18 nt, Human
cauugaguugguuacuuc

SEQ ID NO: 1396663 - RNA, 23 nt, Human
cauugaauucuugguugaggaaa

SEQ ID NO: 1396664 - RNA, 22 nt, Human
cauugaauucuugguugaggaa

SEQ ID NO: 1396665 - RNA, 21 nt, Human
cauugaauucuugguugagga

SEQ ID NO: 1396666 - RNA, 23 nt, Human
cauuuucuaagaaacauuuauau

SEQ ID NO: 1396667 - RNA, 14 nt, Human
cauuuucucucagg

SEQ ID NO: 1396668 - RNA, 12 nt, Human
cauuuucucuaa

SEQ ID NO: 1396669 - RNA, 17 nt, Human
cauuuucuaagaaacau

SEQ ID NO: 1396670 - RNA, 14 nt, Human
cauuuucuaagaaa

SEQ ID NO: 1396671 - RNA, 21 nt, Human
ccaaaauguuggucauuuuau

SEQ ID NO: 1396672 - RNA, 20 nt, Human
ccaaaauguuggucauuuua

SEQ ID NO: 1396673 - RNA, 20 nt, Human
ccaaacaccuuccagcuccu

SEQ ID NO: 1396674 - RNA, 19 nt, Human
ccaaacaccuuccagcucc

SEQ ID NO: 1396675 - RNA, 15 nt, Human
ccaaacaccuuccag

SEQ ID NO: 1396676 - RNA, 17 nt, Human
ccaaaauguugcugaaa

SEQ ID NO: 1396677 - RNA, 17 nt, Human
ccaaaauguugaaauau

SEQ ID NO: 1396678 - RNA, 15 nt, Human
ccaaaaugugccuau

SEQ ID NO: 1396679 - RNA, 23 nt, Human
ccaaaauguaggcuuaguuugug

SEQ ID NO: 1396680 - RNA, 20 nt, Human
cauuuuuacuauuguuacau

SEQ ID NO: 1396681 - RNA, 20 nt, Human
cauuuuuacaauguaauuau

SEQ ID NO: 1396682 - RNA, 19 nt, Human
cauuuuuacaauguaauua

SEQ ID NO: 1396683 - RNA, 18 nt, Human
cauuuuuaccaucacuga

SEQ ID NO: 1396684 - RNA, 16 nt, Human
cauuuuuacaauguaa

SEQ ID NO: 1396685 - RNA, 15 nt, Human
cauuugcuuuggaag

SEQ ID NO: 1396686 - RNA, 14 nt, Human
cauuugcuuuggaa

SEQ ID NO: 1396687 - RNA, 16 nt, Human
cauuugcuguuuuaaa

SEQ ID NO: 1396688 - RNA, 15 nt, Human
cauuugcuguuuuaa

SEQ ID NO: 1396689 - RNA, 20 nt, Human
cauuugcugaauagcuacua

SEQ ID NO: 1396690 - RNA, 13 nt, Human
cauuugcauuugu

SEQ ID NO: 1396691 - RNA, 22 nt, Human
cauuugcaggguccucuucugg

SEQ ID NO: 1396692 - RNA, 20 nt, Human
cauuugcaggguccucuucu

SEQ ID NO: 1396693 - RNA, 19 nt, Human
cauuugcaggguccucuuc

SEQ ID NO: 1396694 - RNA, 14 nt, Human
cauuugcagggucc

SEQ ID NO: 1396695 - RNA, 22 nt, Human
cauuugcaagggaaaagucucu

SEQ ID NO: 1396696 - RNA, 22 nt, Human
cauuucuuuuugggagagacuu

SEQ ID NO: 1396697 - RNA, 15 nt, Human
cauuucuuuuuggga

SEQ ID NO: 1396698 - RNA, 18 nt, Human
cauuuuacauuaaauuuu

SEQ ID NO: 1396699 - RNA, 23 nt, Human
cauuuuauuuuauuaugcaugaa

SEQ ID NO: 1396700 - RNA, 17 nt, Human
cauuugcuguuuuaaac

SEQ ID NO: 1396701 - RNA, 16 nt, Human
cauuugcuuuuucacc

SEQ ID NO: 1396702 - RNA, 19 nt, Human
cauuugcuuuuugugauau

SEQ ID NO: 1396703 - RNA, 15 nt, Human
cauuugcuuuuugug

SEQ ID NO: 1396704 - RNA, 23 nt, Human
cauuuuaccuuugacaaagguaa

SEQ ID NO: 1396705 - RNA, 14 nt, Human
cauucuuucccaac

SEQ ID NO: 1396706 - RNA, 12 nt, Human
cauucuuuccca

SEQ ID NO: 1396707 - RNA, 18 nt, Human
cauucuucugagcacugu

SEQ ID NO: 1396708 - RNA, 19 nt, Human
cauucuucugagcacuguu

SEQ ID NO: 1396709 - RNA, 21 nt, Human
cauucuucucuguugucguaa

SEQ ID NO: 1396710 - RNA, 18 nt, Human
cauucuucucuguugucg

SEQ ID NO: 1396711 - RNA, 16 nt, Human
cauucuucucuguugu

SEQ ID NO: 1396712 - RNA, 21 nt, Human
cauucuuccuaguuuucuccu

SEQ ID NO: 1396713 - RNA, 18 nt, Human
cauucuuccuaguuuucu

SEQ ID NO: 1396714 - RNA, 13 nt, Human
cauucuuccuagu

SEQ ID NO: 1396715 - RNA, 15 nt, Human
cauucugucuugaag

SEQ ID NO: 1396716 - RNA, 17 nt, Human
cauucuguuaaucauua

SEQ ID NO: 1396717 - RNA, 13 nt, Human
cauucuggaauaa

SEQ ID NO: 1396718 - RNA, 17 nt, Human
cauucuggaccucuggg

SEQ ID NO: 1396719 - RNA, 16 nt, Human
cauucugcuccuuccc

SEQ ID NO: 1396720 - RNA, 12 nt, Human
cauucuggaagu

SEQ ID NO: 1396721 - RNA, 16 nt, Human
cauucuggaccucugg

SEQ ID NO: 1396722 - RNA, 14 nt, Human
cauucugcuccuuc

SEQ ID NO: 1396723 - RNA, 16 nt, Human
cauucuggaagugacu

SEQ ID NO: 1396724 - RNA, 18 nt, Human
cauucugccucucuagga

SEQ ID NO: 1396725 - RNA, 17 nt, Human
cauucugccucucuagg

SEQ ID NO: 1396726 - RNA, 17 nt, Human
cauucugcaaguauacu

SEQ ID NO: 1396727 - RNA, 11 nt, Human
cauucugcaag

SEQ ID NO: 1396728 - RNA, 22 nt, Human
cauucugauucgaaugacacug

SEQ ID NO: 1396729 - RNA, 23 nt, Human
cauucugauucgaaugacacugu

SEQ ID NO: 1396730 - RNA, 23 nt, Human
cauucugacucgguuucuccaaa

SEQ ID NO: 1396731 - RNA, 21 nt, Human
cauucugacucgguuucucca

SEQ ID NO: 1396732 - RNA, 19 nt, Human
cauucugacucgguuucuc

SEQ ID NO: 1396733 - RNA, 16 nt, Human
cauucugacucgguuu

SEQ ID NO: 1396734 - RNA, 12 nt, Human
cauucugacucg

SEQ ID NO: 1396735 - RNA, 18 nt, Human
cauucugaaugcuucuaa

SEQ ID NO: 1396736 - RNA, 16 nt, Human
cauucugaaugcuucu

SEQ ID NO: 1396737 - RNA, 15 nt, Human
cauucugaaugcuuc

SEQ ID NO: 1396738 - RNA, 21 nt, Human
cauuccugggaaauauucccu

SEQ ID NO: 1396739 - RNA, 13 nt, Human
cauucugaaugcu

SEQ ID NO: 1396740 - RNA, 21 nt, Human
cauuccugaagaaccaguccc

SEQ ID NO: 1396741 - RNA, 20 nt, Human
cauuccugaagaaccagucc

SEQ ID NO: 1396742 - RNA, 17 nt, Human
cauuccugaagaaccag

SEQ ID NO: 1396743 - RNA, 16 nt, Human
cauuccugaagaacca

SEQ ID NO: 1396744 - RNA, 13 nt, Human
cauuccugaagaa

SEQ ID NO: 1396745 - RNA, 14 nt, Human
cauuccugaacagg

SEQ ID NO: 1396746 - RNA, 21 nt, Human
cauuccucaugaauguaaauu

SEQ ID NO: 1396747 - RNA, 19 nt, Human
cauuccucaugaauguaaa

SEQ ID NO: 1396748 - RNA, 18 nt, Human
cauuccucaugaauguaa

SEQ ID NO: 1396749 - RNA, 17 nt, Human
cauuccucaugaaugua

SEQ ID NO: 1396750 - RNA, 12 nt, Human
cauuccuccagg

SEQ ID NO: 1396751 - RNA, 13 nt, Human
cauuccuccaggu

SEQ ID NO: 1396752 - RNA, 13 nt, Human
cauuccgcagccc

SEQ ID NO: 1396753 - RNA, 20 nt, Human
cauuccgcagcccccacccc

SEQ ID NO: 1396754 - RNA, 22 nt, Human
cauucccgcagugggagcaaac

SEQ ID NO: 1396755 - RNA, 20 nt, Human
cauucccgcagugggagcaa

SEQ ID NO: 1396756 - RNA, 19 nt, Human
cauucccgcagugggagca

SEQ ID NO: 1396757 - RNA, 16 nt, Human
cauucccgcaguggga

SEQ ID NO: 1396758 - RNA, 11 nt, Human
cauucccaggu

SEQ ID NO: 1396759 - RNA, 15 nt, Human
cauuccauucuggaa

SEQ ID NO: 1396760 - RNA, 21 nt, Human
cauuccaugugcccaguuaau

SEQ ID NO: 1396761 - RNA, 17 nt, Human
cauucccagcucuaccc

SEQ ID NO: 1396762 - RNA, 18 nt, Human
cauucccagcucuacccu

SEQ ID NO: 1396763 - RNA, 14 nt, Human
cauuccauucugga

SEQ ID NO: 1396764 - RNA, 19 nt, Human
cauuccagccccucugguc

SEQ ID NO: 1396765 - RNA, 18 nt, Human
cauuccagccccucuggu

SEQ ID NO: 1396766 - RNA, 15 nt, Human
cauuccagccccucu

SEQ ID NO: 1396767 - RNA, 13 nt, Human
cauuccagccccu

SEQ ID NO: 1396768 - RNA, 18 nt, Human
cauuccaagacucuagag

SEQ ID NO: 1396769 - RNA, 22 nt, Human
cauuccagccccucuggucgcu

SEQ ID NO: 1396770 - RNA, 18 nt, Human
cauuccaugugcccaguu

SEQ ID NO: 1396771 - RNA, 17 nt, Human
cauuccaugugcccagu

SEQ ID NO: 1396772 - RNA, 16 nt, Human
cauuccaugugcccag

SEQ ID NO: 1396773 - RNA, 15 nt, Human
cauuccaugugccca

SEQ ID NO: 1396774 - RNA, 12 nt, Human
cauuccauccuu

SEQ ID NO: 1396775 - RNA, 14 nt, Human
cauuccauccuuga

SEQ ID NO: 1396776 - RNA, 17 nt, Human
cauuccaagacucuaga

SEQ ID NO: 1396777 - RNA, 14 nt, Human
cauuccaagacucu

SEQ ID NO: 1396778 - RNA, 21 nt, Human
cauuccaacucguauagcaug

SEQ ID NO: 1396779 - RNA, 22 nt, Human
cauuccaacuaucucauuucca

SEQ ID NO: 1396780 - RNA, 21 nt, Human
cauucauuagucauguuuauc

SEQ ID NO: 1396781 - RNA, 15 nt, Human
cauucauuccauucu

SEQ ID NO: 1396782 - RNA, 20 nt, Human
cauucauuuagcuaaacgga

SEQ ID NO: 1396783 - RNA, 16 nt, Human
cauucauuccauucug

SEQ ID NO: 1396784 - RNA, 17 nt, Human
cauucauuccauucugg

SEQ ID NO: 1396785 - RNA, 16 nt, Human
cauuccaaagaacagc

SEQ ID NO: 1396786 - RNA, 17 nt, Human
cauucauuuuuguuguu

SEQ ID NO: 1396787 - RNA, 19 nt, Human
cauucauuuucuggguguu

SEQ ID NO: 1396788 - RNA, 19 nt, Human
cauucaccugccccaacuc

SEQ ID NO: 1396789 - RNA, 16 nt, Human
cauucaccugccccaa

SEQ ID NO: 1396790 - RNA, 15 nt, Human
cauucaccugcccca

SEQ ID NO: 1396791 - RNA, 11 nt, Human
cauucacuuca

SEQ ID NO: 1396792 - RNA, 18 nt, Human
cauucagaagaaaaagaa

SEQ ID NO: 1396793 - RNA, 13 nt, Human
cauucagaagaaa

SEQ ID NO: 1396794 - RNA, 15 nt, Human
cauucacuucauaau

SEQ ID NO: 1396795 - RNA, 14 nt, Human
cauucacuucauaa

SEQ ID NO: 1396796 - RNA, 17 nt, Human
cauucaggacugcuggu

SEQ ID NO: 1396797 - RNA, 19 nt, Human
cauucaggaauucuuggag

SEQ ID NO: 1396798 - RNA, 13 nt, Human
cauucaggaauuc

SEQ ID NO: 1396799 - RNA, 17 nt, Human
cauucagaagaaaaaga

SEQ ID NO: 1396800 - RNA, 21 nt, Human
cauucagauaugauucaaaug

SEQ ID NO: 1396801 - RNA, 17 nt, Human
cauuacaaguauuuuua

SEQ ID NO: 1396802 - RNA, 15 nt, Human
cauuaacucauuaga

SEQ ID NO: 1396803 - RNA, 18 nt, Human
cauuaacucauuagacug

SEQ ID NO: 1396804 - RNA, 19 nt, Human
cauuaaaccaucucccugg

SEQ ID NO: 1396805 - RNA, 13 nt, Human
cauucaccugccc

SEQ ID NO: 1396806 - RNA, 17 nt, Human
cauucacaucgcagauu

SEQ ID NO: 1396807 - RNA, 23 nt, Human
cauucacaguucuuugggccaga

SEQ ID NO: 1396808 - RNA, 22 nt, Human
cauucacaguucuuugggccag

SEQ ID NO: 1396809 - RNA, 21 nt, Human
cauucaaguguaaaauauuuu

SEQ ID NO: 1396810 - RNA, 20 nt, Human
cauucaaguguaaaauauuu

SEQ ID NO: 1396811 - RNA, 19 nt, Human
cauucaaguguaaaauauu

SEQ ID NO: 1396812 - RNA, 18 nt, Human
cauucaaguguaaaauau

SEQ ID NO: 1396813 - RNA, 23 nt, Human
cauucaaguguaaaauauuuuga

SEQ ID NO: 1396814 - RNA, 22 nt, Human
cauucaaguguaaaauauuuug

SEQ ID NO: 1396815 - RNA, 17 nt, Human
cauucaaguguaaaaua

SEQ ID NO: 1396816 - RNA, 17 nt, Human
cauucaagucagcucuu

SEQ ID NO: 1396817 - RNA, 16 nt, Human
cauucaagucagcucu

SEQ ID NO: 1396818 - RNA, 18 nt, Human
cauucaacagagacugaa

SEQ ID NO: 1396819 - RNA, 12 nt, Human
cauucaacaaga

SEQ ID NO: 1396820 - RNA, 23 nt, Human
cauucaaaauaggguauauuuuc

SEQ ID NO: 1396821 - RNA, 20 nt, Human
cauucaaauguauuacagug

SEQ ID NO: 1396822 - RNA, 19 nt, Human
cauuagaauuauuuaaaca

SEQ ID NO: 1396823 - RNA, 14 nt, Human
cauuagaauuauuu

SEQ ID NO: 1396824 - RNA, 19 nt, Human
cauuagaagacaauugaca

SEQ ID NO: 1396825 - RNA, 18 nt, Human
cauuagaaauauuuuaaa

SEQ ID NO: 1396826 - RNA, 14 nt, Human
cauuagaaauauuu

SEQ ID NO: 1396827 - RNA, 17 nt, Human
cauuacuauaagaacuu

SEQ ID NO: 1396828 - RNA, 23 nt, Human
cauuacuguacaggguuaucugc

SEQ ID NO: 1396829 - RNA, 23 nt, Human
cauuacugcaugcacuucuuaca

SEQ ID NO: 1396830 - RNA, 16 nt, Human
cauuacugcaugcacu

SEQ ID NO: 1396831 - RNA, 13 nt, Human
cauuacugcaugc

SEQ ID NO: 1396832 - RNA, 23 nt, Human
cauuacuauaagaacuuugagcu

SEQ ID NO: 1396833 - RNA, 18 nt, Human
cauuauuggaauauaauu

SEQ ID NO: 1396834 - RNA, 15 nt, Human
cauuagaaauauuuu

SEQ ID NO: 1396835 - RNA, 22 nt, Human
cauuauucguagauauuggaca

SEQ ID NO: 1396836 - RNA, 13 nt, Human
ccacaccugcggc

SEQ ID NO: 1396837 - RNA, 14 nt, Human
ccacacugcacaau

SEQ ID NO: 1396838 - RNA, 12 nt, Human
ccacacugcaca

SEQ ID NO: 1396839 - RNA, 16 nt, Human
ccacacucuuucuccu

SEQ ID NO: 1396840 - RNA, 18 nt, Human
ccacacucuuucuccugc

SEQ ID NO: 1396841 - RNA, 19 nt, Human
ccacacucuuucuccugcu

SEQ ID NO: 1396842 - RNA, 15 nt, Human
ccacauacccugacc

SEQ ID NO: 1396843 - RNA, 14 nt, Human
ccacaucaaagagg

SEQ ID NO: 1396844 - RNA, 17 nt, Human
ccacccacuucugcacu

SEQ ID NO: 1396845 - RNA, 15 nt, Human
ccacccacuucugca

SEQ ID NO: 1396846 - RNA, 22 nt, Human
ccacccaauucaaaacauugug

SEQ ID NO: 1396847 - RNA, 19 nt, Human
ccacaccuccuucccucuc

SEQ ID NO: 1396848 - RNA, 16 nt, Human
ccacaccuccuucccu

SEQ ID NO: 1396849 - RNA, 15 nt, Human
ccacaccuccuuccc

SEQ ID NO: 1396850 - RNA, 11 nt, Human
ccacaccuccu

SEQ ID NO: 1396851 - RNA, 16 nt, Human
ccacacccacacucag

SEQ ID NO: 1396852 - RNA, 23 nt, Human
ccacacccuguacuguucugugu

SEQ ID NO: 1396853 - RNA, 11 nt, Human
ccaaaccacuu

SEQ ID NO: 1396854 - RNA, 14 nt, Human
ccaaaccacuuuuu

SEQ ID NO: 1396855 - RNA, 22 nt, Human
ccaaaccacuuuuugcagcuuu

SEQ ID NO: 1396856 - RNA, 16 nt, Human
ccaccccgccugcccu

SEQ ID NO: 1396857 - RNA, 11 nt, Human
ccacccagagg

SEQ ID NO: 1396858 - RNA, 17 nt, Human
ccacccagaggcagcag

SEQ ID NO: 1396859 - RNA, 22 nt, Human
ccacccagaaugagacauccag

SEQ ID NO: 1396860 - RNA, 23 nt, Human
ccaccccuuucuagaccaauaaa

SEQ ID NO: 1396861 - RNA, 21 nt, Human
ccacccucacuggcucuccug

SEQ ID NO: 1396862 - RNA, 19 nt, Human
ccacccucacuggcucucc

SEQ ID NO: 1396863 - RNA, 17 nt, Human
ccacccucacuggcucu

SEQ ID NO: 1396864 - RNA, 14 nt, Human
ccacccucacuggc

SEQ ID NO: 1396865 - RNA, 12 nt, Human
ccacccucacug

SEQ ID NO: 1396866 - RNA, 21 nt, Human
ccacccucguggacaccugcc

SEQ ID NO: 1396867 - RNA, 22 nt, Human
ccacccucguggacaccugccc

SEQ ID NO: 1396868 - RNA, 20 nt, Human
ccacccucguggacaccugc

SEQ ID NO: 1396869 - RNA, 19 nt, Human
ccacggcaccugggcccug

SEQ ID NO: 1396870 - RNA, 20 nt, Human
ccacggcaccugggcccugg

SEQ ID NO: 1396871 - RNA, 15 nt, Human
ccacggcaccugggc

SEQ ID NO: 1396872 - RNA, 21 nt, Human
ccacggagccacuccucugac

SEQ ID NO: 1396873 - RNA, 20 nt, Human
ccacggagccacuccucuga

SEQ ID NO: 1396874 - RNA, 12 nt, Human
ccacggagccac

SEQ ID NO: 1396875 - RNA, 22 nt, Human
ccacggaccaaagggagucugc

SEQ ID NO: 1396876 - RNA, 22 nt, Human
ccaccugcuagugugaauuaaa

SEQ ID NO: 1396877 - RNA, 19 nt, Human
ccaccugcuagugugaauu

SEQ ID NO: 1396878 - RNA, 16 nt, Human
ccaccuccccccacaa

SEQ ID NO: 1396879 - RNA, 23 nt, Human
ccaccugacacaccaggcgcuaa

SEQ ID NO: 1396880 - RNA, 20 nt, Human
ccaccugacacaccaggcgc

SEQ ID NO: 1396881 - RNA, 20 nt, Human
ccaccugaggaacugucucg

SEQ ID NO: 1396882 - RNA, 17 nt, Human
ccaccugacacaccagg

SEQ ID NO: 1396883 - RNA, 16 nt, Human
ccaccugacacaccag

SEQ ID NO: 1396884 - RNA, 20 nt, Human
ccaccugaauaaagaaugaa

SEQ ID NO: 1396885 - RNA, 16 nt, Human
ccaccuccccuugggc

SEQ ID NO: 1396886 - RNA, 15 nt, Human
ccaccuccccuuggg

SEQ ID NO: 1396887 - RNA, 18 nt, Human
ccaccucccucaaccuca

SEQ ID NO: 1396888 - RNA, 20 nt, Human
ccaccucccucaaccucauc

SEQ ID NO: 1396889 - RNA, 17 nt, Human
ccacuaaccuugccugg

SEQ ID NO: 1396890 - RNA, 21 nt, Human
ccacuaaccuugccugguaca

SEQ ID NO: 1396891 - RNA, 21 nt, Human
ccacguuggagaagcccgugu

SEQ ID NO: 1396892 - RNA, 20 nt, Human
ccacguuggagaagcccgug

SEQ ID NO: 1396893 - RNA, 23 nt, Human
ccacguucugcucaucauucucu

SEQ ID NO: 1396894 - RNA, 13 nt, Human
ccacguuucuaaa

SEQ ID NO: 1396895 - RNA, 18 nt, Human
ccacucacuaggccccca

SEQ ID NO: 1396896 - RNA, 22 nt, Human
ccacucacuaggcccccacuug

SEQ ID NO: 1396897 - RNA, 22 nt, Human
ccacucaugugacucuuuccaa

SEQ ID NO: 1396898 - RNA, 19 nt, Human
ccacucaugugacucuuuc

SEQ ID NO: 1396899 - RNA, 18 nt, Human
ccacuccaagcccagccc

SEQ ID NO: 1396900 - RNA, 20 nt, Human
ccacucacaacagcugccug

SEQ ID NO: 1396901 - RNA, 14 nt, Human
ccacucacaacagc

SEQ ID NO: 1396902 - RNA, 18 nt, Human
ccacuacauucuguuaau

SEQ ID NO: 1396903 - RNA, 20 nt, Human
ccacugcccccugcugccau

SEQ ID NO: 1396904 - RNA, 19 nt, Human
ccacugcccccugcugcca

SEQ ID NO: 1396905 - RNA, 17 nt, Human
ccacugcccccugcugc

SEQ ID NO: 1396906 - RNA, 18 nt, Human
ccacucccuccuaaccua

SEQ ID NO: 1396907 - RNA, 14 nt, Human
ccacucccucacaa

SEQ ID NO: 1396908 - RNA, 13 nt, Human
ccacucccucaca

SEQ ID NO: 1396909 - RNA, 12 nt, Human
ccacucccucac

SEQ ID NO: 1396910 - RNA, 18 nt, Human
ccacuggagcagaagggg

SEQ ID NO: 1396911 - RNA, 11 nt, Human
ccacuggagca

SEQ ID NO: 1396912 - RNA, 18 nt, Human
ccacugccuucgcuucuu

SEQ ID NO: 1396913 - RNA, 16 nt, Human
ccacugccuucgcuuc

SEQ ID NO: 1396914 - RNA, 15 nt, Human
ccacugccuucgcuu

SEQ ID NO: 1396915 - RNA, 14 nt, Human
ccacugccuucgcu

SEQ ID NO: 1396916 - RNA, 23 nt, Human
ccacugccuucgcuucuugccuc

SEQ ID NO: 1396917 - RNA, 22 nt, Human
ccacugccuucgcuucuugccu

SEQ ID NO: 1396918 - RNA, 14 nt, Human
ccacugccuuugac

SEQ ID NO: 1396919 - RNA, 22 nt, Human
ccacugccuuugaccugccucc

SEQ ID NO: 1396920 - RNA, 14 nt, Human
ccagaugcuuuccu

SEQ ID NO: 1396921 - RNA, 14 nt, Human
ccagaugcugaaaa

SEQ ID NO: 1396922 - RNA, 17 nt, Human
ccagaugccccuuucug

SEQ ID NO: 1396923 - RNA, 18 nt, Human
ccagaugccccuuucugg

SEQ ID NO: 1396924 - RNA, 18 nt, Human
ccagaugcagggcaguca

SEQ ID NO: 1396925 - RNA, 15 nt, Human
ccagaugcagggcag

SEQ ID NO: 1396926 - RNA, 14 nt, Human
ccagaugcagggca

SEQ ID NO: 1396927 - RNA, 16 nt, Human
ccagaugcagcucaag

SEQ ID NO: 1396928 - RNA, 16 nt, Human
ccagaggcuggguuca

SEQ ID NO: 1396929 - RNA, 13 nt, Human
ccagauuuaugca

SEQ ID NO: 1396930 - RNA, 22 nt, Human
ccagauuuaugcauauuauuuu

SEQ ID NO: 1396931 - RNA, 15 nt, Human
ccagaggcuggguuc

SEQ ID NO: 1396932 - RNA, 12 nt, Human
ccagaggcuggg

SEQ ID NO: 1396933 - RNA, 19 nt, Human
ccagaggccaaggaggccu

SEQ ID NO: 1396934 - RNA, 11 nt, Human
ccagaggcucg

SEQ ID NO: 1396935 - RNA, 19 nt, Human
ccagaggcuauuauuuuca

SEQ ID NO: 1396936 - RNA, 22 nt, Human
ccagaggcccccagcccagggc

SEQ ID NO: 1396937 - RNA, 21 nt, Human
ccagaggcccccagcccaggg

SEQ ID NO: 1396938 - RNA, 19 nt, Human
ccagaggcccccagcccag

SEQ ID NO: 1396939 - RNA, 18 nt, Human
ccagaggcccccagccca

SEQ ID NO: 1396940 - RNA, 15 nt, Human
ccagaggcccccagc

SEQ ID NO: 1396941 - RNA, 14 nt, Human
ccagaggcccccag

SEQ ID NO: 1396942 - RNA, 15 nt, Human
ccagaggccaaggag

SEQ ID NO: 1396943 - RNA, 21 nt, Human
ccagaggauugcugccccauc

SEQ ID NO: 1396944 - RNA, 21 nt, Human
ccagaggagccaccaguucuc

SEQ ID NO: 1396945 - RNA, 19 nt, Human
ccagaggagccaccaguuc

SEQ ID NO: 1396946 - RNA, 17 nt, Human
ccagaggagccaccagu

SEQ ID NO: 1396947 - RNA, 16 nt, Human
ccagaggagccaccag

SEQ ID NO: 1396948 - RNA, 22 nt, Human
ccagaggaaggggccagaggcu

SEQ ID NO: 1396949 - RNA, 19 nt, Human
ccagaggaaggggccagag

SEQ ID NO: 1396950 - RNA, 17 nt, Human
ccagaggaaggggccag

SEQ ID NO: 1396951 - RNA, 20 nt, Human
ccagagauccaaaagaagcc

SEQ ID NO: 1396952 - RNA, 13 nt, Human
ccagagcaaaaua

SEQ ID NO: 1396953 - RNA, 19 nt, Human
ccagagcaccugcugucug

SEQ ID NO: 1396954 - RNA, 18 nt, Human
ccagagcaccugcugucu

SEQ ID NO: 1396955 - RNA, 17 nt, Human
ccagagcaccugcuguc

SEQ ID NO: 1396956 - RNA, 20 nt, Human
ccagagcaccugcugucugg

SEQ ID NO: 1396957 - RNA, 16 nt, Human
ccagagcacugcucca

SEQ ID NO: 1396958 - RNA, 21 nt, Human
ccagagcuacccgcagaguuc

SEQ ID NO: 1396959 - RNA, 16 nt, Human
ccagacacccaggacu

SEQ ID NO: 1396960 - RNA, 15 nt, Human
ccagacacccaggac

SEQ ID NO: 1396961 - RNA, 14 nt, Human
ccagacacccagga

SEQ ID NO: 1396962 - RNA, 20 nt, Human
ccacuguacuugcucuugau

SEQ ID NO: 1396963 - RNA, 11 nt, Human
ccacuggcucc

SEQ ID NO: 1396964 - RNA, 17 nt, Human
ccacuguacuugcucuu

SEQ ID NO: 1396965 - RNA, 18 nt, Human
ccacuguacuugcucuug

SEQ ID NO: 1396966 - RNA, 19 nt, Human
ccacuguacuugcucuuga

SEQ ID NO: 1396967 - RNA, 21 nt, Human
ccagaccauugucucagagca

SEQ ID NO: 1396968 - RNA, 18 nt, Human
ccagaccauugucucaga

SEQ ID NO: 1396969 - RNA, 15 nt, Human
ccagaccauggacac

SEQ ID NO: 1396970 - RNA, 22 nt, Human
ccagcaagcggggaugucccug

SEQ ID NO: 1396971 - RNA, 20 nt, Human
ccagcaagcggggauguccc

SEQ ID NO: 1396972 - RNA, 17 nt, Human
ccagauuagagccugua

SEQ ID NO: 1396973 - RNA, 23 nt, Human
ccagcaauuacaacggagucaaa

SEQ ID NO: 1396974 - RNA, 18 nt, Human
ccagccccacuccucugc

SEQ ID NO: 1396975 - RNA, 19 nt, Human
ccagccccacuccucugcu

SEQ ID NO: 1396976 - RNA, 15 nt, Human
ccagccagggcucaa

SEQ ID NO: 1396977 - RNA, 19 nt, Human
ccagccagggcucaaucuc

SEQ ID NO: 1396978 - RNA, 14 nt, Human
ccagcccucauccc

SEQ ID NO: 1396979 - RNA, 13 nt, Human
ccagcccucaucc

SEQ ID NO: 1396980 - RNA, 16 nt, Human
ccagccccagccaggg

SEQ ID NO: 1396981 - RNA, 15 nt, Human
ccagccccagccagg

SEQ ID NO: 1396982 - RNA, 13 nt, Human
ccagccccagcca

SEQ ID NO: 1396983 - RNA, 17 nt, Human
ccagccgacccccucuc

SEQ ID NO: 1396984 - RNA, 14 nt, Human
ccagccgacccccu

SEQ ID NO: 1396985 - RNA, 18 nt, Human
ccagccgagcaggaggcc

SEQ ID NO: 1396986 - RNA, 15 nt, Human
ccagccgacccccuc

SEQ ID NO: 1396987 - RNA, 14 nt, Human
ccagccucagcucu

SEQ ID NO: 1396988 - RNA, 21 nt, Human
ccagccaggcccagccgaccc

SEQ ID NO: 1396989 - RNA, 20 nt, Human
ccagccaggcccagccgacc

SEQ ID NO: 1396990 - RNA, 18 nt, Human
ccagccaggcccagccga

SEQ ID NO: 1396991 - RNA, 22 nt, Human
ccagccaggcccagccgacccc

SEQ ID NO: 1396992 - RNA, 16 nt, Human
ccagccaggcccagcc

SEQ ID NO: 1396993 - RNA, 14 nt, Human
ccagccaggcccag

SEQ ID NO: 1396994 - RNA, 22 nt, Human
ccagccagcgucggucugugcc

SEQ ID NO: 1396995 - RNA, 21 nt, Human
ccagcauucccagguaggcca

SEQ ID NO: 1396996 - RNA, 19 nt, Human
ccagcauucccagguaggc

SEQ ID NO: 1396997 - RNA, 17 nt, Human
ccagcauucccagguag

SEQ ID NO: 1396998 - RNA, 21 nt, Human
ccagcauuucccuuccuuccu

SEQ ID NO: 1396999 - RNA, 16 nt, Human
ccagcauuucccuucc

SEQ ID NO: 1397000 - RNA, 20 nt, Human
ccagccaagcucugcagucc

SEQ ID NO: 1397001 - RNA, 14 nt, Human
ccagccaagcucug

SEQ ID NO: 1397002 - RNA, 18 nt, Human
ccagcaggugcugacuuc

SEQ ID NO: 1397003 - RNA, 15 nt, Human
ccagcaggugcugac

SEQ ID NO: 1397004 - RNA, 22 nt, Human
ccagcacugcuugaggaaaaca

SEQ ID NO: 1397005 - RNA, 19 nt, Human
ccagcacugcuugaggaaa

SEQ ID NO: 1397006 - RNA, 18 nt, Human
ccagcacugcuugaggaa

SEQ ID NO: 1397007 - RNA, 15 nt, Human
ccagcacugcuugag

SEQ ID NO: 1397008 - RNA, 12 nt, Human
ccagcacugcuu

SEQ ID NO: 1397009 - RNA, 20 nt, Human
ccagcacucgcuagcagugg

SEQ ID NO: 1397010 - RNA, 15 nt, Human
ccagcauucccaggu

SEQ ID NO: 1397011 - RNA, 14 nt, Human
ccagcauucccagg

SEQ ID NO: 1397012 - RNA, 22 nt, Human
ccagcauuccagccccucuggu

SEQ ID NO: 1397013 - RNA, 21 nt, Human
ccagcauuccagccccucugg

SEQ ID NO: 1397014 - RNA, 20 nt, Human
ccagcauuccagccccucug

SEQ ID NO: 1397015 - RNA, 19 nt, Human
ccagcauuccagccccucu

SEQ ID NO: 1397016 - RNA, 18 nt, Human
ccagcauuccagccccuc

SEQ ID NO: 1397017 - RNA, 17 nt, Human
ccagcauuccagccccu

SEQ ID NO: 1397018 - RNA, 16 nt, Human
ccagcauuccagcccc

SEQ ID NO: 1397019 - RNA, 15 nt, Human
ccagcauuccagccc

SEQ ID NO: 1397020 - RNA, 14 nt, Human
ccagcauuccagcc

SEQ ID NO: 1397021 - RNA, 21 nt, Human
ccagcaucugggccuuggccu

SEQ ID NO: 1397022 - RNA, 17 nt, Human
ccagcaucugggccuug

SEQ ID NO: 1397023 - RNA, 15 nt, Human
ccagcaucugggccu

SEQ ID NO: 1397024 - RNA, 14 nt, Human
ccagcaucugggcc

SEQ ID NO: 1397025 - RNA, 13 nt, Human
ccagcaucugggc

SEQ ID NO: 1397026 - RNA, 12 nt, Human
ccagcaucuggg

SEQ ID NO: 1397027 - RNA, 11 nt, Human
ccagcaucugg

SEQ ID NO: 1397028 - RNA, 23 nt, Human
ccagcauaauacuugcuuuggaa

SEQ ID NO: 1397029 - RNA, 18 nt, Human
ccagugcccugaucccag

SEQ ID NO: 1397030 - RNA, 17 nt, Human
ccagugcccugauccca

SEQ ID NO: 1397031 - RNA, 16 nt, Human
ccagugcccugauccc

SEQ ID NO: 1397032 - RNA, 21 nt, Human
ccagugcccugagccaggguc

SEQ ID NO: 1397033 - RNA, 18 nt, Human
ccagugcccugagccagg

SEQ ID NO: 1397034 - RNA, 17 nt, Human
ccagugcccugagccag

SEQ ID NO: 1397035 - RNA, 16 nt, Human
ccagugcccugagcca

SEQ ID NO: 1397036 - RNA, 15 nt, Human
ccagugcccugagcc

SEQ ID NO: 1397037 - RNA, 14 nt, Human
ccagugcccugagc

SEQ ID NO: 1397038 - RNA, 23 nt, Human
ccagugcccucuccccucagccu

SEQ ID NO: 1397039 - RNA, 18 nt, Human
ccagugcccccacugacc

SEQ ID NO: 1397040 - RNA, 16 nt, Human
ccagugcccccacuga

SEQ ID NO: 1397041 - RNA, 14 nt, Human
ccagugcccccacu

SEQ ID NO: 1397042 - RNA, 16 nt, Human
ccagucuguggaucag

SEQ ID NO: 1397043 - RNA, 18 nt, Human
ccaguguguggcuuucag

SEQ ID NO: 1397044 - RNA, 16 nt, Human
ccaguguguggcuuuc

SEQ ID NO: 1397045 - RNA, 22 nt, Human
ccaguguccugagcucagcgug

SEQ ID NO: 1397046 - RNA, 23 nt, Human
ccaguguccugagcucagcgugg

SEQ ID NO: 1397047 - RNA, 20 nt, Human
ccaguguccugagcucagcg

SEQ ID NO: 1397048 - RNA, 19 nt, Human
ccaguguccugagcucagc

SEQ ID NO: 1397049 - RNA, 18 nt, Human
ccaguguccugagcucag

SEQ ID NO: 1397050 - RNA, 23 nt, Human
ccaguguccugagccccagggag

SEQ ID NO: 1397051 - RNA, 22 nt, Human
ccaguguccugagccccaggga

SEQ ID NO: 1397052 - RNA, 19 nt, Human
ccaguguccugagccccag

SEQ ID NO: 1397053 - RNA, 20 nt, Human
ccagugucauuucucaucca

SEQ ID NO: 1397054 - RNA, 24 nt, Human
ccagugcccugaucccagagagcc

SEQ ID NO: 1397055 - RNA, 17 nt, Human
ccaguuaaaaaaaauuu

SEQ ID NO: 1397056 - RNA, 19 nt, Human
ccaguguuuuaggagcaug

SEQ ID NO: 1397057 - RNA, 20 nt, Human
ccaguguuagggaagggccu

SEQ ID NO: 1397058 - RNA, 17 nt, Human
ccaguguuagggaaggg

SEQ ID NO: 1397059 - RNA, 23 nt, Human
ccaguguguggcuuucagagccu

SEQ ID NO: 1397060 - RNA, 22 nt, Human
ccaguguguggcuuucagagcc

SEQ ID NO: 1397061 - RNA, 21 nt, Human
ccaguguguggcuuucagagc

SEQ ID NO: 1397062 - RNA, 22 nt, Human
ccaguguuguggauuuaacaga

SEQ ID NO: 1397063 - RNA, 22 nt, Human
ccaguuagccucugcaggaugu

SEQ ID NO: 1397064 - RNA, 17 nt, Human
ccaguuagccucugcag

SEQ ID NO: 1397065 - RNA, 19 nt, Human
ccaguuaaucuugcuuucu

SEQ ID NO: 1397066 - RNA, 18 nt, Human
ccaguuaauuuuuccaac

SEQ ID NO: 1397067 - RNA, 16 nt, Human
ccaguuaauuuuucca

SEQ ID NO: 1397068 - RNA, 17 nt, Human
ccaguuaaucuugcuuu

SEQ ID NO: 1397069 - RNA, 13 nt, Human
ccaguguuuaaaa

SEQ ID NO: 1397070 - RNA, 15 nt, Human
ccauagguagaaugu

SEQ ID NO: 1397071 - RNA, 20 nt, Human
ccaggagaaggccaauuccu

SEQ ID NO: 1397072 - RNA, 22 nt, Human
ccaggagaagcucagcugcauu

SEQ ID NO: 1397073 - RNA, 21 nt, Human
ccaggagaagcucagcugcau

SEQ ID NO: 1397074 - RNA, 18 nt, Human
ccaggagaagcucagcug

SEQ ID NO: 1397075 - RNA, 17 nt, Human
ccaggagaagcucagcu

SEQ ID NO: 1397076 - RNA, 21 nt, Human
ccagccucccugaagccuuug

SEQ ID NO: 1397077 - RNA, 17 nt, Human
ccagccucccugaagcc

SEQ ID NO: 1397078 - RNA, 15 nt, Human
ccagccucccugaag

SEQ ID NO: 1397079 - RNA, 13 nt, Human
ccagccucccuga

SEQ ID NO: 1397080 - RNA, 13 nt, Human
ccaggagacaggu

SEQ ID NO: 1397081 - RNA, 17 nt, Human
ccaggagcuccaguguc

SEQ ID NO: 1397082 - RNA, 14 nt, Human
ccaggagcuccagu

SEQ ID NO: 1397083 - RNA, 13 nt, Human
ccaggagcuccag

SEQ ID NO: 1397084 - RNA, 12 nt, Human
ccaggagcucca

SEQ ID NO: 1397085 - RNA, 17 nt, Human
ccaggagccugugccuc

SEQ ID NO: 1397086 - RNA, 16 nt, Human
ccaggagccugugccu

SEQ ID NO: 1397087 - RNA, 23 nt, Human
ccaggccaggacucugcagccuc

SEQ ID NO: 1397088 - RNA, 18 nt, Human
ccaggccaggcauguggc

SEQ ID NO: 1397089 - RNA, 22 nt, Human
ccaggccaggacucugcagccu

SEQ ID NO: 1397090 - RNA, 21 nt, Human
ccaggccaggacucugcagcc

SEQ ID NO: 1397091 - RNA, 20 nt, Human
ccaggccaggacucugcagc

SEQ ID NO: 1397092 - RNA, 19 nt, Human
ccaggccaggacucugcag

SEQ ID NO: 1397093 - RNA, 18 nt, Human
ccaggccaggacucugca

SEQ ID NO: 1397094 - RNA, 17 nt, Human
ccaggccaggacucugc

SEQ ID NO: 1397095 - RNA, 13 nt, Human
ccaggccaggacu

SEQ ID NO: 1397096 - RNA, 23 nt, Human
ccaggagcugggcagaaggccaa

SEQ ID NO: 1397097 - RNA, 20 nt, Human
ccaggagcuccccuccccaa

SEQ ID NO: 1397098 - RNA, 19 nt, Human
ccaggagcuccccucccca

SEQ ID NO: 1397099 - RNA, 14 nt, Human
ccaggagcuccccu

SEQ ID NO: 1397100 - RNA, 23 nt, Human
ccaggagcuccaguguccugagc

SEQ ID NO: 1397101 - RNA, 21 nt, Human
ccaggagcuccaguguccuga

SEQ ID NO: 1397102 - RNA, 20 nt, Human
ccaggagcuccaguguccug

SEQ ID NO: 1397103 - RNA, 18 nt, Human
ccaggagcuccagugucc

SEQ ID NO: 1397104 - RNA, 16 nt, Human
ccaggagcugggcaga

SEQ ID NO: 1397105 - RNA, 21 nt, Human
ccaggagcugggcagaaggcc

SEQ ID NO: 1397106 - RNA, 19 nt, Human
ccaggcccaaggcucccgg

SEQ ID NO: 1397107 - RNA, 17 nt, Human
ccaggcccaaggcuccc

SEQ ID NO: 1397108 - RNA, 15 nt, Human
ccaggcccaaggcuc

SEQ ID NO: 1397109 - RNA, 14 nt, Human
ccaggcccaaggcu

SEQ ID NO: 1397110 - RNA, 22 nt, Human
ccaggcccacugugccucagag

SEQ ID NO: 1397111 - RNA, 18 nt, Human
ccaggcccagccgacccc

SEQ ID NO: 1397112 - RNA, 17 nt, Human
ccaggcccacugugccu

SEQ ID NO: 1397113 - RNA, 18 nt, Human
ccaggcccaaggcucccg

SEQ ID NO: 1397114 - RNA, 21 nt, Human
ccaggccgggaaaaagcccac

SEQ ID NO: 1397115 - RNA, 16 nt, Human
ccaggcgcuaauucaa

SEQ ID NO: 1397116 - RNA, 24 nt, Human
ccaggcuaauuuuuuuguauuuua

SEQ ID NO: 1397117 - RNA, 18 nt, Human
ccagggagagggggcugg

SEQ ID NO: 1397118 - RNA, 13 nt, Human
ccagggagagggg

SEQ ID NO: 1397119 - RNA, 19 nt, Human
ccagggagcaugagaggag

SEQ ID NO: 1397120 - RNA, 22 nt, Human
ccagggagcaugagaggaggca

SEQ ID NO: 1397121 - RNA, 23 nt, Human
ccagggagcaugagaggaggcag

SEQ ID NO: 1397122 - RNA, 21 nt, Human
ccagggagagcccaggagcuc

SEQ ID NO: 1397123 - RNA, 23 nt, Human
ccagggagagcccaggagcuccc

SEQ ID NO: 1397124 - RNA, 20 nt, Human
ccagggagagcccaggagcu

SEQ ID NO: 1397125 - RNA, 19 nt, Human
ccagggagagcccaggagc

SEQ ID NO: 1397126 - RNA, 18 nt, Human
ccagggagagcccaggag

SEQ ID NO: 1397127 - RNA, 17 nt, Human
ccagggagagcccagga

SEQ ID NO: 1397128 - RNA, 15 nt, Human
ccagggagagcccag

SEQ ID NO: 1397129 - RNA, 14 nt, Human
ccagggagagccca

SEQ ID NO: 1397130 - RNA, 23 nt, Human
ccaggcuguguuuggcuuucagg

SEQ ID NO: 1397131 - RNA, 18 nt, Human
ccagggcccagagcccag

SEQ ID NO: 1397132 - RNA, 17 nt, Human
ccagggcccagagccca

SEQ ID NO: 1397133 - RNA, 16 nt, Human
ccagggcccagagccc

SEQ ID NO: 1397134 - RNA, 15 nt, Human
ccagggcccagagcc

SEQ ID NO: 1397135 - RNA, 14 nt, Human
ccagggcccagagc

SEQ ID NO: 1397136 - RNA, 13 nt, Human
ccagggcccagag

SEQ ID NO: 1397137 - RNA, 14 nt, Human
ccagggccagccuc

SEQ ID NO: 1397138 - RNA, 15 nt, Human
ccagggccagccucu

SEQ ID NO: 1397139 - RNA, 22 nt, Human
ccagggagagggggcugguggg

SEQ ID NO: 1397140 - RNA, 14 nt, Human
ccagggcuccugca

SEQ ID NO: 1397141 - RNA, 13 nt, Human
ccagggcuccugc

SEQ ID NO: 1397142 - RNA, 12 nt, Human
ccagggcuccug

SEQ ID NO: 1397143 - RNA, 19 nt, Human
ccagggcuccagccccucu

SEQ ID NO: 1397144 - RNA, 23 nt, Human
ccagggcccagagcccagcucca

SEQ ID NO: 1397145 - RNA, 22 nt, Human
ccagggcccagagcccagcucc

SEQ ID NO: 1397146 - RNA, 21 nt, Human
ccagggcccagagcccagcuc

SEQ ID NO: 1397147 - RNA, 19 nt, Human
ccagggcccagagcccagc

SEQ ID NO: 1397148 - RNA, 21 nt, Human
ccagggcuccagccccucuug

SEQ ID NO: 1397149 - RNA, 20 nt, Human
ccagggcuccugcacuuacu

SEQ ID NO: 1397150 - RNA, 16 nt, Human
ccaggguuuuaacuuu

SEQ ID NO: 1397151 - RNA, 13 nt, Human
ccaggguuuuaac

SEQ ID NO: 1397152 - RNA, 21 nt, Human
ccaggguugaccccagaggau

SEQ ID NO: 1397153 - RNA, 18 nt, Human
ccaggguugaccccagag

SEQ ID NO: 1397154 - RNA, 16 nt, Human
ccaggguugaccccag

SEQ ID NO: 1397155 - RNA, 13 nt, Human
ccagucuguggau

SEQ ID NO: 1397156 - RNA, 12 nt, Human
ccagucugugga

SEQ ID NO: 1397157 - RNA, 17 nt, Human
ccaguaaaauugccaua

SEQ ID NO: 1397158 - RNA, 19 nt, Human
ccaguaaaauugccauauu

SEQ ID NO: 1397159 - RNA, 23 nt, Human
ccaguaaaauugccauauugcac

SEQ ID NO: 1397160 - RNA, 24 nt, Human
ccagguucuccguuagcuccugug

SEQ ID NO: 1397161 - RNA, 23 nt, Human
ccagguucuccguuagcuccugu

SEQ ID NO: 1397162 - RNA, 22 nt, Human
ccagguucuccguuagcuccug

SEQ ID NO: 1397163 - RNA, 21 nt, Human
ccagguucuccguuagcuccu

SEQ ID NO: 1397164 - RNA, 18 nt, Human
ccagguuccacagaggac

SEQ ID NO: 1397165 - RNA, 15 nt, Human
ccagguuccacagag

SEQ ID NO: 1397166 - RNA, 18 nt, Human
ccagguuggcucugccag

SEQ ID NO: 1397167 - RNA, 17 nt, Human
ccagguuggcucugcca

SEQ ID NO: 1397168 - RNA, 16 nt, Human
ccagguuggcucugcc

SEQ ID NO: 1397169 - RNA, 14 nt, Human
ccagguuggcucug

SEQ ID NO: 1397170 - RNA, 18 nt, Human
ccagguuggagugcagug

SEQ ID NO: 1397171 - RNA, 11 nt, Human
ccaguaaaauu

SEQ ID NO: 1397172 - RNA, 13 nt, Human
ccaguaaaauugc

SEQ ID NO: 1397173 - RNA, 15 nt, Human
ccaguaaaauugcca

SEQ ID NO: 1397174 - RNA, 17 nt, Human
cccaauccucccagaaa

SEQ ID NO: 1397175 - RNA, 16 nt, Human
cccaagggaggcugcu

SEQ ID NO: 1397176 - RNA, 18 nt, Human
cccaagggaggcugcugc

SEQ ID NO: 1397177 - RNA, 19 nt, Human
cccaaggcucccggaauuc

SEQ ID NO: 1397178 - RNA, 13 nt, Human
cccaaccugcucu

SEQ ID NO: 1397179 - RNA, 17 nt, Human
cccaacccuucccucac

SEQ ID NO: 1397180 - RNA, 22 nt, Human
cccaacccguggaggcugcucg

SEQ ID NO: 1397181 - RNA, 23 nt, Human
cccaacccguggaggcugcucgg

SEQ ID NO: 1397182 - RNA, 21 nt, Human
cccaacccguggaggcugcuc

SEQ ID NO: 1397183 - RNA, 20 nt, Human
cccaacccguggaggcugcu

SEQ ID NO: 1397184 - RNA, 19 nt, Human
cccaacccguggaggcugc

SEQ ID NO: 1397185 - RNA, 18 nt, Human
cccaacccguggaggcug

SEQ ID NO: 1397186 - RNA, 14 nt, Human
cccaaaugagccau

SEQ ID NO: 1397187 - RNA, 23 nt, Human
cccaaaguuguuguaaccugcug

SEQ ID NO: 1397188 - RNA, 20 nt, Human
cccaaagugcugagauuaca

SEQ ID NO: 1397189 - RNA, 15 nt, Human
cccaaagugcugaga

SEQ ID NO: 1397190 - RNA, 15 nt, Human
cccaaagcuuuccug

SEQ ID NO: 1397191 - RNA, 14 nt, Human
cccaaagcuuuccu

SEQ ID NO: 1397192 - RNA, 18 nt, Human
cccaaaggacgcacugag

SEQ ID NO: 1397193 - RNA, 19 nt, Human
cccaaaggacgcacugagc

SEQ ID NO: 1397194 - RNA, 15 nt, Human
cccaaaggacgcacu

SEQ ID NO: 1397195 - RNA, 20 nt, Human
cccaaagcuuuccugcccca

SEQ ID NO: 1397196 - RNA, 17 nt, Human
cccaaagcuuuccugcc

SEQ ID NO: 1397197 - RNA, 16 nt, Human
cccaaagcuuuccugc

SEQ ID NO: 1397198 - RNA, 13 nt, Human
ccauuuguacuga

SEQ ID NO: 1397199 - RNA, 18 nt, Human
ccauuuggcaucccuggg

SEQ ID NO: 1397200 - RNA, 19 nt, Human
ccauuuggcaucccugggc

SEQ ID NO: 1397201 - RNA, 21 nt, Human
ccauuuguguacacagucagc

SEQ ID NO: 1397202 - RNA, 16 nt, Human
ccauuuggcaucccug

SEQ ID NO: 1397203 - RNA, 23 nt, Human
ccauuuggauccuguguggagag

SEQ ID NO: 1397204 - RNA, 13 nt, Human
ccauucauuccau

SEQ ID NO: 1397205 - RNA, 14 nt, Human
ccauucauuccauu

SEQ ID NO: 1397206 - RNA, 15 nt, Human
ccaugggaccacaac

SEQ ID NO: 1397207 - RNA, 22 nt, Human
ccaugggagcugguuagaaaug

SEQ ID NO: 1397208 - RNA, 11 nt, Human
ccaugggacca

SEQ ID NO: 1397209 - RNA, 13 nt, Human
ccauguuggcuag

SEQ ID NO: 1397210 - RNA, 13 nt, Human
ccauguuucaaau

SEQ ID NO: 1397211 - RNA, 20 nt, Human
ccauucacuucauaauccag

SEQ ID NO: 1397212 - RNA, 17 nt, Human
ccauccuaggcugacac

SEQ ID NO: 1397213 - RNA, 16 nt, Human
ccauccuaggcugaca

SEQ ID NO: 1397214 - RNA, 17 nt, Human
ccauauuuaccucagcc

SEQ ID NO: 1397215 - RNA, 18 nt, Human
ccauauuguaaaacaggu

SEQ ID NO: 1397216 - RNA, 14 nt, Human
ccauauuguaaaac

SEQ ID NO: 1397217 - RNA, 16 nt, Human
ccauauuuaccucagc

SEQ ID NO: 1397218 - RNA, 15 nt, Human
ccauauuuaccucag

SEQ ID NO: 1397219 - RNA, 18 nt, Human
ccauccuacccccugugc

SEQ ID NO: 1397220 - RNA, 14 nt, Human
ccauauuggccagu

SEQ ID NO: 1397221 - RNA, 23 nt, Human
ccauauugcacaugucuuaauga

SEQ ID NO: 1397222 - RNA, 18 nt, Human
ccauauugcacaugucuu

SEQ ID NO: 1397223 - RNA, 21 nt, Human
ccauauugcacaugucuuaau

SEQ ID NO: 1397224 - RNA, 13 nt, Human
ccauauugcacau

SEQ ID NO: 1397225 - RNA, 21 nt, Human
ccaucguugcccccauuucug

SEQ ID NO: 1397226 - RNA, 15 nt, Human
ccaucugcauuccca

SEQ ID NO: 1397227 - RNA, 17 nt, Human
ccaucugcauucccagc

SEQ ID NO: 1397228 - RNA, 21 nt, Human
ccauggccugcaaacugggaa

SEQ ID NO: 1397229 - RNA, 18 nt, Human
ccauggccugcaaacugg

SEQ ID NO: 1397230 - RNA, 16 nt, Human
ccauggccugcaaacu

SEQ ID NO: 1397231 - RNA, 22 nt, Human
ccauggccugcaaacugggaac

SEQ ID NO: 1397232 - RNA, 20 nt, Human
ccaucugcgugacaauaaaa

SEQ ID NO: 1397233 - RNA, 22 nt, Human
ccaucugcgugacaauaaaaca

SEQ ID NO: 1397234 - RNA, 13 nt, Human
ccauggcccugcc

SEQ ID NO: 1397235 - RNA, 19 nt, Human
cccuagcgcuaucucccug

SEQ ID NO: 1397236 - RNA, 14 nt, Human
cccuagccuugcuu

SEQ ID NO: 1397237 - RNA, 11 nt, Human
cccuagccuug

SEQ ID NO: 1397238 - RNA, 16 nt, Human
cccuaccugccccacu

SEQ ID NO: 1397239 - RNA, 14 nt, Human
cccuaccugugccu

SEQ ID NO: 1397240 - RNA, 14 nt, Human
cccuaccugcccca

SEQ ID NO: 1397241 - RNA, 15 nt, Human
cccuacccucuagag

SEQ ID NO: 1397242 - RNA, 14 nt, Human
cccuacccucuaga

SEQ ID NO: 1397243 - RNA, 13 nt, Human
cccuacccucuag

SEQ ID NO: 1397244 - RNA, 11 nt, Human
cccuacccucu

SEQ ID NO: 1397245 - RNA, 22 nt, Human
cccuaaucuauggucgggagac

SEQ ID NO: 1397246 - RNA, 15 nt, Human
cccuaaucuaugguc

SEQ ID NO: 1397247 - RNA, 14 nt, Human
cccuacauguauug

SEQ ID NO: 1397248 - RNA, 13 nt, Human
cccgucucagugu

SEQ ID NO: 1397249 - RNA, 12 nt, Human
cccgucucagug

SEQ ID NO: 1397250 - RNA, 17 nt, Human
cccguccugccuguggc

SEQ ID NO: 1397251 - RNA, 16 nt, Human
cccguccugccugugg

SEQ ID NO: 1397252 - RNA, 15 nt, Human
cccguccugccugug

SEQ ID NO: 1397253 - RNA, 14 nt, Human
cccguccugccugu

SEQ ID NO: 1397254 - RNA, 13 nt, Human
cccguccugccug

SEQ ID NO: 1397255 - RNA, 17 nt, Human
cccgucuggcccaccag

SEQ ID NO: 1397256 - RNA, 23 nt, Human
cccggggugagggggggcucccu

SEQ ID NO: 1397257 - RNA, 14 nt, Human
cccggggccagcac

SEQ ID NO: 1397258 - RNA, 16 nt, Human
cccggggccagcacuu

SEQ ID NO: 1397259 - RNA, 21 nt, Human
cccggggugcccacaggccgc

SEQ ID NO: 1397260 - RNA, 22 nt, Human
cccggggaaaggcaagguccgg

SEQ ID NO: 1397261 - RNA, 13 nt, Human
cccagaaaagaaa

SEQ ID NO: 1397262 - RNA, 20 nt, Human
cccagaaaagaaagcuacag

SEQ ID NO: 1397263 - RNA, 21 nt, Human
cccgagucauucguucugugg

SEQ ID NO: 1397264 - RNA, 12 nt, Human
cccgccugcccu

SEQ ID NO: 1397265 - RNA, 13 nt, Human
cccgccucagccu

SEQ ID NO: 1397266 - RNA, 11 nt, Human
cccuggucccu

SEQ ID NO: 1397267 - RNA, 14 nt, Human
cccugggccuuggg

SEQ ID NO: 1397268 - RNA, 19 nt, Human
cccugguaauagcuguaaa

SEQ ID NO: 1397269 - RNA, 16 nt, Human
cccugguaauagcugu

SEQ ID NO: 1397270 - RNA, 14 nt, Human
cccuggucccuugu

SEQ ID NO: 1397271 - RNA, 21 nt, Human
cccugguccccuccuucccaa

SEQ ID NO: 1397272 - RNA, 14 nt, Human
cccugguccccucc

SEQ ID NO: 1397273 - RNA, 18 nt, Human
cccuggucccucugcagu

SEQ ID NO: 1397274 - RNA, 21 nt, Human
cccuggacugugugcucagga

SEQ ID NO: 1397275 - RNA, 15 nt, Human
cccuggacugugugc

SEQ ID NO: 1397276 - RNA, 18 nt, Human
cccugggccuugggcucc

SEQ ID NO: 1397277 - RNA, 13 nt, Human
cccugggccuugg

SEQ ID NO: 1397278 - RNA, 20 nt, Human
cccugggccugcugcugaga

SEQ ID NO: 1397279 - RNA, 19 nt, Human
cccugggccugcugcugag

SEQ ID NO: 1397280 - RNA, 17 nt, Human
cccugggccugcugcug

SEQ ID NO: 1397281 - RNA, 16 nt, Human
cccugggccugcugcu

SEQ ID NO: 1397282 - RNA, 15 nt, Human
cccugggccugcugc

SEQ ID NO: 1397283 - RNA, 14 nt, Human
cccugggccugcug

SEQ ID NO: 1397284 - RNA, 13 nt, Human
cccugggccugcu

SEQ ID NO: 1397285 - RNA, 19 nt, Human
cccugggccugccucacca

SEQ ID NO: 1397286 - RNA, 13 nt, Human
cccugggccugcc

SEQ ID NO: 1397287 - RNA, 11 nt, Human
cccugggccug

SEQ ID NO: 1397288 - RNA, 19 nt, Human
cccugggcccugggcugga

SEQ ID NO: 1397289 - RNA, 18 nt, Human
cccugggcccugggcugg

SEQ ID NO: 1397290 - RNA, 16 nt, Human
cccugggcccugggcu

SEQ ID NO: 1397291 - RNA, 13 nt, Human
cccugggcccugg

SEQ ID NO: 1397292 - RNA, 24 nt, Human
cccugggagaaucgcuccugcagc

SEQ ID NO: 1397293 - RNA, 22 nt, Human
cccugggagaaucgcuccugca

SEQ ID NO: 1397294 - RNA, 15 nt, Human
cccugggaggcucug

SEQ ID NO: 1397295 - RNA, 20 nt, Human
cccugccacucacuaggccc

SEQ ID NO: 1397296 - RNA, 18 nt, Human
cccuggacccagccagaa

SEQ ID NO: 1397297 - RNA, 16 nt, Human
cccuggacccagccag

SEQ ID NO: 1397298 - RNA, 23 nt, Human
cccuggaaugaguugaggccacu

SEQ ID NO: 1397299 - RNA, 21 nt, Human
cccuggaaggacauccauguu

SEQ ID NO: 1397300 - RNA, 18 nt, Human
cccucuguguauuugcuu

SEQ ID NO: 1397301 - RNA, 24 nt, Human
cccucuguccaggcacugagauac

SEQ ID NO: 1397302 - RNA, 20 nt, Human
cccucuguccaggcacugag

SEQ ID NO: 1397303 - RNA, 22 nt, Human
cccucuggucgcuccugcccac

SEQ ID NO: 1397304 - RNA, 20 nt, Human
cccucuggucgcuccugccc

SEQ ID NO: 1397305 - RNA, 19 nt, Human
cccucuggucgcuccugcc

SEQ ID NO: 1397306 - RNA, 18 nt, Human
cccucuggucgcuccugc

SEQ ID NO: 1397307 - RNA, 13 nt, Human
cccugcacaguug

SEQ ID NO: 1397308 - RNA, 22 nt, Human
cccugcacagugacuucugaga

SEQ ID NO: 1397309 - RNA, 20 nt, Human
cccugcacagugacuucuga

SEQ ID NO: 1397310 - RNA, 17 nt, Human
cccugcacuguaaaaug

SEQ ID NO: 1397311 - RNA, 20 nt, Human
cccugcacuguaaaaugugg

SEQ ID NO: 1397312 - RNA, 16 nt, Human
cccugcacuguaaaau

SEQ ID NO: 1397313 - RNA, 23 nt, Human
cccugcaccaugcugcuggggaa

SEQ ID NO: 1397314 - RNA, 20 nt, Human
cccugccaccuccugccuca

SEQ ID NO: 1397315 - RNA, 13 nt, Human
cccugccaccugu

SEQ ID NO: 1397316 - RNA, 14 nt, Human
cccugccaccuguc

SEQ ID NO: 1397317 - RNA, 15 nt, Human
cccugccaccugucu

SEQ ID NO: 1397318 - RNA, 16 nt, Human
cccugccaccugucug

SEQ ID NO: 1397319 - RNA, 17 nt, Human
cccugccaccugucugu

SEQ ID NO: 1397320 - RNA, 19 nt, Human
cccugccacucacuaggcc

SEQ ID NO: 1397321 - RNA, 18 nt, Human
cccugccacucacuaggc

SEQ ID NO: 1397322 - RNA, 13 nt, Human
cccugccacucac

SEQ ID NO: 1397323 - RNA, 18 nt, Human
cccugccaccugucuguc

SEQ ID NO: 1397324 - RNA, 18 nt, Human
cccucccccccaugcacu

SEQ ID NO: 1397325 - RNA, 15 nt, Human
cccucccccccaugc

SEQ ID NO: 1397326 - RNA, 21 nt, Human
cccuccccaacugaccaccuu

SEQ ID NO: 1397327 - RNA, 19 nt, Human
cccuccaccgcagaaggaa

SEQ ID NO: 1397328 - RNA, 19 nt, Human
cccuauacuguaguauucu

SEQ ID NO: 1397329 - RNA, 23 nt, Human
cccuauacugcuuggagcugagc

SEQ ID NO: 1397330 - RNA, 19 nt, Human
cccuaguucuaccucaggc

SEQ ID NO: 1397331 - RNA, 22 nt, Human
cccuagguguuuuguucaccau

SEQ ID NO: 1397332 - RNA, 16 nt, Human
cccuagguguuuuguu

SEQ ID NO: 1397333 - RNA, 15 nt, Human
cccuagguguuuugu

SEQ ID NO: 1397334 - RNA, 12 nt, Human
cccuagguguuu

SEQ ID NO: 1397335 - RNA, 16 nt, Human
cccuauccaaucaauc

SEQ ID NO: 1397336 - RNA, 23 nt, Human
cccuccacauuucccccuagccu

SEQ ID NO: 1397337 - RNA, 21 nt, Human
cccuccaccgcagaaggaagg

SEQ ID NO: 1397338 - RNA, 18 nt, Human
cccuccaccgcagaagga

SEQ ID NO: 1397339 - RNA, 22 nt, Human
cccucuggagggguguggcucc

SEQ ID NO: 1397340 - RNA, 21 nt, Human
cccucuggagggguguggcuc

SEQ ID NO: 1397341 - RNA, 12 nt, Human
cccucuggaggg

SEQ ID NO: 1397342 - RNA, 15 nt, Human
cccucugcugcuguc

SEQ ID NO: 1397343 - RNA, 14 nt, Human
cccucugcugcugu

SEQ ID NO: 1397344 - RNA, 19 nt, Human
cccucugaccugcacuggg

SEQ ID NO: 1397345 - RNA, 17 nt, Human
cccucugaccugcacug

SEQ ID NO: 1397346 - RNA, 16 nt, Human
cccucugaccugcacu

SEQ ID NO: 1397347 - RNA, 15 nt, Human
cccucugaccugcac

SEQ ID NO: 1397348 - RNA, 14 nt, Human
cccucugaccugca

SEQ ID NO: 1397349 - RNA, 13 nt, Human
cccucugaaauac

SEQ ID NO: 1397350 - RNA, 14 nt, Human
cccucucuggagaa

SEQ ID NO: 1397351 - RNA, 13 nt, Human
cccucucuggaga

SEQ ID NO: 1397352 - RNA, 16 nt, Human
cccucucugcucugcg

SEQ ID NO: 1397353 - RNA, 15 nt, Human
cccucucugcucugc

SEQ ID NO: 1397354 - RNA, 20 nt, Human
cccucccccccaugcacugu

SEQ ID NO: 1397355 - RNA, 18 nt, Human
cccucucucauacccucc

SEQ ID NO: 1397356 - RNA, 14 nt, Human
cccucucugcucug

SEQ ID NO: 1397357 - RNA, 20 nt, Human
cccucucugcagacuuccca

SEQ ID NO: 1397358 - RNA, 22 nt, Human
cccucucucauacccucccucc

SEQ ID NO: 1397359 - RNA, 23 nt, Human
cccgagucauucguucuguggag

SEQ ID NO: 1397360 - RNA, 22 nt, Human
cccacaagccucugcccaggca

SEQ ID NO: 1397361 - RNA, 23 nt, Human
cccacaggaagccugcaguccug

SEQ ID NO: 1397362 - RNA, 22 nt, Human
cccacaggaagccugcaguccu

SEQ ID NO: 1397363 - RNA, 20 nt, Human
cccacaggaagccugcaguc

SEQ ID NO: 1397364 - RNA, 19 nt, Human
cccaccaacccucagggca

SEQ ID NO: 1397365 - RNA, 18 nt, Human
cccaccaacccucagggc

SEQ ID NO: 1397366 - RNA, 17 nt, Human
cccaccaacccucaggg

SEQ ID NO: 1397367 - RNA, 16 nt, Human
cccaccaacccucagg

SEQ ID NO: 1397368 - RNA, 20 nt, Human
cccacauuggaagagcagca

SEQ ID NO: 1397369 - RNA, 22 nt, Human
cccacauuggaagagcagcacc

SEQ ID NO: 1397370 - RNA, 14 nt, Human
cccacauuaaagaa

SEQ ID NO: 1397371 - RNA, 20 nt, Human
cccacaggacauuucucuaa

SEQ ID NO: 1397372 - RNA, 19 nt, Human
cccacaggacauuucucua

SEQ ID NO: 1397373 - RNA, 21 nt, Human
cccacaagugcccuccaggcu

SEQ ID NO: 1397374 - RNA, 13 nt, Human
cccacaagccuga

SEQ ID NO: 1397375 - RNA, 20 nt, Human
cccacaagccucugcccagg

SEQ ID NO: 1397376 - RNA, 19 nt, Human
cccacaacccaaaagguuu

SEQ ID NO: 1397377 - RNA, 15 nt, Human
cccacaagccugagg

SEQ ID NO: 1397378 - RNA, 18 nt, Human
cccacuuguccuuagccu

SEQ ID NO: 1397379 - RNA, 14 nt, Human
cccacuuguccuua

SEQ ID NO: 1397380 - RNA, 21 nt, Human
cccacuugccucuuccuugaa

SEQ ID NO: 1397381 - RNA, 15 nt, Human
cccacuugccucuuc

SEQ ID NO: 1397382 - RNA, 14 nt, Human
cccacuugccucuu

SEQ ID NO: 1397383 - RNA, 13 nt, Human
cccacuugccucu

SEQ ID NO: 1397384 - RNA, 14 nt, Human
cccacgagggcugg

SEQ ID NO: 1397385 - RNA, 13 nt, Human
cccacgagggcug

SEQ ID NO: 1397386 - RNA, 16 nt, Human
cccacgacacugcagc

SEQ ID NO: 1397387 - RNA, 16 nt, Human
cccaccagaugcugaa

SEQ ID NO: 1397388 - RNA, 13 nt, Human
cccaccaggcugc

SEQ ID NO: 1397389 - RNA, 16 nt, Human
cccaccaggcugcuca

SEQ ID NO: 1397390 - RNA, 17 nt, Human
cccaccaggcugcucag

SEQ ID NO: 1397391 - RNA, 22 nt, Human
cccaccaggcugcucagggcug

SEQ ID NO: 1397392 - RNA, 17 nt, Human
cccaccgggccacuccu

SEQ ID NO: 1397393 - RNA, 13 nt, Human
cccaccagggucc

SEQ ID NO: 1397394 - RNA, 18 nt, Human
cccaccugacacaccagg

SEQ ID NO: 1397395 - RNA, 15 nt, Human
cccaccuccugacac

SEQ ID NO: 1397396 - RNA, 16 nt, Human
cccaccuccccuuggg

SEQ ID NO: 1397397 - RNA, 23 nt, Human
cccaccgggccacuccuuccugc

SEQ ID NO: 1397398 - RNA, 22 nt, Human
cccaccgggccacuccuuccug

SEQ ID NO: 1397399 - RNA, 19 nt, Human
cccaccgggccacuccuuc

SEQ ID NO: 1397400 - RNA, 18 nt, Human
cccaccgggccacuccuu

SEQ ID NO: 1397401 - RNA, 21 nt, Human
cccaccucccucaaccucauc

SEQ ID NO: 1397402 - RNA, 23 nt, Human
ccuagggaggcauggucugcccu

SEQ ID NO: 1397403 - RNA, 11 nt, Human
ccuaggcugca

SEQ ID NO: 1397404 - RNA, 15 nt, Human
ccuagaaacaacacu

SEQ ID NO: 1397405 - RNA, 18 nt, Human
ccuaggcuccaccccauc

SEQ ID NO: 1397406 - RNA, 17 nt, Human
ccuaggcuccaccccau

SEQ ID NO: 1397407 - RNA, 15 nt, Human
ccuaggcuccacccc

SEQ ID NO: 1397408 - RNA, 16 nt, Human
ccuagaaacaacacug

SEQ ID NO: 1397409 - RNA, 21 nt, Human
ccuacuuugacuuuuugcauu

SEQ ID NO: 1397410 - RNA, 15 nt, Human
ccuacuuugacuuuu

SEQ ID NO: 1397411 - RNA, 14 nt, Human
ccuacuuugacuuu

SEQ ID NO: 1397412 - RNA, 22 nt, Human
ccuacuucuuuugcucuuagcu

SEQ ID NO: 1397413 - RNA, 16 nt, Human
ccuacuucuuuugcuc

SEQ ID NO: 1397414 - RNA, 17 nt, Human
ccuacagaaaaaccuug

SEQ ID NO: 1397415 - RNA, 19 nt, Human
ccuacagaaaaaccuuggg

SEQ ID NO: 1397416 - RNA, 14 nt, Human
ccuacagaaaaacc

SEQ ID NO: 1397417 - RNA, 13 nt, Human
ccuacagaaaaac

SEQ ID NO: 1397418 - RNA, 18 nt, Human
ccuacacucaccugcacu

SEQ ID NO: 1397419 - RNA, 19 nt, Human
ccuaguuuucuccucccag

SEQ ID NO: 1397420 - RNA, 18 nt, Human
ccuaguuuucuccuccca

SEQ ID NO: 1397421 - RNA, 16 nt, Human
ccuaguuuucuccucc

SEQ ID NO: 1397422 - RNA, 15 nt, Human
ccuaguuuucuccuc

SEQ ID NO: 1397423 - RNA, 15 nt, Human
ccuaguuuuccaugc

SEQ ID NO: 1397424 - RNA, 13 nt, Human
ccuaguuuuccau

SEQ ID NO: 1397425 - RNA, 12 nt, Human
ccuaguuuucca

SEQ ID NO: 1397426 - RNA, 13 nt, Human
ccuaguucuucau

SEQ ID NO: 1397427 - RNA, 19 nt, Human
ccuaguucuguagaaaugg

SEQ ID NO: 1397428 - RNA, 18 nt, Human
ccuaguucuagaaaaaca

SEQ ID NO: 1397429 - RNA, 18 nt, Human
ccuaguucuguagaaaug

SEQ ID NO: 1397430 - RNA, 17 nt, Human
ccuaguucuagaaaaac

SEQ ID NO: 1397431 - RNA, 15 nt, Human
ccuaguucuagaaaa

SEQ ID NO: 1397432 - RNA, 19 nt, Human
ccuauacuguaguauucuu

SEQ ID NO: 1397433 - RNA, 23 nt, Human
ccuauacugcuuggagcugagca

SEQ ID NO: 1397434 - RNA, 22 nt, Human
ccuauacugcuuggagcugagc

SEQ ID NO: 1397435 - RNA, 13 nt, Human
ccuauacugcuug

SEQ ID NO: 1397436 - RNA, 22 nt, Human
ccuauacgcagcgugcuuuaaa

SEQ ID NO: 1397437 - RNA, 18 nt, Human
ccuauaccuguguuucuu

SEQ ID NO: 1397438 - RNA, 20 nt, Human
ccuaguuuucuccucccagg

SEQ ID NO: 1397439 - RNA, 16 nt, Human
ccuaaauauauuuuaa

SEQ ID NO: 1397440 - RNA, 18 nt, Human
ccuaaauauauuuuaaga

SEQ ID NO: 1397441 - RNA, 19 nt, Human
ccuaaauaauaaaaauaaa

SEQ ID NO: 1397442 - RNA, 15 nt, Human
ccguguccaccccca

SEQ ID NO: 1397443 - RNA, 22 nt, Human
ccgugugagaagugaaugcugg

SEQ ID NO: 1397444 - RNA, 23 nt, Human
ccgugugagaagugaaugcuggg

SEQ ID NO: 1397445 - RNA, 18 nt, Human
ccguguccacccccauac

SEQ ID NO: 1397446 - RNA, 12 nt, Human
ccguguccaccc

SEQ ID NO: 1397447 - RNA, 14 nt, Human
ccgugguccuuugg

SEQ ID NO: 1397448 - RNA, 22 nt, Human
ccuaaaagugggcuugauucug

SEQ ID NO: 1397449 - RNA, 19 nt, Human
ccuaaaagaaacccugcac

SEQ ID NO: 1397450 - RNA, 21 nt, Human
ccgaggaggugucucaggcug

SEQ ID NO: 1397451 - RNA, 20 nt, Human
ccgaggaggugucucaggcu

SEQ ID NO: 1397452 - RNA, 18 nt, Human
ccgaggaggugucucagg

SEQ ID NO: 1397453 - RNA, 15 nt, Human
ccgaggcagggaagg

SEQ ID NO: 1397454 - RNA, 23 nt, Human
ccgaggaggugucucaggcugcc

SEQ ID NO: 1397455 - RNA, 13 nt, Human
cccuggugacauc

SEQ ID NO: 1397456 - RNA, 16 nt, Human
ccgauuguaacucaaa

SEQ ID NO: 1397457 - RNA, 13 nt, Human
ccgauuguaacuc

SEQ ID NO: 1397458 - RNA, 13 nt, Human
ccgauucacccug

SEQ ID NO: 1397459 - RNA, 15 nt, Human
ccgaguccaagcugg

SEQ ID NO: 1397460 - RNA, 13 nt, Human
ccgaguccaagcu

SEQ ID NO: 1397461 - RNA, 12 nt, Human
ccgaguccaagc

SEQ ID NO: 1397462 - RNA, 20 nt, Human
ccgagucauucguucugugg

SEQ ID NO: 1397463 - RNA, 19 nt, Human
ccgagucauucguucugug

SEQ ID NO: 1397464 - RNA, 22 nt, Human
ccgaggccuaccccgcagacac

SEQ ID NO: 1397465 - RNA, 23 nt, Human
ccgcgauguggaacugcugccac

SEQ ID NO: 1397466 - RNA, 22 nt, Human
ccgcgauguggaacugcugcca

SEQ ID NO: 1397467 - RNA, 17 nt, Human
ccgccuuggccuguguu

SEQ ID NO: 1397468 - RNA, 13 nt, Human
ccgcaccccccaa

SEQ ID NO: 1397469 - RNA, 17 nt, Human
ccgcgucuacccuggga

SEQ ID NO: 1397470 - RNA, 15 nt, Human
ccgcgucuacccugg

SEQ ID NO: 1397471 - RNA, 13 nt, Human
ccgcgucuacccu

SEQ ID NO: 1397472 - RNA, 18 nt, Human
ccgcuaaaagaaacuuuc

SEQ ID NO: 1397473 - RNA, 14 nt, Human
ccgcuaaaagaaac

SEQ ID NO: 1397474 - RNA, 22 nt, Human
ccgcgugcggaggggacagagc

SEQ ID NO: 1397475 - RNA, 16 nt, Human
ccgcgucuacccuggg

SEQ ID NO: 1397476 - RNA, 21 nt, Human
ccgcuacaccacucuggcagc

SEQ ID NO: 1397477 - RNA, 20 nt, Human
ccgcuacaccacucuggcag

SEQ ID NO: 1397478 - RNA, 19 nt, Human
ccgcuacaccacucuggca

SEQ ID NO: 1397479 - RNA, 17 nt, Human
ccgcuacaccacucugg

SEQ ID NO: 1397480 - RNA, 16 nt, Human
ccgcuacaccacucug

SEQ ID NO: 1397481 - RNA, 21 nt, Human
ccgggaccacccugagccggc

SEQ ID NO: 1397482 - RNA, 17 nt, Human
ccgggaccuggugcugc

SEQ ID NO: 1397483 - RNA, 20 nt, Human
ccgggaccacccugagccgg

SEQ ID NO: 1397484 - RNA, 21 nt, Human
ccgggaagugagggcucacuc

SEQ ID NO: 1397485 - RNA, 23 nt, Human
ccggguguccccaacagcgccca

SEQ ID NO: 1397486 - RNA, 22 nt, Human
ccggguguccccaacagcgccc

SEQ ID NO: 1397487 - RNA, 14 nt, Human
ccgggucugccucu

SEQ ID NO: 1397488 - RNA, 15 nt, Human
ccggggaaaggcaag

SEQ ID NO: 1397489 - RNA, 17 nt, Human
ccgugcucgccccagca

SEQ ID NO: 1397490 - RNA, 16 nt, Human
ccgugcucgccccagc

SEQ ID NO: 1397491 - RNA, 19 nt, Human
ccgguaagagcaaaagaau

SEQ ID NO: 1397492 - RNA, 23 nt, Human
ccgcugagcgaggagaugcuccu

SEQ ID NO: 1397493 - RNA, 20 nt, Human
ccgcucaggcugaccacuuu

SEQ ID NO: 1397494 - RNA, 20 nt, Human
ccgcugccacguuggagaag

SEQ ID NO: 1397495 - RNA, 20 nt, Human
ccgcuuggcgaugccagcca

SEQ ID NO: 1397496 - RNA, 21 nt, Human
ccgcuuggcgaugccagccaa

SEQ ID NO: 1397497 - RNA, 23 nt, Human
ccgcuuggagcuauuuuccaggc

SEQ ID NO: 1397498 - RNA, 20 nt, Human
ccgggacaccuaggcuaggg

SEQ ID NO: 1397499 - RNA, 19 nt, Human
ccgggacaccuaggcuagg

SEQ ID NO: 1397500 - RNA, 17 nt, Human
ccggcuugccacacccc

SEQ ID NO: 1397501 - RNA, 12 nt, Human
ccuaugcuuuga

SEQ ID NO: 1397502 - RNA, 23 nt, Human
ccuaugcaugguuucagcacuag

SEQ ID NO: 1397503 - RNA, 19 nt, Human
ccuaugcaugguuucagca

SEQ ID NO: 1397504 - RNA, 18 nt, Human
ccuaugcaugguuucagc

SEQ ID NO: 1397505 - RNA, 14 nt, Human
ccuaugcaugguuu

SEQ ID NO: 1397506 - RNA, 11 nt, Human
ccuaugcaugg

SEQ ID NO: 1397507 - RNA, 21 nt, Human
ccucagugacccuggcuccuu

SEQ ID NO: 1397508 - RNA, 20 nt, Human
ccucagugacccuggcuccu

SEQ ID NO: 1397509 - RNA, 19 nt, Human
ccucagugacccuggcucc

SEQ ID NO: 1397510 - RNA, 18 nt, Human
ccucagugacccuggcuc

SEQ ID NO: 1397511 - RNA, 17 nt, Human
ccucagugacccuggcu

SEQ ID NO: 1397512 - RNA, 16 nt, Human
ccuauggagagcccug

SEQ ID NO: 1397513 - RNA, 15 nt, Human
ccuauggagagcccu

SEQ ID NO: 1397514 - RNA, 14 nt, Human
ccuauggagagccc

SEQ ID NO: 1397515 - RNA, 13 nt, Human
ccuauggagagcc

SEQ ID NO: 1397516 - RNA, 22 nt, Human
ccuaugcaugguuucagcacua

SEQ ID NO: 1397517 - RNA, 21 nt, Human
ccuaugcaugguuucagcacu

SEQ ID NO: 1397518 - RNA, 20 nt, Human
ccuaugcaugguuucagcac

SEQ ID NO: 1397519 - RNA, 20 nt, Human
ccuccacauccuccacguuc

SEQ ID NO: 1397520 - RNA, 16 nt, Human
ccuccacauccuccac

SEQ ID NO: 1397521 - RNA, 15 nt, Human
ccuccacauccucca

SEQ ID NO: 1397522 - RNA, 14 nt, Human
ccuccacauccucc

SEQ ID NO: 1397523 - RNA, 16 nt, Human
ccuccacaccugcggc

SEQ ID NO: 1397524 - RNA, 17 nt, Human
ccuccacaccugcggcc

SEQ ID NO: 1397525 - RNA, 18 nt, Human
ccucaucuucuucaccau

SEQ ID NO: 1397526 - RNA, 15 nt, Human
ccucaucuucuucac

SEQ ID NO: 1397527 - RNA, 17 nt, Human
ccucaucugucccuccg

SEQ ID NO: 1397528 - RNA, 15 nt, Human
ccucaucugucccuc

SEQ ID NO: 1397529 - RNA, 20 nt, Human
ccucaucucucugcccaacc

SEQ ID NO: 1397530 - RNA, 15 nt, Human
ccuccacaccugcgg

SEQ ID NO: 1397531 - RNA, 14 nt, Human
ccuccacaccugcg

SEQ ID NO: 1397532 - RNA, 13 nt, Human
ccuccacaccugc

SEQ ID NO: 1397533 - RNA, 13 nt, Human
ccucaugaaugua

SEQ ID NO: 1397534 - RNA, 17 nt, Human
ccucaucuucuucacca

SEQ ID NO: 1397535 - RNA, 20 nt, Human
ccucaucccguguucuccuu

SEQ ID NO: 1397536 - RNA, 20 nt, Human
ccucaucccgagcaccucca

SEQ ID NO: 1397537 - RNA, 14 nt, Human
ccucaucccgagca

SEQ ID NO: 1397538 - RNA, 22 nt, Human
ccucauccaccccaucccuccc

SEQ ID NO: 1397539 - RNA, 16 nt, Human
ccucaucaaggacacg

SEQ ID NO: 1397540 - RNA, 19 nt, Human
ccucaucucucugcccaac

SEQ ID NO: 1397541 - RNA, 17 nt, Human
ccucaucucucugccca

SEQ ID NO: 1397542 - RNA, 17 nt, Human
ccucauccuccuucuuc

SEQ ID NO: 1397543 - RNA, 21 nt, Human
ccucaucuccccaucauuggu

SEQ ID NO: 1397544 - RNA, 18 nt, Human
ccucccaaagugcugaga

SEQ ID NO: 1397545 - RNA, 15 nt, Human
ccuccagggacagca

SEQ ID NO: 1397546 - RNA, 13 nt, Human
ccuccagggacag

SEQ ID NO: 1397547 - RNA, 12 nt, Human
ccuccagccccu

SEQ ID NO: 1397548 - RNA, 13 nt, Human
ccuccagccccug

SEQ ID NO: 1397549 - RNA, 21 nt, Human
ccuccacguucugcucaucau

SEQ ID NO: 1397550 - RNA, 18 nt, Human
ccuccacguucugcucau

SEQ ID NO: 1397551 - RNA, 17 nt, Human
ccuccacguucugcuca

SEQ ID NO: 1397552 - RNA, 18 nt, Human
ccuccaccgcagaaggaa

SEQ ID NO: 1397553 - RNA, 13 nt, Human
ccuccaccuccug

SEQ ID NO: 1397554 - RNA, 12 nt, Human
ccuccaccucaa

SEQ ID NO: 1397555 - RNA, 12 nt, Human
ccuccucuguga

SEQ ID NO: 1397556 - RNA, 22 nt, Human
ccuccucugugaccaaugucuu

SEQ ID NO: 1397557 - RNA, 21 nt, Human
ccuccucauguacauacccug

SEQ ID NO: 1397558 - RNA, 20 nt, Human
ccuccucauguacauacccu

SEQ ID NO: 1397559 - RNA, 12 nt, Human
ccuccucaugua

SEQ ID NO: 1397560 - RNA, 23 nt, Human
ccuccucaucccguguucuccuu

SEQ ID NO: 1397561 - RNA, 20 nt, Human
ccuccucaucccguguucuc

SEQ ID NO: 1397562 - RNA, 13 nt, Human
ccuccucaucccg

SEQ ID NO: 1397563 - RNA, 21 nt, Human
ccuccucaggcacacagcuac

SEQ ID NO: 1397564 - RNA, 11 nt, Human
ccuccugcuca

SEQ ID NO: 1397565 - RNA, 18 nt, Human
ccuccugccucuacuggg

SEQ ID NO: 1397566 - RNA, 13 nt, Human
ccuccugccucua

SEQ ID NO: 1397567 - RNA, 12 nt, Human
ccuccugccucu

SEQ ID NO: 1397568 - RNA, 12 nt, Human
ccuccugagaaa

SEQ ID NO: 1397569 - RNA, 22 nt, Human
ccuccugacacccuucucccac

SEQ ID NO: 1397570 - RNA, 19 nt, Human
ccuccugacacccuucucc

SEQ ID NO: 1397571 - RNA, 18 nt, Human
ccuccugacacccuucuc

SEQ ID NO: 1397572 - RNA, 15 nt, Human
ccuccugacacccuu

SEQ ID NO: 1397573 - RNA, 24 nt, Human
ccuccccuugggcccacaccuccu

SEQ ID NO: 1397574 - RNA, 14 nt, Human
ccuccccuugccug

SEQ ID NO: 1397575 - RNA, 12 nt, Human
ccuccccuuggg

SEQ ID NO: 1397576 - RNA, 13 nt, Human
ccuccccuugccu

SEQ ID NO: 1397577 - RNA, 18 nt, Human
ccuccccuuaaaggggag

SEQ ID NO: 1397578 - RNA, 22 nt, Human
ccuccccuggagggggaauggc

SEQ ID NO: 1397579 - RNA, 14 nt, Human
ccuccccuggaggg

SEQ ID NO: 1397580 - RNA, 12 nt, Human
ccuccccuggag

SEQ ID NO: 1397581 - RNA, 13 nt, Human
ccucccccacuuu

SEQ ID NO: 1397582 - RNA, 21 nt, Human
ccuccccuugggcccacaccu

SEQ ID NO: 1397583 - RNA, 19 nt, Human
ccuccucaggcacacagcu

SEQ ID NO: 1397584 - RNA, 17 nt, Human
ccuccucaggcacacag

SEQ ID NO: 1397585 - RNA, 22 nt, Human
ccuccucagccugaaccccagg

SEQ ID NO: 1397586 - RNA, 15 nt, Human
ccuccucagccugaa

SEQ ID NO: 1397587 - RNA, 14 nt, Human
ccuccucagccuga

SEQ ID NO: 1397588 - RNA, 13 nt, Human
ccuccucagccug

SEQ ID NO: 1397589 - RNA, 12 nt, Human
ccuccucagccu

SEQ ID NO: 1397590 - RNA, 15 nt, Human
ccucuagagcagacu

SEQ ID NO: 1397591 - RNA, 14 nt, Human
ccucuagagcagac

SEQ ID NO: 1397592 - RNA, 22 nt, Human
ccucuagagaaauaagaucuuu

SEQ ID NO: 1397593 - RNA, 15 nt, Human
ccucuaacagcacca

SEQ ID NO: 1397594 - RNA, 14 nt, Human
ccucuaacagcacc

SEQ ID NO: 1397595 - RNA, 16 nt, Human
ccucuaacagcaccaa

SEQ ID NO: 1397596 - RNA, 15 nt, Human
ccucguuuguguucu

SEQ ID NO: 1397597 - RNA, 14 nt, Human
ccucguuuguguuc

SEQ ID NO: 1397598 - RNA, 13 nt, Human
ccucguuuguguu

SEQ ID NO: 1397599 - RNA, 16 nt, Human
ccucggggaugugucc

SEQ ID NO: 1397600 - RNA, 13 nt, Human
ccuccuuccuaaa

SEQ ID NO: 1397601 - RNA, 20 nt, Human
ccuccuucccucucuggaga

SEQ ID NO: 1397602 - RNA, 15 nt, Human
ccuccuucccucucu

SEQ ID NO: 1397603 - RNA, 13 nt, Human
ccuccuucccucu

SEQ ID NO: 1397604 - RNA, 21 nt, Human
ccuccugugcucagcccugag

SEQ ID NO: 1397605 - RNA, 19 nt, Human
ccuccugugcucagcccug

SEQ ID NO: 1397606 - RNA, 18 nt, Human
ccuccugugcucagcccu

SEQ ID NO: 1397607 - RNA, 17 nt, Human
ccuccugugcucagccc

SEQ ID NO: 1397608 - RNA, 16 nt, Human
ccuccugugcucagcc

SEQ ID NO: 1397609 - RNA, 15 nt, Human
ccuccugugcucagc

SEQ ID NO: 1397610 - RNA, 14 nt, Human
ccuccugugcucag

SEQ ID NO: 1397611 - RNA, 13 nt, Human
ccuccuuccucuu

SEQ ID NO: 1397612 - RNA, 23 nt, Human
ccuccuuccucuuuuccuuccca

SEQ ID NO: 1397613 - RNA, 18 nt, Human
ccucuccacucaugugac

SEQ ID NO: 1397614 - RNA, 22 nt, Human
ccucuagguccccauacuccua

SEQ ID NO: 1397615 - RNA, 15 nt, Human
ccucuagguccccau

SEQ ID NO: 1397616 - RNA, 22 nt, Human
ccucuagcugugggggugaggg

SEQ ID NO: 1397617 - RNA, 20 nt, Human
ccucucauuuagccuguccu

SEQ ID NO: 1397618 - RNA, 19 nt, Human
ccucucauuuagccugucc

SEQ ID NO: 1397619 - RNA, 18 nt, Human
ccucucauuuagccuguc

SEQ ID NO: 1397620 - RNA, 22 nt, Human
ccucucaauauucaauaaagcu

SEQ ID NO: 1397621 - RNA, 15 nt, Human
ccucucaacacccag

SEQ ID NO: 1397622 - RNA, 18 nt, Human
ccucucaauauucaauaa

SEQ ID NO: 1397623 - RNA, 20 nt, Human
ccucucaauauucaauaaag

SEQ ID NO: 1397624 - RNA, 15 nt, Human
ccugcuccagaccug

SEQ ID NO: 1397625 - RNA, 14 nt, Human
ccugcuccagaccu

SEQ ID NO: 1397626 - RNA, 13 nt, Human
ccugcuccagacc

SEQ ID NO: 1397627 - RNA, 12 nt, Human
ccugcuccagac

SEQ ID NO: 1397628 - RNA, 11 nt, Human
ccugcuccaga

SEQ ID NO: 1397629 - RNA, 17 nt, Human
ccugcucauccacucua

SEQ ID NO: 1397630 - RNA, 13 nt, Human
ccugcucauccac

SEQ ID NO: 1397631 - RNA, 20 nt, Human
ccugcucagcccugcaccau

SEQ ID NO: 1397632 - RNA, 19 nt, Human
ccugcucagcccugcacca

SEQ ID NO: 1397633 - RNA, 16 nt, Human
ccugcucagcccugca

SEQ ID NO: 1397634 - RNA, 19 nt, Human
ccugcucacgucaaaugca

SEQ ID NO: 1397635 - RNA, 19 nt, Human
ccugcucaaucccugagga

SEQ ID NO: 1397636 - RNA, 15 nt, Human
ccugcuauuugaagu

SEQ ID NO: 1397637 - RNA, 19 nt, Human
ccugcuaggccagagccca

SEQ ID NO: 1397638 - RNA, 21 nt, Human
ccugcuaggccagagcccacu

SEQ ID NO: 1397639 - RNA, 18 nt, Human
ccugcuaggccagagccc

SEQ ID NO: 1397640 - RNA, 17 nt, Human
ccugcuaggccagagcc

SEQ ID NO: 1397641 - RNA, 21 nt, Human
ccugcugagcucugagaggcc

SEQ ID NO: 1397642 - RNA, 20 nt, Human
ccugcugagcucugagaggc

SEQ ID NO: 1397643 - RNA, 19 nt, Human
ccugcugagcucugagagg

SEQ ID NO: 1397644 - RNA, 18 nt, Human
ccugcugagcucugagag

SEQ ID NO: 1397645 - RNA, 17 nt, Human
ccugcugagcucugaga

SEQ ID NO: 1397646 - RNA, 16 nt, Human
ccugcugagcucugag

SEQ ID NO: 1397647 - RNA, 15 nt, Human
ccugcugagcucuga

SEQ ID NO: 1397648 - RNA, 14 nt, Human
ccugcugagcucug

SEQ ID NO: 1397649 - RNA, 13 nt, Human
ccugcugagcucu

SEQ ID NO: 1397650 - RNA, 12 nt, Human
ccugcugagcuc

SEQ ID NO: 1397651 - RNA, 11 nt, Human
ccugcugagcu

SEQ ID NO: 1397652 - RNA, 18 nt, Human
ccugcugaccugugcaca

SEQ ID NO: 1397653 - RNA, 16 nt, Human
ccugcugaccugugca

SEQ ID NO: 1397654 - RNA, 15 nt, Human
ccugcugaccugugc

SEQ ID NO: 1397655 - RNA, 14 nt, Human
ccugcugaccugug

SEQ ID NO: 1397656 - RNA, 13 nt, Human
ccugcugaccugu

SEQ ID NO: 1397657 - RNA, 16 nt, Human
ccugcucuccucuucu

SEQ ID NO: 1397658 - RNA, 15 nt, Human
ccugcucuccucuuc

SEQ ID NO: 1397659 - RNA, 12 nt, Human
ccugcucuccuc

SEQ ID NO: 1397660 - RNA, 15 nt, Human
ccugcucgcucccug

SEQ ID NO: 1397661 - RNA, 18 nt, Human
ccugcucguccccaagug

SEQ ID NO: 1397662 - RNA, 18 nt, Human
ccugcuuugggcuugggc

SEQ ID NO: 1397663 - RNA, 22 nt, Human
ccugcugagcucugagaggccc

SEQ ID NO: 1397664 - RNA, 24 nt, Human
ccugcugagcucugagaggcccug

SEQ ID NO: 1397665 - RNA, 19 nt, Human
ccugcugugaaagaaguaa

SEQ ID NO: 1397666 - RNA, 20 nt, Human
ccuggaaggacauccauguu

SEQ ID NO: 1397667 - RNA, 23 nt, Human
ccuggaagcauuuguuucuacuu

SEQ ID NO: 1397668 - RNA, 17 nt, Human
ccuggaagccagcuuuc

SEQ ID NO: 1397669 - RNA, 15 nt, Human
ccuggaagccagcuu

SEQ ID NO: 1397670 - RNA, 17 nt, Human
ccuggaagagcagcccu

SEQ ID NO: 1397671 - RNA, 16 nt, Human
ccuggaagagcagccc

SEQ ID NO: 1397672 - RNA, 17 nt, Human
ccuggaacuuggggagu

SEQ ID NO: 1397673 - RNA, 16 nt, Human
ccuggaacuuggggag

SEQ ID NO: 1397674 - RNA, 13 nt, Human
ccuggaacuuggg

SEQ ID NO: 1397675 - RNA, 20 nt, Human
ccuggaacugucucucauga

SEQ ID NO: 1397676 - RNA, 18 nt, Human
ccuggaacugucucucau

SEQ ID NO: 1397677 - RNA, 23 nt, Human
ccuggaaaucaggguuaguauug

SEQ ID NO: 1397678 - RNA, 20 nt, Human
ccugcuuuuuauggccugug

SEQ ID NO: 1397679 - RNA, 19 nt, Human
ccugccuuggccucccaag

SEQ ID NO: 1397680 - RNA, 19 nt, Human
ccugccuugaaaaagacau

SEQ ID NO: 1397681 - RNA, 22 nt, Human
ccugccuuccuccugggcccuc

SEQ ID NO: 1397682 - RNA, 17 nt, Human
ccugccuuccuccuggg

SEQ ID NO: 1397683 - RNA, 16 nt, Human
ccugccuuccuccugg

SEQ ID NO: 1397684 - RNA, 14 nt, Human
ccugccuuccuccu

SEQ ID NO: 1397685 - RNA, 20 nt, Human
ccugcgccaccgcccagaga

SEQ ID NO: 1397686 - RNA, 15 nt, Human
ccugcgaaaaccccc

SEQ ID NO: 1397687 - RNA, 16 nt, Human
ccugccuuuccaucca

SEQ ID NO: 1397688 - RNA, 13 nt, Human
ccugccuuuccau

SEQ ID NO: 1397689 - RNA, 20 nt, Human
ccugcggcccaauccaaggu

SEQ ID NO: 1397690 - RNA, 23 nt, Human
ccugcgguagaugggagggaggc

SEQ ID NO: 1397691 - RNA, 24 nt, Human
ccugcggguggggcuuggggcuca

SEQ ID NO: 1397692 - RNA, 21 nt, Human
ccugcggguggggcuuggggc

SEQ ID NO: 1397693 - RNA, 20 nt, Human
ccugcggguggggcuugggg

SEQ ID NO: 1397694 - RNA, 24 nt, Human
ccugcgggugaacaaagcagccac

SEQ ID NO: 1397695 - RNA, 23 nt, Human
ccugcgggugaacaaagcagcca

SEQ ID NO: 1397696 - RNA, 13 nt, Human
ccugccggcuccu

SEQ ID NO: 1397697 - RNA, 23 nt, Human
ccugccuggaggaccugagccug

SEQ ID NO: 1397698 - RNA, 16 nt, Human
ccugccuuaucuugca

SEQ ID NO: 1397699 - RNA, 24 nt, Human
ccugccuggaggaccugagccugc

SEQ ID NO: 1397700 - RNA, 22 nt, Human
ccugccuggaggaccugagccu

SEQ ID NO: 1397701 - RNA, 21 nt, Human
ccugccuggaggaccugagcc

SEQ ID NO: 1397702 - RNA, 20 nt, Human
ccugccuggaggaccugagc

SEQ ID NO: 1397703 - RNA, 19 nt, Human
ccugccuggaggaccugag

SEQ ID NO: 1397704 - RNA, 17 nt, Human
ccugccuggaggaccug

SEQ ID NO: 1397705 - RNA, 14 nt, Human
ccugccuggaggac

SEQ ID NO: 1397706 - RNA, 16 nt, Human
ccugccucaccacgga

SEQ ID NO: 1397707 - RNA, 19 nt, Human
ccugccuauuaucugucag

SEQ ID NO: 1397708 - RNA, 13 nt, Human
ccugccuggagga

SEQ ID NO: 1397709 - RNA, 12 nt, Human
ccugccuggagg

SEQ ID NO: 1397710 - RNA, 22 nt, Human
ccugccucaccagcccuggcaa

SEQ ID NO: 1397711 - RNA, 19 nt, Human
ccugguccccuccuuccca

SEQ ID NO: 1397712 - RNA, 19 nt, Human
ccuggcuggcugagggcag

SEQ ID NO: 1397713 - RNA, 18 nt, Human
ccuggcuggcugagggca

SEQ ID NO: 1397714 - RNA, 17 nt, Human
ccuggcuggcugagggc

SEQ ID NO: 1397715 - RNA, 13 nt, Human
ccuggcuggcuga

SEQ ID NO: 1397716 - RNA, 22 nt, Human
ccuggcugcugaucgccuuccc

SEQ ID NO: 1397717 - RNA, 23 nt, Human
ccuggcugcugaucgccuucccc

SEQ ID NO: 1397718 - RNA, 21 nt, Human
ccuggcugcugaucgccuucc

SEQ ID NO: 1397719 - RNA, 20 nt, Human
ccuggcugcugaucgccuuc

SEQ ID NO: 1397720 - RNA, 18 nt, Human
ccuggcugcagccugcgc

SEQ ID NO: 1397721 - RNA, 23 nt, Human
ccuggcagcucuggacagcccca

SEQ ID NO: 1397722 - RNA, 21 nt, Human
ccuggcagcucuggacagccc

SEQ ID NO: 1397723 - RNA, 20 nt, Human
ccuggcagcucuggacagcc

SEQ ID NO: 1397724 - RNA, 19 nt, Human
ccuggcagcucuggacagc

SEQ ID NO: 1397725 - RNA, 17 nt, Human
ccuggcagcucuggaca

SEQ ID NO: 1397726 - RNA, 15 nt, Human
ccuggcagcucugga

SEQ ID NO: 1397727 - RNA, 14 nt, Human
ccuggcagcucugg

SEQ ID NO: 1397728 - RNA, 13 nt, Human
ccuggcagcucug

SEQ ID NO: 1397729 - RNA, 12 nt, Human
ccuggcagcucu

SEQ ID NO: 1397730 - RNA, 23 nt, Human
ccuggccagacacaggcccuccc

SEQ ID NO: 1397731 - RNA, 19 nt, Human
ccuggccagacacaggccc

SEQ ID NO: 1397732 - RNA, 18 nt, Human
ccuggccagacacaggcc

SEQ ID NO: 1397733 - RNA, 16 nt, Human
ccuggccagacacagg

SEQ ID NO: 1397734 - RNA, 15 nt, Human
ccuggccagacacag

SEQ ID NO: 1397735 - RNA, 14 nt, Human
ccuggccagacaca

SEQ ID NO: 1397736 - RNA, 13 nt, Human
ccuggccagacac

SEQ ID NO: 1397737 - RNA, 12 nt, Human
ccuggccagaca

SEQ ID NO: 1397738 - RNA, 19 nt, Human
ccuggcagagaugccuccc

SEQ ID NO: 1397739 - RNA, 12 nt, Human
ccuggcagagau

SEQ ID NO: 1397740 - RNA, 23 nt, Human
ccuggcacuaacguugagccccu

SEQ ID NO: 1397741 - RNA, 19 nt, Human
ccuggagauccuccugcag

SEQ ID NO: 1397742 - RNA, 18 nt, Human
ccuggagauccuccugca

SEQ ID NO: 1397743 - RNA, 17 nt, Human
ccuggagauccuccugc

SEQ ID NO: 1397744 - RNA, 16 nt, Human
ccuggagauccuccug

SEQ ID NO: 1397745 - RNA, 15 nt, Human
ccuggagauccuccu

SEQ ID NO: 1397746 - RNA, 13 nt, Human
ccuggagauccuc

SEQ ID NO: 1397747 - RNA, 23 nt, Human
ccuggagacuuagggcaccaggg

SEQ ID NO: 1397748 - RNA, 19 nt, Human
ccuggagacuuagggcacc

SEQ ID NO: 1397749 - RNA, 18 nt, Human
ccuggagacugcccagcu

SEQ ID NO: 1397750 - RNA, 19 nt, Human
ccuggacagcugugccucg

SEQ ID NO: 1397751 - RNA, 18 nt, Human
ccuggacagcugugccuc

SEQ ID NO: 1397752 - RNA, 17 nt, Human
ccuggacagcugugccu

SEQ ID NO: 1397753 - RNA, 16 nt, Human
ccuggacagcugugcc

SEQ ID NO: 1397754 - RNA, 15 nt, Human
ccuggacagcugugc

SEQ ID NO: 1397755 - RNA, 14 nt, Human
ccuggacagcugug

SEQ ID NO: 1397756 - RNA, 13 nt, Human
ccuggacagcugu

SEQ ID NO: 1397757 - RNA, 17 nt, Human
ccuggacacucagaccu

SEQ ID NO: 1397758 - RNA, 16 nt, Human
ccuggacacucagacc

SEQ ID NO: 1397759 - RNA, 20 nt, Human
ccuggaaugaguugaggcca

SEQ ID NO: 1397760 - RNA, 17 nt, Human
ccuggaagggagguggg

SEQ ID NO: 1397761 - RNA, 22 nt, Human
ccuggaaggacauccauguucc

SEQ ID NO: 1397762 - RNA, 18 nt, Human
ccuggaauauauaaccag

SEQ ID NO: 1397763 - RNA, 15 nt, Human
ccugggugacauuug

SEQ ID NO: 1397764 - RNA, 14 nt, Human
ccugggugacauuu

SEQ ID NO: 1397765 - RNA, 13 nt, Human
ccugggugacauu

SEQ ID NO: 1397766 - RNA, 15 nt, Human
ccugggucccaggac

SEQ ID NO: 1397767 - RNA, 22 nt, Human
ccugggucccaggacccuggac

SEQ ID NO: 1397768 - RNA, 21 nt, Human
ccugggguauaaaacuuuccu

SEQ ID NO: 1397769 - RNA, 14 nt, Human
ccugggggugccag

SEQ ID NO: 1397770 - RNA, 16 nt, Human
ccugggggugccagga

SEQ ID NO: 1397771 - RNA, 15 nt, Human
ccugggggugccagg

SEQ ID NO: 1397772 - RNA, 14 nt, Human
ccugggcaggaggg

SEQ ID NO: 1397773 - RNA, 23 nt, Human
ccuggcuucccauccccagcgau

SEQ ID NO: 1397774 - RNA, 22 nt, Human
ccuggcuucccauccccagcga

SEQ ID NO: 1397775 - RNA, 21 nt, Human
ccuggcuucccauccccagcg

SEQ ID NO: 1397776 - RNA, 20 nt, Human
ccuggcuucccauccccagc

SEQ ID NO: 1397777 - RNA, 19 nt, Human
ccuggcuucccauccccag

SEQ ID NO: 1397778 - RNA, 15 nt, Human
ccuggcuucccaucc

SEQ ID NO: 1397779 - RNA, 16 nt, Human
ccuggcugucugaggc

SEQ ID NO: 1397780 - RNA, 20 nt, Human
ccuggcuggcugagggcagu

SEQ ID NO: 1397781 - RNA, 24 nt, Human
ccuggcugggacguggcucagcca

SEQ ID NO: 1397782 - RNA, 22 nt, Human
ccuggcugggacguggcucagc

SEQ ID NO: 1397783 - RNA, 21 nt, Human
ccuggcugggacguggcucag

SEQ ID NO: 1397784 - RNA, 20 nt, Human
ccuggcugggacguggcuca

SEQ ID NO: 1397785 - RNA, 12 nt, Human
ccugggcaggag

SEQ ID NO: 1397786 - RNA, 18 nt, Human
ccugguagaccacugcca

SEQ ID NO: 1397787 - RNA, 20 nt, Human
ccugguagaccacugccaua

SEQ ID NO: 1397788 - RNA, 20 nt, Human
ccugguacucccucucagga

SEQ ID NO: 1397789 - RNA, 13 nt, Human
ccugguacucccu

SEQ ID NO: 1397790 - RNA, 17 nt, Human
ccugguacccuccuggc

SEQ ID NO: 1397791 - RNA, 15 nt, Human
ccugguacccuccug

SEQ ID NO: 1397792 - RNA, 14 nt, Human
ccugguacccuccu

SEQ ID NO: 1397793 - RNA, 18 nt, Human
ccugguaauagcuguaaa

SEQ ID NO: 1397794 - RNA, 23 nt, Human
ccuggguuuuguauucucugagc

SEQ ID NO: 1397795 - RNA, 22 nt, Human
ccuggguuuuguauucucugag

SEQ ID NO: 1397796 - RNA, 21 nt, Human
ccuggguuuuguauucucuga

SEQ ID NO: 1397797 - RNA, 20 nt, Human
ccuggguuuuguauucucug

SEQ ID NO: 1397798 - RNA, 19 nt, Human
ccuggguuuuguauucucu

SEQ ID NO: 1397799 - RNA, 19 nt, Human
ccuggguuugguguauggu

SEQ ID NO: 1397800 - RNA, 16 nt, Human
ccuggguugcagacag

SEQ ID NO: 1397801 - RNA, 17 nt, Human
ccuggguugcagacagg

SEQ ID NO: 1397802 - RNA, 23 nt, Human
ccuggguggcuacucugugccag

SEQ ID NO: 1397803 - RNA, 22 nt, Human
ccuggguggcuacucugugcca

SEQ ID NO: 1397804 - RNA, 21 nt, Human
ccuggguggcuacucugugcc

SEQ ID NO: 1397805 - RNA, 20 nt, Human
ccuggguggcuacucugugc

SEQ ID NO: 1397806 - RNA, 19 nt, Human
ccuggguggcuacucugug

SEQ ID NO: 1397807 - RNA, 17 nt, Human
ccuggguggcuacucug

SEQ ID NO: 1397808 - RNA, 15 nt, Human
ccuggguggcuacuc

SEQ ID NO: 1397809 - RNA, 14 nt, Human
ccuggguggcuacu

SEQ ID NO: 1397810 - RNA, 20 nt, Human
ccugguauauccaaaagcuu

SEQ ID NO: 1397811 - RNA, 18 nt, Human
ccugguauauccaaaagc

SEQ ID NO: 1397812 - RNA, 21 nt, Human
ccuggucaccuaggaagccuc

SEQ ID NO: 1397813 - RNA, 17 nt, Human
ccuggucaccuaggaag

SEQ ID NO: 1397814 - RNA, 15 nt, Human
ccuggucaccuagga

SEQ ID NO: 1397815 - RNA, 18 nt, Human
ccugguccccuccuuccc

SEQ ID NO: 1397816 - RNA, 23 nt, Human
ccuggugacaucagguuuuuccc

SEQ ID NO: 1397817 - RNA, 15 nt, Human
ccugguccccuccuu

SEQ ID NO: 1397818 - RNA, 13 nt, Human
ccugguccccucc

SEQ ID NO: 1397819 - RNA, 13 nt, Human
ccuggugccaccu

SEQ ID NO: 1397820 - RNA, 17 nt, Human
ccuggugcacuggcccc

SEQ ID NO: 1397821 - RNA, 19 nt, Human
ccuggugcacuggccccac

SEQ ID NO: 1397822 - RNA, 12 nt, Human
ccuggugccacc

SEQ ID NO: 1397823 - RNA, 14 nt, Human
ccuggugaucacgu

SEQ ID NO: 1397824 - RNA, 20 nt, Human
ccuggugcacuggccccacc

SEQ ID NO: 1397825 - RNA, 17 nt, Human
ccugacacaccaggcgc

SEQ ID NO: 1397826 - RNA, 15 nt, Human
ccugacacaccaggc

SEQ ID NO: 1397827 - RNA, 14 nt, Human
ccugacacaccagg

SEQ ID NO: 1397828 - RNA, 19 nt, Human
ccugacaaccacuggucug

SEQ ID NO: 1397829 - RNA, 18 nt, Human
ccugacaaccacuggucu

SEQ ID NO: 1397830 - RNA, 23 nt, Human
ccucuccacacagugcucaaggc

SEQ ID NO: 1397831 - RNA, 18 nt, Human
ccucuccacacagugcuc

SEQ ID NO: 1397832 - RNA, 17 nt, Human
ccucuccacacagugcu

SEQ ID NO: 1397833 - RNA, 13 nt, Human
ccucuccacacag

SEQ ID NO: 1397834 - RNA, 21 nt, Human
ccugacaucaaaaaaggcagu

SEQ ID NO: 1397835 - RNA, 19 nt, Human
ccugacaucaaaaaaggca

SEQ ID NO: 1397836 - RNA, 18 nt, Human
ccugacaucaaaaaaggc

SEQ ID NO: 1397837 - RNA, 23 nt, Human
ccugacaggugaggucuguuccu

SEQ ID NO: 1397838 - RNA, 22 nt, Human
ccugacaggugaggucuguucc

SEQ ID NO: 1397839 - RNA, 23 nt, Human
ccugaccaaacagccaacuagcc

SEQ ID NO: 1397840 - RNA, 23 nt, Human
ccugagcaacucuugauuaucca

SEQ ID NO: 1397841 - RNA, 18 nt, Human
ccugagcaacucuugauu

SEQ ID NO: 1397842 - RNA, 15 nt, Human
ccugagcaacucuug

SEQ ID NO: 1397843 - RNA, 14 nt, Human
ccugagcaacucuu

SEQ ID NO: 1397844 - RNA, 13 nt, Human
ccugagcaacucu

SEQ ID NO: 1397845 - RNA, 17 nt, Human
ccugacauguccuucug

SEQ ID NO: 1397846 - RNA, 12 nt, Human
ccugacacugca

SEQ ID NO: 1397847 - RNA, 13 nt, Human
ccugacacucccu

SEQ ID NO: 1397848 - RNA, 23 nt, Human
ccugacacccuucucccacucuc

SEQ ID NO: 1397849 - RNA, 18 nt, Human
ccugacacccuucuccca

SEQ ID NO: 1397850 - RNA, 14 nt, Human
ccugacacccuucu

SEQ ID NO: 1397851 - RNA, 13 nt, Human
ccugacacccuuc

SEQ ID NO: 1397852 - RNA, 20 nt, Human
ccugacacacuaaccaagcu

SEQ ID NO: 1397853 - RNA, 23 nt, Human
ccugacacacuaaccaagcugag

SEQ ID NO: 1397854 - RNA, 14 nt, Human
ccugacacacuaac

SEQ ID NO: 1397855 - RNA, 18 nt, Human
ccugacacaccaggcgcu

SEQ ID NO: 1397856 - RNA, 15 nt, Human
ccugacacuuuaauu

SEQ ID NO: 1397857 - RNA, 14 nt, Human
ccugacacuuuaau

SEQ ID NO: 1397858 - RNA, 13 nt, Human
ccugacacuuuaa

SEQ ID NO: 1397859 - RNA, 15 nt, Human
ccugacacugcugga

SEQ ID NO: 1397860 - RNA, 14 nt, Human
ccugacacugcugg

SEQ ID NO: 1397861 - RNA, 19 nt, Human
ccugaggacagaugccucc

SEQ ID NO: 1397862 - RNA, 13 nt, Human
ccugaggaacugu

SEQ ID NO: 1397863 - RNA, 18 nt, Human
ccugaggaacccuuacag

SEQ ID NO: 1397864 - RNA, 16 nt, Human
ccugagccccagggag

SEQ ID NO: 1397865 - RNA, 22 nt, Human
ccugaggagucugagguccuga

SEQ ID NO: 1397866 - RNA, 20 nt, Human
ccugaggagucugagguccu

SEQ ID NO: 1397867 - RNA, 19 nt, Human
ccugaggagucugaggucc

SEQ ID NO: 1397868 - RNA, 18 nt, Human
ccugaggagucugagguc

SEQ ID NO: 1397869 - RNA, 17 nt, Human
ccugaggagucugaggu

SEQ ID NO: 1397870 - RNA, 16 nt, Human
ccugaggagucugagg

SEQ ID NO: 1397871 - RNA, 14 nt, Human
ccugaggagucuga

SEQ ID NO: 1397872 - RNA, 13 nt, Human
ccugaggagucug

SEQ ID NO: 1397873 - RNA, 23 nt, Human
ccugaggacugauuucagaguga

SEQ ID NO: 1397874 - RNA, 19 nt, Human
ccugaggacugauuucaga

SEQ ID NO: 1397875 - RNA, 21 nt, Human
ccugaggagucugagguccug

SEQ ID NO: 1397876 - RNA, 14 nt, Human
ccugagcccaggga

SEQ ID NO: 1397877 - RNA, 13 nt, Human
ccugagcccaggg

SEQ ID NO: 1397878 - RNA, 12 nt, Human
ccugagcccagg

SEQ ID NO: 1397879 - RNA, 21 nt, Human
ccugagccagggucuccagaa

SEQ ID NO: 1397880 - RNA, 17 nt, Human
ccugagccccagggaga

SEQ ID NO: 1397881 - RNA, 15 nt, Human
ccugagccccaggga

SEQ ID NO: 1397882 - RNA, 19 nt, Human
ccugagcccagggaggccg

SEQ ID NO: 1397883 - RNA, 18 nt, Human
ccugagcccagggaggcc

SEQ ID NO: 1397884 - RNA, 17 nt, Human
ccugagcccagggaggc

SEQ ID NO: 1397885 - RNA, 16 nt, Human
ccugagcccagggagg

SEQ ID NO: 1397886 - RNA, 15 nt, Human
ccugagcccagggag

SEQ ID NO: 1397887 - RNA, 22 nt, Human
ccugagcaguccuuggccugcu

SEQ ID NO: 1397888 - RNA, 19 nt, Human
ccugagcaguccuuggccu

SEQ ID NO: 1397889 - RNA, 18 nt, Human
ccugagcaguccuuggcc

SEQ ID NO: 1397890 - RNA, 14 nt, Human
ccugagcaguccuu

SEQ ID NO: 1397891 - RNA, 20 nt, Human
ccugagcacugccaggaggg

SEQ ID NO: 1397892 - RNA, 19 nt, Human
ccugagcacugccaggagg

SEQ ID NO: 1397893 - RNA, 18 nt, Human
ccugagcacugccaggag

SEQ ID NO: 1397894 - RNA, 17 nt, Human
ccugagcacugccagga

SEQ ID NO: 1397895 - RNA, 16 nt, Human
ccugagcacugccagg

SEQ ID NO: 1397896 - RNA, 15 nt, Human
ccugagcacugccag

SEQ ID NO: 1397897 - RNA, 14 nt, Human
ccugagcacugcca

SEQ ID NO: 1397898 - RNA, 12 nt, Human
ccugagcacugc

SEQ ID NO: 1397899 - RNA, 23 nt, Human
ccugagccagggucuccagaaag

SEQ ID NO: 1397900 - RNA, 20 nt, Human
ccugagccagggucuccaga

SEQ ID NO: 1397901 - RNA, 19 nt, Human
ccugagccagggucuccag

SEQ ID NO: 1397902 - RNA, 18 nt, Human
ccugagccagggucucca

SEQ ID NO: 1397903 - RNA, 15 nt, Human
ccugagccagggucu

SEQ ID NO: 1397904 - RNA, 13 nt, Human
ccugagccagggu

SEQ ID NO: 1397905 - RNA, 23 nt, Human
ccugcauggcauccuccagcccc

SEQ ID NO: 1397906 - RNA, 16 nt, Human
ccugcauggcugagcu

SEQ ID NO: 1397907 - RNA, 21 nt, Human
ccugcauggcugagcugccca

SEQ ID NO: 1397908 - RNA, 21 nt, Human
ccugcauggcauccuccagcc

SEQ ID NO: 1397909 - RNA, 20 nt, Human
ccugcauggcauccuccagc

SEQ ID NO: 1397910 - RNA, 19 nt, Human
ccugcauggcauccuccag

SEQ ID NO: 1397911 - RNA, 18 nt, Human
ccugcauggcauccucca

SEQ ID NO: 1397912 - RNA, 16 nt, Human
ccugcauggcauccuc

SEQ ID NO: 1397913 - RNA, 15 nt, Human
ccugcauggcauccu

SEQ ID NO: 1397914 - RNA, 23 nt, Human
ccugcauccauucuccugaggau

SEQ ID NO: 1397915 - RNA, 22 nt, Human
ccugcauccauucuccugagga

SEQ ID NO: 1397916 - RNA, 22 nt, Human
ccugcauaauguuucuggauuu

SEQ ID NO: 1397917 - RNA, 22 nt, Human
ccugcauggcauccuccagccc

SEQ ID NO: 1397918 - RNA, 23 nt, Human
ccugccagcugcacugaugcugc

SEQ ID NO: 1397919 - RNA, 18 nt, Human
ccugccagcugcacugau

SEQ ID NO: 1397920 - RNA, 17 nt, Human
ccugccagcugcacuga

SEQ ID NO: 1397921 - RNA, 16 nt, Human
ccugccagcugcacug

SEQ ID NO: 1397922 - RNA, 14 nt, Human
ccugccagcugcac

SEQ ID NO: 1397923 - RNA, 13 nt, Human
ccugccagcugca

SEQ ID NO: 1397924 - RNA, 12 nt, Human
ccugccagcugc

SEQ ID NO: 1397925 - RNA, 16 nt, Human
ccugccagccccugcc

SEQ ID NO: 1397926 - RNA, 13 nt, Human
ccugccagccccu

SEQ ID NO: 1397927 - RNA, 19 nt, Human
ccugcccccaccccauucc

SEQ ID NO: 1397928 - RNA, 18 nt, Human
ccugcccccaccccauuc

SEQ ID NO: 1397929 - RNA, 14 nt, Human
ccugcccccacccc

SEQ ID NO: 1397930 - RNA, 13 nt, Human
ccugcccccaccc

SEQ ID NO: 1397931 - RNA, 12 nt, Human
ccugccaggagg

SEQ ID NO: 1397932 - RNA, 13 nt, Human
ccugccaggagga

SEQ ID NO: 1397933 - RNA, 21 nt, Human
ccugccaggagcuuuggaccu

SEQ ID NO: 1397934 - RNA, 11 nt, Human
ccugccaggag

SEQ ID NO: 1397935 - RNA, 14 nt, Human
ccugccagccccug

SEQ ID NO: 1397936 - RNA, 19 nt, Human
ccugcaaaaggacucucag

SEQ ID NO: 1397937 - RNA, 17 nt, Human
ccugcaaaaggacucuc

SEQ ID NO: 1397938 - RNA, 22 nt, Human
ccugauuuuuuuuccuuuuaau

SEQ ID NO: 1397939 - RNA, 17 nt, Human
ccugcacuaacagagug

SEQ ID NO: 1397940 - RNA, 15 nt, Human
ccugcagucacagcu

SEQ ID NO: 1397941 - RNA, 20 nt, Human
ccugcaacucaaggacuuug

SEQ ID NO: 1397942 - RNA, 18 nt, Human
ccugcaacucaaggacuu

SEQ ID NO: 1397943 - RNA, 17 nt, Human
ccugcaacucaaggacu

SEQ ID NO: 1397944 - RNA, 17 nt, Human
ccugcaagucaguccag

SEQ ID NO: 1397945 - RNA, 21 nt, Human
ccuguguguccaaaacugccu

SEQ ID NO: 1397946 - RNA, 20 nt, Human
ccuguguguccaaaacugcc

SEQ ID NO: 1397947 - RNA, 22 nt, Human
ccuguguggagagggaauguga

SEQ ID NO: 1397948 - RNA, 21 nt, Human
ccuguguggagagggaaugug

SEQ ID NO: 1397949 - RNA, 23 nt, Human
ccuguguggagagggaaugugaa

SEQ ID NO: 1397950 - RNA, 19 nt, Human
ccuguguggagagggaaug

SEQ ID NO: 1397951 - RNA, 16 nt, Human
ccuguguggagaggga

SEQ ID NO: 1397952 - RNA, 15 nt, Human
ccuguguggagaggg

SEQ ID NO: 1397953 - RNA, 14 nt, Human
ccuguguggagagg

SEQ ID NO: 1397954 - RNA, 13 nt, Human
ccuguguggagag

SEQ ID NO: 1397955 - RNA, 12 nt, Human
ccuguguggaga

SEQ ID NO: 1397956 - RNA, 17 nt, Human
ccuguguggacaggacu

SEQ ID NO: 1397957 - RNA, 15 nt, Human
ccuguguggacagga

SEQ ID NO: 1397958 - RNA, 14 nt, Human
ccuguguggacagg

SEQ ID NO: 1397959 - RNA, 13 nt, Human
ccuguguccaugc

SEQ ID NO: 1397960 - RNA, 22 nt, Human
ccuguguagcugugaccugcug

SEQ ID NO: 1397961 - RNA, 21 nt, Human
ccuguguagcugugaccugcu

SEQ ID NO: 1397962 - RNA, 20 nt, Human
ccuguguagcugugaccugc

SEQ ID NO: 1397963 - RNA, 23 nt, Human
ccuguguagcugugaccugcuga

SEQ ID NO: 1397964 - RNA, 19 nt, Human
ccuguguagcugugaccug

SEQ ID NO: 1397965 - RNA, 17 nt, Human
ccuguguagcugugacc

SEQ ID NO: 1397966 - RNA, 15 nt, Human
ccuguguagcuguga

SEQ ID NO: 1397967 - RNA, 14 nt, Human
ccuguguagcugug

SEQ ID NO: 1397968 - RNA, 13 nt, Human
ccuguguagcugu

SEQ ID NO: 1397969 - RNA, 19 nt, Human
ccuguguccaugcgcucag

SEQ ID NO: 1397970 - RNA, 13 nt, Human
ccuguuuuccccc

SEQ ID NO: 1397971 - RNA, 23 nt, Human
ccuguuuucccacgaggaaucug

SEQ ID NO: 1397972 - RNA, 20 nt, Human
ccuguuuggccucucuaucc

SEQ ID NO: 1397973 - RNA, 21 nt, Human
ccuguuuggccucucuauccu

SEQ ID NO: 1397974 - RNA, 16 nt, Human
ccuguuuggccucucu

SEQ ID NO: 1397975 - RNA, 15 nt, Human
ccuguuuggccucuc

SEQ ID NO: 1397976 - RNA, 19 nt, Human
ccuguuugaggaaagcaag

SEQ ID NO: 1397977 - RNA, 16 nt, Human
ccuguuuaaaaaacca

SEQ ID NO: 1397978 - RNA, 14 nt, Human
ccuguuuaaaaaac

SEQ ID NO: 1397979 - RNA, 18 nt, Human
ccuguuucagaggcucag

SEQ ID NO: 1397980 - RNA, 12 nt, Human
ccuguuucuucc

SEQ ID NO: 1397981 - RNA, 14 nt, Human
ccuguuucuggcac

SEQ ID NO: 1397982 - RNA, 15 nt, Human
ccuguuucccaggcc

SEQ ID NO: 1397983 - RNA, 17 nt, Human
ccuguuucccaggccca

SEQ ID NO: 1397984 - RNA, 19 nt, Human
ccuguguuucuugccucau

SEQ ID NO: 1397985 - RNA, 22 nt, Human
ccuguguugucucuagagcagg

SEQ ID NO: 1397986 - RNA, 20 nt, Human
ccuguguugucucuagagca

SEQ ID NO: 1397987 - RNA, 16 nt, Human
ccuguguugucucuag

SEQ ID NO: 1397988 - RNA, 20 nt, Human
ccuguguucuuccuggccgc

SEQ ID NO: 1397989 - RNA, 19 nt, Human
ccuguguucuuccuggccg

SEQ ID NO: 1397990 - RNA, 17 nt, Human
ccuguguguuaagcucu

SEQ ID NO: 1397991 - RNA, 20 nt, Human
ccuguguguuaagcucugcu

SEQ ID NO: 1397992 - RNA, 16 nt, Human
ccuguguguuaagcuc

SEQ ID NO: 1397993 - RNA, 18 nt, Human
ccuguguuucuugccuca

SEQ ID NO: 1397994 - RNA, 14 nt, Human
ccuguguuucuugc

SEQ ID NO: 1397995 - RNA, 12 nt, Human
ccuguuuaagag

SEQ ID NO: 1397996 - RNA, 15 nt, Human
ccuguuuaagagaca

SEQ ID NO: 1397997 - RNA, 21 nt, Human
ccuuagacagaggcccucaag

SEQ ID NO: 1397998 - RNA, 20 nt, Human
ccuuagacagaggcccucaa

SEQ ID NO: 1397999 - RNA, 17 nt, Human
ccuuagacagaggcccu

SEQ ID NO: 1398000 - RNA, 15 nt, Human
ccuuagacagaggcc

SEQ ID NO: 1398001 - RNA, 22 nt, Human
ccuuacuccugugggagccucg

SEQ ID NO: 1398002 - RNA, 22 nt, Human
ccuuacucuucuugaaauuuua

SEQ ID NO: 1398003 - RNA, 17 nt, Human
ccuuacucuucuugaaa

SEQ ID NO: 1398004 - RNA, 16 nt, Human
ccuuacucuucuugaa

SEQ ID NO: 1398005 - RNA, 21 nt, Human
ccuuacuccugugggagccuc

SEQ ID NO: 1398006 - RNA, 20 nt, Human
ccuuacuccugugggagccu

SEQ ID NO: 1398007 - RNA, 19 nt, Human
ccuuacuccugugggagcc

SEQ ID NO: 1398008 - RNA, 15 nt, Human
ccuuacuccuguggg

SEQ ID NO: 1398009 - RNA, 14 nt, Human
ccuuacuccugugg

SEQ ID NO: 1398010 - RNA, 13 nt, Human
ccuuacuccugug

SEQ ID NO: 1398011 - RNA, 12 nt, Human
ccuuacuccugu

SEQ ID NO: 1398012 - RNA, 16 nt, Human
ccuuacucccaggcac

SEQ ID NO: 1398013 - RNA, 14 nt, Human
ccuuaccuuuuuau

SEQ ID NO: 1398014 - RNA, 19 nt, Human
ccuuacccucauguucuua

SEQ ID NO: 1398015 - RNA, 15 nt, Human
ccuuacccucauguu

SEQ ID NO: 1398016 - RNA, 21 nt, Human
ccuuacaguaggagcccagcu

SEQ ID NO: 1398017 - RNA, 17 nt, Human
ccuuacaguaggagccc

SEQ ID NO: 1398018 - RNA, 22 nt, Human
ccuuacaaguuagaaaacauaa

SEQ ID NO: 1398019 - RNA, 20 nt, Human
ccuguuuuucacauuuuccu

SEQ ID NO: 1398020 - RNA, 16 nt, Human
ccuguuuuucacauuu

SEQ ID NO: 1398021 - RNA, 13 nt, Human
ccuguuuuucaca

SEQ ID NO: 1398022 - RNA, 20 nt, Human
ccuuaaacaaaaauuaaaau

SEQ ID NO: 1398023 - RNA, 17 nt, Human
ccuuaacaguuguauuu

SEQ ID NO: 1398024 - RNA, 16 nt, Human
ccuuaacaguuguauu

SEQ ID NO: 1398025 - RNA, 14 nt, Human
ccuuaaaggggaga

SEQ ID NO: 1398026 - RNA, 16 nt, Human
ccuuaauuuauuauua

SEQ ID NO: 1398027 - RNA, 23 nt, Human
ccuuaaucagguccucagagaau

SEQ ID NO: 1398028 - RNA, 12 nt, Human
ccuuaagucaga

SEQ ID NO: 1398029 - RNA, 18 nt, Human
ccuuaaggcucuuuugua

SEQ ID NO: 1398030 - RNA, 16 nt, Human
ccuuaaggcucuuuug

SEQ ID NO: 1398031 - RNA, 23 nt, Human
ccuuaagaccuacuguucuaaag

SEQ ID NO: 1398032 - RNA, 13 nt, Human
ccuuaaggcucuu

SEQ ID NO: 1398033 - RNA, 16 nt, Human
ccuuaacugcauccag

SEQ ID NO: 1398034 - RNA, 14 nt, Human
ccuuaacuggagcc

SEQ ID NO: 1398035 - RNA, 17 nt, Human
ccuuaacuggagcccca

SEQ ID NO: 1398036 - RNA, 23 nt, Human
ccuuaacuggagccccaucagcu

SEQ ID NO: 1398037 - RNA, 22 nt, Human
ccuuaagaccuacuguucuaaa

SEQ ID NO: 1398038 - RNA, 17 nt, Human
ccuuaagagucauccag

SEQ ID NO: 1398039 - RNA, 18 nt, Human
ccuucgcuucuugccucu

SEQ ID NO: 1398040 - RNA, 17 nt, Human
ccuucgcuucuugccuc

SEQ ID NO: 1398041 - RNA, 16 nt, Human
ccuucgcuucuugccu

SEQ ID NO: 1398042 - RNA, 23 nt, Human
ccuucgcuucuugccucugugcu

SEQ ID NO: 1398043 - RNA, 21 nt, Human
ccuucgcuucuugccucugug

SEQ ID NO: 1398044 - RNA, 20 nt, Human
ccuucgcuucuugccucugu

SEQ ID NO: 1398045 - RNA, 19 nt, Human
ccuucgcuucuugccucug

SEQ ID NO: 1398046 - RNA, 22 nt, Human
ccuuagacagaggcccucaagu

SEQ ID NO: 1398047 - RNA, 19 nt, Human
ccuucacugucaccacccu

SEQ ID NO: 1398048 - RNA, 23 nt, Human
ccuucagagagcagugcuuuugg

SEQ ID NO: 1398049 - RNA, 22 nt, Human
ccuucagagagcagugcuuuug

SEQ ID NO: 1398050 - RNA, 20 nt, Human
ccuucagagagcagugcuuu

SEQ ID NO: 1398051 - RNA, 19 nt, Human
ccuucagagagcagugcuu

SEQ ID NO: 1398052 - RNA, 16 nt, Human
ccuucagagagcagug

SEQ ID NO: 1398053 - RNA, 15 nt, Human
ccuucagagagcagu

SEQ ID NO: 1398054 - RNA, 13 nt, Human
ccuucagagagca

SEQ ID NO: 1398055 - RNA, 20 nt, Human
ccuucagcacuuuagaauau

SEQ ID NO: 1398056 - RNA, 14 nt, Human
ccuucgggcugugc

SEQ ID NO: 1398057 - RNA, 18 nt, Human
ccuucuauacccacccag

SEQ ID NO: 1398058 - RNA, 20 nt, Human
ccuucuauacccacccagaa

SEQ ID NO: 1398059 - RNA, 19 nt, Human
ccuucuauacccacccaga

SEQ ID NO: 1398060 - RNA, 17 nt, Human
ccuugagggcaagagcc

SEQ ID NO: 1398061 - RNA, 19 nt, Human
ccuugaguaguuuuuaucu

SEQ ID NO: 1398062 - RNA, 14 nt, Human
ccuugaggucucag

SEQ ID NO: 1398063 - RNA, 17 nt, Human
ccuugaggucucagccc

SEQ ID NO: 1398064 - RNA, 18 nt, Human
ccuugaaggacuaauaga

SEQ ID NO: 1398065 - RNA, 16 nt, Human
ccuugaaggagaauca

SEQ ID NO: 1398066 - RNA, 13 nt, Human
ccuugaaggacua

SEQ ID NO: 1398067 - RNA, 23 nt, Human
ccuugaagaacugcaggcccugg

SEQ ID NO: 1398068 - RNA, 22 nt, Human
ccuugaagaacugcaggcccug

SEQ ID NO: 1398069 - RNA, 21 nt, Human
ccuugaagaacugcaggcccu

SEQ ID NO: 1398070 - RNA, 18 nt, Human
ccuugaagaacugcaggc

SEQ ID NO: 1398071 - RNA, 21 nt, Human
ccuugaaaauaagaauagaaa

SEQ ID NO: 1398072 - RNA, 13 nt, Human
ccuugaacuagga

SEQ ID NO: 1398073 - RNA, 22 nt, Human
ccuugauuuuagccuucucugu

SEQ ID NO: 1398074 - RNA, 21 nt, Human
ccuugauuuuagccuucucug

SEQ ID NO: 1398075 - RNA, 20 nt, Human
ccuugauuuuagccuucucu

SEQ ID NO: 1398076 - RNA, 21 nt, Human
ccuugauuuaucacacaaagc

SEQ ID NO: 1398077 - RNA, 20 nt, Human
ccuugaguaguuuuuaucug

SEQ ID NO: 1398078 - RNA, 19 nt, Human
ccuugauggagauauuuac

SEQ ID NO: 1398079 - RNA, 23 nt, Human
ccuugaugauugacaacacccau

SEQ ID NO: 1398080 - RNA, 23 nt, Human
ccuugagugggguuaucucugug

SEQ ID NO: 1398081 - RNA, 22 nt, Human
ccuugagugggguuaucucugu

SEQ ID NO: 1398082 - RNA, 14 nt, Human
ccuugagugggguu

SEQ ID NO: 1398083 - RNA, 22 nt, Human
ccuugggccagaaguaccagac

SEQ ID NO: 1398084 - RNA, 22 nt, Human
ccuuggguuagaccuacagggg

SEQ ID NO: 1398085 - RNA, 23 nt, Human
ccuugggccagaaguaccagacu

SEQ ID NO: 1398086 - RNA, 22 nt, Human
ccuuggggauucuuccaucuga

SEQ ID NO: 1398087 - RNA, 18 nt, Human
ccuuggggauucuuccau

SEQ ID NO: 1398088 - RNA, 17 nt, Human
ccuugggcccuuugagu

SEQ ID NO: 1398089 - RNA, 14 nt, Human
ccuugggcccuuug

SEQ ID NO: 1398090 - RNA, 12 nt, Human
ccuugggcccuu

SEQ ID NO: 1398091 - RNA, 23 nt, Human
ccuugggcccacaccuccuuccc

SEQ ID NO: 1398092 - RNA, 20 nt, Human
ccuuggguuagaccuacagg

SEQ ID NO: 1398093 - RNA, 18 nt, Human
ccuuggguuagaccuaca

SEQ ID NO: 1398094 - RNA, 21 nt, Human
ccuuggggguccuccuccagg

SEQ ID NO: 1398095 - RNA, 22 nt, Human
ccuuggggguccuccuccaggg

SEQ ID NO: 1398096 - RNA, 20 nt, Human
ccuuggggguccuccuccag

SEQ ID NO: 1398097 - RNA, 11 nt, Human
ccuuggggguc

SEQ ID NO: 1398098 - RNA, 19 nt, Human
ccuuggggcugaugcaguu

SEQ ID NO: 1398099 - RNA, 18 nt, Human
ccuuucuaucguucucuc

SEQ ID NO: 1398100 - RNA, 14 nt, Human
ccuuucuaguugaa

SEQ ID NO: 1398101 - RNA, 15 nt, Human
ccuuucuaguugaaa

SEQ ID NO: 1398102 - RNA, 15 nt, Human
ccuuucuagccuggc

SEQ ID NO: 1398103 - RNA, 19 nt, Human
ccuuucuagagcacugcca

SEQ ID NO: 1398104 - RNA, 14 nt, Human
ccuuucuagagcac

SEQ ID NO: 1398105 - RNA, 21 nt, Human
ccuuucggauccagggaggcu

SEQ ID NO: 1398106 - RNA, 17 nt, Human
ccuuucggauccaggga

SEQ ID NO: 1398107 - RNA, 16 nt, Human
ccuuugaccugccucc

SEQ ID NO: 1398108 - RNA, 14 nt, Human
ccuuguccuuuccc

SEQ ID NO: 1398109 - RNA, 16 nt, Human
ccuugucacugguaga

SEQ ID NO: 1398110 - RNA, 18 nt, Human
ccuugucacgccagacuu

SEQ ID NO: 1398111 - RNA, 15 nt, Human
ccuugucacgccaga

SEQ ID NO: 1398112 - RNA, 11 nt, Human
ccuuguucugu

SEQ ID NO: 1398113 - RNA, 21 nt, Human
ccuuguucugauaaugaaaau

SEQ ID NO: 1398114 - RNA, 19 nt, Human
ccuuguuacuucugaggua

SEQ ID NO: 1398115 - RNA, 18 nt, Human
ccuuguuacuucugaggu

SEQ ID NO: 1398116 - RNA, 16 nt, Human
ccuuguuacuucugag

SEQ ID NO: 1398117 - RNA, 19 nt, Human
ccuuguuuacacauacccu

SEQ ID NO: 1398118 - RNA, 17 nt, Human
ccuuguuguuucuugcc

SEQ ID NO: 1398119 - RNA, 21 nt, Human
ccuuguuucucuuccuuucuu

SEQ ID NO: 1398120 - RNA, 15 nt, Human
cgcaccauucugacu

SEQ ID NO: 1398121 - RNA, 14 nt, Human
cgcaccauucugac

SEQ ID NO: 1398122 - RNA, 22 nt, Human
cgcaacccgugccaaguccagg

SEQ ID NO: 1398123 - RNA, 19 nt, Human
cgcaacccgugccaagucc

SEQ ID NO: 1398124 - RNA, 14 nt, Human
cgcaacccgugcca

SEQ ID NO: 1398125 - RNA, 13 nt, Human
cgcaacccgugcc

SEQ ID NO: 1398126 - RNA, 17 nt, Human
cgauucccucucccagg

SEQ ID NO: 1398127 - RNA, 11 nt, Human
cgauuagacug

SEQ ID NO: 1398128 - RNA, 14 nt, Human
cgauuugucccagg

SEQ ID NO: 1398129 - RNA, 18 nt, Human
cgauucccucucccaggc

SEQ ID NO: 1398130 - RNA, 20 nt, Human
cgauuucuguuuagauaaua

SEQ ID NO: 1398131 - RNA, 18 nt, Human
cgauuagacuggacagcu

SEQ ID NO: 1398132 - RNA, 19 nt, Human
cgauguggucacagcugua

SEQ ID NO: 1398133 - RNA, 18 nt, Human
cgauguggucacagcugu

SEQ ID NO: 1398134 - RNA, 16 nt, Human
cgauucacccugucca

SEQ ID NO: 1398135 - RNA, 21 nt, Human
cgauucacccuguccaaacug

SEQ ID NO: 1398136 - RNA, 17 nt, Human
cgauguggucacagcug

SEQ ID NO: 1398137 - RNA, 21 nt, Human
cgauguggaacugcugccacu

SEQ ID NO: 1398138 - RNA, 20 nt, Human
cgauguggaacugcugccac

SEQ ID NO: 1398139 - RNA, 19 nt, Human
cgauguggaacugcugcca

SEQ ID NO: 1398140 - RNA, 15 nt, Human
cgauguggaacugcu

SEQ ID NO: 1398141 - RNA, 15 nt, Human
cgagcaugucgugga

SEQ ID NO: 1398142 - RNA, 23 nt, Human
cgccaggcugaccacagcacagc

SEQ ID NO: 1398143 - RNA, 21 nt, Human
cgccaggcugaccacagcaca

SEQ ID NO: 1398144 - RNA, 20 nt, Human
cgccaggcugaccacagcac

SEQ ID NO: 1398145 - RNA, 17 nt, Human
cgccaggcugaccacag

SEQ ID NO: 1398146 - RNA, 16 nt, Human
cgccaggcugaccaca

SEQ ID NO: 1398147 - RNA, 23 nt, Human
cgccaggauggaacacggccaca

SEQ ID NO: 1398148 - RNA, 17 nt, Human
cgcaccccccaagcugu

SEQ ID NO: 1398149 - RNA, 22 nt, Human
cgcagccacccugaggagucug

SEQ ID NO: 1398150 - RNA, 17 nt, Human
cgcagccacccugagga

SEQ ID NO: 1398151 - RNA, 16 nt, Human
cgcagccacccugagg

SEQ ID NO: 1398152 - RNA, 14 nt, Human
cgcagccacccuga

SEQ ID NO: 1398153 - RNA, 13 nt, Human
cgcagccacccug

SEQ ID NO: 1398154 - RNA, 12 nt, Human
cgcagccacccu

SEQ ID NO: 1398155 - RNA, 11 nt, Human
cgcagccaccc

SEQ ID NO: 1398156 - RNA, 18 nt, Human
cgaaagcucuagaaucug

SEQ ID NO: 1398157 - RNA, 14 nt, Human
cgaaagcucuagaa

SEQ ID NO: 1398158 - RNA, 13 nt, Human
cgaaagcucuaga

SEQ ID NO: 1398159 - RNA, 13 nt, Human
cgaagacacagac

SEQ ID NO: 1398160 - RNA, 15 nt, Human
cgaacuccuugauuu

SEQ ID NO: 1398161 - RNA, 17 nt, Human
cgaaacacagaaaccuu

SEQ ID NO: 1398162 - RNA, 13 nt, Human
cgaaaaucaaaug

SEQ ID NO: 1398163 - RNA, 22 nt, Human
cgaaaaucauauaaucuuacaa

SEQ ID NO: 1398164 - RNA, 19 nt, Human
cgaaaacccccaaaccaga

SEQ ID NO: 1398165 - RNA, 10 nt, Human
ccuuuucaua

SEQ ID NO: 1398166 - RNA, 18 nt, Human
ccuuuuuuuccaucuuua

SEQ ID NO: 1398167 - RNA, 15 nt, Human
ccuuuuauugacaca

SEQ ID NO: 1398168 - RNA, 22 nt, Human
ccuuuuauguaguaauugacau

SEQ ID NO: 1398169 - RNA, 19 nt, Human
ccuuuuaucccaaaguugu

SEQ ID NO: 1398170 - RNA, 16 nt, Human
ccuuuuauaucccauu

SEQ ID NO: 1398171 - RNA, 21 nt, Human
ccuuugaccugccucccuuca

SEQ ID NO: 1398172 - RNA, 22 nt, Human
ccuuugaccugccucccuucau

SEQ ID NO: 1398173 - RNA, 15 nt, Human
cgacuuucugccugg

SEQ ID NO: 1398174 - RNA, 14 nt, Human
cgacuuucugccug

SEQ ID NO: 1398175 - RNA, 13 nt, Human
cgacuuucugccu

SEQ ID NO: 1398176 - RNA, 19 nt, Human
cgacuuguuuuugcacaug

SEQ ID NO: 1398177 - RNA, 16 nt, Human
cgacuugccaaauuua

SEQ ID NO: 1398178 - RNA, 21 nt, Human
cgagaaauucguguguuuuuu

SEQ ID NO: 1398179 - RNA, 21 nt, Human
cgagaaagaggcaccaggaag

SEQ ID NO: 1398180 - RNA, 19 nt, Human
cgagaaagaggcaccagga

SEQ ID NO: 1398181 - RNA, 16 nt, Human
cgacuuucugccugga

SEQ ID NO: 1398182 - RNA, 17 nt, Human
cgagaaagaggcaccag

SEQ ID NO: 1398183 - RNA, 19 nt, Human
cgaauacuuuugcccuuug

SEQ ID NO: 1398184 - RNA, 11 nt, Human
cgacugucucc

SEQ ID NO: 1398185 - RNA, 20 nt, Human
cgagaggugggccagucugu

SEQ ID NO: 1398186 - RNA, 19 nt, Human
cgagaggugggccagucug

SEQ ID NO: 1398187 - RNA, 15 nt, Human
cgagaggugggccag

SEQ ID NO: 1398188 - RNA, 14 nt, Human
cgagaggugggcca

SEQ ID NO: 1398189 - RNA, 22 nt, Human
cgagaggggccgaugcccagag

SEQ ID NO: 1398190 - RNA, 21 nt, Human
cgagaggggccgaugcccaga

SEQ ID NO: 1398191 - RNA, 16 nt, Human
cgagaagggcugcuuc

SEQ ID NO: 1398192 - RNA, 23 nt, Human
cgagaggugggccagucugugga

SEQ ID NO: 1398193 - RNA, 22 nt, Human
cgagaggugggccagucugugg

SEQ ID NO: 1398194 - RNA, 13 nt, Human
cgagauaccccac

SEQ ID NO: 1398195 - RNA, 13 nt, Human
cgagcaggaggcc

SEQ ID NO: 1398196 - RNA, 19 nt, Human
cgagcagcugagcagggcc

SEQ ID NO: 1398197 - RNA, 16 nt, Human
cgagcagcugagcagg

SEQ ID NO: 1398198 - RNA, 15 nt, Human
cgagcagcugagcag

SEQ ID NO: 1398199 - RNA, 14 nt, Human
cgagcagcugagca

SEQ ID NO: 1398200 - RNA, 13 nt, Human
cgagcagcugagc

SEQ ID NO: 1398201 - RNA, 12 nt, Human
cgagcagcugag

SEQ ID NO: 1398202 - RNA, 14 nt, Human
cgagcaggaggccu

SEQ ID NO: 1398203 - RNA, 11 nt, Human
cgagcagcuga

SEQ ID NO: 1398204 - RNA, 13 nt, Human
cgagcaccuccac

SEQ ID NO: 1398205 - RNA, 23 nt, Human
cgagcaaccguggcccuuccugg

SEQ ID NO: 1398206 - RNA, 22 nt, Human
cgagcaaccguggcccuuccug

SEQ ID NO: 1398207 - RNA, 16 nt, Human
cgagcaaccguggccc

SEQ ID NO: 1398208 - RNA, 15 nt, Human
cgagcaaccguggcc

SEQ ID NO: 1398209 - RNA, 14 nt, Human
cgagcaaccguggc

SEQ ID NO: 1398210 - RNA, 23 nt, Human
cgagauuaucguuuucuuaaagu

SEQ ID NO: 1398211 - RNA, 21 nt, Human
cgagauuaucguuuucuuaaa

SEQ ID NO: 1398212 - RNA, 19 nt, Human
cgagaucaguauuuaacua

SEQ ID NO: 1398213 - RNA, 17 nt, Human
cgagaucaguauuuaac

SEQ ID NO: 1398214 - RNA, 22 nt, Human
cgagaucccaacacugccagca

SEQ ID NO: 1398215 - RNA, 21 nt, Human
cgagaucccaacacugccagc

SEQ ID NO: 1398216 - RNA, 15 nt, Human
cgagaucccaacacu

SEQ ID NO: 1398217 - RNA, 13 nt, Human
cgagaucccaaca

SEQ ID NO: 1398218 - RNA, 20 nt, Human
cgagauaccccaccucccuc

SEQ ID NO: 1398219 - RNA, 22 nt, Human
cucagggcuccuugugggccug

SEQ ID NO: 1398220 - RNA, 15 nt, Human
cucagggcuccuugu

SEQ ID NO: 1398221 - RNA, 14 nt, Human
cucagggcuccuug

SEQ ID NO: 1398222 - RNA, 17 nt, Human
cucagggcuccuggguu

SEQ ID NO: 1398223 - RNA, 15 nt, Human
cucagggcuccuggg

SEQ ID NO: 1398224 - RNA, 14 nt, Human
cucagggcuccugg

SEQ ID NO: 1398225 - RNA, 13 nt, Human
cucagggcuccug

SEQ ID NO: 1398226 - RNA, 22 nt, Human
cucagggcaaagccaggucccu

SEQ ID NO: 1398227 - RNA, 10 nt, Human
cucagggcag

SEQ ID NO: 1398228 - RNA, 18 nt, Human
cucagggcaaagccaggu

SEQ ID NO: 1398229 - RNA, 17 nt, Human
cucagggcaaagccagg

SEQ ID NO: 1398230 - RNA, 16 nt, Human
cucagggcaaagccag

SEQ ID NO: 1398231 - RNA, 15 nt, Human
cucagggcaaagcca

SEQ ID NO: 1398232 - RNA, 14 nt, Human
cucagggcaaagcc

SEQ ID NO: 1398233 - RNA, 17 nt, Human
cucagggaccauggcuu

SEQ ID NO: 1398234 - RNA, 16 nt, Human
cucagggaccauggcu

SEQ ID NO: 1398235 - RNA, 15 nt, Human
cucaggcaggggccu

SEQ ID NO: 1398236 - RNA, 15 nt, Human
cucaggcagcucaag

SEQ ID NO: 1398237 - RNA, 14 nt, Human
cucaggcagcucaa

SEQ ID NO: 1398238 - RNA, 18 nt, Human
cucaggcacacagcuacu

SEQ ID NO: 1398239 - RNA, 16 nt, Human
cucaggcacacagcua

SEQ ID NO: 1398240 - RNA, 15 nt, Human
cucaggcacacagcu

SEQ ID NO: 1398241 - RNA, 14 nt, Human
cucaggcacacagc

SEQ ID NO: 1398242 - RNA, 13 nt, Human
cucaggcacacag

SEQ ID NO: 1398243 - RNA, 21 nt, Human
cucaggaugagggaaaagaaa

SEQ ID NO: 1398244 - RNA, 22 nt, Human
cucaggaugagggaaaagaaaa

SEQ ID NO: 1398245 - RNA, 20 nt, Human
cucaggaugagggaaaagaa

SEQ ID NO: 1398246 - RNA, 16 nt, Human
cucaggaugagggaaa

SEQ ID NO: 1398247 - RNA, 20 nt, Human
cucaggauccaagcuaagca

SEQ ID NO: 1398248 - RNA, 18 nt, Human
cucaggauccaagcuaag

SEQ ID NO: 1398249 - RNA, 12 nt, Human
cucaggauccaa

SEQ ID NO: 1398250 - RNA, 13 nt, Human
cucagccagccuc

SEQ ID NO: 1398251 - RNA, 12 nt, Human
cucagccagccu

SEQ ID NO: 1398252 - RNA, 13 nt, Human
cucagccagcacu

SEQ ID NO: 1398253 - RNA, 11 nt, Human
cucagccagca

SEQ ID NO: 1398254 - RNA, 21 nt, Human
cucagccacccugaguugcuu

SEQ ID NO: 1398255 - RNA, 18 nt, Human
cucagccacccugaguug

SEQ ID NO: 1398256 - RNA, 17 nt, Human
cucagccacccugaguu

SEQ ID NO: 1398257 - RNA, 16 nt, Human
cucagccacccugagu

SEQ ID NO: 1398258 - RNA, 15 nt, Human
cucagccacccugag

SEQ ID NO: 1398259 - RNA, 14 nt, Human
cucagccagccucg

SEQ ID NO: 1398260 - RNA, 19 nt, Human
cucaucccguguucuccuu

SEQ ID NO: 1398261 - RNA, 16 nt, Human
cucaucccguguucuc

SEQ ID NO: 1398262 - RNA, 22 nt, Human
cucaucccgagcaccuccacau

SEQ ID NO: 1398263 - RNA, 22 nt, Human
cucaucauucucugucucaucc

SEQ ID NO: 1398264 - RNA, 20 nt, Human
cucaucauucucugucucau

SEQ ID NO: 1398265 - RNA, 19 nt, Human
cucaucauucucugucuca

SEQ ID NO: 1398266 - RNA, 18 nt, Human
cucaucauucucugucuc

SEQ ID NO: 1398267 - RNA, 17 nt, Human
cucaucauucucugucu

SEQ ID NO: 1398268 - RNA, 15 nt, Human
cucaucauucucugu

SEQ ID NO: 1398269 - RNA, 14 nt, Human
cucaucauucucug

SEQ ID NO: 1398270 - RNA, 13 nt, Human
cucaucauucucu

SEQ ID NO: 1398271 - RNA, 17 nt, Human
cucaucucucugcccaa

SEQ ID NO: 1398272 - RNA, 16 nt, Human
cucaucucucugccca

SEQ ID NO: 1398273 - RNA, 14 nt, Human
cucauccuccuucu

SEQ ID NO: 1398274 - RNA, 16 nt, Human
cucauccuccuucuuc

SEQ ID NO: 1398275 - RNA, 13 nt, Human
cucauccuccuuc

SEQ ID NO: 1398276 - RNA, 12 nt, Human
cucauccuccuu

SEQ ID NO: 1398277 - RNA, 12 nt, Human
cucaucaguagu

SEQ ID NO: 1398278 - RNA, 18 nt, Human
cucaucaauggggccagu

SEQ ID NO: 1398279 - RNA, 14 nt, Human
cucaucaacugaau

SEQ ID NO: 1398280 - RNA, 16 nt, Human
cucaucaacugaauga

SEQ ID NO: 1398281 - RNA, 17 nt, Human
cucauauaauuauaugu

SEQ ID NO: 1398282 - RNA, 20 nt, Human
cucauauaauuauauguugu

SEQ ID NO: 1398283 - RNA, 17 nt, Human
cucauacccucccuccc

SEQ ID NO: 1398284 - RNA, 16 nt, Human
cucauacccucccucc

SEQ ID NO: 1398285 - RNA, 17 nt, Human
cuccacguucugcucau

SEQ ID NO: 1398286 - RNA, 16 nt, Human
cuccacguucugcuca

SEQ ID NO: 1398287 - RNA, 15 nt, Human
cuccacguucugcuc

SEQ ID NO: 1398288 - RNA, 14 nt, Human
cuccaccuucccac

SEQ ID NO: 1398289 - RNA, 12 nt, Human
cuccaccuuccc

SEQ ID NO: 1398290 - RNA, 17 nt, Human
cuccaccuugcagcucu

SEQ ID NO: 1398291 - RNA, 14 nt, Human
cuccaccuccuggg

SEQ ID NO: 1398292 - RNA, 19 nt, Human
cuccagcggcccugucauc

SEQ ID NO: 1398293 - RNA, 22 nt, Human
cuccagcggcccugucauccag

SEQ ID NO: 1398294 - RNA, 15 nt, Human
cuccagcggcccugu

SEQ ID NO: 1398295 - RNA, 13 nt, Human
cuccagcggcccu

SEQ ID NO: 1398296 - RNA, 18 nt, Human
cuccacguucugcucauc

SEQ ID NO: 1398297 - RNA, 12 nt, Human
cuccaucccugg

SEQ ID NO: 1398298 - RNA, 11 nt, Human
cuccaucccug

SEQ ID NO: 1398299 - RNA, 20 nt, Human
cuccauccacaugggagccg

SEQ ID NO: 1398300 - RNA, 18 nt, Human
cuccauccaaggccaggu

SEQ ID NO: 1398301 - RNA, 14 nt, Human
cuccauccaaggcc

SEQ ID NO: 1398302 - RNA, 13 nt, Human
cuccauccaaggc

SEQ ID NO: 1398303 - RNA, 12 nt, Human
cuccauccaagg

SEQ ID NO: 1398304 - RNA, 16 nt, Human
cuccauccuaccacaa

SEQ ID NO: 1398305 - RNA, 19 nt, Human
cuccaggaagccuuccccu

SEQ ID NO: 1398306 - RNA, 15 nt, Human
cuccagcuuuccugu

SEQ ID NO: 1398307 - RNA, 16 nt, Human
cuccagcuuuccugua

SEQ ID NO: 1398308 - RNA, 13 nt, Human
cuccagcuuuccu

SEQ ID NO: 1398309 - RNA, 13 nt, Human
cuccacauccucc

SEQ ID NO: 1398310 - RNA, 20 nt, Human
cuccacaccauucaggucuu

SEQ ID NO: 1398311 - RNA, 20 nt, Human
cuccacacagugcucaaggc

SEQ ID NO: 1398312 - RNA, 18 nt, Human
cuccacaccauucagguc

SEQ ID NO: 1398313 - RNA, 23 nt, Human
cuccaauuuuuuaagugaaaaua

SEQ ID NO: 1398314 - RNA, 15 nt, Human
cuccaauuuuuuaag

SEQ ID NO: 1398315 - RNA, 17 nt, Human
cuccacauccuccacgu

SEQ ID NO: 1398316 - RNA, 15 nt, Human
cuccacauccuccac

SEQ ID NO: 1398317 - RNA, 14 nt, Human
cuccacauccucca

SEQ ID NO: 1398318 - RNA, 15 nt, Human
cuccacccuggccga

SEQ ID NO: 1398319 - RNA, 14 nt, Human
cuccacccuggccg

SEQ ID NO: 1398320 - RNA, 23 nt, Human
cucauguugaagccacugccuuc

SEQ ID NO: 1398321 - RNA, 13 nt, Human
cucaucugcuggu

SEQ ID NO: 1398322 - RNA, 12 nt, Human
cucaucugcugg

SEQ ID NO: 1398323 - RNA, 12 nt, Human
cucaucucuucu

SEQ ID NO: 1398324 - RNA, 15 nt, Human
cucaucucuucuuuu

SEQ ID NO: 1398325 - RNA, 13 nt, Human
cucauuagacugg

SEQ ID NO: 1398326 - RNA, 17 nt, Human
cucauuaaaagaauauc

SEQ ID NO: 1398327 - RNA, 12 nt, Human
cucauuagacug

SEQ ID NO: 1398328 - RNA, 14 nt, Human
cucauuucuagcag

SEQ ID NO: 1398329 - RNA, 19 nt, Human
cucauuuuuuuccuugcaa

SEQ ID NO: 1398330 - RNA, 15 nt, Human
cuccaaaauaaaacu

SEQ ID NO: 1398331 - RNA, 16 nt, Human
cuccaaaauaaaacuu

SEQ ID NO: 1398332 - RNA, 18 nt, Human
cuccaaaauaaaacuuuu

SEQ ID NO: 1398333 - RNA, 21 nt, Human
cuccaaacugacucuuaagaa

SEQ ID NO: 1398334 - RNA, 22 nt, Human
cuccucccacccggcugcagag

SEQ ID NO: 1398335 - RNA, 20 nt, Human
cuccucccacccggcugcag

SEQ ID NO: 1398336 - RNA, 11 nt, Human
cuccucccagg

SEQ ID NO: 1398337 - RNA, 12 nt, Human
cuccucccagga

SEQ ID NO: 1398338 - RNA, 11 nt, Human
cuccucaggga

SEQ ID NO: 1398339 - RNA, 17 nt, Human
cuccucagggacucagg

SEQ ID NO: 1398340 - RNA, 23 nt, Human
cuccucaggcacacagcuacucu

SEQ ID NO: 1398341 - RNA, 22 nt, Human
cuccucaggcacacagcuacuc

SEQ ID NO: 1398342 - RNA, 21 nt, Human
cuccucaggcacacagcuacu

SEQ ID NO: 1398343 - RNA, 19 nt, Human
cuccucaggcacacagcua

SEQ ID NO: 1398344 - RNA, 18 nt, Human
cuccucaggcacacagcu

SEQ ID NO: 1398345 - RNA, 17 nt, Human
cuccucaggcacacagc

SEQ ID NO: 1398346 - RNA, 13 nt, Human
cuccucagccuga

SEQ ID NO: 1398347 - RNA, 24 nt, Human
cuccucagccugaaccccagggcu

SEQ ID NO: 1398348 - RNA, 12 nt, Human
cuccucagccug

SEQ ID NO: 1398349 - RNA, 11 nt, Human
cuccucagccu

SEQ ID NO: 1398350 - RNA, 15 nt, Human
cuccucacccccagc

SEQ ID NO: 1398351 - RNA, 20 nt, Human
cuccucaaccccuccccucc

SEQ ID NO: 1398352 - RNA, 14 nt, Human
cuccucacccccag

SEQ ID NO: 1398353 - RNA, 15 nt, Human
cuccucccacccggc

SEQ ID NO: 1398354 - RNA, 19 nt, Human
cucccuguuccccagagaa

SEQ ID NO: 1398355 - RNA, 18 nt, Human
cucccuguuccccagaga

SEQ ID NO: 1398356 - RNA, 17 nt, Human
cucccuguuccccagag

SEQ ID NO: 1398357 - RNA, 16 nt, Human
cucccuguuccccaga

SEQ ID NO: 1398358 - RNA, 19 nt, Human
cucccugugcccccagggu

SEQ ID NO: 1398359 - RNA, 15 nt, Human
cucccugugccccca

SEQ ID NO: 1398360 - RNA, 13 nt, Human
cucccugugcccc

SEQ ID NO: 1398361 - RNA, 18 nt, Human
cucccuguacaguguuac

SEQ ID NO: 1398362 - RNA, 15 nt, Human
cucccuguacagugu

SEQ ID NO: 1398363 - RNA, 15 nt, Human
cucccuguaacuuga

SEQ ID NO: 1398364 - RNA, 13 nt, Human
cucccuguaacuu

SEQ ID NO: 1398365 - RNA, 18 nt, Human
cucccuggugcuuaugcu

SEQ ID NO: 1398366 - RNA, 19 nt, Human
cucccuguaaccucuucag

SEQ ID NO: 1398367 - RNA, 22 nt, Human
cucccuggugcuuaugcucuua

SEQ ID NO: 1398368 - RNA, 17 nt, Human
cucccuugggcucugau

SEQ ID NO: 1398369 - RNA, 16 nt, Human
cucccuugggcucuga

SEQ ID NO: 1398370 - RNA, 18 nt, Human
cucccuugggcucccugu

SEQ ID NO: 1398371 - RNA, 14 nt, Human
cucccuugggcucc

SEQ ID NO: 1398372 - RNA, 13 nt, Human
cucccuugggcuc

SEQ ID NO: 1398373 - RNA, 21 nt, Human
cucccuugggcucugaugaaa

SEQ ID NO: 1398374 - RNA, 20 nt, Human
cucccuugggcucugaugaa

SEQ ID NO: 1398375 - RNA, 19 nt, Human
cucccuugggcucugauga

SEQ ID NO: 1398376 - RNA, 18 nt, Human
cucccuugggcucugaug

SEQ ID NO: 1398377 - RNA, 23 nt, Human
cucccuugggcucugaugaaaaa

SEQ ID NO: 1398378 - RNA, 17 nt, Human
cuccgaggacccaggaa

SEQ ID NO: 1398379 - RNA, 15 nt, Human
cuccgaggacccagg

SEQ ID NO: 1398380 - RNA, 22 nt, Human
cuccgagaggugggccagucug

SEQ ID NO: 1398381 - RNA, 18 nt, Human
cuccgagaggugggccag

SEQ ID NO: 1398382 - RNA, 17 nt, Human
cuccgagaggugggcca

SEQ ID NO: 1398383 - RNA, 15 nt, Human
cuccgagaggugggc

SEQ ID NO: 1398384 - RNA, 14 nt, Human
cuccgagagguggg

SEQ ID NO: 1398385 - RNA, 13 nt, Human
cuccgagaggugg

SEQ ID NO: 1398386 - RNA, 18 nt, Human
cuccuauguuuggcugcu

SEQ ID NO: 1398387 - RNA, 22 nt, Human
cuccuauggguugucaccaagc

SEQ ID NO: 1398388 - RNA, 23 nt, Human
cuccuaugaucugagucagagcc

SEQ ID NO: 1398389 - RNA, 19 nt, Human
cuccuaugaucugagucag

SEQ ID NO: 1398390 - RNA, 16 nt, Human
cuccuaugaucugagu

SEQ ID NO: 1398391 - RNA, 21 nt, Human
cuccucaaccccuccccucca

SEQ ID NO: 1398392 - RNA, 15 nt, Human
cuccucaaccccucc

SEQ ID NO: 1398393 - RNA, 12 nt, Human
cuccccuucucu

SEQ ID NO: 1398394 - RNA, 20 nt, Human
cuccccugcccccugcagga

SEQ ID NO: 1398395 - RNA, 23 nt, Human
cuccccugcccccugcaggaagg

SEQ ID NO: 1398396 - RNA, 19 nt, Human
cuccccugcccccugcagg

SEQ ID NO: 1398397 - RNA, 18 nt, Human
cuccccugcccccugcag

SEQ ID NO: 1398398 - RNA, 17 nt, Human
cuccccugcccccugca

SEQ ID NO: 1398399 - RNA, 15 nt, Human
cuccccugcccccug

SEQ ID NO: 1398400 - RNA, 13 nt, Human
cuccccugccccc

SEQ ID NO: 1398401 - RNA, 24 nt, Human
cuccaucccuggcccccucccugg

SEQ ID NO: 1398402 - RNA, 19 nt, Human
cuccaucccuggcccccuc

SEQ ID NO: 1398403 - RNA, 19 nt, Human
cuccccagcauuccagccc

SEQ ID NO: 1398404 - RNA, 16 nt, Human
cuccaucccuggcccc

SEQ ID NO: 1398405 - RNA, 15 nt, Human
cuccaucccuggccc

SEQ ID NO: 1398406 - RNA, 14 nt, Human
cuccaucccuggcc

SEQ ID NO: 1398407 - RNA, 13 nt, Human
cuccaucccuggc

SEQ ID NO: 1398408 - RNA, 15 nt, Human
cucccuggugcuuau

SEQ ID NO: 1398409 - RNA, 13 nt, Human
cucccuggugcuu

SEQ ID NO: 1398410 - RNA, 12 nt, Human
cucccuggugcu

SEQ ID NO: 1398411 - RNA, 14 nt, Human
cucccugccuccug

SEQ ID NO: 1398412 - RNA, 23 nt, Human
cucccugcauggcauccuccagc

SEQ ID NO: 1398413 - RNA, 22 nt, Human
cucccugcauggcauccuccag

SEQ ID NO: 1398414 - RNA, 14 nt, Human
cucccugcauggca

SEQ ID NO: 1398415 - RNA, 18 nt, Human
cuccccuugccugugcca

SEQ ID NO: 1398416 - RNA, 13 nt, Human
cuccccuugccug

SEQ ID NO: 1398417 - RNA, 16 nt, Human
cuccccuuuuuuuccc

SEQ ID NO: 1398418 - RNA, 18 nt, Human
cuccuucccucucuggag

SEQ ID NO: 1398419 - RNA, 19 nt, Human
cuccuucccucucuggaga

SEQ ID NO: 1398420 - RNA, 17 nt, Human
cuccuucccucucugga

SEQ ID NO: 1398421 - RNA, 13 nt, Human
cuccuucccucuc

SEQ ID NO: 1398422 - RNA, 12 nt, Human
cuccuuccccau

SEQ ID NO: 1398423 - RNA, 17 nt, Human
cuccuucccaucgcugu

SEQ ID NO: 1398424 - RNA, 16 nt, Human
cuccuucccaucgcug

SEQ ID NO: 1398425 - RNA, 14 nt, Human
cuccuucccaagug

SEQ ID NO: 1398426 - RNA, 13 nt, Human
cuccuucccaagu

SEQ ID NO: 1398427 - RNA, 22 nt, Human
cuccuggaccccccuuucacag

SEQ ID NO: 1398428 - RNA, 21 nt, Human
cuccuggaccccccuuucaca

SEQ ID NO: 1398429 - RNA, 23 nt, Human
cuccugcugcucccucagacugg

SEQ ID NO: 1398430 - RNA, 22 nt, Human
cuccugcugcucccucagacug

SEQ ID NO: 1398431 - RNA, 21 nt, Human
cuccugcugcucccucagacu

SEQ ID NO: 1398432 - RNA, 20 nt, Human
cuccugcugcucccucagac

SEQ ID NO: 1398433 - RNA, 19 nt, Human
cuccugcugcucccucaga

SEQ ID NO: 1398434 - RNA, 18 nt, Human
cuccugcugcucccucag

SEQ ID NO: 1398435 - RNA, 17 nt, Human
cuccugcugcucccuca

SEQ ID NO: 1398436 - RNA, 16 nt, Human
cuccugcugcucccuc

SEQ ID NO: 1398437 - RNA, 15 nt, Human
cuccugcugcucccu

SEQ ID NO: 1398438 - RNA, 15 nt, Human
cuccugccggcuccu

SEQ ID NO: 1398439 - RNA, 14 nt, Human
cuccucuccccagc

SEQ ID NO: 1398440 - RNA, 17 nt, Human
cuccugccucagccucc

SEQ ID NO: 1398441 - RNA, 23 nt, Human
cucgagaucccaacacugccagc

SEQ ID NO: 1398442 - RNA, 22 nt, Human
cucgagaucccaacacugccag

SEQ ID NO: 1398443 - RNA, 21 nt, Human
cucgagaucccaacacugcca

SEQ ID NO: 1398444 - RNA, 21 nt, Human
cuccuugguucuugaggggac

SEQ ID NO: 1398445 - RNA, 13 nt, Human
cucgagaucccaa

SEQ ID NO: 1398446 - RNA, 13 nt, Human
cuccuuccugugu

SEQ ID NO: 1398447 - RNA, 21 nt, Human
cuccuuccugccccaacuccu

SEQ ID NO: 1398448 - RNA, 14 nt, Human
cuccuuccuggaga

SEQ ID NO: 1398449 - RNA, 13 nt, Human
cuccuuccuggag

SEQ ID NO: 1398450 - RNA, 15 nt, Human
cuccuuccugcccca

SEQ ID NO: 1398451 - RNA, 13 nt, Human
cuccuuccugccc

SEQ ID NO: 1398452 - RNA, 11 nt, Human
cuccuuccugc

SEQ ID NO: 1398453 - RNA, 12 nt, Human
cuccuuccuaaa

SEQ ID NO: 1398454 - RNA, 16 nt, Human
cuccuugggcccuuug

SEQ ID NO: 1398455 - RNA, 13 nt, Human
cuccuugggcccu

SEQ ID NO: 1398456 - RNA, 12 nt, Human
cuccuugggccc

SEQ ID NO: 1398457 - RNA, 15 nt, Human
cuccuuccugugugu

SEQ ID NO: 1398458 - RNA, 19 nt, Human
cuccuugggcccuuugagu

SEQ ID NO: 1398459 - RNA, 18 nt, Human
cuccuugggcccuuugag

SEQ ID NO: 1398460 - RNA, 17 nt, Human
cuccuugggcccuuuga

SEQ ID NO: 1398461 - RNA, 22 nt, Human
cucgcaacccgugccaagucca

SEQ ID NO: 1398462 - RNA, 23 nt, Human
cucgcaacccgugccaaguccag

SEQ ID NO: 1398463 - RNA, 21 nt, Human
cucgcaacccgugccaagucc

SEQ ID NO: 1398464 - RNA, 16 nt, Human
cucgcaacccgugcca

SEQ ID NO: 1398465 - RNA, 12 nt, Human
cucgcaacccgu

SEQ ID NO: 1398466 - RNA, 19 nt, Human
cucgaggggugggcuggua

SEQ ID NO: 1398467 - RNA, 14 nt, Human
cucgauuucuccag

SEQ ID NO: 1398468 - RNA, 17 nt, Human
cucgaggggugggcugg

SEQ ID NO: 1398469 - RNA, 16 nt, Human
cucgaggggugggcug

SEQ ID NO: 1398470 - RNA, 14 nt, Human
cucgaggggugggc

SEQ ID NO: 1398471 - RNA, 23 nt, Human
cucgagggcagggaccacacccu

SEQ ID NO: 1398472 - RNA, 18 nt, Human
cucgagggcagggaccac

SEQ ID NO: 1398473 - RNA, 23 nt, Human
cucgagcgcccugcagacccugc

SEQ ID NO: 1398474 - RNA, 21 nt, Human
cucgagcgcccugcagacccu

SEQ ID NO: 1398475 - RNA, 20 nt, Human
cucgagcgcccugcagaccc

SEQ ID NO: 1398476 - RNA, 19 nt, Human
cucgagcgcccugcagacc

SEQ ID NO: 1398477 - RNA, 18 nt, Human
cucgagcgcccugcagac

SEQ ID NO: 1398478 - RNA, 17 nt, Human
cucgagcgcccugcaga

SEQ ID NO: 1398479 - RNA, 16 nt, Human
cucgagcgcccugcag

SEQ ID NO: 1398480 - RNA, 15 nt, Human
cucgagcgcccugca

SEQ ID NO: 1398481 - RNA, 12 nt, Human
cucgagcgcccu

SEQ ID NO: 1398482 - RNA, 23 nt, Human
cucgcuccccacucugcucugau

SEQ ID NO: 1398483 - RNA, 21 nt, Human
cucgcuccccacucugcucug

SEQ ID NO: 1398484 - RNA, 17 nt, Human
cucgcuccccacucugc

SEQ ID NO: 1398485 - RNA, 16 nt, Human
cucgcuccccacucug

SEQ ID NO: 1398486 - RNA, 15 nt, Human
cucgcuccccacucu

SEQ ID NO: 1398487 - RNA, 23 nt, Human
cucgccugacaaccacuggucug

SEQ ID NO: 1398488 - RNA, 18 nt, Human
cucgccggaucugaggga

SEQ ID NO: 1398489 - RNA, 19 nt, Human
cucgcauaggaccuuucca

SEQ ID NO: 1398490 - RNA, 18 nt, Human
cucgcauaggaccuuucc

SEQ ID NO: 1398491 - RNA, 20 nt, Human
cucgcccugcgguagauggg

SEQ ID NO: 1398492 - RNA, 17 nt, Human
cucgccggaucugaggg

SEQ ID NO: 1398493 - RNA, 12 nt, Human
cuagguggaaaa

SEQ ID NO: 1398494 - RNA, 15 nt, Human
cuagguggaaaagcc

SEQ ID NO: 1398495 - RNA, 18 nt, Human
cuaggugcuauuugucau

SEQ ID NO: 1398496 - RNA, 21 nt, Human
cuagguccccauacuccuaug

SEQ ID NO: 1398497 - RNA, 17 nt, Human
cuagguaggaaaugugg

SEQ ID NO: 1398498 - RNA, 15 nt, Human
cuagguaggguuuaa

SEQ ID NO: 1398499 - RNA, 20 nt, Human
cuagguacgaugacaguguu

SEQ ID NO: 1398500 - RNA, 19 nt, Human
cuagguacgaugacagugu

SEQ ID NO: 1398501 - RNA, 14 nt, Human
cuagguacgaugac

SEQ ID NO: 1398502 - RNA, 22 nt, Human
cgccccaacccguggaggcugc

SEQ ID NO: 1398503 - RNA, 21 nt, Human
cgccccaacccguggaggcug

SEQ ID NO: 1398504 - RNA, 20 nt, Human
cuagguaauuuuuacagaau

SEQ ID NO: 1398505 - RNA, 22 nt, Human
cuagguaaauuacaguuccuag

SEQ ID NO: 1398506 - RNA, 16 nt, Human
cuagugacccacaugc

SEQ ID NO: 1398507 - RNA, 21 nt, Human
cuagugaaggcuucucucugu

SEQ ID NO: 1398508 - RNA, 17 nt, Human
cuagugaaggcuucucu

SEQ ID NO: 1398509 - RNA, 17 nt, Human
cuagucuuuugcuuuug

SEQ ID NO: 1398510 - RNA, 18 nt, Human
cuagugacuuguguccca

SEQ ID NO: 1398511 - RNA, 19 nt, Human
cuagugacccacaugccau

SEQ ID NO: 1398512 - RNA, 18 nt, Human
cuagugacccacaugcca

SEQ ID NO: 1398513 - RNA, 17 nt, Human
cuagugacccacaugcc

SEQ ID NO: 1398514 - RNA, 21 nt, Human
cuagugagcagucaggaaaga

SEQ ID NO: 1398515 - RNA, 13 nt, Human
cuagucauaaccu

SEQ ID NO: 1398516 - RNA, 20 nt, Human
cuagugaaacucguuaauuu

SEQ ID NO: 1398517 - RNA, 13 nt, Human
cuagguucuaaaa

SEQ ID NO: 1398518 - RNA, 17 nt, Human
cuagguguuuuguucac

SEQ ID NO: 1398519 - RNA, 14 nt, Human
cuagguguuuuguu

SEQ ID NO: 1398520 - RNA, 23 nt, Human
cuagguggguugaaagccaagga

SEQ ID NO: 1398521 - RNA, 19 nt, Human
cuagguggguugaaagcca

SEQ ID NO: 1398522 - RNA, 18 nt, Human
cuagguggguugaaagcc

SEQ ID NO: 1398523 - RNA, 13 nt, Human
cuagguuucaaag

SEQ ID NO: 1398524 - RNA, 16 nt, Human
cuaguaauuggaaagg

SEQ ID NO: 1398525 - RNA, 15 nt, Human
cuagucaaugacaug

SEQ ID NO: 1398526 - RNA, 21 nt, Human
cuagucaaucaagucuguuua

SEQ ID NO: 1398527 - RNA, 20 nt, Human
cuagucaaucaagucuguuu

SEQ ID NO: 1398528 - RNA, 16 nt, Human
cuagucaaucaagucu

SEQ ID NO: 1398529 - RNA, 17 nt, Human
cuagucacgcaugcagu

SEQ ID NO: 1398530 - RNA, 21 nt, Human
cuagucacgcaugcaguguug

SEQ ID NO: 1398531 - RNA, 20 nt, Human
cuagucaaugacaugaauuu

SEQ ID NO: 1398532 - RNA, 18 nt, Human
cuagucaaugacaugaau

SEQ ID NO: 1398533 - RNA, 14 nt, Human
cuagucaccagaga

SEQ ID NO: 1398534 - RNA, 18 nt, Human
cuaguggccgaaccagaa

SEQ ID NO: 1398535 - RNA, 20 nt, Human
cuagugacuugugucccaug

SEQ ID NO: 1398536 - RNA, 19 nt, Human
cuagugacuugugucccau

SEQ ID NO: 1398537 - RNA, 23 nt, Human
cuauaaggugcucucuuucuguc

SEQ ID NO: 1398538 - RNA, 22 nt, Human
cuauaaggugcucucuuucugu

SEQ ID NO: 1398539 - RNA, 21 nt, Human
cuauaaggugcucucuuucug

SEQ ID NO: 1398540 - RNA, 22 nt, Human
cuauaagcaagaaggcaaaaau

SEQ ID NO: 1398541 - RNA, 22 nt, Human
cuauaauuuaccuaagauuaca

SEQ ID NO: 1398542 - RNA, 13 nt, Human
cuauagccaaaaa

SEQ ID NO: 1398543 - RNA, 22 nt, Human
cuauagaugucuuuucccauuu

SEQ ID NO: 1398544 - RNA, 16 nt, Human
cuauagaugucuuuuc

SEQ ID NO: 1398545 - RNA, 15 nt, Human
cuauagaugucuuuu

SEQ ID NO: 1398546 - RNA, 14 nt, Human
cuauagaugucuuu

SEQ ID NO: 1398547 - RNA, 13 nt, Human
cuauaccaauaaa

SEQ ID NO: 1398548 - RNA, 14 nt, Human
cuauaccaauaaag

SEQ ID NO: 1398549 - RNA, 10 nt, Human
cuauauguau

SEQ ID NO: 1398550 - RNA, 14 nt, Human
cuauagccaaaaau

SEQ ID NO: 1398551 - RNA, 19 nt, Human
cuauagccaaaaauagcua

SEQ ID NO: 1398552 - RNA, 19 nt, Human
cuauauuacgguuugcccc

SEQ ID NO: 1398553 - RNA, 18 nt, Human
cuauauuguuugcuaagc

SEQ ID NO: 1398554 - RNA, 16 nt, Human
cuauauuuaacaagau

SEQ ID NO: 1398555 - RNA, 16 nt, Human
cuauauuguucagcau

SEQ ID NO: 1398556 - RNA, 22 nt, Human
cuauauuugggccugcuccaga

SEQ ID NO: 1398557 - RNA, 12 nt, Human
cuauauuugggc

SEQ ID NO: 1398558 - RNA, 17 nt, Human
cuauauuuuacauaaau

SEQ ID NO: 1398559 - RNA, 17 nt, Human
cuaucuguauucccaaa

SEQ ID NO: 1398560 - RNA, 21 nt, Human
cuaucugucugguggccccgu

SEQ ID NO: 1398561 - RNA, 18 nt, Human
cuaucugucugguggccc

SEQ ID NO: 1398562 - RNA, 17 nt, Human
cuaucugucugguggcc

SEQ ID NO: 1398563 - RNA, 16 nt, Human
cuaucugucugguggc

SEQ ID NO: 1398564 - RNA, 14 nt, Human
cuaucugucuggug

SEQ ID NO: 1398565 - RNA, 11 nt, Human
cuaucugucug

SEQ ID NO: 1398566 - RNA, 12 nt, Human
cuaucuguauuc

SEQ ID NO: 1398567 - RNA, 23 nt, Human
cuaucugggcuuccuggagcaga

SEQ ID NO: 1398568 - RNA, 21 nt, Human
cuaucugggcuuccuggagca

SEQ ID NO: 1398569 - RNA, 20 nt, Human
cuaucugggcuuccuggagc

SEQ ID NO: 1398570 - RNA, 19 nt, Human
cuaucugggcuuccuggag

SEQ ID NO: 1398571 - RNA, 18 nt, Human
cuaucugggcuuccugga

SEQ ID NO: 1398572 - RNA, 17 nt, Human
cuaucugggcuuccugg

SEQ ID NO: 1398573 - RNA, 16 nt, Human
cuaucugggcuuccug

SEQ ID NO: 1398574 - RNA, 15 nt, Human
cuaucugggcuuccu

SEQ ID NO: 1398575 - RNA, 14 nt, Human
cuaucugggcuucc

SEQ ID NO: 1398576 - RNA, 21 nt, Human
cuauuaggugcaauuucaagg

SEQ ID NO: 1398577 - RNA, 17 nt, Human
cuauuacauuuucagug

SEQ ID NO: 1398578 - RNA, 21 nt, Human
cuauggucgggagacagcauc

SEQ ID NO: 1398579 - RNA, 17 nt, Human
cuauggucgggagacag

SEQ ID NO: 1398580 - RNA, 20 nt, Human
cuauggguguuaucaccuag

SEQ ID NO: 1398581 - RNA, 17 nt, Human
cuauggugcucugucua

SEQ ID NO: 1398582 - RNA, 16 nt, Human
cuauggugcucugucu

SEQ ID NO: 1398583 - RNA, 14 nt, Human
cuauggugcucugu

SEQ ID NO: 1398584 - RNA, 23 nt, Human
cuauggugcucugucuacuugcu

SEQ ID NO: 1398585 - RNA, 13 nt, Human
cuauguaaacuac

SEQ ID NO: 1398586 - RNA, 23 nt, Human
cuaugcauggugccccaggacca

SEQ ID NO: 1398587 - RNA, 22 nt, Human
cuaugcauggugccccaggacc

SEQ ID NO: 1398588 - RNA, 21 nt, Human
cuaugcauggugccccaggac

SEQ ID NO: 1398589 - RNA, 20 nt, Human
cuaugcauggugccccagga

SEQ ID NO: 1398590 - RNA, 19 nt, Human
cuaugcauggugccccagg

SEQ ID NO: 1398591 - RNA, 13 nt, Human
cuaugcauggugc

SEQ ID NO: 1398592 - RNA, 23 nt, Human
cuaugauauuuucugugccugaa

SEQ ID NO: 1398593 - RNA, 17 nt, Human
cuaugagucuagauguu

SEQ ID NO: 1398594 - RNA, 19 nt, Human
cuaugagucuagauguuua

SEQ ID NO: 1398595 - RNA, 16 nt, Human
cuaugagucuagaugu

SEQ ID NO: 1398596 - RNA, 15 nt, Human
cuaugagucuagaug

SEQ ID NO: 1398597 - RNA, 14 nt, Human
cuaugagucuagau

SEQ ID NO: 1398598 - RNA, 13 nt, Human
cuaugagucuaga

SEQ ID NO: 1398599 - RNA, 14 nt, Human
cuauggagagcccu

SEQ ID NO: 1398600 - RNA, 11 nt, Human
cuauggagagc

SEQ ID NO: 1398601 - RNA, 19 nt, Human
cuaugcuuugaaacagaaa

SEQ ID NO: 1398602 - RNA, 15 nt, Human
cuauggaaagauggc

SEQ ID NO: 1398603 - RNA, 17 nt, Human
cuaugcuuugaaacaga

SEQ ID NO: 1398604 - RNA, 15 nt, Human
cuaugcuuugaaaca

SEQ ID NO: 1398605 - RNA, 11 nt, Human
cuaugcuuuga

SEQ ID NO: 1398606 - RNA, 15 nt, Human
cuaugcaugguuuca

SEQ ID NO: 1398607 - RNA, 18 nt, Human
cuaugcaugguuucagca

SEQ ID NO: 1398608 - RNA, 19 nt, Human
cuauggagagcccugggac

SEQ ID NO: 1398609 - RNA, 19 nt, Human
cuauggagugcaccaaaga

SEQ ID NO: 1398610 - RNA, 21 nt, Human
cuauggagagcccugggaccg

SEQ ID NO: 1398611 - RNA, 18 nt, Human
cuauggagagcccuggga

SEQ ID NO: 1398612 - RNA, 17 nt, Human
cuauggagagcccuggg

SEQ ID NO: 1398613 - RNA, 16 nt, Human
cuauggagagcccugg

SEQ ID NO: 1398614 - RNA, 15 nt, Human
cuauggagagcccug

SEQ ID NO: 1398615 - RNA, 13 nt, Human
cuaugggaacaau

SEQ ID NO: 1398616 - RNA, 14 nt, Human
cuauggccucaugu

SEQ ID NO: 1398617 - RNA, 13 nt, Human
cuauggccugugg

SEQ ID NO: 1398618 - RNA, 15 nt, Human
cucacucuguuuccu

SEQ ID NO: 1398619 - RNA, 18 nt, Human
cucacugcaaccuucacc

SEQ ID NO: 1398620 - RNA, 19 nt, Human
cucacuccuuuuaaagaaa

SEQ ID NO: 1398621 - RNA, 14 nt, Human
cucacucgucuccc

SEQ ID NO: 1398622 - RNA, 18 nt, Human
cucacuccuuuuaaagaa

SEQ ID NO: 1398623 - RNA, 15 nt, Human
cucacuccuuuuaaa

SEQ ID NO: 1398624 - RNA, 14 nt, Human
cucacuccuuuuaa

SEQ ID NO: 1398625 - RNA, 13 nt, Human
cucacuccuuuua

SEQ ID NO: 1398626 - RNA, 18 nt, Human
cucacccccagcuuugcu

SEQ ID NO: 1398627 - RNA, 17 nt, Human
cucacccccagcuuugc

SEQ ID NO: 1398628 - RNA, 14 nt, Human
cucacccccagcuu

SEQ ID NO: 1398629 - RNA, 17 nt, Human
cucaccauuuggauccu

SEQ ID NO: 1398630 - RNA, 22 nt, Human
cucaccauuccaagucuccacc

SEQ ID NO: 1398631 - RNA, 20 nt, Human
cucaccauuccaagucucca

SEQ ID NO: 1398632 - RNA, 12 nt, Human
cucaccauucca

SEQ ID NO: 1398633 - RNA, 13 nt, Human
cucacccagugcc

SEQ ID NO: 1398634 - RNA, 17 nt, Human
cucacccaccccugcac

SEQ ID NO: 1398635 - RNA, 22 nt, Human
cucacucagccacccugaguug

SEQ ID NO: 1398636 - RNA, 21 nt, Human
cucacucagccacccugaguu

SEQ ID NO: 1398637 - RNA, 18 nt, Human
cucacucagccacccuga

SEQ ID NO: 1398638 - RNA, 12 nt, Human
cucacucagcca

SEQ ID NO: 1398639 - RNA, 19 nt, Human
cucacucagcacuuggccc

SEQ ID NO: 1398640 - RNA, 14 nt, Human
cucacucagcacuu

SEQ ID NO: 1398641 - RNA, 18 nt, Human
cucacuccccacauccca

SEQ ID NO: 1398642 - RNA, 19 nt, Human
cucacccccagcuuugcua

SEQ ID NO: 1398643 - RNA, 16 nt, Human
cucagauccuccucau

SEQ ID NO: 1398644 - RNA, 22 nt, Human
cucagauccagggacagaggcc

SEQ ID NO: 1398645 - RNA, 20 nt, Human
cucagauccagggacagagg

SEQ ID NO: 1398646 - RNA, 18 nt, Human
cucagauccagggacaga

SEQ ID NO: 1398647 - RNA, 17 nt, Human
cucagauccagggacag

SEQ ID NO: 1398648 - RNA, 16 nt, Human
cucagauccagggaca

SEQ ID NO: 1398649 - RNA, 15 nt, Human
cucagauccagggac

SEQ ID NO: 1398650 - RNA, 14 nt, Human
cucagauccaggga

SEQ ID NO: 1398651 - RNA, 13 nt, Human
cucagauccaggg

SEQ ID NO: 1398652 - RNA, 10 nt, Human
cucagaucca

SEQ ID NO: 1398653 - RNA, 21 nt, Human
cucagaucaguguaccauuug

SEQ ID NO: 1398654 - RNA, 17 nt, Human
cucagaucaguguacca

SEQ ID NO: 1398655 - RNA, 18 nt, Human
cucagauagaaugacagu

SEQ ID NO: 1398656 - RNA, 16 nt, Human
cucagauagaaugaca

SEQ ID NO: 1398657 - RNA, 23 nt, Human
cucagauaagguaaaaugccaug

SEQ ID NO: 1398658 - RNA, 22 nt, Human
cucagauaagguaaaaugccau

SEQ ID NO: 1398659 - RNA, 21 nt, Human
cucagauaagguaaaaugcca

SEQ ID NO: 1398660 - RNA, 22 nt, Human
cucagagaccagggcuccagcc

SEQ ID NO: 1398661 - RNA, 21 nt, Human
cucagagaccagggcuccagc

SEQ ID NO: 1398662 - RNA, 16 nt, Human
cucagagaccagggcu

SEQ ID NO: 1398663 - RNA, 13 nt, Human
cucagagaccagg

SEQ ID NO: 1398664 - RNA, 19 nt, Human
cucagagacaugcagagau

SEQ ID NO: 1398665 - RNA, 17 nt, Human
cucagagacaugcagag

SEQ ID NO: 1398666 - RNA, 16 nt, Human
cucagagacaugcaga

SEQ ID NO: 1398667 - RNA, 13 nt, Human
cucagagacaugc

SEQ ID NO: 1398668 - RNA, 23 nt, Human
cucagagaauuucuaccauuuca

SEQ ID NO: 1398669 - RNA, 18 nt, Human
cucagcacuuggcccuuc

SEQ ID NO: 1398670 - RNA, 16 nt, Human
cucagcacuuggcccu

SEQ ID NO: 1398671 - RNA, 15 nt, Human
cucagcacuuggccc

SEQ ID NO: 1398672 - RNA, 14 nt, Human
cucagcacuuggcc

SEQ ID NO: 1398673 - RNA, 13 nt, Human
cucagcacuuggc

SEQ ID NO: 1398674 - RNA, 21 nt, Human
cucagcacugccugcucccau

SEQ ID NO: 1398675 - RNA, 19 nt, Human
cucagcacugccugcuccc

SEQ ID NO: 1398676 - RNA, 18 nt, Human
cucagcacugccugcucc

SEQ ID NO: 1398677 - RNA, 17 nt, Human
cucagcacugccugcuc

SEQ ID NO: 1398678 - RNA, 16 nt, Human
cucagcacugccugcu

SEQ ID NO: 1398679 - RNA, 15 nt, Human
cucagcacugccugc

SEQ ID NO: 1398680 - RNA, 13 nt, Human
cucagcacugccu

SEQ ID NO: 1398681 - RNA, 17 nt, Human
cucagcacuuggcccuu

SEQ ID NO: 1398682 - RNA, 14 nt, Human
cucagauccuccuc

SEQ ID NO: 1398683 - RNA, 16 nt, Human
cucagauuccuuccca

SEQ ID NO: 1398684 - RNA, 14 nt, Human
cucagauuccuucc

SEQ ID NO: 1398685 - RNA, 22 nt, Human
cucagauuguaauauguaaaug

SEQ ID NO: 1398686 - RNA, 15 nt, Human
cucagauuguaauau

SEQ ID NO: 1398687 - RNA, 24 nt, Human
cucagauuccuucccauggaggga

SEQ ID NO: 1398688 - RNA, 21 nt, Human
cucagauuccuucccauggag

SEQ ID NO: 1398689 - RNA, 20 nt, Human
cucagauuccuucccaugga

SEQ ID NO: 1398690 - RNA, 17 nt, Human
cucagauuccuucccau

SEQ ID NO: 1398691 - RNA, 16 nt, Human
cucagauuucugagga

SEQ ID NO: 1398692 - RNA, 17 nt, Human
cucagauuucugaggaa

SEQ ID NO: 1398693 - RNA, 20 nt, Human
cucagcacaaggccaucugg

SEQ ID NO: 1398694 - RNA, 14 nt, Human
cucagcacaaggcc

SEQ ID NO: 1398695 - RNA, 20 nt, Human
cucaccaggcagccucuggg

SEQ ID NO: 1398696 - RNA, 21 nt, Human
cucaccaggcagccucugggg

SEQ ID NO: 1398697 - RNA, 19 nt, Human
cucaccaggcagccucugg

SEQ ID NO: 1398698 - RNA, 18 nt, Human
cucaccaggcagccucug

SEQ ID NO: 1398699 - RNA, 21 nt, Human
cucaccacugcccccugcugc

SEQ ID NO: 1398700 - RNA, 17 nt, Human
cucaccacugcccccug

SEQ ID NO: 1398701 - RNA, 16 nt, Human
cucaccacggaccaaa

SEQ ID NO: 1398702 - RNA, 13 nt, Human
cucaccaacuccu

SEQ ID NO: 1398703 - RNA, 12 nt, Human
cucacauuuaug

SEQ ID NO: 1398704 - RNA, 22 nt, Human
cucacaguauugcucacccagu

SEQ ID NO: 1398705 - RNA, 15 nt, Human
cucacaggucccaaa

SEQ ID NO: 1398706 - RNA, 16 nt, Human
cucacaggucccaaau

SEQ ID NO: 1398707 - RNA, 21 nt, Human
cucacaccacuagccucaggg

SEQ ID NO: 1398708 - RNA, 20 nt, Human
cucacaccacuagccucagg

SEQ ID NO: 1398709 - RNA, 17 nt, Human
cucacaccacuagccuc

SEQ ID NO: 1398710 - RNA, 23 nt, Human
cucacaccaggcuugccugcagg

SEQ ID NO: 1398711 - RNA, 21 nt, Human
cucaagucuuucucuuucccu

SEQ ID NO: 1398712 - RNA, 16 nt, Human
cucaagucuuucucuu

SEQ ID NO: 1398713 - RNA, 15 nt, Human
cucaagucuuucucu

SEQ ID NO: 1398714 - RNA, 15 nt, Human
cucaagagaucccaa

SEQ ID NO: 1398715 - RNA, 19 nt, Human
cucaagagaucccaaguag

SEQ ID NO: 1398716 - RNA, 23 nt, Human
cucaagacccuuuuggguuucug

SEQ ID NO: 1398717 - RNA, 23 nt, Human
cucaagaaauaaaaggaagccaa

SEQ ID NO: 1398718 - RNA, 22 nt, Human
cucaagaaauaaaaggaagcca

SEQ ID NO: 1398719 - RNA, 17 nt, Human
cucaacaggccucaggg

SEQ ID NO: 1398720 - RNA, 12 nt, Human
cucaaccucauc

SEQ ID NO: 1398721 - RNA, 21 nt, Human
cucaagaaauaaaaggaagcc

SEQ ID NO: 1398722 - RNA, 13 nt, Human
cucaaccucaucc

SEQ ID NO: 1398723 - RNA, 21 nt, Human
cuauucgccacacaguauuuu

SEQ ID NO: 1398724 - RNA, 17 nt, Human
cuauuccgagcccuuag

SEQ ID NO: 1398725 - RNA, 19 nt, Human
cuauuccagcugucccccc

SEQ ID NO: 1398726 - RNA, 16 nt, Human
cuauuccagcuguccc

SEQ ID NO: 1398727 - RNA, 17 nt, Human
cuauuuauauguacaug

SEQ ID NO: 1398728 - RNA, 16 nt, Human
cuauuucacuggagca

SEQ ID NO: 1398729 - RNA, 15 nt, Human
cuauuucacuggagc

SEQ ID NO: 1398730 - RNA, 22 nt, Human
cuauugugcaauguaaauauuu

SEQ ID NO: 1398731 - RNA, 18 nt, Human
cucaacaggccucagggc

SEQ ID NO: 1398732 - RNA, 16 nt, Human
cucaacaggccucagg

SEQ ID NO: 1398733 - RNA, 15 nt, Human
cucaacaggccucag

SEQ ID NO: 1398734 - RNA, 14 nt, Human
cucaacaggccuca

SEQ ID NO: 1398735 - RNA, 14 nt, Human
cucaacacccaguu

SEQ ID NO: 1398736 - RNA, 13 nt, Human
cucaacacccagu

SEQ ID NO: 1398737 - RNA, 23 nt, Human
cucaacaccaugauuccuuuaac

SEQ ID NO: 1398738 - RNA, 17 nt, Human
cucaaaugaugggaagu

SEQ ID NO: 1398739 - RNA, 20 nt, Human
cucaacacccaacugucucg

SEQ ID NO: 1398740 - RNA, 22 nt, Human
cucaacaccaugauuccuuuaa

SEQ ID NO: 1398741 - RNA, 21 nt, Human
cucaacaccaugauuccuuua

SEQ ID NO: 1398742 - RNA, 19 nt, Human
cucaacaccaugauuccuu

SEQ ID NO: 1398743 - RNA, 16 nt, Human
cucaacaccaugauuc

SEQ ID NO: 1398744 - RNA, 22 nt, Human
cucaaaugcggggugggggcag

SEQ ID NO: 1398745 - RNA, 22 nt, Human
cucaaaugaguaacauuugcug

SEQ ID NO: 1398746 - RNA, 21 nt, Human
cucaaaugaguaacauuugcu

SEQ ID NO: 1398747 - RNA, 20 nt, Human
cucaaaugaguaacauuugc

SEQ ID NO: 1398748 - RNA, 16 nt, Human
cucaaaugaguaacau

SEQ ID NO: 1398749 - RNA, 19 nt, Human
cucaaaucguccagcgacc

SEQ ID NO: 1398750 - RNA, 23 nt, Human
cucaaauacgugggcauucaaau

SEQ ID NO: 1398751 - RNA, 17 nt, Human
cuauuucauguuuuuga

SEQ ID NO: 1398752 - RNA, 15 nt, Human
cuauuucauguuuuu

SEQ ID NO: 1398753 - RNA, 17 nt, Human
cuauuucacuggagcac

SEQ ID NO: 1398754 - RNA, 22 nt, Human
cucugggcuggaugagcuccca

SEQ ID NO: 1398755 - RNA, 21 nt, Human
cucugggcuggaugagcuccc

SEQ ID NO: 1398756 - RNA, 20 nt, Human
cucugggcuggaugagcucc

SEQ ID NO: 1398757 - RNA, 19 nt, Human
cucugggcuggaugagcuc

SEQ ID NO: 1398758 - RNA, 16 nt, Human
cucugggcuggaugag

SEQ ID NO: 1398759 - RNA, 15 nt, Human
cucugggcuggauga

SEQ ID NO: 1398760 - RNA, 13 nt, Human
cucugggcucuga

SEQ ID NO: 1398761 - RNA, 15 nt, Human
cucugggcucugagu

SEQ ID NO: 1398762 - RNA, 11 nt, Human
cucugggcucu

SEQ ID NO: 1398763 - RNA, 20 nt, Human
cucugggccauucuccacag

SEQ ID NO: 1398764 - RNA, 21 nt, Human
cucugggggcugaggagcagc

SEQ ID NO: 1398765 - RNA, 16 nt, Human
cucugucuuguguuuc

SEQ ID NO: 1398766 - RNA, 15 nt, Human
cucugucuuguguuu

SEQ ID NO: 1398767 - RNA, 19 nt, Human
cucugucuacuugcucagg

SEQ ID NO: 1398768 - RNA, 18 nt, Human
cucugucgcccaugcugg

SEQ ID NO: 1398769 - RNA, 20 nt, Human
cucugucgcccaugcuggag

SEQ ID NO: 1398770 - RNA, 16 nt, Human
cucugggggcugagga

SEQ ID NO: 1398771 - RNA, 23 nt, Human
cucuggcauuagaauuauuuaaa

SEQ ID NO: 1398772 - RNA, 20 nt, Human
cucuggcauuagaauuauuu

SEQ ID NO: 1398773 - RNA, 13 nt, Human
cucuggcagccac

SEQ ID NO: 1398774 - RNA, 11 nt, Human
cucuggcagcc

SEQ ID NO: 1398775 - RNA, 19 nt, Human
cucuggcauuagaauuauu

SEQ ID NO: 1398776 - RNA, 18 nt, Human
cucuggcauuagaauuau

SEQ ID NO: 1398777 - RNA, 16 nt, Human
cucuggcagccacacu

SEQ ID NO: 1398778 - RNA, 15 nt, Human
cucuggcagccacac

SEQ ID NO: 1398779 - RNA, 14 nt, Human
cucuggcagccaca

SEQ ID NO: 1398780 - RNA, 15 nt, Human
cucugccuacagaac

SEQ ID NO: 1398781 - RNA, 13 nt, Human
cucugccaguccu

SEQ ID NO: 1398782 - RNA, 19 nt, Human
cucuggauuauauuaugaa

SEQ ID NO: 1398783 - RNA, 20 nt, Human
cucuggauuauauuaugaag

SEQ ID NO: 1398784 - RNA, 21 nt, Human
cucuuccuuacuuuuuauaua

SEQ ID NO: 1398785 - RNA, 15 nt, Human
cucuuccuucccugc

SEQ ID NO: 1398786 - RNA, 16 nt, Human
cucuuccuuuuaucag

SEQ ID NO: 1398787 - RNA, 23 nt, Human
cucuuccuugaagaacugcaggc

SEQ ID NO: 1398788 - RNA, 19 nt, Human
cucuuccuucccugcugug

SEQ ID NO: 1398789 - RNA, 19 nt, Human
cucuucuauuuuguaaacu

SEQ ID NO: 1398790 - RNA, 17 nt, Human
cucuucuauuuuguaaa

SEQ ID NO: 1398791 - RNA, 22 nt, Human
cucuucuacucacuuuucccac

SEQ ID NO: 1398792 - RNA, 18 nt, Human
cucuucuacucacuuuuc

SEQ ID NO: 1398793 - RNA, 14 nt, Human
cucuucuacucacu

SEQ ID NO: 1398794 - RNA, 13 nt, Human
cucuuccuuucuu

SEQ ID NO: 1398795 - RNA, 16 nt, Human
cucuucccccucuccc

SEQ ID NO: 1398796 - RNA, 15 nt, Human
cucuucccccucucc

SEQ ID NO: 1398797 - RNA, 15 nt, Human
cucuucccccaagau

SEQ ID NO: 1398798 - RNA, 15 nt, Human
cucuucccccaccac

SEQ ID NO: 1398799 - RNA, 14 nt, Human
cucuucccccaaga

SEQ ID NO: 1398800 - RNA, 22 nt, Human
cucuuccccagacgccuggcug

SEQ ID NO: 1398801 - RNA, 21 nt, Human
cucuuccccagacgccuggcu

SEQ ID NO: 1398802 - RNA, 16 nt, Human
cucuuccccagacgcc

SEQ ID NO: 1398803 - RNA, 14 nt, Human
cucuuccccagacg

SEQ ID NO: 1398804 - RNA, 16 nt, Human
cucuuccaugcugugc

SEQ ID NO: 1398805 - RNA, 12 nt, Human
cucuuccccaga

SEQ ID NO: 1398806 - RNA, 15 nt, Human
cucuuccaugcugug

SEQ ID NO: 1398807 - RNA, 14 nt, Human
cucuuccaugcugu

SEQ ID NO: 1398808 - RNA, 12 nt, Human
cucuuaauugcc

SEQ ID NO: 1398809 - RNA, 14 nt, Human
cucuuccaguuugc

SEQ ID NO: 1398810 - RNA, 23 nt, Human
cucuuaauugccaccucuaacag

SEQ ID NO: 1398811 - RNA, 19 nt, Human
cucuucccccucucccagu

SEQ ID NO: 1398812 - RNA, 20 nt, Human
cucuucccccucucccaguu

SEQ ID NO: 1398813 - RNA, 18 nt, Human
cucuucccccucucccag

SEQ ID NO: 1398814 - RNA, 17 nt, Human
cucuucccccucuccca

SEQ ID NO: 1398815 - RNA, 13 nt, Human
cucuuccucuucc

SEQ ID NO: 1398816 - RNA, 19 nt, Human
cucugugaccaaugucuug

SEQ ID NO: 1398817 - RNA, 18 nt, Human
cucugugaccaaugucuu

SEQ ID NO: 1398818 - RNA, 17 nt, Human
cucugugaccaaugucu

SEQ ID NO: 1398819 - RNA, 15 nt, Human
cucugugaccaaugu

SEQ ID NO: 1398820 - RNA, 14 nt, Human
cucugugaccaaug

SEQ ID NO: 1398821 - RNA, 21 nt, Human
cucuguugccaggcuggagug

SEQ ID NO: 1398822 - RNA, 17 nt, Human
cucugugugcacaaaua

SEQ ID NO: 1398823 - RNA, 15 nt, Human
cucugugugcacaaa

SEQ ID NO: 1398824 - RNA, 23 nt, Human
cucugugucuaagauucuagauc

SEQ ID NO: 1398825 - RNA, 22 nt, Human
cucugugucuaagauucuagau

SEQ ID NO: 1398826 - RNA, 21 nt, Human
cucugugucuaagauucuaga

SEQ ID NO: 1398827 - RNA, 19 nt, Human
cucugugucuaagauucua

SEQ ID NO: 1398828 - RNA, 18 nt, Human
cucugugucuaagauucu

SEQ ID NO: 1398829 - RNA, 15 nt, Human
cucugugucuaagau

SEQ ID NO: 1398830 - RNA, 16 nt, Human
cucuguuuuacaaguu

SEQ ID NO: 1398831 - RNA, 21 nt, Human
cucuguugucguaaagauuug

SEQ ID NO: 1398832 - RNA, 23 nt, Human
cucuguuuuacaaguuggaguca

SEQ ID NO: 1398833 - RNA, 22 nt, Human
cucuguuuuacaaguuggaguc

SEQ ID NO: 1398834 - RNA, 20 nt, Human
cucuguuuuacaaguuggag

SEQ ID NO: 1398835 - RNA, 19 nt, Human
cucuuaagaagacugcauu

SEQ ID NO: 1398836 - RNA, 22 nt, Human
cucugaggugccugucccaccc

SEQ ID NO: 1398837 - RNA, 19 nt, Human
cucugaggugccuguccca

SEQ ID NO: 1398838 - RNA, 15 nt, Human
cucugaggugccugu

SEQ ID NO: 1398839 - RNA, 12 nt, Human
cucugaggacaa

SEQ ID NO: 1398840 - RNA, 17 nt, Human
cucugagagucuagauu

SEQ ID NO: 1398841 - RNA, 16 nt, Human
cucugagcugugcagg

SEQ ID NO: 1398842 - RNA, 16 nt, Human
cucugagagucuagau

SEQ ID NO: 1398843 - RNA, 15 nt, Human
cucugagagucuaga

SEQ ID NO: 1398844 - RNA, 13 nt, Human
cucugagagucua

SEQ ID NO: 1398845 - RNA, 18 nt, Human
cucugagaggcccuggau

SEQ ID NO: 1398846 - RNA, 17 nt, Human
cucugagaggcccugga

SEQ ID NO: 1398847 - RNA, 16 nt, Human
cucugagaggcccugg

SEQ ID NO: 1398848 - RNA, 15 nt, Human
cucugagaggcccug

SEQ ID NO: 1398849 - RNA, 14 nt, Human
cucugagaggcccu

SEQ ID NO: 1398850 - RNA, 13 nt, Human
cucugagaggccc

SEQ ID NO: 1398851 - RNA, 14 nt, Human
cucugaccugcacu

SEQ ID NO: 1398852 - RNA, 12 nt, Human
cucugaccugca

SEQ ID NO: 1398853 - RNA, 23 nt, Human
cucugacauuaugugguuuuaga

SEQ ID NO: 1398854 - RNA, 23 nt, Human
cucugacagcagcaucucuaccu

SEQ ID NO: 1398855 - RNA, 18 nt, Human
cucugacagcagcaucuc

SEQ ID NO: 1398856 - RNA, 17 nt, Human
cucugacagcagcaucu

SEQ ID NO: 1398857 - RNA, 14 nt, Human
cucugacagcagca

SEQ ID NO: 1398858 - RNA, 13 nt, Human
cucugacagcagc

SEQ ID NO: 1398859 - RNA, 12 nt, Human
cucugacagcag

SEQ ID NO: 1398860 - RNA, 16 nt, Human
cucugacucagggcuc

SEQ ID NO: 1398861 - RNA, 15 nt, Human
cucugacucagggcu

SEQ ID NO: 1398862 - RNA, 14 nt, Human
cucugacucagggc

SEQ ID NO: 1398863 - RNA, 15 nt, Human
cucugaccugcacug

SEQ ID NO: 1398864 - RNA, 21 nt, Human
cucugacucagggcuccuggg

SEQ ID NO: 1398865 - RNA, 20 nt, Human
cucugacucagggcuccugg

SEQ ID NO: 1398866 - RNA, 17 nt, Human
cucugacucagggcucc

SEQ ID NO: 1398867 - RNA, 12 nt, Human
cucgcugccagc

SEQ ID NO: 1398868 - RNA, 19 nt, Human
cucugaauuugagauacaa

SEQ ID NO: 1398869 - RNA, 19 nt, Human
cucugaaggguaauuauau

SEQ ID NO: 1398870 - RNA, 20 nt, Human
cucugcccaacccuucccuc

SEQ ID NO: 1398871 - RNA, 14 nt, Human
cucugcccaacccu

SEQ ID NO: 1398872 - RNA, 18 nt, Human
cucugccaguccuguccu

SEQ ID NO: 1398873 - RNA, 14 nt, Human
cucugcccgggagc

SEQ ID NO: 1398874 - RNA, 20 nt, Human
cucugcccgggagcucagga

SEQ ID NO: 1398875 - RNA, 20 nt, Human
cucugccagugacagacagg

SEQ ID NO: 1398876 - RNA, 15 nt, Human
cucugccagugacag

SEQ ID NO: 1398877 - RNA, 14 nt, Human
cucugccagugaca

SEQ ID NO: 1398878 - RNA, 13 nt, Human
cucugccagugac

SEQ ID NO: 1398879 - RNA, 17 nt, Human
cucugccaguccugucc

SEQ ID NO: 1398880 - RNA, 15 nt, Human
cucugccaguccugu

SEQ ID NO: 1398881 - RNA, 14 nt, Human
cucugccaguccug

SEQ ID NO: 1398882 - RNA, 21 nt, Human
cucugccaaaggaugugauau

SEQ ID NO: 1398883 - RNA, 19 nt, Human
cucugccaaaggaugugau

SEQ ID NO: 1398884 - RNA, 14 nt, Human
cucugccaaaggau

SEQ ID NO: 1398885 - RNA, 15 nt, Human
cucugcauucuagua

SEQ ID NO: 1398886 - RNA, 14 nt, Human
cucugcauucuagu

SEQ ID NO: 1398887 - RNA, 20 nt, Human
cucugcauccucuggagcca

SEQ ID NO: 1398888 - RNA, 18 nt, Human
cucugcauccucuggagc

SEQ ID NO: 1398889 - RNA, 17 nt, Human
cucugcauccucuggag

SEQ ID NO: 1398890 - RNA, 21 nt, Human
cucugcaggucccuaauaaag

SEQ ID NO: 1398891 - RNA, 22 nt, Human
cucugcaggucccuaauaaagc

SEQ ID NO: 1398892 - RNA, 19 nt, Human
cucugcaggucccuaauaa

SEQ ID NO: 1398893 - RNA, 20 nt, Human
cucugcaggucccuaauaaa

SEQ ID NO: 1398894 - RNA, 14 nt, Human
cucugauaagagaa

SEQ ID NO: 1398895 - RNA, 22 nt, Human
cucugaguguuuuaugagaaag

SEQ ID NO: 1398896 - RNA, 19 nt, Human
cucugaguguuuuaugaga

SEQ ID NO: 1398897 - RNA, 17 nt, Human
cucugaguguuuuauga

SEQ ID NO: 1398898 - RNA, 12 nt, Human
cucugaguguga

SEQ ID NO: 1398899 - RNA, 15 nt, Human
cucugauacagaaaa

SEQ ID NO: 1398900 - RNA, 23 nt, Human
cucuucugagcuauuucaucuau

SEQ ID NO: 1398901 - RNA, 22 nt, Human
cucuucugagcuauuucaucua

SEQ ID NO: 1398902 - RNA, 21 nt, Human
cucuucugagcuauuucaucu

SEQ ID NO: 1398903 - RNA, 18 nt, Human
cucuucugagcuauuuca

SEQ ID NO: 1398904 - RNA, 15 nt, Human
cucuucugagcuauu

SEQ ID NO: 1398905 - RNA, 10 nt, Human
cucuucugaa

SEQ ID NO: 1398906 - RNA, 16 nt, Human
cucuucugaauaaagc

SEQ ID NO: 1398907 - RNA, 19 nt, Human
cucuucugaauaaagcaau

SEQ ID NO: 1398908 - RNA, 12 nt, Human
cucuucugagcu

SEQ ID NO: 1398909 - RNA, 20 nt, Human
cucuucugaauaaagcaauu

SEQ ID NO: 1398910 - RNA, 21 nt, Human
cucuuuuacccuggccccucu

SEQ ID NO: 1398911 - RNA, 23 nt, Human
cucuuuuacccuggccccucucc

SEQ ID NO: 1398912 - RNA, 20 nt, Human
cucuuuuacccuggccccuc

SEQ ID NO: 1398913 - RNA, 14 nt, Human
cucuuuuacccugg

SEQ ID NO: 1398914 - RNA, 20 nt, Human
cucuuuguuuugugucucuu

SEQ ID NO: 1398915 - RNA, 18 nt, Human
cucuuuguuuugugucuc

SEQ ID NO: 1398916 - RNA, 12 nt, Human
cucuuuguaaga

SEQ ID NO: 1398917 - RNA, 18 nt, Human
cucuuuguuauuugaaaa

SEQ ID NO: 1398918 - RNA, 16 nt, Human
cugaacaagaauugga

SEQ ID NO: 1398919 - RNA, 14 nt, Human
cugaacaagaauug

SEQ ID NO: 1398920 - RNA, 13 nt, Human
cugaacaagaauu

SEQ ID NO: 1398921 - RNA, 12 nt, Human
cugaacaagaau

SEQ ID NO: 1398922 - RNA, 19 nt, Human
cugaaauuuuucuucuuga

SEQ ID NO: 1398923 - RNA, 16 nt, Human
cugaaauuuuucuucu

SEQ ID NO: 1398924 - RNA, 20 nt, Human
cugaaauuuuucuucuugag

SEQ ID NO: 1398925 - RNA, 22 nt, Human
cugaaauuuuauaugcuuacug

SEQ ID NO: 1398926 - RNA, 18 nt, Human
cugaaauuccaaagucuc

SEQ ID NO: 1398927 - RNA, 19 nt, Human
cugaaauucuccuggaggu

SEQ ID NO: 1398928 - RNA, 18 nt, Human
cugaaauucuccuggagg

SEQ ID NO: 1398929 - RNA, 17 nt, Human
cugaaauucuccuggag

SEQ ID NO: 1398930 - RNA, 16 nt, Human
cugaaauucuccugga

SEQ ID NO: 1398931 - RNA, 15 nt, Human
cugaaauucuccugg

SEQ ID NO: 1398932 - RNA, 14 nt, Human
cugaaauucuccug

SEQ ID NO: 1398933 - RNA, 20 nt, Human
cugaaauuccaaagucucua

SEQ ID NO: 1398934 - RNA, 17 nt, Human
cugaaauuccaaagucu

SEQ ID NO: 1398935 - RNA, 16 nt, Human
cugaaauuccaaaguc

SEQ ID NO: 1398936 - RNA, 15 nt, Human
cugaaauuccaaagu

SEQ ID NO: 1398937 - RNA, 14 nt, Human
cugaaauuccaaag

SEQ ID NO: 1398938 - RNA, 13 nt, Human
cugaaauuccaaa

SEQ ID NO: 1398939 - RNA, 12 nt, Human
cugaaauuccaa

SEQ ID NO: 1398940 - RNA, 20 nt, Human
cugaaauaaacgucuuaaau

SEQ ID NO: 1398941 - RNA, 20 nt, Human
cugaacaucugaguccugga

SEQ ID NO: 1398942 - RNA, 23 nt, Human
cugaacaucugaguccuggauga

SEQ ID NO: 1398943 - RNA, 19 nt, Human
cugaacaucugaguccugg

SEQ ID NO: 1398944 - RNA, 15 nt, Human
cugaacaucugaguc

SEQ ID NO: 1398945 - RNA, 11 nt, Human
cugaacaccau

SEQ ID NO: 1398946 - RNA, 15 nt, Human
cugaaccccagggcu

SEQ ID NO: 1398947 - RNA, 14 nt, Human
cugaaccccagggc

SEQ ID NO: 1398948 - RNA, 16 nt, Human
cugaaccccagggcug

SEQ ID NO: 1398949 - RNA, 12 nt, Human
cugaacuuugcu

SEQ ID NO: 1398950 - RNA, 22 nt, Human
cugaagaaccaguccccccacc

SEQ ID NO: 1398951 - RNA, 15 nt, Human
cugaagaaccagucc

SEQ ID NO: 1398952 - RNA, 14 nt, Human
cugaagaaccaguc

SEQ ID NO: 1398953 - RNA, 13 nt, Human
cugaacuuugcug

SEQ ID NO: 1398954 - RNA, 14 nt, Human
cugaacuuugcuga

SEQ ID NO: 1398955 - RNA, 21 nt, Human
cugaacuuugcugagccugua

SEQ ID NO: 1398956 - RNA, 14 nt, Human
cugaagaagauggu

SEQ ID NO: 1398957 - RNA, 13 nt, Human
cugaauaaagcaa

SEQ ID NO: 1398958 - RNA, 14 nt, Human
cugaauaaagcaau

SEQ ID NO: 1398959 - RNA, 22 nt, Human
cugaaugucauugaaaaacuaa

SEQ ID NO: 1398960 - RNA, 20 nt, Human
cugaaugcuucuaaguaaau

SEQ ID NO: 1398961 - RNA, 18 nt, Human
cugaaugcuucuaaguaa

SEQ ID NO: 1398962 - RNA, 15 nt, Human
cugaaugcuucuaag

SEQ ID NO: 1398963 - RNA, 14 nt, Human
cugaaugcuucuaa

SEQ ID NO: 1398964 - RNA, 13 nt, Human
cugaaugcuucua

SEQ ID NO: 1398965 - RNA, 20 nt, Human
cugaaugaggucagcauguc

SEQ ID NO: 1398966 - RNA, 18 nt, Human
cugaauaaaguguaacaa

SEQ ID NO: 1398967 - RNA, 15 nt, Human
cugaauaaagcaauu

SEQ ID NO: 1398968 - RNA, 20 nt, Human
cugaauguuuuucuaaagga

SEQ ID NO: 1398969 - RNA, 23 nt, Human
cugaauguuuuucuaaaggaguu

SEQ ID NO: 1398970 - RNA, 18 nt, Human
cugaauguuuuucuaaag

SEQ ID NO: 1398971 - RNA, 17 nt, Human
cugaauguuuuucuaaa

SEQ ID NO: 1398972 - RNA, 16 nt, Human
cugaauguuuuucuaa

SEQ ID NO: 1398973 - RNA, 15 nt, Human
cugaauguuuuucua

SEQ ID NO: 1398974 - RNA, 14 nt, Human
cugaauguuuuucu

SEQ ID NO: 1398975 - RNA, 19 nt, Human
cugaauguugggacugcua

SEQ ID NO: 1398976 - RNA, 16 nt, Human
cugaauguugggacug

SEQ ID NO: 1398977 - RNA, 15 nt, Human
cugaauguugggacu

SEQ ID NO: 1398978 - RNA, 12 nt, Human
cugaauuauuuu

SEQ ID NO: 1398979 - RNA, 12 nt, Human
cugaauuucuuu

SEQ ID NO: 1398980 - RNA, 15 nt, Human
cugaauuaugaaacu

SEQ ID NO: 1398981 - RNA, 14 nt, Human
cugaauuaugaaac

SEQ ID NO: 1398982 - RNA, 17 nt, Human
cugaauuaucuauuuca

SEQ ID NO: 1398983 - RNA, 13 nt, Human
cugaauuaugaaa

SEQ ID NO: 1398984 - RNA, 16 nt, Human
cugagcacugccagga

SEQ ID NO: 1398985 - RNA, 15 nt, Human
cugagcacugccagg

SEQ ID NO: 1398986 - RNA, 14 nt, Human
cugagcacugccag

SEQ ID NO: 1398987 - RNA, 13 nt, Human
cugagcacugcca

SEQ ID NO: 1398988 - RNA, 18 nt, Human
cugagcagcgagccugcu

SEQ ID NO: 1398989 - RNA, 17 nt, Human
cugagcagcgagccugc

SEQ ID NO: 1398990 - RNA, 16 nt, Human
cugagcagcgagccug

SEQ ID NO: 1398991 - RNA, 22 nt, Human
cugagcacugccaggagggaca

SEQ ID NO: 1398992 - RNA, 18 nt, Human
cugagcacugccaggagg

SEQ ID NO: 1398993 - RNA, 17 nt, Human
cugagcacugccaggag

SEQ ID NO: 1398994 - RNA, 12 nt, Human
cugagcacuguu

SEQ ID NO: 1398995 - RNA, 19 nt, Human
cugagcacugccaggaggg

SEQ ID NO: 1398996 - RNA, 20 nt, Human
cugagcacuguuuauacacu

SEQ ID NO: 1398997 - RNA, 16 nt, Human
cugagcacuguuuaua

SEQ ID NO: 1398998 - RNA, 20 nt, Human
cugagcagugaaugauucag

SEQ ID NO: 1398999 - RNA, 22 nt, Human
cugagcaguccuuggccugcua

SEQ ID NO: 1399000 - RNA, 21 nt, Human
cugagcaguccuuggccugcu

SEQ ID NO: 1399001 - RNA, 18 nt, Human
cugagcaguccuuggccu

SEQ ID NO: 1399002 - RNA, 17 nt, Human
cugagcaguccuuggcc

SEQ ID NO: 1399003 - RNA, 15 nt, Human
cugagcaguccuugg

SEQ ID NO: 1399004 - RNA, 23 nt, Human
cugagcagggccggggaacuggc

SEQ ID NO: 1399005 - RNA, 12 nt, Human
cugagcagggcc

SEQ ID NO: 1399006 - RNA, 15 nt, Human
cugagcaggccacac

SEQ ID NO: 1399007 - RNA, 23 nt, Human
cugagcaggccacacuucaaacu

SEQ ID NO: 1399008 - RNA, 13 nt, Human
cugagcaggccac

SEQ ID NO: 1399009 - RNA, 12 nt, Human
cugagcaggcca

SEQ ID NO: 1399010 - RNA, 21 nt, Human
cugagcagggccggggaacug

SEQ ID NO: 1399011 - RNA, 17 nt, Human
cugagcagggccgggga

SEQ ID NO: 1399012 - RNA, 16 nt, Human
cugagcagggccgggg

SEQ ID NO: 1399013 - RNA, 13 nt, Human
cugagcagggccg

SEQ ID NO: 1399014 - RNA, 22 nt, Human
cugagcccagggaggccgaagc

SEQ ID NO: 1399015 - RNA, 17 nt, Human
cugagcccagggaggcc

SEQ ID NO: 1399016 - RNA, 16 nt, Human
cugagcccagggaggc

SEQ ID NO: 1399017 - RNA, 15 nt, Human
cugagcccagggagg

SEQ ID NO: 1399018 - RNA, 14 nt, Human
cugagcccagggag

SEQ ID NO: 1399019 - RNA, 13 nt, Human
cugagcccaggga

SEQ ID NO: 1399020 - RNA, 12 nt, Human
cugagcccaggg

SEQ ID NO: 1399021 - RNA, 20 nt, Human
cugagcaacucuugauuauc

SEQ ID NO: 1399022 - RNA, 23 nt, Human
cugagcaacgcuauuccagcugu

SEQ ID NO: 1399023 - RNA, 20 nt, Human
cugagcaacgcuauuccagc

SEQ ID NO: 1399024 - RNA, 19 nt, Human
cugagcaacgcuauuccag

SEQ ID NO: 1399025 - RNA, 19 nt, Human
cugagauuuauuaaagaaa

SEQ ID NO: 1399026 - RNA, 18 nt, Human
cugagauuuauuaaagaa

SEQ ID NO: 1399027 - RNA, 17 nt, Human
cugagauuuauuaaaga

SEQ ID NO: 1399028 - RNA, 15 nt, Human
cugagauuuauuaaa

SEQ ID NO: 1399029 - RNA, 14 nt, Human
cugagauuuauuaa

SEQ ID NO: 1399030 - RNA, 12 nt, Human
cugacugggagu

SEQ ID NO: 1399031 - RNA, 18 nt, Human
cugacugggaccaggcac

SEQ ID NO: 1399032 - RNA, 18 nt, Human
cugacucgguuucuccaa

SEQ ID NO: 1399033 - RNA, 17 nt, Human
cugacucgguuucucca

SEQ ID NO: 1399034 - RNA, 16 nt, Human
cugacucgguuucucc

SEQ ID NO: 1399035 - RNA, 15 nt, Human
cugacucgguuucuc

SEQ ID NO: 1399036 - RNA, 16 nt, Human
cugacucauucugaag

SEQ ID NO: 1399037 - RNA, 21 nt, Human
cugacucagggcuccuggguu

SEQ ID NO: 1399038 - RNA, 19 nt, Human
cugacucagggcuccuggg

SEQ ID NO: 1399039 - RNA, 18 nt, Human
cugacucagggcuccugg

SEQ ID NO: 1399040 - RNA, 16 nt, Human
cugacucagggcuccu

SEQ ID NO: 1399041 - RNA, 22 nt, Human
cugacuaaacuuuuuuucugua

SEQ ID NO: 1399042 - RNA, 19 nt, Human
cugacuaaacuuuuuuucu

SEQ ID NO: 1399043 - RNA, 15 nt, Human
cugacuaaacuuuuu

SEQ ID NO: 1399044 - RNA, 14 nt, Human
cugacuaaacuuuu

SEQ ID NO: 1399045 - RNA, 21 nt, Human
cugagaaaagcuuugaacccu

SEQ ID NO: 1399046 - RNA, 19 nt, Human
cugacuuugcuugcuuuga

SEQ ID NO: 1399047 - RNA, 18 nt, Human
cugacuuugcuugcuuug

SEQ ID NO: 1399048 - RNA, 17 nt, Human
cugacuuugcuugcuuu

SEQ ID NO: 1399049 - RNA, 16 nt, Human
cugacuuugcuugcuu

SEQ ID NO: 1399050 - RNA, 15 nt, Human
cugacuuugcuugcu

SEQ ID NO: 1399051 - RNA, 14 nt, Human
cugacuuugcuugc

SEQ ID NO: 1399052 - RNA, 18 nt, Human
cugacuguagcuuuggaa

SEQ ID NO: 1399053 - RNA, 13 nt, Human
cugacuguagcuu

SEQ ID NO: 1399054 - RNA, 16 nt, Human
cugacggaguccugug

SEQ ID NO: 1399055 - RNA, 21 nt, Human
cugacggccagggagaagcuc

SEQ ID NO: 1399056 - RNA, 20 nt, Human
cugacggccagggagaagcu

SEQ ID NO: 1399057 - RNA, 19 nt, Human
cugacggccagggagaagc

SEQ ID NO: 1399058 - RNA, 15 nt, Human
cugacggccagggag

SEQ ID NO: 1399059 - RNA, 14 nt, Human
cugacggacucaug

SEQ ID NO: 1399060 - RNA, 19 nt, Human
cugaccagcugcuccgagg

SEQ ID NO: 1399061 - RNA, 16 nt, Human
cugaccagcugcuccg

SEQ ID NO: 1399062 - RNA, 23 nt, Human
cugacgacuugagugcucaguag

SEQ ID NO: 1399063 - RNA, 13 nt, Human
cugaccagcugcu

SEQ ID NO: 1399064 - RNA, 22 nt, Human
cugaccagcucccccucccucc

SEQ ID NO: 1399065 - RNA, 21 nt, Human
cugaccagcucccccucccuc

SEQ ID NO: 1399066 - RNA, 20 nt, Human
cugaccagcucccccucccu

SEQ ID NO: 1399067 - RNA, 14 nt, Human
cugaccagcucccc

SEQ ID NO: 1399068 - RNA, 13 nt, Human
cugaccagcuccc

SEQ ID NO: 1399069 - RNA, 23 nt, Human
cugaccagccgugagcauguuug

SEQ ID NO: 1399070 - RNA, 20 nt, Human
cugaccagccgugagcaugu

SEQ ID NO: 1399071 - RNA, 18 nt, Human
cugaauuuuuaaacaagu

SEQ ID NO: 1399072 - RNA, 21 nt, Human
cugaauuuuuaaacaaguauu

SEQ ID NO: 1399073 - RNA, 12 nt, Human
cugaauuuuuaa

SEQ ID NO: 1399074 - RNA, 11 nt, Human
cugaauuuuua

SEQ ID NO: 1399075 - RNA, 18 nt, Human
cugaauuaucuauuucau

SEQ ID NO: 1399076 - RNA, 16 nt, Human
cugaauuaugaaacuu

SEQ ID NO: 1399077 - RNA, 14 nt, Human
cugaauuucuuuug

SEQ ID NO: 1399078 - RNA, 21 nt, Human
cugcauccauucuccugagga

SEQ ID NO: 1399079 - RNA, 16 nt, Human
cugcagaaacuacuga

SEQ ID NO: 1399080 - RNA, 22 nt, Human
cugcacuugcgguuccggcaug

SEQ ID NO: 1399081 - RNA, 23 nt, Human
cugcacuugcgguuccggcaugg

SEQ ID NO: 1399082 - RNA, 21 nt, Human
cugcaucuagaggcuuccuuc

SEQ ID NO: 1399083 - RNA, 20 nt, Human
cugcaucuagaggcuuccuu

SEQ ID NO: 1399084 - RNA, 22 nt, Human
cugcauccucuggagccagccg

SEQ ID NO: 1399085 - RNA, 20 nt, Human
cugcauccucuggagccagc

SEQ ID NO: 1399086 - RNA, 18 nt, Human
cugcauccucuggagcca

SEQ ID NO: 1399087 - RNA, 16 nt, Human
cugcauccucuggagc

SEQ ID NO: 1399088 - RNA, 15 nt, Human
cugcauccucuggag

SEQ ID NO: 1399089 - RNA, 19 nt, Human
cugcauccauucuccugag

SEQ ID NO: 1399090 - RNA, 13 nt, Human
cugcauccagccu

SEQ ID NO: 1399091 - RNA, 20 nt, Human
cugcauggcagggggcugcu

SEQ ID NO: 1399092 - RNA, 17 nt, Human
cugcauggcagggggcu

SEQ ID NO: 1399093 - RNA, 14 nt, Human
cugcauggcagggg

SEQ ID NO: 1399094 - RNA, 13 nt, Human
cugcauggcaggg

SEQ ID NO: 1399095 - RNA, 21 nt, Human
cugcaugcccagagacccagc

SEQ ID NO: 1399096 - RNA, 22 nt, Human
cugcaugcccagagacccagcg

SEQ ID NO: 1399097 - RNA, 20 nt, Human
cugcaugcccagagacccag

SEQ ID NO: 1399098 - RNA, 19 nt, Human
cugcaugcccagagaccca

SEQ ID NO: 1399099 - RNA, 17 nt, Human
cugcaugcccagagacc

SEQ ID NO: 1399100 - RNA, 16 nt, Human
cugcaugcccagagac

SEQ ID NO: 1399101 - RNA, 14 nt, Human
cugcaugcccagag

SEQ ID NO: 1399102 - RNA, 13 nt, Human
cugcaugcccaga

SEQ ID NO: 1399103 - RNA, 12 nt, Human
cugcaugcccag

SEQ ID NO: 1399104 - RNA, 23 nt, Human
cugcaugcgagugcucauuucag

SEQ ID NO: 1399105 - RNA, 21 nt, Human
cugcauguacuguauauuaca

SEQ ID NO: 1399106 - RNA, 22 nt, Human
cugcauggcauccuccagcccc

SEQ ID NO: 1399107 - RNA, 21 nt, Human
cugcauggcauccuccagccc

SEQ ID NO: 1399108 - RNA, 19 nt, Human
cugcauggcauccuccagc

SEQ ID NO: 1399109 - RNA, 18 nt, Human
cugcauggcauccuccag

SEQ ID NO: 1399110 - RNA, 17 nt, Human
cugcauggcauccucca

SEQ ID NO: 1399111 - RNA, 16 nt, Human
cugcauggcauccucc

SEQ ID NO: 1399112 - RNA, 23 nt, Human
cugcauggcagggggcugcugcu

SEQ ID NO: 1399113 - RNA, 22 nt, Human
cugcauggcagggggcugcugc

SEQ ID NO: 1399114 - RNA, 21 nt, Human
cugcauggcagggggcugcug

SEQ ID NO: 1399115 - RNA, 12 nt, Human
cugccacacagg

SEQ ID NO: 1399116 - RNA, 14 nt, Human
cugccaccuccugc

SEQ ID NO: 1399117 - RNA, 16 nt, Human
cugccaccuccugccu

SEQ ID NO: 1399118 - RNA, 21 nt, Human
cugccaccuggaccccugcau

SEQ ID NO: 1399119 - RNA, 22 nt, Human
cugccaccuggaccccugcauu

SEQ ID NO: 1399120 - RNA, 20 nt, Human
cugccaccuggaccccugca

SEQ ID NO: 1399121 - RNA, 16 nt, Human
cugccaccuggacccc

SEQ ID NO: 1399122 - RNA, 15 nt, Human
cugccaccuggaccc

SEQ ID NO: 1399123 - RNA, 14 nt, Human
cugccaccuggacc

SEQ ID NO: 1399124 - RNA, 13 nt, Human
cugccaccuggac

SEQ ID NO: 1399125 - RNA, 12 nt, Human
cugccaccugga

SEQ ID NO: 1399126 - RNA, 19 nt, Human
cugccaccuccugccucag

SEQ ID NO: 1399127 - RNA, 20 nt, Human
cugcccauggacaggcuggc

SEQ ID NO: 1399128 - RNA, 18 nt, Human
cugcccauggacaggcug

SEQ ID NO: 1399129 - RNA, 16 nt, Human
cugcccauggacaggc

SEQ ID NO: 1399130 - RNA, 13 nt, Human
cugcccaguugca

SEQ ID NO: 1399131 - RNA, 17 nt, Human
cugcccacucccaggac

SEQ ID NO: 1399132 - RNA, 23 nt, Human
cugccacugaggggggauccagu

SEQ ID NO: 1399133 - RNA, 18 nt, Human
cugccacugaggggggau

SEQ ID NO: 1399134 - RNA, 14 nt, Human
cugccacugagggg

SEQ ID NO: 1399135 - RNA, 19 nt, Human
cugccacucacuaggcccc

SEQ ID NO: 1399136 - RNA, 16 nt, Human
cugccacucacuaggc

SEQ ID NO: 1399137 - RNA, 17 nt, Human
cugccaccugucugucu

SEQ ID NO: 1399138 - RNA, 11 nt, Human
cugccaccugu

SEQ ID NO: 1399139 - RNA, 12 nt, Human
cugccaccuguc

SEQ ID NO: 1399140 - RNA, 13 nt, Human
cugccaccugucu

SEQ ID NO: 1399141 - RNA, 14 nt, Human
cugccaccugucug

SEQ ID NO: 1399142 - RNA, 15 nt, Human
cugccaccugucugu

SEQ ID NO: 1399143 - RNA, 16 nt, Human
cugccaccugucuguc

SEQ ID NO: 1399144 - RNA, 18 nt, Human
cugccaccugucugucug

SEQ ID NO: 1399145 - RNA, 15 nt, Human
cugccgcgcagugug

SEQ ID NO: 1399146 - RNA, 17 nt, Human
cugccccucucaccaaa

SEQ ID NO: 1399147 - RNA, 13 nt, Human
cugccccucucac

SEQ ID NO: 1399148 - RNA, 12 nt, Human
cugccccaacuc

SEQ ID NO: 1399149 - RNA, 17 nt, Human
cugccuauuaucuguca

SEQ ID NO: 1399150 - RNA, 19 nt, Human
cugccuagauucagggaaa

SEQ ID NO: 1399151 - RNA, 23 nt, Human
cugccuagauucagggaaagugg

SEQ ID NO: 1399152 - RNA, 15 nt, Human
cugccuagauucagg

SEQ ID NO: 1399153 - RNA, 23 nt, Human
cugccuagaaacaacacuguagu

SEQ ID NO: 1399154 - RNA, 21 nt, Human
cugccuagaaacaacacugua

SEQ ID NO: 1399155 - RNA, 20 nt, Human
cugccuagaaacaacacugu

SEQ ID NO: 1399156 - RNA, 18 nt, Human
cugccuagaaacaacacu

SEQ ID NO: 1399157 - RNA, 15 nt, Human
cugccuagaaacaac

SEQ ID NO: 1399158 - RNA, 14 nt, Human
cugccuagaaacaa

SEQ ID NO: 1399159 - RNA, 23 nt, Human
cugccuacagaacuucagaaaga

SEQ ID NO: 1399160 - RNA, 20 nt, Human
cugccuacagaacuucagaa

SEQ ID NO: 1399161 - RNA, 16 nt, Human
cugccggcuccuuggu

SEQ ID NO: 1399162 - RNA, 10 nt, Human
cugccucagg

SEQ ID NO: 1399163 - RNA, 18 nt, Human
cugccucagccucccaag

SEQ ID NO: 1399164 - RNA, 23 nt, Human
cugccuauuaucugucagcugca

SEQ ID NO: 1399165 - RNA, 13 nt, Human
cugccuauuuuaa

SEQ ID NO: 1399166 - RNA, 11 nt, Human
cugccucagga

SEQ ID NO: 1399167 - RNA, 15 nt, Human
cugccucucugcagg

SEQ ID NO: 1399168 - RNA, 16 nt, Human
cugccucucugcaggu

SEQ ID NO: 1399169 - RNA, 17 nt, Human
cugccucucugcagguc

SEQ ID NO: 1399170 - RNA, 18 nt, Human
cugccucucugcaggucc

SEQ ID NO: 1399171 - RNA, 19 nt, Human
cugcgugacaauaaaacau

SEQ ID NO: 1399172 - RNA, 16 nt, Human
cugccuuugccaggug

SEQ ID NO: 1399173 - RNA, 15 nt, Human
cugccuuugccaggu

SEQ ID NO: 1399174 - RNA, 14 nt, Human
cugccuuugccagg

SEQ ID NO: 1399175 - RNA, 21 nt, Human
cugccuuuccauccauggcca

SEQ ID NO: 1399176 - RNA, 22 nt, Human
cugccuuuccauccauggccag

SEQ ID NO: 1399177 - RNA, 20 nt, Human
cugccuuuccauccauggcc

SEQ ID NO: 1399178 - RNA, 15 nt, Human
cugccuuuccaucca

SEQ ID NO: 1399179 - RNA, 24 nt, Human
cugccuuuauuguguuugucauua

SEQ ID NO: 1399180 - RNA, 22 nt, Human
cugccuuuauuguguuugucau

SEQ ID NO: 1399181 - RNA, 17 nt, Human
cugccuuugccagguga

SEQ ID NO: 1399182 - RNA, 18 nt, Human
cugccuuugccaggugac

SEQ ID NO: 1399183 - RNA, 18 nt, Human
cugccuuuggcagaguuc

SEQ ID NO: 1399184 - RNA, 18 nt, Human
cugcggcccaauccaagg

SEQ ID NO: 1399185 - RNA, 23 nt, Human
cugcggaggaaggaggacccagg

SEQ ID NO: 1399186 - RNA, 11 nt, Human
cugccuggacc

SEQ ID NO: 1399187 - RNA, 15 nt, Human
cugccugcccuggug

SEQ ID NO: 1399188 - RNA, 20 nt, Human
cugccuggaagagcagcccu

SEQ ID NO: 1399189 - RNA, 14 nt, Human
cugccugcccuggu

SEQ ID NO: 1399190 - RNA, 19 nt, Human
cugccucucugcagguccc

SEQ ID NO: 1399191 - RNA, 17 nt, Human
cugccuugaaaaagaca

SEQ ID NO: 1399192 - RNA, 23 nt, Human
cugccuucgcuucuugccucugu

SEQ ID NO: 1399193 - RNA, 21 nt, Human
cugccuucgcuucuugccucu

SEQ ID NO: 1399194 - RNA, 22 nt, Human
cugccuggaggaccugagccug

SEQ ID NO: 1399195 - RNA, 23 nt, Human
cugccuggaggaccugagccugc

SEQ ID NO: 1399196 - RNA, 21 nt, Human
cugccuggaggaccugagccu

SEQ ID NO: 1399197 - RNA, 20 nt, Human
cugccuggaggaccugagcc

SEQ ID NO: 1399198 - RNA, 19 nt, Human
cugccuggaggaccugagc

SEQ ID NO: 1399199 - RNA, 18 nt, Human
cugccuggaggaccugag

SEQ ID NO: 1399200 - RNA, 17 nt, Human
cugccuggaggaccuga

SEQ ID NO: 1399201 - RNA, 16 nt, Human
cugccuggaggaccug

SEQ ID NO: 1399202 - RNA, 15 nt, Human
cugccuggaggaccu

SEQ ID NO: 1399203 - RNA, 12 nt, Human
cugccuggagga

SEQ ID NO: 1399204 - RNA, 11 nt, Human
cugccuggagg

SEQ ID NO: 1399205 - RNA, 13 nt, Human
cugccuggacccg

SEQ ID NO: 1399206 - RNA, 17 nt, Human
cugccuggaccagccuc

SEQ ID NO: 1399207 - RNA, 22 nt, Human
cugccuggagacuuagggcacc

SEQ ID NO: 1399208 - RNA, 10 nt, Human
cugccuggag

SEQ ID NO: 1399209 - RNA, 12 nt, Human
cugccuggaccc

SEQ ID NO: 1399210 - RNA, 22 nt, Human
cugccuggacuuggccccugcc

SEQ ID NO: 1399211 - RNA, 23 nt, Human
cugccuggacuuggccccugcca

SEQ ID NO: 1399212 - RNA, 19 nt, Human
cugagcccgguaagagcaa

SEQ ID NO: 1399213 - RNA, 20 nt, Human
cugagcccgguaagagcaaa

SEQ ID NO: 1399214 - RNA, 18 nt, Human
cugagccccagggagagg

SEQ ID NO: 1399215 - RNA, 15 nt, Human
cugagccccagggag

SEQ ID NO: 1399216 - RNA, 13 nt, Human
cugagccccaggg

SEQ ID NO: 1399217 - RNA, 12 nt, Human
cugagccccagg

SEQ ID NO: 1399218 - RNA, 19 nt, Human
cugagcccagggaggccga

SEQ ID NO: 1399219 - RNA, 23 nt, Human
cugaggccugggccgcugccacg

SEQ ID NO: 1399220 - RNA, 22 nt, Human
cugaggccugggccgcugccac

SEQ ID NO: 1399221 - RNA, 19 nt, Human
cugaggccugggccgcugc

SEQ ID NO: 1399222 - RNA, 15 nt, Human
cugaggccugggccg

SEQ ID NO: 1399223 - RNA, 14 nt, Human
cugaggccugggcc

SEQ ID NO: 1399224 - RNA, 22 nt, Human
cugaggccuggacuuuccugca

SEQ ID NO: 1399225 - RNA, 20 nt, Human
cugaggccuggacuuuccug

SEQ ID NO: 1399226 - RNA, 19 nt, Human
cugaggccuggacuuuccu

SEQ ID NO: 1399227 - RNA, 15 nt, Human
cugaggccuggacuu

SEQ ID NO: 1399228 - RNA, 12 nt, Human
cugaggccugga

SEQ ID NO: 1399229 - RNA, 22 nt, Human
cugaggcgagaagggcugcuuc

SEQ ID NO: 1399230 - RNA, 23 nt, Human
cugaggcgccccaacccguggag

SEQ ID NO: 1399231 - RNA, 21 nt, Human
cugagucagagccaugucuuc

SEQ ID NO: 1399232 - RNA, 17 nt, Human
cugagucaggacuugaa

SEQ ID NO: 1399233 - RNA, 19 nt, Human
cugagucagagccaugucu

SEQ ID NO: 1399234 - RNA, 18 nt, Human
cugagucagagccauguc

SEQ ID NO: 1399235 - RNA, 14 nt, Human
cugagucagagcca

SEQ ID NO: 1399236 - RNA, 23 nt, Human
cugagucacccuaccugugccug

SEQ ID NO: 1399237 - RNA, 22 nt, Human
cugagucacccuaccugugccu

SEQ ID NO: 1399238 - RNA, 15 nt, Human
cugagggaucuuuac

SEQ ID NO: 1399239 - RNA, 17 nt, Human
cugagggagccuggccc

SEQ ID NO: 1399240 - RNA, 13 nt, Human
cugagggagccug

SEQ ID NO: 1399241 - RNA, 12 nt, Human
cugagggagccu

SEQ ID NO: 1399242 - RNA, 20 nt, Human
cugaggcuguggucacagcg

SEQ ID NO: 1399243 - RNA, 19 nt, Human
cugaggcuguggucacagc

SEQ ID NO: 1399244 - RNA, 17 nt, Human
cugaggcuguggucaca

SEQ ID NO: 1399245 - RNA, 14 nt, Human
cugaggcugugguc

SEQ ID NO: 1399246 - RNA, 13 nt, Human
cugaggcuguggu

SEQ ID NO: 1399247 - RNA, 20 nt, Human
cugaggcuggcacaggacau

SEQ ID NO: 1399248 - RNA, 19 nt, Human
cugaggcuggcacaggaca

SEQ ID NO: 1399249 - RNA, 18 nt, Human
cugaggcuggcacaggac

SEQ ID NO: 1399250 - RNA, 17 nt, Human
cugaggcuggcacagga

SEQ ID NO: 1399251 - RNA, 12 nt, Human
cugaggcugagg

SEQ ID NO: 1399252 - RNA, 13 nt, Human
cugaggcuggcac

SEQ ID NO: 1399253 - RNA, 11 nt, Human
cugaggcuggc

SEQ ID NO: 1399254 - RNA, 14 nt, Human
cugaggcugaggca

SEQ ID NO: 1399255 - RNA, 17 nt, Human
cugauccuggaggccca

SEQ ID NO: 1399256 - RNA, 15 nt, Human
cugauccuggaggcc

SEQ ID NO: 1399257 - RNA, 12 nt, Human
cugauccuggag

SEQ ID NO: 1399258 - RNA, 15 nt, Human
cugaucccucuacag

SEQ ID NO: 1399259 - RNA, 16 nt, Human
cugaucagaacaaaug

SEQ ID NO: 1399260 - RNA, 20 nt, Human
cugaucagagccgugguccu

SEQ ID NO: 1399261 - RNA, 14 nt, Human
cugaucagagccgu

SEQ ID NO: 1399262 - RNA, 17 nt, Human
cugaucagaccacggcu

SEQ ID NO: 1399263 - RNA, 15 nt, Human
cugauauuuucucua

SEQ ID NO: 1399264 - RNA, 14 nt, Human
cugauauuuucucu

SEQ ID NO: 1399265 - RNA, 15 nt, Human
cugaucaaggccuua

SEQ ID NO: 1399266 - RNA, 12 nt, Human
cugaucaaggcc

SEQ ID NO: 1399267 - RNA, 16 nt, Human
cugauauuuucucuag

SEQ ID NO: 1399268 - RNA, 18 nt, Human
cugauauuuucucuagga

SEQ ID NO: 1399269 - RNA, 18 nt, Human
cugauauauuuuacaauu

SEQ ID NO: 1399270 - RNA, 16 nt, Human
cugauauauuuuacaa

SEQ ID NO: 1399271 - RNA, 18 nt, Human
cugauaauuuuaaauucu

SEQ ID NO: 1399272 - RNA, 17 nt, Human
cugauaauuuuaaauuc

SEQ ID NO: 1399273 - RNA, 15 nt, Human
cugauaauuuuaaau

SEQ ID NO: 1399274 - RNA, 22 nt, Human
cugauacagaaaaguugaauuu

SEQ ID NO: 1399275 - RNA, 17 nt, Human
cugaguuacagaaauga

SEQ ID NO: 1399276 - RNA, 11 nt, Human
cugaguuuccu

SEQ ID NO: 1399277 - RNA, 16 nt, Human
cugaguugcuuuucag

SEQ ID NO: 1399278 - RNA, 15 nt, Human
cugaguugcuuuuca

SEQ ID NO: 1399279 - RNA, 16 nt, Human
cugaguuccugcaugc

SEQ ID NO: 1399280 - RNA, 14 nt, Human
cugaguuccugcau

SEQ ID NO: 1399281 - RNA, 19 nt, Human
cugauaagagaaucaacau

SEQ ID NO: 1399282 - RNA, 11 nt, Human
cugaguuuucc

SEQ ID NO: 1399283 - RNA, 16 nt, Human
cugaguuuuccauggc

SEQ ID NO: 1399284 - RNA, 20 nt, Human
cugaguuuccuaugggaaca

SEQ ID NO: 1399285 - RNA, 19 nt, Human
cugaguuuccuaugggaac

SEQ ID NO: 1399286 - RNA, 12 nt, Human
cugaguuuccua

SEQ ID NO: 1399287 - RNA, 19 nt, Human
cugcacugaugcugccccu

SEQ ID NO: 1399288 - RNA, 18 nt, Human
cugcacugaugcugcccc

SEQ ID NO: 1399289 - RNA, 17 nt, Human
cugcacugaugcugccc

SEQ ID NO: 1399290 - RNA, 15 nt, Human
cugcacugaugcugc

SEQ ID NO: 1399291 - RNA, 23 nt, Human
cugcacaugacucgggggugggg

SEQ ID NO: 1399292 - RNA, 22 nt, Human
cugcacaugacucggggguggg

SEQ ID NO: 1399293 - RNA, 22 nt, Human
cugcacaucuguaaaucuacac

SEQ ID NO: 1399294 - RNA, 18 nt, Human
cugcacaucuguaaaucu

SEQ ID NO: 1399295 - RNA, 15 nt, Human
cugcacaguugaagg

SEQ ID NO: 1399296 - RNA, 23 nt, Human
cugcacaauaacuccucccaggg

SEQ ID NO: 1399297 - RNA, 22 nt, Human
cugcacaauaacuccucccagg

SEQ ID NO: 1399298 - RNA, 21 nt, Human
cugcacaauaacuccucccag

SEQ ID NO: 1399299 - RNA, 20 nt, Human
cugcacaauaacuccuccca

SEQ ID NO: 1399300 - RNA, 16 nt, Human
cugcacaauaacuccu

SEQ ID NO: 1399301 - RNA, 15 nt, Human
cugcacaauaacucc

SEQ ID NO: 1399302 - RNA, 22 nt, Human
cugcacaauaaaaauguuuaac

SEQ ID NO: 1399303 - RNA, 18 nt, Human
cugcacaauaaaaauguu

SEQ ID NO: 1399304 - RNA, 15 nt, Human
cugcacaauaaaaau

SEQ ID NO: 1399305 - RNA, 22 nt, Human
cugcaagugaggugugucacaa

SEQ ID NO: 1399306 - RNA, 19 nt, Human
cugcaagugagguguguca

SEQ ID NO: 1399307 - RNA, 20 nt, Human
cugauuuuuuuuccuuuuaa

SEQ ID NO: 1399308 - RNA, 19 nt, Human
cugauuuuuuuuccuuuua

SEQ ID NO: 1399309 - RNA, 15 nt, Human
cugauuuuuuuuccu

SEQ ID NO: 1399310 - RNA, 21 nt, Human
cugauuuucaaagcuuuuucc

SEQ ID NO: 1399311 - RNA, 18 nt, Human
cugauuuucaaagcuuuu

SEQ ID NO: 1399312 - RNA, 23 nt, Human
cugauuuuaggagcuaaggcucu

SEQ ID NO: 1399313 - RNA, 22 nt, Human
cugauuuuaggagcuaaggcuc

SEQ ID NO: 1399314 - RNA, 21 nt, Human
cugauuuuaggagcuaaggcu

SEQ ID NO: 1399315 - RNA, 19 nt, Human
cugauuuguaacccacuga

SEQ ID NO: 1399316 - RNA, 18 nt, Human
cugauuuguaacccacug

SEQ ID NO: 1399317 - RNA, 14 nt, Human
cugcaaacugggaa

SEQ ID NO: 1399318 - RNA, 13 nt, Human
cugcaaacuggga

SEQ ID NO: 1399319 - RNA, 12 nt, Human
cugcaaacuggg

SEQ ID NO: 1399320 - RNA, 17 nt, Human
cugcaaaaggacucuca

SEQ ID NO: 1399321 - RNA, 23 nt, Human
cugcaaagaucuguccucagccu

SEQ ID NO: 1399322 - RNA, 22 nt, Human
cugcaaagaucuguccucagcc

SEQ ID NO: 1399323 - RNA, 23 nt, Human
cugcaaacugggaaccccuuucc

SEQ ID NO: 1399324 - RNA, 21 nt, Human
cugcaaacugggaaccccuuu

SEQ ID NO: 1399325 - RNA, 16 nt, Human
cugcaaacugggaacc

SEQ ID NO: 1399326 - RNA, 15 nt, Human
cugcaaacugggaac

SEQ ID NO: 1399327 - RNA, 14 nt, Human
cugcaaaaagaaaa

SEQ ID NO: 1399328 - RNA, 18 nt, Human
cugauccuggaggcccag

SEQ ID NO: 1399329 - RNA, 21 nt, Human
cugauuuaggagaagccagga

SEQ ID NO: 1399330 - RNA, 22 nt, Human
cugauuuaggagaagccaggaa

SEQ ID NO: 1399331 - RNA, 20 nt, Human
cugauuuaggagaagccagg

SEQ ID NO: 1399332 - RNA, 18 nt, Human
cugauuuaggagaagcca

SEQ ID NO: 1399333 - RNA, 17 nt, Human
cugauuuaggagaagcc

SEQ ID NO: 1399334 - RNA, 16 nt, Human
cugauuuaggagaagc

SEQ ID NO: 1399335 - RNA, 12 nt, Human
cugauuucuagg

SEQ ID NO: 1399336 - RNA, 23 nt, Human
cugggcugagggagccuggcccc

SEQ ID NO: 1399337 - RNA, 19 nt, Human
cugggcugagggagccugg

SEQ ID NO: 1399338 - RNA, 18 nt, Human
cugggcugagggagccug

SEQ ID NO: 1399339 - RNA, 16 nt, Human
cugggcugagggagcc

SEQ ID NO: 1399340 - RNA, 13 nt, Human
cugggcugaggga

SEQ ID NO: 1399341 - RNA, 12 nt, Human
cugggcugaggg

SEQ ID NO: 1399342 - RNA, 13 nt, Human
cugggcucugagu

SEQ ID NO: 1399343 - RNA, 23 nt, Human
cugggcucugcaauuccccucug

SEQ ID NO: 1399344 - RNA, 22 nt, Human
cugggcucugcaauuccccucu

SEQ ID NO: 1399345 - RNA, 14 nt, Human
cugggcuccuggac

SEQ ID NO: 1399346 - RNA, 15 nt, Human
cugggcuccuggacc

SEQ ID NO: 1399347 - RNA, 13 nt, Human
cugggcuccugga

SEQ ID NO: 1399348 - RNA, 17 nt, Human
cugggcuccuccagggu

SEQ ID NO: 1399349 - RNA, 15 nt, Human
cugggcuccuccagg

SEQ ID NO: 1399350 - RNA, 14 nt, Human
cugggcuccuccag

SEQ ID NO: 1399351 - RNA, 18 nt, Human
cugggccuuaggaagagc

SEQ ID NO: 1399352 - RNA, 14 nt, Human
cugggccuuaggaa

SEQ ID NO: 1399353 - RNA, 23 nt, Human
cugggccuggucucacccuggag

SEQ ID NO: 1399354 - RNA, 19 nt, Human
cugggccuggucucacccu

SEQ ID NO: 1399355 - RNA, 16 nt, Human
cugggccuggucucac

SEQ ID NO: 1399356 - RNA, 15 nt, Human
cugggccuggucuca

SEQ ID NO: 1399357 - RNA, 14 nt, Human
cugggccuggucuc

SEQ ID NO: 1399358 - RNA, 13 nt, Human
cugggccuggucu

SEQ ID NO: 1399359 - RNA, 11 nt, Human
cugggccuggu

SEQ ID NO: 1399360 - RNA, 20 nt, Human
cugggccugcugcugagaac

SEQ ID NO: 1399361 - RNA, 22 nt, Human
cugggccugcugcugagaaccu

SEQ ID NO: 1399362 - RNA, 19 nt, Human
cugggccugcugcugagaa

SEQ ID NO: 1399363 - RNA, 18 nt, Human
cugggccugcugcugaga

SEQ ID NO: 1399364 - RNA, 17 nt, Human
cugggccugcugcugag

SEQ ID NO: 1399365 - RNA, 16 nt, Human
cugggccugcugcuga

SEQ ID NO: 1399366 - RNA, 15 nt, Human
cugggccugcugcug

SEQ ID NO: 1399367 - RNA, 14 nt, Human
cugggccugcugcu

SEQ ID NO: 1399368 - RNA, 13 nt, Human
cugggccugcugc

SEQ ID NO: 1399369 - RNA, 12 nt, Human
cugggccugcug

SEQ ID NO: 1399370 - RNA, 16 nt, Human
cugggccugccucacc

SEQ ID NO: 1399371 - RNA, 15 nt, Human
cugggccugccucac

SEQ ID NO: 1399372 - RNA, 14 nt, Human
cugggccugccuca

SEQ ID NO: 1399373 - RNA, 20 nt, Human
cugggccugaccaaacagcc

SEQ ID NO: 1399374 - RNA, 13 nt, Human
cugggccugcaga

SEQ ID NO: 1399375 - RNA, 11 nt, Human
cugggcccugg

SEQ ID NO: 1399376 - RNA, 15 nt, Human
cugggcaagcuggcg

SEQ ID NO: 1399377 - RNA, 15 nt, Human
cugggcaaagccuag

SEQ ID NO: 1399378 - RNA, 23 nt, Human
cugggauuccuuagacucuuuuc

SEQ ID NO: 1399379 - RNA, 22 nt, Human
cugggauucaggaaaaggccug

SEQ ID NO: 1399380 - RNA, 23 nt, Human
cugggauucaggaaaaggccugg

SEQ ID NO: 1399381 - RNA, 11 nt, Human
cugggauuagg

SEQ ID NO: 1399382 - RNA, 18 nt, Human
cugggcccucucugcucu

SEQ ID NO: 1399383 - RNA, 15 nt, Human
cugggcccucucugc

SEQ ID NO: 1399384 - RNA, 14 nt, Human
cugggcccucucug

SEQ ID NO: 1399385 - RNA, 13 nt, Human
cugggcccucucu

SEQ ID NO: 1399386 - RNA, 20 nt, Human
cugggccccugccucucugc

SEQ ID NO: 1399387 - RNA, 23 nt, Human
cugggccccugccucucugcagg

SEQ ID NO: 1399388 - RNA, 17 nt, Human
cuggguccauaucacac

SEQ ID NO: 1399389 - RNA, 15 nt, Human
cuggguccauaucac

SEQ ID NO: 1399390 - RNA, 13 nt, Human
cuggguccauauc

SEQ ID NO: 1399391 - RNA, 23 nt, Human
cuggguccaauuguggcacuugg

SEQ ID NO: 1399392 - RNA, 20 nt, Human
cuggguccauaucacacaca

SEQ ID NO: 1399393 - RNA, 13 nt, Human
cugggucgcccug

SEQ ID NO: 1399394 - RNA, 20 nt, Human
cugggguauaaaacuuuccu

SEQ ID NO: 1399395 - RNA, 19 nt, Human
cugggguaaguggucuaag

SEQ ID NO: 1399396 - RNA, 22 nt, Human
cuggguuuuguauucucugagc

SEQ ID NO: 1399397 - RNA, 20 nt, Human
cuggguuuuguauucucuga

SEQ ID NO: 1399398 - RNA, 15 nt, Human
cugggucgcccugga

SEQ ID NO: 1399399 - RNA, 16 nt, Human
cugggucgcccuggac

SEQ ID NO: 1399400 - RNA, 20 nt, Human
cugguauauccaaaagcuuu

SEQ ID NO: 1399401 - RNA, 19 nt, Human
cugguauauccaaaagcuu

SEQ ID NO: 1399402 - RNA, 14 nt, Human
cugguaauagcugu

SEQ ID NO: 1399403 - RNA, 18 nt, Human
cugguauauccaaaagcu

SEQ ID NO: 1399404 - RNA, 19 nt, Human
cugguaauauugacuugua

SEQ ID NO: 1399405 - RNA, 15 nt, Human
cugguaauauugacu

SEQ ID NO: 1399406 - RNA, 23 nt, Human
cugguaucucagaaagugccuga

SEQ ID NO: 1399407 - RNA, 22 nt, Human
cugguaucucagaaagugccug

SEQ ID NO: 1399408 - RNA, 19 nt, Human
cugguaucucagaaagugc

SEQ ID NO: 1399409 - RNA, 17 nt, Human
cugguaucucagaaagu

SEQ ID NO: 1399410 - RNA, 15 nt, Human
cugguaucucagaaa

SEQ ID NO: 1399411 - RNA, 14 nt, Human
cugguaucucagaa

SEQ ID NO: 1399412 - RNA, 18 nt, Human
cugguaugaacuugagga

SEQ ID NO: 1399413 - RNA, 20 nt, Human
cugguaugaacuugaggaca

SEQ ID NO: 1399414 - RNA, 21 nt, Human
cugguaugaacuugaggacac

SEQ ID NO: 1399415 - RNA, 22 nt, Human
cugguaugaacuugaggacaca

SEQ ID NO: 1399416 - RNA, 12 nt, Human
cugggcugggaa

SEQ ID NO: 1399417 - RNA, 20 nt, Human
cugggcuggaugagcuccca

SEQ ID NO: 1399418 - RNA, 19 nt, Human
cugggcuggaugagcuccc

SEQ ID NO: 1399419 - RNA, 18 nt, Human
cugggcuggaugagcucc

SEQ ID NO: 1399420 - RNA, 17 nt, Human
cugggcuggaugagcuc

SEQ ID NO: 1399421 - RNA, 16 nt, Human
cugggcuggaugagcu

SEQ ID NO: 1399422 - RNA, 20 nt, Human
cugggcuuauaucuggccuc

SEQ ID NO: 1399423 - RNA, 17 nt, Human
cugggggguggccaggc

SEQ ID NO: 1399424 - RNA, 19 nt, Human
cugggggugccaggaccag

SEQ ID NO: 1399425 - RNA, 15 nt, Human
cugggggugccagga

SEQ ID NO: 1399426 - RNA, 14 nt, Human
cugggggugccagg

SEQ ID NO: 1399427 - RNA, 19 nt, Human
cugggggguggccaggccg

SEQ ID NO: 1399428 - RNA, 16 nt, Human
cugggggguggccagg

SEQ ID NO: 1399429 - RNA, 18 nt, Human
cugggggcugcaguucga

SEQ ID NO: 1399430 - RNA, 14 nt, Human
cugggggcugcagu

SEQ ID NO: 1399431 - RNA, 18 nt, Human
cugggggcugaggagcag

SEQ ID NO: 1399432 - RNA, 23 nt, Human
cugggggccuggcuggcugaggg

SEQ ID NO: 1399433 - RNA, 18 nt, Human
cugggggccuggcuggcu

SEQ ID NO: 1399434 - RNA, 17 nt, Human
cugggggccuggcuggc

SEQ ID NO: 1399435 - RNA, 16 nt, Human
cugggggccuggcugg

SEQ ID NO: 1399436 - RNA, 19 nt, Human
cuggggaaacuggccaugg

SEQ ID NO: 1399437 - RNA, 22 nt, Human
cuggggaaacuggccauggccu

SEQ ID NO: 1399438 - RNA, 17 nt, Human
cuggggaaacuggccau

SEQ ID NO: 1399439 - RNA, 20 nt, Human
cuggggaaaacuccaccuuc

SEQ ID NO: 1399440 - RNA, 22 nt, Human
cugggcuuauaucuggccucug

SEQ ID NO: 1399441 - RNA, 15 nt, Human
cugggggccuggcug

SEQ ID NO: 1399442 - RNA, 14 nt, Human
cugggggccuggcu

SEQ ID NO: 1399443 - RNA, 13 nt, Human
cugggggccuggc

SEQ ID NO: 1399444 - RNA, 12 nt, Human
cugggggccugg

SEQ ID NO: 1399445 - RNA, 16 nt, Human
cugggggccucuucug

SEQ ID NO: 1399446 - RNA, 17 nt, Human
cuguauugucugaacuu

SEQ ID NO: 1399447 - RNA, 14 nt, Human
cuguauugucugaa

SEQ ID NO: 1399448 - RNA, 13 nt, Human
cuguauugucuga

SEQ ID NO: 1399449 - RNA, 20 nt, Human
cuguauuuuguauuguuuca

SEQ ID NO: 1399450 - RNA, 15 nt, Human
cuguauucagacaga

SEQ ID NO: 1399451 - RNA, 16 nt, Human
cuguauucagacagau

SEQ ID NO: 1399452 - RNA, 11 nt, Human
cuguauaaaau

SEQ ID NO: 1399453 - RNA, 17 nt, Human
cuguauaaaaucagcca

SEQ ID NO: 1399454 - RNA, 19 nt, Human
cuguauaaaaucagccaau

SEQ ID NO: 1399455 - RNA, 12 nt, Human
cuguaauugugu

SEQ ID NO: 1399456 - RNA, 16 nt, Human
cuguaauuguguguga

SEQ ID NO: 1399457 - RNA, 17 nt, Human
cuguacaugaaaacaca

SEQ ID NO: 1399458 - RNA, 20 nt, Human
cuguacaugaaaacacauuu

SEQ ID NO: 1399459 - RNA, 21 nt, Human
cuguacaugaaaacacauuuu

SEQ ID NO: 1399460 - RNA, 19 nt, Human
cuguaguucuaagacucaa

SEQ ID NO: 1399461 - RNA, 16 nt, Human
cuguaguucuaagacu

SEQ ID NO: 1399462 - RNA, 14 nt, Human
cuguaguucuaaga

SEQ ID NO: 1399463 - RNA, 13 nt, Human
cuguaguucuaag

SEQ ID NO: 1399464 - RNA, 23 nt, Human
cuguaccuuuugaggagccccag

SEQ ID NO: 1399465 - RNA, 14 nt, Human
cuguacaucuauuu

SEQ ID NO: 1399466 - RNA, 14 nt, Human
cuguaauugcaaaa

SEQ ID NO: 1399467 - RNA, 19 nt, Human
cuguaauugaauauuauuc

SEQ ID NO: 1399468 - RNA, 18 nt, Human
cuguaauugaauauuauu

SEQ ID NO: 1399469 - RNA, 15 nt, Human
cuguaauucagguuu

SEQ ID NO: 1399470 - RNA, 14 nt, Human
cuguaauuugugau

SEQ ID NO: 1399471 - RNA, 15 nt, Human
cuguaauuugugaua

SEQ ID NO: 1399472 - RNA, 20 nt, Human
cuguaaucccagcaugcuga

SEQ ID NO: 1399473 - RNA, 23 nt, Human
cugguuagaaaugcagaauccua

SEQ ID NO: 1399474 - RNA, 14 nt, Human
cugguuagaaaugc

SEQ ID NO: 1399475 - RNA, 15 nt, Human
cugguauuguucuca

SEQ ID NO: 1399476 - RNA, 22 nt, Human
cugguauguaaaagaaaaucca

SEQ ID NO: 1399477 - RNA, 23 nt, Human
cugguaugaacuugaggacacau

SEQ ID NO: 1399478 - RNA, 22 nt, Human
cuggugguggcucgggaggcga

SEQ ID NO: 1399479 - RNA, 14 nt, Human
cuggugguggcucg

SEQ ID NO: 1399480 - RNA, 23 nt, Human
cugguguagcuacagagaaacca

SEQ ID NO: 1399481 - RNA, 21 nt, Human
cugguguagcuacagagaaac

SEQ ID NO: 1399482 - RNA, 20 nt, Human
cugguguagcuacagagaaa

SEQ ID NO: 1399483 - RNA, 12 nt, Human
cugguguagcua

SEQ ID NO: 1399484 - RNA, 19 nt, Human
cugguguagcuacagagaa

SEQ ID NO: 1399485 - RNA, 18 nt, Human
cugguguagcuacagaga

SEQ ID NO: 1399486 - RNA, 17 nt, Human
cugguguagcuacagag

SEQ ID NO: 1399487 - RNA, 15 nt, Human
cugguguagcuacag

SEQ ID NO: 1399488 - RNA, 20 nt, Human
cugugccaggugaggucagc

SEQ ID NO: 1399489 - RNA, 19 nt, Human
cugugccaggugaggucag

SEQ ID NO: 1399490 - RNA, 23 nt, Human
cugugcccccaggguccugggag

SEQ ID NO: 1399491 - RNA, 20 nt, Human
cugugcccccaggguccugg

SEQ ID NO: 1399492 - RNA, 14 nt, Human
cugugcccccaggg

SEQ ID NO: 1399493 - RNA, 13 nt, Human
cugugcccccagg

SEQ ID NO: 1399494 - RNA, 12 nt, Human
cugugcccccag

SEQ ID NO: 1399495 - RNA, 21 nt, Human
cugugccccuuccgccacugg

SEQ ID NO: 1399496 - RNA, 20 nt, Human
cugugccccuuccgccacug

SEQ ID NO: 1399497 - RNA, 18 nt, Human
cugugccccuuccgccac

SEQ ID NO: 1399498 - RNA, 17 nt, Human
cugugccccuuccgcca

SEQ ID NO: 1399499 - RNA, 13 nt, Human
cugugccccuucc

SEQ ID NO: 1399500 - RNA, 22 nt, Human
cugugcccccaggguccuggga

SEQ ID NO: 1399501 - RNA, 19 nt, Human
cugugcccuaaaguguauu

SEQ ID NO: 1399502 - RNA, 21 nt, Human
cugugcagccgcugagcgagg

SEQ ID NO: 1399503 - RNA, 19 nt, Human
cugugcagccgcugagcga

SEQ ID NO: 1399504 - RNA, 17 nt, Human
cugugcagccgcugagc

SEQ ID NO: 1399505 - RNA, 16 nt, Human
cugugcagccgcugag

SEQ ID NO: 1399506 - RNA, 14 nt, Human
cugugcacugccca

SEQ ID NO: 1399507 - RNA, 14 nt, Human
cugugcaccaagca

SEQ ID NO: 1399508 - RNA, 21 nt, Human
cugugcaaccucuuggccuga

SEQ ID NO: 1399509 - RNA, 16 nt, Human
cugugauucagaaaau

SEQ ID NO: 1399510 - RNA, 18 nt, Human
cugugccagagccugggg

SEQ ID NO: 1399511 - RNA, 17 nt, Human
cugugccagagccuggg

SEQ ID NO: 1399512 - RNA, 16 nt, Human
cugugccagagccugg

SEQ ID NO: 1399513 - RNA, 15 nt, Human
cugugccagagccug

SEQ ID NO: 1399514 - RNA, 14 nt, Human
cugugccagagccu

SEQ ID NO: 1399515 - RNA, 13 nt, Human
cugugccagagcc

SEQ ID NO: 1399516 - RNA, 16 nt, Human
cugugcagguucccac

SEQ ID NO: 1399517 - RNA, 17 nt, Human
cugugcagguucccacu

SEQ ID NO: 1399518 - RNA, 14 nt, Human
cugugccaggugag

SEQ ID NO: 1399519 - RNA, 21 nt, Human
cugugccagagccuggggcuc

SEQ ID NO: 1399520 - RNA, 22 nt, Human
cugugccagagccuggggcucu

SEQ ID NO: 1399521 - RNA, 20 nt, Human
cugugccagagccuggggcu

SEQ ID NO: 1399522 - RNA, 19 nt, Human
cugugccagagccuggggc

SEQ ID NO: 1399523 - RNA, 13 nt, Human
cugugauucagaa

SEQ ID NO: 1399524 - RNA, 17 nt, Human
cugugaggcuguccugu

SEQ ID NO: 1399525 - RNA, 16 nt, Human
cugugaggcuguccug

SEQ ID NO: 1399526 - RNA, 15 nt, Human
cugugaggcuguccu

SEQ ID NO: 1399527 - RNA, 12 nt, Human
cugugaggcugu

SEQ ID NO: 1399528 - RNA, 17 nt, Human
cugugagcccagcuggg

SEQ ID NO: 1399529 - RNA, 22 nt, Human
cugugaacccaggacaagcaug

SEQ ID NO: 1399530 - RNA, 19 nt, Human
cugugaacccaggacaagc

SEQ ID NO: 1399531 - RNA, 17 nt, Human
cugugaacccaggacaa

SEQ ID NO: 1399532 - RNA, 16 nt, Human
cugugaacccaggaca

SEQ ID NO: 1399533 - RNA, 15 nt, Human
cugugaacccaggac

SEQ ID NO: 1399534 - RNA, 14 nt, Human
cugugaacccagga

SEQ ID NO: 1399535 - RNA, 19 nt, Human
cugucugccccgcccucau

SEQ ID NO: 1399536 - RNA, 14 nt, Human
cugucugccccgcc

SEQ ID NO: 1399537 - RNA, 20 nt, Human
cugucugccaaccuaaaacu

SEQ ID NO: 1399538 - RNA, 17 nt, Human
cugucugccaaccuaaa

SEQ ID NO: 1399539 - RNA, 15 nt, Human
cugucugguggcccc

SEQ ID NO: 1399540 - RNA, 13 nt, Human
cugucugguggcc

SEQ ID NO: 1399541 - RNA, 16 nt, Human
cugucuggguggcuca

SEQ ID NO: 1399542 - RNA, 23 nt, Human
cugucugggugcuacuggggaaa

SEQ ID NO: 1399543 - RNA, 22 nt, Human
cugucugggugcuacuggggaa

SEQ ID NO: 1399544 - RNA, 21 nt, Human
cugucugggugcuacugggga

SEQ ID NO: 1399545 - RNA, 19 nt, Human
cugucugggugcuacuggg

SEQ ID NO: 1399546 - RNA, 17 nt, Human
cugucugggugcuacug

SEQ ID NO: 1399547 - RNA, 16 nt, Human
cugucugggugcuacu

SEQ ID NO: 1399548 - RNA, 15 nt, Human
cugucuggccccccu

SEQ ID NO: 1399549 - RNA, 16 nt, Human
cugucuggccccccug

SEQ ID NO: 1399550 - RNA, 19 nt, Human
cugucuggcaaugccacag

SEQ ID NO: 1399551 - RNA, 23 nt, Human
cugucuggcaaugccacagcccu

SEQ ID NO: 1399552 - RNA, 17 nt, Human
cugucuggcaaugccac

SEQ ID NO: 1399553 - RNA, 16 nt, Human
cugucuggcaaugcca

SEQ ID NO: 1399554 - RNA, 18 nt, Human
cugucuggaagaugggga

SEQ ID NO: 1399555 - RNA, 17 nt, Human
cugucuggaagaugggg

SEQ ID NO: 1399556 - RNA, 15 nt, Human
cugucugcucagaca

SEQ ID NO: 1399557 - RNA, 17 nt, Human
cugucuggguggcucac

SEQ ID NO: 1399558 - RNA, 23 nt, Human
cugucugguggccccguuucugg

SEQ ID NO: 1399559 - RNA, 14 nt, Human
cugucugucugucc

SEQ ID NO: 1399560 - RNA, 15 nt, Human
cugucugucuguccc

SEQ ID NO: 1399561 - RNA, 16 nt, Human
cugucugucuguccca

SEQ ID NO: 1399562 - RNA, 17 nt, Human
cugucugucugucccaa

SEQ ID NO: 1399563 - RNA, 14 nt, Human
cugucugucugucu

SEQ ID NO: 1399564 - RNA, 15 nt, Human
cugucugucugucug

SEQ ID NO: 1399565 - RNA, 21 nt, Human
cugucuuaaacuaaaugugca

SEQ ID NO: 1399566 - RNA, 19 nt, Human
cugucuuaaacuaaaugug

SEQ ID NO: 1399567 - RNA, 19 nt, Human
cugucuguuguauucauug

SEQ ID NO: 1399568 - RNA, 18 nt, Human
cugucuguuguauucauu

SEQ ID NO: 1399569 - RNA, 16 nt, Human
cugucuuauccuccac

SEQ ID NO: 1399570 - RNA, 14 nt, Human
cugucuuaauuuuc

SEQ ID NO: 1399571 - RNA, 11 nt, Human
cugucuuccca

SEQ ID NO: 1399572 - RNA, 21 nt, Human
cugucuuuuuucuaaaguaaa

SEQ ID NO: 1399573 - RNA, 16 nt, Human
cugucuuuaauucugu

SEQ ID NO: 1399574 - RNA, 14 nt, Human
cugucuucuggacu

SEQ ID NO: 1399575 - RNA, 15 nt, Human
cugucuucuggacug

SEQ ID NO: 1399576 - RNA, 13 nt, Human
cugucuucuggac

SEQ ID NO: 1399577 - RNA, 21 nt, Human
cugugggagccucgcaacccg

SEQ ID NO: 1399578 - RNA, 15 nt, Human
cugugggagccucgc

SEQ ID NO: 1399579 - RNA, 14 nt, Human
cugugggagccucg

SEQ ID NO: 1399580 - RNA, 13 nt, Human
cugugggagccuc

SEQ ID NO: 1399581 - RNA, 24 nt, Human
cugugggaaaugguacuguacagc

SEQ ID NO: 1399582 - RNA, 14 nt, Human
cugugggaaauggu

SEQ ID NO: 1399583 - RNA, 14 nt, Human
cugugggaugggau

SEQ ID NO: 1399584 - RNA, 16 nt, Human
cugugggagccucgca

SEQ ID NO: 1399585 - RNA, 23 nt, Human
cugugggggugagggucccaugu

SEQ ID NO: 1399586 - RNA, 24 nt, Human
cugugggggugagggucccaugug

SEQ ID NO: 1399587 - RNA, 19 nt, Human
cugugggggugugcccccu

SEQ ID NO: 1399588 - RNA, 22 nt, Human
cugugggucugggagucacaca

SEQ ID NO: 1399589 - RNA, 16 nt, Human
cugugggucugggagu

SEQ ID NO: 1399590 - RNA, 15 nt, Human
cuguggguaguauga

SEQ ID NO: 1399591 - RNA, 20 nt, Human
cugugggggugugcccccuu

SEQ ID NO: 1399592 - RNA, 16 nt, Human
cuguggucacagcgga

SEQ ID NO: 1399593 - RNA, 22 nt, Human
cugugguucugagauggcuccc

SEQ ID NO: 1399594 - RNA, 20 nt, Human
cugugguucugagauggcuc

SEQ ID NO: 1399595 - RNA, 18 nt, Human
cugugguucugagauggc

SEQ ID NO: 1399596 - RNA, 22 nt, Human
cuguggugugucccccucuguc

SEQ ID NO: 1399597 - RNA, 15 nt, Human
cuguggugugucccc

SEQ ID NO: 1399598 - RNA, 14 nt, Human
cugugguguguccc

SEQ ID NO: 1399599 - RNA, 22 nt, Human
cuguggccaugacccugccucu

SEQ ID NO: 1399600 - RNA, 20 nt, Human
cuguggccaugacccugccu

SEQ ID NO: 1399601 - RNA, 15 nt, Human
cuguggccaggaggu

SEQ ID NO: 1399602 - RNA, 14 nt, Human
cuguggccaggagg

SEQ ID NO: 1399603 - RNA, 13 nt, Human
cuguggccaggag

SEQ ID NO: 1399604 - RNA, 12 nt, Human
cuguggccagga

SEQ ID NO: 1399605 - RNA, 15 nt, Human
cuguggaucagagau

SEQ ID NO: 1399606 - RNA, 20 nt, Human
cuguggccccacccugggcc

SEQ ID NO: 1399607 - RNA, 18 nt, Human
cuguggccccacccuggg

SEQ ID NO: 1399608 - RNA, 17 nt, Human
cuguggccccacccugg

SEQ ID NO: 1399609 - RNA, 16 nt, Human
cuguggccccacccug

SEQ ID NO: 1399610 - RNA, 21 nt, Human
cuguggccccacccugggccc

SEQ ID NO: 1399611 - RNA, 18 nt, Human
cuguggccuaaccugccg

SEQ ID NO: 1399612 - RNA, 14 nt, Human
cuguggaucaaauc

SEQ ID NO: 1399613 - RNA, 24 nt, Human
cuguggaucaaauccagccugcug

SEQ ID NO: 1399614 - RNA, 15 nt, Human
cugugccucagagac

SEQ ID NO: 1399615 - RNA, 20 nt, Human
cugugccccuugacaacugg

SEQ ID NO: 1399616 - RNA, 23 nt, Human
cugugccccuuccgccacugggg

SEQ ID NO: 1399617 - RNA, 22 nt, Human
cugugccccuuccgccacuggg

SEQ ID NO: 1399618 - RNA, 23 nt, Human
cuguggaccauggaguggcagcc

SEQ ID NO: 1399619 - RNA, 18 nt, Human
cuguggaacauaaaaagg

SEQ ID NO: 1399620 - RNA, 21 nt, Human
cuguggaacauaaaaaggaca

SEQ ID NO: 1399621 - RNA, 19 nt, Human
cuguuaaauacaggaaaca

SEQ ID NO: 1399622 - RNA, 17 nt, Human
cuguuaaauacaggaaa

SEQ ID NO: 1399623 - RNA, 16 nt, Human
cuguuaaauacaggaa

SEQ ID NO: 1399624 - RNA, 15 nt, Human
cuguuaaauacagga

SEQ ID NO: 1399625 - RNA, 11 nt, Human
cuguuaaauac

SEQ ID NO: 1399626 - RNA, 22 nt, Human
cuguguuuugaaagaauagaac

SEQ ID NO: 1399627 - RNA, 18 nt, Human
cuguguuuugaaagaaua

SEQ ID NO: 1399628 - RNA, 22 nt, Human
cuguguugucucuagagcaggg

SEQ ID NO: 1399629 - RNA, 17 nt, Human
cuguguuuugaaagaau

SEQ ID NO: 1399630 - RNA, 19 nt, Human
cuguguugucucuagagca

SEQ ID NO: 1399631 - RNA, 14 nt, Human
cuguguugucucua

SEQ ID NO: 1399632 - RNA, 21 nt, Human
cuguguugccaagcuccaagc

SEQ ID NO: 1399633 - RNA, 19 nt, Human
cuguguugccaagcuccaa

SEQ ID NO: 1399634 - RNA, 17 nt, Human
cuguguugccaagcucc

SEQ ID NO: 1399635 - RNA, 16 nt, Human
cuguguugccaagcuc

SEQ ID NO: 1399636 - RNA, 14 nt, Human
cuguguugccaagc

SEQ ID NO: 1399637 - RNA, 13 nt, Human
cuguguugccaag

SEQ ID NO: 1399638 - RNA, 13 nt, Human
cuguguuccuucc

SEQ ID NO: 1399639 - RNA, 21 nt, Human
cuguguuccuuccgcuuggag

SEQ ID NO: 1399640 - RNA, 17 nt, Human
cuguguuaugcaaaagc

SEQ ID NO: 1399641 - RNA, 19 nt, Human
cuguguuaugcaaaagcaa

SEQ ID NO: 1399642 - RNA, 23 nt, Human
cuguguuacuaaaaaaaagauga

SEQ ID NO: 1399643 - RNA, 22 nt, Human
cuguguuacuaaaaaaaagaug

SEQ ID NO: 1399644 - RNA, 20 nt, Human
cugugugugcccucugggcu

SEQ ID NO: 1399645 - RNA, 21 nt, Human
cugugguuuucuuuugccaug

SEQ ID NO: 1399646 - RNA, 22 nt, Human
cugugguuuucuuuugccauga

SEQ ID NO: 1399647 - RNA, 18 nt, Human
cugugguuucauguuagu

SEQ ID NO: 1399648 - RNA, 17 nt, Human
cugugguuucauguuag

SEQ ID NO: 1399649 - RNA, 16 nt, Human
cugugguuucauguua

SEQ ID NO: 1399650 - RNA, 15 nt, Human
cugugguuucauguu

SEQ ID NO: 1399651 - RNA, 23 nt, Human
cugugguucugagauggcuccca

SEQ ID NO: 1399652 - RNA, 20 nt, Human
cugugugaaacuuucauucc

SEQ ID NO: 1399653 - RNA, 20 nt, Human
cugugucuuucacagcuccu

SEQ ID NO: 1399654 - RNA, 18 nt, Human
cugugugaauaccugcuc

SEQ ID NO: 1399655 - RNA, 19 nt, Human
cugugugaauaccugcuca

SEQ ID NO: 1399656 - RNA, 18 nt, Human
cugugugacucaaaccaa

SEQ ID NO: 1399657 - RNA, 16 nt, Human
cugugugcacaaauau

SEQ ID NO: 1399658 - RNA, 14 nt, Human
cugugugcucagga

SEQ ID NO: 1399659 - RNA, 23 nt, Human
cugugugugcccucugggcucug

SEQ ID NO: 1399660 - RNA, 19 nt, Human
cugugugugcccucugggc

SEQ ID NO: 1399661 - RNA, 18 nt, Human
cugugugugcccucuggg

SEQ ID NO: 1399662 - RNA, 16 nt, Human
cugugugugcccucug

SEQ ID NO: 1399663 - RNA, 13 nt, Human
cugugugugcccu

SEQ ID NO: 1399664 - RNA, 11 nt, Human
cugugugugcc

SEQ ID NO: 1399665 - RNA, 22 nt, Human
cuguguguccaaaacugccuca

SEQ ID NO: 1399666 - RNA, 21 nt, Human
cuguguguccaaaacugccuc

SEQ ID NO: 1399667 - RNA, 19 nt, Human
cuguguguccaaaacugcc

SEQ ID NO: 1399668 - RNA, 15 nt, Human
cuguguguccaaaac

SEQ ID NO: 1399669 - RNA, 15 nt, Human
cuguugcacgugugu

SEQ ID NO: 1399670 - RNA, 23 nt, Human
cuguugcacguguguuuuucuau

SEQ ID NO: 1399671 - RNA, 22 nt, Human
cuguugcacguguguuuuucua

SEQ ID NO: 1399672 - RNA, 20 nt, Human
cuguugcacguguguuuuuc

SEQ ID NO: 1399673 - RNA, 18 nt, Human
cuguugcacguguguuuu

SEQ ID NO: 1399674 - RNA, 17 nt, Human
cuguugcacguguguuu

SEQ ID NO: 1399675 - RNA, 17 nt, Human
cuguugagcaucacaga

SEQ ID NO: 1399676 - RNA, 17 nt, Human
cuguugaauuucccaca

SEQ ID NO: 1399677 - RNA, 23 nt, Human
cuguucuuucuggcuaugcauuu

SEQ ID NO: 1399678 - RNA, 23 nt, Human
cuguucuuccucagccagccucg

SEQ ID NO: 1399679 - RNA, 15 nt, Human
cuguucuuuccaaag

SEQ ID NO: 1399680 - RNA, 16 nt, Human
cuguucuuuccaaagu

SEQ ID NO: 1399681 - RNA, 19 nt, Human
cuguucuuuccaaaguaca

SEQ ID NO: 1399682 - RNA, 21 nt, Human
cuguucuuuccaaaguacacu

SEQ ID NO: 1399683 - RNA, 13 nt, Human
cuguucuuucugg

SEQ ID NO: 1399684 - RNA, 14 nt, Human
cuguucuuucuggc

SEQ ID NO: 1399685 - RNA, 21 nt, Human
cuguucuuucuggcuaugcau

SEQ ID NO: 1399686 - RNA, 22 nt, Human
cuguucuuccucagccagccuc

SEQ ID NO: 1399687 - RNA, 20 nt, Human
cuguucuuccucagccagcc

SEQ ID NO: 1399688 - RNA, 19 nt, Human
cuguucuuccucagccagc

SEQ ID NO: 1399689 - RNA, 18 nt, Human
cuguucuuccucagccag

SEQ ID NO: 1399690 - RNA, 17 nt, Human
cuguucuuccucagcca

SEQ ID NO: 1399691 - RNA, 16 nt, Human
cuguucuuccucagcc

SEQ ID NO: 1399692 - RNA, 23 nt, Human
cuguucuuagcucaaugagcaug

SEQ ID NO: 1399693 - RNA, 21 nt, Human
cuguucuuagcucaaugagca

SEQ ID NO: 1399694 - RNA, 19 nt, Human
cuguucuuagcucaaugag

SEQ ID NO: 1399695 - RNA, 17 nt, Human
cuguucuuagcucaaug

SEQ ID NO: 1399696 - RNA, 16 nt, Human
cuguucuuagcucaau

SEQ ID NO: 1399697 - RNA, 13 nt, Human
cuguucuuagcuc

SEQ ID NO: 1399698 - RNA, 21 nt, Human
cuguucuguuucaaggcacuc

SEQ ID NO: 1399699 - RNA, 15 nt, Human
cuguucuguuucaag

SEQ ID NO: 1399700 - RNA, 14 nt, Human
cuguucuguuucaa

SEQ ID NO: 1399701 - RNA, 14 nt, Human
cuguucugugucuu

SEQ ID NO: 1399702 - RNA, 13 nt, Human
cuguucugugucu

SEQ ID NO: 1399703 - RNA, 11 nt, Human
cuguucugugu

SEQ ID NO: 1399704 - RNA, 19 nt, Human
cuguuaacugaauaccacu

SEQ ID NO: 1399705 - RNA, 22 nt, Human
cuguuaacugaauaccacucug

SEQ ID NO: 1399706 - RNA, 18 nt, Human
cuguuaacugaauaccac

SEQ ID NO: 1399707 - RNA, 17 nt, Human
cuguuaacugaauacca

SEQ ID NO: 1399708 - RNA, 15 nt, Human
cuguuaacugaauac

SEQ ID NO: 1399709 - RNA, 14 nt, Human
cuguuaacugaaua

SEQ ID NO: 1399710 - RNA, 13 nt, Human
cuguuaacugaau

SEQ ID NO: 1399711 - RNA, 12 nt, Human
cuguuaacugaa

SEQ ID NO: 1399712 - RNA, 23 nt, Human
cuguuaaauacaggaaacaguug

SEQ ID NO: 1399713 - RNA, 15 nt, Human
cuguuuuucacauuu

SEQ ID NO: 1399714 - RNA, 17 nt, Human
cuguuuuucagggaggu

SEQ ID NO: 1399715 - RNA, 21 nt, Human
cuguuuuucagggagguggcu

SEQ ID NO: 1399716 - RNA, 13 nt, Human
cuguuuuucacau

SEQ ID NO: 1399717 - RNA, 12 nt, Human
cuguuuuucaca

SEQ ID NO: 1399718 - RNA, 21 nt, Human
cuguuuucucucggcucccca

SEQ ID NO: 1399719 - RNA, 13 nt, Human
cuguuuucccccc

SEQ ID NO: 1399720 - RNA, 12 nt, Human
cuguuuuccccc

SEQ ID NO: 1399721 - RNA, 16 nt, Human
cuguuuucccacgagg

SEQ ID NO: 1399722 - RNA, 21 nt, Human
cuguuuuacaaguuggaguca

SEQ ID NO: 1399723 - RNA, 17 nt, Human
cuguuuuacaaguugga

SEQ ID NO: 1399724 - RNA, 14 nt, Human
cuguuuuacaaguu

SEQ ID NO: 1399725 - RNA, 15 nt, Human
cuguuuuauaauuuu

SEQ ID NO: 1399726 - RNA, 22 nt, Human
cuguuuggaaauugauuuugaa

SEQ ID NO: 1399727 - RNA, 14 nt, Human
cuguuuggccucuc

SEQ ID NO: 1399728 - RNA, 20 nt, Human
cuguuuguuuacaaaaucag

SEQ ID NO: 1399729 - RNA, 14 nt, Human
cuguuuuauaauuu

SEQ ID NO: 1399730 - RNA, 16 nt, Human
cuguuucagaggcuca

SEQ ID NO: 1399731 - RNA, 22 nt, Human
cuguuucaaggcacucuagauu

SEQ ID NO: 1399732 - RNA, 21 nt, Human
cuguuucaaggcacucuagau

SEQ ID NO: 1399733 - RNA, 11 nt, Human
cuguuucaagg

SEQ ID NO: 1399734 - RNA, 17 nt, Human
cuguuuaguagcaguga

SEQ ID NO: 1399735 - RNA, 23 nt, Human
cuguuugacaccucuuuuuucgu

SEQ ID NO: 1399736 - RNA, 19 nt, Human
cuguuugacaccucuuuuu

SEQ ID NO: 1399737 - RNA, 15 nt, Human
cuguuugacaccucu

SEQ ID NO: 1399738 - RNA, 21 nt, Human
cuguuugaggaaagcaagaau

SEQ ID NO: 1399739 - RNA, 23 nt, Human
cuguuuggaaauugauuuugaac

SEQ ID NO: 1399740 - RNA, 23 nt, Human
cuguuuggaaauaaaucuuccua

SEQ ID NO: 1399741 - RNA, 13 nt, Human
cuguuugcugugc

SEQ ID NO: 1399742 - RNA, 22 nt, Human
cuguuugcauuugauacauuuu

SEQ ID NO: 1399743 - RNA, 18 nt, Human
cuguuugcauuugauaca

SEQ ID NO: 1399744 - RNA, 21 nt, Human
cuguugccaggcuggagugca

SEQ ID NO: 1399745 - RNA, 17 nt, Human
cuguuuagauaauacac

SEQ ID NO: 1399746 - RNA, 18 nt, Human
cuguuuagauaauacacc

SEQ ID NO: 1399747 - RNA, 15 nt, Human
cuguuucaaacuuua

SEQ ID NO: 1399748 - RNA, 17 nt, Human
cuguuucaaacuuuacu

SEQ ID NO: 1399749 - RNA, 13 nt, Human
cuuacucuaagau

SEQ ID NO: 1399750 - RNA, 21 nt, Human
cuuacugauauauuuuacaau

SEQ ID NO: 1399751 - RNA, 19 nt, Human
cuuacugauauauuuuaca

SEQ ID NO: 1399752 - RNA, 15 nt, Human
cuuacugauauauuu

SEQ ID NO: 1399753 - RNA, 12 nt, Human
cuuacugauaua

SEQ ID NO: 1399754 - RNA, 19 nt, Human
cuuacucuucuugaaauuu

SEQ ID NO: 1399755 - RNA, 15 nt, Human
cuuacucuucuugaa

SEQ ID NO: 1399756 - RNA, 20 nt, Human
cuuacucuaagaucuuagau

SEQ ID NO: 1399757 - RNA, 12 nt, Human
cuuacucuaaga

SEQ ID NO: 1399758 - RNA, 20 nt, Human
cuuacuccugugggagccuc

SEQ ID NO: 1399759 - RNA, 13 nt, Human
cuuaccuuuuuau

SEQ ID NO: 1399760 - RNA, 21 nt, Human
cuuaccuggcccaucagggua

SEQ ID NO: 1399761 - RNA, 20 nt, Human
cuuaccuguaugucuccagu

SEQ ID NO: 1399762 - RNA, 19 nt, Human
cuuaccugggcauucuugu

SEQ ID NO: 1399763 - RNA, 18 nt, Human
cuuaccuggcccaucagg

SEQ ID NO: 1399764 - RNA, 13 nt, Human
cuuaccuggccca

SEQ ID NO: 1399765 - RNA, 12 nt, Human
cuuaccuggccc

SEQ ID NO: 1399766 - RNA, 15 nt, Human
cuuaauuuauuauua

SEQ ID NO: 1399767 - RNA, 23 nt, Human
cuuagaaaaccagcucagcacug

SEQ ID NO: 1399768 - RNA, 24 nt, Human
cuuagaaaaccagcucagcacugc

SEQ ID NO: 1399769 - RNA, 21 nt, Human
cuuagaaaaccagcucagcac

SEQ ID NO: 1399770 - RNA, 20 nt, Human
cuuagaaaaccagcucagca

SEQ ID NO: 1399771 - RNA, 19 nt, Human
cuuagaaaaccagcucagc

SEQ ID NO: 1399772 - RNA, 18 nt, Human
cuuagaaaaccagcucag

SEQ ID NO: 1399773 - RNA, 11 nt, Human
cuuagaaaacc

SEQ ID NO: 1399774 - RNA, 11 nt, Human
cuuacugcuug

SEQ ID NO: 1399775 - RNA, 13 nt, Human
cuuacuguacaug

SEQ ID NO: 1399776 - RNA, 15 nt, Human
cuuagacucuuuucc

SEQ ID NO: 1399777 - RNA, 21 nt, Human
cuuagacagaggcccucaagu

SEQ ID NO: 1399778 - RNA, 20 nt, Human
cuuagacagaggcccucaag

SEQ ID NO: 1399779 - RNA, 19 nt, Human
cuuagacagaggcccucaa

SEQ ID NO: 1399780 - RNA, 16 nt, Human
cuuagaauacaguuuu

SEQ ID NO: 1399781 - RNA, 14 nt, Human
cuuaaucuuugaaa

SEQ ID NO: 1399782 - RNA, 19 nt, Human
cuuaauauauauauccaga

SEQ ID NO: 1399783 - RNA, 12 nt, Human
cuuaaugaaguu

SEQ ID NO: 1399784 - RNA, 14 nt, Human
cuuaaugaaguuug

SEQ ID NO: 1399785 - RNA, 15 nt, Human
cuuaaugaaguuuga

SEQ ID NO: 1399786 - RNA, 17 nt, Human
cuuaaugaaguuugaau

SEQ ID NO: 1399787 - RNA, 18 nt, Human
cuuaaugaaguuugaaug

SEQ ID NO: 1399788 - RNA, 19 nt, Human
cuuaaugaaguuugaaugu

SEQ ID NO: 1399789 - RNA, 20 nt, Human
cuuaaugaaguuugaauguu

SEQ ID NO: 1399790 - RNA, 21 nt, Human
cuuaaugaaguuugaauguua

SEQ ID NO: 1399791 - RNA, 23 nt, Human
cuuaaugaaguuugaauguuaaa

SEQ ID NO: 1399792 - RNA, 22 nt, Human
cuuaaugaaguuugaauguuaa

SEQ ID NO: 1399793 - RNA, 18 nt, Human
cuuaauuauuauuugugu

SEQ ID NO: 1399794 - RNA, 15 nt, Human
cuuaauuauuauuug

SEQ ID NO: 1399795 - RNA, 11 nt, Human
cuuaauuauua

SEQ ID NO: 1399796 - RNA, 16 nt, Human
cuuaauuuauuauuaa

SEQ ID NO: 1399797 - RNA, 20 nt, Human
cuuaauugccaccucuaaca

SEQ ID NO: 1399798 - RNA, 16 nt, Human
cuuaauugccaccucu

SEQ ID NO: 1399799 - RNA, 19 nt, Human
cuuaauuauuauuuguguu

SEQ ID NO: 1399800 - RNA, 13 nt, Human
cuuaauucaaaua

SEQ ID NO: 1399801 - RNA, 20 nt, Human
cuuaauucuuagcucauucu

SEQ ID NO: 1399802 - RNA, 23 nt, Human
cuuaagaccuacuguucuaaagc

SEQ ID NO: 1399803 - RNA, 22 nt, Human
cuuaagaccuacuguucuaaag

SEQ ID NO: 1399804 - RNA, 20 nt, Human
cuuaagaccuacuguucuaa

SEQ ID NO: 1399805 - RNA, 15 nt, Human
cuuaaggcucuuuug

SEQ ID NO: 1399806 - RNA, 21 nt, Human
cuuaaggauggagccagcucu

SEQ ID NO: 1399807 - RNA, 13 nt, Human
cuuaauacuaagg

SEQ ID NO: 1399808 - RNA, 22 nt, Human
cuuaauacucaaaugaguaaca

SEQ ID NO: 1399809 - RNA, 18 nt, Human
cuuaauacuaccuugaaa

SEQ ID NO: 1399810 - RNA, 16 nt, Human
cuuaauacuaccuuga

SEQ ID NO: 1399811 - RNA, 21 nt, Human
cuuaagguguagccacaccag

SEQ ID NO: 1399812 - RNA, 17 nt, Human
cuuaagguguagccaca

SEQ ID NO: 1399813 - RNA, 14 nt, Human
cuuaagguguagcc

SEQ ID NO: 1399814 - RNA, 20 nt, Human
cuuaauaaauuguguuuccu

SEQ ID NO: 1399815 - RNA, 17 nt, Human
cuuaacaguuguauuua

SEQ ID NO: 1399816 - RNA, 16 nt, Human
cuuaacaguuguauuu

SEQ ID NO: 1399817 - RNA, 14 nt, Human
cuuaaaaaguuaua

SEQ ID NO: 1399818 - RNA, 12 nt, Human
cuuaaaaaguua

SEQ ID NO: 1399819 - RNA, 23 nt, Human
cuuaagaagacugcauuauauuu

SEQ ID NO: 1399820 - RNA, 17 nt, Human
cuuaaccagaucauugu

SEQ ID NO: 1399821 - RNA, 16 nt, Human
cuuccagaaaacaaaa

SEQ ID NO: 1399822 - RNA, 13 nt, Human
cuuccagaaauac

SEQ ID NO: 1399823 - RNA, 18 nt, Human
cuuccacugagggcaguc

SEQ ID NO: 1399824 - RNA, 19 nt, Human
cuuccaaugucuggagacc

SEQ ID NO: 1399825 - RNA, 23 nt, Human
cuuccccacccaccaacccucag

SEQ ID NO: 1399826 - RNA, 20 nt, Human
cuuccccacccaccaacccu

SEQ ID NO: 1399827 - RNA, 19 nt, Human
cuuccagauccuggaaauc

SEQ ID NO: 1399828 - RNA, 15 nt, Human
cuucccccaccacca

SEQ ID NO: 1399829 - RNA, 13 nt, Human
cuucccccaccac

SEQ ID NO: 1399830 - RNA, 21 nt, Human
cuuccccauggcccugagcga

SEQ ID NO: 1399831 - RNA, 19 nt, Human
cuuccccauggcccugagc

SEQ ID NO: 1399832 - RNA, 18 nt, Human
cuuccccaucuucuaaac

SEQ ID NO: 1399833 - RNA, 18 nt, Human
cuuccccagacgccuggc

SEQ ID NO: 1399834 - RNA, 21 nt, Human
cuuccccagacgccuggcugc

SEQ ID NO: 1399835 - RNA, 16 nt, Human
cuucccccaccaccaa

SEQ ID NO: 1399836 - RNA, 16 nt, Human
cuucccuaucuuugcc

SEQ ID NO: 1399837 - RNA, 17 nt, Human
cuucccuaucuuugcca

SEQ ID NO: 1399838 - RNA, 18 nt, Human
cuucccuaucuuugccac

SEQ ID NO: 1399839 - RNA, 22 nt, Human
cuuccuggacagcugugccucg

SEQ ID NO: 1399840 - RNA, 21 nt, Human
cuuccuggacagcugugccuc

SEQ ID NO: 1399841 - RNA, 20 nt, Human
cuuccuggacagcugugccu

SEQ ID NO: 1399842 - RNA, 17 nt, Human
cuuccuggacagcugug

SEQ ID NO: 1399843 - RNA, 16 nt, Human
cuuccuggacagcugu

SEQ ID NO: 1399844 - RNA, 15 nt, Human
cuuccuggacagcug

SEQ ID NO: 1399845 - RNA, 14 nt, Human
cuuccuggacagcu

SEQ ID NO: 1399846 - RNA, 13 nt, Human
cuuccuggacagc

SEQ ID NO: 1399847 - RNA, 16 nt, Human
cuuccugcuugccaag

SEQ ID NO: 1399848 - RNA, 14 nt, Human
cuuccugcuugcca

SEQ ID NO: 1399849 - RNA, 12 nt, Human
cuuccugcuugc

SEQ ID NO: 1399850 - RNA, 14 nt, Human
cuuccucagccagc

SEQ ID NO: 1399851 - RNA, 22 nt, Human
cuuccugccagccccugccauu

SEQ ID NO: 1399852 - RNA, 12 nt, Human
cuuccucagcca

SEQ ID NO: 1399853 - RNA, 11 nt, Human
cuuccucagcc

SEQ ID NO: 1399854 - RNA, 21 nt, Human
cuuccugccccaacuccuucc

SEQ ID NO: 1399855 - RNA, 21 nt, Human
cuuccuggagcagaagcagca

SEQ ID NO: 1399856 - RNA, 18 nt, Human
cuuccuguccagcuccaa

SEQ ID NO: 1399857 - RNA, 19 nt, Human
cuuccuggagcagaagcag

SEQ ID NO: 1399858 - RNA, 18 nt, Human
cuuccuggagcagaagca

SEQ ID NO: 1399859 - RNA, 13 nt, Human
cuuccuggagcag

SEQ ID NO: 1399860 - RNA, 12 nt, Human
cuuccuggagca

SEQ ID NO: 1399861 - RNA, 22 nt, Human
cuuccuggagacugcccagcua

SEQ ID NO: 1399862 - RNA, 14 nt, Human
cuuccuggagacug

SEQ ID NO: 1399863 - RNA, 24 nt, Human
cuuccuggacagcugugccucgcu

SEQ ID NO: 1399864 - RNA, 23 nt, Human
cuuccuggacagcugugccucgc

SEQ ID NO: 1399865 - RNA, 22 nt, Human
cuuccuaguuuucuccucccag

SEQ ID NO: 1399866 - RNA, 23 nt, Human
cuuccuaguuuucuccucccagg

SEQ ID NO: 1399867 - RNA, 17 nt, Human
cuuccuaguuuucuccu

SEQ ID NO: 1399868 - RNA, 15 nt, Human
cuuccuaguuuucuc

SEQ ID NO: 1399869 - RNA, 20 nt, Human
cuucccugacucauucugaa

SEQ ID NO: 1399870 - RNA, 13 nt, Human
cuucccugacuca

SEQ ID NO: 1399871 - RNA, 17 nt, Human
cuucccugaagcuccca

SEQ ID NO: 1399872 - RNA, 15 nt, Human
cuucccugaagcucc

SEQ ID NO: 1399873 - RNA, 13 nt, Human
cuucccugaagcu

SEQ ID NO: 1399874 - RNA, 22 nt, Human
cuucccucuuccuucccugcug

SEQ ID NO: 1399875 - RNA, 22 nt, Human
cuucccuaucuuugccacccuc

SEQ ID NO: 1399876 - RNA, 23 nt, Human
cuucccuaucuuugccacccuca

SEQ ID NO: 1399877 - RNA, 14 nt, Human
cuucccugacucau

SEQ ID NO: 1399878 - RNA, 19 nt, Human
cuucccugcugugaaagaa

SEQ ID NO: 1399879 - RNA, 23 nt, Human
cuucccuggaaaccuuccaccca

SEQ ID NO: 1399880 - RNA, 18 nt, Human
cuucccugaagcucccac

SEQ ID NO: 1399881 - RNA, 22 nt, Human
cuucccuggaaaccuuccaccc

SEQ ID NO: 1399882 - RNA, 14 nt, Human
cuucucaugaucca

SEQ ID NO: 1399883 - RNA, 17 nt, Human
cuucucauccugcaggc

SEQ ID NO: 1399884 - RNA, 16 nt, Human
cuucucauccugcagg

SEQ ID NO: 1399885 - RNA, 15 nt, Human
cuucucauccugcag

SEQ ID NO: 1399886 - RNA, 22 nt, Human
cuucgucuuucccauggggagg

SEQ ID NO: 1399887 - RNA, 21 nt, Human
cuucgucuuucccauggggag

SEQ ID NO: 1399888 - RNA, 14 nt, Human
cuucgucuuuccca

SEQ ID NO: 1399889 - RNA, 15 nt, Human
cuucggggcugggaa

SEQ ID NO: 1399890 - RNA, 14 nt, Human
cuucggggcuggga

SEQ ID NO: 1399891 - RNA, 16 nt, Human
cuucgggcugugcccg

SEQ ID NO: 1399892 - RNA, 17 nt, Human
cuuccuuuuaucaguag

SEQ ID NO: 1399893 - RNA, 21 nt, Human
cuucgcuucuugccucugugc

SEQ ID NO: 1399894 - RNA, 20 nt, Human
cuucgcuucuugccucugug

SEQ ID NO: 1399895 - RNA, 18 nt, Human
cuucgcuucuugccucug

SEQ ID NO: 1399896 - RNA, 17 nt, Human
cuucgcuucuugccucu

SEQ ID NO: 1399897 - RNA, 16 nt, Human
cuucgcuucuugccuc

SEQ ID NO: 1399898 - RNA, 15 nt, Human
cuucgcuucuugccu

SEQ ID NO: 1399899 - RNA, 21 nt, Human
cuuccuucagagagcagugcu

SEQ ID NO: 1399900 - RNA, 16 nt, Human
cuuccuucagagagca

SEQ ID NO: 1399901 - RNA, 15 nt, Human
cuuccuucagagagc

SEQ ID NO: 1399902 - RNA, 14 nt, Human
cuuccuucagagag

SEQ ID NO: 1399903 - RNA, 13 nt, Human
cuuccuucagaga

SEQ ID NO: 1399904 - RNA, 19 nt, Human
cuuccuuacucccaggcac

SEQ ID NO: 1399905 - RNA, 23 nt, Human
cuuccuguuuuucacauuuuccu

SEQ ID NO: 1399906 - RNA, 18 nt, Human
cuuccuguuuuucacauu

SEQ ID NO: 1399907 - RNA, 17 nt, Human
cuuccuguuuuucacau

SEQ ID NO: 1399908 - RNA, 16 nt, Human
cuuccuguuuuucaca

SEQ ID NO: 1399909 - RNA, 22 nt, Human
cuuccuguuuaaaaaaccacau

SEQ ID NO: 1399910 - RNA, 23 nt, Human
cuuccuguguguccaaaacugcc

SEQ ID NO: 1399911 - RNA, 15 nt, Human
cuuccugugugucca

SEQ ID NO: 1399912 - RNA, 16 nt, Human
cuuccuucauuuccuc

SEQ ID NO: 1399913 - RNA, 15 nt, Human
cuuccuucauuuccu

SEQ ID NO: 1399914 - RNA, 13 nt, Human
cuuccuucauuuc

SEQ ID NO: 1399915 - RNA, 23 nt, Human
cuuccuucagagagcagugcuuu

SEQ ID NO: 1399916 - RNA, 22 nt, Human
cuuccuucagagagcagugcuu

SEQ ID NO: 1399917 - RNA, 15 nt, Human
cuuccuucccugcug

SEQ ID NO: 1399918 - RNA, 18 nt, Human
cuucaagaaaacaggcac

SEQ ID NO: 1399919 - RNA, 14 nt, Human
cuucaagcucugag

SEQ ID NO: 1399920 - RNA, 13 nt, Human
cuucaagcucuga

SEQ ID NO: 1399921 - RNA, 12 nt, Human
cuucaagcucug

SEQ ID NO: 1399922 - RNA, 22 nt, Human
cuucaagcauggcuauuuuaua

SEQ ID NO: 1399923 - RNA, 20 nt, Human
cuucaacaauucuaaaauga

SEQ ID NO: 1399924 - RNA, 16 nt, Human
cuucaaaugccugacu

SEQ ID NO: 1399925 - RNA, 13 nt, Human
cuucaaaugccug

SEQ ID NO: 1399926 - RNA, 17 nt, Human
cuucaaauccuugaaga

SEQ ID NO: 1399927 - RNA, 21 nt, Human
cuucacaaucugucaguucua

SEQ ID NO: 1399928 - RNA, 17 nt, Human
cuucaagcucugaggga

SEQ ID NO: 1399929 - RNA, 18 nt, Human
cuucagagagcagugcuu

SEQ ID NO: 1399930 - RNA, 17 nt, Human
cuucagagagcagugcu

SEQ ID NO: 1399931 - RNA, 14 nt, Human
cuucagagagcagu

SEQ ID NO: 1399932 - RNA, 14 nt, Human
cuucacauauugau

SEQ ID NO: 1399933 - RNA, 23 nt, Human
cuucacauauugauuuccguuaa

SEQ ID NO: 1399934 - RNA, 23 nt, Human
cuucagaggcccucgcugccagc

SEQ ID NO: 1399935 - RNA, 21 nt, Human
cuucagaggcccucgcugcca

SEQ ID NO: 1399936 - RNA, 22 nt, Human
cuucagagagcagugcuuuugg

SEQ ID NO: 1399937 - RNA, 20 nt, Human
cuucagagagcagugcuuuu

SEQ ID NO: 1399938 - RNA, 19 nt, Human
cuucagagagcagugcuuu

SEQ ID NO: 1399939 - RNA, 14 nt, Human
cuucagcacuuuag

SEQ ID NO: 1399940 - RNA, 15 nt, Human
cuucagcacuuuaga

SEQ ID NO: 1399941 - RNA, 16 nt, Human
cuucagcacuuuagaa

SEQ ID NO: 1399942 - RNA, 17 nt, Human
cuucaggaucaaguccu

SEQ ID NO: 1399943 - RNA, 19 nt, Human
cuucaggacacucacuaca

SEQ ID NO: 1399944 - RNA, 16 nt, Human
cuucaggacacucacu

SEQ ID NO: 1399945 - RNA, 14 nt, Human
cuucagcugccagu

SEQ ID NO: 1399946 - RNA, 17 nt, Human
cuucagguccaggcugu

SEQ ID NO: 1399947 - RNA, 18 nt, Human
cuucagguccaggcugug

SEQ ID NO: 1399948 - RNA, 10 nt, Human
cuucaggucc

SEQ ID NO: 1399949 - RNA, 21 nt, Human
cuucaggcccccgccuuggcc

SEQ ID NO: 1399950 - RNA, 16 nt, Human
cuucagcgguuuauau

SEQ ID NO: 1399951 - RNA, 19 nt, Human
cuuccaaacaggcucagag

SEQ ID NO: 1399952 - RNA, 24 nt, Human
cuucauuugggaugcuacucuagu

SEQ ID NO: 1399953 - RNA, 18 nt, Human
cuuccaaugucuggagac

SEQ ID NO: 1399954 - RNA, 17 nt, Human
cuuccaaugucuggaga

SEQ ID NO: 1399955 - RNA, 16 nt, Human
cuuccaaacuaauuuu

SEQ ID NO: 1399956 - RNA, 18 nt, Human
cuucagguugguuuaauc

SEQ ID NO: 1399957 - RNA, 22 nt, Human
cuucaguaaaugugauucaccu

SEQ ID NO: 1399958 - RNA, 13 nt, Human
cuucagucucuau

SEQ ID NO: 1399959 - RNA, 17 nt, Human
cuucagucucuauacca

SEQ ID NO: 1399960 - RNA, 21 nt, Human
cuucagucucuauaccaauaa

SEQ ID NO: 1399961 - RNA, 20 nt, Human
cuucaugugucccagaagau

SEQ ID NO: 1399962 - RNA, 17 nt, Human
cuucaugugucccagaa

SEQ ID NO: 1399963 - RNA, 16 nt, Human
cuucaugugucccaga

SEQ ID NO: 1399964 - RNA, 15 nt, Human
cuucaugugucccag

SEQ ID NO: 1399965 - RNA, 14 nt, Human
cuucauguguccca

SEQ ID NO: 1399966 - RNA, 13 nt, Human
cuucauguguccc

SEQ ID NO: 1399967 - RNA, 21 nt, Human
cuucauggcagaaggcaaacc

SEQ ID NO: 1399968 - RNA, 15 nt, Human
cuucauggcagaagg

SEQ ID NO: 1399969 - RNA, 23 nt, Human
cuucauggaugggggaacucaga

SEQ ID NO: 1399970 - RNA, 23 nt, Human
cuucagucucuauaccaauaaag

SEQ ID NO: 1399971 - RNA, 22 nt, Human
cuucagucucuauaccaauaaa

SEQ ID NO: 1399972 - RNA, 22 nt, Human
cuuuguuccccacuggagcaga

SEQ ID NO: 1399973 - RNA, 19 nt, Human
cuuuguuccccacuggagc

SEQ ID NO: 1399974 - RNA, 18 nt, Human
cuuuguuccccacuggag

SEQ ID NO: 1399975 - RNA, 16 nt, Human
cuuuguuccccacugg

SEQ ID NO: 1399976 - RNA, 12 nt, Human
cuuuguucccca

SEQ ID NO: 1399977 - RNA, 18 nt, Human
cuuuguucauagcccagu

SEQ ID NO: 1399978 - RNA, 17 nt, Human
cuuugugauuuuuguaa

SEQ ID NO: 1399979 - RNA, 18 nt, Human
cuuugugauuuuuguaau

SEQ ID NO: 1399980 - RNA, 19 nt, Human
cuuugugauuuuuguaauu

SEQ ID NO: 1399981 - RNA, 21 nt, Human
cuuuggcuuauaauucuuuca

SEQ ID NO: 1399982 - RNA, 17 nt, Human
cuuugggaauauuugaa

SEQ ID NO: 1399983 - RNA, 18 nt, Human
cuuugggaauauuugaau

SEQ ID NO: 1399984 - RNA, 19 nt, Human
cuuugggaauauuugaauc

SEQ ID NO: 1399985 - RNA, 20 nt, Human
cuuugggaauauuugaaucu

SEQ ID NO: 1399986 - RNA, 23 nt, Human
cuuugggaauauuugaaucuugu

SEQ ID NO: 1399987 - RNA, 14 nt, Human
cuuugugauuuuug

SEQ ID NO: 1399988 - RNA, 18 nt, Human
cuuuggcuuauaauucuu

SEQ ID NO: 1399989 - RNA, 21 nt, Human
cuuuggaaguuuagcucugag

SEQ ID NO: 1399990 - RNA, 20 nt, Human
cuuuggaccuaaauggccuc

SEQ ID NO: 1399991 - RNA, 17 nt, Human
cuuugcucuucaagaaa

SEQ ID NO: 1399992 - RNA, 17 nt, Human
cuuucccagucugucga

SEQ ID NO: 1399993 - RNA, 16 nt, Human
cuuucccauggggagg

SEQ ID NO: 1399994 - RNA, 15 nt, Human
cuuucccagucuguc

SEQ ID NO: 1399995 - RNA, 23 nt, Human
cuuucccaccccaaccugcucuc

SEQ ID NO: 1399996 - RNA, 22 nt, Human
cuuucccaccccacgccuuauc

SEQ ID NO: 1399997 - RNA, 22 nt, Human
cuuucccaccccaaccugcucu

SEQ ID NO: 1399998 - RNA, 21 nt, Human
cuuucccaccccaaccugcuc

SEQ ID NO: 1399999 - RNA, 15 nt, Human
cuuucccaccccaac

SEQ ID NO: 1400000 - RNA, 22 nt, Human
cuuuggaaguuuagcucugaga

SEQ ID NO: 1400001 - RNA, 20 nt, Human
cuuuggaaguuuagcucuga

SEQ ID NO: 1400002 - RNA, 18 nt, Human
cuuuggaaguuuagcucu

SEQ ID NO: 1400003 - RNA, 22 nt, Human
cuuugcugugaggcuguccugu

SEQ ID NO: 1400004 - RNA, 21 nt, Human
cuuugcugugaggcuguccug

SEQ ID NO: 1400005 - RNA, 17 nt, Human
cuuugcugugaggcugu

SEQ ID NO: 1400006 - RNA, 15 nt, Human
cuuugcugcauggca

SEQ ID NO: 1400007 - RNA, 18 nt, Human
cuuugcugagccuguaaa

SEQ ID NO: 1400008 - RNA, 22 nt, Human
cuuuucccaaagcaucccucuu

SEQ ID NO: 1400009 - RNA, 22 nt, Human
cuuuucccaaaauguugaaaua

SEQ ID NO: 1400010 - RNA, 18 nt, Human
cuuuucccaaaauguuga

SEQ ID NO: 1400011 - RNA, 20 nt, Human
cuuuucaugcaaacucuuug

SEQ ID NO: 1400012 - RNA, 19 nt, Human
cuuuucaugcaaacucuuu

SEQ ID NO: 1400013 - RNA, 17 nt, Human
cuuuucaugcaaacucu

SEQ ID NO: 1400014 - RNA, 15 nt, Human
cuuuucaugcaaacu

SEQ ID NO: 1400015 - RNA, 14 nt, Human
cuuuucaugcaaac

SEQ ID NO: 1400016 - RNA, 13 nt, Human
cuuuucaugcaaa

SEQ ID NO: 1400017 - RNA, 20 nt, Human
cuuuucauaggucugaaauu

SEQ ID NO: 1400018 - RNA, 18 nt, Human
cuuuucauaggucugaaa

SEQ ID NO: 1400019 - RNA, 18 nt, Human
cuuuucauacauuuucua

SEQ ID NO: 1400020 - RNA, 14 nt, Human
cuuuuacucugccu

SEQ ID NO: 1400021 - RNA, 15 nt, Human
cuuuguuuggcuggg

SEQ ID NO: 1400022 - RNA, 16 nt, Human
cuuuguuucuccccca

SEQ ID NO: 1400023 - RNA, 15 nt, Human
cuuuguuucuccccc

SEQ ID NO: 1400024 - RNA, 14 nt, Human
cuuuguuucucccc

SEQ ID NO: 1400025 - RNA, 18 nt, Human
cuuuguuucguggggagg

SEQ ID NO: 1400026 - RNA, 17 nt, Human
cuuuguuucguggggag

SEQ ID NO: 1400027 - RNA, 15 nt, Human
cuuuuacccuggccc

SEQ ID NO: 1400028 - RNA, 23 nt, Human
cuuuuacaaguaacaaaaauaaa

SEQ ID NO: 1400029 - RNA, 14 nt, Human
cuuuuaauuuuccu

SEQ ID NO: 1400030 - RNA, 13 nt, Human
cuuuuaauucauu

SEQ ID NO: 1400031 - RNA, 12 nt, Human
cuuuuaauucau

SEQ ID NO: 1400032 - RNA, 23 nt, Human
cuuuuacccuggccccucucccu

SEQ ID NO: 1400033 - RNA, 22 nt, Human
cuuuuacccuggccccucuccc

SEQ ID NO: 1400034 - RNA, 21 nt, Human
cuuuuacccuggccccucucc

SEQ ID NO: 1400035 - RNA, 19 nt, Human
cuuuuacccuggccccucu

SEQ ID NO: 1400036 - RNA, 16 nt, Human
cuuuuacccuggcccc

SEQ ID NO: 1400037 - RNA, 20 nt, Human
cuuuuacguccaucucuugu

SEQ ID NO: 1400038 - RNA, 16 nt, Human
cuuuucuguaauucag

SEQ ID NO: 1400039 - RNA, 15 nt, Human
cuuuucuguaauuca

SEQ ID NO: 1400040 - RNA, 14 nt, Human
cuuuucuguaauuc

SEQ ID NO: 1400041 - RNA, 13 nt, Human
cuuuucuguaauu

SEQ ID NO: 1400042 - RNA, 16 nt, Human
cuuuucugaccaaaga

SEQ ID NO: 1400043 - RNA, 19 nt, Human
cuuuucuggaauguaauca

SEQ ID NO: 1400044 - RNA, 18 nt, Human
cuuuucuggaauguaauc

SEQ ID NO: 1400045 - RNA, 23 nt, Human
cuuuucccccauuaaucaguuca

SEQ ID NO: 1400046 - RNA, 22 nt, Human
cuuuucccacuccaagcccagc

SEQ ID NO: 1400047 - RNA, 21 nt, Human
cuuuucccauuuaucuaaaua

SEQ ID NO: 1400048 - RNA, 18 nt, Human
cuuuucccacuguuuaag

SEQ ID NO: 1400049 - RNA, 17 nt, Human
cuuuucccacuccaagc

SEQ ID NO: 1400050 - RNA, 13 nt, Human
cuuuucccacucc

SEQ ID NO: 1400051 - RNA, 14 nt, Human
cuuuucccaaccau

SEQ ID NO: 1400052 - RNA, 22 nt, Human
cuuuucccucuuuggcuccccu

SEQ ID NO: 1400053 - RNA, 20 nt, Human
cuuuucccucuuuggcuccc

SEQ ID NO: 1400054 - RNA, 19 nt, Human
cuuuucccccauuaaucag

SEQ ID NO: 1400055 - RNA, 17 nt, Human
cuuuucucugguaauau

SEQ ID NO: 1400056 - RNA, 17 nt, Human
cuuuucuccucacugua

SEQ ID NO: 1400057 - RNA, 18 nt, Human
gaaacagcaucuccaagc

SEQ ID NO: 1400058 - RNA, 17 nt, Human
gaaacagcaucuccaag

SEQ ID NO: 1400059 - RNA, 13 nt, Human
gaaacagcaucuc

SEQ ID NO: 1400060 - RNA, 22 nt, Human
gaaacagaaacaaaaacacuaa

SEQ ID NO: 1400061 - RNA, 14 nt, Human
gaaacagaaacaaa

SEQ ID NO: 1400062 - RNA, 22 nt, Human
gaaacagaaaaauauguaccaa

SEQ ID NO: 1400063 - RNA, 11 nt, Human
gaaacagaaaa

SEQ ID NO: 1400064 - RNA, 16 nt, Human
gaaacacuuugcauaa

SEQ ID NO: 1400065 - RNA, 15 nt, Human
gaaaaucaaauggua

SEQ ID NO: 1400066 - RNA, 14 nt, Human
gaaacacagaaacc

SEQ ID NO: 1400067 - RNA, 20 nt, Human
gaaaaucuuauaauuuaaaa

SEQ ID NO: 1400068 - RNA, 18 nt, Human
gaaacacccucacacugg

SEQ ID NO: 1400069 - RNA, 19 nt, Human
gaaacacccucacacuggg

SEQ ID NO: 1400070 - RNA, 22 nt, Human
gaaacacccucacacugggacu

SEQ ID NO: 1400071 - RNA, 19 nt, Human
gaaaaucuuauaauuuaaa

SEQ ID NO: 1400072 - RNA, 12 nt, Human
gaaaauaucacu

SEQ ID NO: 1400073 - RNA, 21 nt, Human
gaaaauaaggcacccaucugu

SEQ ID NO: 1400074 - RNA, 13 nt, Human
gaaaauaaggcac

SEQ ID NO: 1400075 - RNA, 19 nt, Human
gaaaauaagagcucaggau

SEQ ID NO: 1400076 - RNA, 17 nt, Human
gaaaauaagagcucagg

SEQ ID NO: 1400077 - RNA, 18 nt, Human
gaaaauaagaauagaaau

SEQ ID NO: 1400078 - RNA, 19 nt, Human
gaaaauaacgauaaaagac

SEQ ID NO: 1400079 - RNA, 23 nt, Human
gaaaagcuagaauugaguguuua

SEQ ID NO: 1400080 - RNA, 20 nt, Human
gaaaaccagcucagcacugc

SEQ ID NO: 1400081 - RNA, 15 nt, Human
gaaaaccagcucagc

SEQ ID NO: 1400082 - RNA, 16 nt, Human
gaaaacaugcuacaca

SEQ ID NO: 1400083 - RNA, 19 nt, Human
gaaaaauaaagaaaagaug

SEQ ID NO: 1400084 - RNA, 17 nt, Human
gaaaaauaaagaaaaga

SEQ ID NO: 1400085 - RNA, 14 nt, Human
gaaaaauaaagaaa

SEQ ID NO: 1400086 - RNA, 13 nt, Human
gaaaacacauuuu

SEQ ID NO: 1400087 - RNA, 22 nt, Human
gaaaacaauaacgauaaaagac

SEQ ID NO: 1400088 - RNA, 14 nt, Human
gaaaacacauuuuu

SEQ ID NO: 1400089 - RNA, 12 nt, Human
gaaaacaugcua

SEQ ID NO: 1400090 - RNA, 14 nt, Human
gaaaacaugcuaca

SEQ ID NO: 1400091 - RNA, 15 nt, Human
gaaaacaugcuacac

SEQ ID NO: 1400092 - RNA, 13 nt, Human
gaaaaauaaagaa

SEQ ID NO: 1400093 - RNA, 14 nt, Human
gaaaaaguuuguuu

SEQ ID NO: 1400094 - RNA, 16 nt, Human
cuuuuuuggccaucug

SEQ ID NO: 1400095 - RNA, 23 nt, Human
gaaaaaggaugcacagaguuguu

SEQ ID NO: 1400096 - RNA, 22 nt, Human
cuuuuuucucugauacagaaaa

SEQ ID NO: 1400097 - RNA, 18 nt, Human
cuuuugacacugcucuaa

SEQ ID NO: 1400098 - RNA, 17 nt, Human
cuuuugacacugcucua

SEQ ID NO: 1400099 - RNA, 12 nt, Human
cuuuugacacug

SEQ ID NO: 1400100 - RNA, 15 nt, Human
cuuuuuuccccagac

SEQ ID NO: 1400101 - RNA, 12 nt, Human
cuuuuuucccca

SEQ ID NO: 1400102 - RNA, 20 nt, Human
cuuuuuucucugauacagaa

SEQ ID NO: 1400103 - RNA, 14 nt, Human
cuuuuuucuaaagu

SEQ ID NO: 1400104 - RNA, 23 nt, Human
cuuggaacuugccugccuuucca

SEQ ID NO: 1400105 - RNA, 22 nt, Human
cuuggaacuugccugccuuucc

SEQ ID NO: 1400106 - RNA, 19 nt, Human
cuuggaacuugccugccuu

SEQ ID NO: 1400107 - RNA, 15 nt, Human
cuuggaacuugccug

SEQ ID NO: 1400108 - RNA, 13 nt, Human
cuuggaacugcau

SEQ ID NO: 1400109 - RNA, 11 nt, Human
cuuggaacugc

SEQ ID NO: 1400110 - RNA, 15 nt, Human
cuuggaacugaaggg

SEQ ID NO: 1400111 - RNA, 16 nt, Human
cuuggaacauuggaau

SEQ ID NO: 1400112 - RNA, 15 nt, Human
cuuggaaaggaccag

SEQ ID NO: 1400113 - RNA, 15 nt, Human
cuugcuuaccucuca

SEQ ID NO: 1400114 - RNA, 15 nt, Human
cuugcuuauuugaca

SEQ ID NO: 1400115 - RNA, 19 nt, Human
cuugcuuuucaugcaaacu

SEQ ID NO: 1400116 - RNA, 15 nt, Human
cuugcugugaauuaa

SEQ ID NO: 1400117 - RNA, 22 nt, Human
cuugccccccuggccuccccca

SEQ ID NO: 1400118 - RNA, 21 nt, Human
cuugccccccuggccuccccc

SEQ ID NO: 1400119 - RNA, 16 nt, Human
cuugccccccuggccu

SEQ ID NO: 1400120 - RNA, 18 nt, Human
cuugcccuaagcagaaag

SEQ ID NO: 1400121 - RNA, 16 nt, Human
cuugcccuaagcagaa

SEQ ID NO: 1400122 - RNA, 15 nt, Human
cuugcccuaagcaga

SEQ ID NO: 1400123 - RNA, 17 nt, Human
cuugcccgcucaggcug

SEQ ID NO: 1400124 - RNA, 23 nt, Human
cuugccagagauccaaaagaagc

SEQ ID NO: 1400125 - RNA, 16 nt, Human
cuugccagagauccaa

SEQ ID NO: 1400126 - RNA, 12 nt, Human
cuugccagagau

SEQ ID NO: 1400127 - RNA, 11 nt, Human
cuugccagaga

SEQ ID NO: 1400128 - RNA, 23 nt, Human
cuuggagcugugaguucucccug

SEQ ID NO: 1400129 - RNA, 18 nt, Human
cuuggaguauuggggucu

SEQ ID NO: 1400130 - RNA, 17 nt, Human
cuuggaggagaugggga

SEQ ID NO: 1400131 - RNA, 14 nt, Human
cuuggagcugugag

SEQ ID NO: 1400132 - RNA, 14 nt, Human
cuuggagcugagca

SEQ ID NO: 1400133 - RNA, 17 nt, Human
cuuggagcugagcaaau

SEQ ID NO: 1400134 - RNA, 20 nt, Human
cuugggcagagcuggcucug

SEQ ID NO: 1400135 - RNA, 19 nt, Human
cuugggcagagcuggcucu

SEQ ID NO: 1400136 - RNA, 18 nt, Human
cuugggcagagcuggcuc

SEQ ID NO: 1400137 - RNA, 15 nt, Human
cuugggcagagcugg

SEQ ID NO: 1400138 - RNA, 14 nt, Human
cuugggcagagcug

SEQ ID NO: 1400139 - RNA, 19 nt, Human
cuugggacuaaaugcccug

SEQ ID NO: 1400140 - RNA, 20 nt, Human
cuugggacuaaaugcccugc

SEQ ID NO: 1400141 - RNA, 13 nt, Human
cuugggaauuuua

SEQ ID NO: 1400142 - RNA, 18 nt, Human
cuugggaauggauccugg

SEQ ID NO: 1400143 - RNA, 10 nt, Human
cuugggaaug

SEQ ID NO: 1400144 - RNA, 21 nt, Human
cuugggaagacuccuagcugu

SEQ ID NO: 1400145 - RNA, 20 nt, Human
cuugggaagacuccuagcug

SEQ ID NO: 1400146 - RNA, 18 nt, Human
cuugggaagacuccuagc

SEQ ID NO: 1400147 - RNA, 22 nt, Human
cuugggaaaggugguguuucug

SEQ ID NO: 1400148 - RNA, 20 nt, Human
cuuggcuggacccagccagg

SEQ ID NO: 1400149 - RNA, 11 nt, Human
cuuggcuggug

SEQ ID NO: 1400150 - RNA, 18 nt, Human
cuuggcuggacccagcca

SEQ ID NO: 1400151 - RNA, 17 nt, Human
cuuggcuggacccagcc

SEQ ID NO: 1400152 - RNA, 16 nt, Human
cuuggcuggacccagc

SEQ ID NO: 1400153 - RNA, 15 nt, Human
cuuggcuggacccag

SEQ ID NO: 1400154 - RNA, 14 nt, Human
cuuggcuggaccca

SEQ ID NO: 1400155 - RNA, 22 nt, Human
cuuggaguauuggggucugacc

SEQ ID NO: 1400156 - RNA, 14 nt, Human
cuugggcagcaucc

SEQ ID NO: 1400157 - RNA, 23 nt, Human
cuugggcagagcuggcucugagc

SEQ ID NO: 1400158 - RNA, 22 nt, Human
cuugggcagagcuggcucugag

SEQ ID NO: 1400159 - RNA, 21 nt, Human
cuuggggaguuaagaccuggc

SEQ ID NO: 1400160 - RNA, 20 nt, Human
cuuggggaguuaagaccugg

SEQ ID NO: 1400161 - RNA, 19 nt, Human
cuuggggaguuaagaccug

SEQ ID NO: 1400162 - RNA, 22 nt, Human
cuuggggagaccucuacugccu

SEQ ID NO: 1400163 - RNA, 19 nt, Human
cuuguaaaggaauuuaaaa

SEQ ID NO: 1400164 - RNA, 19 nt, Human
cuuguuuggggcaggagua

SEQ ID NO: 1400165 - RNA, 18 nt, Human
cuuguuuggggcaggagu

SEQ ID NO: 1400166 - RNA, 17 nt, Human
cuuguuuggggcaggag

SEQ ID NO: 1400167 - RNA, 15 nt, Human
cuuguuguuucuugc

SEQ ID NO: 1400168 - RNA, 16 nt, Human
cuuguuguuucuugcc

SEQ ID NO: 1400169 - RNA, 15 nt, Human
cuuguugugcuuuua

SEQ ID NO: 1400170 - RNA, 17 nt, Human
cuuguugugcuuuuagu

SEQ ID NO: 1400171 - RNA, 22 nt, Human
cuuguuggcguaggcuacagag

SEQ ID NO: 1400172 - RNA, 23 nt, Human
cuuguuggcguaggcuacagaga

SEQ ID NO: 1400173 - RNA, 17 nt, Human
cuuguguuggcuguggc

SEQ ID NO: 1400174 - RNA, 14 nt, Human
cuuguguuggcugu

SEQ ID NO: 1400175 - RNA, 13 nt, Human
cuuguguuggcug

SEQ ID NO: 1400176 - RNA, 22 nt, Human
cuugugggccugggcuccugga

SEQ ID NO: 1400177 - RNA, 12 nt, Human
cuuguggggccu

SEQ ID NO: 1400178 - RNA, 23 nt, Human
cuugugggccugggcuccuggac

SEQ ID NO: 1400179 - RNA, 21 nt, Human
cuugugggccugggcuccugg

SEQ ID NO: 1400180 - RNA, 19 nt, Human
cuugugggccugggcuccu

SEQ ID NO: 1400181 - RNA, 17 nt, Human
cuugugggccugggcuc

SEQ ID NO: 1400182 - RNA, 16 nt, Human
cuugugggccugggcu

SEQ ID NO: 1400183 - RNA, 15 nt, Human
cuugugggccugggc

SEQ ID NO: 1400184 - RNA, 14 nt, Human
cuugugggccuggg

SEQ ID NO: 1400185 - RNA, 12 nt, Human
cuugugggccug

SEQ ID NO: 1400186 - RNA, 16 nt, Human
cuuguggcagcaacgg

SEQ ID NO: 1400187 - RNA, 15 nt, Human
cuuguggacuaaaag

SEQ ID NO: 1400188 - RNA, 18 nt, Human
cuugcuuuucaugcaaac

SEQ ID NO: 1400189 - RNA, 16 nt, Human
cuuguggacuaaaaga

SEQ ID NO: 1400190 - RNA, 17 nt, Human
cuuguggacuaaaagau

SEQ ID NO: 1400191 - RNA, 18 nt, Human
cuuguggacuaaaagaua

SEQ ID NO: 1400192 - RNA, 19 nt, Human
cuuguggacuaaaagauau

SEQ ID NO: 1400193 - RNA, 16 nt, Human
cuuguuuuugcacaug

SEQ ID NO: 1400194 - RNA, 12 nt, Human
cuuguuuuugca

SEQ ID NO: 1400195 - RNA, 14 nt, Human
cuuguuuuggaugc

SEQ ID NO: 1400196 - RNA, 13 nt, Human
cuuguuuuggaug

SEQ ID NO: 1400197 - RNA, 14 nt, Human
cuuguuuuggacag

SEQ ID NO: 1400198 - RNA, 23 nt, Human
cuuguuuuuuguuuguuuguugc

SEQ ID NO: 1400199 - RNA, 23 nt, Human
cuuuagaaacagugcaacacugg

SEQ ID NO: 1400200 - RNA, 14 nt, Human
cuuuagaaacagug

SEQ ID NO: 1400201 - RNA, 14 nt, Human
cuuuacuuuuaaac

SEQ ID NO: 1400202 - RNA, 20 nt, Human
cuuuagaaucccagcccccu

SEQ ID NO: 1400203 - RNA, 18 nt, Human
cuuuagaaucccagcccc

SEQ ID NO: 1400204 - RNA, 15 nt, Human
cuuuagaagccugca

SEQ ID NO: 1400205 - RNA, 15 nt, Human
cuuuagaaucccagc

SEQ ID NO: 1400206 - RNA, 14 nt, Human
cuuuagaagccugc

SEQ ID NO: 1400207 - RNA, 16 nt, Human
cuuuagaauaugccuu

SEQ ID NO: 1400208 - RNA, 17 nt, Human
cuuuauuaaaaacugag

SEQ ID NO: 1400209 - RNA, 14 nt, Human
cuuuauuaaaaacu

SEQ ID NO: 1400210 - RNA, 20 nt, Human
cuuuauguuacuacaugcac

SEQ ID NO: 1400211 - RNA, 20 nt, Human
cuuuauuccagaaugcugua

SEQ ID NO: 1400212 - RNA, 18 nt, Human
cuuuauaagaaagccuga

SEQ ID NO: 1400213 - RNA, 16 nt, Human
cuuuauaagaaagccu

SEQ ID NO: 1400214 - RNA, 15 nt, Human
cuuuauaagaaagcc

SEQ ID NO: 1400215 - RNA, 13 nt, Human
cuuuauaagaaag

SEQ ID NO: 1400216 - RNA, 12 nt, Human
cuuuauaagaaa

SEQ ID NO: 1400217 - RNA, 13 nt, Human
cuuuauaaaugua

SEQ ID NO: 1400218 - RNA, 18 nt, Human
cuuuauaacuaacauguc

SEQ ID NO: 1400219 - RNA, 19 nt, Human
cuuuauaagaaagccugag

SEQ ID NO: 1400220 - RNA, 18 nt, Human
cuuuauuggcugagauau

SEQ ID NO: 1400221 - RNA, 16 nt, Human
cuuuauuguguuuguc

SEQ ID NO: 1400222 - RNA, 18 nt, Human
cuuuauuguguuugucau

SEQ ID NO: 1400223 - RNA, 19 nt, Human
cuuuauuguguuugucauu

SEQ ID NO: 1400224 - RNA, 20 nt, Human
cuuuauuguguuugucauua

SEQ ID NO: 1400225 - RNA, 23 nt, Human
cuuuauuguguuugucauuagcc

SEQ ID NO: 1400226 - RNA, 16 nt, Human
cuuuauuggcugagau

SEQ ID NO: 1400227 - RNA, 18 nt, Human
cuuuauuccuucauuuca

SEQ ID NO: 1400228 - RNA, 23 nt, Human
cuuuauuccagaaugcuguacau

SEQ ID NO: 1400229 - RNA, 22 nt, Human
cuuuauuuuaaccuuugauaga

SEQ ID NO: 1400230 - RNA, 22 nt, Human
cuuuauuuguuaauaguuccug

SEQ ID NO: 1400231 - RNA, 21 nt, Human
cuuuauuuucuauaauuuaaa

SEQ ID NO: 1400232 - RNA, 18 nt, Human
cuuucaucacacugggug

SEQ ID NO: 1400233 - RNA, 15 nt, Human
cuuucauuucuucua

SEQ ID NO: 1400234 - RNA, 19 nt, Human
cuuucaucacacugggugg

SEQ ID NO: 1400235 - RNA, 16 nt, Human
cuuucaucacacuggg

SEQ ID NO: 1400236 - RNA, 23 nt, Human
cuuucauauaguuagcuaauaaa

SEQ ID NO: 1400237 - RNA, 23 nt, Human
cuuucauauuuuaaacagaggau

SEQ ID NO: 1400238 - RNA, 19 nt, Human
cuuucauauuuuaaacaga

SEQ ID NO: 1400239 - RNA, 16 nt, Human
cuuucauauuuuaaac

SEQ ID NO: 1400240 - RNA, 13 nt, Human
cuuucauauaguu

SEQ ID NO: 1400241 - RNA, 19 nt, Human
cuuucauuuucucucaggu

SEQ ID NO: 1400242 - RNA, 21 nt, Human
cuuucauuuucucucagguga

SEQ ID NO: 1400243 - RNA, 18 nt, Human
cuuucauuuucucucagg

SEQ ID NO: 1400244 - RNA, 17 nt, Human
cuuucauuuucucucag

SEQ ID NO: 1400245 - RNA, 18 nt, Human
cuuucauuugcuuuggaa

SEQ ID NO: 1400246 - RNA, 14 nt, Human
cuuucauuugcuuu

SEQ ID NO: 1400247 - RNA, 23 nt, Human
cuuuccaccacagccagcaccug

SEQ ID NO: 1400248 - RNA, 22 nt, Human
cuuuccaccacagccagcaccu

SEQ ID NO: 1400249 - RNA, 21 nt, Human
cuuuccaccacagccagcacc

SEQ ID NO: 1400250 - RNA, 17 nt, Human
cuuuccaccacagccag

SEQ ID NO: 1400251 - RNA, 15 nt, Human
cuuuccaccacagcc

SEQ ID NO: 1400252 - RNA, 17 nt, Human
cuuucccaacaccucuu

SEQ ID NO: 1400253 - RNA, 13 nt, Human
cuuuccacagaag

SEQ ID NO: 1400254 - RNA, 21 nt, Human
gaagccuuggggcugaugcag

SEQ ID NO: 1400255 - RNA, 23 nt, Human
gaagccuuccccuuauccucccu

SEQ ID NO: 1400256 - RNA, 14 nt, Human
gaagcuuuggugag

SEQ ID NO: 1400257 - RNA, 19 nt, Human
gaagcuuggggaagaccca

SEQ ID NO: 1400258 - RNA, 18 nt, Human
gaagcuuggggaagaccc

SEQ ID NO: 1400259 - RNA, 20 nt, Human
gaagcuuuggugagaaccug

SEQ ID NO: 1400260 - RNA, 18 nt, Human
gaagcuuuuaugugaaac

SEQ ID NO: 1400261 - RNA, 17 nt, Human
gaagcccagagggucug

SEQ ID NO: 1400262 - RNA, 13 nt, Human
gaagcccagaggg

SEQ ID NO: 1400263 - RNA, 18 nt, Human
gaagcccaauugcuggag

SEQ ID NO: 1400264 - RNA, 14 nt, Human
gaagcccagagggu

SEQ ID NO: 1400265 - RNA, 16 nt, Human
gaagccucagauuccu

SEQ ID NO: 1400266 - RNA, 20 nt, Human
gaagccgugcucgccccagc

SEQ ID NO: 1400267 - RNA, 22 nt, Human
gaagccguccuggcgccuggca

SEQ ID NO: 1400268 - RNA, 22 nt, Human
gaagccucagauuccuucccau

SEQ ID NO: 1400269 - RNA, 21 nt, Human
gaagccucagauuccuuccca

SEQ ID NO: 1400270 - RNA, 20 nt, Human
gaagccucagauuccuuccc

SEQ ID NO: 1400271 - RNA, 19 nt, Human
gaagccucagauuccuucc

SEQ ID NO: 1400272 - RNA, 19 nt, Human
gaagccuccuuagaaaaaa

SEQ ID NO: 1400273 - RNA, 23 nt, Human
gaagccaugaguuccagaaagua

SEQ ID NO: 1400274 - RNA, 22 nt, Human
gaagccaucaccucagauggca

SEQ ID NO: 1400275 - RNA, 20 nt, Human
gaagccaucaccucagaugg

SEQ ID NO: 1400276 - RNA, 18 nt, Human
gaagccaucaccucagau

SEQ ID NO: 1400277 - RNA, 17 nt, Human
gaagccaucaccucaga

SEQ ID NO: 1400278 - RNA, 22 nt, Human
gaagccagcuuguuuacaugcu

SEQ ID NO: 1400279 - RNA, 24 nt, Human
gaagccaggaauuucccaggaccc

SEQ ID NO: 1400280 - RNA, 23 nt, Human
gaagccaggaauuucccaggacc

SEQ ID NO: 1400281 - RNA, 21 nt, Human
gaagccaggaauuucccagga

SEQ ID NO: 1400282 - RNA, 19 nt, Human
gaagccaggaauuucccag

SEQ ID NO: 1400283 - RNA, 22 nt, Human
gaagccagcuuucccugccucu

SEQ ID NO: 1400284 - RNA, 18 nt, Human
gaagccagcuuguuuaca

SEQ ID NO: 1400285 - RNA, 13 nt, Human
gaagccagcuugu

SEQ ID NO: 1400286 - RNA, 20 nt, Human
gaagccacgggugccagaag

SEQ ID NO: 1400287 - RNA, 17 nt, Human
gaagacugcauuauauu

SEQ ID NO: 1400288 - RNA, 15 nt, Human
gaagacuccuagcug

SEQ ID NO: 1400289 - RNA, 22 nt, Human
gaagccacgguguucugugaua

SEQ ID NO: 1400290 - RNA, 18 nt, Human
gaaggagcugccuggacc

SEQ ID NO: 1400291 - RNA, 19 nt, Human
gaaggagcugccuggaccc

SEQ ID NO: 1400292 - RNA, 17 nt, Human
gaaggagcugccuggac

SEQ ID NO: 1400293 - RNA, 16 nt, Human
gaaggagcugccugga

SEQ ID NO: 1400294 - RNA, 15 nt, Human
gaaggagcugccugg

SEQ ID NO: 1400295 - RNA, 14 nt, Human
gaaggagcugccug

SEQ ID NO: 1400296 - RNA, 12 nt, Human
gaaggagcugcc

SEQ ID NO: 1400297 - RNA, 22 nt, Human
gaaggagccccauuccugggaa

SEQ ID NO: 1400298 - RNA, 21 nt, Human
gaaggagccccauuccuggga

SEQ ID NO: 1400299 - RNA, 20 nt, Human
gaaggagccccauuccuggg

SEQ ID NO: 1400300 - RNA, 15 nt, Human
gaaggcaaagcacga

SEQ ID NO: 1400301 - RNA, 19 nt, Human
gaaggaucccaugagcucc

SEQ ID NO: 1400302 - RNA, 21 nt, Human
gaaggauacaaaagcauguga

SEQ ID NO: 1400303 - RNA, 12 nt, Human
gaaggauacaaa

SEQ ID NO: 1400304 - RNA, 19 nt, Human
gaaggauacaaaagcaugu

SEQ ID NO: 1400305 - RNA, 20 nt, Human
gaaggacuaauagaaaagua

SEQ ID NO: 1400306 - RNA, 21 nt, Human
gaaggacuaugaaaagcuaga

SEQ ID NO: 1400307 - RNA, 19 nt, Human
gaaggacuaauagaaaagu

SEQ ID NO: 1400308 - RNA, 18 nt, Human
gaaggagaaucaucagga

SEQ ID NO: 1400309 - RNA, 22 nt, Human
gaaggagaaucaucaggacccu

SEQ ID NO: 1400310 - RNA, 17 nt, Human
gaagguaaauaaaaaga

SEQ ID NO: 1400311 - RNA, 13 nt, Human
gaagguaaauaaa

SEQ ID NO: 1400312 - RNA, 14 nt, Human
gaaggguaaacaau

SEQ ID NO: 1400313 - RNA, 20 nt, Human
gaagguuaucagugcuuccc

SEQ ID NO: 1400314 - RNA, 22 nt, Human
gaagguaaauaaaaagaaaggc

SEQ ID NO: 1400315 - RNA, 17 nt, Human
gaaggguaaacaauaua

SEQ ID NO: 1400316 - RNA, 13 nt, Human
gaaggguaaacaa

SEQ ID NO: 1400317 - RNA, 17 nt, Human
gaagggguuggauugca

SEQ ID NO: 1400318 - RNA, 15 nt, Human
gaaggcaggcagggc

SEQ ID NO: 1400319 - RNA, 14 nt, Human
gaaggcaggcaggg

SEQ ID NO: 1400320 - RNA, 13 nt, Human
gaaggcaggcagg

SEQ ID NO: 1400321 - RNA, 23 nt, Human
gaaggcaggcagggcucuccugg

SEQ ID NO: 1400322 - RNA, 22 nt, Human
gaaggcaggcagggcucuccug

SEQ ID NO: 1400323 - RNA, 21 nt, Human
gaaggcaggcagggcucuccu

SEQ ID NO: 1400324 - RNA, 19 nt, Human
gaaggcaggcagggcucuc

SEQ ID NO: 1400325 - RNA, 18 nt, Human
gaaggcaggcagggcucu

SEQ ID NO: 1400326 - RNA, 17 nt, Human
gaaggcaggcagggcuc

SEQ ID NO: 1400327 - RNA, 16 nt, Human
gaaggcaggcagggcu

SEQ ID NO: 1400328 - RNA, 14 nt, Human
gaaggcagggagga

SEQ ID NO: 1400329 - RNA, 16 nt, Human
gaaggcagggaggagg

SEQ ID NO: 1400330 - RNA, 17 nt, Human
gaaggcagggaggaggc

SEQ ID NO: 1400331 - RNA, 18 nt, Human
gaaggcagggaggaggca

SEQ ID NO: 1400332 - RNA, 20 nt, Human
gaaggcagggaggaggcaga

SEQ ID NO: 1400333 - RNA, 23 nt, Human
gaaucuugguuugccuuccagaa

SEQ ID NO: 1400334 - RNA, 20 nt, Human
gaaucuugguuugccuucca

SEQ ID NO: 1400335 - RNA, 15 nt, Human
gaaucuugguuugcc

SEQ ID NO: 1400336 - RNA, 22 nt, Human
gaaucuuaagguguagccacac

SEQ ID NO: 1400337 - RNA, 13 nt, Human
gaaucuugucuca

SEQ ID NO: 1400338 - RNA, 14 nt, Human
gaaucuugucucaa

SEQ ID NO: 1400339 - RNA, 15 nt, Human
gaaucuugucucaau

SEQ ID NO: 1400340 - RNA, 16 nt, Human
gaaucuugucucaaug

SEQ ID NO: 1400341 - RNA, 18 nt, Human
gaaucuugucucaaugcu

SEQ ID NO: 1400342 - RNA, 20 nt, Human
gaaucuugucucaaugcuca

SEQ ID NO: 1400343 - RNA, 21 nt, Human
gaaucuugucucaaugcucau

SEQ ID NO: 1400344 - RNA, 22 nt, Human
gaaucuugucucaaugcucaua

SEQ ID NO: 1400345 - RNA, 14 nt, Human
gaauccugucgauu

SEQ ID NO: 1400346 - RNA, 20 nt, Human
gaauccuaggcuccacccca

SEQ ID NO: 1400347 - RNA, 21 nt, Human
gaaucccuuaacaguuguauu

SEQ ID NO: 1400348 - RNA, 19 nt, Human
gaaucccuuaacaguugua

SEQ ID NO: 1400349 - RNA, 21 nt, Human
gaaucuuaagguguagccaca

SEQ ID NO: 1400350 - RNA, 14 nt, Human
gaaucugugugaaa

SEQ ID NO: 1400351 - RNA, 20 nt, Human
gaaucugugggucugggagu

SEQ ID NO: 1400352 - RNA, 19 nt, Human
gaaucugugggucugggag

SEQ ID NO: 1400353 - RNA, 23 nt, Human
gaaucucaguugauuuucuggau

SEQ ID NO: 1400354 - RNA, 24 nt, Human
gaaucauuuagcauguuguugaaa

SEQ ID NO: 1400355 - RNA, 22 nt, Human
gaaucauuucuauuucuccucc

SEQ ID NO: 1400356 - RNA, 13 nt, Human
gaaucauuuagca

SEQ ID NO: 1400357 - RNA, 20 nt, Human
gaaucauuguauguggucau

SEQ ID NO: 1400358 - RNA, 18 nt, Human
gaaucagccuacaggccu

SEQ ID NO: 1400359 - RNA, 23 nt, Human
gaaucagagaccuuccagaaaua

SEQ ID NO: 1400360 - RNA, 13 nt, Human
gaaucagaacuca

SEQ ID NO: 1400361 - RNA, 16 nt, Human
gaaucccuuaacaguu

SEQ ID NO: 1400362 - RNA, 19 nt, Human
gaauccccaacaugcacug

SEQ ID NO: 1400363 - RNA, 22 nt, Human
gaaucccagcccccugaccacu

SEQ ID NO: 1400364 - RNA, 19 nt, Human
gaaucccagcccccugacc

SEQ ID NO: 1400365 - RNA, 16 nt, Human
gaauccacauuucuaa

SEQ ID NO: 1400366 - RNA, 18 nt, Human
gaauccacauuucuaaaa

SEQ ID NO: 1400367 - RNA, 17 nt, Human
gaauccacauuucuaaa

SEQ ID NO: 1400368 - RNA, 20 nt, Human
gaaucacuguuuagaacaca

SEQ ID NO: 1400369 - RNA, 21 nt, Human
gaaucaauaauauauuuucug

SEQ ID NO: 1400370 - RNA, 23 nt, Human
gaauagccauauuuguaaaauga

SEQ ID NO: 1400371 - RNA, 16 nt, Human
gaauagauaugaaagc

SEQ ID NO: 1400372 - RNA, 20 nt, Human
gaauacuuugaauguguuuc

SEQ ID NO: 1400373 - RNA, 18 nt, Human
gaauagaagcuaagguuu

SEQ ID NO: 1400374 - RNA, 15 nt, Human
gaauagcaugucacu

SEQ ID NO: 1400375 - RNA, 18 nt, Human
gaauagccauauuuguaa

SEQ ID NO: 1400376 - RNA, 19 nt, Human
gaauagauaugaaagcuga

SEQ ID NO: 1400377 - RNA, 23 nt, Human
gaauagccacauuuggaauacuu

SEQ ID NO: 1400378 - RNA, 18 nt, Human
gaauagccacauuuggaa

SEQ ID NO: 1400379 - RNA, 15 nt, Human
gaauagccacauuug

SEQ ID NO: 1400380 - RNA, 20 nt, Human
gaaguaaacuuuuuguucug

SEQ ID NO: 1400381 - RNA, 13 nt, Human
gaaguaaacuuuu

SEQ ID NO: 1400382 - RNA, 19 nt, Human
gaaguaaaagcaaaaaaga

SEQ ID NO: 1400383 - RNA, 16 nt, Human
gaaguaaacuuuuugu

SEQ ID NO: 1400384 - RNA, 17 nt, Human
gaaguuuagcucugaga

SEQ ID NO: 1400385 - RNA, 11 nt, Human
gaaguuucauc

SEQ ID NO: 1400386 - RNA, 12 nt, Human
gaauaaaauuuu

SEQ ID NO: 1400387 - RNA, 20 nt, Human
gaauaaaggcaguuuucuaa

SEQ ID NO: 1400388 - RNA, 19 nt, Human
gaauaaaggcaguuuucua

SEQ ID NO: 1400389 - RNA, 17 nt, Human
gaauaaaggcaguuuuc

SEQ ID NO: 1400390 - RNA, 16 nt, Human
gaauaaaggcaguuuu

SEQ ID NO: 1400391 - RNA, 15 nt, Human
gaauaaaggcaguuu

SEQ ID NO: 1400392 - RNA, 17 nt, Human
gaauaaagaaugaaugg

SEQ ID NO: 1400393 - RNA, 11 nt, Human
gaauaaagcaa

SEQ ID NO: 1400394 - RNA, 13 nt, Human
gaauaaagcaauu

SEQ ID NO: 1400395 - RNA, 19 nt, Human
gaauaaguuauugcaguuu

SEQ ID NO: 1400396 - RNA, 18 nt, Human
gaauaaguuauugcaguu

SEQ ID NO: 1400397 - RNA, 16 nt, Human
gaauaaguuauugcag

SEQ ID NO: 1400398 - RNA, 14 nt, Human
gaauaaguuauugc

SEQ ID NO: 1400399 - RNA, 13 nt, Human
gaauaaguuauug

SEQ ID NO: 1400400 - RNA, 12 nt, Human
gaauaaguuauu

SEQ ID NO: 1400401 - RNA, 23 nt, Human
gaauaagguacaagaagcauuuu

SEQ ID NO: 1400402 - RNA, 20 nt, Human
gaauaagguacaagaagcau

SEQ ID NO: 1400403 - RNA, 19 nt, Human
gaauaagguacaagaagca

SEQ ID NO: 1400404 - RNA, 17 nt, Human
gaauaagguacaagaag

SEQ ID NO: 1400405 - RNA, 23 nt, Human
gaauaaaugucacuuuuugaggc

SEQ ID NO: 1400406 - RNA, 18 nt, Human
gaauaaaugucacuuuuu

SEQ ID NO: 1400407 - RNA, 16 nt, Human
gaauaaaugucacuuu

SEQ ID NO: 1400408 - RNA, 15 nt, Human
gaauaaaugucacuu

SEQ ID NO: 1400409 - RNA, 14 nt, Human
gaauaaaugucacu

SEQ ID NO: 1400410 - RNA, 19 nt, Human
gaauaaauuguacagccgg

SEQ ID NO: 1400411 - RNA, 17 nt, Human
gaauaaauuguacagcc

SEQ ID NO: 1400412 - RNA, 16 nt, Human
gaauaaauugauuuuu

SEQ ID NO: 1400413 - RNA, 18 nt, Human
gaauaagcucccagggcc

SEQ ID NO: 1400414 - RNA, 20 nt, Human
gaauaaauuguacagccggc

SEQ ID NO: 1400415 - RNA, 17 nt, Human
gaauagaagcuaagguu

SEQ ID NO: 1400416 - RNA, 23 nt, Human
gaauagaaauaaaggaugugauu

SEQ ID NO: 1400417 - RNA, 20 nt, Human
gaauacuuuuuacaauuaaa

SEQ ID NO: 1400418 - RNA, 14 nt, Human
gaauacuuuuuaca

SEQ ID NO: 1400419 - RNA, 19 nt, Human
gaauacuuuugcccuuuga

SEQ ID NO: 1400420 - RNA, 24 nt, Human
gaauacuuugcagcacagcugaga

SEQ ID NO: 1400421 - RNA, 18 nt, Human
gaauacuuugaauguguu

SEQ ID NO: 1400422 - RNA, 17 nt, Human
gaauacuuugaaugugu

SEQ ID NO: 1400423 - RNA, 16 nt, Human
gaauacuuugaaugug

SEQ ID NO: 1400424 - RNA, 13 nt, Human
gaauacugcuaca

SEQ ID NO: 1400425 - RNA, 22 nt, Human
gaauacugaacaucugaguccu

SEQ ID NO: 1400426 - RNA, 14 nt, Human
gaauacuuuauaaa

SEQ ID NO: 1400427 - RNA, 19 nt, Human
gaaauagcuuaugaaaaga

SEQ ID NO: 1400428 - RNA, 21 nt, Human
gaaauagcuuaugaaaagaau

SEQ ID NO: 1400429 - RNA, 18 nt, Human
gaaauagcuuaugaaaag

SEQ ID NO: 1400430 - RNA, 15 nt, Human
gaaauagcuuaugaa

SEQ ID NO: 1400431 - RNA, 18 nt, Human
gaaauagacagcaugaga

SEQ ID NO: 1400432 - RNA, 16 nt, Human
gaaauagaauuauaac

SEQ ID NO: 1400433 - RNA, 15 nt, Human
gaaauacuauuuaaa

SEQ ID NO: 1400434 - RNA, 14 nt, Human
gaaauacuauuuaa

SEQ ID NO: 1400435 - RNA, 17 nt, Human
gaaauacuacuguguaa

SEQ ID NO: 1400436 - RNA, 19 nt, Human
gaaauacaguucugcucug

SEQ ID NO: 1400437 - RNA, 17 nt, Human
gaaauacaguucugcuc

SEQ ID NO: 1400438 - RNA, 17 nt, Human
gaaauacagacuggaug

SEQ ID NO: 1400439 - RNA, 17 nt, Human
gaaauacagauuuugau

SEQ ID NO: 1400440 - RNA, 22 nt, Human
gaaauacagauuuugauagcaa

SEQ ID NO: 1400441 - RNA, 14 nt, Human
gaaauacaaaaaua

SEQ ID NO: 1400442 - RNA, 13 nt, Human
gaaauacaaaaau

SEQ ID NO: 1400443 - RNA, 21 nt, Human
gaaauaauuguuguucuguua

SEQ ID NO: 1400444 - RNA, 18 nt, Human
gaaauacaaaaauacuca

SEQ ID NO: 1400445 - RNA, 18 nt, Human
gaaauaugcacaauagca

SEQ ID NO: 1400446 - RNA, 17 nt, Human
gaaauaugcacaauagc

SEQ ID NO: 1400447 - RNA, 20 nt, Human
gaaauaugaagaacugagga

SEQ ID NO: 1400448 - RNA, 19 nt, Human
gaaauaucuucacuuguca

SEQ ID NO: 1400449 - RNA, 23 nt, Human
gaaauauacuuuuacaaguaaca

SEQ ID NO: 1400450 - RNA, 21 nt, Human
gaaauauacuuuuacaaguaa

SEQ ID NO: 1400451 - RNA, 17 nt, Human
gaaauauaggaacuuaa

SEQ ID NO: 1400452 - RNA, 22 nt, Human
gaaauaauuguuguucuguuaa

SEQ ID NO: 1400453 - RNA, 20 nt, Human
gaaauaauuguuguucuguu

SEQ ID NO: 1400454 - RNA, 19 nt, Human
gaaauaauuguuguucugu

SEQ ID NO: 1400455 - RNA, 15 nt, Human
gaaauaauuguuguu

SEQ ID NO: 1400456 - RNA, 13 nt, Human
gaaauaauuguug

SEQ ID NO: 1400457 - RNA, 22 nt, Human
gaaauaauguguaguucaugua

SEQ ID NO: 1400458 - RNA, 13 nt, Human
gaaauaaugugua

SEQ ID NO: 1400459 - RNA, 12 nt, Human
gaaauaaugugu

SEQ ID NO: 1400460 - RNA, 21 nt, Human
gaaauaaguuuuuguuucaca

SEQ ID NO: 1400461 - RNA, 20 nt, Human
gaaauaagugcccucuccca

SEQ ID NO: 1400462 - RNA, 18 nt, Human
gaaauaagugcccucucc

SEQ ID NO: 1400463 - RNA, 23 nt, Human
gaaauaagcuauuugauguaaua

SEQ ID NO: 1400464 - RNA, 20 nt, Human
gaaauaagcuauuugaugua

SEQ ID NO: 1400465 - RNA, 19 nt, Human
gaaauaagcuauuugaugu

SEQ ID NO: 1400466 - RNA, 18 nt, Human
gaaauaagcuauuugaug

SEQ ID NO: 1400467 - RNA, 15 nt, Human
gaaauaagcuauuug

SEQ ID NO: 1400468 - RNA, 21 nt, Human
gaaauaaauguaucauagaaa

SEQ ID NO: 1400469 - RNA, 23 nt, Human
gaaacaguugguaacuuuuguga

SEQ ID NO: 1400470 - RNA, 21 nt, Human
gaaacaguugguaacuuuugu

SEQ ID NO: 1400471 - RNA, 20 nt, Human
gaaacaguugguaacuuuug

SEQ ID NO: 1400472 - RNA, 19 nt, Human
gaaacaguugguaacuuuu

SEQ ID NO: 1400473 - RNA, 18 nt, Human
gaaacaguugguaacuuu

SEQ ID NO: 1400474 - RNA, 23 nt, Human
gaaacaguugcauguaguaacac

SEQ ID NO: 1400475 - RNA, 20 nt, Human
gaaacaguugcauguaguaa

SEQ ID NO: 1400476 - RNA, 19 nt, Human
gaaacaguugcauguagua

SEQ ID NO: 1400477 - RNA, 17 nt, Human
gaaacaguugcauguag

SEQ ID NO: 1400478 - RNA, 19 nt, Human
gaaauaaagucagauggaa

SEQ ID NO: 1400479 - RNA, 14 nt, Human
gaaauaaagucaga

SEQ ID NO: 1400480 - RNA, 13 nt, Human
gaaacauuuauau

SEQ ID NO: 1400481 - RNA, 11 nt, Human
gaaacauuugg

SEQ ID NO: 1400482 - RNA, 18 nt, Human
gaaauuuagcauuguagu

SEQ ID NO: 1400483 - RNA, 16 nt, Human
gaaauuuagcauugua

SEQ ID NO: 1400484 - RNA, 14 nt, Human
gaaauuuagcauug

SEQ ID NO: 1400485 - RNA, 12 nt, Human
gaaauuuagcau

SEQ ID NO: 1400486 - RNA, 23 nt, Human
gaaauuuaaagcagguucuuguu

SEQ ID NO: 1400487 - RNA, 22 nt, Human
gaaauuuaaagcagguucuugu

SEQ ID NO: 1400488 - RNA, 14 nt, Human
gaaauuuaaagcag

SEQ ID NO: 1400489 - RNA, 13 nt, Human
gaaauuuaaagca

SEQ ID NO: 1400490 - RNA, 23 nt, Human
gaaauuuaaacuauaagcaagaa

SEQ ID NO: 1400491 - RNA, 20 nt, Human
gaaauuuaaacuauaagcaa

SEQ ID NO: 1400492 - RNA, 14 nt, Human
gaaauuuaaacuau

SEQ ID NO: 1400493 - RNA, 13 nt, Human
gaaauuuaaacua

SEQ ID NO: 1400494 - RNA, 23 nt, Human
gaacacuggggacuuggccucuc

SEQ ID NO: 1400495 - RNA, 22 nt, Human
gaacacuggggacuuggccucu

SEQ ID NO: 1400496 - RNA, 13 nt, Human
gaacacuggggac

SEQ ID NO: 1400497 - RNA, 22 nt, Human
gaaauuuuauaugcuuacugau

SEQ ID NO: 1400498 - RNA, 19 nt, Human
gaaauuuuauaugcuuacu

SEQ ID NO: 1400499 - RNA, 15 nt, Human
gaaauuuuauaugcu

SEQ ID NO: 1400500 - RNA, 22 nt, Human
gaaauuuuaaccuaugauauuu

SEQ ID NO: 1400501 - RNA, 21 nt, Human
gaaauugaauacuuugaaugu

SEQ ID NO: 1400502 - RNA, 22 nt, Human
gaaauugaauacuuugaaugug

SEQ ID NO: 1400503 - RNA, 20 nt, Human
gaaauugaauacuuugaaug

SEQ ID NO: 1400504 - RNA, 19 nt, Human
gaaauugaauacuuugaau

SEQ ID NO: 1400505 - RNA, 18 nt, Human
gaaauugaauacuuugaa

SEQ ID NO: 1400506 - RNA, 17 nt, Human
gaaauugaauacuuuga

SEQ ID NO: 1400507 - RNA, 16 nt, Human
gaaauugaauacuuug

SEQ ID NO: 1400508 - RNA, 13 nt, Human
gaaauugaauacu

SEQ ID NO: 1400509 - RNA, 21 nt, Human
gaaauugaaccuuugugcccu

SEQ ID NO: 1400510 - RNA, 17 nt, Human
gaaauugaaccuuugug

SEQ ID NO: 1400511 - RNA, 14 nt, Human
gaaauugaaccuuu

SEQ ID NO: 1400512 - RNA, 23 nt, Human
gaaauucuuucccagucugucga

SEQ ID NO: 1400513 - RNA, 22 nt, Human
gaaauucuuucccagucugucg

SEQ ID NO: 1400514 - RNA, 17 nt, Human
gaaauucguguguuuuu

SEQ ID NO: 1400515 - RNA, 17 nt, Human
gaaauucuccuggaggu

SEQ ID NO: 1400516 - RNA, 15 nt, Human
gaaauugauuuugaa

SEQ ID NO: 1400517 - RNA, 17 nt, Human
gaaauugccugacgaac

SEQ ID NO: 1400518 - RNA, 18 nt, Human
gaaauugcuuuguauugu

SEQ ID NO: 1400519 - RNA, 16 nt, Human
gaaauuggaagagcac

SEQ ID NO: 1400520 - RNA, 16 nt, Human
gaaauucuccuggagg

SEQ ID NO: 1400521 - RNA, 15 nt, Human
gaaauucuccuggag

SEQ ID NO: 1400522 - RNA, 14 nt, Human
gaaauucuccugga

SEQ ID NO: 1400523 - RNA, 19 nt, Human
gaaauucguguguuuuuuu

SEQ ID NO: 1400524 - RNA, 15 nt, Human
gaaauucguguguuu

SEQ ID NO: 1400525 - RNA, 15 nt, Human
gaaauuaccugugga

SEQ ID NO: 1400526 - RNA, 17 nt, Human
gaaauuacacccaaaga

SEQ ID NO: 1400527 - RNA, 23 nt, Human
gaaauuaagacuuuauguaguuu

SEQ ID NO: 1400528 - RNA, 22 nt, Human
gaaauuaagaaggcaaaaaugu

SEQ ID NO: 1400529 - RNA, 18 nt, Human
gaaauuaagaaggcaaaa

SEQ ID NO: 1400530 - RNA, 17 nt, Human
gaaauuaagaaggcaaa

SEQ ID NO: 1400531 - RNA, 22 nt, Human
gaaauguuuuuaauaaaagaaa

SEQ ID NO: 1400532 - RNA, 21 nt, Human
gaaauguuuuuaauaaaagaa

SEQ ID NO: 1400533 - RNA, 19 nt, Human
gaaauguuuuuaauaaaag

SEQ ID NO: 1400534 - RNA, 22 nt, Human
gaaauguuauuuuuuaauuauu

SEQ ID NO: 1400535 - RNA, 21 nt, Human
gaaauguuauuuuuuaauuau

SEQ ID NO: 1400536 - RNA, 14 nt, Human
gaaauguaaggcug

SEQ ID NO: 1400537 - RNA, 21 nt, Human
gaaauguaaggcuguguaaga

SEQ ID NO: 1400538 - RNA, 13 nt, Human
gaaaugguuguau

SEQ ID NO: 1400539 - RNA, 14 nt, Human
gaaaugguuguauu

SEQ ID NO: 1400540 - RNA, 15 nt, Human
gaaaugguuguauua

SEQ ID NO: 1400541 - RNA, 17 nt, Human
gaaaugguuguauuaga

SEQ ID NO: 1400542 - RNA, 18 nt, Human
gaaaugguuguauuagau

SEQ ID NO: 1400543 - RNA, 19 nt, Human
gaaaugguuguauuagaug

SEQ ID NO: 1400544 - RNA, 20 nt, Human
gaaaugguuguauuagaugu

SEQ ID NO: 1400545 - RNA, 18 nt, Human
gaaaugguacuguacagc

SEQ ID NO: 1400546 - RNA, 21 nt, Human
gaaaugguacuguacagcugg

SEQ ID NO: 1400547 - RNA, 16 nt, Human
gaaauggcuuugugau

SEQ ID NO: 1400548 - RNA, 15 nt, Human
gaaauauucccuaga

SEQ ID NO: 1400549 - RNA, 16 nt, Human
gaaauauuauguuaaa

SEQ ID NO: 1400550 - RNA, 13 nt, Human
gaaauauuauguu

SEQ ID NO: 1400551 - RNA, 22 nt, Human
gaacuugccugccuuuccaucc

SEQ ID NO: 1400552 - RNA, 24 nt, Human
gaacuugcgagaaauucguguguu

SEQ ID NO: 1400553 - RNA, 22 nt, Human
gaacuugcugcugagugcacca

SEQ ID NO: 1400554 - RNA, 21 nt, Human
gaacuuguaaaggaauuuaaa

SEQ ID NO: 1400555 - RNA, 21 nt, Human
gaagaagcaccaaucaugaau

SEQ ID NO: 1400556 - RNA, 20 nt, Human
gaagaaacaagguuuucagu

SEQ ID NO: 1400557 - RNA, 16 nt, Human
gaagaaagaacggaag

SEQ ID NO: 1400558 - RNA, 19 nt, Human
gaagaaagaacggaagaag

SEQ ID NO: 1400559 - RNA, 14 nt, Human
gaagaaaaagaagc

SEQ ID NO: 1400560 - RNA, 13 nt, Human
gaagaaaaagaag

SEQ ID NO: 1400561 - RNA, 22 nt, Human
gaacuuguaaaggaauuuaaaa

SEQ ID NO: 1400562 - RNA, 16 nt, Human
gaacucaacuuugaca

SEQ ID NO: 1400563 - RNA, 23 nt, Human
gaacucaaauggggccagaucca

SEQ ID NO: 1400564 - RNA, 22 nt, Human
gaacucaaauggggccagaucc

SEQ ID NO: 1400565 - RNA, 20 nt, Human
gaacucaaauggggccagau

SEQ ID NO: 1400566 - RNA, 19 nt, Human
gaacucaaauggggccaga

SEQ ID NO: 1400567 - RNA, 16 nt, Human
gaacucaaauggggcc

SEQ ID NO: 1400568 - RNA, 20 nt, Human
gaacuauuuucaaagacuua

SEQ ID NO: 1400569 - RNA, 19 nt, Human
gaacuauuuucaaagacuu

SEQ ID NO: 1400570 - RNA, 22 nt, Human
gaacuauuuucaaagacuuaag

SEQ ID NO: 1400571 - RNA, 15 nt, Human
gaacucaacuuugac

SEQ ID NO: 1400572 - RNA, 17 nt, Human
gaacugucucucaugaa

SEQ ID NO: 1400573 - RNA, 20 nt, Human
gaacuuagauuuuacaugaa

SEQ ID NO: 1400574 - RNA, 21 nt, Human
gaacugucucucaugaaccuc

SEQ ID NO: 1400575 - RNA, 18 nt, Human
gaacuucagaaagacuug

SEQ ID NO: 1400576 - RNA, 14 nt, Human
gaacuucagaaaga

SEQ ID NO: 1400577 - RNA, 13 nt, Human
gaacuucagaaag

SEQ ID NO: 1400578 - RNA, 19 nt, Human
gaacuuagauuuuacauga

SEQ ID NO: 1400579 - RNA, 17 nt, Human
gaacuuagauuuuacau

SEQ ID NO: 1400580 - RNA, 16 nt, Human
gaacuuagauuuuaca

SEQ ID NO: 1400581 - RNA, 22 nt, Human
gaacuuccagauccuggaaauc

SEQ ID NO: 1400582 - RNA, 23 nt, Human
gaacuuccagguguuacuguaau

SEQ ID NO: 1400583 - RNA, 15 nt, Human
gaacuugacccugag

SEQ ID NO: 1400584 - RNA, 13 nt, Human
gaacuugaggaca

SEQ ID NO: 1400585 - RNA, 14 nt, Human
gaacuugaggacac

SEQ ID NO: 1400586 - RNA, 15 nt, Human
gaacuugaggacaca

SEQ ID NO: 1400587 - RNA, 16 nt, Human
gaacuugaggacacau

SEQ ID NO: 1400588 - RNA, 17 nt, Human
gaacuugaggacacaug

SEQ ID NO: 1400589 - RNA, 19 nt, Human
gaacuugccugccuuucca

SEQ ID NO: 1400590 - RNA, 17 nt, Human
gaacuugccugccuuuc

SEQ ID NO: 1400591 - RNA, 16 nt, Human
gaacuugccugccuuu

SEQ ID NO: 1400592 - RNA, 11 nt, Human
gaacuugccug

SEQ ID NO: 1400593 - RNA, 23 nt, Human
gaacuugcauugugauuggccug

SEQ ID NO: 1400594 - RNA, 15 nt, Human
gaacuugcauuguga

SEQ ID NO: 1400595 - RNA, 18 nt, Human
gaacuugaggacacaugu

SEQ ID NO: 1400596 - RNA, 19 nt, Human
gaacuugaggacacauguc

SEQ ID NO: 1400597 - RNA, 21 nt, Human
gaacuugaggacacaugucca

SEQ ID NO: 1400598 - RNA, 23 nt, Human
gaacagaacauagacagaagaaa

SEQ ID NO: 1400599 - RNA, 23 nt, Human
gaaccuacaguuuuaacugugga

SEQ ID NO: 1400600 - RNA, 21 nt, Human
gaaccuacaguuuuaacugug

SEQ ID NO: 1400601 - RNA, 19 nt, Human
gaaccuacaguuuuaacug

SEQ ID NO: 1400602 - RNA, 18 nt, Human
gaaccuacaguuuuaacu

SEQ ID NO: 1400603 - RNA, 19 nt, Human
gaaccuaauucaauucaaa

SEQ ID NO: 1400604 - RNA, 19 nt, Human
gaaccguuuugaagcuacu

SEQ ID NO: 1400605 - RNA, 18 nt, Human
gaaccguuuugaagcuac

SEQ ID NO: 1400606 - RNA, 17 nt, Human
gaaccguuuugaagcua

SEQ ID NO: 1400607 - RNA, 20 nt, Human
gaaccugaugaaaauaaaga

SEQ ID NO: 1400608 - RNA, 15 nt, Human
gaaccugaugaaaau

SEQ ID NO: 1400609 - RNA, 16 nt, Human
gaaccggagagccagc

SEQ ID NO: 1400610 - RNA, 17 nt, Human
gaaccggagagccagcu

SEQ ID NO: 1400611 - RNA, 15 nt, Human
gaacgucuuaucuaa

SEQ ID NO: 1400612 - RNA, 22 nt, Human
gaacuagaguuuagcuggaaaa

SEQ ID NO: 1400613 - RNA, 12 nt, Human
gaaccugugucc

SEQ ID NO: 1400614 - RNA, 21 nt, Human
gaaccuggguugcagacagga

SEQ ID NO: 1400615 - RNA, 14 nt, Human
gaaccuggccuuca

SEQ ID NO: 1400616 - RNA, 16 nt, Human
gaaccuggccuucagu

SEQ ID NO: 1400617 - RNA, 13 nt, Human
gaaccuggccuuc

SEQ ID NO: 1400618 - RNA, 12 nt, Human
gaaccuggccuu

SEQ ID NO: 1400619 - RNA, 11 nt, Human
gaaccuggccu

SEQ ID NO: 1400620 - RNA, 16 nt, Human
gaaccuggaacuuggg

SEQ ID NO: 1400621 - RNA, 16 nt, Human
gaaccugaugaaaaua

SEQ ID NO: 1400622 - RNA, 15 nt, Human
gagcccagggaggcc

SEQ ID NO: 1400623 - RNA, 11 nt, Human
gagcccaggga

SEQ ID NO: 1400624 - RNA, 22 nt, Human
gagcccaggcucggccugcccc

SEQ ID NO: 1400625 - RNA, 21 nt, Human
gagcccaggcucggccugccc

SEQ ID NO: 1400626 - RNA, 12 nt, Human
gagcccaggcuc

SEQ ID NO: 1400627 - RNA, 11 nt, Human
gagcccaggcu

SEQ ID NO: 1400628 - RNA, 14 nt, Human
gagcccaagggaau

SEQ ID NO: 1400629 - RNA, 24 nt, Human
gagcccaggccaggacucugcagc

SEQ ID NO: 1400630 - RNA, 13 nt, Human
gagccauuugaga

SEQ ID NO: 1400631 - RNA, 12 nt, Human
gagccauguuuc

SEQ ID NO: 1400632 - RNA, 22 nt, Human
gagccaugucuucucccuggaa

SEQ ID NO: 1400633 - RNA, 18 nt, Human
gagccaugucuucucccu

SEQ ID NO: 1400634 - RNA, 17 nt, Human
gagccaugcgcccccuc

SEQ ID NO: 1400635 - RNA, 15 nt, Human
gagccacuccucuga

SEQ ID NO: 1400636 - RNA, 14 nt, Human
gagccacuccucug

SEQ ID NO: 1400637 - RNA, 18 nt, Human
gagcagaaggggagaugg

SEQ ID NO: 1400638 - RNA, 17 nt, Human
gagcagaaggggagaug

SEQ ID NO: 1400639 - RNA, 16 nt, Human
gagcagaagcagcaac

SEQ ID NO: 1400640 - RNA, 14 nt, Human
gagcagaagcagca

SEQ ID NO: 1400641 - RNA, 12 nt, Human
gagcagaagcag

SEQ ID NO: 1400642 - RNA, 23 nt, Human
gagcagaaaacccuugggccaga

SEQ ID NO: 1400643 - RNA, 22 nt, Human
gagcagaaaacccuugggccag

SEQ ID NO: 1400644 - RNA, 13 nt, Human
gagcacugcucca

SEQ ID NO: 1400645 - RNA, 17 nt, Human
gagcaccugcugucugg

SEQ ID NO: 1400646 - RNA, 14 nt, Human
gagcagaggucucc

SEQ ID NO: 1400647 - RNA, 22 nt, Human
gagcagaccaccccgccugccc

SEQ ID NO: 1400648 - RNA, 18 nt, Human
gagcagcaggagggggga

SEQ ID NO: 1400649 - RNA, 22 nt, Human
gagcagcaccuccucagccuga

SEQ ID NO: 1400650 - RNA, 21 nt, Human
gagcagcaccuccucagccug

SEQ ID NO: 1400651 - RNA, 20 nt, Human
gagcagcaccuccucagccu

SEQ ID NO: 1400652 - RNA, 19 nt, Human
gagcagcaccuccucagcc

SEQ ID NO: 1400653 - RNA, 15 nt, Human
gagcagcaccuccuc

SEQ ID NO: 1400654 - RNA, 14 nt, Human
gagcagcaccuccu

SEQ ID NO: 1400655 - RNA, 11 nt, Human
gagcagcaccu

SEQ ID NO: 1400656 - RNA, 19 nt, Human
gagcaggcagccagcaucu

SEQ ID NO: 1400657 - RNA, 17 nt, Human
gagcaggcagccagcau

SEQ ID NO: 1400658 - RNA, 16 nt, Human
gagcaggcagccagca

SEQ ID NO: 1400659 - RNA, 11 nt, Human
gagcaggcagc

SEQ ID NO: 1400660 - RNA, 20 nt, Human
gagcaggaggccuaggaggg

SEQ ID NO: 1400661 - RNA, 21 nt, Human
gagcaggaggccuaggagggu

SEQ ID NO: 1400662 - RNA, 21 nt, Human
gagcagcaggaggggggaggg

SEQ ID NO: 1400663 - RNA, 22 nt, Human
gagcagcaggaggggggaggga

SEQ ID NO: 1400664 - RNA, 20 nt, Human
gagcaggacugaugucuccu

SEQ ID NO: 1400665 - RNA, 14 nt, Human
gagccaccaguucu

SEQ ID NO: 1400666 - RNA, 20 nt, Human
gagcacaauaaauggcugua

SEQ ID NO: 1400667 - RNA, 22 nt, Human
gagcaaagccuguucauggcag

SEQ ID NO: 1400668 - RNA, 22 nt, Human
gagcacaagaggagauccaggg

SEQ ID NO: 1400669 - RNA, 14 nt, Human
gagcaaagccuguu

SEQ ID NO: 1400670 - RNA, 13 nt, Human
gagcaaagccugu

SEQ ID NO: 1400671 - RNA, 19 nt, Human
gagcaccuccacauccucc

SEQ ID NO: 1400672 - RNA, 14 nt, Human
gagcaccuccacau

SEQ ID NO: 1400673 - RNA, 22 nt, Human
gagcaccgccugugaaauacca

SEQ ID NO: 1400674 - RNA, 16 nt, Human
gagcaccugcugucug

SEQ ID NO: 1400675 - RNA, 15 nt, Human
gagcaccugcugucu

SEQ ID NO: 1400676 - RNA, 14 nt, Human
gagcaccugcuguc

SEQ ID NO: 1400677 - RNA, 23 nt, Human
gagcaaagccuguucauggcaga

SEQ ID NO: 1400678 - RNA, 12 nt, Human
gagcaaagccug

SEQ ID NO: 1400679 - RNA, 23 nt, Human
gagcaaacugcaugcccagagac

SEQ ID NO: 1400680 - RNA, 22 nt, Human
gagcaaacugcaugcccagaga

SEQ ID NO: 1400681 - RNA, 20 nt, Human
gagcaaacugcaugcccaga

SEQ ID NO: 1400682 - RNA, 19 nt, Human
gagcaaacugcaugcccag

SEQ ID NO: 1400683 - RNA, 12 nt, Human
gagcaaaauaau

SEQ ID NO: 1400684 - RNA, 13 nt, Human
gaaugcuguacau

SEQ ID NO: 1400685 - RNA, 19 nt, Human
gaaugcugggacucagccu

SEQ ID NO: 1400686 - RNA, 18 nt, Human
gaaugcugggacucagcc

SEQ ID NO: 1400687 - RNA, 17 nt, Human
gaaugcugggacucagc

SEQ ID NO: 1400688 - RNA, 16 nt, Human
gaaugcugggacucag

SEQ ID NO: 1400689 - RNA, 14 nt, Human
gaaugcugggacuc

SEQ ID NO: 1400690 - RNA, 13 nt, Human
gaaugcugggacu

SEQ ID NO: 1400691 - RNA, 20 nt, Human
gaaugcuguacaucuauuuu

SEQ ID NO: 1400692 - RNA, 17 nt, Human
gaaugcuguacaucuau

SEQ ID NO: 1400693 - RNA, 15 nt, Human
gaaugcuguacaucu

SEQ ID NO: 1400694 - RNA, 14 nt, Human
gaaugcuguacauc

SEQ ID NO: 1400695 - RNA, 18 nt, Human
gagauauuaaugcccaga

SEQ ID NO: 1400696 - RNA, 11 nt, Human
gagauauuaau

SEQ ID NO: 1400697 - RNA, 14 nt, Human
gagaucaaagauga

SEQ ID NO: 1400698 - RNA, 13 nt, Human
gagaucaaagaug

SEQ ID NO: 1400699 - RNA, 19 nt, Human
gagauauuaaugcccagac

SEQ ID NO: 1400700 - RNA, 11 nt, Human
gagauauuuac

SEQ ID NO: 1400701 - RNA, 22 nt, Human
gagauauuuacaugaauugcau

SEQ ID NO: 1400702 - RNA, 20 nt, Human
gagaucaaagaugaaaagua

SEQ ID NO: 1400703 - RNA, 15 nt, Human
gagaucaaagaugaa

SEQ ID NO: 1400704 - RNA, 15 nt, Human
gagauccuuaucgaa

SEQ ID NO: 1400705 - RNA, 17 nt, Human
gagauccuccugcagac

SEQ ID NO: 1400706 - RNA, 23 nt, Human
gagauccuccugcagaccacgcc

SEQ ID NO: 1400707 - RNA, 14 nt, Human
gagauccuccugca

SEQ ID NO: 1400708 - RNA, 13 nt, Human
gagauccuccugc

SEQ ID NO: 1400709 - RNA, 13 nt, Human
gagaucaggaaga

SEQ ID NO: 1400710 - RNA, 20 nt, Human
gagaucaggaagagaaggag

SEQ ID NO: 1400711 - RNA, 23 nt, Human
gagccuggggcucuaacgccuga

SEQ ID NO: 1400712 - RNA, 15 nt, Human
gagccuggggcucua

SEQ ID NO: 1400713 - RNA, 13 nt, Human
gagccuggggcuc

SEQ ID NO: 1400714 - RNA, 11 nt, Human
gagccuggggc

SEQ ID NO: 1400715 - RNA, 23 nt, Human
gagccuggcuccguccaggagcc

SEQ ID NO: 1400716 - RNA, 19 nt, Human
gagcgugagcugagcaggc

SEQ ID NO: 1400717 - RNA, 17 nt, Human
gagcgugagcugagcag

SEQ ID NO: 1400718 - RNA, 16 nt, Human
gagcgugagcugagca

SEQ ID NO: 1400719 - RNA, 23 nt, Human
gagccugugaacccaggacaagc

SEQ ID NO: 1400720 - RNA, 21 nt, Human
gagccugugaacccaggacaa

SEQ ID NO: 1400721 - RNA, 20 nt, Human
gagccugugaacccaggaca

SEQ ID NO: 1400722 - RNA, 19 nt, Human
gagccugugaacccaggac

SEQ ID NO: 1400723 - RNA, 18 nt, Human
gagccugugaacccagga

SEQ ID NO: 1400724 - RNA, 17 nt, Human
gagccugugaacccagg

SEQ ID NO: 1400725 - RNA, 16 nt, Human
gagccugugaacccag

SEQ ID NO: 1400726 - RNA, 21 nt, Human
gagccuguccugccuguggcc

SEQ ID NO: 1400727 - RNA, 19 nt, Human
gagccuguccugccugugg

SEQ ID NO: 1400728 - RNA, 18 nt, Human
gagccuguccugccugug

SEQ ID NO: 1400729 - RNA, 17 nt, Human
gagccuguccugccugu

SEQ ID NO: 1400730 - RNA, 15 nt, Human
gagccuguccugccu

SEQ ID NO: 1400731 - RNA, 12 nt, Human
gagccuguccug

SEQ ID NO: 1400732 - RNA, 11 nt, Human
gagccuguccu

SEQ ID NO: 1400733 - RNA, 15 nt, Human
gagccuguaaacuuu

SEQ ID NO: 1400734 - RNA, 12 nt, Human
gagcuacaaaug

SEQ ID NO: 1400735 - RNA, 13 nt, Human
gagcuacaaaugc

SEQ ID NO: 1400736 - RNA, 18 nt, Human
gagccuccuuucuggcuu

SEQ ID NO: 1400737 - RNA, 13 nt, Human
gagccugcaggau

SEQ ID NO: 1400738 - RNA, 15 nt, Human
gagccugcaggaucu

SEQ ID NO: 1400739 - RNA, 17 nt, Human
gagcuucccugacucau

SEQ ID NO: 1400740 - RNA, 13 nt, Human
gagcuucccugac

SEQ ID NO: 1400741 - RNA, 19 nt, Human
gagcuucauggcagaaggc

SEQ ID NO: 1400742 - RNA, 16 nt, Human
gagcuucauggcagaa

SEQ ID NO: 1400743 - RNA, 22 nt, Human
gagcuuaaucuuugaaagguua

SEQ ID NO: 1400744 - RNA, 21 nt, Human
gagcuuaaucuuugaaagguu

SEQ ID NO: 1400745 - RNA, 17 nt, Human
gagcuuaaaauacaaga

SEQ ID NO: 1400746 - RNA, 16 nt, Human
gagcuuaaaauacaag

SEQ ID NO: 1400747 - RNA, 15 nt, Human
gagcuuaaaauacaa

SEQ ID NO: 1400748 - RNA, 17 nt, Human
gagcugcccacagcagg

SEQ ID NO: 1400749 - RNA, 18 nt, Human
gagcugcccacagcaggc

SEQ ID NO: 1400750 - RNA, 19 nt, Human
gagcugcccacagcaggcc

SEQ ID NO: 1400751 - RNA, 23 nt, Human
gagcucugagaggcccuggauca

SEQ ID NO: 1400752 - RNA, 22 nt, Human
gagcucugagaggcccuggauc

SEQ ID NO: 1400753 - RNA, 21 nt, Human
gagcucugagaggcccuggau

SEQ ID NO: 1400754 - RNA, 17 nt, Human
gagcucuucauguuuca

SEQ ID NO: 1400755 - RNA, 18 nt, Human
gagcugauggagaaggaa

SEQ ID NO: 1400756 - RNA, 19 nt, Human
gagcugauggagaaggaag

SEQ ID NO: 1400757 - RNA, 23 nt, Human
gagcuccucccucucaacaccca

SEQ ID NO: 1400758 - RNA, 12 nt, Human
gagcuccucccu

SEQ ID NO: 1400759 - RNA, 18 nt, Human
gagcuccccuccccaacu

SEQ ID NO: 1400760 - RNA, 19 nt, Human
gagcuccccuccccaacug

SEQ ID NO: 1400761 - RNA, 17 nt, Human
gagcuccccuccccaac

SEQ ID NO: 1400762 - RNA, 15 nt, Human
gagcuccccucccca

SEQ ID NO: 1400763 - RNA, 21 nt, Human
gagcuccacucugcuucucug

SEQ ID NO: 1400764 - RNA, 18 nt, Human
gagcuccacucugcuucu

SEQ ID NO: 1400765 - RNA, 16 nt, Human
gagcuccacucugcuu

SEQ ID NO: 1400766 - RNA, 13 nt, Human
gagcuccacucug

SEQ ID NO: 1400767 - RNA, 12 nt, Human
gagcuccacucu

SEQ ID NO: 1400768 - RNA, 23 nt, Human
gagcucaggaugagggaaaagaa

SEQ ID NO: 1400769 - RNA, 13 nt, Human
gagcucaggauga

SEQ ID NO: 1400770 - RNA, 12 nt, Human
gagcucaggaug

SEQ ID NO: 1400771 - RNA, 20 nt, Human
gagcucugagaggcccugga

SEQ ID NO: 1400772 - RNA, 19 nt, Human
gagcucugagaggcccugg

SEQ ID NO: 1400773 - RNA, 18 nt, Human
gagcucugagaggcccug

SEQ ID NO: 1400774 - RNA, 17 nt, Human
gagcucugagaggcccu

SEQ ID NO: 1400775 - RNA, 16 nt, Human
gagcucugagaggccc

SEQ ID NO: 1400776 - RNA, 15 nt, Human
gagcucugagaggcc

SEQ ID NO: 1400777 - RNA, 14 nt, Human
gagcucugagaggc

SEQ ID NO: 1400778 - RNA, 13 nt, Human
gagcucugagagg

SEQ ID NO: 1400779 - RNA, 12 nt, Human
gagcucugagag

SEQ ID NO: 1400780 - RNA, 11 nt, Human
gagcucugaga

SEQ ID NO: 1400781 - RNA, 17 nt, Human
gagcucucugcccuuga

SEQ ID NO: 1400782 - RNA, 15 nt, Human
gagcucucugcccuu

SEQ ID NO: 1400783 - RNA, 19 nt, Human
gagcuccuguccccugcua

SEQ ID NO: 1400784 - RNA, 19 nt, Human
gagcucuauuaugaaugug

SEQ ID NO: 1400785 - RNA, 14 nt, Human
gagcuccucuucca

SEQ ID NO: 1400786 - RNA, 13 nt, Human
gagcuccucuucc

SEQ ID NO: 1400787 - RNA, 17 nt, Human
gagcuccuguccccugc

SEQ ID NO: 1400788 - RNA, 19 nt, Human
gagcuccucuuccaugcug

SEQ ID NO: 1400789 - RNA, 15 nt, Human
gagcuacguauuuaa

SEQ ID NO: 1400790 - RNA, 22 nt, Human
gagcuaccuguguggacaggac

SEQ ID NO: 1400791 - RNA, 20 nt, Human
gagcuaccuguguggacagg

SEQ ID NO: 1400792 - RNA, 19 nt, Human
gagcuaccuguguggacag

SEQ ID NO: 1400793 - RNA, 14 nt, Human
gagcuaccugugug

SEQ ID NO: 1400794 - RNA, 15 nt, Human
gagcuacauaauuua

SEQ ID NO: 1400795 - RNA, 13 nt, Human
gagcuaaggcucu

SEQ ID NO: 1400796 - RNA, 18 nt, Human
gagcuacccgcagaguuc

SEQ ID NO: 1400797 - RNA, 14 nt, Human
gagcuaaggcucua

SEQ ID NO: 1400798 - RNA, 11 nt, Human
gagcucaggau

SEQ ID NO: 1400799 - RNA, 20 nt, Human
gagcuacguauuuaauagca

SEQ ID NO: 1400800 - RNA, 11 nt, Human
gagcuacugcc

SEQ ID NO: 1400801 - RNA, 17 nt, Human
gagcuagaacccucugu

SEQ ID NO: 1400802 - RNA, 23 nt, Human
gagcucaggaaccgaggcaggga

SEQ ID NO: 1400803 - RNA, 11 nt, Human
gagcuaaggcu

SEQ ID NO: 1400804 - RNA, 14 nt, Human
gagcuacaaaugca

SEQ ID NO: 1400805 - RNA, 23 nt, Human
gaggcccuggaucagcguggccu

SEQ ID NO: 1400806 - RNA, 22 nt, Human
gaggcccuggaucagcguggcc

SEQ ID NO: 1400807 - RNA, 14 nt, Human
gaggcccuggauca

SEQ ID NO: 1400808 - RNA, 13 nt, Human
gaggcccuggauc

SEQ ID NO: 1400809 - RNA, 12 nt, Human
gaggcccuggau

SEQ ID NO: 1400810 - RNA, 21 nt, Human
gaggcccuccacaccugcggc

SEQ ID NO: 1400811 - RNA, 17 nt, Human
gaggcccucgcugccag

SEQ ID NO: 1400812 - RNA, 22 nt, Human
gaggcccuccacaccugcggcc

SEQ ID NO: 1400813 - RNA, 19 nt, Human
gaggcccuccacaccugcg

SEQ ID NO: 1400814 - RNA, 18 nt, Human
gaggcccuccacaccugc

SEQ ID NO: 1400815 - RNA, 17 nt, Human
gaggcccuccacaccug

SEQ ID NO: 1400816 - RNA, 12 nt, Human
gaggcccuccac

SEQ ID NO: 1400817 - RNA, 20 nt, Human
gaggcccgcaugcggcccag

SEQ ID NO: 1400818 - RNA, 20 nt, Human
gaggcccccagcccagggcu

SEQ ID NO: 1400819 - RNA, 19 nt, Human
gaggcccccagcccagggc

SEQ ID NO: 1400820 - RNA, 17 nt, Human
gaggcccccagcccagg

SEQ ID NO: 1400821 - RNA, 16 nt, Human
gaggcccccagcccag

SEQ ID NO: 1400822 - RNA, 15 nt, Human
gaggcccccagccca

SEQ ID NO: 1400823 - RNA, 22 nt, Human
gaggccagccuggccuccugcc

SEQ ID NO: 1400824 - RNA, 19 nt, Human
gaggccagggcagagugag

SEQ ID NO: 1400825 - RNA, 21 nt, Human
gaggcccccagcccagggcuc

SEQ ID NO: 1400826 - RNA, 20 nt, Human
gaggccccugucucagggug

SEQ ID NO: 1400827 - RNA, 18 nt, Human
gaggccuggacuuuccug

SEQ ID NO: 1400828 - RNA, 13 nt, Human
gaggccuggacuu

SEQ ID NO: 1400829 - RNA, 21 nt, Human
gaggccguggcugcuguggga

SEQ ID NO: 1400830 - RNA, 14 nt, Human
gaggccguggcugc

SEQ ID NO: 1400831 - RNA, 18 nt, Human
gaggccgaagcuaacagg

SEQ ID NO: 1400832 - RNA, 22 nt, Human
gaggcccugugccccuugacaa

SEQ ID NO: 1400833 - RNA, 21 nt, Human
gaggccuuacuuaaacccagc

SEQ ID NO: 1400834 - RNA, 19 nt, Human
gaggccuguuuggccucuc

SEQ ID NO: 1400835 - RNA, 17 nt, Human
gaggccugggcugggaa

SEQ ID NO: 1400836 - RNA, 18 nt, Human
gaggccugggcugggaaa

SEQ ID NO: 1400837 - RNA, 13 nt, Human
gaggccugggcug

SEQ ID NO: 1400838 - RNA, 22 nt, Human
gaggccugggccgcugccacgu

SEQ ID NO: 1400839 - RNA, 21 nt, Human
gaggccugggccgcugccacg

SEQ ID NO: 1400840 - RNA, 20 nt, Human
gaggccugggccgcugccac

SEQ ID NO: 1400841 - RNA, 16 nt, Human
gaggccugggccgcug

SEQ ID NO: 1400842 - RNA, 14 nt, Human
gaggccugggccgc

SEQ ID NO: 1400843 - RNA, 20 nt, Human
gaggccuggacuuuccugca

SEQ ID NO: 1400844 - RNA, 19 nt, Human
gaggccuggacuuuccugc

SEQ ID NO: 1400845 - RNA, 14 nt, Human
gaggcuuccuucau

SEQ ID NO: 1400846 - RNA, 17 nt, Human
gaggcuguucccaccag

SEQ ID NO: 1400847 - RNA, 18 nt, Human
gaggcuacuguaaggcaa

SEQ ID NO: 1400848 - RNA, 16 nt, Human
gagggcagagcuggug

SEQ ID NO: 1400849 - RNA, 17 nt, Human
gagggcagagcuggugc

SEQ ID NO: 1400850 - RNA, 14 nt, Human
gagggcagagcugg

SEQ ID NO: 1400851 - RNA, 22 nt, Human
gaggggccugccaccuggaccc

SEQ ID NO: 1400852 - RNA, 21 nt, Human
gaggggccugccaccuggacc

SEQ ID NO: 1400853 - RNA, 20 nt, Human
gaggggccugccaccuggac

SEQ ID NO: 1400854 - RNA, 19 nt, Human
gaggggccugccaccugga

SEQ ID NO: 1400855 - RNA, 17 nt, Human
gaggggccugccaccug

SEQ ID NO: 1400856 - RNA, 15 nt, Human
gaggggccugccacc

SEQ ID NO: 1400857 - RNA, 13 nt, Human
gaggggccugcca

SEQ ID NO: 1400858 - RNA, 23 nt, Human
gagggacaugcuuagcagucccc

SEQ ID NO: 1400859 - RNA, 22 nt, Human
gagggacaaaggagccugugaa

SEQ ID NO: 1400860 - RNA, 21 nt, Human
gagggacaaaggagccuguga

SEQ ID NO: 1400861 - RNA, 20 nt, Human
gagggacaaaggagccugug

SEQ ID NO: 1400862 - RNA, 19 nt, Human
gagggacaaaggagccugu

SEQ ID NO: 1400863 - RNA, 18 nt, Human
gagggacaaaggagccug

SEQ ID NO: 1400864 - RNA, 17 nt, Human
gagggacaaaggagccu

SEQ ID NO: 1400865 - RNA, 16 nt, Human
gagggacaaaggagcc

SEQ ID NO: 1400866 - RNA, 14 nt, Human
gagggaaugugaaa

SEQ ID NO: 1400867 - RNA, 19 nt, Human
gagggaagggagccaaggg

SEQ ID NO: 1400868 - RNA, 20 nt, Human
gagggaagggagccaaggga

SEQ ID NO: 1400869 - RNA, 17 nt, Human
gagggaagggagccaag

SEQ ID NO: 1400870 - RNA, 16 nt, Human
gagggaagggagccaa

SEQ ID NO: 1400871 - RNA, 15 nt, Human
gagggaagggagcca

SEQ ID NO: 1400872 - RNA, 14 nt, Human
gagggaagggagcc

SEQ ID NO: 1400873 - RNA, 16 nt, Human
gagggaaaggccagca

SEQ ID NO: 1400874 - RNA, 14 nt, Human
gaggcuuuccaugg

SEQ ID NO: 1400875 - RNA, 20 nt, Human
gaggcuuuggauuugacauu

SEQ ID NO: 1400876 - RNA, 16 nt, Human
gaggcuuuggauuuga

SEQ ID NO: 1400877 - RNA, 14 nt, Human
gaggcuuuggauuu

SEQ ID NO: 1400878 - RNA, 23 nt, Human
gaggcuuuaugauaauagauucu

SEQ ID NO: 1400879 - RNA, 14 nt, Human
gaggcuugguuccu

SEQ ID NO: 1400880 - RNA, 15 nt, Human
gagggacugucgcug

SEQ ID NO: 1400881 - RNA, 23 nt, Human
gagggacgccugggggugccagg

SEQ ID NO: 1400882 - RNA, 16 nt, Human
gagggacgccuggggg

SEQ ID NO: 1400883 - RNA, 15 nt, Human
gagggacgccugggg

SEQ ID NO: 1400884 - RNA, 14 nt, Human
gagggacgccuggg

SEQ ID NO: 1400885 - RNA, 15 nt, Human
gagggagaaauaguc

SEQ ID NO: 1400886 - RNA, 17 nt, Human
gaggccagccuggccuc

SEQ ID NO: 1400887 - RNA, 23 nt, Human
gagggacugucgcugcuucgugg

SEQ ID NO: 1400888 - RNA, 18 nt, Human
gagggacugucgcugcuu

SEQ ID NO: 1400889 - RNA, 16 nt, Human
gagggagaacaagacc

SEQ ID NO: 1400890 - RNA, 13 nt, Human
gaggauacgacag

SEQ ID NO: 1400891 - RNA, 21 nt, Human
gaggauguaaagaucaauaaa

SEQ ID NO: 1400892 - RNA, 21 nt, Human
gaggaguaacaauacaaaugg

SEQ ID NO: 1400893 - RNA, 20 nt, Human
gaggaguaacaauacaaaug

SEQ ID NO: 1400894 - RNA, 12 nt, Human
gaggaguaacaa

SEQ ID NO: 1400895 - RNA, 11 nt, Human
gaggaguaaca

SEQ ID NO: 1400896 - RNA, 22 nt, Human
gaggaggugucucaggcugccu

SEQ ID NO: 1400897 - RNA, 23 nt, Human
gaggaggugucucaggcugccug

SEQ ID NO: 1400898 - RNA, 21 nt, Human
gaggaggugucucaggcugcc

SEQ ID NO: 1400899 - RNA, 19 nt, Human
gaggaggugucucaggcug

SEQ ID NO: 1400900 - RNA, 21 nt, Human
gaggagggucggugccuucaa

SEQ ID NO: 1400901 - RNA, 19 nt, Human
gaggagguaaugaauuaaa

SEQ ID NO: 1400902 - RNA, 20 nt, Human
gaggagggucggugccuuca

SEQ ID NO: 1400903 - RNA, 23 nt, Human
gaggagucugagguccugagcac

SEQ ID NO: 1400904 - RNA, 22 nt, Human
gaggagucugagguccugagca

SEQ ID NO: 1400905 - RNA, 21 nt, Human
gaggagucugagguccugagc

SEQ ID NO: 1400906 - RNA, 20 nt, Human
gaggagucugagguccugag

SEQ ID NO: 1400907 - RNA, 19 nt, Human
gaggagucugagguccuga

SEQ ID NO: 1400908 - RNA, 18 nt, Human
gaggagucugagguccug

SEQ ID NO: 1400909 - RNA, 15 nt, Human
gaggagucugagguc

SEQ ID NO: 1400910 - RNA, 14 nt, Human
gaggagucugaggu

SEQ ID NO: 1400911 - RNA, 13 nt, Human
gaggagucugagg

SEQ ID NO: 1400912 - RNA, 22 nt, Human
gaggaguaacaauacaaaugga

SEQ ID NO: 1400913 - RNA, 15 nt, Human
gaggccagggcagag

SEQ ID NO: 1400914 - RNA, 13 nt, Human
gaggccagggcag

SEQ ID NO: 1400915 - RNA, 20 nt, Human
gaggccagccuggccuccug

SEQ ID NO: 1400916 - RNA, 19 nt, Human
gaggccagccuggccuccu

SEQ ID NO: 1400917 - RNA, 18 nt, Human
gaggccagccuggccucc

SEQ ID NO: 1400918 - RNA, 12 nt, Human
gaggcagcccgc

SEQ ID NO: 1400919 - RNA, 16 nt, Human
gaggcagcccaggaag

SEQ ID NO: 1400920 - RNA, 13 nt, Human
gaggcagcccagg

SEQ ID NO: 1400921 - RNA, 12 nt, Human
gaggcagcccag

SEQ ID NO: 1400922 - RNA, 15 nt, Human
gaggcagcaggacug

SEQ ID NO: 1400923 - RNA, 17 nt, Human
gaggcagcaggacuguc

SEQ ID NO: 1400924 - RNA, 18 nt, Human
gaggcacugaagugcuua

SEQ ID NO: 1400925 - RNA, 20 nt, Human
gaggcaccugguggccaugc

SEQ ID NO: 1400926 - RNA, 17 nt, Human
gaggcaccaggaagccg

SEQ ID NO: 1400927 - RNA, 13 nt, Human
gaggcaccaggaa

SEQ ID NO: 1400928 - RNA, 17 nt, Human
gaggcacaugucagcaa

SEQ ID NO: 1400929 - RNA, 21 nt, Human
gaggcaauuagacacuuugga

SEQ ID NO: 1400930 - RNA, 22 nt, Human
gaggcagcagugugaggccagg

SEQ ID NO: 1400931 - RNA, 21 nt, Human
gaggcagcagugugaggccag

SEQ ID NO: 1400932 - RNA, 20 nt, Human
gaggcagcagugugaggcca

SEQ ID NO: 1400933 - RNA, 13 nt, Human
gaggcagcagugu

SEQ ID NO: 1400934 - RNA, 17 nt, Human
gaggaauacugaacauc

SEQ ID NO: 1400935 - RNA, 21 nt, Human
gaggaauaagcucccagggcc

SEQ ID NO: 1400936 - RNA, 19 nt, Human
gaggaaggggccagaggcu

SEQ ID NO: 1400937 - RNA, 16 nt, Human
gaggaaggacuucccu

SEQ ID NO: 1400938 - RNA, 22 nt, Human
gagcuugaaacccguggcgcuu

SEQ ID NO: 1400939 - RNA, 16 nt, Human
gaggaaggaggaccca

SEQ ID NO: 1400940 - RNA, 18 nt, Human
gaggaaggaggacccagg

SEQ ID NO: 1400941 - RNA, 21 nt, Human
gaggaaggaggacccaggaca

SEQ ID NO: 1400942 - RNA, 20 nt, Human
gaggaaucugugggucuggg

SEQ ID NO: 1400943 - RNA, 19 nt, Human
gaggaaucugugggucugg

SEQ ID NO: 1400944 - RNA, 22 nt, Human
gaggaaucugugggucugggag

SEQ ID NO: 1400945 - RNA, 21 nt, Human
gaggaaucugugggucuggga

SEQ ID NO: 1400946 - RNA, 15 nt, Human
gaggacaaccauucc

SEQ ID NO: 1400947 - RNA, 14 nt, Human
gaggaauuucaccu

SEQ ID NO: 1400948 - RNA, 22 nt, Human
gaggaauuuucuuuguguagcu

SEQ ID NO: 1400949 - RNA, 13 nt, Human
gaggacacagaga

SEQ ID NO: 1400950 - RNA, 18 nt, Human
gaggacaagagaaaaaag

SEQ ID NO: 1400951 - RNA, 11 nt, Human
gaggacacaug

SEQ ID NO: 1400952 - RNA, 12 nt, Human
gaggacacaugu

SEQ ID NO: 1400953 - RNA, 13 nt, Human
gaggacacauguc

SEQ ID NO: 1400954 - RNA, 14 nt, Human
gaggacacaugucc

SEQ ID NO: 1400955 - RNA, 14 nt, Human
gaggagccuguccu

SEQ ID NO: 1400956 - RNA, 12 nt, Human
gaggagccuguc

SEQ ID NO: 1400957 - RNA, 23 nt, Human
gaggagcccccacccuguuccug

SEQ ID NO: 1400958 - RNA, 21 nt, Human
gaggagcccccacccuguucc

SEQ ID NO: 1400959 - RNA, 20 nt, Human
gaggagcccccacccuguuc

SEQ ID NO: 1400960 - RNA, 15 nt, Human
gaggagccccagcua

SEQ ID NO: 1400961 - RNA, 14 nt, Human
gaggagccccagcu

SEQ ID NO: 1400962 - RNA, 21 nt, Human
gaggagcccaggccaggacuc

SEQ ID NO: 1400963 - RNA, 20 nt, Human
gaggagcccaggccaggacu

SEQ ID NO: 1400964 - RNA, 18 nt, Human
gaggagcccaggccagga

SEQ ID NO: 1400965 - RNA, 13 nt, Human
gaggagcccaggc

SEQ ID NO: 1400966 - RNA, 12 nt, Human
gaggagcccagg

SEQ ID NO: 1400967 - RNA, 23 nt, Human
gaggagcccacgacacugcagcc

SEQ ID NO: 1400968 - RNA, 18 nt, Human
gaggagccaccaguucuc

SEQ ID NO: 1400969 - RNA, 16 nt, Human
gaggagccaccaguuc

SEQ ID NO: 1400970 - RNA, 22 nt, Human
gaggacagaugccuccuuccuc

SEQ ID NO: 1400971 - RNA, 21 nt, Human
gaggacagaugccuccuuccu

SEQ ID NO: 1400972 - RNA, 20 nt, Human
gaggacagaugccuccuucc

SEQ ID NO: 1400973 - RNA, 17 nt, Human
gaggacagaugccuccu

SEQ ID NO: 1400974 - RNA, 16 nt, Human
gaggacagaugccucc

SEQ ID NO: 1400975 - RNA, 18 nt, Human
gaggaggcuccagagggc

SEQ ID NO: 1400976 - RNA, 12 nt, Human
gaggaggcagca

SEQ ID NO: 1400977 - RNA, 13 nt, Human
gaggaggcagcag

SEQ ID NO: 1400978 - RNA, 14 nt, Human
gaggaggcagcagg

SEQ ID NO: 1400979 - RNA, 15 nt, Human
gaggaggcagcagga

SEQ ID NO: 1400980 - RNA, 16 nt, Human
gaggaggcagcaggac

SEQ ID NO: 1400981 - RNA, 15 nt, Human
gaggagggcaggcau

SEQ ID NO: 1400982 - RNA, 14 nt, Human
gaggagggcaggca

SEQ ID NO: 1400983 - RNA, 13 nt, Human
gaggagggcaggc

SEQ ID NO: 1400984 - RNA, 19 nt, Human
gaggagccuguccugccug

SEQ ID NO: 1400985 - RNA, 22 nt, Human
gaggagccuguccugccugugg

SEQ ID NO: 1400986 - RNA, 18 nt, Human
gaggagccuguccugccu

SEQ ID NO: 1400987 - RNA, 16 nt, Human
gaggagccuguccugc

SEQ ID NO: 1400988 - RNA, 18 nt, Human
gaggaggaaaucccuuca

SEQ ID NO: 1400989 - RNA, 19 nt, Human
gaggaggaaaucccuucau

SEQ ID NO: 1400990 - RNA, 16 nt, Human
gaggaggcagagaaga

SEQ ID NO: 1400991 - RNA, 20 nt, Human
gaggaggcagagaagaaaga

SEQ ID NO: 1400992 - RNA, 23 nt, Human
gauauauuuuacaauuuuuuauc

SEQ ID NO: 1400993 - RNA, 14 nt, Human
gauauauuuuacaa

SEQ ID NO: 1400994 - RNA, 19 nt, Human
gauauagaaguauaaagaa

SEQ ID NO: 1400995 - RNA, 17 nt, Human
gauauacucuagaugaa

SEQ ID NO: 1400996 - RNA, 23 nt, Human
gauagauaggucagugcaaauac

SEQ ID NO: 1400997 - RNA, 21 nt, Human
gauauaaguguguguuuuuca

SEQ ID NO: 1400998 - RNA, 13 nt, Human
gauaaugaacaga

SEQ ID NO: 1400999 - RNA, 14 nt, Human
gauaaugaacagaa

SEQ ID NO: 1401000 - RNA, 21 nt, Human
gauaaaacaucuuugaaauua

SEQ ID NO: 1401001 - RNA, 16 nt, Human
gaguuuuuuguaccaa

SEQ ID NO: 1401002 - RNA, 17 nt, Human
gaguuuuguuuccucug

SEQ ID NO: 1401003 - RNA, 22 nt, Human
gaguuuuguguuuguuguagau

SEQ ID NO: 1401004 - RNA, 18 nt, Human
gaguuuuguguuuguugu

SEQ ID NO: 1401005 - RNA, 15 nt, Human
gaguuuuguguuugu

SEQ ID NO: 1401006 - RNA, 13 nt, Human
gaguuuuguguuu

SEQ ID NO: 1401007 - RNA, 14 nt, Human
gauagaaugacagu

SEQ ID NO: 1401008 - RNA, 13 nt, Human
gauacaaugcugu

SEQ ID NO: 1401009 - RNA, 18 nt, Human
gauacaaugcugugcccu

SEQ ID NO: 1401010 - RNA, 23 nt, Human
gauagagacuggaacacuagaca

SEQ ID NO: 1401011 - RNA, 23 nt, Human
gagucugagguccugagcacugc

SEQ ID NO: 1401012 - RNA, 22 nt, Human
gagucugagguccugagcacug

SEQ ID NO: 1401013 - RNA, 19 nt, Human
gagucugagguccugagca

SEQ ID NO: 1401014 - RNA, 18 nt, Human
gagucugagguccugagc

SEQ ID NO: 1401015 - RNA, 17 nt, Human
gagucugagguccugag

SEQ ID NO: 1401016 - RNA, 16 nt, Human
gagucugagguccuga

SEQ ID NO: 1401017 - RNA, 15 nt, Human
gagucugagguccug

SEQ ID NO: 1401018 - RNA, 14 nt, Human
gagucugagguccu

SEQ ID NO: 1401019 - RNA, 13 nt, Human
gagucugaggucc

SEQ ID NO: 1401020 - RNA, 21 nt, Human
gagucugccagggccccucuc

SEQ ID NO: 1401021 - RNA, 20 nt, Human
gagucugccagggccccucu

SEQ ID NO: 1401022 - RNA, 13 nt, Human
gagucugccaggg

SEQ ID NO: 1401023 - RNA, 12 nt, Human
gagucugccagg

SEQ ID NO: 1401024 - RNA, 18 nt, Human
gagucugccacccaggau

SEQ ID NO: 1401025 - RNA, 16 nt, Human
gagucugccacccagg

SEQ ID NO: 1401026 - RNA, 22 nt, Human
gaguggcccuuucggauccagg

SEQ ID NO: 1401027 - RNA, 13 nt, Human
gagugggaagccc

SEQ ID NO: 1401028 - RNA, 12 nt, Human
gagugggaagcc

SEQ ID NO: 1401029 - RNA, 11 nt, Human
gagugggaagc

SEQ ID NO: 1401030 - RNA, 21 nt, Human
gagugucuuuccacggagcca

SEQ ID NO: 1401031 - RNA, 19 nt, Human
gagugucuuuccacggagc

SEQ ID NO: 1401032 - RNA, 15 nt, Human
gagugucuuuccacg

SEQ ID NO: 1401033 - RNA, 13 nt, Human
gagugucuuucca

SEQ ID NO: 1401034 - RNA, 21 nt, Human
gaguuagggacugaccagcag

SEQ ID NO: 1401035 - RNA, 19 nt, Human
gaguuagggacugaccagc

SEQ ID NO: 1401036 - RNA, 20 nt, Human
gagugugaccaaaaguuaca

SEQ ID NO: 1401037 - RNA, 21 nt, Human
gagugugaccaaaaguuacau

SEQ ID NO: 1401038 - RNA, 12 nt, Human
gaguuagacugu

SEQ ID NO: 1401039 - RNA, 14 nt, Human
gaguuagacuguug

SEQ ID NO: 1401040 - RNA, 12 nt, Human
gagugugaccaa

SEQ ID NO: 1401041 - RNA, 22 nt, Human
gagugucuuuccacggagccac

SEQ ID NO: 1401042 - RNA, 21 nt, Human
gaguucuuuuugaaguauuua

SEQ ID NO: 1401043 - RNA, 19 nt, Human
gaguucuuuuugaaguauu

SEQ ID NO: 1401044 - RNA, 17 nt, Human
gaguucuuuuugaagua

SEQ ID NO: 1401045 - RNA, 14 nt, Human
gaguuccugcaugc

SEQ ID NO: 1401046 - RNA, 15 nt, Human
gaguuccagaaagua

SEQ ID NO: 1401047 - RNA, 16 nt, Human
gaguuccagaaaguaa

SEQ ID NO: 1401048 - RNA, 12 nt, Human
gaguuccugcau

SEQ ID NO: 1401049 - RNA, 18 nt, Human
gaguuuuccauggcagga

SEQ ID NO: 1401050 - RNA, 16 nt, Human
gaguuuuggaugcagu

SEQ ID NO: 1401051 - RNA, 21 nt, Human
gaguuuuccauggcaggaagg

SEQ ID NO: 1401052 - RNA, 21 nt, Human
gaguugaaaaucuuauaauuu

SEQ ID NO: 1401053 - RNA, 16 nt, Human
gagguuugcaguccca

SEQ ID NO: 1401054 - RNA, 19 nt, Human
gagguucaaagauauuuug

SEQ ID NO: 1401055 - RNA, 18 nt, Human
gaguaaagaauuauuuug

SEQ ID NO: 1401056 - RNA, 16 nt, Human
gaguacguugugcauu

SEQ ID NO: 1401057 - RNA, 21 nt, Human
gagguuuuauuucauuuuuca

SEQ ID NO: 1401058 - RNA, 16 nt, Human
gagguuuuauuucauu

SEQ ID NO: 1401059 - RNA, 22 nt, Human
gagguuugcagucccaagcggu

SEQ ID NO: 1401060 - RNA, 19 nt, Human
gagguuugcagucccaagc

SEQ ID NO: 1401061 - RNA, 15 nt, Human
gaguagcugagcuca

SEQ ID NO: 1401062 - RNA, 17 nt, Human
gaguaauuuuggauuuu

SEQ ID NO: 1401063 - RNA, 22 nt, Human
gaguaccccugcuuugggcuug

SEQ ID NO: 1401064 - RNA, 17 nt, Human
gaguacguugugcauuu

SEQ ID NO: 1401065 - RNA, 18 nt, Human
gaguacguugugcauuug

SEQ ID NO: 1401066 - RNA, 20 nt, Human
gaguacguugugcauuuggu

SEQ ID NO: 1401067 - RNA, 19 nt, Human
gagguccugagcacugcca

SEQ ID NO: 1401068 - RNA, 18 nt, Human
gagguccugagcacugcc

SEQ ID NO: 1401069 - RNA, 17 nt, Human
gagguccugagcacugc

SEQ ID NO: 1401070 - RNA, 16 nt, Human
gagguccugagcacug

SEQ ID NO: 1401071 - RNA, 14 nt, Human
gagguccugagcac

SEQ ID NO: 1401072 - RNA, 13 nt, Human
gagguccugagca

SEQ ID NO: 1401073 - RNA, 12 nt, Human
gagguccugagc

SEQ ID NO: 1401074 - RNA, 17 nt, Human
gaggugggccagucugu

SEQ ID NO: 1401075 - RNA, 22 nt, Human
gagguccugagcacugccagga

SEQ ID NO: 1401076 - RNA, 23 nt, Human
gagguccugagcacugccaggag

SEQ ID NO: 1401077 - RNA, 21 nt, Human
gagguccugagcacugccagg

SEQ ID NO: 1401078 - RNA, 20 nt, Human
gagguccugagcacugccag

SEQ ID NO: 1401079 - RNA, 21 nt, Human
gagggggucguggagagcuag

SEQ ID NO: 1401080 - RNA, 19 nt, Human
gagggggucguggagagcu

SEQ ID NO: 1401081 - RNA, 18 nt, Human
gagggggucguggagagc

SEQ ID NO: 1401082 - RNA, 17 nt, Human
gagggggucguggagag

SEQ ID NO: 1401083 - RNA, 15 nt, Human
gagucccugccugga

SEQ ID NO: 1401084 - RNA, 14 nt, Human
gagucccugccugg

SEQ ID NO: 1401085 - RNA, 19 nt, Human
gaguccccucaccuccucu

SEQ ID NO: 1401086 - RNA, 18 nt, Human
gaguccccucaccuccuc

SEQ ID NO: 1401087 - RNA, 22 nt, Human
gagucccagguuggcucugcca

SEQ ID NO: 1401088 - RNA, 23 nt, Human
gagucccagguuggcucugccag

SEQ ID NO: 1401089 - RNA, 21 nt, Human
gagucccagguuggcucugcc

SEQ ID NO: 1401090 - RNA, 18 nt, Human
gagucccagguuggcucu

SEQ ID NO: 1401091 - RNA, 17 nt, Human
gaguccccucaccuccu

SEQ ID NO: 1401092 - RNA, 16 nt, Human
gaguccccucaccucc

SEQ ID NO: 1401093 - RNA, 11 nt, Human
gaguccccuca

SEQ ID NO: 1401094 - RNA, 14 nt, Human
gaguagcugagcuc

SEQ ID NO: 1401095 - RNA, 13 nt, Human
gaguagcugagcu

SEQ ID NO: 1401096 - RNA, 19 nt, Human
gaguagcugggacuacagg

SEQ ID NO: 1401097 - RNA, 19 nt, Human
gagucaaaugguaggcauu

SEQ ID NO: 1401098 - RNA, 19 nt, Human
gagucaaaacuacaaauca

SEQ ID NO: 1401099 - RNA, 20 nt, Human
gagucaaaacacuuguaauu

SEQ ID NO: 1401100 - RNA, 17 nt, Human
gagucaaaacacuugua

SEQ ID NO: 1401101 - RNA, 14 nt, Human
gagucaaaacacuu

SEQ ID NO: 1401102 - RNA, 14 nt, Human
gagucaaaaagaac

SEQ ID NO: 1401103 - RNA, 15 nt, Human
gagucaaaaauuaaa

SEQ ID NO: 1401104 - RNA, 17 nt, Human
gagucguggggugugcu

SEQ ID NO: 1401105 - RNA, 22 nt, Human
gagucguacagaaagcugccug

SEQ ID NO: 1401106 - RNA, 17 nt, Human
gagucguacagaaagcu

SEQ ID NO: 1401107 - RNA, 19 nt, Human
gagucccugccuggaccag

SEQ ID NO: 1401108 - RNA, 16 nt, Human
gagucccugccuggac

SEQ ID NO: 1401109 - RNA, 21 nt, Human
gagucguggggugugcuggga

SEQ ID NO: 1401110 - RNA, 20 nt, Human
gagucguggggugugcuggg

SEQ ID NO: 1401111 - RNA, 19 nt, Human
gagucguggggugugcugg

SEQ ID NO: 1401112 - RNA, 18 nt, Human
gagucguggggugugcug

SEQ ID NO: 1401113 - RNA, 13 nt, Human
gagucucucuggg

SEQ ID NO: 1401114 - RNA, 13 nt, Human
gagucucccaggg

SEQ ID NO: 1401115 - RNA, 14 nt, Human
gagucucccaggga

SEQ ID NO: 1401116 - RNA, 15 nt, Human
gagucucccagggag

SEQ ID NO: 1401117 - RNA, 14 nt, Human
gagucucucugggc

SEQ ID NO: 1401118 - RNA, 16 nt, Human
gagucucugaggggcu

SEQ ID NO: 1401119 - RNA, 18 nt, Human
gauccuauccuccuaccu

SEQ ID NO: 1401120 - RNA, 16 nt, Human
gauauauuuucuuucu

SEQ ID NO: 1401121 - RNA, 15 nt, Human
gauauauuuucuuuc

SEQ ID NO: 1401122 - RNA, 11 nt, Human
gaugaaaauaa

SEQ ID NO: 1401123 - RNA, 23 nt, Human
gaugaaaaguauauugauaaccu

SEQ ID NO: 1401124 - RNA, 21 nt, Human
gaugaaaaguauauugauaac

SEQ ID NO: 1401125 - RNA, 20 nt, Human
gaugaaaaauugcugacugu

SEQ ID NO: 1401126 - RNA, 18 nt, Human
gaugaaaaauugcugacu

SEQ ID NO: 1401127 - RNA, 14 nt, Human
gaucuuuuuuguca

SEQ ID NO: 1401128 - RNA, 13 nt, Human
gaucuuagauucu

SEQ ID NO: 1401129 - RNA, 14 nt, Human
gaucuuagauucuc

SEQ ID NO: 1401130 - RNA, 20 nt, Human
gaucuguuuugaaggcaaaa

SEQ ID NO: 1401131 - RNA, 12 nt, Human
gaucgccuuccc

SEQ ID NO: 1401132 - RNA, 17 nt, Human
gaucgaaccguuuugaa

SEQ ID NO: 1401133 - RNA, 20 nt, Human
gauccuguguggagagggaa

SEQ ID NO: 1401134 - RNA, 19 nt, Human
gauccuguguggagaggga

SEQ ID NO: 1401135 - RNA, 18 nt, Human
gauggcagcuuuuaaaag

SEQ ID NO: 1401136 - RNA, 18 nt, Human
gauggcaaccagaccauu

SEQ ID NO: 1401137 - RNA, 22 nt, Human
gauggcaacagaucuggaaccu

SEQ ID NO: 1401138 - RNA, 21 nt, Human
gauggcaacagaucuggaacc

SEQ ID NO: 1401139 - RNA, 17 nt, Human
gauggcaacagaucugg

SEQ ID NO: 1401140 - RNA, 16 nt, Human
gauggcaacagaucug

SEQ ID NO: 1401141 - RNA, 15 nt, Human
gauggcaacagaucu

SEQ ID NO: 1401142 - RNA, 17 nt, Human
gauggcagcuuuuaaaa

SEQ ID NO: 1401143 - RNA, 22 nt, Human
gaugggacauuccaaagaacag

SEQ ID NO: 1401144 - RNA, 22 nt, Human
gaugcuccaagauucuagauga

SEQ ID NO: 1401145 - RNA, 20 nt, Human
gaugcuccaagauucuagau

SEQ ID NO: 1401146 - RNA, 19 nt, Human
gaugcuccaagauucuaga

SEQ ID NO: 1401147 - RNA, 17 nt, Human
gaugcuccaagauucua

SEQ ID NO: 1401148 - RNA, 16 nt, Human
gaugcuccaagauucu

SEQ ID NO: 1401149 - RNA, 15 nt, Human
gaugccuccuuccuc

SEQ ID NO: 1401150 - RNA, 16 nt, Human
gaugccuccuuccucu

SEQ ID NO: 1401151 - RNA, 21 nt, Human
gaugccuggcgggguggggug

SEQ ID NO: 1401152 - RNA, 20 nt, Human
gaugcaucagaaagggaggg

SEQ ID NO: 1401153 - RNA, 13 nt, Human
gaugcaaugaaca

SEQ ID NO: 1401154 - RNA, 21 nt, Human
gaugcacagaguuguuacauu

SEQ ID NO: 1401155 - RNA, 18 nt, Human
gaugcaguucugaagaag

SEQ ID NO: 1401156 - RNA, 18 nt, Human
gaugacuaaaauauuuau

SEQ ID NO: 1401157 - RNA, 15 nt, Human
gaugacuaaaauauu

SEQ ID NO: 1401158 - RNA, 12 nt, Human
gaugacuaaaau

SEQ ID NO: 1401159 - RNA, 16 nt, Human
gaugaaaauaaagaau

SEQ ID NO: 1401160 - RNA, 15 nt, Human
gaugaaaauaaagaa

SEQ ID NO: 1401161 - RNA, 14 nt, Human
gaugaaaauaaaga

SEQ ID NO: 1401162 - RNA, 14 nt, Human
gaugacuauggaaa

SEQ ID NO: 1401163 - RNA, 15 nt, Human
gauucuaaugaugau

SEQ ID NO: 1401164 - RNA, 15 nt, Human
gauucuaaaggucca

SEQ ID NO: 1401165 - RNA, 20 nt, Human
gauucuaaagauucuauagu

SEQ ID NO: 1401166 - RNA, 17 nt, Human
gauucuaaagauucuau

SEQ ID NO: 1401167 - RNA, 16 nt, Human
gauucuaaagauucua

SEQ ID NO: 1401168 - RNA, 15 nt, Human
gauucuaaagauucu

SEQ ID NO: 1401169 - RNA, 15 nt, Human
gauuccugagccagu

SEQ ID NO: 1401170 - RNA, 18 nt, Human
gauuccggauccuaagca

SEQ ID NO: 1401171 - RNA, 22 nt, Human
gauuccggauccuaagcaucua

SEQ ID NO: 1401172 - RNA, 15 nt, Human
gauuccggauccuaa

SEQ ID NO: 1401173 - RNA, 19 nt, Human
gauucccucucccaggccc

SEQ ID NO: 1401174 - RNA, 20 nt, Human
gauucccucucccaggcccc

SEQ ID NO: 1401175 - RNA, 18 nt, Human
gauucccucucccaggcc

SEQ ID NO: 1401176 - RNA, 17 nt, Human
gauucccucucccaggc

SEQ ID NO: 1401177 - RNA, 14 nt, Human
gauucccucuccca

SEQ ID NO: 1401178 - RNA, 20 nt, Human
gauuccccaucucaggccag

SEQ ID NO: 1401179 - RNA, 17 nt, Human
gauuccccaucucaggc

SEQ ID NO: 1401180 - RNA, 19 nt, Human
gauucccagagcaaaauaa

SEQ ID NO: 1401181 - RNA, 13 nt, Human
gauucccagagca

SEQ ID NO: 1401182 - RNA, 15 nt, Human
gauucacaucucauu

SEQ ID NO: 1401183 - RNA, 16 nt, Human
gauucacaucucauuu

SEQ ID NO: 1401184 - RNA, 19 nt, Human
gauucaaucuguaaacugu

SEQ ID NO: 1401185 - RNA, 18 nt, Human
gauucaaucuguaaacug

SEQ ID NO: 1401186 - RNA, 16 nt, Human
gauucaaucuguaaac

SEQ ID NO: 1401187 - RNA, 14 nt, Human
gauucaaucuguaa

SEQ ID NO: 1401188 - RNA, 19 nt, Human
gauucaaagguucuagguu

SEQ ID NO: 1401189 - RNA, 18 nt, Human
gauucaaagguucuaggu

SEQ ID NO: 1401190 - RNA, 15 nt, Human
gauucaaagguucua

SEQ ID NO: 1401191 - RNA, 13 nt, Human
gauucaaagguuc

SEQ ID NO: 1401192 - RNA, 23 nt, Human
gauucagaaaauguucuguuugc

SEQ ID NO: 1401193 - RNA, 18 nt, Human
gauucagaaaugaggcca

SEQ ID NO: 1401194 - RNA, 21 nt, Human
gauucagaaaauguucuguuu

SEQ ID NO: 1401195 - RNA, 21 nt, Human
gauucacccuguccaaacugc

SEQ ID NO: 1401196 - RNA, 15 nt, Human
gauugucuuaauauu

SEQ ID NO: 1401197 - RNA, 18 nt, Human
gauuguccuuuugcaaag

SEQ ID NO: 1401198 - RNA, 17 nt, Human
gauuguccuuuugcaaa

SEQ ID NO: 1401199 - RNA, 16 nt, Human
gauuguccuuuugcaa

SEQ ID NO: 1401200 - RNA, 15 nt, Human
gauuguauuguugaa

SEQ ID NO: 1401201 - RNA, 20 nt, Human
gauuguauuguugaaaaagu

SEQ ID NO: 1401202 - RNA, 10 nt, Human
gauuguauug

SEQ ID NO: 1401203 - RNA, 11 nt, Human
gauuguaacuc

SEQ ID NO: 1401204 - RNA, 23 nt, Human
gauuguaauauguaaaugguaug

SEQ ID NO: 1401205 - RNA, 22 nt, Human
gauuggauacgcaucagacaga

SEQ ID NO: 1401206 - RNA, 23 nt, Human
gauugaaguauuuugcuggaaua

SEQ ID NO: 1401207 - RNA, 21 nt, Human
gauugaaguauuuugcuggaa

SEQ ID NO: 1401208 - RNA, 20 nt, Human
gauugaaaauguccaggaaa

SEQ ID NO: 1401209 - RNA, 19 nt, Human
gauugaaaauguccaggaa

SEQ ID NO: 1401210 - RNA, 18 nt, Human
gauugaaaauguccagga

SEQ ID NO: 1401211 - RNA, 19 nt, Human
gauucuauaguucuagaca

SEQ ID NO: 1401212 - RNA, 18 nt, Human
gauucuauaguucuagac

SEQ ID NO: 1401213 - RNA, 17 nt, Human
gauucuauaguucuaga

SEQ ID NO: 1401214 - RNA, 15 nt, Human
gauucuauaguucua

SEQ ID NO: 1401215 - RNA, 23 nt, Human
gauucuagaucagaugcuccaag

SEQ ID NO: 1401216 - RNA, 21 nt, Human
gauucuagaucagaugcucca

SEQ ID NO: 1401217 - RNA, 19 nt, Human
gauucuagaucagaugcuc

SEQ ID NO: 1401218 - RNA, 18 nt, Human
gauucuagaucagaugcu

SEQ ID NO: 1401219 - RNA, 23 nt, Human
gauugacgggacuguugguauug

SEQ ID NO: 1401220 - RNA, 17 nt, Human
gauguguccugacacug

SEQ ID NO: 1401221 - RNA, 13 nt, Human
gauguguccugac

SEQ ID NO: 1401222 - RNA, 11 nt, Human
gauguguccug

SEQ ID NO: 1401223 - RNA, 19 nt, Human
gauguggaacugcugccac

SEQ ID NO: 1401224 - RNA, 21 nt, Human
gauguggaacugcugccacug

SEQ ID NO: 1401225 - RNA, 18 nt, Human
gauguggaacugcugcca

SEQ ID NO: 1401226 - RNA, 23 nt, Human
gauguguguugauacuguugcac

SEQ ID NO: 1401227 - RNA, 22 nt, Human
gauguguguugauacuguugca

SEQ ID NO: 1401228 - RNA, 21 nt, Human
gauguguguugauacuguugc

SEQ ID NO: 1401229 - RNA, 20 nt, Human
gauguguguugauacuguug

SEQ ID NO: 1401230 - RNA, 17 nt, Human
gauguguguugauacug

SEQ ID NO: 1401231 - RNA, 14 nt, Human
gauguguguugaua

SEQ ID NO: 1401232 - RNA, 12 nt, Human
gauguguguuga

SEQ ID NO: 1401233 - RNA, 19 nt, Human
gauguguccugacacugca

SEQ ID NO: 1401234 - RNA, 18 nt, Human
gauguguccugacacugc

SEQ ID NO: 1401235 - RNA, 16 nt, Human
gauguguuugcuuucu

SEQ ID NO: 1401236 - RNA, 14 nt, Human
gauguguuugcuuu

SEQ ID NO: 1401237 - RNA, 22 nt, Human
gaugggcaugguguucuccugc

SEQ ID NO: 1401238 - RNA, 20 nt, Human
gaugggcaugguguucuccu

SEQ ID NO: 1401239 - RNA, 13 nt, Human
gaugggcuuccca

SEQ ID NO: 1401240 - RNA, 15 nt, Human
gaugggcuucccaag

SEQ ID NO: 1401241 - RNA, 21 nt, Human
gauggugucucuucuuuagaa

SEQ ID NO: 1401242 - RNA, 15 nt, Human
gaugguggagggcca

SEQ ID NO: 1401243 - RNA, 14 nt, Human
gaugguggagggcc

SEQ ID NO: 1401244 - RNA, 18 nt, Human
gauguguuugcuuucuga

SEQ ID NO: 1401245 - RNA, 22 nt, Human
gauguuaaaaaaauaagaagaa

SEQ ID NO: 1401246 - RNA, 12 nt, Human
gauuaaauucuu

SEQ ID NO: 1401247 - RNA, 19 nt, Human
gauuaaauucuugcaaagu

SEQ ID NO: 1401248 - RNA, 21 nt, Human
gauuaaaugacacucauauaa

SEQ ID NO: 1401249 - RNA, 17 nt, Human
gauuaaccucugcacua

SEQ ID NO: 1401250 - RNA, 14 nt, Human
gauuaaccucugca

SEQ ID NO: 1401251 - RNA, 21 nt, Human
gauuaacagguaugaaccacc

SEQ ID NO: 1401252 - RNA, 23 nt, Human
gcaggacuccaggcccaaggcuc

SEQ ID NO: 1401253 - RNA, 22 nt, Human
gcaggacuccaggcccaaggcu

SEQ ID NO: 1401254 - RNA, 18 nt, Human
gcaggacuccaggcccaa

SEQ ID NO: 1401255 - RNA, 17 nt, Human
gcaggacuccaggccca

SEQ ID NO: 1401256 - RNA, 14 nt, Human
gcaggacuccaggc

SEQ ID NO: 1401257 - RNA, 13 nt, Human
gcaggacuccagg

SEQ ID NO: 1401258 - RNA, 21 nt, Human
gcaggaccuucgggcugugcc

SEQ ID NO: 1401259 - RNA, 23 nt, Human
gcaggaaggacuaugaaaagcua

SEQ ID NO: 1401260 - RNA, 16 nt, Human
gcaggaagcugugaga

SEQ ID NO: 1401261 - RNA, 23 nt, Human
gcagccucugggggguggccagg

SEQ ID NO: 1401262 - RNA, 16 nt, Human
gcagccucuccccagg

SEQ ID NO: 1401263 - RNA, 12 nt, Human
gcagccucuccc

SEQ ID NO: 1401264 - RNA, 21 nt, Human
gcagccucgccccuggcagag

SEQ ID NO: 1401265 - RNA, 19 nt, Human
gcagccucgccccuggcag

SEQ ID NO: 1401266 - RNA, 16 nt, Human
gcagccucgccccugg

SEQ ID NO: 1401267 - RNA, 22 nt, Human
gcagccucugggggguggccag

SEQ ID NO: 1401268 - RNA, 15 nt, Human
gcagccucugggggg

SEQ ID NO: 1401269 - RNA, 14 nt, Human
gcagccucuggggg

SEQ ID NO: 1401270 - RNA, 20 nt, Human
gcagccucgccccuggcaga

SEQ ID NO: 1401271 - RNA, 20 nt, Human
gcagccucuccccaggucca

SEQ ID NO: 1401272 - RNA, 21 nt, Human
gcagccucccauccagggccc

SEQ ID NO: 1401273 - RNA, 20 nt, Human
gcagccucccauccagggcc

SEQ ID NO: 1401274 - RNA, 18 nt, Human
gcagccucccauccaggg

SEQ ID NO: 1401275 - RNA, 21 nt, Human
gcagccucaggacugggagcc

SEQ ID NO: 1401276 - RNA, 19 nt, Human
gcagccucaggacugggag

SEQ ID NO: 1401277 - RNA, 15 nt, Human
gcagccucaggacug

SEQ ID NO: 1401278 - RNA, 13 nt, Human
gcagccucaggac

SEQ ID NO: 1401279 - RNA, 23 nt, Human
gcagccucagagacaucagcccu

SEQ ID NO: 1401280 - RNA, 15 nt, Human
gcagccucagagaca

SEQ ID NO: 1401281 - RNA, 19 nt, Human
gcagccggcacagggucug

SEQ ID NO: 1401282 - RNA, 18 nt, Human
gcagccggcacagggucu

SEQ ID NO: 1401283 - RNA, 17 nt, Human
gcagccgcugagcgagg

SEQ ID NO: 1401284 - RNA, 16 nt, Human
gcagccgcugagcgag

SEQ ID NO: 1401285 - RNA, 14 nt, Human
gcagcccuuccaaa

SEQ ID NO: 1401286 - RNA, 19 nt, Human
gcagcaggaggggggaggg

SEQ ID NO: 1401287 - RNA, 15 nt, Human
gcagcaggagggggg

SEQ ID NO: 1401288 - RNA, 14 nt, Human
gcagcaggaggggg

SEQ ID NO: 1401289 - RNA, 13 nt, Human
gcagcaggagggg

SEQ ID NO: 1401290 - RNA, 22 nt, Human
gcagcagccucgccccuggcag

SEQ ID NO: 1401291 - RNA, 18 nt, Human
gcagcaggacuguccccu

SEQ ID NO: 1401292 - RNA, 23 nt, Human
gcagcagccucgccccuggcaga

SEQ ID NO: 1401293 - RNA, 20 nt, Human
gcagcagccucgccccuggc

SEQ ID NO: 1401294 - RNA, 13 nt, Human
gcagcagccccca

SEQ ID NO: 1401295 - RNA, 22 nt, Human
gcagcagcccccagcucccacc

SEQ ID NO: 1401296 - RNA, 22 nt, Human
gcagcagccagcccugccugga

SEQ ID NO: 1401297 - RNA, 23 nt, Human
gcagcagccagcccugccuggag

SEQ ID NO: 1401298 - RNA, 21 nt, Human
gcagcagccagcccugccugg

SEQ ID NO: 1401299 - RNA, 20 nt, Human
gcagcagccagcccugccug

SEQ ID NO: 1401300 - RNA, 19 nt, Human
gcagcagccagcccugccu

SEQ ID NO: 1401301 - RNA, 18 nt, Human
gcagcagccagcccugcc

SEQ ID NO: 1401302 - RNA, 17 nt, Human
gcagcagccagcccugc

SEQ ID NO: 1401303 - RNA, 16 nt, Human
gcagcagccagcccug

SEQ ID NO: 1401304 - RNA, 15 nt, Human
gcagcagccagcccu

SEQ ID NO: 1401305 - RNA, 14 nt, Human
gcagcagccagccc

SEQ ID NO: 1401306 - RNA, 13 nt, Human
gcagcagccagcc

SEQ ID NO: 1401307 - RNA, 12 nt, Human
gcagcagccagc

SEQ ID NO: 1401308 - RNA, 11 nt, Human
gcagcagccag

SEQ ID NO: 1401309 - RNA, 21 nt, Human
gcagcaggaggggggagggaa

SEQ ID NO: 1401310 - RNA, 18 nt, Human
gcagacuucccagcuagg

SEQ ID NO: 1401311 - RNA, 16 nt, Human
gcagacuucccagcua

SEQ ID NO: 1401312 - RNA, 15 nt, Human
gcagacuucccagcu

SEQ ID NO: 1401313 - RNA, 11 nt, Human
gcagacuggcg

SEQ ID NO: 1401314 - RNA, 20 nt, Human
gcagacucuuuaugcuugca

SEQ ID NO: 1401315 - RNA, 14 nt, Human
gcagaggggcagag

SEQ ID NO: 1401316 - RNA, 15 nt, Human
gcagaggggcagagg

SEQ ID NO: 1401317 - RNA, 13 nt, Human
gcagaggggcaga

SEQ ID NO: 1401318 - RNA, 23 nt, Human
gcacuucuuuuucucgcuguccu

SEQ ID NO: 1401319 - RNA, 15 nt, Human
gcagauccaggacua

SEQ ID NO: 1401320 - RNA, 14 nt, Human
gcagauguaggagg

SEQ ID NO: 1401321 - RNA, 13 nt, Human
gcagauguaggag

SEQ ID NO: 1401322 - RNA, 19 nt, Human
gcagauguaggagggacug

SEQ ID NO: 1401323 - RNA, 17 nt, Human
gcagauguaggagggac

SEQ ID NO: 1401324 - RNA, 16 nt, Human
gcagauguaggaggga

SEQ ID NO: 1401325 - RNA, 15 nt, Human
gcagauguaggaggg

SEQ ID NO: 1401326 - RNA, 19 nt, Human
gcacguguguuuuucuauu

SEQ ID NO: 1401327 - RNA, 23 nt, Human
gcacguguguuuuucuauuaaaa

SEQ ID NO: 1401328 - RNA, 18 nt, Human
gcacguguguuuuucuau

SEQ ID NO: 1401329 - RNA, 16 nt, Human
gcacguguguuuuucu

SEQ ID NO: 1401330 - RNA, 14 nt, Human
gcacguguguuuuu

SEQ ID NO: 1401331 - RNA, 18 nt, Human
gcacgugguaaaacacuu

SEQ ID NO: 1401332 - RNA, 15 nt, Human
gcacgcgugugcagg

SEQ ID NO: 1401333 - RNA, 20 nt, Human
gcacgcggagugaguuuuuu

SEQ ID NO: 1401334 - RNA, 15 nt, Human
gcacgcacacugucu

SEQ ID NO: 1401335 - RNA, 16 nt, Human
gcacgcacacugucug

SEQ ID NO: 1401336 - RNA, 20 nt, Human
gcacccucauacacagaaac

SEQ ID NO: 1401337 - RNA, 17 nt, Human
gcacccucauacacaga

SEQ ID NO: 1401338 - RNA, 16 nt, Human
gcacuacauucauuua

SEQ ID NO: 1401339 - RNA, 12 nt, Human
gcacuacauuca

SEQ ID NO: 1401340 - RNA, 19 nt, Human
gcacuguucccccugugca

SEQ ID NO: 1401341 - RNA, 18 nt, Human
gcacuguucccccugugc

SEQ ID NO: 1401342 - RNA, 15 nt, Human
gcacuguucccccug

SEQ ID NO: 1401343 - RNA, 20 nt, Human
gcacuguucccccugugcag

SEQ ID NO: 1401344 - RNA, 15 nt, Human
gcacugggcuccgga

SEQ ID NO: 1401345 - RNA, 13 nt, Human
gcacugggcauga

SEQ ID NO: 1401346 - RNA, 20 nt, Human
gcacugggaggcuccccuuc

SEQ ID NO: 1401347 - RNA, 18 nt, Human
gcacugggaggcuccccu

SEQ ID NO: 1401348 - RNA, 15 nt, Human
gcacuggccccaccc

SEQ ID NO: 1401349 - RNA, 15 nt, Human
gcacuggcgaggaga

SEQ ID NO: 1401350 - RNA, 16 nt, Human
gcacuggcgaggagag

SEQ ID NO: 1401351 - RNA, 23 nt, Human
gcaccaaaucaaaaucucuccac

SEQ ID NO: 1401352 - RNA, 22 nt, Human
gcaccaaaucaaaaucucucca

SEQ ID NO: 1401353 - RNA, 21 nt, Human
gcaccaaaucaaaaucucucc

SEQ ID NO: 1401354 - RNA, 20 nt, Human
gcaccaaaucaaaaucucuc

SEQ ID NO: 1401355 - RNA, 23 nt, Human
gcacagggucugcucuuucucug

SEQ ID NO: 1401356 - RNA, 18 nt, Human
gcacagggucugcucuuu

SEQ ID NO: 1401357 - RNA, 17 nt, Human
gcacagggucugcucuu

SEQ ID NO: 1401358 - RNA, 12 nt, Human
gcacagggucug

SEQ ID NO: 1401359 - RNA, 20 nt, Human
gcaccagacacccaggacuu

SEQ ID NO: 1401360 - RNA, 19 nt, Human
gcaccagacacccaggacu

SEQ ID NO: 1401361 - RNA, 18 nt, Human
gcaccagacacccaggac

SEQ ID NO: 1401362 - RNA, 17 nt, Human
gcaccagacacccagga

SEQ ID NO: 1401363 - RNA, 16 nt, Human
gcaccagacacccagg

SEQ ID NO: 1401364 - RNA, 15 nt, Human
gcaccagacacccag

SEQ ID NO: 1401365 - RNA, 17 nt, Human
gcaccaccaagccaagg

SEQ ID NO: 1401366 - RNA, 14 nt, Human
gcaccaccaagcca

SEQ ID NO: 1401367 - RNA, 15 nt, Human
gcaccaagcaggaaa

SEQ ID NO: 1401368 - RNA, 13 nt, Human
gcaccaccaagcc

SEQ ID NO: 1401369 - RNA, 22 nt, Human
gcaccaagugcggguccggcag

SEQ ID NO: 1401370 - RNA, 19 nt, Human
gcacccccugcagcuugua

SEQ ID NO: 1401371 - RNA, 24 nt, Human
gcacccccugcagcuuguagccag

SEQ ID NO: 1401372 - RNA, 15 nt, Human
gcacccccugcagcu

SEQ ID NO: 1401373 - RNA, 14 nt, Human
gcacccccugcagc

SEQ ID NO: 1401374 - RNA, 13 nt, Human
gcacccccugcag

SEQ ID NO: 1401375 - RNA, 16 nt, Human
gcacccccgucaagag

SEQ ID NO: 1401376 - RNA, 20 nt, Human
gcaccaucucugauuuucaa

SEQ ID NO: 1401377 - RNA, 21 nt, Human
gcaccagacacccaggacuua

SEQ ID NO: 1401378 - RNA, 14 nt, Human
gcacaggacaugcg

SEQ ID NO: 1401379 - RNA, 22 nt, Human
gcacagcuugaccugaggcugu

SEQ ID NO: 1401380 - RNA, 21 nt, Human
gcacagcuugaccugaggcug

SEQ ID NO: 1401381 - RNA, 20 nt, Human
gcacagcuugaccugaggcu

SEQ ID NO: 1401382 - RNA, 19 nt, Human
gcacagcuugaccugaggc

SEQ ID NO: 1401383 - RNA, 18 nt, Human
gcacagcuugaccugagg

SEQ ID NO: 1401384 - RNA, 14 nt, Human
gcacagcuugaccu

SEQ ID NO: 1401385 - RNA, 11 nt, Human
gcacagcccuu

SEQ ID NO: 1401386 - RNA, 18 nt, Human
gcacagccucuuagaugc

SEQ ID NO: 1401387 - RNA, 22 nt, Human
gcacagcagccuggggcuggcc

SEQ ID NO: 1401388 - RNA, 22 nt, Human
gcacagcacaaauuaguuauau

SEQ ID NO: 1401389 - RNA, 23 nt, Human
gcacagauggccagccccuuaga

SEQ ID NO: 1401390 - RNA, 19 nt, Human
gcacagauggccagccccu

SEQ ID NO: 1401391 - RNA, 14 nt, Human
gcacagauggccag

SEQ ID NO: 1401392 - RNA, 15 nt, Human
gcacagcagccuggg

SEQ ID NO: 1401393 - RNA, 17 nt, Human
gcacagccaaauuuaaa

SEQ ID NO: 1401394 - RNA, 22 nt, Human
gcacagccaacacgcaccugcc

SEQ ID NO: 1401395 - RNA, 15 nt, Human
gcacagccucuuaga

SEQ ID NO: 1401396 - RNA, 17 nt, Human
gcauugacuuuccccac

SEQ ID NO: 1401397 - RNA, 15 nt, Human
gcauugacuuucccc

SEQ ID NO: 1401398 - RNA, 19 nt, Human
gcauugaauggcuauguuu

SEQ ID NO: 1401399 - RNA, 12 nt, Human
gcauugacuuuc

SEQ ID NO: 1401400 - RNA, 23 nt, Human
gcauugaccgcgacuaauuucaa

SEQ ID NO: 1401401 - RNA, 22 nt, Human
gcauugaccgcgacuaauuuca

SEQ ID NO: 1401402 - RNA, 16 nt, Human
gcauugacuuucccca

SEQ ID NO: 1401403 - RNA, 18 nt, Human
gcauuugaggucuguucu

SEQ ID NO: 1401404 - RNA, 21 nt, Human
gcauugaauggcuauguuuuu

SEQ ID NO: 1401405 - RNA, 23 nt, Human
gcauugaacacaaacuguaaaua

SEQ ID NO: 1401406 - RNA, 22 nt, Human
gcauugaacacaaacuguaaau

SEQ ID NO: 1401407 - RNA, 21 nt, Human
gcauugaacacaaacuguaaa

SEQ ID NO: 1401408 - RNA, 15 nt, Human
gcauuaaauuacaga

SEQ ID NO: 1401409 - RNA, 23 nt, Human
gcauuaaauuuuagcaaagauau

SEQ ID NO: 1401410 - RNA, 18 nt, Human
gcauuaaauucacaaacu

SEQ ID NO: 1401411 - RNA, 22 nt, Human
gcauuaaauucacaaacuuuua

SEQ ID NO: 1401412 - RNA, 14 nt, Human
gcauuaaauuacag

SEQ ID NO: 1401413 - RNA, 20 nt, Human
gcauuaugcaauuuuuauau

SEQ ID NO: 1401414 - RNA, 19 nt, Human
gcauuaugcaauuuuuaua

SEQ ID NO: 1401415 - RNA, 18 nt, Human
gcauuaugcaauuuuuau

SEQ ID NO: 1401416 - RNA, 13 nt, Human
gcauuaugcaauu

SEQ ID NO: 1401417 - RNA, 22 nt, Human
gcauuaucuagauacuguauca

SEQ ID NO: 1401418 - RNA, 24 nt, Human
gcauuaucuagauacuguaucaug

SEQ ID NO: 1401419 - RNA, 14 nt, Human
gcaucugggccuug

SEQ ID NO: 1401420 - RNA, 12 nt, Human
gcaucugggccu

SEQ ID NO: 1401421 - RNA, 19 nt, Human
gcaucuggccuggccagug

SEQ ID NO: 1401422 - RNA, 18 nt, Human
gcaucuggccuggccagu

SEQ ID NO: 1401423 - RNA, 17 nt, Human
gcaucuggccuggccag

SEQ ID NO: 1401424 - RNA, 16 nt, Human
gcaucuggccuggcca

SEQ ID NO: 1401425 - RNA, 15 nt, Human
gcaucuggccuggcc

SEQ ID NO: 1401426 - RNA, 16 nt, Human
gcaucuggagagaaca

SEQ ID NO: 1401427 - RNA, 15 nt, Human
gcaucuggagagaac

SEQ ID NO: 1401428 - RNA, 23 nt, Human
gcaucucugggcuggaugagcuc

SEQ ID NO: 1401429 - RNA, 20 nt, Human
gcaucucugggcuggaugag

SEQ ID NO: 1401430 - RNA, 16 nt, Human
gcaucucugggcugga

SEQ ID NO: 1401431 - RNA, 14 nt, Human
gcaucucugggcug

SEQ ID NO: 1401432 - RNA, 13 nt, Human
gcaucucugggcu

SEQ ID NO: 1401433 - RNA, 22 nt, Human
gcaucucuaccuucuccccagc

SEQ ID NO: 1401434 - RNA, 18 nt, Human
gcaucucuaccuucuccc

SEQ ID NO: 1401435 - RNA, 21 nt, Human
gcaucucccagauaaugugaa

SEQ ID NO: 1401436 - RNA, 13 nt, Human
gcaucucccagau

SEQ ID NO: 1401437 - RNA, 12 nt, Human
gcaucucccaga

SEQ ID NO: 1401438 - RNA, 20 nt, Human
gcaucuccaagcagcuuaga

SEQ ID NO: 1401439 - RNA, 19 nt, Human
gcaucuccaagcagcuuag

SEQ ID NO: 1401440 - RNA, 17 nt, Human
gcaucuccaagcagcuu

SEQ ID NO: 1401441 - RNA, 17 nt, Human
gcaucucaguaugaauu

SEQ ID NO: 1401442 - RNA, 16 nt, Human
gcaucugucccccuuu

SEQ ID NO: 1401443 - RNA, 23 nt, Human
gcaugaaguaauaugcacacauu

SEQ ID NO: 1401444 - RNA, 21 nt, Human
gcaucugggccuuggccugga

SEQ ID NO: 1401445 - RNA, 22 nt, Human
gcaucugggccuuggccuggag

SEQ ID NO: 1401446 - RNA, 20 nt, Human
gcaugaaguaauaugcacac

SEQ ID NO: 1401447 - RNA, 21 nt, Human
gcaugaaguaauaugcacaca

SEQ ID NO: 1401448 - RNA, 22 nt, Human
gcaugaaguaauaugcacacau

SEQ ID NO: 1401449 - RNA, 12 nt, Human
gcaucaggguua

SEQ ID NO: 1401450 - RNA, 20 nt, Human
gcaucauuauuuauguauug

SEQ ID NO: 1401451 - RNA, 19 nt, Human
gcaucauuauuuauguauu

SEQ ID NO: 1401452 - RNA, 17 nt, Human
gcaucauuauuuaugua

SEQ ID NO: 1401453 - RNA, 13 nt, Human
gcaucauggcuau

SEQ ID NO: 1401454 - RNA, 21 nt, Human
gcaucaugccucugaggccag

SEQ ID NO: 1401455 - RNA, 20 nt, Human
gcaucaugccucugaggcca

SEQ ID NO: 1401456 - RNA, 18 nt, Human
gcaucaugccucugaggc

SEQ ID NO: 1401457 - RNA, 17 nt, Human
gcaucaugccucugagg

SEQ ID NO: 1401458 - RNA, 16 nt, Human
gcaucaugccucugag

SEQ ID NO: 1401459 - RNA, 15 nt, Human
gcaucaugccucuga

SEQ ID NO: 1401460 - RNA, 14 nt, Human
gcaucaugccucug

SEQ ID NO: 1401461 - RNA, 13 nt, Human
gcaucaugccucu

SEQ ID NO: 1401462 - RNA, 12 nt, Human
gcaucaugccuc

SEQ ID NO: 1401463 - RNA, 15 nt, Human
gcaucaucucagcuc

SEQ ID NO: 1401464 - RNA, 22 nt, Human
gcaguucccacauuaaagaaga

SEQ ID NO: 1401465 - RNA, 19 nt, Human
gcauacguacacauuuuau

SEQ ID NO: 1401466 - RNA, 21 nt, Human
gcaguucccacauuaaagaag

SEQ ID NO: 1401467 - RNA, 19 nt, Human
gcaguucccacauuaaaga

SEQ ID NO: 1401468 - RNA, 22 nt, Human
gcaguggugguuuucuguucuu

SEQ ID NO: 1401469 - RNA, 19 nt, Human
gcaguggugguuuucuguu

SEQ ID NO: 1401470 - RNA, 20 nt, Human
gcaguggugguuuucuguuc

SEQ ID NO: 1401471 - RNA, 21 nt, Human
gcaguggugguuuucuguucu

SEQ ID NO: 1401472 - RNA, 19 nt, Human
gcaguggcugguccagggc

SEQ ID NO: 1401473 - RNA, 18 nt, Human
gcaguggcugguccaggg

SEQ ID NO: 1401474 - RNA, 15 nt, Human
gcaguggcuggucca

SEQ ID NO: 1401475 - RNA, 14 nt, Human
gcaguggcuggucc

SEQ ID NO: 1401476 - RNA, 14 nt, Human
gcagugggaaaaau

SEQ ID NO: 1401477 - RNA, 17 nt, Human
gcagggucuagaaggcu

SEQ ID NO: 1401478 - RNA, 20 nt, Human
gcaguggcugguccagggcu

SEQ ID NO: 1401479 - RNA, 19 nt, Human
gcagugggaaaaauguagg

SEQ ID NO: 1401480 - RNA, 17 nt, Human
gcagugggaaaaaugua

SEQ ID NO: 1401481 - RNA, 21 nt, Human
gcaggguccucuucugggccu

SEQ ID NO: 1401482 - RNA, 23 nt, Human
gcaggucccuaauaaagcugugu

SEQ ID NO: 1401483 - RNA, 20 nt, Human
gcaggucccuaauaaagcug

SEQ ID NO: 1401484 - RNA, 21 nt, Human
gcaggucccuaauaaagcugu

SEQ ID NO: 1401485 - RNA, 16 nt, Human
gcaggucccuaauaaa

SEQ ID NO: 1401486 - RNA, 17 nt, Human
gcaggucccuaauaaag

SEQ ID NO: 1401487 - RNA, 18 nt, Human
gcaggucccuaauaaagc

SEQ ID NO: 1401488 - RNA, 19 nt, Human
gcaggucccuaauaaagcu

SEQ ID NO: 1401489 - RNA, 16 nt, Human
gcaggcccuggccucc

SEQ ID NO: 1401490 - RNA, 15 nt, Human
gcaggcccuggccuc

SEQ ID NO: 1401491 - RNA, 14 nt, Human
gcaggcccuggccu

SEQ ID NO: 1401492 - RNA, 12 nt, Human
gcaggcccuggc

SEQ ID NO: 1401493 - RNA, 19 nt, Human
gcaggccagguccagagag

SEQ ID NO: 1401494 - RNA, 22 nt, Human
gcaggccagcugugguuuucuu

SEQ ID NO: 1401495 - RNA, 22 nt, Human
gcaggccaccuggcucucaccu

SEQ ID NO: 1401496 - RNA, 21 nt, Human
gcaggccaccuggcucucacc

SEQ ID NO: 1401497 - RNA, 18 nt, Human
gcaggccaccuggcucuc

SEQ ID NO: 1401498 - RNA, 17 nt, Human
gcaggccaccuggcucu

SEQ ID NO: 1401499 - RNA, 23 nt, Human
gcaggccacacuucaaacuacuu

SEQ ID NO: 1401500 - RNA, 21 nt, Human
gcaggccacacuucaaacuac

SEQ ID NO: 1401501 - RNA, 20 nt, Human
gcaggccacacuucaaacua

SEQ ID NO: 1401502 - RNA, 20 nt, Human
gcaggccaagucaggcccuu

SEQ ID NO: 1401503 - RNA, 23 nt, Human
gcaggcaucggggagccgggagc

SEQ ID NO: 1401504 - RNA, 14 nt, Human
gcaggcagggcucu

SEQ ID NO: 1401505 - RNA, 13 nt, Human
gcaggcagggcuc

SEQ ID NO: 1401506 - RNA, 12 nt, Human
gcaggcagggcu

SEQ ID NO: 1401507 - RNA, 17 nt, Human
gcaggcaggcucccagg

SEQ ID NO: 1401508 - RNA, 18 nt, Human
gcaggcaggcucccaggg

SEQ ID NO: 1401509 - RNA, 15 nt, Human
gcaggcaggcuccca

SEQ ID NO: 1401510 - RNA, 22 nt, Human
gcaggcagggcucuccuggcuu

SEQ ID NO: 1401511 - RNA, 20 nt, Human
gcaggcagggcucuccuggc

SEQ ID NO: 1401512 - RNA, 19 nt, Human
gcaggcagggcucuccugg

SEQ ID NO: 1401513 - RNA, 16 nt, Human
gcaggcagggcucucc

SEQ ID NO: 1401514 - RNA, 15 nt, Human
gcaggcagggcucuc

SEQ ID NO: 1401515 - RNA, 22 nt, Human
gcaggcaucggggagccgggag

SEQ ID NO: 1401516 - RNA, 21 nt, Human
gcaggcaucggggagccggga

SEQ ID NO: 1401517 - RNA, 23 nt, Human
gcaggacugaugucuccuaagca

SEQ ID NO: 1401518 - RNA, 15 nt, Human
gcaggacuguccccu

SEQ ID NO: 1401519 - RNA, 18 nt, Human
gcaggacuguccccuuga

SEQ ID NO: 1401520 - RNA, 19 nt, Human
gcaggacugaugucuccua

SEQ ID NO: 1401521 - RNA, 18 nt, Human
gcaggacugaugucuccu

SEQ ID NO: 1401522 - RNA, 14 nt, Human
gcaggacugauguc

SEQ ID NO: 1401523 - RNA, 13 nt, Human
gcaggacugaugu

SEQ ID NO: 1401524 - RNA, 16 nt, Human
gcagggcucuccuggc

SEQ ID NO: 1401525 - RNA, 15 nt, Human
gcagggcucuccugg

SEQ ID NO: 1401526 - RNA, 14 nt, Human
gcagggcucuccug

SEQ ID NO: 1401527 - RNA, 12 nt, Human
gcagggcucucc

SEQ ID NO: 1401528 - RNA, 23 nt, Human
gcagggauguggguuccacagac

SEQ ID NO: 1401529 - RNA, 22 nt, Human
gcagggauuaaccucugcacua

SEQ ID NO: 1401530 - RNA, 19 nt, Human
gcagggauuaaccucugca

SEQ ID NO: 1401531 - RNA, 22 nt, Human
gcagggauguggguuccacaga

SEQ ID NO: 1401532 - RNA, 13 nt, Human
gcagggauguggg

SEQ ID NO: 1401533 - RNA, 20 nt, Human
gcaggccgugacgucugggu

SEQ ID NO: 1401534 - RNA, 19 nt, Human
gcaggccgugacgucuggg

SEQ ID NO: 1401535 - RNA, 18 nt, Human
gcagggcucuccuggcuu

SEQ ID NO: 1401536 - RNA, 19 nt, Human
gcagggguuggggaaacag

SEQ ID NO: 1401537 - RNA, 14 nt, Human
gcaggucccuaaua

SEQ ID NO: 1401538 - RNA, 15 nt, Human
gcaggucccuaauaa

SEQ ID NO: 1401539 - RNA, 18 nt, Human
gcccagccccacuccucu

SEQ ID NO: 1401540 - RNA, 23 nt, Human
gcccagccccacuccucugcuga

SEQ ID NO: 1401541 - RNA, 17 nt, Human
gcccagccccacuccuc

SEQ ID NO: 1401542 - RNA, 16 nt, Human
gcccagcccauggaga

SEQ ID NO: 1401543 - RNA, 22 nt, Human
gcccagccagcgucggucugug

SEQ ID NO: 1401544 - RNA, 14 nt, Human
gcccagccagcguc

SEQ ID NO: 1401545 - RNA, 13 nt, Human
gcccagccagcgu

SEQ ID NO: 1401546 - RNA, 12 nt, Human
gcccagccagcg

SEQ ID NO: 1401547 - RNA, 21 nt, Human
gcccagcacugcuugaggaaa

SEQ ID NO: 1401548 - RNA, 20 nt, Human
gcccagcacugcuugaggaa

SEQ ID NO: 1401549 - RNA, 19 nt, Human
gcccagcacaugugcugcc

SEQ ID NO: 1401550 - RNA, 18 nt, Human
gcccagagggucuggggg

SEQ ID NO: 1401551 - RNA, 19 nt, Human
gcccagagggucugggggc

SEQ ID NO: 1401552 - RNA, 15 nt, Human
gcccagagggucugg

SEQ ID NO: 1401553 - RNA, 14 nt, Human
gcccagagggucug

SEQ ID NO: 1401554 - RNA, 18 nt, Human
gcccagagcccagcucca

SEQ ID NO: 1401555 - RNA, 17 nt, Human
gcccagagcccagcucc

SEQ ID NO: 1401556 - RNA, 23 nt, Human
gcccagagacccagcggacacac

SEQ ID NO: 1401557 - RNA, 23 nt, Human
gcccagagacauacuugaagggc

SEQ ID NO: 1401558 - RNA, 19 nt, Human
gcccagagacccaagcugc

SEQ ID NO: 1401559 - RNA, 20 nt, Human
gcccagagacauacuugaag

SEQ ID NO: 1401560 - RNA, 10 nt, Human
gcccagagac

SEQ ID NO: 1401561 - RNA, 13 nt, Human
gcccagagaagcc

SEQ ID NO: 1401562 - RNA, 15 nt, Human
gcccagagaagccaa

SEQ ID NO: 1401563 - RNA, 16 nt, Human
gcccagagcccagcuc

SEQ ID NO: 1401564 - RNA, 15 nt, Human
gcccagagcccagcu

SEQ ID NO: 1401565 - RNA, 14 nt, Human
gcccagagcccagc

SEQ ID NO: 1401566 - RNA, 16 nt, Human
gcccagagacccagcg

SEQ ID NO: 1401567 - RNA, 14 nt, Human
gcccaaugaaauga

SEQ ID NO: 1401568 - RNA, 13 nt, Human
gcccaggcuggga

SEQ ID NO: 1401569 - RNA, 16 nt, Human
gcccaggcugguuucg

SEQ ID NO: 1401570 - RNA, 15 nt, Human
gcccaggcugggaac

SEQ ID NO: 1401571 - RNA, 17 nt, Human
gcccagccuuuguuccc

SEQ ID NO: 1401572 - RNA, 23 nt, Human
gcccagccuuuguuccccacugg

SEQ ID NO: 1401573 - RNA, 13 nt, Human
gcccagccgaccc

SEQ ID NO: 1401574 - RNA, 19 nt, Human
gcccagccgacccccucuc

SEQ ID NO: 1401575 - RNA, 21 nt, Human
gcccagcggcuugccugccug

SEQ ID NO: 1401576 - RNA, 18 nt, Human
gcccagcugggucaggca

SEQ ID NO: 1401577 - RNA, 15 nt, Human
gcccagcugggucag

SEQ ID NO: 1401578 - RNA, 14 nt, Human
gcccagcuggguca

SEQ ID NO: 1401579 - RNA, 13 nt, Human
gcccagcuggguc

SEQ ID NO: 1401580 - RNA, 20 nt, Human
gcccagcugggucaggcagg

SEQ ID NO: 1401581 - RNA, 19 nt, Human
gcccagcugggucaggcag

SEQ ID NO: 1401582 - RNA, 16 nt, Human
gcccagcccuaaacau

SEQ ID NO: 1401583 - RNA, 11 nt, Human
gccagauccag

SEQ ID NO: 1401584 - RNA, 14 nt, Human
gccagauccagccu

SEQ ID NO: 1401585 - RNA, 19 nt, Human
gccagauuuuccugaaaac

SEQ ID NO: 1401586 - RNA, 22 nt, Human
gccaggcugaccacagcacagc

SEQ ID NO: 1401587 - RNA, 16 nt, Human
gccaggcuggagugca

SEQ ID NO: 1401588 - RNA, 13 nt, Human
gccaggcuggguc

SEQ ID NO: 1401589 - RNA, 20 nt, Human
gccagggagaagcuccucuc

SEQ ID NO: 1401590 - RNA, 16 nt, Human
gccagggagaagcucc

SEQ ID NO: 1401591 - RNA, 15 nt, Human
gccagggagaagcuc

SEQ ID NO: 1401592 - RNA, 14 nt, Human
gccagggagaagcu

SEQ ID NO: 1401593 - RNA, 18 nt, Human
gccaggcuggagugcagu

SEQ ID NO: 1401594 - RNA, 19 nt, Human
gccaggcuggagugcagug

SEQ ID NO: 1401595 - RNA, 15 nt, Human
gccaguauuuuaaaa

SEQ ID NO: 1401596 - RNA, 23 nt, Human
gccagguucuccguuagcuccug

SEQ ID NO: 1401597 - RNA, 15 nt, Human
gccagggucuccaga

SEQ ID NO: 1401598 - RNA, 12 nt, Human
gccaguaaaugg

SEQ ID NO: 1401599 - RNA, 19 nt, Human
gccagggucuccagaaagc

SEQ ID NO: 1401600 - RNA, 22 nt, Human
gccagggggagcugggccuggu

SEQ ID NO: 1401601 - RNA, 22 nt, Human
gccaggggggugaggagcuggg

SEQ ID NO: 1401602 - RNA, 21 nt, Human
gccaggggggugaggagcugg

SEQ ID NO: 1401603 - RNA, 20 nt, Human
gccaggggggugaggagcug

SEQ ID NO: 1401604 - RNA, 19 nt, Human
gccaggggggugaggagcu

SEQ ID NO: 1401605 - RNA, 20 nt, Human
gccagggggagcugggccug

SEQ ID NO: 1401606 - RNA, 20 nt, Human
gccaggggagcagaggggca

SEQ ID NO: 1401607 - RNA, 21 nt, Human
gccaggggagcagaggggcag

SEQ ID NO: 1401608 - RNA, 14 nt, Human
gccaggggagcaga

SEQ ID NO: 1401609 - RNA, 15 nt, Human
gccagggccccucuc

SEQ ID NO: 1401610 - RNA, 14 nt, Human
gccagggccccucu

SEQ ID NO: 1401611 - RNA, 22 nt, Human
gccagggccccucacccugccu

SEQ ID NO: 1401612 - RNA, 13 nt, Human
gccagggccccuc

SEQ ID NO: 1401613 - RNA, 20 nt, Human
gccagggccacgcuccagcu

SEQ ID NO: 1401614 - RNA, 22 nt, Human
gccagggccacgcuccagcugc

SEQ ID NO: 1401615 - RNA, 19 nt, Human
gccagggccacgcuccagc

SEQ ID NO: 1401616 - RNA, 15 nt, Human
gccagggccacgcuc

SEQ ID NO: 1401617 - RNA, 19 nt, Human
gccagggcagggccccagg

SEQ ID NO: 1401618 - RNA, 14 nt, Human
gccagggcagggcc

SEQ ID NO: 1401619 - RNA, 21 nt, Human
gccagggcagagugagaccca

SEQ ID NO: 1401620 - RNA, 16 nt, Human
gccagggcagagugag

SEQ ID NO: 1401621 - RNA, 15 nt, Human
gccagggcagaguga

SEQ ID NO: 1401622 - RNA, 20 nt, Human
gccagggcaaugaugaauga

SEQ ID NO: 1401623 - RNA, 17 nt, Human
gccagggagagcccagg

SEQ ID NO: 1401624 - RNA, 16 nt, Human
gccagggagagcccag

SEQ ID NO: 1401625 - RNA, 15 nt, Human
gccagggagagccca

SEQ ID NO: 1401626 - RNA, 13 nt, Human
gccagggagagcc

SEQ ID NO: 1401627 - RNA, 22 nt, Human
gccagggagagcccaggagcuc

SEQ ID NO: 1401628 - RNA, 21 nt, Human
gccagggagagcccaggagcu

SEQ ID NO: 1401629 - RNA, 20 nt, Human
gccagggagagcccaggagc

SEQ ID NO: 1401630 - RNA, 19 nt, Human
gccagggagagcccaggag

SEQ ID NO: 1401631 - RNA, 14 nt, Human
gccagggagcgagu

SEQ ID NO: 1401632 - RNA, 18 nt, Human
gccagugcccugagccag

SEQ ID NO: 1401633 - RNA, 17 nt, Human
gccagugcccugagcca

SEQ ID NO: 1401634 - RNA, 16 nt, Human
gccagugcccugagcc

SEQ ID NO: 1401635 - RNA, 18 nt, Human
gccagugcccugauccca

SEQ ID NO: 1401636 - RNA, 15 nt, Human
gccagugcccugagc

SEQ ID NO: 1401637 - RNA, 14 nt, Human
gccagugcccugag

SEQ ID NO: 1401638 - RNA, 13 nt, Human
gccagugcccuga

SEQ ID NO: 1401639 - RNA, 17 nt, Human
gccaguauuuuaaaaua

SEQ ID NO: 1401640 - RNA, 17 nt, Human
gccagugaccaaccuuu

SEQ ID NO: 1401641 - RNA, 21 nt, Human
gccaucugcgugacaauaaaa

SEQ ID NO: 1401642 - RNA, 23 nt, Human
gccaugagaugauacauccaaag

SEQ ID NO: 1401643 - RNA, 23 nt, Human
gccaugacccugccucucccagg

SEQ ID NO: 1401644 - RNA, 22 nt, Human
gccaugacccugccucucccag

SEQ ID NO: 1401645 - RNA, 15 nt, Human
gccaugcagaaagca

SEQ ID NO: 1401646 - RNA, 16 nt, Human
gcccaacccuucccuc

SEQ ID NO: 1401647 - RNA, 20 nt, Human
gcccaaguucaugcagcugu

SEQ ID NO: 1401648 - RNA, 19 nt, Human
gcccaaguucaugcagcug

SEQ ID NO: 1401649 - RNA, 19 nt, Human
gccauggacucuguccuga

SEQ ID NO: 1401650 - RNA, 21 nt, Human
gccaugcugaggccugggccg

SEQ ID NO: 1401651 - RNA, 20 nt, Human
gccaugcugaggccugggcc

SEQ ID NO: 1401652 - RNA, 19 nt, Human
gccaugcugaggccugggc

SEQ ID NO: 1401653 - RNA, 18 nt, Human
gccaugcugaggccuggg

SEQ ID NO: 1401654 - RNA, 17 nt, Human
gccaugcugaggccugg

SEQ ID NO: 1401655 - RNA, 14 nt, Human
gccaugcugaggcc

SEQ ID NO: 1401656 - RNA, 13 nt, Human
gccaugcugaggc

SEQ ID NO: 1401657 - RNA, 18 nt, Human
gccauggacucuguccug

SEQ ID NO: 1401658 - RNA, 17 nt, Human
gccauggacucuguccu

SEQ ID NO: 1401659 - RNA, 16 nt, Human
gccauggacucugucc

SEQ ID NO: 1401660 - RNA, 19 nt, Human
gccaugggcacugugggua

SEQ ID NO: 1401661 - RNA, 19 nt, Human
gccacaaggacuuccuguc

SEQ ID NO: 1401662 - RNA, 18 nt, Human
gccacaaggacuuccugu

SEQ ID NO: 1401663 - RNA, 17 nt, Human
gccacaaggacuuccug

SEQ ID NO: 1401664 - RNA, 14 nt, Human
gccacaaggacuuc

SEQ ID NO: 1401665 - RNA, 21 nt, Human
gccacaaugaacaucccuuuu

SEQ ID NO: 1401666 - RNA, 21 nt, Human
gccacaaggacuuccugucca

SEQ ID NO: 1401667 - RNA, 21 nt, Human
gccacaccaggauagagacug

SEQ ID NO: 1401668 - RNA, 15 nt, Human
gccacacagcugccg

SEQ ID NO: 1401669 - RNA, 15 nt, Human
gccacacaguauuuu

SEQ ID NO: 1401670 - RNA, 14 nt, Human
gccacacagcugcc

SEQ ID NO: 1401671 - RNA, 13 nt, Human
gccacacagcugc

SEQ ID NO: 1401672 - RNA, 20 nt, Human
gccaauuucaaguuccaagu

SEQ ID NO: 1401673 - RNA, 13 nt, Human
gccaauuccuaua

SEQ ID NO: 1401674 - RNA, 18 nt, Human
gccaauucagacaggcaa

SEQ ID NO: 1401675 - RNA, 17 nt, Human
gccaauucagacaggca

SEQ ID NO: 1401676 - RNA, 15 nt, Human
gccaauucagacagg

SEQ ID NO: 1401677 - RNA, 20 nt, Human
gccaauuauguuaaacuagc

SEQ ID NO: 1401678 - RNA, 14 nt, Human
gccaauuauguuaa

SEQ ID NO: 1401679 - RNA, 15 nt, Human
gccaauuauguuaaa

SEQ ID NO: 1401680 - RNA, 16 nt, Human
gccaauuauguuaaac

SEQ ID NO: 1401681 - RNA, 17 nt, Human
gccaauuauguuaaacu

SEQ ID NO: 1401682 - RNA, 19 nt, Human
gccaauuauguuaaacuag

SEQ ID NO: 1401683 - RNA, 15 nt, Human
gccacaaaaacaggu

SEQ ID NO: 1401684 - RNA, 16 nt, Human
gccacagcuuuugcaa

SEQ ID NO: 1401685 - RNA, 18 nt, Human
gccacagcuuuugcaacu

SEQ ID NO: 1401686 - RNA, 15 nt, Human
gccacagcuuuugca

SEQ ID NO: 1401687 - RNA, 13 nt, Human
gccacagcuuuug

SEQ ID NO: 1401688 - RNA, 12 nt, Human
gccacagcuuuu

SEQ ID NO: 1401689 - RNA, 10 nt, Human
gccacagcuu

SEQ ID NO: 1401690 - RNA, 16 nt, Human
gccacagccuccccug

SEQ ID NO: 1401691 - RNA, 21 nt, Human
gccacagccuccccugccagg

SEQ ID NO: 1401692 - RNA, 21 nt, Human
gccacagcccugucagcauga

SEQ ID NO: 1401693 - RNA, 15 nt, Human
gccacagcccuguca

SEQ ID NO: 1401694 - RNA, 14 nt, Human
gccacagcccuguc

SEQ ID NO: 1401695 - RNA, 14 nt, Human
gccacagccagggg

SEQ ID NO: 1401696 - RNA, 12 nt, Human
gccacagccagg

SEQ ID NO: 1401697 - RNA, 23 nt, Human
gccacacuucucaggacacaggc

SEQ ID NO: 1401698 - RNA, 22 nt, Human
gccacacuucucaggacacagg

SEQ ID NO: 1401699 - RNA, 17 nt, Human
gccacacucagcacaag

SEQ ID NO: 1401700 - RNA, 16 nt, Human
gccacacucagcacaa

SEQ ID NO: 1401701 - RNA, 13 nt, Human
gccacacucagca

SEQ ID NO: 1401702 - RNA, 16 nt, Human
gccacaccaggauaga

SEQ ID NO: 1401703 - RNA, 13 nt, Human
gccacaccaggau

SEQ ID NO: 1401704 - RNA, 19 nt, Human
gccacacucagcacaaggc

SEQ ID NO: 1401705 - RNA, 20 nt, Human
gccacacucuuucuccugcu

SEQ ID NO: 1401706 - RNA, 21 nt, Human
gccacacucuuucuccugcuu

SEQ ID NO: 1401707 - RNA, 19 nt, Human
gccacacuucucaggacac

SEQ ID NO: 1401708 - RNA, 17 nt, Human
gccacacuucucaggac

SEQ ID NO: 1401709 - RNA, 16 nt, Human
gccacacuucucagga

SEQ ID NO: 1401710 - RNA, 19 nt, Human
gccacacuucaaacuacuu

SEQ ID NO: 1401711 - RNA, 22 nt, Human
gccaauauuaguaggauuuuug

SEQ ID NO: 1401712 - RNA, 18 nt, Human
gccaauauuaaaucugcu

SEQ ID NO: 1401713 - RNA, 19 nt, Human
gccaaugcaccuaaagaaa

SEQ ID NO: 1401714 - RNA, 21 nt, Human
gccaaugcaccuaaagaaaaa

SEQ ID NO: 1401715 - RNA, 22 nt, Human
gccaaucccucaccuucugagu

SEQ ID NO: 1401716 - RNA, 21 nt, Human
gccaaucccucaccuucugag

SEQ ID NO: 1401717 - RNA, 16 nt, Human
gccaaguuccucuaac

SEQ ID NO: 1401718 - RNA, 12 nt, Human
gccaaguuccuc

SEQ ID NO: 1401719 - RNA, 22 nt, Human
gccaaguccagguccugguggg

SEQ ID NO: 1401720 - RNA, 21 nt, Human
gccaaguccagguccuggugg

SEQ ID NO: 1401721 - RNA, 19 nt, Human
gccaaguccagguccuggu

SEQ ID NO: 1401722 - RNA, 18 nt, Human
gccaaguccagguccugg

SEQ ID NO: 1401723 - RNA, 17 nt, Human
gccaaguccagguccug

SEQ ID NO: 1401724 - RNA, 16 nt, Human
gccaaguccagguccu

SEQ ID NO: 1401725 - RNA, 15 nt, Human
gccaaguccaggucc

SEQ ID NO: 1401726 - RNA, 23 nt, Human
gccaagguguccuacagaaaaac

SEQ ID NO: 1401727 - RNA, 16 nt, Human
gccaauagugucaucc

SEQ ID NO: 1401728 - RNA, 20 nt, Human
gccaagguuuuauaaggcug

SEQ ID NO: 1401729 - RNA, 21 nt, Human
gccaagguguccuacagaaaa

SEQ ID NO: 1401730 - RNA, 20 nt, Human
gccaagguguccuacagaaa

SEQ ID NO: 1401731 - RNA, 19 nt, Human
gccaagguguccuacagaa

SEQ ID NO: 1401732 - RNA, 18 nt, Human
gccaagguguccuacaga

SEQ ID NO: 1401733 - RNA, 16 nt, Human
gccaagguguccuaca

SEQ ID NO: 1401734 - RNA, 14 nt, Human
gccaagguguccua

SEQ ID NO: 1401735 - RNA, 13 nt, Human
gccaagguguccu

SEQ ID NO: 1401736 - RNA, 21 nt, Human
gccaagggccgacuaagagaa

SEQ ID NO: 1401737 - RNA, 18 nt, Human
gccaaggggcuucagguc

SEQ ID NO: 1401738 - RNA, 16 nt, Human
gccaagggcuuuguuu

SEQ ID NO: 1401739 - RNA, 19 nt, Human
gccaagggcauaaauuauu

SEQ ID NO: 1401740 - RNA, 22 nt, Human
gccaagggcaacagaucaguaa

SEQ ID NO: 1401741 - RNA, 21 nt, Human
gccaagggauggacaucuugu

SEQ ID NO: 1401742 - RNA, 19 nt, Human
gccaagggaaccugugucc

SEQ ID NO: 1401743 - RNA, 18 nt, Human
gccaagggaaccuguguc

SEQ ID NO: 1401744 - RNA, 21 nt, Human
gcauuugaggucuguucuuuc

SEQ ID NO: 1401745 - RNA, 19 nt, Human
gcauuugaggucuguucuu

SEQ ID NO: 1401746 - RNA, 20 nt, Human
gcauuugaggucuguucuuu

SEQ ID NO: 1401747 - RNA, 22 nt, Human
gcauuuggugguuucagaaaug

SEQ ID NO: 1401748 - RNA, 23 nt, Human
gcauuuggugguuucagaaaugu

SEQ ID NO: 1401749 - RNA, 21 nt, Human
gccagacuucccacggcuccu

SEQ ID NO: 1401750 - RNA, 18 nt, Human
gccacuccuuccugcccc

SEQ ID NO: 1401751 - RNA, 17 nt, Human
gccacuccuuccugccc

SEQ ID NO: 1401752 - RNA, 15 nt, Human
gccacuccuuccugc

SEQ ID NO: 1401753 - RNA, 14 nt, Human
gccacuccuuccug

SEQ ID NO: 1401754 - RNA, 13 nt, Human
gccacuccuuccu

SEQ ID NO: 1401755 - RNA, 23 nt, Human
gccacuccucugacucagggcuc

SEQ ID NO: 1401756 - RNA, 15 nt, Human
gccacaucaaagagg

SEQ ID NO: 1401757 - RNA, 18 nt, Human
gccacaguagucuugaug

SEQ ID NO: 1401758 - RNA, 23 nt, Human
gccaccucagaccccggggugag

SEQ ID NO: 1401759 - RNA, 21 nt, Human
gccaccucuaacagcaccaaa

SEQ ID NO: 1401760 - RNA, 19 nt, Human
gccaccucuaacagcacca

SEQ ID NO: 1401761 - RNA, 18 nt, Human
gccaccucuaacagcacc

SEQ ID NO: 1401762 - RNA, 17 nt, Human
gccaccucuaacagcac

SEQ ID NO: 1401763 - RNA, 16 nt, Human
gccaccugaauaaaga

SEQ ID NO: 1401764 - RNA, 17 nt, Human
gccacgcuccagcugcc

SEQ ID NO: 1401765 - RNA, 15 nt, Human
gccacgcuccagcug

SEQ ID NO: 1401766 - RNA, 14 nt, Human
gccacgcuccagcu

SEQ ID NO: 1401767 - RNA, 13 nt, Human
gccacgcuccagc

SEQ ID NO: 1401768 - RNA, 16 nt, Human
gccacgcuccagcugc

SEQ ID NO: 1401769 - RNA, 23 nt, Human
gccacgggugccagaagcuacug

SEQ ID NO: 1401770 - RNA, 18 nt, Human
gccacggggacucagccc

SEQ ID NO: 1401771 - RNA, 12 nt, Human
gccaccuggacc

SEQ ID NO: 1401772 - RNA, 20 nt, Human
gccaccuggcucucaccucu

SEQ ID NO: 1401773 - RNA, 19 nt, Human
gccaccuggaccccugcau

SEQ ID NO: 1401774 - RNA, 16 nt, Human
gccaccuggaccccug

SEQ ID NO: 1401775 - RNA, 15 nt, Human
gccaccuggaccccu

SEQ ID NO: 1401776 - RNA, 14 nt, Human
gccaccuggacccc

SEQ ID NO: 1401777 - RNA, 13 nt, Human
gccaccuggaccc

SEQ ID NO: 1401778 - RNA, 18 nt, Human
gccaccuggaccccugca

SEQ ID NO: 1401779 - RNA, 14 nt, Human
gccaccugucuguc

SEQ ID NO: 1401780 - RNA, 15 nt, Human
gccaccugucugucu

SEQ ID NO: 1401781 - RNA, 10 nt, Human
gccaccuguc

SEQ ID NO: 1401782 - RNA, 12 nt, Human
gccaccugucug

SEQ ID NO: 1401783 - RNA, 13 nt, Human
gccaccugucugu

SEQ ID NO: 1401784 - RNA, 16 nt, Human
gccugggccgcugcca

SEQ ID NO: 1401785 - RNA, 14 nt, Human
gccugggcagugga

SEQ ID NO: 1401786 - RNA, 13 nt, Human
gccugggcagugg

SEQ ID NO: 1401787 - RNA, 16 nt, Human
gccugggcaggaggga

SEQ ID NO: 1401788 - RNA, 16 nt, Human
gccuggccccaugguc

SEQ ID NO: 1401789 - RNA, 18 nt, Human
gccuggcccaccccaccc

SEQ ID NO: 1401790 - RNA, 17 nt, Human
gccugggcuccuggacc

SEQ ID NO: 1401791 - RNA, 15 nt, Human
gccugggcuccugga

SEQ ID NO: 1401792 - RNA, 14 nt, Human
gccugggcuccugg

SEQ ID NO: 1401793 - RNA, 13 nt, Human
gccugggcuccug

SEQ ID NO: 1401794 - RNA, 21 nt, Human
gccugggcgcugguccuuucu

SEQ ID NO: 1401795 - RNA, 10 nt, Human
gccugggcuc

SEQ ID NO: 1401796 - RNA, 20 nt, Human
gccugggcgcugguccuuuc

SEQ ID NO: 1401797 - RNA, 17 nt, Human
gccugggcgcugguccu

SEQ ID NO: 1401798 - RNA, 23 nt, Human
gccugggccuauggagagcccug

SEQ ID NO: 1401799 - RNA, 22 nt, Human
gccugggccuauggagagcccu

SEQ ID NO: 1401800 - RNA, 21 nt, Human
gccugggccuauggagagccc

SEQ ID NO: 1401801 - RNA, 20 nt, Human
gccugggccuauggagagcc

SEQ ID NO: 1401802 - RNA, 19 nt, Human
gccugggccuauggagagc

SEQ ID NO: 1401803 - RNA, 18 nt, Human
gccugggccuauggagag

SEQ ID NO: 1401804 - RNA, 14 nt, Human
gccugggccuaugg

SEQ ID NO: 1401805 - RNA, 18 nt, Human
gccugggccgcugccacg

SEQ ID NO: 1401806 - RNA, 17 nt, Human
gccugggccgcugccac

SEQ ID NO: 1401807 - RNA, 16 nt, Human
gccugggcuccuggac

SEQ ID NO: 1401808 - RNA, 15 nt, Human
gccugggcugggaaa

SEQ ID NO: 1401809 - RNA, 20 nt, Human
gccugguauauccaaaagcu

SEQ ID NO: 1401810 - RNA, 20 nt, Human
gccuggguuugguguauggu

SEQ ID NO: 1401811 - RNA, 12 nt, Human
gccugucucaag

SEQ ID NO: 1401812 - RNA, 19 nt, Human
gccuguccugccuguggcc

SEQ ID NO: 1401813 - RNA, 16 nt, Human
gccuguacugccugcu

SEQ ID NO: 1401814 - RNA, 15 nt, Human
gccuguccugccugu

SEQ ID NO: 1401815 - RNA, 15 nt, Human
gccuguacugccugc

SEQ ID NO: 1401816 - RNA, 14 nt, Human
gccuguacugccug

SEQ ID NO: 1401817 - RNA, 13 nt, Human
gccuguacugccu

SEQ ID NO: 1401818 - RNA, 11 nt, Human
gccuguacugc

SEQ ID NO: 1401819 - RNA, 19 nt, Human
gccuggguuugguguaugg

SEQ ID NO: 1401820 - RNA, 17 nt, Human
gccuggaagagcagccc

SEQ ID NO: 1401821 - RNA, 15 nt, Human
gccuggaagagcagc

SEQ ID NO: 1401822 - RNA, 21 nt, Human
gccugcugcugagaaccuggc

SEQ ID NO: 1401823 - RNA, 20 nt, Human
gccugcugcugagaaccugg

SEQ ID NO: 1401824 - RNA, 19 nt, Human
gccugcugcugagaaccug

SEQ ID NO: 1401825 - RNA, 18 nt, Human
gccugcugcugagaaccu

SEQ ID NO: 1401826 - RNA, 17 nt, Human
gccugcugcugagaacc

SEQ ID NO: 1401827 - RNA, 15 nt, Human
gccugcugcugagaa

SEQ ID NO: 1401828 - RNA, 14 nt, Human
gccugcugcugaga

SEQ ID NO: 1401829 - RNA, 13 nt, Human
gccugcugcugag

SEQ ID NO: 1401830 - RNA, 12 nt, Human
gccugcugcuga

SEQ ID NO: 1401831 - RNA, 21 nt, Human
gccugcucccauccugugugu

SEQ ID NO: 1401832 - RNA, 21 nt, Human
gccugcauccauucuccugag

SEQ ID NO: 1401833 - RNA, 22 nt, Human
gccugcauccauucuccugagg

SEQ ID NO: 1401834 - RNA, 23 nt, Human
gccugcauaggaguuuggaggaa

SEQ ID NO: 1401835 - RNA, 22 nt, Human
gccugcauaggaguuuggagga

SEQ ID NO: 1401836 - RNA, 17 nt, Human
gccugcaguccuggaag

SEQ ID NO: 1401837 - RNA, 23 nt, Human
gccuggacccguucaugggggag

SEQ ID NO: 1401838 - RNA, 17 nt, Human
gccuggaccagccucuc

SEQ ID NO: 1401839 - RNA, 16 nt, Human
gccuggaccagccucu

SEQ ID NO: 1401840 - RNA, 18 nt, Human
gccuggcaagugggugaa

SEQ ID NO: 1401841 - RNA, 23 nt, Human
gccugcaggaucucaccaggcag

SEQ ID NO: 1401842 - RNA, 16 nt, Human
gccugcaggaucucac

SEQ ID NO: 1401843 - RNA, 13 nt, Human
gccugcaggaucu

SEQ ID NO: 1401844 - RNA, 24 nt, Human
gccugcaggaucucaccaggcagc

SEQ ID NO: 1401845 - RNA, 15 nt, Human
gccugagggaaaggc

SEQ ID NO: 1401846 - RNA, 14 nt, Human
gccugagggaaagg

SEQ ID NO: 1401847 - RNA, 10 nt, Human
gccugaggga

SEQ ID NO: 1401848 - RNA, 20 nt, Human
gccuuguaauucuaaaugaa

SEQ ID NO: 1401849 - RNA, 17 nt, Human
gccuuguaauucuaaau

SEQ ID NO: 1401850 - RNA, 23 nt, Human
gccuugguuuuuacugcucugag

SEQ ID NO: 1401851 - RNA, 22 nt, Human
gccuugguuuuuacugcucuga

SEQ ID NO: 1401852 - RNA, 17 nt, Human
gccuugguuuuuacugc

SEQ ID NO: 1401853 - RNA, 15 nt, Human
gccuuguuuuuuucu

SEQ ID NO: 1401854 - RNA, 12 nt, Human
gccuuguucugu

SEQ ID NO: 1401855 - RNA, 16 nt, Human
gccuuguucugucacc

SEQ ID NO: 1401856 - RNA, 23 nt, Human
gccuugugaugucauacagagaa

SEQ ID NO: 1401857 - RNA, 22 nt, Human
gccuugugaugucauacagaga

SEQ ID NO: 1401858 - RNA, 21 nt, Human
gccuugugaugucauacagag

SEQ ID NO: 1401859 - RNA, 12 nt, Human
gccuuguguaca

SEQ ID NO: 1401860 - RNA, 17 nt, Human
gccuugucacgccagac

SEQ ID NO: 1401861 - RNA, 16 nt, Human
gccuugucacgccaga

SEQ ID NO: 1401862 - RNA, 15 nt, Human
gccuugucacgccag

SEQ ID NO: 1401863 - RNA, 22 nt, Human
gccuuccuccugggcccucucu

SEQ ID NO: 1401864 - RNA, 17 nt, Human
gccuuccuccugggccc

SEQ ID NO: 1401865 - RNA, 16 nt, Human
gccuuccuccugggcc

SEQ ID NO: 1401866 - RNA, 14 nt, Human
gccuuccuccuggg

SEQ ID NO: 1401867 - RNA, 13 nt, Human
gccuuccuccugg

SEQ ID NO: 1401868 - RNA, 17 nt, Human
gccugugaacccaggac

SEQ ID NO: 1401869 - RNA, 16 nt, Human
gccugugaacccagga

SEQ ID NO: 1401870 - RNA, 15 nt, Human
gccugugaacccagg

SEQ ID NO: 1401871 - RNA, 14 nt, Human
gccugugaacccag

SEQ ID NO: 1401872 - RNA, 17 nt, Human
gccugucuuaauuuucu

SEQ ID NO: 1401873 - RNA, 16 nt, Human
gccugucuuaauuuuc

SEQ ID NO: 1401874 - RNA, 20 nt, Human
gccuuuccauccauggccag

SEQ ID NO: 1401875 - RNA, 21 nt, Human
gccuuuccauccauggccagc

SEQ ID NO: 1401876 - RNA, 19 nt, Human
gccuuuccauccauggcca

SEQ ID NO: 1401877 - RNA, 15 nt, Human
gccuuuccauccaug

SEQ ID NO: 1401878 - RNA, 18 nt, Human
gccuuucaggaucuauuu

SEQ ID NO: 1401879 - RNA, 16 nt, Human
gccuuguuuuuuucua

SEQ ID NO: 1401880 - RNA, 13 nt, Human
gccuuuaaaauuu

SEQ ID NO: 1401881 - RNA, 17 nt, Human
gccuuucuucucuccag

SEQ ID NO: 1401882 - RNA, 17 nt, Human
gcgaagcguuguccuca

SEQ ID NO: 1401883 - RNA, 23 nt, Human
gcgguagccagcacacagggcag

SEQ ID NO: 1401884 - RNA, 22 nt, Human
gcgguagccagcacacagggca

SEQ ID NO: 1401885 - RNA, 21 nt, Human
gcgguagccagcacacagggc

SEQ ID NO: 1401886 - RNA, 15 nt, Human
gcgguagccagcaca

SEQ ID NO: 1401887 - RNA, 17 nt, Human
gcggaccacccucacug

SEQ ID NO: 1401888 - RNA, 13 nt, Human
gcgcaucagacug

SEQ ID NO: 1401889 - RNA, 22 nt, Human
gcgcaguuuuuuuuuucuuguc

SEQ ID NO: 1401890 - RNA, 18 nt, Human
gcgcaguguggaggccac

SEQ ID NO: 1401891 - RNA, 22 nt, Human
gcgcccccuccgcccugccacu

SEQ ID NO: 1401892 - RNA, 21 nt, Human
gcgcccccuccgcccugccac

SEQ ID NO: 1401893 - RNA, 22 nt, Human
gcgccccaacccguggaggcug

SEQ ID NO: 1401894 - RNA, 21 nt, Human
gcgccccaacccguggaggcu

SEQ ID NO: 1401895 - RNA, 18 nt, Human
gcgccccaacccguggag

SEQ ID NO: 1401896 - RNA, 15 nt, Human
gcgccugugguucug

SEQ ID NO: 1401897 - RNA, 21 nt, Human
gcgccucgccggaucugaggg

SEQ ID NO: 1401898 - RNA, 19 nt, Human
gcgccuccauccaaggcca

SEQ ID NO: 1401899 - RNA, 18 nt, Human
gcgcccugcagacccugc

SEQ ID NO: 1401900 - RNA, 16 nt, Human
gcgcccugcagacccu

SEQ ID NO: 1401901 - RNA, 14 nt, Human
gcgcccugcagacc

SEQ ID NO: 1401902 - RNA, 13 nt, Human
gcgcccugcagac

SEQ ID NO: 1401903 - RNA, 12 nt, Human
gcgcccugcaga

SEQ ID NO: 1401904 - RNA, 22 nt, Human
gcgcccuuaacugcauccagcc

SEQ ID NO: 1401905 - RNA, 13 nt, Human
gcuagauguaugu

SEQ ID NO: 1401906 - RNA, 21 nt, Human
gcuauaaagcaguauuuuucu

SEQ ID NO: 1401907 - RNA, 19 nt, Human
gcuauaaagcaguauuuuu

SEQ ID NO: 1401908 - RNA, 16 nt, Human
gcuagauguauguacu

SEQ ID NO: 1401909 - RNA, 14 nt, Human
gcuagauguaugua

SEQ ID NO: 1401910 - RNA, 21 nt, Human
gcuauacugcauacuuuuuaa

SEQ ID NO: 1401911 - RNA, 17 nt, Human
gcuauauaagacaagaa

SEQ ID NO: 1401912 - RNA, 12 nt, Human
gcuauccaccaa

SEQ ID NO: 1401913 - RNA, 13 nt, Human
gcucacacaccug

SEQ ID NO: 1401914 - RNA, 22 nt, Human
gcucacaaggcagcaaggcccg

SEQ ID NO: 1401915 - RNA, 21 nt, Human
gcucacaaggcagcaaggccc

SEQ ID NO: 1401916 - RNA, 20 nt, Human
gcucacaaggcagcaaggcc

SEQ ID NO: 1401917 - RNA, 19 nt, Human
gcucacaaggcagcaaggc

SEQ ID NO: 1401918 - RNA, 15 nt, Human
gcucacaaggcagca

SEQ ID NO: 1401919 - RNA, 14 nt, Human
gcucacaaggcagc

SEQ ID NO: 1401920 - RNA, 13 nt, Human
gcucacaaggcag

SEQ ID NO: 1401921 - RNA, 14 nt, Human
gcucacaaaccaug

SEQ ID NO: 1401922 - RNA, 17 nt, Human
gcucaauggacuggaag

SEQ ID NO: 1401923 - RNA, 20 nt, Human
gcucaaugagcauguuuaga

SEQ ID NO: 1401924 - RNA, 19 nt, Human
gcucaaugagcauguuuag

SEQ ID NO: 1401925 - RNA, 14 nt, Human
gcucaaugagcaug

SEQ ID NO: 1401926 - RNA, 13 nt, Human
gcucaaugagcau

SEQ ID NO: 1401927 - RNA, 20 nt, Human
gcucaaucccugaggacuga

SEQ ID NO: 1401928 - RNA, 16 nt, Human
gcucaaucccugagga

SEQ ID NO: 1401929 - RNA, 14 nt, Human
gcucaaggccagcu

SEQ ID NO: 1401930 - RNA, 18 nt, Human
gcucaagcgauucuccug

SEQ ID NO: 1401931 - RNA, 17 nt, Human
gcuaucguaaaauuaag

SEQ ID NO: 1401932 - RNA, 15 nt, Human
gcuaucguaaaauua

SEQ ID NO: 1401933 - RNA, 16 nt, Human
gcuaucguaaaauuaa

SEQ ID NO: 1401934 - RNA, 21 nt, Human
gcucagccccaccccagggca

SEQ ID NO: 1401935 - RNA, 20 nt, Human
gcucagccccaccccagggc

SEQ ID NO: 1401936 - RNA, 15 nt, Human
gcucagccccacccc

SEQ ID NO: 1401937 - RNA, 21 nt, Human
gcucagccaucccgucuucuc

SEQ ID NO: 1401938 - RNA, 15 nt, Human
gcucagccagcacuu

SEQ ID NO: 1401939 - RNA, 22 nt, Human
gcucagccccaccccagggcag

SEQ ID NO: 1401940 - RNA, 12 nt, Human
gcucagcccugc

SEQ ID NO: 1401941 - RNA, 15 nt, Human
gcucagcccugagga

SEQ ID NO: 1401942 - RNA, 12 nt, Human
gcucagcccuga

SEQ ID NO: 1401943 - RNA, 19 nt, Human
gcucagcugcauuccgcag

SEQ ID NO: 1401944 - RNA, 12 nt, Human
gcucagcugcau

SEQ ID NO: 1401945 - RNA, 17 nt, Human
gcucagcucugggccau

SEQ ID NO: 1401946 - RNA, 16 nt, Human
gcucagcucugggcca

SEQ ID NO: 1401947 - RNA, 18 nt, Human
gcucagcucauccaugcc

SEQ ID NO: 1401948 - RNA, 16 nt, Human
gcucagcccugcacca

SEQ ID NO: 1401949 - RNA, 19 nt, Human
gcucagcugucaaggcuca

SEQ ID NO: 1401950 - RNA, 15 nt, Human
gcucaucugcugguc

SEQ ID NO: 1401951 - RNA, 14 nt, Human
gcucaucugcuggu

SEQ ID NO: 1401952 - RNA, 13 nt, Human
gcucaucugcugg

SEQ ID NO: 1401953 - RNA, 20 nt, Human
gcucaucauucucugucuca

SEQ ID NO: 1401954 - RNA, 19 nt, Human
gcucaucauucucugucuc

SEQ ID NO: 1401955 - RNA, 18 nt, Human
gcucaucauucucugucu

SEQ ID NO: 1401956 - RNA, 16 nt, Human
gcucaucauucucugu

SEQ ID NO: 1401957 - RNA, 23 nt, Human
gcucaucugcugguccgugggac

SEQ ID NO: 1401958 - RNA, 21 nt, Human
gcucaucugcugguccguggg

SEQ ID NO: 1401959 - RNA, 16 nt, Human
gcucaucugcuggucc

SEQ ID NO: 1401960 - RNA, 18 nt, Human
gcucauggacuucugcca

SEQ ID NO: 1401961 - RNA, 21 nt, Human
gcuccagguggcucugaggug

SEQ ID NO: 1401962 - RNA, 18 nt, Human
gcuccagguggcucugag

SEQ ID NO: 1401963 - RNA, 16 nt, Human
gcuccagguggcucug

SEQ ID NO: 1401964 - RNA, 15 nt, Human
gcuccagguggcucu

SEQ ID NO: 1401965 - RNA, 15 nt, Human
gcucccacaagccuc

SEQ ID NO: 1401966 - RNA, 21 nt, Human
gcucccaaggggccugagcag

SEQ ID NO: 1401967 - RNA, 20 nt, Human
gcucccaaggggccugagca

SEQ ID NO: 1401968 - RNA, 19 nt, Human
gcucccaaggggccugagc

SEQ ID NO: 1401969 - RNA, 17 nt, Human
gcucccaaggggccuga

SEQ ID NO: 1401970 - RNA, 16 nt, Human
gcucccaaggggccug

SEQ ID NO: 1401971 - RNA, 15 nt, Human
gcucccaaggggccu

SEQ ID NO: 1401972 - RNA, 19 nt, Human
gcuccaguguccugagcuc

SEQ ID NO: 1401973 - RNA, 17 nt, Human
gcuccaguguccugagc

SEQ ID NO: 1401974 - RNA, 16 nt, Human
gcuccaguguccugag

SEQ ID NO: 1401975 - RNA, 15 nt, Human
gcuccaguguccuga

SEQ ID NO: 1401976 - RNA, 13 nt, Human
gcucccacagaac

SEQ ID NO: 1401977 - RNA, 19 nt, Human
gcucccacaagccugaggg

SEQ ID NO: 1401978 - RNA, 18 nt, Human
gcucccacaagccugagg

SEQ ID NO: 1401979 - RNA, 17 nt, Human
gcucccacaagccugag

SEQ ID NO: 1401980 - RNA, 16 nt, Human
gcucccacaagccuga

SEQ ID NO: 1401981 - RNA, 15 nt, Human
gcucccacaagccug

SEQ ID NO: 1401982 - RNA, 23 nt, Human
gcucccacaagccucugcccagg

SEQ ID NO: 1401983 - RNA, 16 nt, Human
gcuccgaggacccagg

SEQ ID NO: 1401984 - RNA, 15 nt, Human
gcuccgaggacccag

SEQ ID NO: 1401985 - RNA, 14 nt, Human
gcucccuucuuccc

SEQ ID NO: 1401986 - RNA, 21 nt, Human
gcucccuucuacagccucaga

SEQ ID NO: 1401987 - RNA, 19 nt, Human
gcucccacagaacacagca

SEQ ID NO: 1401988 - RNA, 22 nt, Human
gcucaugugugcaacaggguau

SEQ ID NO: 1401989 - RNA, 17 nt, Human
gcucaugugugcaacag

SEQ ID NO: 1401990 - RNA, 14 nt, Human
gcucauuucaggau

SEQ ID NO: 1401991 - RNA, 23 nt, Human
gcuccuuccuggagacugcccag

SEQ ID NO: 1401992 - RNA, 14 nt, Human
gcuccuuccuggag

SEQ ID NO: 1401993 - RNA, 13 nt, Human
gcuccuucccauc

SEQ ID NO: 1401994 - RNA, 18 nt, Human
gcuccuucccaucgcugu

SEQ ID NO: 1401995 - RNA, 22 nt, Human
gcuccuguuuugcacagccaaa

SEQ ID NO: 1401996 - RNA, 21 nt, Human
gcuccuuaaggcucuuuugua

SEQ ID NO: 1401997 - RNA, 17 nt, Human
gcuccuuaaggcucuuu

SEQ ID NO: 1401998 - RNA, 15 nt, Human
gcuccuuaaggcucu

SEQ ID NO: 1401999 - RNA, 16 nt, Human
gcucgaggggugggcu

SEQ ID NO: 1402000 - RNA, 21 nt, Human
gcuccuugugggccugggcuc

SEQ ID NO: 1402001 - RNA, 22 nt, Human
gcuccuugugggccugggcucc

SEQ ID NO: 1402002 - RNA, 20 nt, Human
gcuccuugugggccugggcu

SEQ ID NO: 1402003 - RNA, 18 nt, Human
gcuccuugugggccuggg

SEQ ID NO: 1402004 - RNA, 17 nt, Human
gcuccuugugggccugg

SEQ ID NO: 1402005 - RNA, 16 nt, Human
gcuccuugugggccug

SEQ ID NO: 1402006 - RNA, 15 nt, Human
gcuccuugugggccu

SEQ ID NO: 1402007 - RNA, 15 nt, Human
gcuccuugugccaga

SEQ ID NO: 1402008 - RNA, 19 nt, Human
gcuccuugggcccuuugag

SEQ ID NO: 1402009 - RNA, 17 nt, Human
gcuccuugggcccuuug

SEQ ID NO: 1402010 - RNA, 14 nt, Human
gcuccuugggcccu

SEQ ID NO: 1402011 - RNA, 23 nt, Human
gcuccguccaggagccugugccu

SEQ ID NO: 1402012 - RNA, 22 nt, Human
gcuccguccaggagccugugcc

SEQ ID NO: 1402013 - RNA, 23 nt, Human
gcuccggaggacucaccacugcc

SEQ ID NO: 1402014 - RNA, 15 nt, Human
gcuccgccuggccug

SEQ ID NO: 1402015 - RNA, 17 nt, Human
gcuccgccuggccuggc

SEQ ID NO: 1402016 - RNA, 22 nt, Human
gcuccgugugggagaccggccu

SEQ ID NO: 1402017 - RNA, 23 nt, Human
gcuccgugugggagaccggccug

SEQ ID NO: 1402018 - RNA, 20 nt, Human
gcuccucagggacucaggug

SEQ ID NO: 1402019 - RNA, 19 nt, Human
gcuccucagggacucaggu

SEQ ID NO: 1402020 - RNA, 18 nt, Human
gcuccucagggacucagg

SEQ ID NO: 1402021 - RNA, 22 nt, Human
gcuccucaaccccuccccucca

SEQ ID NO: 1402022 - RNA, 21 nt, Human
gcuccucaaccccuccccucc

SEQ ID NO: 1402023 - RNA, 21 nt, Human
gcuccuauucaacacacacau

SEQ ID NO: 1402024 - RNA, 21 nt, Human
gcuccuguggccccacccugg

SEQ ID NO: 1402025 - RNA, 20 nt, Human
gcuccuguggccccacccug

SEQ ID NO: 1402026 - RNA, 15 nt, Human
gcuccuguggcccca

SEQ ID NO: 1402027 - RNA, 13 nt, Human
gcuccuguggccc

SEQ ID NO: 1402028 - RNA, 17 nt, Human
gcuccuguccccugcua

SEQ ID NO: 1402029 - RNA, 19 nt, Human
gcuccuguccccugcuaca

SEQ ID NO: 1402030 - RNA, 14 nt, Human
gcuccuguccccug

SEQ ID NO: 1402031 - RNA, 21 nt, Human
gcuccuggucaccuaggaagc

SEQ ID NO: 1402032 - RNA, 15 nt, Human
gcuccuccccuggag

SEQ ID NO: 1402033 - RNA, 20 nt, Human
gcuccuccagggugugugcu

SEQ ID NO: 1402034 - RNA, 11 nt, Human
gcuccucccac

SEQ ID NO: 1402035 - RNA, 21 nt, Human
gcuccuccaggguggcagcaa

SEQ ID NO: 1402036 - RNA, 22 nt, Human
gcuccuccaggguggcagcaac

SEQ ID NO: 1402037 - RNA, 21 nt, Human
gcuuacugauauauuuuacaa

SEQ ID NO: 1402038 - RNA, 17 nt, Human
gcuuacugauauauuuu

SEQ ID NO: 1402039 - RNA, 22 nt, Human
gcuuaccuggcccaucagggua

SEQ ID NO: 1402040 - RNA, 12 nt, Human
gcuuaccuggcc

SEQ ID NO: 1402041 - RNA, 11 nt, Human
gcuuauaucug

SEQ ID NO: 1402042 - RNA, 23 nt, Human
gcuuauacgaaauaauuguuguu

SEQ ID NO: 1402043 - RNA, 22 nt, Human
gcuuauacgaaauaauuguugu

SEQ ID NO: 1402044 - RNA, 19 nt, Human
gcuuauacgaaauaauugu

SEQ ID NO: 1402045 - RNA, 18 nt, Human
gcuuauacgaaauaauug

SEQ ID NO: 1402046 - RNA, 17 nt, Human
gcuuauacgaaauaauu

SEQ ID NO: 1402047 - RNA, 20 nt, Human
gcuuauaucuggccucugcu

SEQ ID NO: 1402048 - RNA, 17 nt, Human
gcuuauaucuggccucu

SEQ ID NO: 1402049 - RNA, 15 nt, Human
gcuuauaucuggccu

SEQ ID NO: 1402050 - RNA, 18 nt, Human
gcuucaugugucccagaa

SEQ ID NO: 1402051 - RNA, 17 nt, Human
gcuucaugugucccaga

SEQ ID NO: 1402052 - RNA, 16 nt, Human
gcuucaugugucccag

SEQ ID NO: 1402053 - RNA, 15 nt, Human
gcuucauguguccca

SEQ ID NO: 1402054 - RNA, 14 nt, Human
gcuucauguguccc

SEQ ID NO: 1402055 - RNA, 17 nt, Human
gcuucauggcagaaggc

SEQ ID NO: 1402056 - RNA, 14 nt, Human
gcuucaugccagcu

SEQ ID NO: 1402057 - RNA, 14 nt, Human
gcuucaucuggcaa

SEQ ID NO: 1402058 - RNA, 18 nt, Human
gcuuaucaacuaaugauu

SEQ ID NO: 1402059 - RNA, 21 nt, Human
gcuuccacguacugcagccuc

SEQ ID NO: 1402060 - RNA, 12 nt, Human
gcuuccaauuuu

SEQ ID NO: 1402061 - RNA, 22 nt, Human
gcuucauucaagucagcucuuc

SEQ ID NO: 1402062 - RNA, 23 nt, Human
gcuuccagauugacgacaagugc

SEQ ID NO: 1402063 - RNA, 22 nt, Human
gcuuccagauugacgacaagug

SEQ ID NO: 1402064 - RNA, 21 nt, Human
gcuucucagauuucugaggaa

SEQ ID NO: 1402065 - RNA, 16 nt, Human
gcuucucauccugcag

SEQ ID NO: 1402066 - RNA, 22 nt, Human
gcuucucagauuucugaggaaa

SEQ ID NO: 1402067 - RNA, 22 nt, Human
gcuucugcuggggccugggaca

SEQ ID NO: 1402068 - RNA, 21 nt, Human
gcuucugcuggggccugggac

SEQ ID NO: 1402069 - RNA, 20 nt, Human
gcuucugcuggggccuggga

SEQ ID NO: 1402070 - RNA, 18 nt, Human
gcuucugcuggggccugg

SEQ ID NO: 1402071 - RNA, 16 nt, Human
gcuucugcuggggccu

SEQ ID NO: 1402072 - RNA, 15 nt, Human
gcuucugcuggggcc

SEQ ID NO: 1402073 - RNA, 18 nt, Human
gcuucucauccugcaggc

SEQ ID NO: 1402074 - RNA, 17 nt, Human
gcuucucauccugcagg

SEQ ID NO: 1402075 - RNA, 14 nt, Human
gcuucuggccagga

SEQ ID NO: 1402076 - RNA, 19 nt, Human
gcuucuguuuuauaauuuu

SEQ ID NO: 1402077 - RNA, 14 nt, Human
gcuuguuaaauuuu

SEQ ID NO: 1402078 - RNA, 19 nt, Human
gcuuguggggccugggagg

SEQ ID NO: 1402079 - RNA, 18 nt, Human
gcuuguggggccugggag

SEQ ID NO: 1402080 - RNA, 17 nt, Human
gcuuguggggccuggga

SEQ ID NO: 1402081 - RNA, 16 nt, Human
gcuuguggggccuggg

SEQ ID NO: 1402082 - RNA, 13 nt, Human
gcuuguggggccu

SEQ ID NO: 1402083 - RNA, 18 nt, Human
gcuuguggcaagugaauu

SEQ ID NO: 1402084 - RNA, 16 nt, Human
gcuuggagcagagggg

SEQ ID NO: 1402085 - RNA, 14 nt, Human
gcuuggagcagagg

SEQ ID NO: 1402086 - RNA, 21 nt, Human
gcuugcuuuucaugcaaacuc

SEQ ID NO: 1402087 - RNA, 23 nt, Human
gcuugcuuuucaugcaaacucuu

SEQ ID NO: 1402088 - RNA, 14 nt, Human
gcuugcuuuucaug

SEQ ID NO: 1402089 - RNA, 20 nt, Human
gcuugcuauucugucccuag

SEQ ID NO: 1402090 - RNA, 18 nt, Human
gcuugcuauucugucccu

SEQ ID NO: 1402091 - RNA, 14 nt, Human
gcuugcuauucugu

SEQ ID NO: 1402092 - RNA, 16 nt, Human
gcuugccugccugcuc

SEQ ID NO: 1402093 - RNA, 14 nt, Human
gcuugccugcaggc

SEQ ID NO: 1402094 - RNA, 13 nt, Human
gcuugccugcagg

SEQ ID NO: 1402095 - RNA, 16 nt, Human
gcuuguuuacaugcuu

SEQ ID NO: 1402096 - RNA, 19 nt, Human
gcuuguuuacaugcuuauu

SEQ ID NO: 1402097 - RNA, 15 nt, Human
gcuuguuuacaugcu

SEQ ID NO: 1402098 - RNA, 11 nt, Human
gcuuguuuaca

SEQ ID NO: 1402099 - RNA, 16 nt, Human
gcuuguugugcuuuua

SEQ ID NO: 1402100 - RNA, 13 nt, Human
gcuuguugugcuu

SEQ ID NO: 1402101 - RNA, 12 nt, Human
gcuuucauguaa

SEQ ID NO: 1402102 - RNA, 18 nt, Human
gcuuucagggaggcccug

SEQ ID NO: 1402103 - RNA, 18 nt, Human
gcuuuaacuuaaauagua

SEQ ID NO: 1402104 - RNA, 18 nt, Human
gcuuucauuuucucucag

SEQ ID NO: 1402105 - RNA, 17 nt, Human
gcuuucauuuucucuca

SEQ ID NO: 1402106 - RNA, 21 nt, Human
gcuuucauguaaacugugcac

SEQ ID NO: 1402107 - RNA, 20 nt, Human
gcuuucauguaaacugugca

SEQ ID NO: 1402108 - RNA, 15 nt, Human
gcuuucauguaaacu

SEQ ID NO: 1402109 - RNA, 19 nt, Human
gcuuucauuuucucucagg

SEQ ID NO: 1402110 - RNA, 21 nt, Human
gcuuucauuuucucucaggug

SEQ ID NO: 1402111 - RNA, 15 nt, Human
gcuuuccaugggacc

SEQ ID NO: 1402112 - RNA, 16 nt, Human
gcuuugguuuaaaaga

SEQ ID NO: 1402113 - RNA, 17 nt, Human
gcuuuggugagaaccug

SEQ ID NO: 1402114 - RNA, 15 nt, Human
gcuuugggcuugggc

SEQ ID NO: 1402115 - RNA, 19 nt, Human
gcuuuccauucgugaaaac

SEQ ID NO: 1402116 - RNA, 21 nt, Human
gcuuuuaguauuuuagugaac

SEQ ID NO: 1402117 - RNA, 17 nt, Human
gcuuuggucucuugcuu

SEQ ID NO: 1402118 - RNA, 13 nt, Human
gcuuuuaugugaa

SEQ ID NO: 1402119 - RNA, 15 nt, Human
gcuuuuaugugaaac

SEQ ID NO: 1402120 - RNA, 23 nt, Human
gcuggggaccugguacccuccug

SEQ ID NO: 1402121 - RNA, 16 nt, Human
gcuggggaccugguac

SEQ ID NO: 1402122 - RNA, 18 nt, Human
gcuggggacagguccuca

SEQ ID NO: 1402123 - RNA, 21 nt, Human
gcuggggaagacaguggcccc

SEQ ID NO: 1402124 - RNA, 24 nt, Human
gcugguaucucagaaagugccuga

SEQ ID NO: 1402125 - RNA, 18 nt, Human
gcugguaucucagaaagu

SEQ ID NO: 1402126 - RNA, 16 nt, Human
gcugguaucucagaaa

SEQ ID NO: 1402127 - RNA, 20 nt, Human
gcugguccuauggccucaug

SEQ ID NO: 1402128 - RNA, 20 nt, Human
gcuggucucaaacuccugac

SEQ ID NO: 1402129 - RNA, 18 nt, Human
gcuggucuagucacgcau

SEQ ID NO: 1402130 - RNA, 17 nt, Human
gcugguccuuucuuccg

SEQ ID NO: 1402131 - RNA, 19 nt, Human
gcugguccuauggccucau

SEQ ID NO: 1402132 - RNA, 16 nt, Human
gcugguccgugggacg

SEQ ID NO: 1402133 - RNA, 15 nt, Human
gcugguccgugggac

SEQ ID NO: 1402134 - RNA, 19 nt, Human
gcugguccagggcuaguga

SEQ ID NO: 1402135 - RNA, 14 nt, Human
gcugguccagggcu

SEQ ID NO: 1402136 - RNA, 16 nt, Human
gcuggggaagacagug

SEQ ID NO: 1402137 - RNA, 15 nt, Human
gcuggggaagacagu

SEQ ID NO: 1402138 - RNA, 14 nt, Human
gcuggggaagacag

SEQ ID NO: 1402139 - RNA, 23 nt, Human
gcuggggaaaucaaaagggccaa

SEQ ID NO: 1402140 - RNA, 13 nt, Human
gcugggcucugca

SEQ ID NO: 1402141 - RNA, 18 nt, Human
gcugggauagagggguca

SEQ ID NO: 1402142 - RNA, 18 nt, Human
gcugggaguaguugucuu

SEQ ID NO: 1402143 - RNA, 21 nt, Human
gcugggaggagggcaggcauc

SEQ ID NO: 1402144 - RNA, 15 nt, Human
gcuguccccccacuc

SEQ ID NO: 1402145 - RNA, 21 nt, Human
gcuguccccccacucccucac

SEQ ID NO: 1402146 - RNA, 14 nt, Human
gcuguccccccacu

SEQ ID NO: 1402147 - RNA, 18 nt, Human
gcuguccagaaagguuug

SEQ ID NO: 1402148 - RNA, 22 nt, Human
gcugucaucugugcacugccca

SEQ ID NO: 1402149 - RNA, 14 nt, Human
gcugucccggaggc

SEQ ID NO: 1402150 - RNA, 16 nt, Human
gcugucaucugugcac

SEQ ID NO: 1402151 - RNA, 15 nt, Human
gcugucaucugugca

SEQ ID NO: 1402152 - RNA, 14 nt, Human
gcugucaucugugc

SEQ ID NO: 1402153 - RNA, 18 nt, Human
gcugucaucaauuaaagg

SEQ ID NO: 1402154 - RNA, 23 nt, Human
gcugucaggauugcgagagaugu

SEQ ID NO: 1402155 - RNA, 24 nt, Human
gcugucaggauugcgagagaugug

SEQ ID NO: 1402156 - RNA, 22 nt, Human
gcugucaggauugcgagagaug

SEQ ID NO: 1402157 - RNA, 18 nt, Human
gcugucaggauugcgaga

SEQ ID NO: 1402158 - RNA, 23 nt, Human
gcugguguagcuacagagaaacc

SEQ ID NO: 1402159 - RNA, 18 nt, Human
gcugguguagcuacagag

SEQ ID NO: 1402160 - RNA, 17 nt, Human
gcugguguagcuacaga

SEQ ID NO: 1402161 - RNA, 15 nt, Human
gcugguguagcuaca

SEQ ID NO: 1402162 - RNA, 12 nt, Human
gcugguguagcu

SEQ ID NO: 1402163 - RNA, 22 nt, Human
gcugguguagcuacagagaaac

SEQ ID NO: 1402164 - RNA, 21 nt, Human
gcugguguagcuacagagaaa

SEQ ID NO: 1402165 - RNA, 20 nt, Human
gcugguguagcuacagagaa

SEQ ID NO: 1402166 - RNA, 19 nt, Human
gcugguguagcuacagaga

SEQ ID NO: 1402167 - RNA, 23 nt, Human
gcuguuagggguuauugguguaa

SEQ ID NO: 1402168 - RNA, 23 nt, Human
gcuguuaaauacaggaaacaguu

SEQ ID NO: 1402169 - RNA, 22 nt, Human
gcuguuaaauacaggaaacagu

SEQ ID NO: 1402170 - RNA, 16 nt, Human
gcuguuaaauacagga

SEQ ID NO: 1402171 - RNA, 15 nt, Human
gcuguuaaauacagg

SEQ ID NO: 1402172 - RNA, 13 nt, Human
gcuguuaaauaca

SEQ ID NO: 1402173 - RNA, 23 nt, Human
gcuguguuuggcuuucagggagg

SEQ ID NO: 1402174 - RNA, 18 nt, Human
gcugugugcuuuuuuugu

SEQ ID NO: 1402175 - RNA, 18 nt, Human
gcuguggccaggaggugc

SEQ ID NO: 1402176 - RNA, 20 nt, Human
gcuguggccaggaggugcca

SEQ ID NO: 1402177 - RNA, 16 nt, Human
gcuguggccaggaggu

SEQ ID NO: 1402178 - RNA, 15 nt, Human
gcuguggccaggagg

SEQ ID NO: 1402179 - RNA, 15 nt, Human
gcugugggaaauggu

SEQ ID NO: 1402180 - RNA, 20 nt, Human
gcuguggccuaaccugccga

SEQ ID NO: 1402181 - RNA, 19 nt, Human
gcuguggccuaaccugccg

SEQ ID NO: 1402182 - RNA, 20 nt, Human
gcugugugaauaccugcuca

SEQ ID NO: 1402183 - RNA, 18 nt, Human
gcugugugaauaccugcu

SEQ ID NO: 1402184 - RNA, 16 nt, Human
gcuguguggcagucug

SEQ ID NO: 1402185 - RNA, 21 nt, Human
gcugccuuauucagggaagga

SEQ ID NO: 1402186 - RNA, 19 nt, Human
gcugccuuauucagggaag

SEQ ID NO: 1402187 - RNA, 23 nt, Human
gcugcuaauauuuuccuccugag

SEQ ID NO: 1402188 - RNA, 24 nt, Human
gcugcuaauauuuuccuccugagu

SEQ ID NO: 1402189 - RNA, 22 nt, Human
gcugcuaauauuuuccuccuga

SEQ ID NO: 1402190 - RNA, 21 nt, Human
gcugcuaauauuuuccuccug

SEQ ID NO: 1402191 - RNA, 18 nt, Human
gcugcuaauauuuuccuc

SEQ ID NO: 1402192 - RNA, 14 nt, Human
gcugcuacuuauau

SEQ ID NO: 1402193 - RNA, 18 nt, Human
gcuggaagauccugcggg

SEQ ID NO: 1402194 - RNA, 17 nt, Human
gcuggaagauccugcgg

SEQ ID NO: 1402195 - RNA, 15 nt, Human
gcuggaagauccugc

SEQ ID NO: 1402196 - RNA, 14 nt, Human
gcuggaagauccug

SEQ ID NO: 1402197 - RNA, 17 nt, Human
gcuggaagauagcugug

SEQ ID NO: 1402198 - RNA, 23 nt, Human
gcuggaagacgcaagggccugau

SEQ ID NO: 1402199 - RNA, 21 nt, Human
gcuggaagacgcaagggccug

SEQ ID NO: 1402200 - RNA, 17 nt, Human
gcuggaagcugggaggu

SEQ ID NO: 1402201 - RNA, 16 nt, Human
gcuggaagcugggagg

SEQ ID NO: 1402202 - RNA, 18 nt, Human
gcuggaagauagcuguga

SEQ ID NO: 1402203 - RNA, 22 nt, Human
gcuggaaaauaauacugcugag

SEQ ID NO: 1402204 - RNA, 17 nt, Human
gcuggaaaauaauacug

SEQ ID NO: 1402205 - RNA, 23 nt, Human
gcuggaaaaguauguuagugcaa

SEQ ID NO: 1402206 - RNA, 21 nt, Human
gcuggaaaaguauguuagugc

SEQ ID NO: 1402207 - RNA, 19 nt, Human
gcuggccauggagaaagcu

SEQ ID NO: 1402208 - RNA, 20 nt, Human
gcuggccauggagaaagcug

SEQ ID NO: 1402209 - RNA, 18 nt, Human
gcuggccauggagaaagc

SEQ ID NO: 1402210 - RNA, 17 nt, Human
gcuggccauggagaaag

SEQ ID NO: 1402211 - RNA, 16 nt, Human
gcuggccauggagaaa

SEQ ID NO: 1402212 - RNA, 15 nt, Human
gcuggccauggagaa

SEQ ID NO: 1402213 - RNA, 17 nt, Human
gcuggccaguccaggcu

SEQ ID NO: 1402214 - RNA, 16 nt, Human
gcuggccaguccaggc

SEQ ID NO: 1402215 - RNA, 15 nt, Human
gcuggccaguccagg

SEQ ID NO: 1402216 - RNA, 14 nt, Human
gcuggccaguccag

SEQ ID NO: 1402217 - RNA, 16 nt, Human
gcuggccagcgagcgc

SEQ ID NO: 1402218 - RNA, 18 nt, Human
gcuggccgcccccagccc

SEQ ID NO: 1402219 - RNA, 20 nt, Human
gcuggacccugaccagcucc

SEQ ID NO: 1402220 - RNA, 15 nt, Human
gcuggacccugacca

SEQ ID NO: 1402221 - RNA, 14 nt, Human
gcuggacccugacc

SEQ ID NO: 1402222 - RNA, 21 nt, Human
gcuggacccagccaggcccag

SEQ ID NO: 1402223 - RNA, 20 nt, Human
gcuggacccagccaggccca

SEQ ID NO: 1402224 - RNA, 15 nt, Human
gcuggacccagccag

SEQ ID NO: 1402225 - RNA, 14 nt, Human
gcuggacccagcca

SEQ ID NO: 1402226 - RNA, 13 nt, Human
gcuggacccagcc

SEQ ID NO: 1402227 - RNA, 12 nt, Human
gcuggacccagc

SEQ ID NO: 1402228 - RNA, 23 nt, Human
gcuggacccugaccagcuccccc

SEQ ID NO: 1402229 - RNA, 22 nt, Human
gcuggacccugaccagcucccc

SEQ ID NO: 1402230 - RNA, 21 nt, Human
gcuggacccugaccagcuccc

SEQ ID NO: 1402231 - RNA, 17 nt, Human
gcuggaccucaccaagc

SEQ ID NO: 1402232 - RNA, 17 nt, Human
gcuggcaguccuggaag

SEQ ID NO: 1402233 - RNA, 16 nt, Human
gcuggcauuacaggug

SEQ ID NO: 1402234 - RNA, 9 nt, Human
gcugagacu

SEQ ID NO: 1402235 - RNA, 18 nt, Human
gcugagaaccuggccuuc

SEQ ID NO: 1402236 - RNA, 21 nt, Human
gcugagaaccuggccuucagu

SEQ ID NO: 1402237 - RNA, 17 nt, Human
gcugagaaccuggccuu

SEQ ID NO: 1402238 - RNA, 16 nt, Human
gcugagaaccuggccu

SEQ ID NO: 1402239 - RNA, 15 nt, Human
gcugagaaccuggcc

SEQ ID NO: 1402240 - RNA, 14 nt, Human
gcugagaaccuggc

SEQ ID NO: 1402241 - RNA, 13 nt, Human
gcugagaaccugg

SEQ ID NO: 1402242 - RNA, 22 nt, Human
gcugacuuggcuggugugguac

SEQ ID NO: 1402243 - RNA, 23 nt, Human
gcugacuuggcuggugugguaca

SEQ ID NO: 1402244 - RNA, 15 nt, Human
gcugaucgccuuccc

SEQ ID NO: 1402245 - RNA, 17 nt, Human
gcugauauuuucucuag

SEQ ID NO: 1402246 - RNA, 15 nt, Human
gcugauaauuuuaaa

SEQ ID NO: 1402247 - RNA, 16 nt, Human
gcugaucagugggccu

SEQ ID NO: 1402248 - RNA, 14 nt, Human
gcugauaauuuuaa

SEQ ID NO: 1402249 - RNA, 13 nt, Human
gcugauaauuuua

SEQ ID NO: 1402250 - RNA, 19 nt, Human
gcugauaauuuuaaauucu

SEQ ID NO: 1402251 - RNA, 12 nt, Human
gcugauaauuuu

SEQ ID NO: 1402252 - RNA, 19 nt, Human
gcugaucgccuuccccacc

SEQ ID NO: 1402253 - RNA, 17 nt, Human
gcugaucgccuucccca

SEQ ID NO: 1402254 - RNA, 16 nt, Human
gcugaucgccuucccc

SEQ ID NO: 1402255 - RNA, 15 nt, Human
gcugauuaaaugaca

SEQ ID NO: 1402256 - RNA, 13 nt, Human
gcugauuucuagg

SEQ ID NO: 1402257 - RNA, 23 nt, Human
gcugauuucuagguaggaaaugu

SEQ ID NO: 1402258 - RNA, 19 nt, Human
gcugcauuuaaaagauaca

SEQ ID NO: 1402259 - RNA, 18 nt, Human
gcugcauuuaaaagauac

SEQ ID NO: 1402260 - RNA, 18 nt, Human
gcugcaguucgacucugu

SEQ ID NO: 1402261 - RNA, 17 nt, Human
gcugcaguucgacucug

SEQ ID NO: 1402262 - RNA, 11 nt, Human
gcugauuuuuu

SEQ ID NO: 1402263 - RNA, 22 nt, Human
gcugcccuccugugcucagccc

SEQ ID NO: 1402264 - RNA, 23 nt, Human
gcugcccuccugugcucagcccu

SEQ ID NO: 1402265 - RNA, 17 nt, Human
gcugaccugcugaccug

SEQ ID NO: 1402266 - RNA, 13 nt, Human
gcugaccugcuga

SEQ ID NO: 1402267 - RNA, 12 nt, Human
gcugaccugcug

SEQ ID NO: 1402268 - RNA, 21 nt, Human
gcugaccagccgugagcaugu

SEQ ID NO: 1402269 - RNA, 12 nt, Human
gcugaccagaca

SEQ ID NO: 1402270 - RNA, 19 nt, Human
gcugaccacagcacagcca

SEQ ID NO: 1402271 - RNA, 17 nt, Human
gcugaccacagcacagc

SEQ ID NO: 1402272 - RNA, 16 nt, Human
gcugaccacagcacag

SEQ ID NO: 1402273 - RNA, 14 nt, Human
gcugaccacagcac

SEQ ID NO: 1402274 - RNA, 18 nt, Human
gcugacuuggcuggugug

SEQ ID NO: 1402275 - RNA, 17 nt, Human
gcugacuuggcuggugu

SEQ ID NO: 1402276 - RNA, 16 nt, Human
gcugacuuggcuggug

SEQ ID NO: 1402277 - RNA, 15 nt, Human
gcugacuuggcuggu

SEQ ID NO: 1402278 - RNA, 14 nt, Human
gcugacuuggcugg

SEQ ID NO: 1402279 - RNA, 24 nt, Human
gcugacuucaucucccaccuagca

SEQ ID NO: 1402280 - RNA, 19 nt, Human
gcugacuucaucucccacc

SEQ ID NO: 1402281 - RNA, 20 nt, Human
gcugacuaaacuuuuuuucu

SEQ ID NO: 1402282 - RNA, 19 nt, Human
gcugacgggacccacaugc

SEQ ID NO: 1402283 - RNA, 15 nt, Human
gcugacggccaggga

SEQ ID NO: 1402284 - RNA, 13 nt, Human
gcugacggccagg

SEQ ID NO: 1402285 - RNA, 13 nt, Human
gcugaccacagca

SEQ ID NO: 1402286 - RNA, 17 nt, Human
gcugacauucaccugcc

SEQ ID NO: 1402287 - RNA, 16 nt, Human
gcugacauucaccugc

SEQ ID NO: 1402288 - RNA, 21 nt, Human
gcugacaugaagcuguugugu

SEQ ID NO: 1402289 - RNA, 17 nt, Human
gcugacaugaagcuguu

SEQ ID NO: 1402290 - RNA, 18 nt, Human
gcucuuugucagggagug

SEQ ID NO: 1402291 - RNA, 16 nt, Human
gcucuuugucagggag

SEQ ID NO: 1402292 - RNA, 15 nt, Human
gcucuuugucaggga

SEQ ID NO: 1402293 - RNA, 22 nt, Human
gcucuuugguagaaaaggcuag

SEQ ID NO: 1402294 - RNA, 18 nt, Human
gcucuuugguagaaaagg

SEQ ID NO: 1402295 - RNA, 13 nt, Human
gcucuuugguaga

SEQ ID NO: 1402296 - RNA, 22 nt, Human
gcucgauguggucacagcugua

SEQ ID NO: 1402297 - RNA, 20 nt, Human
gcucgauguggucacagcug

SEQ ID NO: 1402298 - RNA, 12 nt, Human
gcucucaguucu

SEQ ID NO: 1402299 - RNA, 16 nt, Human
gcucuccaaaccacuu

SEQ ID NO: 1402300 - RNA, 17 nt, Human
gcucuccaaaccacuuu

SEQ ID NO: 1402301 - RNA, 12 nt, Human
gcucuucuuaaa

SEQ ID NO: 1402302 - RNA, 22 nt, Human
gcucuccaaaccacuuuuugca

SEQ ID NO: 1402303 - RNA, 13 nt, Human
gcucuuugagaaa

SEQ ID NO: 1402304 - RNA, 21 nt, Human
gcucuuucucugccagugaca

SEQ ID NO: 1402305 - RNA, 18 nt, Human
gcucuuucucugccagug

SEQ ID NO: 1402306 - RNA, 21 nt, Human
gcucuuggcuggacccagcca

SEQ ID NO: 1402307 - RNA, 23 nt, Human
gcucuuggcuggacccagccagg

SEQ ID NO: 1402308 - RNA, 20 nt, Human
gcucuuggcuggacccagcc

SEQ ID NO: 1402309 - RNA, 18 nt, Human
gcucuuggcuggacccag

SEQ ID NO: 1402310 - RNA, 15 nt, Human
gcucuuggcuggacc

SEQ ID NO: 1402311 - RNA, 14 nt, Human
gcucuuggcuggac

SEQ ID NO: 1402312 - RNA, 13 nt, Human
gcucuuggcugga

SEQ ID NO: 1402313 - RNA, 17 nt, Human
gcucuuggagcugugag

SEQ ID NO: 1402314 - RNA, 20 nt, Human
gcucuugauaccccccucug

SEQ ID NO: 1402315 - RNA, 19 nt, Human
gcucuugauaccccccucu

SEQ ID NO: 1402316 - RNA, 17 nt, Human
gcucuugauaccccccu

SEQ ID NO: 1402317 - RNA, 19 nt, Human
gcucuugaugccuggcggg

SEQ ID NO: 1402318 - RNA, 22 nt, Human
ggcccaccccacccacuucugc

SEQ ID NO: 1402319 - RNA, 23 nt, Human
ggcccaccccacccacuucugca

SEQ ID NO: 1402320 - RNA, 19 nt, Human
ggcccaccccacccacuuc

SEQ ID NO: 1402321 - RNA, 18 nt, Human
ggcccaccccacccacuu

SEQ ID NO: 1402322 - RNA, 15 nt, Human
ggcccaccagggucc

SEQ ID NO: 1402323 - RNA, 14 nt, Human
ggcccaccaggguc

SEQ ID NO: 1402324 - RNA, 18 nt, Human
ggcccacauuggaagagc

SEQ ID NO: 1402325 - RNA, 16 nt, Human
ggcccacauuggaaga

SEQ ID NO: 1402326 - RNA, 21 nt, Human
ggccauggagaaagcugacuu

SEQ ID NO: 1402327 - RNA, 18 nt, Human
ggccauggagaaagcuga

SEQ ID NO: 1402328 - RNA, 16 nt, Human
ggccauggagaaagcu

SEQ ID NO: 1402329 - RNA, 15 nt, Human
ggccauggagaaagc

SEQ ID NO: 1402330 - RNA, 22 nt, Human
ggccauggacucuguccugaag

SEQ ID NO: 1402331 - RNA, 21 nt, Human
ggccauggacucuguccugaa

SEQ ID NO: 1402332 - RNA, 18 nt, Human
ggccauggacucuguccu

SEQ ID NO: 1402333 - RNA, 17 nt, Human
ggccauggacucugucc

SEQ ID NO: 1402334 - RNA, 14 nt, Human
ggccauggacucug

SEQ ID NO: 1402335 - RNA, 22 nt, Human
ggccaugcugaggccugggccg

SEQ ID NO: 1402336 - RNA, 19 nt, Human
ggccaugcugaggccuggg

SEQ ID NO: 1402337 - RNA, 18 nt, Human
ggccaugcugaggccugg

SEQ ID NO: 1402338 - RNA, 15 nt, Human
ggccaugcugaggcc

SEQ ID NO: 1402339 - RNA, 14 nt, Human
ggccaugcugaggc

SEQ ID NO: 1402340 - RNA, 13 nt, Human
ggccaugcugagg

SEQ ID NO: 1402341 - RNA, 21 nt, Human
ggccaugcuccucuuccccag

SEQ ID NO: 1402342 - RNA, 22 nt, Human
ggccaugcuccucuuccccaga

SEQ ID NO: 1402343 - RNA, 18 nt, Human
ggccaugcuccucuuccc

SEQ ID NO: 1402344 - RNA, 17 nt, Human
ggccaugcuccucuucc

SEQ ID NO: 1402345 - RNA, 15 nt, Human
ggccaugcuccucuu

SEQ ID NO: 1402346 - RNA, 13 nt, Human
ggccaugcuccuc

SEQ ID NO: 1402347 - RNA, 21 nt, Human
ggccaggacucugcagccuca

SEQ ID NO: 1402348 - RNA, 20 nt, Human
ggccaggacucugcagccuc

SEQ ID NO: 1402349 - RNA, 18 nt, Human
ggccaggacucugcagcc

SEQ ID NO: 1402350 - RNA, 16 nt, Human
ggccaggacucugcag

SEQ ID NO: 1402351 - RNA, 15 nt, Human
ggccaggacucugca

SEQ ID NO: 1402352 - RNA, 14 nt, Human
ggccaggacucugc

SEQ ID NO: 1402353 - RNA, 18 nt, Human
ggccagacaugccacaag

SEQ ID NO: 1402354 - RNA, 15 nt, Human
ggccagacaugccac

SEQ ID NO: 1402355 - RNA, 18 nt, Human
ggccagacacaggcccuc

SEQ ID NO: 1402356 - RNA, 17 nt, Human
ggccagacacaggcccu

SEQ ID NO: 1402357 - RNA, 16 nt, Human
ggccagacacaggccc

SEQ ID NO: 1402358 - RNA, 12 nt, Human
ggccagaaguac

SEQ ID NO: 1402359 - RNA, 16 nt, Human
ggccagaaguaccaga

SEQ ID NO: 1402360 - RNA, 20 nt, Human
ggccacuguuuggaaauaaa

SEQ ID NO: 1402361 - RNA, 16 nt, Human
ggccacuguguuccuu

SEQ ID NO: 1402362 - RNA, 17 nt, Human
ggccaccuccccagcau

SEQ ID NO: 1402363 - RNA, 16 nt, Human
ggccaccuccccagca

SEQ ID NO: 1402364 - RNA, 13 nt, Human
ggccaccucccca

SEQ ID NO: 1402365 - RNA, 19 nt, Human
ggccacaucaaagaggcug

SEQ ID NO: 1402366 - RNA, 16 nt, Human
ggccacaucaaagagg

SEQ ID NO: 1402367 - RNA, 20 nt, Human
ggccacaguagucuugauga

SEQ ID NO: 1402368 - RNA, 13 nt, Human
ggccacagccagg

SEQ ID NO: 1402369 - RNA, 11 nt, Human
ggccacagcca

SEQ ID NO: 1402370 - RNA, 12 nt, Human
ggccacagccag

SEQ ID NO: 1402371 - RNA, 20 nt, Human
ggccacacuucaaacuacuu

SEQ ID NO: 1402372 - RNA, 17 nt, Human
ggccacacuucaaacua

SEQ ID NO: 1402373 - RNA, 21 nt, Human
ggccacacucagcacaaggcc

SEQ ID NO: 1402374 - RNA, 23 nt, Human
ggcauguuagcccuuccuccaau

SEQ ID NO: 1402375 - RNA, 16 nt, Human
ggccacacucagcaca

SEQ ID NO: 1402376 - RNA, 23 nt, Human
ggcauguguuuacuuuauguuac

SEQ ID NO: 1402377 - RNA, 13 nt, Human
ggcaguaccugag

SEQ ID NO: 1402378 - RNA, 14 nt, Human
ggcaguaauaaaaa

SEQ ID NO: 1402379 - RNA, 17 nt, Human
ggcagggguuagagcag

SEQ ID NO: 1402380 - RNA, 19 nt, Human
ggcagaguuacaguucugu

SEQ ID NO: 1402381 - RNA, 18 nt, Human
ggcagaguuacaguucug

SEQ ID NO: 1402382 - RNA, 13 nt, Human
ggcagaguuacag

SEQ ID NO: 1402383 - RNA, 21 nt, Human
ggcagaguucuauaauguaaa

SEQ ID NO: 1402384 - RNA, 16 nt, Human
ggcaguccgugggacg

SEQ ID NO: 1402385 - RNA, 19 nt, Human
ggcagucgauagagcugua

SEQ ID NO: 1402386 - RNA, 15 nt, Human
ggcaguccgugggac

SEQ ID NO: 1402387 - RNA, 20 nt, Human
ggcagucauuggcugucucc

SEQ ID NO: 1402388 - RNA, 22 nt, Human
ggcaguauccuguuugaggaaa

SEQ ID NO: 1402389 - RNA, 23 nt, Human
ggcaguaccugggcaagcuggcg

SEQ ID NO: 1402390 - RNA, 17 nt, Human
ggcaguaccugggcaag

SEQ ID NO: 1402391 - RNA, 20 nt, Human
ggcaguaccugagggucugu

SEQ ID NO: 1402392 - RNA, 16 nt, Human
ggcaguaccugagggu

SEQ ID NO: 1402393 - RNA, 15 nt, Human
ggcagugggaaaaau

SEQ ID NO: 1402394 - RNA, 13 nt, Human
ggcagugggaaaa

SEQ ID NO: 1402395 - RNA, 15 nt, Human
ggcauggucugcccu

SEQ ID NO: 1402396 - RNA, 23 nt, Human
ggcaugagggguuccuccccucc

SEQ ID NO: 1402397 - RNA, 20 nt, Human
ggcaugagggguuccucccc

SEQ ID NO: 1402398 - RNA, 13 nt, Human
ggcaugagaaaua

SEQ ID NO: 1402399 - RNA, 24 nt, Human
ggcaugucaacagcguuccuagag

SEQ ID NO: 1402400 - RNA, 22 nt, Human
ggcaugguguucuccugcugcu

SEQ ID NO: 1402401 - RNA, 16 nt, Human
ggcaugguguucuccu

SEQ ID NO: 1402402 - RNA, 17 nt, Human
ggcaccagggguuucuc

SEQ ID NO: 1402403 - RNA, 15 nt, Human
ggcaccaggaagccg

SEQ ID NO: 1402404 - RNA, 14 nt, Human
ggcaccaggaagcc

SEQ ID NO: 1402405 - RNA, 18 nt, Human
ggcaaggacuuuguacau

SEQ ID NO: 1402406 - RNA, 13 nt, Human
ggauugagucugu

SEQ ID NO: 1402407 - RNA, 20 nt, Human
ggauugaucggagccuccuc

SEQ ID NO: 1402408 - RNA, 12 nt, Human
ggauucuuuaaa

SEQ ID NO: 1402409 - RNA, 19 nt, Human
ggauugaaaauguccagga

SEQ ID NO: 1402410 - RNA, 19 nt, Human
ggauugaaggaugcugucu

SEQ ID NO: 1402411 - RNA, 14 nt, Human
ggauucuuuccauu

SEQ ID NO: 1402412 - RNA, 23 nt, Human
ggauucuguacaugcauugagcu

SEQ ID NO: 1402413 - RNA, 19 nt, Human
ggauucugguuccaggguc

SEQ ID NO: 1402414 - RNA, 18 nt, Human
ggauucugguuccagggu

SEQ ID NO: 1402415 - RNA, 14 nt, Human
ggauucugguucca

SEQ ID NO: 1402416 - RNA, 13 nt, Human
ggcagagggcugg

SEQ ID NO: 1402417 - RNA, 12 nt, Human
ggcagagggcug

SEQ ID NO: 1402418 - RNA, 11 nt, Human
ggcagagcugg

SEQ ID NO: 1402419 - RNA, 19 nt, Human
ggcagagcuggcucugagc

SEQ ID NO: 1402420 - RNA, 17 nt, Human
ggcagagcuggcucuga

SEQ ID NO: 1402421 - RNA, 16 nt, Human
ggcagagcuggcucug

SEQ ID NO: 1402422 - RNA, 21 nt, Human
ggcagagggcuggaggcccag

SEQ ID NO: 1402423 - RNA, 20 nt, Human
ggcagagggcuggaggccca

SEQ ID NO: 1402424 - RNA, 14 nt, Human
ggcagagggcugga

SEQ ID NO: 1402425 - RNA, 12 nt, Human
ggcagagccagg

SEQ ID NO: 1402426 - RNA, 13 nt, Human
ggcagagccagga

SEQ ID NO: 1402427 - RNA, 14 nt, Human
ggcagagccaggaa

SEQ ID NO: 1402428 - RNA, 16 nt, Human
ggcagagcccaaggga

SEQ ID NO: 1402429 - RNA, 12 nt, Human
ggcagagcccaa

SEQ ID NO: 1402430 - RNA, 16 nt, Human
ggcagagccaggaaga

SEQ ID NO: 1402431 - RNA, 17 nt, Human
ggcagagccaggaagau

SEQ ID NO: 1402432 - RNA, 20 nt, Human
ggaugagggaaaagaaaaag

SEQ ID NO: 1402433 - RNA, 23 nt, Human
ggaugagcucccacaagccugag

SEQ ID NO: 1402434 - RNA, 22 nt, Human
ggaugagcucccacaagccuga

SEQ ID NO: 1402435 - RNA, 21 nt, Human
ggaugagcucccacaagccug

SEQ ID NO: 1402436 - RNA, 14 nt, Human
ggaugagcucccac

SEQ ID NO: 1402437 - RNA, 20 nt, Human
ggaugagaguuuuggaugca

SEQ ID NO: 1402438 - RNA, 22 nt, Human
ggaugagaguuuuggaugcagu

SEQ ID NO: 1402439 - RNA, 15 nt, Human
ggaguccccucaccu

SEQ ID NO: 1402440 - RNA, 13 nt, Human
ggaguccccucac

SEQ ID NO: 1402441 - RNA, 14 nt, Human
ggagucacugagac

SEQ ID NO: 1402442 - RNA, 18 nt, Human
ggaugaugacuauggaaa

SEQ ID NO: 1402443 - RNA, 11 nt, Human
ggaugccuccu

SEQ ID NO: 1402444 - RNA, 19 nt, Human
ggauuauuagaaucaaaca

SEQ ID NO: 1402445 - RNA, 19 nt, Human
ggauuaugggucacaggaa

SEQ ID NO: 1402446 - RNA, 12 nt, Human
ggauuauauuau

SEQ ID NO: 1402447 - RNA, 20 nt, Human
ggauucaggaaaaggccugg

SEQ ID NO: 1402448 - RNA, 21 nt, Human
ggauucaggaaaaggccuggg

SEQ ID NO: 1402449 - RNA, 19 nt, Human
ggauucaggaaaaggccug

SEQ ID NO: 1402450 - RNA, 18 nt, Human
ggauucugcuggccucug

SEQ ID NO: 1402451 - RNA, 18 nt, Human
ggauuccccaucucaggc

SEQ ID NO: 1402452 - RNA, 22 nt, Human
ggauuccacucguguguuucua

SEQ ID NO: 1402453 - RNA, 18 nt, Human
ggacagaggccccagccu

SEQ ID NO: 1402454 - RNA, 17 nt, Human
ggacagaggccccagcc

SEQ ID NO: 1402455 - RNA, 16 nt, Human
ggacagaggccccagc

SEQ ID NO: 1402456 - RNA, 15 nt, Human
ggacagaggccccag

SEQ ID NO: 1402457 - RNA, 14 nt, Human
ggacagaggcccca

SEQ ID NO: 1402458 - RNA, 23 nt, Human
ggacagaggccccagccucccug

SEQ ID NO: 1402459 - RNA, 20 nt, Human
ggacagaggccccagccucc

SEQ ID NO: 1402460 - RNA, 16 nt, Human
ggacacuuaauacuac

SEQ ID NO: 1402461 - RNA, 14 nt, Human
ggacacucagaccu

SEQ ID NO: 1402462 - RNA, 14 nt, Human
gcuuuucaaacaaa

SEQ ID NO: 1402463 - RNA, 13 nt, Human
gcuuuucaaacaa

SEQ ID NO: 1402464 - RNA, 22 nt, Human
gcuuuuauuaaugcacuuucua

SEQ ID NO: 1402465 - RNA, 19 nt, Human
gcuuuuauuaaugcacuuu

SEQ ID NO: 1402466 - RNA, 19 nt, Human
gcuuuuaugugaaacaugu

SEQ ID NO: 1402467 - RNA, 20 nt, Human
gcuuuuaugugaaacauguu

SEQ ID NO: 1402468 - RNA, 18 nt, Human
gcuuuuauuaaugcacuu

SEQ ID NO: 1402469 - RNA, 15 nt, Human
gcuuuuauuaaugca

SEQ ID NO: 1402470 - RNA, 21 nt, Human
gcuuuuaugugaaacauguuu

SEQ ID NO: 1402471 - RNA, 16 nt, Human
ggacagccccacccug

SEQ ID NO: 1402472 - RNA, 15 nt, Human
ggacagccccacccu

SEQ ID NO: 1402473 - RNA, 14 nt, Human
ggacagccccaccc

SEQ ID NO: 1402474 - RNA, 13 nt, Human
ggaccagcucagg

SEQ ID NO: 1402475 - RNA, 22 nt, Human
ggaccagccuggcccaccccac

SEQ ID NO: 1402476 - RNA, 15 nt, Human
ggaccagccuggccc

SEQ ID NO: 1402477 - RNA, 13 nt, Human
ggaccagccuggc

SEQ ID NO: 1402478 - RNA, 12 nt, Human
ggaccagccugg

SEQ ID NO: 1402479 - RNA, 19 nt, Human
ggaccagcagccccacacc

SEQ ID NO: 1402480 - RNA, 12 nt, Human
ggaccagccucu

SEQ ID NO: 1402481 - RNA, 20 nt, Human
ggacauuugcucauggaauu

SEQ ID NO: 1402482 - RNA, 16 nt, Human
ggacagccgccuggag

SEQ ID NO: 1402483 - RNA, 17 nt, Human
ggacagccccacccugg

SEQ ID NO: 1402484 - RNA, 17 nt, Human
ggacauuugcucaugga

SEQ ID NO: 1402485 - RNA, 22 nt, Human
ggaccauggaguggcagcccag

SEQ ID NO: 1402486 - RNA, 21 nt, Human
ggaccauggaguggcagccca

SEQ ID NO: 1402487 - RNA, 18 nt, Human
ggaccagucccagagcag

SEQ ID NO: 1402488 - RNA, 17 nt, Human
ggaccagucccagagca

SEQ ID NO: 1402489 - RNA, 16 nt, Human
ggaccagucccagagc

SEQ ID NO: 1402490 - RNA, 19 nt, Human
ggaccagucaaccugggca

SEQ ID NO: 1402491 - RNA, 18 nt, Human
ggaccaggcaccaggcag

SEQ ID NO: 1402492 - RNA, 15 nt, Human
ggaccaggcuguagg

SEQ ID NO: 1402493 - RNA, 16 nt, Human
ggaccagccuggccca

SEQ ID NO: 1402494 - RNA, 23 nt, Human
ggaccaggaguggguggggagug

SEQ ID NO: 1402495 - RNA, 14 nt, Human
ggacgcacugagca

SEQ ID NO: 1402496 - RNA, 23 nt, Human
ggacgacacggucggggcaucug

SEQ ID NO: 1402497 - RNA, 20 nt, Human
ggaccuuuccaccacagcca

SEQ ID NO: 1402498 - RNA, 22 nt, Human
ggaccuuuccaccacagccagc

SEQ ID NO: 1402499 - RNA, 19 nt, Human
ggaccuuuccaccacagcc

SEQ ID NO: 1402500 - RNA, 18 nt, Human
ggaccuuuccaccacagc

SEQ ID NO: 1402501 - RNA, 19 nt, Human
ggacugaauuaugaaacuu

SEQ ID NO: 1402502 - RNA, 17 nt, Human
ggacugaauuaugaaac

SEQ ID NO: 1402503 - RNA, 15 nt, Human
ggacugaccagcagc

SEQ ID NO: 1402504 - RNA, 14 nt, Human
ggacugaccagcag

SEQ ID NO: 1402505 - RNA, 14 nt, Human
ggacugagaaauuu

SEQ ID NO: 1402506 - RNA, 13 nt, Human
ggagaagucucag

SEQ ID NO: 1402507 - RNA, 18 nt, Human
ggagaagugacauugcau

SEQ ID NO: 1402508 - RNA, 22 nt, Human
ggagaagucucagcuaagcuca

SEQ ID NO: 1402509 - RNA, 19 nt, Human
ggagacagguuagcugcuc

SEQ ID NO: 1402510 - RNA, 19 nt, Human
ggagaagcuccucucccca

SEQ ID NO: 1402511 - RNA, 12 nt, Human
ggagaaggaagg

SEQ ID NO: 1402512 - RNA, 23 nt, Human
ggagaagaaagaggugaccccag

SEQ ID NO: 1402513 - RNA, 14 nt, Human
ggagaagaacugaa

SEQ ID NO: 1402514 - RNA, 11 nt, Human
ggagaagaacu

SEQ ID NO: 1402515 - RNA, 20 nt, Human
ggagaagaaagaggugaccc

SEQ ID NO: 1402516 - RNA, 15 nt, Human
ggacugagugggaag

SEQ ID NO: 1402517 - RNA, 18 nt, Human
ggacugagaaauuuauaa

SEQ ID NO: 1402518 - RNA, 22 nt, Human
ggaguaacaauacaaauggauu

SEQ ID NO: 1402519 - RNA, 15 nt, Human
ggagguugggugggc

SEQ ID NO: 1402520 - RNA, 14 nt, Human
ggagggggaauggc

SEQ ID NO: 1402521 - RNA, 19 nt, Human
ggagggggaauggcagcag

SEQ ID NO: 1402522 - RNA, 18 nt, Human
ggaggggcuccuuuccau

SEQ ID NO: 1402523 - RNA, 15 nt, Human
ggagucacugagacc

SEQ ID NO: 1402524 - RNA, 16 nt, Human
ggaguagcugagcuca

SEQ ID NO: 1402525 - RNA, 17 nt, Human
ggaguagcugagcucac

SEQ ID NO: 1402526 - RNA, 15 nt, Human
ggaguagcugagcuc

SEQ ID NO: 1402527 - RNA, 14 nt, Human
ggaguagcugagcu

SEQ ID NO: 1402528 - RNA, 21 nt, Human
ggagucacacaguguuggagg

SEQ ID NO: 1402529 - RNA, 13 nt, Human
ggagucacacagu

SEQ ID NO: 1402530 - RNA, 16 nt, Human
ggagucaaaaauuaaa

SEQ ID NO: 1402531 - RNA, 21 nt, Human
ggagggcggcaggggccugga

SEQ ID NO: 1402532 - RNA, 20 nt, Human
ggagggcggcaggggccugg

SEQ ID NO: 1402533 - RNA, 23 nt, Human
ggagggccacaugggaggcucac

SEQ ID NO: 1402534 - RNA, 19 nt, Human
ggagggccacaugggaggc

SEQ ID NO: 1402535 - RNA, 13 nt, Human
ggaggggaggggg

SEQ ID NO: 1402536 - RNA, 12 nt, Human
ggaggggcagag

SEQ ID NO: 1402537 - RNA, 13 nt, Human
ggaggggcagagc

SEQ ID NO: 1402538 - RNA, 15 nt, Human
ggaggggcagagcca

SEQ ID NO: 1402539 - RNA, 16 nt, Human
ggaggggcagagccag

SEQ ID NO: 1402540 - RNA, 22 nt, Human
ggaggaccugagccugccgagc

SEQ ID NO: 1402541 - RNA, 19 nt, Human
ggaggaccugagccugccg

SEQ ID NO: 1402542 - RNA, 18 nt, Human
ggaggaccugagccugcc

SEQ ID NO: 1402543 - RNA, 17 nt, Human
ggaggaccugagccugc

SEQ ID NO: 1402544 - RNA, 16 nt, Human
ggaggaccugagccug

SEQ ID NO: 1402545 - RNA, 15 nt, Human
ggaggaccugagccu

SEQ ID NO: 1402546 - RNA, 14 nt, Human
ggaggaccugagcc

SEQ ID NO: 1402547 - RNA, 13 nt, Human
ggaggaccugagc

SEQ ID NO: 1402548 - RNA, 18 nt, Human
ggaggacccagggcucug

SEQ ID NO: 1402549 - RNA, 19 nt, Human
ggaggacccagggcucugu

SEQ ID NO: 1402550 - RNA, 15 nt, Human
ggaggacccaggaca

SEQ ID NO: 1402551 - RNA, 14 nt, Human
ggaggacccaggac

SEQ ID NO: 1402552 - RNA, 16 nt, Human
ggaggacccagggcuc

SEQ ID NO: 1402553 - RNA, 15 nt, Human
ggaggacccagggcu

SEQ ID NO: 1402554 - RNA, 16 nt, Human
ggaggacccaggacag

SEQ ID NO: 1402555 - RNA, 22 nt, Human
ggagggauucugguuccagggu

SEQ ID NO: 1402556 - RNA, 17 nt, Human
ggagggauucugguucc

SEQ ID NO: 1402557 - RNA, 14 nt, Human
ggaggcagagaaga

SEQ ID NO: 1402558 - RNA, 15 nt, Human
ggaggcagagaagaa

SEQ ID NO: 1402559 - RNA, 17 nt, Human
ggaggcaggaguuucgu

SEQ ID NO: 1402560 - RNA, 18 nt, Human
ggaggcaggggcuuccug

SEQ ID NO: 1402561 - RNA, 17 nt, Human
ggaggcaggggcuuccu

SEQ ID NO: 1402562 - RNA, 13 nt, Human
ggaggcaggggcu

SEQ ID NO: 1402563 - RNA, 19 nt, Human
ggaggcagagaagaaagaa

SEQ ID NO: 1402564 - RNA, 13 nt, Human
ggaggcagcagga

SEQ ID NO: 1402565 - RNA, 14 nt, Human
ggaggcagcaggac

SEQ ID NO: 1402566 - RNA, 16 nt, Human
ggaggcagcaggacug

SEQ ID NO: 1402567 - RNA, 12 nt, Human
ggagaccaccag

SEQ ID NO: 1402568 - RNA, 19 nt, Human
ggagacaugugacauuuau

SEQ ID NO: 1402569 - RNA, 15 nt, Human
ggagacaugugacau

SEQ ID NO: 1402570 - RNA, 14 nt, Human
ggagacaugugaca

SEQ ID NO: 1402571 - RNA, 22 nt, Human
ggagacauaaccacugcuucca

SEQ ID NO: 1402572 - RNA, 17 nt, Human
ggagcacaaagacccug

SEQ ID NO: 1402573 - RNA, 17 nt, Human
ggagaccccaccagccu

SEQ ID NO: 1402574 - RNA, 21 nt, Human
ggagcacaauaaauggcugua

SEQ ID NO: 1402575 - RNA, 22 nt, Human
ggagcacaaagacccuggcuuu

SEQ ID NO: 1402576 - RNA, 21 nt, Human
ggagcacaaagacccuggcuu

SEQ ID NO: 1402577 - RNA, 20 nt, Human
ggagcacaaagacccuggcu

SEQ ID NO: 1402578 - RNA, 18 nt, Human
ggagcacaaagacccugg

SEQ ID NO: 1402579 - RNA, 16 nt, Human
ggagcccugggaggcu

SEQ ID NO: 1402580 - RNA, 19 nt, Human
ggagcccugggaggcucug

SEQ ID NO: 1402581 - RNA, 17 nt, Human
ggagccgggucugccuc

SEQ ID NO: 1402582 - RNA, 18 nt, Human
ggagccgggucugccucu

SEQ ID NO: 1402583 - RNA, 23 nt, Human
ggagcccugucuccucucucugu

SEQ ID NO: 1402584 - RNA, 22 nt, Human
ggagcacggcucuguccccagc

SEQ ID NO: 1402585 - RNA, 23 nt, Human
ggagcacggcucuguccccagcc

SEQ ID NO: 1402586 - RNA, 18 nt, Human
ggagcccugucuccucuc

SEQ ID NO: 1402587 - RNA, 20 nt, Human
ggagcccugggaggcucugg

SEQ ID NO: 1402588 - RNA, 22 nt, Human
ggagcgagcaugucguggacac

SEQ ID NO: 1402589 - RNA, 21 nt, Human
ggagccugugaacccaggaca

SEQ ID NO: 1402590 - RNA, 22 nt, Human
ggagccugugaacccaggacaa

SEQ ID NO: 1402591 - RNA, 20 nt, Human
ggagccugugaacccaggac

SEQ ID NO: 1402592 - RNA, 19 nt, Human
ggagccugugaacccagga

SEQ ID NO: 1402593 - RNA, 18 nt, Human
ggagccugugaacccagg

SEQ ID NO: 1402594 - RNA, 17 nt, Human
ggagccugugaacccag

SEQ ID NO: 1402595 - RNA, 14 nt, Human
ggagccugugaacc

SEQ ID NO: 1402596 - RNA, 20 nt, Human
ggagccuguccugccugugg

SEQ ID NO: 1402597 - RNA, 16 nt, Human
ggagccuguccugccu

SEQ ID NO: 1402598 - RNA, 14 nt, Human
ggagccuguccugc

SEQ ID NO: 1402599 - RNA, 13 nt, Human
ggagccuguccug

SEQ ID NO: 1402600 - RNA, 11 nt, Human
ggagccugucc

SEQ ID NO: 1402601 - RNA, 10 nt, Human
ggagccuguc

SEQ ID NO: 1402602 - RNA, 18 nt, Human
ggagccucgcaacccgug

SEQ ID NO: 1402603 - RNA, 22 nt, Human
ggagccucgcaacccgugccaa

SEQ ID NO: 1402604 - RNA, 14 nt, Human
ggagcuaccugugu

SEQ ID NO: 1402605 - RNA, 20 nt, Human
ggagcuaaggcucuaugagu

SEQ ID NO: 1402606 - RNA, 15 nt, Human
ggagcuaaggcucua

SEQ ID NO: 1402607 - RNA, 12 nt, Human
ggagcuaaggcu

SEQ ID NO: 1402608 - RNA, 18 nt, Human
ggagcgggucugcuccca

SEQ ID NO: 1402609 - RNA, 20 nt, Human
ggagcgggucugcucccaag

SEQ ID NO: 1402610 - RNA, 14 nt, Human
ggagcgggucugcu

SEQ ID NO: 1402611 - RNA, 20 nt, Human
ggagcggccggccagccccu

SEQ ID NO: 1402612 - RNA, 15 nt, Human
ggagcggcagauggg

SEQ ID NO: 1402613 - RNA, 12 nt, Human
ggagcuauuuuc

SEQ ID NO: 1402614 - RNA, 17 nt, Human
ggagcuccacucugcuu

SEQ ID NO: 1402615 - RNA, 21 nt, Human
ggagcucaggaaccgaggcag

SEQ ID NO: 1402616 - RNA, 23 nt, Human
ggagcuaccuguguggacaggac

SEQ ID NO: 1402617 - RNA, 22 nt, Human
ggagcuaccuguguggacagga

SEQ ID NO: 1402618 - RNA, 19 nt, Human
ggagcuaccuguguggaca

SEQ ID NO: 1402619 - RNA, 14 nt, Human
ggagcuagaauuug

SEQ ID NO: 1402620 - RNA, 22 nt, Human
ggcuccagagggcacucugcuu

SEQ ID NO: 1402621 - RNA, 13 nt, Human
ggcuccagagggc

SEQ ID NO: 1402622 - RNA, 17 nt, Human
ggcucacgccuguaauc

SEQ ID NO: 1402623 - RNA, 18 nt, Human
ggcucaccuugugcuggg

SEQ ID NO: 1402624 - RNA, 22 nt, Human
ggcucacccccuucuccaucca

SEQ ID NO: 1402625 - RNA, 17 nt, Human
ggcucacccccuucucc

SEQ ID NO: 1402626 - RNA, 12 nt, Human
ggcuaugcauuu

SEQ ID NO: 1402627 - RNA, 13 nt, Human
ggcuaugcauuug

SEQ ID NO: 1402628 - RNA, 14 nt, Human
ggcuaugcauuuga

SEQ ID NO: 1402629 - RNA, 13 nt, Human
ggcuagguacaca

SEQ ID NO: 1402630 - RNA, 19 nt, Human
ggcggggguggcggcggcc

SEQ ID NO: 1402631 - RNA, 14 nt, Human
ggcggggguggcgg

SEQ ID NO: 1402632 - RNA, 12 nt, Human
ggcggggguggc

SEQ ID NO: 1402633 - RNA, 16 nt, Human
ggcggggaggaggaaa

SEQ ID NO: 1402634 - RNA, 17 nt, Human
ggcgggcagagggcugg

SEQ ID NO: 1402635 - RNA, 18 nt, Human
ggcgggcagagggcugga

SEQ ID NO: 1402636 - RNA, 19 nt, Human
ggcuagguggguugaaagc

SEQ ID NO: 1402637 - RNA, 20 nt, Human
ggcuagugacuuguguccca

SEQ ID NO: 1402638 - RNA, 23 nt, Human
ggcuagugacuugugucccauga

SEQ ID NO: 1402639 - RNA, 19 nt, Human
ggcgccccaacccguggag

SEQ ID NO: 1402640 - RNA, 23 nt, Human
ggcgccccaacccguggaggcug

SEQ ID NO: 1402641 - RNA, 18 nt, Human
ggcgccccaacccgugga

SEQ ID NO: 1402642 - RNA, 16 nt, Human
ggcgccccaacccgug

SEQ ID NO: 1402643 - RNA, 24 nt, Human
ggcggcuggggucccagcagcugc

SEQ ID NO: 1402644 - RNA, 20 nt, Human
ggcggcuggggucccagcag

SEQ ID NO: 1402645 - RNA, 19 nt, Human
ggcggcuggggucccagca

SEQ ID NO: 1402646 - RNA, 17 nt, Human
ggcucuccuggcuuccc

SEQ ID NO: 1402647 - RNA, 16 nt, Human
ggcucuccuggcuucc

SEQ ID NO: 1402648 - RNA, 13 nt, Human
ggcucuccuggcu

SEQ ID NO: 1402649 - RNA, 14 nt, Human
ggcucuccuggccc

SEQ ID NO: 1402650 - RNA, 12 nt, Human
ggcucuccuggc

SEQ ID NO: 1402651 - RNA, 16 nt, Human
ggcucccccaggggcu

SEQ ID NO: 1402652 - RNA, 22 nt, Human
ggcuccccauguguccugguuc

SEQ ID NO: 1402653 - RNA, 21 nt, Human
ggcuccccauguguccugguu

SEQ ID NO: 1402654 - RNA, 17 nt, Human
ggcuccccauguguccu

SEQ ID NO: 1402655 - RNA, 22 nt, Human
ggcucccaggggcucccuccgc

SEQ ID NO: 1402656 - RNA, 23 nt, Human
ggcucccaggggcucccuccgcc

SEQ ID NO: 1402657 - RNA, 13 nt, Human
ggcucccaggggc

SEQ ID NO: 1402658 - RNA, 17 nt, Human
ggcucccagggacaccu

SEQ ID NO: 1402659 - RNA, 16 nt, Human
ggcuccagagggcacu

SEQ ID NO: 1402660 - RNA, 22 nt, Human
ggcucugaugaaaaauugcuga

SEQ ID NO: 1402661 - RNA, 23 nt, Human
ggcucugaggugccugucccacc

SEQ ID NO: 1402662 - RNA, 20 nt, Human
ggcucugaggugccuguccc

SEQ ID NO: 1402663 - RNA, 19 nt, Human
ggcucugaggugccugucc

SEQ ID NO: 1402664 - RNA, 17 nt, Human
ggcucugaggugccugu

SEQ ID NO: 1402665 - RNA, 14 nt, Human
ggcucugaggcgcc

SEQ ID NO: 1402666 - RNA, 12 nt, Human
ggcucugaggcg

SEQ ID NO: 1402667 - RNA, 15 nt, Human
ggcucugagcgccuc

SEQ ID NO: 1402668 - RNA, 14 nt, Human
ggcucugagcgccu

SEQ ID NO: 1402669 - RNA, 22 nt, Human
ggcucugagagucuagauucuc

SEQ ID NO: 1402670 - RNA, 20 nt, Human
ggcucugagagucuagauuc

SEQ ID NO: 1402671 - RNA, 18 nt, Human
ggcucugagagucuagau

SEQ ID NO: 1402672 - RNA, 15 nt, Human
ggcucugagagucua

SEQ ID NO: 1402673 - RNA, 20 nt, Human
ggcucugccaguccuguccu

SEQ ID NO: 1402674 - RNA, 17 nt, Human
ggcucugccaguccugu

SEQ ID NO: 1402675 - RNA, 16 nt, Human
ggcucugccaguccug

SEQ ID NO: 1402676 - RNA, 12 nt, Human
ggcucugccagu

SEQ ID NO: 1402677 - RNA, 20 nt, Human
ggcucugcaauuccccucug

SEQ ID NO: 1402678 - RNA, 19 nt, Human
ggcucugcaauuccccucu

SEQ ID NO: 1402679 - RNA, 16 nt, Human
ggcucuggagcccacu

SEQ ID NO: 1402680 - RNA, 17 nt, Human
ggcucuggagcccacug

SEQ ID NO: 1402681 - RNA, 19 nt, Human
ggcucuggagcccacugua

SEQ ID NO: 1402682 - RNA, 20 nt, Human
ggccucugcgagugguuucu

SEQ ID NO: 1402683 - RNA, 20 nt, Human
ggccugaccaaacagccaac

SEQ ID NO: 1402684 - RNA, 19 nt, Human
ggccugagcaguccuuggc

SEQ ID NO: 1402685 - RNA, 17 nt, Human
ggccugggcaggaggga

SEQ ID NO: 1402686 - RNA, 15 nt, Human
ggccugggcaggagg

SEQ ID NO: 1402687 - RNA, 17 nt, Human
ggccugagcaguccuug

SEQ ID NO: 1402688 - RNA, 15 nt, Human
ggccugggccgcugc

SEQ ID NO: 1402689 - RNA, 18 nt, Human
ggccugggcaguggaugg

SEQ ID NO: 1402690 - RNA, 19 nt, Human
ggccugggcaggagggagg

SEQ ID NO: 1402691 - RNA, 14 nt, Human
ggccugggcuccug

SEQ ID NO: 1402692 - RNA, 16 nt, Human
ggccugggcuccugga

SEQ ID NO: 1402693 - RNA, 12 nt, Human
ggcgcacuguga

SEQ ID NO: 1402694 - RNA, 15 nt, Human
ggccuguacugccug

SEQ ID NO: 1402695 - RNA, 16 nt, Human
ggccuguacugccugc

SEQ ID NO: 1402696 - RNA, 14 nt, Human
ggccuguacugccu

SEQ ID NO: 1402697 - RNA, 23 nt, Human
ggccugguuaaauaaggcagggu

SEQ ID NO: 1402698 - RNA, 22 nt, Human
ggccugguuaaauaaggcaggg

SEQ ID NO: 1402699 - RNA, 21 nt, Human
ggccugguuaaauaaggcagg

SEQ ID NO: 1402700 - RNA, 23 nt, Human
ggccuggucucacccuggaggca

SEQ ID NO: 1402701 - RNA, 19 nt, Human
ggccuggucucacccugga

SEQ ID NO: 1402702 - RNA, 14 nt, Human
ggccuggucccugu

SEQ ID NO: 1402703 - RNA, 11 nt, Human
ggccugguccc

SEQ ID NO: 1402704 - RNA, 21 nt, Human
ggccuggggugacccggcacc

SEQ ID NO: 1402705 - RNA, 19 nt, Human
ggccuggggugacccggca

SEQ ID NO: 1402706 - RNA, 18 nt, Human
ggccuggggugacccggc

SEQ ID NO: 1402707 - RNA, 15 nt, Human
ggccuggggugaccc

SEQ ID NO: 1402708 - RNA, 11 nt, Human
ggccuggggug

SEQ ID NO: 1402709 - RNA, 14 nt, Human
ggcgcaggccguga

SEQ ID NO: 1402710 - RNA, 11 nt, Human
ggcgcaggagg

SEQ ID NO: 1402711 - RNA, 23 nt, Human
ggccucucuauccucucuuccuc

SEQ ID NO: 1402712 - RNA, 14 nt, Human
ggccucucucuagg

SEQ ID NO: 1402713 - RNA, 22 nt, Human
ggccucucuauccucucuuccu

SEQ ID NO: 1402714 - RNA, 13 nt, Human
ggccucucuaucc

SEQ ID NO: 1402715 - RNA, 20 nt, Human
ggccucucccuccuccagga

SEQ ID NO: 1402716 - RNA, 23 nt, Human
ggccucucccuccuccaggaagc

SEQ ID NO: 1402717 - RNA, 14 nt, Human
ggccuccuucugag

SEQ ID NO: 1402718 - RNA, 22 nt, Human
ggccuccuucugagcuccuguc

SEQ ID NO: 1402719 - RNA, 15 nt, Human
ggccuccugccucua

SEQ ID NO: 1402720 - RNA, 14 nt, Human
ggccuccugccucu

SEQ ID NO: 1402721 - RNA, 13 nt, Human
ggccuccugccuc

SEQ ID NO: 1402722 - RNA, 23 nt, Human
ggccuagcauacguacacauuuu

SEQ ID NO: 1402723 - RNA, 22 nt, Human
ggccuagcauacguacacauuu

SEQ ID NO: 1402724 - RNA, 14 nt, Human
ggccuagaccagca

SEQ ID NO: 1402725 - RNA, 13 nt, Human
ggccuagaccagc

SEQ ID NO: 1402726 - RNA, 20 nt, Human
ggccuagcauacguacacau

SEQ ID NO: 1402727 - RNA, 17 nt, Human
ggcccagagcccagcuc

SEQ ID NO: 1402728 - RNA, 16 nt, Human
ggcccagagcccagcu

SEQ ID NO: 1402729 - RNA, 15 nt, Human
ggcccagagcccagc

SEQ ID NO: 1402730 - RNA, 14 nt, Human
ggcccagagcccag

SEQ ID NO: 1402731 - RNA, 13 nt, Human
ggcccagagccca

SEQ ID NO: 1402732 - RNA, 12 nt, Human
ggcccagagccc

SEQ ID NO: 1402733 - RNA, 19 nt, Human
ggcccagagcccagcucca

SEQ ID NO: 1402734 - RNA, 18 nt, Human
ggcccagagcccagcucc

SEQ ID NO: 1402735 - RNA, 15 nt, Human
ggccguggcugcugu

SEQ ID NO: 1402736 - RNA, 14 nt, Human
ggccguggcugcug

SEQ ID NO: 1402737 - RNA, 13 nt, Human
ggccguggcugcu

SEQ ID NO: 1402738 - RNA, 21 nt, Human
ggccuaaccugccgagagucc

SEQ ID NO: 1402739 - RNA, 16 nt, Human
ggccuaaccugccgag

SEQ ID NO: 1402740 - RNA, 15 nt, Human
ggccuaaccugccga

SEQ ID NO: 1402741 - RNA, 22 nt, Human
ggccggcuucaugccagcuacu

SEQ ID NO: 1402742 - RNA, 21 nt, Human
ggccggggaacuggccaagcu

SEQ ID NO: 1402743 - RNA, 20 nt, Human
ggccggggaacuggccaagc

SEQ ID NO: 1402744 - RNA, 19 nt, Human
ggccggggaacuggccaag

SEQ ID NO: 1402745 - RNA, 18 nt, Human
ggccggggaacuggccaa

SEQ ID NO: 1402746 - RNA, 19 nt, Human
ggccggcuugccacacccc

SEQ ID NO: 1402747 - RNA, 18 nt, Human
ggcugaggcuggcacagg

SEQ ID NO: 1402748 - RNA, 17 nt, Human
ggcugaggcuggcacag

SEQ ID NO: 1402749 - RNA, 14 nt, Human
ggcugaggcuggca

SEQ ID NO: 1402750 - RNA, 16 nt, Human
ggcugaggccuggacu

SEQ ID NO: 1402751 - RNA, 14 nt, Human
ggcugaggccugga

SEQ ID NO: 1402752 - RNA, 13 nt, Human
ggcugaggagcag

SEQ ID NO: 1402753 - RNA, 16 nt, Human
ggcucuguccccagcc

SEQ ID NO: 1402754 - RNA, 14 nt, Human
ggcucuguccccag

SEQ ID NO: 1402755 - RNA, 16 nt, Human
ggcuccccaguacacc

SEQ ID NO: 1402756 - RNA, 14 nt, Human
ggcugagcugccca

SEQ ID NO: 1402757 - RNA, 20 nt, Human
ggcugagcugcccacagcag

SEQ ID NO: 1402758 - RNA, 23 nt, Human
ggcucuggagcccacuguacuug

SEQ ID NO: 1402759 - RNA, 13 nt, Human
ggcugaggccacc

SEQ ID NO: 1402760 - RNA, 15 nt, Human
ggcugagggagccug

SEQ ID NO: 1402761 - RNA, 19 nt, Human
ggcuggaggcccaggcugg

SEQ ID NO: 1402762 - RNA, 15 nt, Human
ggcuggaggcccagg

SEQ ID NO: 1402763 - RNA, 14 nt, Human
ggcuggaggcccag

SEQ ID NO: 1402764 - RNA, 13 nt, Human
ggcuggaggccca

SEQ ID NO: 1402765 - RNA, 16 nt, Human
ggcuggaggagcccag

SEQ ID NO: 1402766 - RNA, 17 nt, Human
ggcuggaggagcccagg

SEQ ID NO: 1402767 - RNA, 15 nt, Human
ggcuggaggagccca

SEQ ID NO: 1402768 - RNA, 14 nt, Human
ggcuggaggagccc

SEQ ID NO: 1402769 - RNA, 11 nt, Human
ggcuggaggag

SEQ ID NO: 1402770 - RNA, 18 nt, Human
ggcuggagcuagaauuug

SEQ ID NO: 1402771 - RNA, 23 nt, Human
ggcugggaguaguugucuuuccu

SEQ ID NO: 1402772 - RNA, 21 nt, Human
ggcugggaggagggcaggcau

SEQ ID NO: 1402773 - RNA, 20 nt, Human
ggcugggaggagggcaggca

SEQ ID NO: 1402774 - RNA, 13 nt, Human
ggcugggaggagg

SEQ ID NO: 1402775 - RNA, 20 nt, Human
ggcuggagugcaguggugca

SEQ ID NO: 1402776 - RNA, 23 nt, Human
ggcuggaguuagggacugaccag

SEQ ID NO: 1402777 - RNA, 20 nt, Human
ggcuggagugcaguggugug

SEQ ID NO: 1402778 - RNA, 20 nt, Human
ggcuggagugcaguggcgcg

SEQ ID NO: 1402779 - RNA, 17 nt, Human
ggcugucccggaggcgg

SEQ ID NO: 1402780 - RNA, 22 nt, Human
ggcuguccuguacauuguggga

SEQ ID NO: 1402781 - RNA, 13 nt, Human
ggcuguccuguac

SEQ ID NO: 1402782 - RNA, 15 nt, Human
ggcugucccggaggc

SEQ ID NO: 1402783 - RNA, 14 nt, Human
ggcugucugaggcu

SEQ ID NO: 1402784 - RNA, 17 nt, Human
ggcugucuguuguauuc

SEQ ID NO: 1402785 - RNA, 23 nt, Human
ggcuguggaccauggaguggcag

SEQ ID NO: 1402786 - RNA, 17 nt, Human
ggcuguggaccauggag

SEQ ID NO: 1402787 - RNA, 15 nt, Human
ggcuguggucacagc

SEQ ID NO: 1402788 - RNA, 23 nt, Human
ggcuguggcauccagagucccug

SEQ ID NO: 1402789 - RNA, 21 nt, Human
ggcuguggcauccagaguccc

SEQ ID NO: 1402790 - RNA, 18 nt, Human
ggcuguguuuccaucuca

SEQ ID NO: 1402791 - RNA, 11 nt, Human
ggcugugugug

SEQ ID NO: 1402792 - RNA, 22 nt, Human
ggcuguguaagauuuguuuuua

SEQ ID NO: 1402793 - RNA, 20 nt, Human
ggcuguguaagauuuguuuu

SEQ ID NO: 1402794 - RNA, 18 nt, Human
ggcuugggccuaggcugc

SEQ ID NO: 1402795 - RNA, 16 nt, Human
ggcuugggccuaggcu

SEQ ID NO: 1402796 - RNA, 13 nt, Human
ggcuugggccuag

SEQ ID NO: 1402797 - RNA, 17 nt, Human
ggcuugggauuugcugu

SEQ ID NO: 1402798 - RNA, 12 nt, Human
ggcuugggauuu

SEQ ID NO: 1402799 - RNA, 18 nt, Human
ggcuuggccacagccagg

SEQ ID NO: 1402800 - RNA, 19 nt, Human
ggcuuggccacagccaggg

SEQ ID NO: 1402801 - RNA, 17 nt, Human
ggcuuggccacagccag

SEQ ID NO: 1402802 - RNA, 15 nt, Human
ggcuugccugcaggc

SEQ ID NO: 1402803 - RNA, 14 nt, Human
ggcuugccugcagg

SEQ ID NO: 1402804 - RNA, 15 nt, Human
ggcuugcuauucugu

SEQ ID NO: 1402805 - RNA, 14 nt, Human
ggcuugccacaccc

SEQ ID NO: 1402806 - RNA, 13 nt, Human
ggcuugccugcag

SEQ ID NO: 1402807 - RNA, 15 nt, Human
ggcuugccacacccc

SEQ ID NO: 1402808 - RNA, 15 nt, Human
gggagcccccagccu

SEQ ID NO: 1402809 - RNA, 13 nt, Human
gggagcccccagc

SEQ ID NO: 1402810 - RNA, 21 nt, Human
gggagcccacuguccugggcc

SEQ ID NO: 1402811 - RNA, 20 nt, Human
gggagcccacuguccugggc

SEQ ID NO: 1402812 - RNA, 12 nt, Human
gggacugagaga

SEQ ID NO: 1402813 - RNA, 23 nt, Human
gggacugagagaugcagaaauau

SEQ ID NO: 1402814 - RNA, 19 nt, Human
gggagcccacuguccuggg

SEQ ID NO: 1402815 - RNA, 11 nt, Human
gggacugagag

SEQ ID NO: 1402816 - RNA, 19 nt, Human
gggacguggcucagccagc

SEQ ID NO: 1402817 - RNA, 18 nt, Human
gggacguggcucagccag

SEQ ID NO: 1402818 - RNA, 14 nt, Human
gggacguggcucag

SEQ ID NO: 1402819 - RNA, 15 nt, Human
gggacugagaaauuu

SEQ ID NO: 1402820 - RNA, 23 nt, Human
gggaccaggaguggguggggagu

SEQ ID NO: 1402821 - RNA, 13 nt, Human
gggaccuggaagg

SEQ ID NO: 1402822 - RNA, 21 nt, Human
gggaccugguacccuccuggc

SEQ ID NO: 1402823 - RNA, 18 nt, Human
gggaccugguacccuccu

SEQ ID NO: 1402824 - RNA, 17 nt, Human
gggacggugcccaagcc

SEQ ID NO: 1402825 - RNA, 22 nt, Human
gggacgccugggggugccagga

SEQ ID NO: 1402826 - RNA, 21 nt, Human
gggacgccugggggugccagg

SEQ ID NO: 1402827 - RNA, 14 nt, Human
gggaccaggcacca

SEQ ID NO: 1402828 - RNA, 19 nt, Human
gggaccaggaguggguggg

SEQ ID NO: 1402829 - RNA, 14 nt, Human
gggacaccuaggcu

SEQ ID NO: 1402830 - RNA, 22 nt, Human
gggacaaguggacucagggcag

SEQ ID NO: 1402831 - RNA, 14 nt, Human
gggaauugaggaca

SEQ ID NO: 1402832 - RNA, 11 nt, Human
gggaaugugaa

SEQ ID NO: 1402833 - RNA, 14 nt, Human
gggaaucagaacuc

SEQ ID NO: 1402834 - RNA, 18 nt, Human
gggaauauuugaaucuug

SEQ ID NO: 1402835 - RNA, 22 nt, Human
gggaauaugagugcguggugcg

SEQ ID NO: 1402836 - RNA, 13 nt, Human
gggaauauuugaa

SEQ ID NO: 1402837 - RNA, 14 nt, Human
gggaauauuugaau

SEQ ID NO: 1402838 - RNA, 19 nt, Human
ggcuuuuauuaaugcacuu

SEQ ID NO: 1402839 - RNA, 20 nt, Human
ggcuuuuauuaaugcacuuu

SEQ ID NO: 1402840 - RNA, 23 nt, Human
gggaagugaagacuggaagcuaa

SEQ ID NO: 1402841 - RNA, 16 nt, Human
ggcuuugauguuccuu

SEQ ID NO: 1402842 - RNA, 17 nt, Human
ggcuugggccuaggcug

SEQ ID NO: 1402843 - RNA, 12 nt, Human
ggcuuuggauuu

SEQ ID NO: 1402844 - RNA, 22 nt, Human
gggagcgggucugcucccaagg

SEQ ID NO: 1402845 - RNA, 22 nt, Human
gggagcucaggaaccgaggcag

SEQ ID NO: 1402846 - RNA, 12 nt, Human
gggagcucagga

SEQ ID NO: 1402847 - RNA, 23 nt, Human
gggagcuccacucugcuucucug

SEQ ID NO: 1402848 - RNA, 19 nt, Human
gggagcuccacucugcuuc

SEQ ID NO: 1402849 - RNA, 23 nt, Human
gggagcucaggaaccgaggcagg

SEQ ID NO: 1402850 - RNA, 21 nt, Human
gggagccucgcaacccgugcc

SEQ ID NO: 1402851 - RNA, 19 nt, Human
gggagccccuucugcucag

SEQ ID NO: 1402852 - RNA, 21 nt, Human
gggagcccccagccugucaga

SEQ ID NO: 1402853 - RNA, 17 nt, Human
gggagcccccagccugu

SEQ ID NO: 1402854 - RNA, 16 nt, Human
gggagcccccagccug

SEQ ID NO: 1402855 - RNA, 13 nt, Human
gggagccgggagc

SEQ ID NO: 1402856 - RNA, 19 nt, Human
gggagcugguuagaaaugc

SEQ ID NO: 1402857 - RNA, 14 nt, Human
gggagcugggcuuc

SEQ ID NO: 1402858 - RNA, 18 nt, Human
gggagcugggccuggucu

SEQ ID NO: 1402859 - RNA, 17 nt, Human
gggagcugggccugguc

SEQ ID NO: 1402860 - RNA, 16 nt, Human
gggagcugggccuggu

SEQ ID NO: 1402861 - RNA, 15 nt, Human
gggagcugggccugg

SEQ ID NO: 1402862 - RNA, 14 nt, Human
gggagcugggccug

SEQ ID NO: 1402863 - RNA, 12 nt, Human
gggagcugaggc

SEQ ID NO: 1402864 - RNA, 17 nt, Human
gggagucugccagggcc

SEQ ID NO: 1402865 - RNA, 14 nt, Human
gggagucugccagg

SEQ ID NO: 1402866 - RNA, 16 nt, Human
gggaggagggcaggca

SEQ ID NO: 1402867 - RNA, 12 nt, Human
gggaggagggca

SEQ ID NO: 1402868 - RNA, 14 nt, Human
gggaggagaaugag

SEQ ID NO: 1402869 - RNA, 15 nt, Human
gggaggaggcagaga

SEQ ID NO: 1402870 - RNA, 17 nt, Human
ucagggccaugcugagg

SEQ ID NO: 1402871 - RNA, 14 nt, Human
ucagggccaugcug

SEQ ID NO: 1402872 - RNA, 13 nt, Human
ucagggccaugcu

SEQ ID NO: 1402873 - RNA, 17 nt, Human
ucagggccaggccucuc

SEQ ID NO: 1402874 - RNA, 13 nt, Human
ucagggccaggcc

SEQ ID NO: 1402875 - RNA, 19 nt, Human
ucagggcagcgccaggcug

SEQ ID NO: 1402876 - RNA, 15 nt, Human
ucagggcagcgccag

SEQ ID NO: 1402877 - RNA, 22 nt, Human
ucagggcaaagccaggucccuc

SEQ ID NO: 1402878 - RNA, 21 nt, Human
ucagggcaaagccaggucccu

SEQ ID NO: 1402879 - RNA, 20 nt, Human
ucagggcaaagccagguccc

SEQ ID NO: 1402880 - RNA, 16 nt, Human
ucagggcaaagccagg

SEQ ID NO: 1402881 - RNA, 15 nt, Human
ucagggcaaagccag

SEQ ID NO: 1402882 - RNA, 19 nt, Human
ucagggaguguucccuauc

SEQ ID NO: 1402883 - RNA, 22 nt, Human
ucagggaggcccugugccccuu

SEQ ID NO: 1402884 - RNA, 19 nt, Human
ucagggaggcccugugccc

SEQ ID NO: 1402885 - RNA, 15 nt, Human
ucagggaggucauuu

SEQ ID NO: 1402886 - RNA, 21 nt, Human
ucagggagugggcuaagcacg

SEQ ID NO: 1402887 - RNA, 15 nt, Human
ucagggaggcccugu

SEQ ID NO: 1402888 - RNA, 18 nt, Human
ucagggaaagugggacag

SEQ ID NO: 1402889 - RNA, 23 nt, Human
ucagggccaugcugaggccuggg

SEQ ID NO: 1402890 - RNA, 21 nt, Human
ucagggccaugcugaggccug

SEQ ID NO: 1402891 - RNA, 19 nt, Human
ucagggccaugcugaggcc

SEQ ID NO: 1402892 - RNA, 18 nt, Human
ucagggccaugcugaggc

SEQ ID NO: 1402893 - RNA, 18 nt, Human
ucaggcacugggcaugag

SEQ ID NO: 1402894 - RNA, 14 nt, Human
ucaggcacacagcu

SEQ ID NO: 1402895 - RNA, 13 nt, Human
ucaggcacacagc

SEQ ID NO: 1402896 - RNA, 23 nt, Human
ucaggauugcgagagaugugugu

SEQ ID NO: 1402897 - RNA, 22 nt, Human
ucaggauugcgagagaugugug

SEQ ID NO: 1402898 - RNA, 21 nt, Human
ucaggauugcgagagaugugu

SEQ ID NO: 1402899 - RNA, 20 nt, Human
ucaggauugcgagagaugug

SEQ ID NO: 1402900 - RNA, 18 nt, Human
ucaggauugcgagagaug

SEQ ID NO: 1402901 - RNA, 17 nt, Human
ucaggcuagauguaugu

SEQ ID NO: 1402902 - RNA, 12 nt, Human
ucagcugccagu

SEQ ID NO: 1402903 - RNA, 18 nt, Human
ucagcugcauuccgcagc

SEQ ID NO: 1402904 - RNA, 22 nt, Human
ucagcugcaagguacucuggug

SEQ ID NO: 1402905 - RNA, 21 nt, Human
ucagcugcaagguacucuggu

SEQ ID NO: 1402906 - RNA, 20 nt, Human
ucagcugcaagguacucugg

SEQ ID NO: 1402907 - RNA, 19 nt, Human
ucaggagcccugggaggcu

SEQ ID NO: 1402908 - RNA, 18 nt, Human
ucaggagcccugggaggc

SEQ ID NO: 1402909 - RNA, 15 nt, Human
ucaggauugcgagag

SEQ ID NO: 1402910 - RNA, 13 nt, Human
ucaggauugcgag

SEQ ID NO: 1402911 - RNA, 14 nt, Human
ucaggagccuguga

SEQ ID NO: 1402912 - RNA, 20 nt, Human
ucagcugcauuccgcagccc

SEQ ID NO: 1402913 - RNA, 20 nt, Human
ucaggagcccugggaggcuc

SEQ ID NO: 1402914 - RNA, 23 nt, Human
ucaggagcccugggaggcucugg

SEQ ID NO: 1402915 - RNA, 20 nt, Human
ucagcucccacaagccucug

SEQ ID NO: 1402916 - RNA, 18 nt, Human
ucagccuggccagacaca

SEQ ID NO: 1402917 - RNA, 17 nt, Human
ucagccuggccagacac

SEQ ID NO: 1402918 - RNA, 16 nt, Human
ucagccuggccagaca

SEQ ID NO: 1402919 - RNA, 15 nt, Human
ucagccuggccagac

SEQ ID NO: 1402920 - RNA, 14 nt, Human
ucagccuggccaga

SEQ ID NO: 1402921 - RNA, 12 nt, Human
ucagccuggcca

SEQ ID NO: 1402922 - RNA, 16 nt, Human
ucagccucccaaagug

SEQ ID NO: 1402923 - RNA, 20 nt, Human
ucagccuccugaguagcugg

SEQ ID NO: 1402924 - RNA, 20 nt, Human
ucagccucccgaguagcugg

SEQ ID NO: 1402925 - RNA, 22 nt, Human
ucagauaucuuggacaaaucac

SEQ ID NO: 1402926 - RNA, 21 nt, Human
ucagauaucuuggacaaauca

SEQ ID NO: 1402927 - RNA, 21 nt, Human
ucagcaugucuauucagcuuc

SEQ ID NO: 1402928 - RNA, 19 nt, Human
ucagcaugucuauucagcu

SEQ ID NO: 1402929 - RNA, 16 nt, Human
ucagcaugucuauuca

SEQ ID NO: 1402930 - RNA, 12 nt, Human
ucagcaugucua

SEQ ID NO: 1402931 - RNA, 15 nt, Human
ucagcaugcaauaca

SEQ ID NO: 1402932 - RNA, 19 nt, Human
ucagcaugaauuuguaaug

SEQ ID NO: 1402933 - RNA, 18 nt, Human
ucagcaugaauuuguaau

SEQ ID NO: 1402934 - RNA, 17 nt, Human
ucagcaugaauuuguaa

SEQ ID NO: 1402935 - RNA, 15 nt, Human
ucagcaugaauuugu

SEQ ID NO: 1402936 - RNA, 14 nt, Human
ucagcaugaauuug

SEQ ID NO: 1402937 - RNA, 23 nt, Human
ucagauaucuuggacaaaucaca

SEQ ID NO: 1402938 - RNA, 13 nt, Human
ucagcaugaauuu

SEQ ID NO: 1402939 - RNA, 16 nt, Human
ucagauaugauucaaa

SEQ ID NO: 1402940 - RNA, 15 nt, Human
ucagauaugauucaa

SEQ ID NO: 1402941 - RNA, 20 nt, Human
ucacuguagaaugauuucau

SEQ ID NO: 1402942 - RNA, 20 nt, Human
ucacugguagaccaaaauaa

SEQ ID NO: 1402943 - RNA, 19 nt, Human
ucacugguagaccaaaaua

SEQ ID NO: 1402944 - RNA, 18 nt, Human
ucacugguagaccaaaau

SEQ ID NO: 1402945 - RNA, 16 nt, Human
ucacuggagcacaaua

SEQ ID NO: 1402946 - RNA, 15 nt, Human
ucacuggagcacaau

SEQ ID NO: 1402947 - RNA, 14 nt, Human
ucacuggagcacaa

SEQ ID NO: 1402948 - RNA, 13 nt, Human
ucacuggagcaca

SEQ ID NO: 1402949 - RNA, 11 nt, Human
ucacuggagca

SEQ ID NO: 1402950 - RNA, 18 nt, Human
ucacuggaccacugggca

SEQ ID NO: 1402951 - RNA, 14 nt, Human
ucacugcucacacu

SEQ ID NO: 1402952 - RNA, 14 nt, Human
ucacugcuuaacuu

SEQ ID NO: 1402953 - RNA, 23 nt, Human
ucaccccuaaaagaaacccugca

SEQ ID NO: 1402954 - RNA, 20 nt, Human
ucacucuguucauuccucca

SEQ ID NO: 1402955 - RNA, 21 nt, Human
ucacucuguucauuccuccag

SEQ ID NO: 1402956 - RNA, 20 nt, Human
ucacucuuaugcuguaccca

SEQ ID NO: 1402957 - RNA, 15 nt, Human
ucacucuuaugcugu

SEQ ID NO: 1402958 - RNA, 22 nt, Human
ucacucuguucauuccuccagg

SEQ ID NO: 1402959 - RNA, 18 nt, Human
ucagacagaaccccuaca

SEQ ID NO: 1402960 - RNA, 23 nt, Human
ucagaauuuuauacuuucccuac

SEQ ID NO: 1402961 - RNA, 22 nt, Human
ucagaauuuuauacuuucccua

SEQ ID NO: 1402962 - RNA, 21 nt, Human
ucagaauuuuauacuuucccu

SEQ ID NO: 1402963 - RNA, 20 nt, Human
ucagaauuuuauacuuuccc

SEQ ID NO: 1402964 - RNA, 21 nt, Human
ucagaauuuaguguauccaua

SEQ ID NO: 1402965 - RNA, 14 nt, Human
ucagaauuuagugu

SEQ ID NO: 1402966 - RNA, 15 nt, Human
ucagaaauguguuau

SEQ ID NO: 1402967 - RNA, 23 nt, Human
ucagaauucucuaguuugauuaa

SEQ ID NO: 1402968 - RNA, 15 nt, Human
ucagaaaccagacuc

SEQ ID NO: 1402969 - RNA, 10 nt, Human
ucagaaaugu

SEQ ID NO: 1402970 - RNA, 21 nt, Human
ucacuuuacacaauagaauua

SEQ ID NO: 1402971 - RNA, 20 nt, Human
ucacuuguuuuauuuaaccu

SEQ ID NO: 1402972 - RNA, 19 nt, Human
ucagaaacacccucacacu

SEQ ID NO: 1402973 - RNA, 21 nt, Human
ucagaaacacccucacacugg

SEQ ID NO: 1402974 - RNA, 22 nt, Human
ucagaaacacccucacacuggg

SEQ ID NO: 1402975 - RNA, 14 nt, Human
ucagacuguuuagu

SEQ ID NO: 1402976 - RNA, 16 nt, Human
ucagacgccugaggaa

SEQ ID NO: 1402977 - RNA, 17 nt, Human
ucagacgccugaggaac

SEQ ID NO: 1402978 - RNA, 12 nt, Human
ucagacccugga

SEQ ID NO: 1402979 - RNA, 14 nt, Human
ucagacccuggagg

SEQ ID NO: 1402980 - RNA, 23 nt, Human
ucagaccauaauguuacauuauu

SEQ ID NO: 1402981 - RNA, 15 nt, Human
ucagaccauaauguu

SEQ ID NO: 1402982 - RNA, 22 nt, Human
ucagacagagaggacuguaggg

SEQ ID NO: 1402983 - RNA, 17 nt, Human
ucagacagagaggacug

SEQ ID NO: 1402984 - RNA, 14 nt, Human
ucagagaaggaaca

SEQ ID NO: 1402985 - RNA, 13 nt, Human
ucagacuggggca

SEQ ID NO: 1402986 - RNA, 12 nt, Human
ucagagaauuuc

SEQ ID NO: 1402987 - RNA, 19 nt, Human
ucagaggguguccugcacc

SEQ ID NO: 1402988 - RNA, 21 nt, Human
ucagaguaauccaagcaaaug

SEQ ID NO: 1402989 - RNA, 22 nt, Human
ucagaguaauccaagcaaaugu

SEQ ID NO: 1402990 - RNA, 15 nt, Human
uccacacugcacaau

SEQ ID NO: 1402991 - RNA, 13 nt, Human
uccacacugcaca

SEQ ID NO: 1402992 - RNA, 22 nt, Human
uccaaaauguuggucauuuuau

SEQ ID NO: 1402993 - RNA, 15 nt, Human
uccaaaaugugccua

SEQ ID NO: 1402994 - RNA, 18 nt, Human
uccaaaaucuugaucagu

SEQ ID NO: 1402995 - RNA, 21 nt, Human
ucauuucuauuucuccuccau

SEQ ID NO: 1402996 - RNA, 17 nt, Human
ucauuucuauuucuccu

SEQ ID NO: 1402997 - RNA, 20 nt, Human
uccaaaauaaaacuuuuuaa

SEQ ID NO: 1402998 - RNA, 18 nt, Human
uccaaaauaaaacuuuuu

SEQ ID NO: 1402999 - RNA, 18 nt, Human
uccaauuuucuggaauac

SEQ ID NO: 1403000 - RNA, 14 nt, Human
uccaauuuucugga

SEQ ID NO: 1403001 - RNA, 16 nt, Human
uccaaaaugugccuau

SEQ ID NO: 1403002 - RNA, 23 nt, Human
uccaccugguacucccucucagg

SEQ ID NO: 1403003 - RNA, 21 nt, Human
uccaccugguacucccucuca

SEQ ID NO: 1403004 - RNA, 20 nt, Human
uccaccugguacucccucuc

SEQ ID NO: 1403005 - RNA, 22 nt, Human
uccaccccuuucuagaccaaua

SEQ ID NO: 1403006 - RNA, 21 nt, Human
uccaccccuuucuagaccaau

SEQ ID NO: 1403007 - RNA, 17 nt, Human
uccacagcaaccccagg

SEQ ID NO: 1403008 - RNA, 19 nt, Human
uccacagaggacacagaga

SEQ ID NO: 1403009 - RNA, 17 nt, Human
uccacagaggacacaga

SEQ ID NO: 1403010 - RNA, 15 nt, Human
uccacagaggacaca

SEQ ID NO: 1403011 - RNA, 22 nt, Human
uccacagacggaaggguaaaca

SEQ ID NO: 1403012 - RNA, 23 nt, Human
uccacagacggaaggguaaacaa

SEQ ID NO: 1403013 - RNA, 10 nt, Human
uccacagacg

SEQ ID NO: 1403014 - RNA, 14 nt, Human
uccacacugcacaa

SEQ ID NO: 1403015 - RNA, 19 nt, Human
uccacagaagcuccaggua

SEQ ID NO: 1403016 - RNA, 15 nt, Human
uccaccuucccacuu

SEQ ID NO: 1403017 - RNA, 12 nt, Human
uccaccuuccca

SEQ ID NO: 1403018 - RNA, 24 nt, Human
uccagccaucaagagacugaguca

SEQ ID NO: 1403019 - RNA, 21 nt, Human
uccagccaucaagagacugag

SEQ ID NO: 1403020 - RNA, 20 nt, Human
uccagccaucaagagacuga

SEQ ID NO: 1403021 - RNA, 19 nt, Human
uccagccaucaagagacug

SEQ ID NO: 1403022 - RNA, 20 nt, Human
uccagcuguugagccccucc

SEQ ID NO: 1403023 - RNA, 21 nt, Human
uccagcuguccccccacuccc

SEQ ID NO: 1403024 - RNA, 17 nt, Human
uccagcuguccccccac

SEQ ID NO: 1403025 - RNA, 16 nt, Human
uccagcugucccccca

SEQ ID NO: 1403026 - RNA, 14 nt, Human
uccagcuguccccc

SEQ ID NO: 1403027 - RNA, 16 nt, Human
uccagguguuacugua

SEQ ID NO: 1403028 - RNA, 17 nt, Human
uccagcuuuccuguauu

SEQ ID NO: 1403029 - RNA, 18 nt, Human
uccagggucccucugugu

SEQ ID NO: 1403030 - RNA, 17 nt, Human
uccagggucccucugug

SEQ ID NO: 1403031 - RNA, 16 nt, Human
uccagggucccucugu

SEQ ID NO: 1403032 - RNA, 14 nt, Human
uccaggguggcagc

SEQ ID NO: 1403033 - RNA, 15 nt, Human
uccaggguggcagca

SEQ ID NO: 1403034 - RNA, 18 nt, Human
uccaggguggcagcaaca

SEQ ID NO: 1403035 - RNA, 20 nt, Human
uccaggguggcagcaacaau

SEQ ID NO: 1403036 - RNA, 19 nt, Human
ucaucagaaaggaaaaaca

SEQ ID NO: 1403037 - RNA, 21 nt, Human
ucaucacuuugaccuaaauua

SEQ ID NO: 1403038 - RNA, 14 nt, Human
ucaucacacugggu

SEQ ID NO: 1403039 - RNA, 16 nt, Human
ucaucagaaaggaaaa

SEQ ID NO: 1403040 - RNA, 19 nt, Human
ucaucaggacccuggaccu

SEQ ID NO: 1403041 - RNA, 16 nt, Human
ucaucuucuucaccau

SEQ ID NO: 1403042 - RNA, 20 nt, Human
ucaucuucaguugucucuga

SEQ ID NO: 1403043 - RNA, 18 nt, Human
ucaucuucaguugucucu

SEQ ID NO: 1403044 - RNA, 14 nt, Human
ucagggcuccuggg

SEQ ID NO: 1403045 - RNA, 14 nt, Human
ucauagcccaguag

SEQ ID NO: 1403046 - RNA, 22 nt, Human
ucauagcccaguagaccuuguu

SEQ ID NO: 1403047 - RNA, 14 nt, Human
ucauagcuaaaaaa

SEQ ID NO: 1403048 - RNA, 13 nt, Human
ucauuucuauuuc

SEQ ID NO: 1403049 - RNA, 13 nt, Human
ucauuuccucaaa

SEQ ID NO: 1403050 - RNA, 15 nt, Human
ucauuucauuuccua

SEQ ID NO: 1403051 - RNA, 16 nt, Human
ucauuuccaagcaagu

SEQ ID NO: 1403052 - RNA, 13 nt, Human
ucauuuccaagca

SEQ ID NO: 1403053 - RNA, 12 nt, Human
ucauugugaaau

SEQ ID NO: 1403054 - RNA, 15 nt, Human
ucauugugaaauuau

SEQ ID NO: 1403055 - RNA, 17 nt, Human
ucauugugaaauuauuc

SEQ ID NO: 1403056 - RNA, 18 nt, Human
ucauugugaaauuauuca

SEQ ID NO: 1403057 - RNA, 20 nt, Human
ucauuguguuaccuguagau

SEQ ID NO: 1403058 - RNA, 16 nt, Human
ucauuccauucuggaa

SEQ ID NO: 1403059 - RNA, 19 nt, Human
ucauuccauucuggaagug

SEQ ID NO: 1403060 - RNA, 21 nt, Human
ucauuucagaaguuaguuugu

SEQ ID NO: 1403061 - RNA, 13 nt, Human
ucauuucagaagu

SEQ ID NO: 1403062 - RNA, 12 nt, Human
ucauuucaucua

SEQ ID NO: 1403063 - RNA, 12 nt, Human
ucauuucaggau

SEQ ID NO: 1403064 - RNA, 23 nt, Human
ucauuauucguagauauuggaca

SEQ ID NO: 1403065 - RNA, 19 nt, Human
ucauuauuacuuuugcugu

SEQ ID NO: 1403066 - RNA, 19 nt, Human
ucauuagucauguuuaucu

SEQ ID NO: 1403067 - RNA, 18 nt, Human
ucaugcugggauuuccaa

SEQ ID NO: 1403068 - RNA, 22 nt, Human
ucauuagucauguuuaucugcu

SEQ ID NO: 1403069 - RNA, 14 nt, Human
ucaugcugggauuu

SEQ ID NO: 1403070 - RNA, 12 nt, Human
ucaugcugccuu

SEQ ID NO: 1403071 - RNA, 22 nt, Human
ucauucaaguguaaaauauuuu

SEQ ID NO: 1403072 - RNA, 14 nt, Human
ucauuauuuaugua

SEQ ID NO: 1403073 - RNA, 16 nt, Human
ucauuauuuauguauu

SEQ ID NO: 1403074 - RNA, 17 nt, Human
ucauuauuuauguauug

SEQ ID NO: 1403075 - RNA, 20 nt, Human
ucauucacaucgcagauucu

SEQ ID NO: 1403076 - RNA, 22 nt, Human
ucauucacaucgcagauucucc

SEQ ID NO: 1403077 - RNA, 14 nt, Human
ucauucauuuuugu

SEQ ID NO: 1403078 - RNA, 16 nt, Human
ucauuccaugugccca

SEQ ID NO: 1403079 - RNA, 20 nt, Human
ucauuccaugugcccaguua

SEQ ID NO: 1403080 - RNA, 19 nt, Human
ucauuccaugugcccaguu

SEQ ID NO: 1403081 - RNA, 18 nt, Human
ucauuccaugugcccagu

SEQ ID NO: 1403082 - RNA, 17 nt, Human
ucauuccaugugcccag

SEQ ID NO: 1403083 - RNA, 14 nt, Human
ucauuccauucugg

SEQ ID NO: 1403084 - RNA, 15 nt, Human
ucauuccauucugga

SEQ ID NO: 1403085 - RNA, 22 nt, Human
ucaccacaaacuguaauacaau

SEQ ID NO: 1403086 - RNA, 12 nt, Human
ucaccacaaacu

SEQ ID NO: 1403087 - RNA, 23 nt, Human
ucaccaauguacccaccgggcca

SEQ ID NO: 1403088 - RNA, 15 nt, Human
ucaccaauguaccca

SEQ ID NO: 1403089 - RNA, 21 nt, Human
ucaccagauuugcuaauuuau

SEQ ID NO: 1403090 - RNA, 15 nt, Human
ucaccagauuugcua

SEQ ID NO: 1403091 - RNA, 18 nt, Human
ucaccagaucugauuugu

SEQ ID NO: 1403092 - RNA, 18 nt, Human
ucacauuuuccuuuucaa

SEQ ID NO: 1403093 - RNA, 17 nt, Human
ucacauuuuccuuuuca

SEQ ID NO: 1403094 - RNA, 16 nt, Human
ucacauuuuccuuuuc

SEQ ID NO: 1403095 - RNA, 14 nt, Human
ucacauuuuccuuu

SEQ ID NO: 1403096 - RNA, 11 nt, Human
ucacauuuucc

SEQ ID NO: 1403097 - RNA, 17 nt, Human
ucacagugggagccagg

SEQ ID NO: 1403098 - RNA, 18 nt, Human
ucacagugggagccaggg

SEQ ID NO: 1403099 - RNA, 17 nt, Human
ucacagugcucuuuucu

SEQ ID NO: 1403100 - RNA, 16 nt, Human
ucacagugaacacuca

SEQ ID NO: 1403101 - RNA, 18 nt, Human
ucacagugcuuuuaagug

SEQ ID NO: 1403102 - RNA, 16 nt, Human
ucacagugcuuuuaag

SEQ ID NO: 1403103 - RNA, 20 nt, Human
ucacagugcucuuuucuccu

SEQ ID NO: 1403104 - RNA, 18 nt, Human
ucacagugcucuuuucuc

SEQ ID NO: 1403105 - RNA, 20 nt, Human
ucacaccugaacugaacacc

SEQ ID NO: 1403106 - RNA, 22 nt, Human
ucacacccaacuugguuuugcu

SEQ ID NO: 1403107 - RNA, 20 nt, Human
ucaauuacugguccaaaaga

SEQ ID NO: 1403108 - RNA, 16 nt, Human
ucaauuacugguccaa

SEQ ID NO: 1403109 - RNA, 13 nt, Human
ucaauuacugguc

SEQ ID NO: 1403110 - RNA, 13 nt, Human
ucaauuaccacac

SEQ ID NO: 1403111 - RNA, 23 nt, Human
ucaaccuuaagaccuacuguucu

SEQ ID NO: 1403112 - RNA, 15 nt, Human
ucaaccuuaagaccu

SEQ ID NO: 1403113 - RNA, 18 nt, Human
ucaaccugggcaaagccu

SEQ ID NO: 1403114 - RNA, 21 nt, Human
ucaaguugauuagaaagacca

SEQ ID NO: 1403115 - RNA, 17 nt, Human
ucaaguugaggggcuuc

SEQ ID NO: 1403116 - RNA, 15 nt, Human
ucaaguugaggggcu

SEQ ID NO: 1403117 - RNA, 19 nt, Human
ucaaguucuaagauucuaa

SEQ ID NO: 1403118 - RNA, 18 nt, Human
ucaaguucuaagauucua

SEQ ID NO: 1403119 - RNA, 17 nt, Human
ucaaguucuaagauucu

SEQ ID NO: 1403120 - RNA, 16 nt, Human
ucaaguucuaagauuc

SEQ ID NO: 1403121 - RNA, 15 nt, Human
ucaaguucuaagauu

SEQ ID NO: 1403122 - RNA, 14 nt, Human
ucaaguucuaagau

SEQ ID NO: 1403123 - RNA, 13 nt, Human
ucaaguucuaaga

SEQ ID NO: 1403124 - RNA, 23 nt, Human
ucaaguuguuccuuaagucagaa

SEQ ID NO: 1403125 - RNA, 16 nt, Human
ucaaguugauuagaaa

SEQ ID NO: 1403126 - RNA, 13 nt, Human
ucaaguugugcca

SEQ ID NO: 1403127 - RNA, 21 nt, Human
ucaauaaaauccauacauuug

SEQ ID NO: 1403128 - RNA, 20 nt, Human
ucaauaauauauuuucuguu

SEQ ID NO: 1403129 - RNA, 19 nt, Human
ucaauaauauauuuucugu

SEQ ID NO: 1403130 - RNA, 18 nt, Human
ucaauaauauauuuucug

SEQ ID NO: 1403131 - RNA, 15 nt, Human
ucaauaauauauuuu

SEQ ID NO: 1403132 - RNA, 22 nt, Human
ucaauaagccucagcuuucuaa

SEQ ID NO: 1403133 - RNA, 11 nt, Human
ucaauaaagua

SEQ ID NO: 1403134 - RNA, 14 nt, Human
ucaauaaaguauuu

SEQ ID NO: 1403135 - RNA, 15 nt, Human
ucaauaaaguauuua

SEQ ID NO: 1403136 - RNA, 16 nt, Human
ucaauaaaguauuuaa

SEQ ID NO: 1403137 - RNA, 17 nt, Human
ucaauaaaguauuuaau

SEQ ID NO: 1403138 - RNA, 18 nt, Human
ucaauaaaguauuuaauu

SEQ ID NO: 1403139 - RNA, 20 nt, Human
ucaauaaaguauuuaauuag

SEQ ID NO: 1403140 - RNA, 22 nt, Human
ucaauaaaguauuuaauuagug

SEQ ID NO: 1403141 - RNA, 22 nt, Human
ucaaugccccugaauuuaaaua

SEQ ID NO: 1403142 - RNA, 20 nt, Human
ucaaugccccugaauuuaaa

SEQ ID NO: 1403143 - RNA, 18 nt, Human
ucaaugccccugaauuua

SEQ ID NO: 1403144 - RNA, 19 nt, Human
ucaaugcaguugucucugu

SEQ ID NO: 1403145 - RNA, 18 nt, Human
ucaaugcaguugucucug

SEQ ID NO: 1403146 - RNA, 17 nt, Human
ucaaugcaguugucucu

SEQ ID NO: 1403147 - RNA, 15 nt, Human
ucaaugcaguugucu

SEQ ID NO: 1403148 - RNA, 17 nt, Human
ucaaugccccugaauuu

SEQ ID NO: 1403149 - RNA, 17 nt, Human
uauuuuauuaugaagaa

SEQ ID NO: 1403150 - RNA, 14 nt, Human
uauuuuauuaugca

SEQ ID NO: 1403151 - RNA, 17 nt, Human
uauuuuauuaugcauga

SEQ ID NO: 1403152 - RNA, 13 nt, Human
uauuuuccaggcu

SEQ ID NO: 1403153 - RNA, 17 nt, Human
uauuuucaaaaccaggu

SEQ ID NO: 1403154 - RNA, 14 nt, Human
uauuuucaaaacca

SEQ ID NO: 1403155 - RNA, 16 nt, Human
uauuuucaaaaccagg

SEQ ID NO: 1403156 - RNA, 17 nt, Human
uauuuuauguugcauag

SEQ ID NO: 1403157 - RNA, 23 nt, Human
uauuuauauauguauuuauaaau

SEQ ID NO: 1403158 - RNA, 16 nt, Human
uauuuauauauguauu

SEQ ID NO: 1403159 - RNA, 13 nt, Human
uauuuuauuauga

SEQ ID NO: 1403160 - RNA, 18 nt, Human
uauuuuuuuuuaagcucu

SEQ ID NO: 1403161 - RNA, 17 nt, Human
uauuuuuuuuaaguauu

SEQ ID NO: 1403162 - RNA, 17 nt, Human
uauuuuuuucuuuucuu

SEQ ID NO: 1403163 - RNA, 14 nt, Human
uauuuuuuuacuaa

SEQ ID NO: 1403164 - RNA, 21 nt, Human
uauuuuccuauauuacgguuu

SEQ ID NO: 1403165 - RNA, 19 nt, Human
uauuuuuucuuuucuuuac

SEQ ID NO: 1403166 - RNA, 16 nt, Human
uauuuuuucaguauua

SEQ ID NO: 1403167 - RNA, 21 nt, Human
uauuuucugugccugaauauu

SEQ ID NO: 1403168 - RNA, 17 nt, Human
uauuuuuuguauaauug

SEQ ID NO: 1403169 - RNA, 16 nt, Human
uauuuuuuguauaauu

SEQ ID NO: 1403170 - RNA, 14 nt, Human
uauuuuuuguauaa

SEQ ID NO: 1403171 - RNA, 13 nt, Human
uauuuuuugaaaa

SEQ ID NO: 1403172 - RNA, 22 nt, Human
ucaaauugugcaguacuuugug

SEQ ID NO: 1403173 - RNA, 15 nt, Human
ucaaauugugugaaa

SEQ ID NO: 1403174 - RNA, 21 nt, Human
ucaaauucuucugaacucaaa

SEQ ID NO: 1403175 - RNA, 16 nt, Human
ucaaauucuucugaac

SEQ ID NO: 1403176 - RNA, 14 nt, Human
ucaaauugugugaa

SEQ ID NO: 1403177 - RNA, 17 nt, Human
ucaaauuguaagcaugc

SEQ ID NO: 1403178 - RNA, 20 nt, Human
ucaaauuguaagcaugcaca

SEQ ID NO: 1403179 - RNA, 15 nt, Human
ucaaauucuucugaa

SEQ ID NO: 1403180 - RNA, 14 nt, Human
ucaaauucuucuga

SEQ ID NO: 1403181 - RNA, 13 nt, Human
ucaaauucaaaua

SEQ ID NO: 1403182 - RNA, 19 nt, Human
ucaaauggggccagaucca

SEQ ID NO: 1403183 - RNA, 18 nt, Human
ucaaauggggccagaucc

SEQ ID NO: 1403184 - RNA, 22 nt, Human
ucaaaugaguaacauuugcugu

SEQ ID NO: 1403185 - RNA, 16 nt, Human
ucaaaugaguaacauu

SEQ ID NO: 1403186 - RNA, 15 nt, Human
ucaaauccuugaaga

SEQ ID NO: 1403187 - RNA, 19 nt, Human
ucaaaacagauuguuugca

SEQ ID NO: 1403188 - RNA, 16 nt, Human
ucaaaacagauuguuu

SEQ ID NO: 1403189 - RNA, 14 nt, Human
ucaaaacagauugu

SEQ ID NO: 1403190 - RNA, 24 nt, Human
ucaaaacacuuguaauuuuguauc

SEQ ID NO: 1403191 - RNA, 17 nt, Human
ucaaaacacuuguaauu

SEQ ID NO: 1403192 - RNA, 14 nt, Human
ucaaaacacuugua

SEQ ID NO: 1403193 - RNA, 16 nt, Human
ucaaaacaaaggccua

SEQ ID NO: 1403194 - RNA, 12 nt, Human
ucaaaaauuaaa

SEQ ID NO: 1403195 - RNA, 20 nt, Human
ucaaaaauuaucuauagcua

SEQ ID NO: 1403196 - RNA, 23 nt, Human
ucaaaaauuaaaccggaccaucu

SEQ ID NO: 1403197 - RNA, 14 nt, Human
ucaaagaaggcauu

SEQ ID NO: 1403198 - RNA, 22 nt, Human
ucaaauauauucagccuggcuu

SEQ ID NO: 1403199 - RNA, 23 nt, Human
ucaaauauauucagccuggcuuc

SEQ ID NO: 1403200 - RNA, 20 nt, Human
ucaaaucaaucuguaaaacu

SEQ ID NO: 1403201 - RNA, 15 nt, Human
uauuaaugcccagac

SEQ ID NO: 1403202 - RNA, 20 nt, Human
uauuaaugcacuuucuaucc

SEQ ID NO: 1403203 - RNA, 17 nt, Human
uauuaaugcacuuucua

SEQ ID NO: 1403204 - RNA, 14 nt, Human
uauuaaugcacuuu

SEQ ID NO: 1403205 - RNA, 13 nt, Human
uauuaaugcacuu

SEQ ID NO: 1403206 - RNA, 12 nt, Human
uauuaaugcacu

SEQ ID NO: 1403207 - RNA, 13 nt, Human
uauuaaugaaaau

SEQ ID NO: 1403208 - RNA, 18 nt, Human
uauuaaucuuaguguaug

SEQ ID NO: 1403209 - RNA, 17 nt, Human
uauuaaucuuaguguau

SEQ ID NO: 1403210 - RNA, 14 nt, Human
uauuaaucuuagug

SEQ ID NO: 1403211 - RNA, 22 nt, Human
uauuaauauauauuaucuuuuc

SEQ ID NO: 1403212 - RNA, 23 nt, Human
uauuaauauauauuaucuuuuca

SEQ ID NO: 1403213 - RNA, 18 nt, Human
uauuaauauauauuaucu

SEQ ID NO: 1403214 - RNA, 14 nt, Human
uauuaagaaaggaa

SEQ ID NO: 1403215 - RNA, 13 nt, Human
uauuaagaaagga

SEQ ID NO: 1403216 - RNA, 12 nt, Human
uauuaagaaagg

SEQ ID NO: 1403217 - RNA, 23 nt, Human
uauuaaauuuuuuguugacauua

SEQ ID NO: 1403218 - RNA, 24 nt, Human
uauuaagaaaggaagcauuguaaa

SEQ ID NO: 1403219 - RNA, 23 nt, Human
uauuaagaaaggaagcauuguaa

SEQ ID NO: 1403220 - RNA, 21 nt, Human
uauuaagaaaggaagcauugu

SEQ ID NO: 1403221 - RNA, 20 nt, Human
uauuaagaaaggaagcauug

SEQ ID NO: 1403222 - RNA, 20 nt, Human
uauuaaauuuuuuguugaca

SEQ ID NO: 1403223 - RNA, 19 nt, Human
uauuaaauuuuuuguugac

SEQ ID NO: 1403224 - RNA, 22 nt, Human
uauuaaauuuuuuaaaaagcaa

SEQ ID NO: 1403225 - RNA, 20 nt, Human
uauuaaauuuuuuaaaaagc

SEQ ID NO: 1403226 - RNA, 16 nt, Human
uauguugcauagaaua

SEQ ID NO: 1403227 - RNA, 21 nt, Human
uauguauuauuuacauuuaau

SEQ ID NO: 1403228 - RNA, 19 nt, Human
uauguauuauuuacauuua

SEQ ID NO: 1403229 - RNA, 21 nt, Human
uauguauugugcaauguguau

SEQ ID NO: 1403230 - RNA, 20 nt, Human
uauguauugugcaaugugua

SEQ ID NO: 1403231 - RNA, 17 nt, Human
uauguauugugcaaugu

SEQ ID NO: 1403232 - RNA, 15 nt, Human
uauguauugugcaau

SEQ ID NO: 1403233 - RNA, 12 nt, Human
uauguauuuaua

SEQ ID NO: 1403234 - RNA, 16 nt, Human
uaugucauuucauuuc

SEQ ID NO: 1403235 - RNA, 12 nt, Human
uauguugcauag

SEQ ID NO: 1403236 - RNA, 20 nt, Human
uauggcaaccauuauaaccu

SEQ ID NO: 1403237 - RNA, 16 nt, Human
uauggauucuaaaaug

SEQ ID NO: 1403238 - RNA, 13 nt, Human
uauguaaaacauu

SEQ ID NO: 1403239 - RNA, 22 nt, Human
uaugguuuuugagauauuaaug

SEQ ID NO: 1403240 - RNA, 17 nt, Human
uaugguggauccaaacu

SEQ ID NO: 1403241 - RNA, 23 nt, Human
uauggugcucugucuacuugcuc

SEQ ID NO: 1403242 - RNA, 15 nt, Human
uauggugcucugucu

SEQ ID NO: 1403243 - RNA, 15 nt, Human
uauggauucuaaaau

SEQ ID NO: 1403244 - RNA, 14 nt, Human
uauggauucuaaaa

SEQ ID NO: 1403245 - RNA, 13 nt, Human
uauggauucuaaa

SEQ ID NO: 1403246 - RNA, 15 nt, Human
uauggauguccccag

SEQ ID NO: 1403247 - RNA, 16 nt, Human
uauggauguccccagc

SEQ ID NO: 1403248 - RNA, 15 nt, Human
uauguaaaacauuua

SEQ ID NO: 1403249 - RNA, 15 nt, Human
uauguaaauuaugua

SEQ ID NO: 1403250 - RNA, 21 nt, Human
uauguaaaugguaugucauuc

SEQ ID NO: 1403251 - RNA, 20 nt, Human
uauguaaaugguaugucauu

SEQ ID NO: 1403252 - RNA, 17 nt, Human
uauguauggugcaaugu

SEQ ID NO: 1403253 - RNA, 23 nt, Human
uauguauggguaggguaaaucag

SEQ ID NO: 1403254 - RNA, 22 nt, Human
uauguauggguaggguaaauca

SEQ ID NO: 1403255 - RNA, 20 nt, Human
uauguaguaauugacaugug

SEQ ID NO: 1403256 - RNA, 17 nt, Human
uauguaguaauugacau

SEQ ID NO: 1403257 - RNA, 14 nt, Human
uauguaguaauuga

SEQ ID NO: 1403258 - RNA, 15 nt, Human
uauguagcucuuugu

SEQ ID NO: 1403259 - RNA, 15 nt, Human
uauguagcaaaauac

SEQ ID NO: 1403260 - RNA, 14 nt, Human
uauguagauaacaa

SEQ ID NO: 1403261 - RNA, 23 nt, Human
uauguagaaaaaaguaaauguga

SEQ ID NO: 1403262 - RNA, 14 nt, Human
uauguaccaagaau

SEQ ID NO: 1403263 - RNA, 15 nt, Human
uauguacaugagaag

SEQ ID NO: 1403264 - RNA, 12 nt, Human
uauguacaguua

SEQ ID NO: 1403265 - RNA, 12 nt, Human
uauguaacaugu

SEQ ID NO: 1403266 - RNA, 11 nt, Human
uauguaacaug

SEQ ID NO: 1403267 - RNA, 20 nt, Human
uauguacccucugaaauaca

SEQ ID NO: 1403268 - RNA, 19 nt, Human
uauguacccucugaaauac

SEQ ID NO: 1403269 - RNA, 18 nt, Human
uauguacccucugaaaua

SEQ ID NO: 1403270 - RNA, 16 nt, Human
uauguacccucugaaa

SEQ ID NO: 1403271 - RNA, 10 nt, Human
uauguaccaa

SEQ ID NO: 1403272 - RNA, 16 nt, Human
uauguaccauguacau

SEQ ID NO: 1403273 - RNA, 17 nt, Human
uauguacuucaugcugu

SEQ ID NO: 1403274 - RNA, 13 nt, Human
uauguacuucaug

SEQ ID NO: 1403275 - RNA, 14 nt, Human
uauugcuagagcuc

SEQ ID NO: 1403276 - RNA, 13 nt, Human
uauugccucacuu

SEQ ID NO: 1403277 - RNA, 16 nt, Human
uauucuccuccucccu

SEQ ID NO: 1403278 - RNA, 18 nt, Human
uauucucuccuguaccuc

SEQ ID NO: 1403279 - RNA, 16 nt, Human
uauucuccuauguuug

SEQ ID NO: 1403280 - RNA, 17 nt, Human
uauucucuccuguaccu

SEQ ID NO: 1403281 - RNA, 16 nt, Human
uauuguguuuguguau

SEQ ID NO: 1403282 - RNA, 21 nt, Human
uauuguguuugucauuagccu

SEQ ID NO: 1403283 - RNA, 17 nt, Human
uauuguguuugucauua

SEQ ID NO: 1403284 - RNA, 18 nt, Human
uauuguguuugucauuag

SEQ ID NO: 1403285 - RNA, 14 nt, Human
uauuguguuuguca

SEQ ID NO: 1403286 - RNA, 16 nt, Human
uauuguguuugucauu

SEQ ID NO: 1403287 - RNA, 19 nt, Human
uauuggccaaggaaaggca

SEQ ID NO: 1403288 - RNA, 17 nt, Human
uauuggacaaagaaccu

SEQ ID NO: 1403289 - RNA, 15 nt, Human
uauuggaacuugcga

SEQ ID NO: 1403290 - RNA, 16 nt, Human
uauuggaauauaauug

SEQ ID NO: 1403291 - RNA, 20 nt, Human
uauugcuagagcuccucccu

SEQ ID NO: 1403292 - RNA, 16 nt, Human
uauugcuagagcuccu

SEQ ID NO: 1403293 - RNA, 15 nt, Human
uauugcuagagcucc

SEQ ID NO: 1403294 - RNA, 17 nt, Human
uauuguucagcaugcaa

SEQ ID NO: 1403295 - RNA, 22 nt, Human
uauuguuacguagccuaaggcu

SEQ ID NO: 1403296 - RNA, 14 nt, Human
uauuguuuuacaau

SEQ ID NO: 1403297 - RNA, 15 nt, Human
uauuguuuuacaaua

SEQ ID NO: 1403298 - RNA, 17 nt, Human
uauuguuuuacaauagu

SEQ ID NO: 1403299 - RNA, 20 nt, Human
uauuguuuuacaauaguucu

SEQ ID NO: 1403300 - RNA, 22 nt, Human
uauuguuuuacaauaguucugu

SEQ ID NO: 1403301 - RNA, 21 nt, Human
uauuuaaaauagcaaaagaag

SEQ ID NO: 1403302 - RNA, 23 nt, Human
uauuuaaaauagcaaaagaagaa

SEQ ID NO: 1403303 - RNA, 15 nt, Human
uauuuaaaauagcaa

SEQ ID NO: 1403304 - RNA, 14 nt, Human
uauuuaaaauagca

SEQ ID NO: 1403305 - RNA, 15 nt, Human
uauuuaaaaguguca

SEQ ID NO: 1403306 - RNA, 13 nt, Human
uauuuaaaacuug

SEQ ID NO: 1403307 - RNA, 12 nt, Human
uauuuaaaacuu

SEQ ID NO: 1403308 - RNA, 23 nt, Human
uauuuaaaaauaagucaacagua

SEQ ID NO: 1403309 - RNA, 17 nt, Human
uauuuaaaaauaaguca

SEQ ID NO: 1403310 - RNA, 13 nt, Human
uauuuaaaaauaa

SEQ ID NO: 1403311 - RNA, 20 nt, Human
uauuuaaaaaacuaaaaacu

SEQ ID NO: 1403312 - RNA, 21 nt, Human
uauuuaaaaaacuaaaaacua

SEQ ID NO: 1403313 - RNA, 16 nt, Human
uauuuaaaaaacuaaa

SEQ ID NO: 1403314 - RNA, 14 nt, Human
uauuuaaaaaacua

SEQ ID NO: 1403315 - RNA, 24 nt, Human
uauuuaaacucuguugcaagugca

SEQ ID NO: 1403316 - RNA, 21 nt, Human
uauuuaaaccgcuaaaagaaa

SEQ ID NO: 1403317 - RNA, 24 nt, Human
uauuuauaaaaauaaaaaacacug

SEQ ID NO: 1403318 - RNA, 19 nt, Human
uauuuauaaauauauuuaa

SEQ ID NO: 1403319 - RNA, 17 nt, Human
uauuuauaaauauauuu

SEQ ID NO: 1403320 - RNA, 16 nt, Human
uauuuauaaauauauu

SEQ ID NO: 1403321 - RNA, 19 nt, Human
uauuuaaaccgcuaaaaga

SEQ ID NO: 1403322 - RNA, 22 nt, Human
uauuuaguuguaaaccaaguga

SEQ ID NO: 1403323 - RNA, 22 nt, Human
uauuccagcuguccccccacuc

SEQ ID NO: 1403324 - RNA, 17 nt, Human
uauuccagcuguccccc

SEQ ID NO: 1403325 - RNA, 23 nt, Human
uauuccagaaugcuguacaucua

SEQ ID NO: 1403326 - RNA, 21 nt, Human
uauuccagaaugcuguacauc

SEQ ID NO: 1403327 - RNA, 20 nt, Human
uauuccagaaugcuguacau

SEQ ID NO: 1403328 - RNA, 17 nt, Human
uauuccagaaugcugua

SEQ ID NO: 1403329 - RNA, 16 nt, Human
uauuccagaaugcugu

SEQ ID NO: 1403330 - RNA, 19 nt, Human
uauuccaagacaugucugu

SEQ ID NO: 1403331 - RNA, 15 nt, Human
uauuccaugacugcu

SEQ ID NO: 1403332 - RNA, 14 nt, Human
uauuccaugacugc

SEQ ID NO: 1403333 - RNA, 12 nt, Human
uauuccaugacu

SEQ ID NO: 1403334 - RNA, 17 nt, Human
uauuccccauucuuccu

SEQ ID NO: 1403335 - RNA, 16 nt, Human
uauuccaugacugcuu

SEQ ID NO: 1403336 - RNA, 23 nt, Human
uauuccaugacugcuugcccuaa

SEQ ID NO: 1403337 - RNA, 21 nt, Human
uauuaauuuuaguuuuucauu

SEQ ID NO: 1403338 - RNA, 14 nt, Human
uauuaauuuuaguu

SEQ ID NO: 1403339 - RNA, 17 nt, Human
uauuaauuuaugcagaa

SEQ ID NO: 1403340 - RNA, 14 nt, Human
uauuacaaugauca

SEQ ID NO: 1403341 - RNA, 19 nt, Human
uauuacacucuguaauuga

SEQ ID NO: 1403342 - RNA, 16 nt, Human
uauuacacucuguaau

SEQ ID NO: 1403343 - RNA, 15 nt, Human
uauuacaaugaucac

SEQ ID NO: 1403344 - RNA, 15 nt, Human
uauuauuauaaucuu

SEQ ID NO: 1403345 - RNA, 22 nt, Human
uauuauuauaaucuuauaauug

SEQ ID NO: 1403346 - RNA, 19 nt, Human
uauuauuaguuuugauuua

SEQ ID NO: 1403347 - RNA, 12 nt, Human
uauuauuagggc

SEQ ID NO: 1403348 - RNA, 17 nt, Human
uauuauuacuuguaaau

SEQ ID NO: 1403349 - RNA, 18 nt, Human
uauuauuacuuguaaaua

SEQ ID NO: 1403350 - RNA, 14 nt, Human
uauuauuacuugua

SEQ ID NO: 1403351 - RNA, 19 nt, Human
uauuauuacuuauuuuuga

SEQ ID NO: 1403352 - RNA, 17 nt, Human
uauuauuaacauaccua

SEQ ID NO: 1403353 - RNA, 20 nt, Human
uauucgccacacaguauuuu

SEQ ID NO: 1403354 - RNA, 19 nt, Human
uauucgccacacaguauuu

SEQ ID NO: 1403355 - RNA, 22 nt, Human
uauucgauacugcgacuuucug

SEQ ID NO: 1403356 - RNA, 22 nt, Human
uauuccugaccuccgccaucca

SEQ ID NO: 1403357 - RNA, 18 nt, Human
uauuccuccugcucauau

SEQ ID NO: 1403358 - RNA, 16 nt, Human
uauuccucaaaaaauu

SEQ ID NO: 1403359 - RNA, 14 nt, Human
uauuccuauugugc

SEQ ID NO: 1403360 - RNA, 21 nt, Human
uauucccuagaaacuuccaaa

SEQ ID NO: 1403361 - RNA, 20 nt, Human
uauucuauuacauuuucagu

SEQ ID NO: 1403362 - RNA, 23 nt, Human
uauucuaagacuuacucuaagau

SEQ ID NO: 1403363 - RNA, 22 nt, Human
uauucuaagacuuacucuaaga

SEQ ID NO: 1403364 - RNA, 21 nt, Human
uauucuaagacuuacucuaag

SEQ ID NO: 1403365 - RNA, 13 nt, Human
uauucuaagacuu

SEQ ID NO: 1403366 - RNA, 12 nt, Human
uauucuaagacu

SEQ ID NO: 1403367 - RNA, 11 nt, Human
uauucuaagac

SEQ ID NO: 1403368 - RNA, 17 nt, Human
uauucguuaucuaauag

SEQ ID NO: 1403369 - RNA, 22 nt, Human
uccuaauaauaucccacuggga

SEQ ID NO: 1403370 - RNA, 19 nt, Human
uccuaauaauaucccacug

SEQ ID NO: 1403371 - RNA, 18 nt, Human
uccuaauaaaguucugua

SEQ ID NO: 1403372 - RNA, 15 nt, Human
uccuaauacugucau

SEQ ID NO: 1403373 - RNA, 14 nt, Human
uccuaauacuguca

SEQ ID NO: 1403374 - RNA, 14 nt, Human
uccuaccaagucaa

SEQ ID NO: 1403375 - RNA, 22 nt, Human
uccucaucccguguucuccuuu

SEQ ID NO: 1403376 - RNA, 14 nt, Human
uccucaucccgugu

SEQ ID NO: 1403377 - RNA, 17 nt, Human
uccucaugaauguaaau

SEQ ID NO: 1403378 - RNA, 15 nt, Human
uccucaugaauguaa

SEQ ID NO: 1403379 - RNA, 14 nt, Human
uccucaugaaugua

SEQ ID NO: 1403380 - RNA, 11 nt, Human
uccuauguuug

SEQ ID NO: 1403381 - RNA, 19 nt, Human
uccuauguuuuuguucaaa

SEQ ID NO: 1403382 - RNA, 18 nt, Human
uccuauguuuuuguucaa

SEQ ID NO: 1403383 - RNA, 16 nt, Human
uccuaguucuucaucc

SEQ ID NO: 1403384 - RNA, 18 nt, Human
uccuaguucuguagaaau

SEQ ID NO: 1403385 - RNA, 19 nt, Human
uccuaguucuguagaaaug

SEQ ID NO: 1403386 - RNA, 22 nt, Human
uccuaguucuagaaaaacaggc

SEQ ID NO: 1403387 - RNA, 16 nt, Human
uccuaguucuguagaa

SEQ ID NO: 1403388 - RNA, 17 nt, Human
uccuaguucuguagaaa

SEQ ID NO: 1403389 - RNA, 18 nt, Human
uccuaguucuagaaaaac

SEQ ID NO: 1403390 - RNA, 17 nt, Human
uccuaguucuagaaaaa

SEQ ID NO: 1403391 - RNA, 16 nt, Human
uccuaguucuagaaaa

SEQ ID NO: 1403392 - RNA, 15 nt, Human
uccuaguucuagaaa

SEQ ID NO: 1403393 - RNA, 13 nt, Human
uccuaguucuaga

SEQ ID NO: 1403394 - RNA, 13 nt, Human
uccuaguuuucuc

SEQ ID NO: 1403395 - RNA, 20 nt, Human
uccuaguuuucuccucccag

SEQ ID NO: 1403396 - RNA, 19 nt, Human
uccuaguucuagaaaaaca

SEQ ID NO: 1403397 - RNA, 23 nt, Human
uccuaguucuguagaaaugguug

SEQ ID NO: 1403398 - RNA, 19 nt, Human
uccuauacgcagcgugcuu

SEQ ID NO: 1403399 - RNA, 18 nt, Human
uccuauacgcagcgugcu

SEQ ID NO: 1403400 - RNA, 13 nt, Human
uccuccuucuuca

SEQ ID NO: 1403401 - RNA, 16 nt, Human
uccuccuguauuccug

SEQ ID NO: 1403402 - RNA, 22 nt, Human
uccuccugggcccucucugcuc

SEQ ID NO: 1403403 - RNA, 20 nt, Human
uccuccugggcccucucugc

SEQ ID NO: 1403404 - RNA, 20 nt, Human
uccucaugaauguaaauuug

SEQ ID NO: 1403405 - RNA, 23 nt, Human
uccuccacguucugcucaucauu

SEQ ID NO: 1403406 - RNA, 22 nt, Human
uccuccacguucugcucaucau

SEQ ID NO: 1403407 - RNA, 21 nt, Human
uccuccacguucugcucauca

SEQ ID NO: 1403408 - RNA, 21 nt, Human
uccucaugaauguaaauuugu

SEQ ID NO: 1403409 - RNA, 18 nt, Human
uccucuacuaacaaucag

SEQ ID NO: 1403410 - RNA, 17 nt, Human
uccucuacuaacaauca

SEQ ID NO: 1403411 - RNA, 16 nt, Human
uccucuaacuuggcuc

SEQ ID NO: 1403412 - RNA, 16 nt, Human
uccucguuuguguucu

SEQ ID NO: 1403413 - RNA, 15 nt, Human
uccucguuuguguuc

SEQ ID NO: 1403414 - RNA, 14 nt, Human
uccucguuuguguu

SEQ ID NO: 1403415 - RNA, 13 nt, Human
uccucguuugugu

SEQ ID NO: 1403416 - RNA, 19 nt, Human
uccucuacuaacaaucagc

SEQ ID NO: 1403417 - RNA, 24 nt, Human
uccucgccugacaaccacuggucu

SEQ ID NO: 1403418 - RNA, 15 nt, Human
uccucgccugacaac

SEQ ID NO: 1403419 - RNA, 13 nt, Human
uccucgccugaca

SEQ ID NO: 1403420 - RNA, 21 nt, Human
uccucuagcugugggggugag

SEQ ID NO: 1403421 - RNA, 15 nt, Human
uccucuagcuguggg

SEQ ID NO: 1403422 - RNA, 14 nt, Human
uccucuucccucuc

SEQ ID NO: 1403423 - RNA, 18 nt, Human
uccucuucccucucugca

SEQ ID NO: 1403424 - RNA, 18 nt, Human
uccucuuccccagacgcc

SEQ ID NO: 1403425 - RNA, 17 nt, Human
uccucuucccccaagau

SEQ ID NO: 1403426 - RNA, 14 nt, Human
uccucuuccccaga

SEQ ID NO: 1403427 - RNA, 13 nt, Human
uccucuuccccag

SEQ ID NO: 1403428 - RNA, 12 nt, Human
uccucuucccca

SEQ ID NO: 1403429 - RNA, 23 nt, Human
uccucuucuacucacuuuuccca

SEQ ID NO: 1403430 - RNA, 19 nt, Human
uccucuucuauuuuguaaa

SEQ ID NO: 1403431 - RNA, 22 nt, Human
uccucuucuacucacuuuuccc

SEQ ID NO: 1403432 - RNA, 20 nt, Human
uccucuucuacucacuuuuc

SEQ ID NO: 1403433 - RNA, 23 nt, Human
ucccugcacagugacuucugaga

SEQ ID NO: 1403434 - RNA, 22 nt, Human
ucccugcacagugacuucugag

SEQ ID NO: 1403435 - RNA, 20 nt, Human
ucccugcacagugacuucug

SEQ ID NO: 1403436 - RNA, 17 nt, Human
ucccugcacagugacuu

SEQ ID NO: 1403437 - RNA, 15 nt, Human
ucccucucucacucc

SEQ ID NO: 1403438 - RNA, 14 nt, Human
ucccucucguaaga

SEQ ID NO: 1403439 - RNA, 16 nt, Human
ucccucucucauaccc

SEQ ID NO: 1403440 - RNA, 18 nt, Human
ucccugccuccugccggc

SEQ ID NO: 1403441 - RNA, 16 nt, Human
ucccugccuccugccg

SEQ ID NO: 1403442 - RNA, 13 nt, Human
ucccugccuccug

SEQ ID NO: 1403443 - RNA, 23 nt, Human
ucccugccucucaucaacugaau

SEQ ID NO: 1403444 - RNA, 17 nt, Human
ucccugccucucaucaa

SEQ ID NO: 1403445 - RNA, 13 nt, Human
ucccugccuggac

SEQ ID NO: 1403446 - RNA, 20 nt, Human
ucccuggaaaccuuccaccc

SEQ ID NO: 1403447 - RNA, 22 nt, Human
ucccuggaaaccuuccacccag

SEQ ID NO: 1403448 - RNA, 22 nt, Human
ucccuggaaugaguugaggcca

SEQ ID NO: 1403449 - RNA, 18 nt, Human
ucccuggaaggacaucca

SEQ ID NO: 1403450 - RNA, 23 nt, Human
ucccuggaaaccuuccacccagu

SEQ ID NO: 1403451 - RNA, 19 nt, Human
ucccuuccuuccucuccug

SEQ ID NO: 1403452 - RNA, 16 nt, Human
ucccuuccuuccucuc

SEQ ID NO: 1403453 - RNA, 20 nt, Human
ucccuggaugacauuaaaga

SEQ ID NO: 1403454 - RNA, 18 nt, Human
ucccuggaugacauuaaa

SEQ ID NO: 1403455 - RNA, 20 nt, Human
ucccuggaaugaguugaggc

SEQ ID NO: 1403456 - RNA, 19 nt, Human
ucccugcuuuuuguguuuu

SEQ ID NO: 1403457 - RNA, 20 nt, Human
ucccuggcccccucccugga

SEQ ID NO: 1403458 - RNA, 18 nt, Human
ucccuggcccccucccug

SEQ ID NO: 1403459 - RNA, 21 nt, Human
ucccuucaucuggaaccauca

SEQ ID NO: 1403460 - RNA, 17 nt, Human
ucccuucaugcauggaa

SEQ ID NO: 1403461 - RNA, 18 nt, Human
ucccuucaugcauggaaa

SEQ ID NO: 1403462 - RNA, 16 nt, Human
ucccuugaugaagaag

SEQ ID NO: 1403463 - RNA, 14 nt, Human
ucccuugagcccuc

SEQ ID NO: 1403464 - RNA, 19 nt, Human
ucccuuccugccagccccu

SEQ ID NO: 1403465 - RNA, 15 nt, Human
ucccuugaugaagaa

SEQ ID NO: 1403466 - RNA, 22 nt, Human
uccccuuauccucccuguaacu

SEQ ID NO: 1403467 - RNA, 20 nt, Human
uccccuuauccucccuguaa

SEQ ID NO: 1403468 - RNA, 23 nt, Human
uccccuuauccucccuguaacuu

SEQ ID NO: 1403469 - RNA, 13 nt, Human
uccccuucacucc

SEQ ID NO: 1403470 - RNA, 19 nt, Human
uccccuuauccucccugua

SEQ ID NO: 1403471 - RNA, 18 nt, Human
uccccuuauccucccugu

SEQ ID NO: 1403472 - RNA, 17 nt, Human
uccccuuauccucccug

SEQ ID NO: 1403473 - RNA, 13 nt, Human
uccccuuauccuc

SEQ ID NO: 1403474 - RNA, 20 nt, Human
uccagguucccucccagagg

SEQ ID NO: 1403475 - RNA, 18 nt, Human
uccagguucccucccaga

SEQ ID NO: 1403476 - RNA, 17 nt, Human
uccagguucccucccag

SEQ ID NO: 1403477 - RNA, 18 nt, Human
uccagguguuacuguaau

SEQ ID NO: 1403478 - RNA, 20 nt, Human
ucccgucaccccuguuucug

SEQ ID NO: 1403479 - RNA, 16 nt, Human
ucccggggccagcacu

SEQ ID NO: 1403480 - RNA, 21 nt, Human
ucccggggccagcacuuccau

SEQ ID NO: 1403481 - RNA, 20 nt, Human
ucccguuucuccaccuagac

SEQ ID NO: 1403482 - RNA, 15 nt, Human
ucccguguucuccuu

SEQ ID NO: 1403483 - RNA, 15 nt, Human
ucccuaauaaagcug

SEQ ID NO: 1403484 - RNA, 17 nt, Human
ucccuauacugcuugga

SEQ ID NO: 1403485 - RNA, 15 nt, Human
ucccuauacugcuug

SEQ ID NO: 1403486 - RNA, 14 nt, Human
ucccuauacugcuu

SEQ ID NO: 1403487 - RNA, 16 nt, Human
ucccuauccaaucaau

SEQ ID NO: 1403488 - RNA, 14 nt, Human
ucccuauggaaaga

SEQ ID NO: 1403489 - RNA, 21 nt, Human
ucccuaucacugaagcuuuuu

SEQ ID NO: 1403490 - RNA, 20 nt, Human
ucccuaucacugaagcuuuu

SEQ ID NO: 1403491 - RNA, 19 nt, Human
ucccuaucuuugccacccu

SEQ ID NO: 1403492 - RNA, 23 nt, Human
ucccuagguguuuuguucaccau

SEQ ID NO: 1403493 - RNA, 24 nt, Human
ucccuacauguauugcacauugua

SEQ ID NO: 1403494 - RNA, 13 nt, Human
ucccuacauguau

SEQ ID NO: 1403495 - RNA, 14 nt, Human
ucccuaauguguuu

SEQ ID NO: 1403496 - RNA, 23 nt, Human
ucccuaaucuauggucgggagac

SEQ ID NO: 1403497 - RNA, 16 nt, Human
ucccuaaucuaugguc

SEQ ID NO: 1403498 - RNA, 16 nt, Human
ucccuaauaaagcugu

SEQ ID NO: 1403499 - RNA, 14 nt, Human
ucccuccuguuggg

SEQ ID NO: 1403500 - RNA, 22 nt, Human
ucccucuacagagcuucccuga

SEQ ID NO: 1403501 - RNA, 21 nt, Human
ucccucuacagagcuucccug

SEQ ID NO: 1403502 - RNA, 21 nt, Human
ucccucucccaggccccauga

SEQ ID NO: 1403503 - RNA, 20 nt, Human
ucccucucccaggccccaug

SEQ ID NO: 1403504 - RNA, 17 nt, Human
ucccucucccaggcccc

SEQ ID NO: 1403505 - RNA, 16 nt, Human
ucccuccucugcccgg

SEQ ID NO: 1403506 - RNA, 11 nt, Human
ucccuccuggg

SEQ ID NO: 1403507 - RNA, 19 nt, Human
ucccuccugggaaugaagc

SEQ ID NO: 1403508 - RNA, 21 nt, Human
uccugucgauuagacuggaca

SEQ ID NO: 1403509 - RNA, 17 nt, Human
uccugucgauuagacug

SEQ ID NO: 1403510 - RNA, 22 nt, Human
uccuguccuuuaccaaagauga

SEQ ID NO: 1403511 - RNA, 19 nt, Human
uccuguccuuuaccaaaga

SEQ ID NO: 1403512 - RNA, 19 nt, Human
uccugucggagcccugucu

SEQ ID NO: 1403513 - RNA, 22 nt, Human
uccugucggagcccugucuccu

SEQ ID NO: 1403514 - RNA, 20 nt, Human
uccuguccucuuucagcucc

SEQ ID NO: 1403515 - RNA, 21 nt, Human
uccuguccucuuucagcuccu

SEQ ID NO: 1403516 - RNA, 19 nt, Human
uccuguccucuuucagcuc

SEQ ID NO: 1403517 - RNA, 18 nt, Human
uccuguccucuuucagcu

SEQ ID NO: 1403518 - RNA, 17 nt, Human
uccuguccucuuucagc

SEQ ID NO: 1403519 - RNA, 15 nt, Human
uccuguccucuuuca

SEQ ID NO: 1403520 - RNA, 14 nt, Human
uccuguacauugug

SEQ ID NO: 1403521 - RNA, 20 nt, Human
uccuguacauugugggaugu

SEQ ID NO: 1403522 - RNA, 22 nt, Human
uccuguaccucuugagccuuga

SEQ ID NO: 1403523 - RNA, 20 nt, Human
uccuguaccucuugagccuu

SEQ ID NO: 1403524 - RNA, 19 nt, Human
uccugccuauuaucuguca

SEQ ID NO: 1403525 - RNA, 17 nt, Human
uccucuucugggccuga

SEQ ID NO: 1403526 - RNA, 13 nt, Human
uccucuucugggc

SEQ ID NO: 1403527 - RNA, 15 nt, Human
uccucuuccaugcug

SEQ ID NO: 1403528 - RNA, 19 nt, Human
uccugagcacugccaggag

SEQ ID NO: 1403529 - RNA, 18 nt, Human
uccugagcacugccagga

SEQ ID NO: 1403530 - RNA, 17 nt, Human
uccugagcacugccagg

SEQ ID NO: 1403531 - RNA, 16 nt, Human
uccugagcacugccag

SEQ ID NO: 1403532 - RNA, 15 nt, Human
uccugagcacugcca

SEQ ID NO: 1403533 - RNA, 14 nt, Human
uccugagcacugcc

SEQ ID NO: 1403534 - RNA, 13 nt, Human
uccugagcacugc

SEQ ID NO: 1403535 - RNA, 12 nt, Human
uccugagcacug

SEQ ID NO: 1403536 - RNA, 14 nt, Human
uccugccucagccu

SEQ ID NO: 1403537 - RNA, 23 nt, Human
uccugagcacugccaggagggac

SEQ ID NO: 1403538 - RNA, 22 nt, Human
uccugagcacugccaggaggga

SEQ ID NO: 1403539 - RNA, 21 nt, Human
uccugagcacugccaggaggg

SEQ ID NO: 1403540 - RNA, 20 nt, Human
uccugagcacugccaggagg

SEQ ID NO: 1403541 - RNA, 17 nt, Human
uccugccucagccuccc

SEQ ID NO: 1403542 - RNA, 17 nt, Human
uccuugcuuccugucuu

SEQ ID NO: 1403543 - RNA, 21 nt, Human
uccuugaaggacuaauagaaa

SEQ ID NO: 1403544 - RNA, 23 nt, Human
uccuugaagaacugcaggcccug

SEQ ID NO: 1403545 - RNA, 21 nt, Human
uccuugaagaacugcaggccc

SEQ ID NO: 1403546 - RNA, 20 nt, Human
uccuugaagaacugcaggcc

SEQ ID NO: 1403547 - RNA, 22 nt, Human
uccugucgauuagacuggacag

SEQ ID NO: 1403548 - RNA, 21 nt, Human
uccuuuucauaggucugaaau

SEQ ID NO: 1403549 - RNA, 20 nt, Human
uccuuuucauaggucugaaa

SEQ ID NO: 1403550 - RNA, 14 nt, Human
uccuuuucauaggu

SEQ ID NO: 1403551 - RNA, 16 nt, Human
ucgaaagcucuagaau

SEQ ID NO: 1403552 - RNA, 14 nt, Human
ucgaaagcucuaga

SEQ ID NO: 1403553 - RNA, 18 nt, Human
ucgaaacacagaaaccuu

SEQ ID NO: 1403554 - RNA, 15 nt, Human
uccuuuuccucucuc

SEQ ID NO: 1403555 - RNA, 19 nt, Human
ucgaaagcucuagaaucug

SEQ ID NO: 1403556 - RNA, 18 nt, Human
ucgaaccguuuugaagcu

SEQ ID NO: 1403557 - RNA, 15 nt, Human
ucgaaccguuuugaa

SEQ ID NO: 1403558 - RNA, 24 nt, Human
uccuuuguucuuaccuguaugucu

SEQ ID NO: 1403559 - RNA, 16 nt, Human
uccuuuguucuuaccu

SEQ ID NO: 1403560 - RNA, 14 nt, Human
uccuuuuaaagaaa

SEQ ID NO: 1403561 - RNA, 17 nt, Human
uccuuuuaauuuuccug

SEQ ID NO: 1403562 - RNA, 23 nt, Human
uccuuuuaaagaaaaaaauugaa

SEQ ID NO: 1403563 - RNA, 13 nt, Human
uccuuuuaaagaa

SEQ ID NO: 1403564 - RNA, 12 nt, Human
uccuuuuaaaga

SEQ ID NO: 1403565 - RNA, 21 nt, Human
uccuuggcaggcugauuucua

SEQ ID NO: 1403566 - RNA, 23 nt, Human
uccuuggcaggcugauuucuagg

SEQ ID NO: 1403567 - RNA, 10 nt, Human
uccuuuguuc

SEQ ID NO: 1403568 - RNA, 16 nt, Human
uccuuggccaugcaga

SEQ ID NO: 1403569 - RNA, 20 nt, Human
ucuaucaaccccagacacug

SEQ ID NO: 1403570 - RNA, 19 nt, Human
ucuaucaaccccagacacu

SEQ ID NO: 1403571 - RNA, 15 nt, Human
ucuaucaaguauuau

SEQ ID NO: 1403572 - RNA, 21 nt, Human
ucuaucaaguauuauaccuuu

SEQ ID NO: 1403573 - RNA, 22 nt, Human
ucuaucaaguauuauaccuuuu

SEQ ID NO: 1403574 - RNA, 18 nt, Human
ucuaugagucuagauguu

SEQ ID NO: 1403575 - RNA, 22 nt, Human
ucuaucaaccccagacacuggu

SEQ ID NO: 1403576 - RNA, 18 nt, Human
ucuaugaaauauuauguu

SEQ ID NO: 1403577 - RNA, 17 nt, Human
ucuaugaaauauuaugu

SEQ ID NO: 1403578 - RNA, 14 nt, Human
ucuaugaaauauua

SEQ ID NO: 1403579 - RNA, 16 nt, Human
ucucaaaggagcgagc

SEQ ID NO: 1403580 - RNA, 15 nt, Human
ucuaugcauuuucug

SEQ ID NO: 1403581 - RNA, 14 nt, Human
ucuaugcauuuucu

SEQ ID NO: 1403582 - RNA, 21 nt, Human
ucuaucaaccccagacacugg

SEQ ID NO: 1403583 - RNA, 13 nt, Human
ucuaugccugucu

SEQ ID NO: 1403584 - RNA, 22 nt, Human
ucuagaaaaacaggcacuuggc

SEQ ID NO: 1403585 - RNA, 18 nt, Human
ucuagaaaaacaggcacu

SEQ ID NO: 1403586 - RNA, 17 nt, Human
ucuagaaaaacaggcac

SEQ ID NO: 1403587 - RNA, 16 nt, Human
ucuagaaaaacaggca

SEQ ID NO: 1403588 - RNA, 20 nt, Human
ucuacuuugaagucauacca

SEQ ID NO: 1403589 - RNA, 12 nt, Human
ucuacuuugaag

SEQ ID NO: 1403590 - RNA, 19 nt, Human
ucuaauucuauuaaagugc

SEQ ID NO: 1403591 - RNA, 21 nt, Human
ucuaauuauguagcucuuugu

SEQ ID NO: 1403592 - RNA, 16 nt, Human
ucuaauucacagugcu

SEQ ID NO: 1403593 - RNA, 19 nt, Human
ucuaauuauguagcucuuu

SEQ ID NO: 1403594 - RNA, 18 nt, Human
ucuaauuauguagcucuu

SEQ ID NO: 1403595 - RNA, 17 nt, Human
ucuaauuaauuguaauc

SEQ ID NO: 1403596 - RNA, 15 nt, Human
ucuaauuaauuguaa

SEQ ID NO: 1403597 - RNA, 19 nt, Human
ucuagugagcagucaggaa

SEQ ID NO: 1403598 - RNA, 19 nt, Human
ucuaggagggagacacugg

SEQ ID NO: 1403599 - RNA, 22 nt, Human
ucuagugagcagucaggaaaga

SEQ ID NO: 1403600 - RNA, 16 nt, Human
ucuagaacacaggcaa

SEQ ID NO: 1403601 - RNA, 15 nt, Human
ucuagaacacaggca

SEQ ID NO: 1403602 - RNA, 13 nt, Human
ucuagaacacagg

SEQ ID NO: 1403603 - RNA, 19 nt, Human
ucuagaaagagaaacaguu

SEQ ID NO: 1403604 - RNA, 23 nt, Human
ucuaggaccaugguuaagagucc

SEQ ID NO: 1403605 - RNA, 16 nt, Human
ucuaggacugaauuau

SEQ ID NO: 1403606 - RNA, 23 nt, Human
ucuaggacugaauuaugaaacuu

SEQ ID NO: 1403607 - RNA, 15 nt, Human
ucggccugcccccac

SEQ ID NO: 1403608 - RNA, 14 nt, Human
ucggccugccccca

SEQ ID NO: 1403609 - RNA, 19 nt, Human
ucggccucccaaagugcug

SEQ ID NO: 1403610 - RNA, 20 nt, Human
ucgaggggugggcugguauc

SEQ ID NO: 1403611 - RNA, 15 nt, Human
ucgugagcucuugug

SEQ ID NO: 1403612 - RNA, 16 nt, Human
ucgugagcucuuguga

SEQ ID NO: 1403613 - RNA, 22 nt, Human
ucgugagcucuugugaggaaag

SEQ ID NO: 1403614 - RNA, 21 nt, Human
ucgugccuguguccaugcgcu

SEQ ID NO: 1403615 - RNA, 15 nt, Human
ucgugccugugucca

SEQ ID NO: 1403616 - RNA, 14 nt, Human
ucgugccugugucc

SEQ ID NO: 1403617 - RNA, 13 nt, Human
ucgugccuguguc

SEQ ID NO: 1403618 - RNA, 12 nt, Human
ucgugccugugu

SEQ ID NO: 1403619 - RNA, 22 nt, Human
ucgugggacagucaccucaugg

SEQ ID NO: 1403620 - RNA, 17 nt, Human
ucguggacacacacaga

SEQ ID NO: 1403621 - RNA, 21 nt, Human
ucguggaacaguuaccucugc

SEQ ID NO: 1403622 - RNA, 23 nt, Human
ucuaacagcccuccucugcacuc

SEQ ID NO: 1403623 - RNA, 22 nt, Human
ucuaacagcccuccucugcacu

SEQ ID NO: 1403624 - RNA, 21 nt, Human
ucuaacagcccuccucugcac

SEQ ID NO: 1403625 - RNA, 20 nt, Human
ucuaacagcccuccucugca

SEQ ID NO: 1403626 - RNA, 13 nt, Human
ucuaacagcccuc

SEQ ID NO: 1403627 - RNA, 12 nt, Human
ucuaacagcccu

SEQ ID NO: 1403628 - RNA, 22 nt, Human
ucuaacagcaccaaaucaaaau

SEQ ID NO: 1403629 - RNA, 14 nt, Human
ucuaacagcaccaa

SEQ ID NO: 1403630 - RNA, 13 nt, Human
ucuaacagcacca

SEQ ID NO: 1403631 - RNA, 13 nt, Human
ucuaacagauuag

SEQ ID NO: 1403632 - RNA, 13 nt, Human
ucuaacaaugaca

SEQ ID NO: 1403633 - RNA, 23 nt, Human
ucuaacaagucauagguuaauau

SEQ ID NO: 1403634 - RNA, 22 nt, Human
ucuaaaucuccaaaauaaaacu

SEQ ID NO: 1403635 - RNA, 14 nt, Human
ucuaauauggccac

SEQ ID NO: 1403636 - RNA, 16 nt, Human
ucuaauagggcaauua

SEQ ID NO: 1403637 - RNA, 22 nt, Human
ucuaauagggcaauuaauuccu

SEQ ID NO: 1403638 - RNA, 16 nt, Human
ucuaaauauggacugc

SEQ ID NO: 1403639 - RNA, 17 nt, Human
ucuaaauaaaaugcuag

SEQ ID NO: 1403640 - RNA, 15 nt, Human
ucuaaauaaaaugcu

SEQ ID NO: 1403641 - RNA, 21 nt, Human
ucuaaaucuccaaaauaaaac

SEQ ID NO: 1403642 - RNA, 18 nt, Human
ucguggggugugcuggga

SEQ ID NO: 1403643 - RNA, 15 nt, Human
ucguggggugugcug

SEQ ID NO: 1403644 - RNA, 12 nt, Human
ucguggggaggu

SEQ ID NO: 1403645 - RNA, 21 nt, Human
ucgugucuggcacagccuggc

SEQ ID NO: 1403646 - RNA, 14 nt, Human
ucgugucuggcaca

SEQ ID NO: 1403647 - RNA, 13 nt, Human
ucguuaauuugua

SEQ ID NO: 1403648 - RNA, 21 nt, Human
ucguguguuucuauuuuuuga

SEQ ID NO: 1403649 - RNA, 13 nt, Human
ucucuguugucgu

SEQ ID NO: 1403650 - RNA, 18 nt, Human
ucucuguugucguaaaga

SEQ ID NO: 1403651 - RNA, 18 nt, Human
ucucuguucauuuccuca

SEQ ID NO: 1403652 - RNA, 17 nt, Human
ucucuguucauuuccuc

SEQ ID NO: 1403653 - RNA, 16 nt, Human
ucucuguucauuuccu

SEQ ID NO: 1403654 - RNA, 14 nt, Human
ucucuguucauuuc

SEQ ID NO: 1403655 - RNA, 13 nt, Human
ucucuguucauuu

SEQ ID NO: 1403656 - RNA, 23 nt, Human
ucucugugucuaagauucuagau

SEQ ID NO: 1403657 - RNA, 10 nt, Human
ucucuguguu

SEQ ID NO: 1403658 - RNA, 18 nt, Human
ucucugugugcacaaaua

SEQ ID NO: 1403659 - RNA, 22 nt, Human
ucucugugucuaagauucuaga

SEQ ID NO: 1403660 - RNA, 21 nt, Human
ucucugugucuaagauucuag

SEQ ID NO: 1403661 - RNA, 20 nt, Human
ucucugugucuaagauucua

SEQ ID NO: 1403662 - RNA, 17 nt, Human
ucucugugucuaagauu

SEQ ID NO: 1403663 - RNA, 16 nt, Human
ucucugugucuaagau

SEQ ID NO: 1403664 - RNA, 15 nt, Human
ucucugugucuaaga

SEQ ID NO: 1403665 - RNA, 14 nt, Human
ucugaaaauauaac

SEQ ID NO: 1403666 - RNA, 13 nt, Human
ucugaaaauauaa

SEQ ID NO: 1403667 - RNA, 20 nt, Human
ucugaaaagugaagacagaa

SEQ ID NO: 1403668 - RNA, 19 nt, Human
ucugaaaagugaagacaga

SEQ ID NO: 1403669 - RNA, 18 nt, Human
ucugaaaagugaagacag

SEQ ID NO: 1403670 - RNA, 14 nt, Human
ucugaaaauugaug

SEQ ID NO: 1403671 - RNA, 12 nt, Human
ucugaaagagaa

SEQ ID NO: 1403672 - RNA, 20 nt, Human
ucugaaaccaguguuaggga

SEQ ID NO: 1403673 - RNA, 15 nt, Human
ucugaaaccaguguu

SEQ ID NO: 1403674 - RNA, 18 nt, Human
ucugaaaauauaaccagc

SEQ ID NO: 1403675 - RNA, 22 nt, Human
ucugaaaauugaugggauuugg

SEQ ID NO: 1403676 - RNA, 13 nt, Human
ucugacagccuca

SEQ ID NO: 1403677 - RNA, 12 nt, Human
ucugacagccuc

SEQ ID NO: 1403678 - RNA, 22 nt, Human
ucugacagcagcaucucuaccu

SEQ ID NO: 1403679 - RNA, 17 nt, Human
ucugacagcagcaucuc

SEQ ID NO: 1403680 - RNA, 14 nt, Human
ucugacagcagcau

SEQ ID NO: 1403681 - RNA, 13 nt, Human
ucugacagcagca

SEQ ID NO: 1403682 - RNA, 15 nt, Human
ucugacauaaguauu

SEQ ID NO: 1403683 - RNA, 14 nt, Human
ucugacagccucag

SEQ ID NO: 1403684 - RNA, 13 nt, Human
ucugacauaaucc

SEQ ID NO: 1403685 - RNA, 19 nt, Human
ucugacauaauccaguaaa

SEQ ID NO: 1403686 - RNA, 23 nt, Human
ucugacauaauccaguaaaauaa

SEQ ID NO: 1403687 - RNA, 13 nt, Human
ucugaacuaaagu

SEQ ID NO: 1403688 - RNA, 20 nt, Human
ucugaacagcugguguagcu

SEQ ID NO: 1403689 - RNA, 21 nt, Human
ucugaacagcugguguagcua

SEQ ID NO: 1403690 - RNA, 17 nt, Human
ucugaacagcuggugua

SEQ ID NO: 1403691 - RNA, 16 nt, Human
ucugaacagcuggugu

SEQ ID NO: 1403692 - RNA, 15 nt, Human
ucugaacagcuggug

SEQ ID NO: 1403693 - RNA, 14 nt, Human
ucugaacagcuggu

SEQ ID NO: 1403694 - RNA, 12 nt, Human
ucugaacagcug

SEQ ID NO: 1403695 - RNA, 15 nt, Human
ucugaacacgaagcu

SEQ ID NO: 1403696 - RNA, 13 nt, Human
ucugaacacauug

SEQ ID NO: 1403697 - RNA, 12 nt, Human
ucugaacacauu

SEQ ID NO: 1403698 - RNA, 20 nt, Human
ucugaaauuuuucuucuuga

SEQ ID NO: 1403699 - RNA, 17 nt, Human
ucugaaauuuuucuucu

SEQ ID NO: 1403700 - RNA, 15 nt, Human
ucugaaauuuuucuu

SEQ ID NO: 1403701 - RNA, 14 nt, Human
ucugaaauuuuucu

SEQ ID NO: 1403702 - RNA, 20 nt, Human
ucugaaauuuccugggagcu

SEQ ID NO: 1403703 - RNA, 18 nt, Human
ucugaaauuuccugggag

SEQ ID NO: 1403704 - RNA, 17 nt, Human
ucugaaauuuccuggga

SEQ ID NO: 1403705 - RNA, 21 nt, Human
ucugcauccucuggagccagc

SEQ ID NO: 1403706 - RNA, 14 nt, Human
ucugcauccucugg

SEQ ID NO: 1403707 - RNA, 19 nt, Human
ucugcauccucuggagcca

SEQ ID NO: 1403708 - RNA, 15 nt, Human
ucugccacccaggau

SEQ ID NO: 1403709 - RNA, 13 nt, Human
ucugccacccagg

SEQ ID NO: 1403710 - RNA, 17 nt, Human
ucugccaaccuaaaacu

SEQ ID NO: 1403711 - RNA, 18 nt, Human
ucugccaaccuaaaacuc

SEQ ID NO: 1403712 - RNA, 14 nt, Human
ucugccaaccuaaa

SEQ ID NO: 1403713 - RNA, 19 nt, Human
ucugccaaaggaugugaua

SEQ ID NO: 1403714 - RNA, 16 nt, Human
ucugcauucuaguacu

SEQ ID NO: 1403715 - RNA, 20 nt, Human
ucugaggccagccuggccuc

SEQ ID NO: 1403716 - RNA, 18 nt, Human
ucugaggccagccuggcc

SEQ ID NO: 1403717 - RNA, 17 nt, Human
ucugaggccagccuggc

SEQ ID NO: 1403718 - RNA, 16 nt, Human
ucugaggccagccugg

SEQ ID NO: 1403719 - RNA, 15 nt, Human
ucugaggccagccug

SEQ ID NO: 1403720 - RNA, 14 nt, Human
ucugaggccagccu

SEQ ID NO: 1403721 - RNA, 13 nt, Human
ucugaggccagcc

SEQ ID NO: 1403722 - RNA, 12 nt, Human
ucugaggccagc

SEQ ID NO: 1403723 - RNA, 22 nt, Human
ucugcacaucuguaaaucuaca

SEQ ID NO: 1403724 - RNA, 21 nt, Human
ucugaggcgccccaacccgug

SEQ ID NO: 1403725 - RNA, 19 nt, Human
ucugaggccagccuggccu

SEQ ID NO: 1403726 - RNA, 15 nt, Human
ucugcaacucugaag

SEQ ID NO: 1403727 - RNA, 14 nt, Human
ucugcaacucugaa

SEQ ID NO: 1403728 - RNA, 22 nt, Human
ucucuaggaccaugguuaagag

SEQ ID NO: 1403729 - RNA, 19 nt, Human
ucucuaacuucaccauauu

SEQ ID NO: 1403730 - RNA, 14 nt, Human
ucucuaacagugga

SEQ ID NO: 1403731 - RNA, 20 nt, Human
ucucuaacaguggacaaagu

SEQ ID NO: 1403732 - RNA, 12 nt, Human
ucucuaacuuca

SEQ ID NO: 1403733 - RNA, 21 nt, Human
ucucguccucguuuguguucu

SEQ ID NO: 1403734 - RNA, 14 nt, Human
ucucgucucuuuua

SEQ ID NO: 1403735 - RNA, 19 nt, Human
ucucguccucguuuguguu

SEQ ID NO: 1403736 - RNA, 18 nt, Human
ucuccuggcuucccaucc

SEQ ID NO: 1403737 - RNA, 21 nt, Human
ucucggcuccccauguguccu

SEQ ID NO: 1403738 - RNA, 15 nt, Human
ucuccuggcuuccca

SEQ ID NO: 1403739 - RNA, 13 nt, Human
ucuccuggcuucc

SEQ ID NO: 1403740 - RNA, 22 nt, Human
ucuccuggcuucccauccccag

SEQ ID NO: 1403741 - RNA, 19 nt, Human
ucuccuguaccucuugagc

SEQ ID NO: 1403742 - RNA, 16 nt, Human
ucuccuguaccucuug

SEQ ID NO: 1403743 - RNA, 17 nt, Human
ucuccuguaccucuuga

SEQ ID NO: 1403744 - RNA, 21 nt, Human
ucuccugcugcucccucagac

SEQ ID NO: 1403745 - RNA, 20 nt, Human
ucuccugcugcucccucaga

SEQ ID NO: 1403746 - RNA, 19 nt, Human
ucuccugcugcucccucag

SEQ ID NO: 1403747 - RNA, 18 nt, Human
ucuccugcugcucccuca

SEQ ID NO: 1403748 - RNA, 17 nt, Human
ucuccugcugcucccuc

SEQ ID NO: 1403749 - RNA, 14 nt, Human
ucuccugcugcucc

SEQ ID NO: 1403750 - RNA, 19 nt, Human
ucuccugccucagccuccc

SEQ ID NO: 1403751 - RNA, 12 nt, Human
ucuccuggcuuc

SEQ ID NO: 1403752 - RNA, 11 nt, Human
ucuccuggagg

SEQ ID NO: 1403753 - RNA, 15 nt, Human
ucuccuguaccucuu

SEQ ID NO: 1403754 - RNA, 21 nt, Human
ucuccuggaagugcuaauuuu

SEQ ID NO: 1403755 - RNA, 15 nt, Human
ucucaaguucuaaga

SEQ ID NO: 1403756 - RNA, 14 nt, Human
ucucaaguucuaag

SEQ ID NO: 1403757 - RNA, 13 nt, Human
ucucaaguucuaa

SEQ ID NO: 1403758 - RNA, 12 nt, Human
ucucaaguucua

SEQ ID NO: 1403759 - RNA, 15 nt, Human
ucucaagcucuuccu

SEQ ID NO: 1403760 - RNA, 13 nt, Human
ucucaagcccugc

SEQ ID NO: 1403761 - RNA, 15 nt, Human
ucucaagagcccugu

SEQ ID NO: 1403762 - RNA, 18 nt, Human
ucucaauauucaauaaag

SEQ ID NO: 1403763 - RNA, 13 nt, Human
ucucaaugcucau

SEQ ID NO: 1403764 - RNA, 20 nt, Human
ucucaaguucuaagauucua

SEQ ID NO: 1403765 - RNA, 18 nt, Human
ucucaaguucuaagauuc

SEQ ID NO: 1403766 - RNA, 17 nt, Human
ucucaaguucuaagauu

SEQ ID NO: 1403767 - RNA, 16 nt, Human
ucucaaguucuaagau

SEQ ID NO: 1403768 - RNA, 22 nt, Human
ucucaaguucuaagauucuaau

SEQ ID NO: 1403769 - RNA, 21 nt, Human
ucucaaguucuaagauucuaa

SEQ ID NO: 1403770 - RNA, 17 nt, Human
ucucaauauucaauaaa

SEQ ID NO: 1403771 - RNA, 20 nt, Human
ucucaauauucaauaaagcu

SEQ ID NO: 1403772 - RNA, 16 nt, Human
ucucucugcccaaccc

SEQ ID NO: 1403773 - RNA, 14 nt, Human
ucucucugcccaac

SEQ ID NO: 1403774 - RNA, 12 nt, Human
ucucucugccca

SEQ ID NO: 1403775 - RNA, 14 nt, Human
ucucucucuacaaa

SEQ ID NO: 1403776 - RNA, 13 nt, Human
ucucucucuacaa

SEQ ID NO: 1403777 - RNA, 17 nt, Human
ucucuaguuccacgccu

SEQ ID NO: 1403778 - RNA, 16 nt, Human
ucucuaguuugauuaa

SEQ ID NO: 1403779 - RNA, 15 nt, Human
ucucuaguuugauua

SEQ ID NO: 1403780 - RNA, 13 nt, Human
ucucugacuucug

SEQ ID NO: 1403781 - RNA, 13 nt, Human
ucucugaagccac

SEQ ID NO: 1403782 - RNA, 15 nt, Human
ucucugauacagaaa

SEQ ID NO: 1403783 - RNA, 21 nt, Human
ucucugaggggcuaccaggaa

SEQ ID NO: 1403784 - RNA, 22 nt, Human
ucucugaggggcuaccaggaaa

SEQ ID NO: 1403785 - RNA, 13 nt, Human
ucucugcaggucc

SEQ ID NO: 1403786 - RNA, 14 nt, Human
ucucugcagguccc

SEQ ID NO: 1403787 - RNA, 11 nt, Human
ucucugugcuu

SEQ ID NO: 1403788 - RNA, 17 nt, Human
ucucugugccuucgucu

SEQ ID NO: 1403789 - RNA, 12 nt, Human
ucucugugccuu

SEQ ID NO: 1403790 - RNA, 23 nt, Human
ucucugucucauccaucaucaug

SEQ ID NO: 1403791 - RNA, 21 nt, Human
ucucugucucauccaucauca

SEQ ID NO: 1403792 - RNA, 14 nt, Human
ucucuguaaagcua

SEQ ID NO: 1403793 - RNA, 12 nt, Human
ucucuguaaagc

SEQ ID NO: 1403794 - RNA, 22 nt, Human
ucucuguaauaaacucauuucu

SEQ ID NO: 1403795 - RNA, 21 nt, Human
ucucugggggcugaggagcag

SEQ ID NO: 1403796 - RNA, 18 nt, Human
ucucuguaauaaacucau

SEQ ID NO: 1403797 - RNA, 16 nt, Human
ucucugucucauccau

SEQ ID NO: 1403798 - RNA, 15 nt, Human
ucucugucucaucca

SEQ ID NO: 1403799 - RNA, 14 nt, Human
ucucugucucaucc

SEQ ID NO: 1403800 - RNA, 12 nt, Human
ucucugucucau

SEQ ID NO: 1403801 - RNA, 17 nt, Human
ucucugguaauauugac

SEQ ID NO: 1403802 - RNA, 18 nt, Human
ucucugggggcugaggag

SEQ ID NO: 1403803 - RNA, 16 nt, Human
ucucugggggcugagg

SEQ ID NO: 1403804 - RNA, 20 nt, Human
ucucugggcuggaugagcuc

SEQ ID NO: 1403805 - RNA, 17 nt, Human
ucucugggcuggaugag

SEQ ID NO: 1403806 - RNA, 16 nt, Human
ucucugggcuggauga

SEQ ID NO: 1403807 - RNA, 22 nt, Human
ucucugggcuggaugagcuccc

SEQ ID NO: 1403808 - RNA, 15 nt, Human
ucucugggcuggaug

SEQ ID NO: 1403809 - RNA, 13 nt, Human
ucucugggcugga

SEQ ID NO: 1403810 - RNA, 12 nt, Human
ucucugggcugg

SEQ ID NO: 1403811 - RNA, 23 nt, Human
ucucuggcuguaaggcucuagau

SEQ ID NO: 1403812 - RNA, 22 nt, Human
ucucuggcuguaaggcucuaga

SEQ ID NO: 1403813 - RNA, 20 nt, Human
ucucuggcuguaaggcucua

SEQ ID NO: 1403814 - RNA, 19 nt, Human
ucucuggcuguaaggcucu

SEQ ID NO: 1403815 - RNA, 15 nt, Human
ucucugcaggucccu

SEQ ID NO: 1403816 - RNA, 16 nt, Human
ucucugcaggucccua

SEQ ID NO: 1403817 - RNA, 18 nt, Human
ucucugcaggucccuaau

SEQ ID NO: 1403818 - RNA, 15 nt, Human
ucucugaugcagcuu

SEQ ID NO: 1403819 - RNA, 16 nt, Human
ucucugaugcagcuua

SEQ ID NO: 1403820 - RNA, 23 nt, Human
ucucugaggggcuaccaggaaag

SEQ ID NO: 1403821 - RNA, 15 nt, Human
ucuucaucccacucc

SEQ ID NO: 1403822 - RNA, 22 nt, Human
ucuuccuggccgccugggucca

SEQ ID NO: 1403823 - RNA, 22 nt, Human
ucuuaggguuaugauuaaguaa

SEQ ID NO: 1403824 - RNA, 18 nt, Human
ucuucagaucucuaacuu

SEQ ID NO: 1403825 - RNA, 23 nt, Human
ucuucagaucucuaacuucacca

SEQ ID NO: 1403826 - RNA, 23 nt, Human
ucuucucguccucguuuguguuc

SEQ ID NO: 1403827 - RNA, 15 nt, Human
ucuucucccuggaau

SEQ ID NO: 1403828 - RNA, 13 nt, Human
ucuugaaaaaugc

SEQ ID NO: 1403829 - RNA, 19 nt, Human
ucuucuccauccuaccaca

SEQ ID NO: 1403830 - RNA, 16 nt, Human
ucuucucccaauucau

SEQ ID NO: 1403831 - RNA, 23 nt, Human
ucuuccuuacuuuuuauauauau

SEQ ID NO: 1403832 - RNA, 22 nt, Human
ucuuccuugaagaacugcaggc

SEQ ID NO: 1403833 - RNA, 20 nt, Human
ucuuccuuacuuuuuauaua

SEQ ID NO: 1403834 - RNA, 14 nt, Human
ucuuccuucccugc

SEQ ID NO: 1403835 - RNA, 15 nt, Human
ucuuccuucccugcu

SEQ ID NO: 1403836 - RNA, 21 nt, Human
ucuuccuugaagaacugcagg

SEQ ID NO: 1403837 - RNA, 17 nt, Human
ucuuccuucccugcugu

SEQ ID NO: 1403838 - RNA, 18 nt, Human
ucuguuuuucuaacuggg

SEQ ID NO: 1403839 - RNA, 21 nt, Human
ucuguuuuguuucgcucuuug

SEQ ID NO: 1403840 - RNA, 19 nt, Human
ucuguuuuguuucgcucuu

SEQ ID NO: 1403841 - RNA, 12 nt, Human
ucuuaaacuaaa

SEQ ID NO: 1403842 - RNA, 16 nt, Human
ucuuaaaccuucaguu

SEQ ID NO: 1403843 - RNA, 16 nt, Human
ucuuaaacacuugcaa

SEQ ID NO: 1403844 - RNA, 18 nt, Human
ucuuaaaguauucuucuc

SEQ ID NO: 1403845 - RNA, 19 nt, Human
ucuuaaagugccaguauuu

SEQ ID NO: 1403846 - RNA, 22 nt, Human
ucuuaaaguauucuucucuucc

SEQ ID NO: 1403847 - RNA, 17 nt, Human
ucuguuuugaaggcaaa

SEQ ID NO: 1403848 - RNA, 12 nt, Human
ucugucuugaag

SEQ ID NO: 1403849 - RNA, 14 nt, Human
ucugucuucuggac

SEQ ID NO: 1403850 - RNA, 13 nt, Human
ucugucugguggc

SEQ ID NO: 1403851 - RNA, 14 nt, Human
ucugucuggcaaug

SEQ ID NO: 1403852 - RNA, 19 nt, Human
ucugucuggaagaugggga

SEQ ID NO: 1403853 - RNA, 21 nt, Human
ucugucugccaaccuaaaacu

SEQ ID NO: 1403854 - RNA, 18 nt, Human
ucugucugccaaccuaaa

SEQ ID NO: 1403855 - RNA, 17 nt, Human
ucugucugguggccccg

SEQ ID NO: 1403856 - RNA, 16 nt, Human
ucugucugguggcccc

SEQ ID NO: 1403857 - RNA, 14 nt, Human
ucugucugucccaa

SEQ ID NO: 1403858 - RNA, 15 nt, Human
ucugucugucccaaa

SEQ ID NO: 1403859 - RNA, 16 nt, Human
ucugucugucccaaag

SEQ ID NO: 1403860 - RNA, 15 nt, Human
ucugucugucugucc

SEQ ID NO: 1403861 - RNA, 18 nt, Human
ucugucugucugucccaa

SEQ ID NO: 1403862 - RNA, 16 nt, Human
ucuuaaccagaucauu

SEQ ID NO: 1403863 - RNA, 17 nt, Human
ucuuaaccagaucauug

SEQ ID NO: 1403864 - RNA, 19 nt, Human
ucuuaaauaagaaacuuuu

SEQ ID NO: 1403865 - RNA, 18 nt, Human
ucuuaaauaagaaacuuu

SEQ ID NO: 1403866 - RNA, 16 nt, Human
ucuuaaauaagaaacu

SEQ ID NO: 1403867 - RNA, 15 nt, Human
ucuuaaauaagaaac

SEQ ID NO: 1403868 - RNA, 21 nt, Human
ucuuaaagugccaguauuuua

SEQ ID NO: 1403869 - RNA, 15 nt, Human
ucuuaaauaaaccuu

SEQ ID NO: 1403870 - RNA, 23 nt, Human
ucuuagcugucugcucagacaga

SEQ ID NO: 1403871 - RNA, 18 nt, Human
ucuuagcugucugcucag

SEQ ID NO: 1403872 - RNA, 15 nt, Human
ucuuagcugucugcu

SEQ ID NO: 1403873 - RNA, 18 nt, Human
ucuuaagaagacugcauu

SEQ ID NO: 1403874 - RNA, 23 nt, Human
ucuuaacuucuugcuucuuucua

SEQ ID NO: 1403875 - RNA, 16 nt, Human
ucuuaacuucuugcuu

SEQ ID NO: 1403876 - RNA, 12 nt, Human
ucuuaagaagac

SEQ ID NO: 1403877 - RNA, 12 nt, Human
ucuuaacuucuu

SEQ ID NO: 1403878 - RNA, 22 nt, Human
ucuuaaccagaucauugugaaa

SEQ ID NO: 1403879 - RNA, 15 nt, Human
ucugccaggagacag

SEQ ID NO: 1403880 - RNA, 13 nt, Human
ucugccagugaca

SEQ ID NO: 1403881 - RNA, 14 nt, Human
ucugccaguccugu

SEQ ID NO: 1403882 - RNA, 24 nt, Human
ucugccagggccccucuccccagg

SEQ ID NO: 1403883 - RNA, 23 nt, Human
ucugccagggccccucuccccag

SEQ ID NO: 1403884 - RNA, 22 nt, Human
ucugccagggccccucucccca

SEQ ID NO: 1403885 - RNA, 20 nt, Human
ucugccagggccccucuccc

SEQ ID NO: 1403886 - RNA, 19 nt, Human
ucugccagggccccucucc

SEQ ID NO: 1403887 - RNA, 21 nt, Human
ucugccagugacagacaggcu

SEQ ID NO: 1403888 - RNA, 19 nt, Human
ucugccagugacagacagg

SEQ ID NO: 1403889 - RNA, 22 nt, Human
ucugcuccccuaaagccucaaa

SEQ ID NO: 1403890 - RNA, 23 nt, Human
ucugcucccaaggggccugagca

SEQ ID NO: 1403891 - RNA, 22 nt, Human
ucugcucccaaggggccugagc

SEQ ID NO: 1403892 - RNA, 20 nt, Human
ucugcucccaaggggccuga

SEQ ID NO: 1403893 - RNA, 19 nt, Human
ucugcucccaaggggccug

SEQ ID NO: 1403894 - RNA, 17 nt, Human
ucugccaguccuguccu

SEQ ID NO: 1403895 - RNA, 23 nt, Human
ucugccagugacagacaggcucu

SEQ ID NO: 1403896 - RNA, 19 nt, Human
ucugcuggggccugggaca

SEQ ID NO: 1403897 - RNA, 16 nt, Human
ucugcuggggccuggg

SEQ ID NO: 1403898 - RNA, 22 nt, Human
ucuggaauacaugaaauauaga

SEQ ID NO: 1403899 - RNA, 14 nt, Human
ucuggaauacauga

SEQ ID NO: 1403900 - RNA, 23 nt, Human
ucugcuggggccugggacaacug

SEQ ID NO: 1403901 - RNA, 19 nt, Human
ucugcuggccucugcgagu

SEQ ID NO: 1403902 - RNA, 17 nt, Human
ucugcuggccucugcga

SEQ ID NO: 1403903 - RNA, 16 nt, Human
ucugcuggccucugcg

SEQ ID NO: 1403904 - RNA, 14 nt, Human
ucugcuggccucug

SEQ ID NO: 1403905 - RNA, 13 nt, Human
ucugcuggccucu

SEQ ID NO: 1403906 - RNA, 19 nt, Human
ucugcugaccugcugaccu

SEQ ID NO: 1403907 - RNA, 20 nt, Human
ucugcugaccugcugaccug

SEQ ID NO: 1403908 - RNA, 18 nt, Human
ucugcugaccugcugacc

SEQ ID NO: 1403909 - RNA, 15 nt, Human
ucugcugaccugcug

SEQ ID NO: 1403910 - RNA, 16 nt, Human
ucugggaccucaguuu

SEQ ID NO: 1403911 - RNA, 13 nt, Human
ucugggaccucag

SEQ ID NO: 1403912 - RNA, 16 nt, Human
ucuggcucuaauucac

SEQ ID NO: 1403913 - RNA, 15 nt, Human
ucuggcucuaauuca

SEQ ID NO: 1403914 - RNA, 12 nt, Human
ucuggcucuaau

SEQ ID NO: 1403915 - RNA, 19 nt, Human
ucuggcuaugcauuugaaa

SEQ ID NO: 1403916 - RNA, 22 nt, Human
ucuggcuaugcauuugaaaauu

SEQ ID NO: 1403917 - RNA, 21 nt, Human
ucugguguuggacaagcuucu

SEQ ID NO: 1403918 - RNA, 16 nt, Human
ucugguggucuguugg

SEQ ID NO: 1403919 - RNA, 14 nt, Human
ucugguggccccgu

SEQ ID NO: 1403920 - RNA, 12 nt, Human
ucugguggcccc

SEQ ID NO: 1403921 - RNA, 16 nt, Human
ucuggugccuccagag

SEQ ID NO: 1403922 - RNA, 15 nt, Human
ucuggugccuccaga

SEQ ID NO: 1403923 - RNA, 13 nt, Human
ucuggugccucca

SEQ ID NO: 1403924 - RNA, 20 nt, Human
ucuggugagucaccacuuca

SEQ ID NO: 1403925 - RNA, 17 nt, Human
ucuggugagucaccacu

SEQ ID NO: 1403926 - RNA, 14 nt, Human
ucugguucucaauu

SEQ ID NO: 1403927 - RNA, 14 nt, Human
ucugguuccagggu

SEQ ID NO: 1403928 - RNA, 13 nt, Human
ucugguuccaggg

SEQ ID NO: 1403929 - RNA, 12 nt, Human
ucugguuccagg

SEQ ID NO: 1403930 - RNA, 23 nt, Human
ucugguuccagggucccucugug

SEQ ID NO: 1403931 - RNA, 21 nt, Human
ucugguuccagggucccucug

SEQ ID NO: 1403932 - RNA, 13 nt, Human
ucugguucuaaca

SEQ ID NO: 1403933 - RNA, 11 nt, Human
ucugguucuaa

SEQ ID NO: 1403934 - RNA, 15 nt, Human
ucuguccuugaagga

SEQ ID NO: 1403935 - RNA, 21 nt, Human
ucugucucgagcgcccugcag

SEQ ID NO: 1403936 - RNA, 22 nt, Human
ucugucucgagcgcccugcaga

SEQ ID NO: 1403937 - RNA, 18 nt, Human
ucuguccuugaaggacua

SEQ ID NO: 1403938 - RNA, 22 nt, Human
ucugucucuggauuauauuaug

SEQ ID NO: 1403939 - RNA, 20 nt, Human
ugcaauguguguauauggac

SEQ ID NO: 1403940 - RNA, 21 nt, Human
ugcaauguguauaaacaagaa

SEQ ID NO: 1403941 - RNA, 20 nt, Human
ugcaauguguauaaacaaga

SEQ ID NO: 1403942 - RNA, 18 nt, Human
ugcaauguguauaaacaa

SEQ ID NO: 1403943 - RNA, 16 nt, Human
ugcaauguguauaaac

SEQ ID NO: 1403944 - RNA, 15 nt, Human
ugcaauguguauaaa

SEQ ID NO: 1403945 - RNA, 14 nt, Human
ugcaauguguauaa

SEQ ID NO: 1403946 - RNA, 13 nt, Human
ugcaauguguaua

SEQ ID NO: 1403947 - RNA, 22 nt, Human
ugcaauguaaauauuuuaaaga

SEQ ID NO: 1403948 - RNA, 11 nt, Human
ugcaaugaaca

SEQ ID NO: 1403949 - RNA, 20 nt, Human
ugcaauuucaagguucuaac

SEQ ID NO: 1403950 - RNA, 19 nt, Human
ugcaauuucaagguucuaa

SEQ ID NO: 1403951 - RNA, 18 nt, Human
ugcaauuucaagguucua

SEQ ID NO: 1403952 - RNA, 17 nt, Human
ugcaauuucaagguucu

SEQ ID NO: 1403953 - RNA, 13 nt, Human
ugcaauuucaagg

SEQ ID NO: 1403954 - RNA, 12 nt, Human
ugcaauuucaag

SEQ ID NO: 1403955 - RNA, 22 nt, Human
ugcaauuggcaccgaagcccag

SEQ ID NO: 1403956 - RNA, 23 nt, Human
ugcaauuggcaccgaagcccaga

SEQ ID NO: 1403957 - RNA, 21 nt, Human
ugcaauugccuuuuuucugua

SEQ ID NO: 1403958 - RNA, 18 nt, Human
ugcaauuccccucugcug

SEQ ID NO: 1403959 - RNA, 14 nt, Human
ugcaauuccccucu

SEQ ID NO: 1403960 - RNA, 13 nt, Human
ugcaauuccccuc

SEQ ID NO: 1403961 - RNA, 21 nt, Human
ugcaauucaaaaguuccaaga

SEQ ID NO: 1403962 - RNA, 19 nt, Human
ugcaauucaaaaguuccaa

SEQ ID NO: 1403963 - RNA, 18 nt, Human
ugcaauucaaaaguucca

SEQ ID NO: 1403964 - RNA, 17 nt, Human
ugcaauucaaaaguucc

SEQ ID NO: 1403965 - RNA, 16 nt, Human
ugcaauucaaaaguuc

SEQ ID NO: 1403966 - RNA, 14 nt, Human
ugcaauucaaaagu

SEQ ID NO: 1403967 - RNA, 19 nt, Human
ugcaauguguguauaugga

SEQ ID NO: 1403968 - RNA, 19 nt, Human
ugcacaaaacccagaccug

SEQ ID NO: 1403969 - RNA, 18 nt, Human
ugcacaaaacccagaccu

SEQ ID NO: 1403970 - RNA, 17 nt, Human
ugcacagaguuguuaca

SEQ ID NO: 1403971 - RNA, 18 nt, Human
ugcacagaguuguuacau

SEQ ID NO: 1403972 - RNA, 19 nt, Human
ugcacagaguuguuacauu

SEQ ID NO: 1403973 - RNA, 15 nt, Human
ugcacugugaaggac

SEQ ID NO: 1403974 - RNA, 18 nt, Human
ugcaccuuucuaguugaa

SEQ ID NO: 1403975 - RNA, 17 nt, Human
ugcacgcacacugucug

SEQ ID NO: 1403976 - RNA, 18 nt, Human
ugcacuuacuugcuuauu

SEQ ID NO: 1403977 - RNA, 16 nt, Human
ugcacuuacuugcuua

SEQ ID NO: 1403978 - RNA, 15 nt, Human
ugcacuuacuugcuu

SEQ ID NO: 1403979 - RNA, 23 nt, Human
ugcacuguucccccugugcagcc

SEQ ID NO: 1403980 - RNA, 21 nt, Human
ugcacuguucccccugugcag

SEQ ID NO: 1403981 - RNA, 20 nt, Human
ugcacuguucccccugugca

SEQ ID NO: 1403982 - RNA, 19 nt, Human
ugcacuguucccccugugc

SEQ ID NO: 1403983 - RNA, 14 nt, Human
ugcacuguuccccc

SEQ ID NO: 1403984 - RNA, 13 nt, Human
ugcacuguucccc

SEQ ID NO: 1403985 - RNA, 18 nt, Human
ugcacugugaaggacccu

SEQ ID NO: 1403986 - RNA, 15 nt, Human
ugcacuucaaauuca

SEQ ID NO: 1403987 - RNA, 14 nt, Human
ugcacuucuuacaa

SEQ ID NO: 1403988 - RNA, 22 nt, Human
ugcacuuauuuaugaaccugcc

SEQ ID NO: 1403989 - RNA, 18 nt, Human
ugcacgaccgccccaguu

SEQ ID NO: 1403990 - RNA, 14 nt, Human
ugcaccuuucuagu

SEQ ID NO: 1403991 - RNA, 16 nt, Human
ugcacgcacacugucu

SEQ ID NO: 1403992 - RNA, 20 nt, Human
ugcacagugacuucugagau

SEQ ID NO: 1403993 - RNA, 17 nt, Human
ugcaccuggaauauaua

SEQ ID NO: 1403994 - RNA, 20 nt, Human
ugcaccuggaauauauaacc

SEQ ID NO: 1403995 - RNA, 22 nt, Human
ugcaccuggaauauauaaccag

SEQ ID NO: 1403996 - RNA, 16 nt, Human
ugcacagugacuucug

SEQ ID NO: 1403997 - RNA, 15 nt, Human
ugcacagugacuucu

SEQ ID NO: 1403998 - RNA, 17 nt, Human
ugcacagucacugcucu

SEQ ID NO: 1403999 - RNA, 23 nt, Human
ugcacaguauuuguaauuaaaag

SEQ ID NO: 1404000 - RNA, 20 nt, Human
ugcacaguauuuguaauuaa

SEQ ID NO: 1404001 - RNA, 19 nt, Human
ugcacaguauuuguaauua

SEQ ID NO: 1404002 - RNA, 18 nt, Human
ugcacaguauuuguaauu

SEQ ID NO: 1404003 - RNA, 17 nt, Human
ugcacaguauuuguaau

SEQ ID NO: 1404004 - RNA, 21 nt, Human
ugcacagugacuucugagauc

SEQ ID NO: 1404005 - RNA, 19 nt, Human
ugcacagugacuucugaga

SEQ ID NO: 1404006 - RNA, 17 nt, Human
ugcacagugacuucuga

SEQ ID NO: 1404007 - RNA, 21 nt, Human
ugcacaaauauuuauuuucuu

SEQ ID NO: 1404008 - RNA, 16 nt, Human
ugcacaguauuuguaa

SEQ ID NO: 1404009 - RNA, 14 nt, Human
ugcacaguaaaaau

SEQ ID NO: 1404010 - RNA, 20 nt, Human
ugcacagaguuguuacauuu

SEQ ID NO: 1404011 - RNA, 22 nt, Human
ugcaaaaggacucucaggacca

SEQ ID NO: 1404012 - RNA, 17 nt, Human
ugcaaccaggaacagca

SEQ ID NO: 1404013 - RNA, 12 nt, Human
ugcaaccaggaa

SEQ ID NO: 1404014 - RNA, 15 nt, Human
ugcaacaugaugagg

SEQ ID NO: 1404015 - RNA, 24 nt, Human
ugcaacaggguauggacuaucugu

SEQ ID NO: 1404016 - RNA, 16 nt, Human
ugcaaccauuugaaac

SEQ ID NO: 1404017 - RNA, 20 nt, Human
ugcaaccaggaacagcaaau

SEQ ID NO: 1404018 - RNA, 16 nt, Human
ugcaaccgucuguuau

SEQ ID NO: 1404019 - RNA, 13 nt, Human
ugcaaccuccacc

SEQ ID NO: 1404020 - RNA, 21 nt, Human
ugcaaccuccaccuccugggu

SEQ ID NO: 1404021 - RNA, 20 nt, Human
ugcaaccuccaccuccuggg

SEQ ID NO: 1404022 - RNA, 19 nt, Human
ugcaaccuccaccuccugg

SEQ ID NO: 1404023 - RNA, 18 nt, Human
ugcaaccuccaccuccug

SEQ ID NO: 1404024 - RNA, 15 nt, Human
ugcaaccuccaccuc

SEQ ID NO: 1404025 - RNA, 20 nt, Human
ugcaaccucgcuggacucuc

SEQ ID NO: 1404026 - RNA, 19 nt, Human
ugcaaccucgcuggacucu

SEQ ID NO: 1404027 - RNA, 14 nt, Human
ugcaaccucgcugg

SEQ ID NO: 1404028 - RNA, 18 nt, Human
ugcaaccucuuggccuga

SEQ ID NO: 1404029 - RNA, 22 nt, Human
ugcaaccucgcuggacucucag

SEQ ID NO: 1404030 - RNA, 14 nt, Human
ugcaaccucugccu

SEQ ID NO: 1404031 - RNA, 17 nt, Human
ugcaacucaaggacuuu

SEQ ID NO: 1404032 - RNA, 16 nt, Human
ugcaacucaaggacuu

SEQ ID NO: 1404033 - RNA, 14 nt, Human
ugcaaccuucaccu

SEQ ID NO: 1404034 - RNA, 22 nt, Human
ugcaacucugaaggguaauuau

SEQ ID NO: 1404035 - RNA, 18 nt, Human
ugcaacuuuguauaaaag

SEQ ID NO: 1404036 - RNA, 14 nt, Human
ugaugugaagccaa

SEQ ID NO: 1404037 - RNA, 22 nt, Human
ugaugugaagccaauucagaca

SEQ ID NO: 1404038 - RNA, 20 nt, Human
ugaugucuccuaagcaccug

SEQ ID NO: 1404039 - RNA, 23 nt, Human
ugaugucuuuguuaagacugcug

SEQ ID NO: 1404040 - RNA, 16 nt, Human
ugaugucuccuaagca

SEQ ID NO: 1404041 - RNA, 12 nt, Human
ugaugucuccua

SEQ ID NO: 1404042 - RNA, 19 nt, Human
ugaugugcacguaaaguac

SEQ ID NO: 1404043 - RNA, 20 nt, Human
ugauuuuaggagcuaaggcu

SEQ ID NO: 1404044 - RNA, 19 nt, Human
ugauuuuagccuucucugu

SEQ ID NO: 1404045 - RNA, 15 nt, Human
ugauuuuagccuucu

SEQ ID NO: 1404046 - RNA, 22 nt, Human
ugauuuuaaguuucucugcaga

SEQ ID NO: 1404047 - RNA, 19 nt, Human
ugauuuuaaguuucucugc

SEQ ID NO: 1404048 - RNA, 19 nt, Human
ugauuuuaagaauccaaac

SEQ ID NO: 1404049 - RNA, 23 nt, Human
ugauuuugaaccugaugaaaaua

SEQ ID NO: 1404050 - RNA, 11 nt, Human
ugauuuugaac

SEQ ID NO: 1404051 - RNA, 13 nt, Human
ugauuuucuggau

SEQ ID NO: 1404052 - RNA, 20 nt, Human
ugauuuucaaagcuuuuucc

SEQ ID NO: 1404053 - RNA, 22 nt, Human
ugauuuuaggagcuaaggcucu

SEQ ID NO: 1404054 - RNA, 16 nt, Human
ugauuuuuuuuccuuu

SEQ ID NO: 1404055 - RNA, 17 nt, Human
ugauuuuuuuuaauuac

SEQ ID NO: 1404056 - RNA, 22 nt, Human
ugauuuuugccucuuccagucu

SEQ ID NO: 1404057 - RNA, 21 nt, Human
ugauuuuugccucuuccaguc

SEQ ID NO: 1404058 - RNA, 14 nt, Human
ugauuuuucuuuac

SEQ ID NO: 1404059 - RNA, 15 nt, Human
ugauuuuucuuuaca

SEQ ID NO: 1404060 - RNA, 23 nt, Human
ugauuuuuauaaauacugcaaau

SEQ ID NO: 1404061 - RNA, 18 nt, Human
ugauuuuuaugccaccug

SEQ ID NO: 1404062 - RNA, 21 nt, Human
ugauuuuuuuuuuuuuuuccu

SEQ ID NO: 1404063 - RNA, 20 nt, Human
ugauuuuuuuuuuuuuuucc

SEQ ID NO: 1404064 - RNA, 22 nt, Human
ugauuuuuuuuucauacacuua

SEQ ID NO: 1404065 - RNA, 18 nt, Human
ugauuuuuuuuucauaca

SEQ ID NO: 1404066 - RNA, 19 nt, Human
ugcaaaaggacucucagga

SEQ ID NO: 1404067 - RNA, 21 nt, Human
ugcaaaaacucuuugagaggg

SEQ ID NO: 1404068 - RNA, 19 nt, Human
ugcaaaaacuacaaccaau

SEQ ID NO: 1404069 - RNA, 14 nt, Human
ugcaaaaaggguca

SEQ ID NO: 1404070 - RNA, 17 nt, Human
ugccucgaaacacagaa

SEQ ID NO: 1404071 - RNA, 13 nt, Human
ugccucgaaacac

SEQ ID NO: 1404072 - RNA, 24 nt, Human
ugccuccucacccccagcuuugcu

SEQ ID NO: 1404073 - RNA, 19 nt, Human
ugccuccucacccccagcu

SEQ ID NO: 1404074 - RNA, 21 nt, Human
ugccucgaaacacagaaaccu

SEQ ID NO: 1404075 - RNA, 21 nt, Human
ugccucugugcugugugugac

SEQ ID NO: 1404076 - RNA, 13 nt, Human
ugccuaagcccuc

SEQ ID NO: 1404077 - RNA, 14 nt, Human
ugccucccugagcu

SEQ ID NO: 1404078 - RNA, 23 nt, Human
ugccucccucucguaagauuucc

SEQ ID NO: 1404079 - RNA, 22 nt, Human
ugccucccucucguaagauuuc

SEQ ID NO: 1404080 - RNA, 12 nt, Human
ugccuccucacc

SEQ ID NO: 1404081 - RNA, 23 nt, Human
ugccuccguccccugcccaugcu

SEQ ID NO: 1404082 - RNA, 19 nt, Human
ugccuccguccccugccca

SEQ ID NO: 1404083 - RNA, 19 nt, Human
ugccucccuuguggcagca

SEQ ID NO: 1404084 - RNA, 13 nt, Human
ugccucccugagc

SEQ ID NO: 1404085 - RNA, 16 nt, Human
ugccucccuucaugca

SEQ ID NO: 1404086 - RNA, 23 nt, Human
ugccugguauauccaaaagcuuu

SEQ ID NO: 1404087 - RNA, 20 nt, Human
ugccugguauauccaaaagc

SEQ ID NO: 1404088 - RNA, 15 nt, Human
ugccugguacaguau

SEQ ID NO: 1404089 - RNA, 14 nt, Human
ugccugguacagua

SEQ ID NO: 1404090 - RNA, 19 nt, Human
ugccugccagcugcacuga

SEQ ID NO: 1404091 - RNA, 15 nt, Human
ugccugccagcugca

SEQ ID NO: 1404092 - RNA, 23 nt, Human
ugccugcauaggaguuuggagga

SEQ ID NO: 1404093 - RNA, 16 nt, Human
ugccugccagcugcac

SEQ ID NO: 1404094 - RNA, 13 nt, Human
ugccucuucuggg

SEQ ID NO: 1404095 - RNA, 17 nt, Human
ugccucuuccuugaaga

SEQ ID NO: 1404096 - RNA, 23 nt, Human
ugccucuuccagucuuccugaca

SEQ ID NO: 1404097 - RNA, 21 nt, Human
ugccucuuccagucuuccuga

SEQ ID NO: 1404098 - RNA, 14 nt, Human
ugccucuucauucu

SEQ ID NO: 1404099 - RNA, 14 nt, Human
ugccucuucccucu

SEQ ID NO: 1404100 - RNA, 23 nt, Human
ugccguggggccgccgccucuuu

SEQ ID NO: 1404101 - RNA, 22 nt, Human
ugccguggauugcacguggccu

SEQ ID NO: 1404102 - RNA, 20 nt, Human
ugccguggauugcacguggc

SEQ ID NO: 1404103 - RNA, 19 nt, Human
ugccgucagugcugugcug

SEQ ID NO: 1404104 - RNA, 14 nt, Human
ugccguaauuuaac

SEQ ID NO: 1404105 - RNA, 22 nt, Human
ugcccugguggcccucuccccu

SEQ ID NO: 1404106 - RNA, 21 nt, Human
ugcccugguggcccucucccc

SEQ ID NO: 1404107 - RNA, 16 nt, Human
ugcccugguggcccuc

SEQ ID NO: 1404108 - RNA, 21 nt, Human
ugcccggggaaaggcaagguc

SEQ ID NO: 1404109 - RNA, 21 nt, Human
ugcccagaauaaguuauugca

SEQ ID NO: 1404110 - RNA, 19 nt, Human
ugcccagaauaaguuauug

SEQ ID NO: 1404111 - RNA, 17 nt, Human
ugcccagaauaaguuau

SEQ ID NO: 1404112 - RNA, 17 nt, Human
ugcccgggagcucagga

SEQ ID NO: 1404113 - RNA, 18 nt, Human
ugcccggggaaaggcaag

SEQ ID NO: 1404114 - RNA, 18 nt, Human
ugcccgggagcucaggaa

SEQ ID NO: 1404115 - RNA, 14 nt, Human
ugcccugcccugcc

SEQ ID NO: 1404116 - RNA, 15 nt, Human
ugcccugcccugcca

SEQ ID NO: 1404117 - RNA, 18 nt, Human
ugcccugcccugccaccu

SEQ ID NO: 1404118 - RNA, 17 nt, Human
ugcccuaaaguguauuu

SEQ ID NO: 1404119 - RNA, 19 nt, Human
ugcccuaaaguguauuuuu

SEQ ID NO: 1404120 - RNA, 23 nt, Human
ugccagggccccucuccccaggg

SEQ ID NO: 1404121 - RNA, 21 nt, Human
ugccagggccccucuccccag

SEQ ID NO: 1404122 - RNA, 18 nt, Human
ugccagggccccucuccc

SEQ ID NO: 1404123 - RNA, 17 nt, Human
ugccagggccccucucc

SEQ ID NO: 1404124 - RNA, 16 nt, Human
ugccagggcagggccc

SEQ ID NO: 1404125 - RNA, 15 nt, Human
ugccagggcagggcc

SEQ ID NO: 1404126 - RNA, 17 nt, Human
ugccaggugaggucagc

SEQ ID NO: 1404127 - RNA, 22 nt, Human
ugccacugaggggggauccagu

SEQ ID NO: 1404128 - RNA, 22 nt, Human
ugccacucacuaggcccccacu

SEQ ID NO: 1404129 - RNA, 21 nt, Human
ugccacucacuaggcccccac

SEQ ID NO: 1404130 - RNA, 20 nt, Human
ugccacucacuaggccccca

SEQ ID NO: 1404131 - RNA, 19 nt, Human
ugccacucacuaggccccc

SEQ ID NO: 1404132 - RNA, 18 nt, Human
ugccacucacuaggcccc

SEQ ID NO: 1404133 - RNA, 17 nt, Human
ugccacucacuaggccc

SEQ ID NO: 1404134 - RNA, 15 nt, Human
ugccacucacuaggc

SEQ ID NO: 1404135 - RNA, 14 nt, Human
ugccacucacuagg

SEQ ID NO: 1404136 - RNA, 13 nt, Human
ugccacucacuag

SEQ ID NO: 1404137 - RNA, 19 nt, Human
ugcccacggagucgugggg

SEQ ID NO: 1404138 - RNA, 17 nt, Human
ugccaugucaaacaaau

SEQ ID NO: 1404139 - RNA, 18 nt, Human
ugccaugucaaacaaaua

SEQ ID NO: 1404140 - RNA, 19 nt, Human
ugccaugaugccucugucu

SEQ ID NO: 1404141 - RNA, 17 nt, Human
ugccaugaugccucugu

SEQ ID NO: 1404142 - RNA, 18 nt, Human
ugccauguacaguauguu

SEQ ID NO: 1404143 - RNA, 16 nt, Human
ugccaugaugccucug

SEQ ID NO: 1404144 - RNA, 20 nt, Human
ugccaugacaacuucuaauu

SEQ ID NO: 1404145 - RNA, 23 nt, Human
ugcaucccaaaccacgccucuug

SEQ ID NO: 1404146 - RNA, 22 nt, Human
ugcaucccaaaccacgccucuu

SEQ ID NO: 1404147 - RNA, 19 nt, Human
ugcauccauucuccugagg

SEQ ID NO: 1404148 - RNA, 18 nt, Human
ugcauccauucuccugag

SEQ ID NO: 1404149 - RNA, 18 nt, Human
ugcagauggugagagaua

SEQ ID NO: 1404150 - RNA, 12 nt, Human
ugcauguaguaa

SEQ ID NO: 1404151 - RNA, 17 nt, Human
ugcauguacuguauauu

SEQ ID NO: 1404152 - RNA, 18 nt, Human
ugcaugguuucagcacua

SEQ ID NO: 1404153 - RNA, 23 nt, Human
ugcauguaacgcaaguucccagu

SEQ ID NO: 1404154 - RNA, 22 nt, Human
ugcaugguuucagcacuagcca

SEQ ID NO: 1404155 - RNA, 17 nt, Human
ugcaugguuucagcacu

SEQ ID NO: 1404156 - RNA, 16 nt, Human
ugcaugguuucagcac

SEQ ID NO: 1404157 - RNA, 15 nt, Human
ugcaugguuucagca

SEQ ID NO: 1404158 - RNA, 14 nt, Human
ugcaugguuucagc

SEQ ID NO: 1404159 - RNA, 14 nt, Human
ugcauguaguaaca

SEQ ID NO: 1404160 - RNA, 17 nt, Human
ugcauguaguaacacua

SEQ ID NO: 1404161 - RNA, 20 nt, Human
ugcauguugucuaagaaauu

SEQ ID NO: 1404162 - RNA, 19 nt, Human
ugcauguugucuaagaaau

SEQ ID NO: 1404163 - RNA, 18 nt, Human
ugcauguugucuaagaaa

SEQ ID NO: 1404164 - RNA, 15 nt, Human
ugcauguuugugauu

SEQ ID NO: 1404165 - RNA, 21 nt, Human
ugcauuuguuuuguuuacaga

SEQ ID NO: 1404166 - RNA, 22 nt, Human
ugcauuuguuuauguaauuuca

SEQ ID NO: 1404167 - RNA, 21 nt, Human
ugcauuuguuuauguaauuuc

SEQ ID NO: 1404168 - RNA, 20 nt, Human
ugcauuuguuuauguaauuu

SEQ ID NO: 1404169 - RNA, 19 nt, Human
ugcauuuguuuauguaauu

SEQ ID NO: 1404170 - RNA, 18 nt, Human
ugcauuuguuuauguaau

SEQ ID NO: 1404171 - RNA, 13 nt, Human
ugcauuuguuuau

SEQ ID NO: 1404172 - RNA, 22 nt, Human
ugcauuauaucaaaucuaccac

SEQ ID NO: 1404173 - RNA, 22 nt, Human
ugcauuagggaugccuccuuuc

SEQ ID NO: 1404174 - RNA, 19 nt, Human
ugcauuagggaugccuccu

SEQ ID NO: 1404175 - RNA, 23 nt, Human
ugcauuuuggagaguuuccugaa

SEQ ID NO: 1404176 - RNA, 18 nt, Human
ugcauuuuguuugguauu

SEQ ID NO: 1404177 - RNA, 22 nt, Human
ugcauuuuguuugguauuguau

SEQ ID NO: 1404178 - RNA, 18 nt, Human
ugcauuacugcaugcacu

SEQ ID NO: 1404179 - RNA, 17 nt, Human
ugcauuacugcaugcac

SEQ ID NO: 1404180 - RNA, 15 nt, Human
ugcauuacugcaugc

SEQ ID NO: 1404181 - RNA, 21 nt, Human
ugcauguugucuaagaaauug

SEQ ID NO: 1404182 - RNA, 14 nt, Human
ugcauuauauuuau

SEQ ID NO: 1404183 - RNA, 12 nt, Human
ugcauuaucuag

SEQ ID NO: 1404184 - RNA, 17 nt, Human
ugcauuaucuagauacu

SEQ ID NO: 1404185 - RNA, 18 nt, Human
ugcauuaucuagauacug

SEQ ID NO: 1404186 - RNA, 17 nt, Human
ugaccuccgccauccac

SEQ ID NO: 1404187 - RNA, 18 nt, Human
ugaccucugcagcaauaa

SEQ ID NO: 1404188 - RNA, 21 nt, Human
ugaccucugcagcaauaaagc

SEQ ID NO: 1404189 - RNA, 23 nt, Human
ugaccucugcagcaauaaagcag

SEQ ID NO: 1404190 - RNA, 18 nt, Human
ugaccuccagcuuuccug

SEQ ID NO: 1404191 - RNA, 13 nt, Human
ugaccuccagcuu

SEQ ID NO: 1404192 - RNA, 19 nt, Human
ugaccuccgccauccaccc

SEQ ID NO: 1404193 - RNA, 18 nt, Human
ugaccucgugauccaccc

SEQ ID NO: 1404194 - RNA, 13 nt, Human
ugaccucugcagc

SEQ ID NO: 1404195 - RNA, 16 nt, Human
ugaccucugcagcaau

SEQ ID NO: 1404196 - RNA, 14 nt, Human
ugacccugagcuga

SEQ ID NO: 1404197 - RNA, 15 nt, Human
ugacccugaagugag

SEQ ID NO: 1404198 - RNA, 17 nt, Human
ugacccugagcugacca

SEQ ID NO: 1404199 - RNA, 22 nt, Human
ugacccuccaccgcagaaggaa

SEQ ID NO: 1404200 - RNA, 23 nt, Human
ugacccuccaccgcagaaggaag

SEQ ID NO: 1404201 - RNA, 22 nt, Human
ugacccugccucucccaggcag

SEQ ID NO: 1404202 - RNA, 19 nt, Human
ugacccugccucucccagg

SEQ ID NO: 1404203 - RNA, 18 nt, Human
ugacccugccucucccag

SEQ ID NO: 1404204 - RNA, 13 nt, Human
ugacccugccucu

SEQ ID NO: 1404205 - RNA, 12 nt, Human
ugacccugccuc

SEQ ID NO: 1404206 - RNA, 17 nt, Human
ugaccuaaauuauuuac

SEQ ID NO: 1404207 - RNA, 23 nt, Human
ugaccuauaccuguguuucuugc

SEQ ID NO: 1404208 - RNA, 17 nt, Human
ugaccuauaccuguguu

SEQ ID NO: 1404209 - RNA, 22 nt, Human
ugaccuaguuuuccaugcgugu

SEQ ID NO: 1404210 - RNA, 17 nt, Human
ugaccuaguuuuccaug

SEQ ID NO: 1404211 - RNA, 20 nt, Human
ugaccucaagugaucugccc

SEQ ID NO: 1404212 - RNA, 13 nt, Human
ucuugaaggugcu

SEQ ID NO: 1404213 - RNA, 16 nt, Human
ucuugaauaauguaag

SEQ ID NO: 1404214 - RNA, 19 nt, Human
ugacggccagggagaagcu

SEQ ID NO: 1404215 - RNA, 23 nt, Human
ugacgccaggguaugaagagugu

SEQ ID NO: 1404216 - RNA, 20 nt, Human
ugacgacaagugcugaacag

SEQ ID NO: 1404217 - RNA, 15 nt, Human
ugacgacaagugcug

SEQ ID NO: 1404218 - RNA, 23 nt, Human
ugaccuuuuauguaguaauugac

SEQ ID NO: 1404219 - RNA, 18 nt, Human
ugaccuuuuauguaguaa

SEQ ID NO: 1404220 - RNA, 17 nt, Human
ugaccuuuuauguagua

SEQ ID NO: 1404221 - RNA, 18 nt, Human
ugacgucuggguggcccu

SEQ ID NO: 1404222 - RNA, 24 nt, Human
ugacgugaccggacuuuucugcaa

SEQ ID NO: 1404223 - RNA, 22 nt, Human
ugacgugaccggacuuuucugc

SEQ ID NO: 1404224 - RNA, 17 nt, Human
ugacgugaccggacuuu

SEQ ID NO: 1404225 - RNA, 15 nt, Human
ugacgucuggguggc

SEQ ID NO: 1404226 - RNA, 14 nt, Human
ugacgucugggugg

SEQ ID NO: 1404227 - RNA, 12 nt, Human
ugacucuuaaga

SEQ ID NO: 1404228 - RNA, 13 nt, Human
ugacugaauuucu

SEQ ID NO: 1404229 - RNA, 20 nt, Human
ugacugagggugaguuggcu

SEQ ID NO: 1404230 - RNA, 13 nt, Human
ugacucuuaagaa

SEQ ID NO: 1404231 - RNA, 14 nt, Human
ugacugaauuucuu

SEQ ID NO: 1404232 - RNA, 15 nt, Human
ugacugaauuucuuu

SEQ ID NO: 1404233 - RNA, 23 nt, Human
ugacugguguuaucaccgugggc

SEQ ID NO: 1404234 - RNA, 22 nt, Human
ugacugccaagacugcuguggc

SEQ ID NO: 1404235 - RNA, 21 nt, Human
ugacugccaagacugcugugg

SEQ ID NO: 1404236 - RNA, 14 nt, Human
ugacugccaagacu

SEQ ID NO: 1404237 - RNA, 17 nt, Human
ugagaaauuuaaacuau

SEQ ID NO: 1404238 - RNA, 15 nt, Human
ugagaaauuuaaacu

SEQ ID NO: 1404239 - RNA, 14 nt, Human
ugagaaauuuaaac

SEQ ID NO: 1404240 - RNA, 13 nt, Human
ugagaaauuuaaa

SEQ ID NO: 1404241 - RNA, 17 nt, Human
ugacuguagcuuuggaa

SEQ ID NO: 1404242 - RNA, 17 nt, Human
ugagaaaucuaaaaaac

SEQ ID NO: 1404243 - RNA, 12 nt, Human
ugagaggcccug

SEQ ID NO: 1404244 - RNA, 20 nt, Human
ugagaccuaaucucuguaaa

SEQ ID NO: 1404245 - RNA, 19 nt, Human
ugagaccuaaucucuguaa

SEQ ID NO: 1404246 - RNA, 18 nt, Human
ugagaccuaaucucugua

SEQ ID NO: 1404247 - RNA, 20 nt, Human
ugagaugauacauccaaagc

SEQ ID NO: 1404248 - RNA, 22 nt, Human
ugagagguuugacuagaugaug

SEQ ID NO: 1404249 - RNA, 18 nt, Human
ugagauccuuccuuuuga

SEQ ID NO: 1404250 - RNA, 14 nt, Human
ugagagguuugacu

SEQ ID NO: 1404251 - RNA, 23 nt, Human
ugagaggcccuggaucagcgugg

SEQ ID NO: 1404252 - RNA, 17 nt, Human
ugagaggcccuggauca

SEQ ID NO: 1404253 - RNA, 16 nt, Human
ugagaggcccuggauc

SEQ ID NO: 1404254 - RNA, 14 nt, Human
ugagaggcccugga

SEQ ID NO: 1404255 - RNA, 13 nt, Human
ugagaggcccugg

SEQ ID NO: 1404256 - RNA, 18 nt, Human
ugagcucuucauguuuca

SEQ ID NO: 1404257 - RNA, 13 nt, Human
ugagcucuuguga

SEQ ID NO: 1404258 - RNA, 18 nt, Human
ugagcucuugugaggaaa

SEQ ID NO: 1404259 - RNA, 22 nt, Human
ugagcucuugugaggaaaguca

SEQ ID NO: 1404260 - RNA, 16 nt, Human
ugagcucuucauguuu

SEQ ID NO: 1404261 - RNA, 15 nt, Human
ugagcucuucauguu

SEQ ID NO: 1404262 - RNA, 12 nt, Human
ugagcucuucau

SEQ ID NO: 1404263 - RNA, 22 nt, Human
ugagcucugagaggcccuggau

SEQ ID NO: 1404264 - RNA, 23 nt, Human
ugagcucugagaggcccuggauc

SEQ ID NO: 1404265 - RNA, 21 nt, Human
ugagcucugagaggcccugga

SEQ ID NO: 1404266 - RNA, 20 nt, Human
ugagcucugagaggcccugg

SEQ ID NO: 1404267 - RNA, 19 nt, Human
ugagcucugagaggcccug

SEQ ID NO: 1404268 - RNA, 18 nt, Human
ugagcucugagaggcccu

SEQ ID NO: 1404269 - RNA, 17 nt, Human
ugagcucugagaggccc

SEQ ID NO: 1404270 - RNA, 15 nt, Human
ugagcucugagaggc

SEQ ID NO: 1404271 - RNA, 12 nt, Human
ugagcucugaga

SEQ ID NO: 1404272 - RNA, 13 nt, Human
ugagcucucugcc

SEQ ID NO: 1404273 - RNA, 12 nt, Human
ugagcucucugu

SEQ ID NO: 1404274 - RNA, 21 nt, Human
ugagcucccacaagccugagg

SEQ ID NO: 1404275 - RNA, 20 nt, Human
ugagcucccacaagccugag

SEQ ID NO: 1404276 - RNA, 19 nt, Human
ugagcucccacaagccuga

SEQ ID NO: 1404277 - RNA, 18 nt, Human
ugagcucccacaagccug

SEQ ID NO: 1404278 - RNA, 15 nt, Human
ugagcucccacaagc

SEQ ID NO: 1404279 - RNA, 13 nt, Human
ugagcccagggag

SEQ ID NO: 1404280 - RNA, 12 nt, Human
ugagcccaggga

SEQ ID NO: 1404281 - RNA, 11 nt, Human
ugagcccaggg

SEQ ID NO: 1404282 - RNA, 21 nt, Human
ugagcccagcugggucaggca

SEQ ID NO: 1404283 - RNA, 17 nt, Human
ugagcccagcuggguca

SEQ ID NO: 1404284 - RNA, 17 nt, Human
ugagcccagggaggccg

SEQ ID NO: 1404285 - RNA, 15 nt, Human
ugagcccagggaggc

SEQ ID NO: 1404286 - RNA, 14 nt, Human
ugagcccagggagg

SEQ ID NO: 1404287 - RNA, 17 nt, Human
ugagcaguccuuggccu

SEQ ID NO: 1404288 - RNA, 16 nt, Human
ugagcaguccuuggcc

SEQ ID NO: 1404289 - RNA, 14 nt, Human
ugagcaguccuugg

SEQ ID NO: 1404290 - RNA, 20 nt, Human
ugagcagucaggaaagagaa

SEQ ID NO: 1404291 - RNA, 17 nt, Human
ugagcagucaggaaaga

SEQ ID NO: 1404292 - RNA, 20 nt, Human
ugauaaagccucaagguuuu

SEQ ID NO: 1404293 - RNA, 13 nt, Human
ugauaaagccuca

SEQ ID NO: 1404294 - RNA, 20 nt, Human
ugauaaagauuuuuuaauaa

SEQ ID NO: 1404295 - RNA, 19 nt, Human
ugauaaagauuuuuuaaua

SEQ ID NO: 1404296 - RNA, 18 nt, Human
ugauaaagauuuuuuaau

SEQ ID NO: 1404297 - RNA, 15 nt, Human
ugauaaagagacagu

SEQ ID NO: 1404298 - RNA, 16 nt, Human
ugauaaaaccauguag

SEQ ID NO: 1404299 - RNA, 11 nt, Human
ugaguuuccua

SEQ ID NO: 1404300 - RNA, 23 nt, Human
ugaguuuaccuuguauacuguag

SEQ ID NO: 1404301 - RNA, 16 nt, Human
ugaguuuaccuuguau

SEQ ID NO: 1404302 - RNA, 21 nt, Human
ugaguuggggucuggcagccu

SEQ ID NO: 1404303 - RNA, 19 nt, Human
ugaguuggggucuggcagc

SEQ ID NO: 1404304 - RNA, 17 nt, Human
ugaguuggggucuggca

SEQ ID NO: 1404305 - RNA, 22 nt, Human
ugaguuggcuuaccuggcccau

SEQ ID NO: 1404306 - RNA, 17 nt, Human
ugauagucuuuugcuuu

SEQ ID NO: 1404307 - RNA, 16 nt, Human
ugauagucuuuugcuu

SEQ ID NO: 1404308 - RNA, 22 nt, Human
ugauagguuauuuugauguaaa

SEQ ID NO: 1404309 - RNA, 19 nt, Human
ugauaggguuugugacagg

SEQ ID NO: 1404310 - RNA, 22 nt, Human
ugauaggaagaggggaagcaga

SEQ ID NO: 1404311 - RNA, 16 nt, Human
ugaggagccccagcua

SEQ ID NO: 1404312 - RNA, 14 nt, Human
ugaggagccccagc

SEQ ID NO: 1404313 - RNA, 11 nt, Human
ugaggagcccc

SEQ ID NO: 1404314 - RNA, 22 nt, Human
ugaggagcagcaggagggggga

SEQ ID NO: 1404315 - RNA, 18 nt, Human
ugaggagauucugccuuu

SEQ ID NO: 1404316 - RNA, 15 nt, Human
ugaggagacacaccu

SEQ ID NO: 1404317 - RNA, 19 nt, Human
ugaggagacacaccugagg

SEQ ID NO: 1404318 - RNA, 17 nt, Human
ugaggacugauuucaga

SEQ ID NO: 1404319 - RNA, 23 nt, Human
ugagcucuugugaggaaagucau

SEQ ID NO: 1404320 - RNA, 11 nt, Human
ugaggcuggca

SEQ ID NO: 1404321 - RNA, 17 nt, Human
ugaggcuggcacaggac

SEQ ID NO: 1404322 - RNA, 15 nt, Human
ugaggcuggcacagg

SEQ ID NO: 1404323 - RNA, 14 nt, Human
ugaggcuggcacag

SEQ ID NO: 1404324 - RNA, 19 nt, Human
ugaggcuuuccaugggacc

SEQ ID NO: 1404325 - RNA, 17 nt, Human
ugagggaaaagaaaaag

SEQ ID NO: 1404326 - RNA, 23 nt, Human
ugaggcuuuggauuugacauugc

SEQ ID NO: 1404327 - RNA, 18 nt, Human
ugaggcuuuggauuugac

SEQ ID NO: 1404328 - RNA, 13 nt, Human
ugaggcuuuggau

SEQ ID NO: 1404329 - RNA, 14 nt, Human
ugaggcuuuccaug

SEQ ID NO: 1404330 - RNA, 19 nt, Human
ugaggagcagcaggagggg

SEQ ID NO: 1404331 - RNA, 21 nt, Human
ugaggcuguggucacagcgga

SEQ ID NO: 1404332 - RNA, 11 nt, Human
ugaggcugugg

SEQ ID NO: 1404333 - RNA, 18 nt, Human
ugaggcuguccuguacau

SEQ ID NO: 1404334 - RNA, 16 nt, Human
ugaggucuguuccuuu

SEQ ID NO: 1404335 - RNA, 14 nt, Human
ugaggucuguuccu

SEQ ID NO: 1404336 - RNA, 13 nt, Human
ugaggucuguucc

SEQ ID NO: 1404337 - RNA, 20 nt, Human
ugaggucuguucuuuccaaa

SEQ ID NO: 1404338 - RNA, 14 nt, Human
ugaggucuguucuu

SEQ ID NO: 1404339 - RNA, 15 nt, Human
ugaggucuguucuuu

SEQ ID NO: 1404340 - RNA, 17 nt, Human
ugagguuacuggaaauu

SEQ ID NO: 1404341 - RNA, 14 nt, Human
ugagguuacuggaa

SEQ ID NO: 1404342 - RNA, 15 nt, Human
ugaggugugucacaa

SEQ ID NO: 1404343 - RNA, 21 nt, Human
ugaguccuggaugauacuaau

SEQ ID NO: 1404344 - RNA, 19 nt, Human
ugaguccuggaugauacua

SEQ ID NO: 1404345 - RNA, 17 nt, Human
ugaguccuggaugauac

SEQ ID NO: 1404346 - RNA, 21 nt, Human
ugaucaguuuuuucaccugga

SEQ ID NO: 1404347 - RNA, 20 nt, Human
ugaucaguuaagaaauuuca

SEQ ID NO: 1404348 - RNA, 19 nt, Human
ugaucucagcucacugcaa

SEQ ID NO: 1404349 - RNA, 18 nt, Human
ugaucucagcucacugca

SEQ ID NO: 1404350 - RNA, 19 nt, Human
ugauaugcauauuuguuua

SEQ ID NO: 1404351 - RNA, 18 nt, Human
ugauaugcauauuuguuu

SEQ ID NO: 1404352 - RNA, 15 nt, Human
ugauaugcacaaugu

SEQ ID NO: 1404353 - RNA, 23 nt, Human
ugauaugcacaauguagauaagu

SEQ ID NO: 1404354 - RNA, 15 nt, Human
ugauauauuuuacaa

SEQ ID NO: 1404355 - RNA, 16 nt, Human
ugauaucccccagccu

SEQ ID NO: 1404356 - RNA, 23 nt, Human
ugaucagagccgugguccuuugg

SEQ ID NO: 1404357 - RNA, 22 nt, Human
ugaucagagccgugguccuuug

SEQ ID NO: 1404358 - RNA, 21 nt, Human
ugaucagagccgugguccuuu

SEQ ID NO: 1404359 - RNA, 18 nt, Human
ugaucagaccauaauguu

SEQ ID NO: 1404360 - RNA, 14 nt, Human
ugauauauuuuaca

SEQ ID NO: 1404361 - RNA, 13 nt, Human
ugauauauuuuac

SEQ ID NO: 1404362 - RNA, 22 nt, Human
ugauauauaaguguacauaugu

SEQ ID NO: 1404363 - RNA, 19 nt, Human
ugauauauaaguguacaua

SEQ ID NO: 1404364 - RNA, 18 nt, Human
ugauauauaaguguacau

SEQ ID NO: 1404365 - RNA, 21 nt, Human
ugauauagaaguauaaagaau

SEQ ID NO: 1404366 - RNA, 16 nt, Human
ugauauagaaguauaa

SEQ ID NO: 1404367 - RNA, 19 nt, Human
ugauauaaaucagauucuu

SEQ ID NO: 1404368 - RNA, 17 nt, Human
ugauauaaguguguguu

SEQ ID NO: 1404369 - RNA, 23 nt, Human
ugauauaaguguguguuuuucau

SEQ ID NO: 1404370 - RNA, 19 nt, Human
ugaugaaaauaaagaaugg

SEQ ID NO: 1404371 - RNA, 17 nt, Human
ugaugaaaauaaagaau

SEQ ID NO: 1404372 - RNA, 16 nt, Human
ugaugaaaauaaagaa

SEQ ID NO: 1404373 - RNA, 15 nt, Human
ugaugaaaauaaaga

SEQ ID NO: 1404374 - RNA, 21 nt, Human
ugaugccaaaaaaaaauacau

SEQ ID NO: 1404375 - RNA, 18 nt, Human
ugaugccaaaaaaaaaua

SEQ ID NO: 1404376 - RNA, 14 nt, Human
ugaugccaaaaaaa

SEQ ID NO: 1404377 - RNA, 13 nt, Human
ugaugaaaauaaa

SEQ ID NO: 1404378 - RNA, 12 nt, Human
ugaugaaaauaa

SEQ ID NO: 1404379 - RNA, 21 nt, Human
ugaugaaaaauugcugacugu

SEQ ID NO: 1404380 - RNA, 19 nt, Human
ugaugaaaaauugcugacu

SEQ ID NO: 1404381 - RNA, 14 nt, Human
ugaucuggaaccca

SEQ ID NO: 1404382 - RNA, 13 nt, Human
ugaucuggaaccc

SEQ ID NO: 1404383 - RNA, 22 nt, Human
ugaucugauaggguuugugaca

SEQ ID NO: 1404384 - RNA, 20 nt, Human
ugaucugauaggguuuguga

SEQ ID NO: 1404385 - RNA, 15 nt, Human
ugaugcugccccuca

SEQ ID NO: 1404386 - RNA, 23 nt, Human
ugauguaaaaucuugucaugugu

SEQ ID NO: 1404387 - RNA, 19 nt, Human
ugauguaaaaucuugucau

SEQ ID NO: 1404388 - RNA, 16 nt, Human
ugauguaaaaucuugu

SEQ ID NO: 1404389 - RNA, 15 nt, Human
ugauguaaaaucuug

SEQ ID NO: 1404390 - RNA, 11 nt, Human
ugauguaaaau

SEQ ID NO: 1404391 - RNA, 21 nt, Human
ugauguaaaaucuugucaugu

SEQ ID NO: 1404392 - RNA, 21 nt, Human
ugauguaaggaugggcauggu

SEQ ID NO: 1404393 - RNA, 22 nt, Human
ugauguaaucuugaauuguaac

SEQ ID NO: 1404394 - RNA, 13 nt, Human
ugauguacaugua

SEQ ID NO: 1404395 - RNA, 16 nt, Human
uggagaguuuccugaa

SEQ ID NO: 1404396 - RNA, 15 nt, Human
uggagaguuuccuga

SEQ ID NO: 1404397 - RNA, 22 nt, Human
uggagagcuaggagcaaagccu

SEQ ID NO: 1404398 - RNA, 23 nt, Human
uggagagcuaggagcaaagccug

SEQ ID NO: 1404399 - RNA, 17 nt, Human
uggagagcuaggagcaa

SEQ ID NO: 1404400 - RNA, 15 nt, Human
uggagagcuaggagc

SEQ ID NO: 1404401 - RNA, 14 nt, Human
uggagagcuaggag

SEQ ID NO: 1404402 - RNA, 18 nt, Human
uggagagcccugggaccg

SEQ ID NO: 1404403 - RNA, 20 nt, Human
uggagagcccugggaccgcu

SEQ ID NO: 1404404 - RNA, 16 nt, Human
uggagagcccugggac

SEQ ID NO: 1404405 - RNA, 15 nt, Human
uggagagcccuggga

SEQ ID NO: 1404406 - RNA, 14 nt, Human
uggagagcccuggg

SEQ ID NO: 1404407 - RNA, 13 nt, Human
uggagagcccugg

SEQ ID NO: 1404408 - RNA, 20 nt, Human
uggagaccccaccagccuca

SEQ ID NO: 1404409 - RNA, 13 nt, Human
uggagaccaccag

SEQ ID NO: 1404410 - RNA, 17 nt, Human
uggagaccaccagggca

SEQ ID NO: 1404411 - RNA, 14 nt, Human
uggacugguuuuca

SEQ ID NO: 1404412 - RNA, 21 nt, Human
uggacugucauagaaauuaca

SEQ ID NO: 1404413 - RNA, 15 nt, Human
uggacugucauagaa

SEQ ID NO: 1404414 - RNA, 23 nt, Human
uggacucuguccugaaggccuga

SEQ ID NO: 1404415 - RNA, 22 nt, Human
uggacucuguccugaaggccug

SEQ ID NO: 1404416 - RNA, 17 nt, Human
uggacucuguccugaag

SEQ ID NO: 1404417 - RNA, 15 nt, Human
uggacucuguccuga

SEQ ID NO: 1404418 - RNA, 13 nt, Human
uggacucuguccu

SEQ ID NO: 1404419 - RNA, 22 nt, Human
uggacucuggugccuccagagg

SEQ ID NO: 1404420 - RNA, 21 nt, Human
uggacucuggugccuccagag

SEQ ID NO: 1404421 - RNA, 16 nt, Human
uggaagaaggggcagg

SEQ ID NO: 1404422 - RNA, 21 nt, Human
uggaacuugccugccuuucca

SEQ ID NO: 1404423 - RNA, 18 nt, Human
uggaacuugccugccuuu

SEQ ID NO: 1404424 - RNA, 15 nt, Human
uggaacuugccugcc

SEQ ID NO: 1404425 - RNA, 13 nt, Human
uggacuaaaagau

SEQ ID NO: 1404426 - RNA, 14 nt, Human
uggacuaaaagaua

SEQ ID NO: 1404427 - RNA, 15 nt, Human
uggacuaaaagauau

SEQ ID NO: 1404428 - RNA, 21 nt, Human
uggacuaaaagauauaagugc

SEQ ID NO: 1404429 - RNA, 22 nt, Human
uggacuaaaagauauaagugcu

SEQ ID NO: 1404430 - RNA, 23 nt, Human
uggacuaaaagauauaagugcug

SEQ ID NO: 1404431 - RNA, 16 nt, Human
uggcaaccagaccauu

SEQ ID NO: 1404432 - RNA, 20 nt, Human
uggauuuaaaagccugcuca

SEQ ID NO: 1404433 - RNA, 18 nt, Human
uggauuuaaaagccugcu

SEQ ID NO: 1404434 - RNA, 16 nt, Human
uggauuuaaaagccug

SEQ ID NO: 1404435 - RNA, 17 nt, Human
uggauuuaacagaaaug

SEQ ID NO: 1404436 - RNA, 15 nt, Human
uggauuuaacagaaa

SEQ ID NO: 1404437 - RNA, 14 nt, Human
uggaugcagugcuc

SEQ ID NO: 1404438 - RNA, 16 nt, Human
uggcaaggaaaaacag

SEQ ID NO: 1404439 - RNA, 21 nt, Human
uggcaaggacuuuguacauuu

SEQ ID NO: 1404440 - RNA, 20 nt, Human
uggcaaggacuuuguacauu

SEQ ID NO: 1404441 - RNA, 19 nt, Human
uggcaaggacuuuguacau

SEQ ID NO: 1404442 - RNA, 13 nt, Human
uggcaaggacuuu

SEQ ID NO: 1404443 - RNA, 19 nt, Human
uggagggggaauggcagca

SEQ ID NO: 1404444 - RNA, 23 nt, Human
uggaggggcagagccaggaagau

SEQ ID NO: 1404445 - RNA, 13 nt, Human
uggaggggcagag

SEQ ID NO: 1404446 - RNA, 14 nt, Human
uggaggggcagagc

SEQ ID NO: 1404447 - RNA, 16 nt, Human
uggaggggcagagcca

SEQ ID NO: 1404448 - RNA, 18 nt, Human
uggaggggcagagccagg

SEQ ID NO: 1404449 - RNA, 21 nt, Human
uggaggggcagagccaggaag

SEQ ID NO: 1404450 - RNA, 18 nt, Human
uggagauccuccugcaga

SEQ ID NO: 1404451 - RNA, 16 nt, Human
uggagauccuccugca

SEQ ID NO: 1404452 - RNA, 14 nt, Human
uggagauccuccug

SEQ ID NO: 1404453 - RNA, 23 nt, Human
uggagaucaccaguguguggcuu

SEQ ID NO: 1404454 - RNA, 17 nt, Human
uggagaguuuccugaaa

SEQ ID NO: 1404455 - RNA, 21 nt, Human
uggagauccuccugcagacca

SEQ ID NO: 1404456 - RNA, 20 nt, Human
uggagauccuccugcagacc

SEQ ID NO: 1404457 - RNA, 14 nt, Human
uggagaugaggcca

SEQ ID NO: 1404458 - RNA, 15 nt, Human
uggagaugaggccag

SEQ ID NO: 1404459 - RNA, 16 nt, Human
uggagaugaggccaga

SEQ ID NO: 1404460 - RNA, 17 nt, Human
uggagaugaggccagac

SEQ ID NO: 1404461 - RNA, 13 nt, Human
uggauauuuguau

SEQ ID NO: 1404462 - RNA, 11 nt, Human
uggauauuugu

SEQ ID NO: 1404463 - RNA, 14 nt, Human
uggauauuguuacg

SEQ ID NO: 1404464 - RNA, 17 nt, Human
uggauauguaaaacauu

SEQ ID NO: 1404465 - RNA, 21 nt, Human
uggauauguaaaacauuuauu

SEQ ID NO: 1404466 - RNA, 16 nt, Human
uggauauguaaaacau

SEQ ID NO: 1404467 - RNA, 17 nt, Human
uggauauaguuuuacuu

SEQ ID NO: 1404468 - RNA, 16 nt, Human
uggaucacaagaugga

SEQ ID NO: 1404469 - RNA, 15 nt, Human
uggaucacaaagugg

SEQ ID NO: 1404470 - RNA, 14 nt, Human
uggaucacaaagug

SEQ ID NO: 1404471 - RNA, 19 nt, Human
uggaucaaauccagccugc

SEQ ID NO: 1404472 - RNA, 15 nt, Human
uggaugcagugcucg

SEQ ID NO: 1404473 - RNA, 18 nt, Human
ugcuguuuugauuuguac

SEQ ID NO: 1404474 - RNA, 23 nt, Human
ugcuguuuuaaacauuaauagca

SEQ ID NO: 1404475 - RNA, 19 nt, Human
ugccugucccacccccacc

SEQ ID NO: 1404476 - RNA, 16 nt, Human
ugccugucccaccccc

SEQ ID NO: 1404477 - RNA, 17 nt, Human
ugcuuaaaauaagcagg

SEQ ID NO: 1404478 - RNA, 15 nt, Human
ugcuuaaaauaagca

SEQ ID NO: 1404479 - RNA, 14 nt, Human
ugcuuaaaauaagc

SEQ ID NO: 1404480 - RNA, 18 nt, Human
ugcuguuuuguuauauaa

SEQ ID NO: 1404481 - RNA, 19 nt, Human
ugcuguuuuguuauauaau

SEQ ID NO: 1404482 - RNA, 16 nt, Human
ugcuguuuuguuauau

SEQ ID NO: 1404483 - RNA, 13 nt, Human
ugcuguuuuguua

SEQ ID NO: 1404484 - RNA, 12 nt, Human
ugcuguuuuguu

SEQ ID NO: 1404485 - RNA, 19 nt, Human
ugcuuaaaauaagcaggug

SEQ ID NO: 1404486 - RNA, 15 nt, Human
ugcuuaauaaauugu

SEQ ID NO: 1404487 - RNA, 19 nt, Human
ugcuuaacuucacauauug

SEQ ID NO: 1404488 - RNA, 16 nt, Human
ugcuuaauucaaauaa

SEQ ID NO: 1404489 - RNA, 17 nt, Human
ugcuuaauucaaauaau

SEQ ID NO: 1404490 - RNA, 18 nt, Human
ugcuuaauucaaauaaua

SEQ ID NO: 1404491 - RNA, 20 nt, Human
ugcuuaauucaaauaauaau

SEQ ID NO: 1404492 - RNA, 13 nt, Human
ugcuuaacuucac

SEQ ID NO: 1404493 - RNA, 14 nt, Human
ugcuuaacuucaca

SEQ ID NO: 1404494 - RNA, 17 nt, Human
ugcuuaacuucacauau

SEQ ID NO: 1404495 - RNA, 18 nt, Human
ugcuuaacuucacauauu

SEQ ID NO: 1404496 - RNA, 15 nt, Human
ugcuucccuaaucua

SEQ ID NO: 1404497 - RNA, 12 nt, Human
ugcuuccagugu

SEQ ID NO: 1404498 - RNA, 22 nt, Human
ugcuuaccucucagccuuagcu

SEQ ID NO: 1404499 - RNA, 14 nt, Human
ugcuuaccucucag

SEQ ID NO: 1404500 - RNA, 13 nt, Human
ugcuuccuccugg

SEQ ID NO: 1404501 - RNA, 12 nt, Human
ugcuuccuccug

SEQ ID NO: 1404502 - RNA, 16 nt, Human
ugcuucccuuuccuga

SEQ ID NO: 1404503 - RNA, 13 nt, Human
ugcuucgggcccu

SEQ ID NO: 1404504 - RNA, 22 nt, Human
ugcuuccugucuuauccuccac

SEQ ID NO: 1404505 - RNA, 15 nt, Human
ugcuuccuccuggaa

SEQ ID NO: 1404506 - RNA, 14 nt, Human
ugcuuccuccugga

SEQ ID NO: 1404507 - RNA, 21 nt, Human
ugcuucucagauuucugagga

SEQ ID NO: 1404508 - RNA, 22 nt, Human
ugcuucucagauuucugaggaa

SEQ ID NO: 1404509 - RNA, 17 nt, Human
ugcuucuguuuuauaau

SEQ ID NO: 1404510 - RNA, 13 nt, Human
ugcuucucugacu

SEQ ID NO: 1404511 - RNA, 12 nt, Human
ugcuucucugac

SEQ ID NO: 1404512 - RNA, 22 nt, Human
ugcuucucccaggcaaggcugu

SEQ ID NO: 1404513 - RNA, 21 nt, Human
ugcuucucccaggcaaggcug

SEQ ID NO: 1404514 - RNA, 20 nt, Human
ugcuucucccaggcaaggcu

SEQ ID NO: 1404515 - RNA, 17 nt, Human
ugcuucucccaggcaag

SEQ ID NO: 1404516 - RNA, 16 nt, Human
ugcuucucccaggcaa

SEQ ID NO: 1404517 - RNA, 13 nt, Human
ugcuucucccagg

SEQ ID NO: 1404518 - RNA, 13 nt, Human
ugcuucuccagcc

SEQ ID NO: 1404519 - RNA, 19 nt, Human
uggaaaccuuccacccagu

SEQ ID NO: 1404520 - RNA, 16 nt, Human
uggaaaccuuccaccc

SEQ ID NO: 1404521 - RNA, 22 nt, Human
uggaaaaguauguuagugcaaa

SEQ ID NO: 1404522 - RNA, 13 nt, Human
uggaacacuucga

SEQ ID NO: 1404523 - RNA, 18 nt, Human
uggaacauaaaaaggaca

SEQ ID NO: 1404524 - RNA, 23 nt, Human
uggaaccucagccuggccagaca

SEQ ID NO: 1404525 - RNA, 19 nt, Human
uggaaccucagccuggcca

SEQ ID NO: 1404526 - RNA, 18 nt, Human
uggaaccucagccuggcc

SEQ ID NO: 1404527 - RNA, 20 nt, Human
uggaacauaaaaaggacauc

SEQ ID NO: 1404528 - RNA, 22 nt, Human
uggaacuugccugccuuuccau

SEQ ID NO: 1404529 - RNA, 16 nt, Human
uggaacuugaacugau

SEQ ID NO: 1404530 - RNA, 15 nt, Human
uggaacuugaacuga

SEQ ID NO: 1404531 - RNA, 13 nt, Human
uggaacuugaacu

SEQ ID NO: 1404532 - RNA, 13 nt, Human
uggaaccuuguuu

SEQ ID NO: 1404533 - RNA, 21 nt, Human
ugcuuuccauucgugaaaaca

SEQ ID NO: 1404534 - RNA, 20 nt, Human
ugcuuuccauucgugaaaac

SEQ ID NO: 1404535 - RNA, 19 nt, Human
ugcuuuccauucgugaaaa

SEQ ID NO: 1404536 - RNA, 22 nt, Human
ugcuucuguuuuauaauuuugu

SEQ ID NO: 1404537 - RNA, 13 nt, Human
ugcuuugauauuu

SEQ ID NO: 1404538 - RNA, 15 nt, Human
ugcuuugccccugag

SEQ ID NO: 1404539 - RNA, 17 nt, Human
ugcuuugauauuucaau

SEQ ID NO: 1404540 - RNA, 15 nt, Human
ugcuuugagagagaa

SEQ ID NO: 1404541 - RNA, 14 nt, Human
ugcuuucugaucaa

SEQ ID NO: 1404542 - RNA, 22 nt, Human
ugcuuucuccuuuaauuguaaa

SEQ ID NO: 1404543 - RNA, 20 nt, Human
ugcuuucuccuuuaauugua

SEQ ID NO: 1404544 - RNA, 15 nt, Human
ugcuuucuccuuuaa

SEQ ID NO: 1404545 - RNA, 18 nt, Human
ugcuuucgaacugcuagu

SEQ ID NO: 1404546 - RNA, 22 nt, Human
ugcuuugcccuucuuucuaccc

SEQ ID NO: 1404547 - RNA, 17 nt, Human
ugcuuuggaaaacccag

SEQ ID NO: 1404548 - RNA, 22 nt, Human
uggccuaagaggcugcccuccu

SEQ ID NO: 1404549 - RNA, 21 nt, Human
uggccuaagaggcugcccucc

SEQ ID NO: 1404550 - RNA, 15 nt, Human
uggccccucucccuu

SEQ ID NO: 1404551 - RNA, 23 nt, Human
uggccuaaccugccgagagucca

SEQ ID NO: 1404552 - RNA, 20 nt, Human
uggccuagcauacguacaca

SEQ ID NO: 1404553 - RNA, 20 nt, Human
uggccccugaacaagaauug

SEQ ID NO: 1404554 - RNA, 14 nt, Human
uggccccugaacaa

SEQ ID NO: 1404555 - RNA, 18 nt, Human
uggccccucugaccugca

SEQ ID NO: 1404556 - RNA, 16 nt, Human
uggccccucugaccug

SEQ ID NO: 1404557 - RNA, 14 nt, Human
uggccccucugacc

SEQ ID NO: 1404558 - RNA, 13 nt, Human
uggccccucugac

SEQ ID NO: 1404559 - RNA, 12 nt, Human
uggccccucuga

SEQ ID NO: 1404560 - RNA, 10 nt, Human
uggccccucu

SEQ ID NO: 1404561 - RNA, 19 nt, Human
uggccccucccccugccag

SEQ ID NO: 1404562 - RNA, 20 nt, Human
uggccccaggaccuggcugc

SEQ ID NO: 1404563 - RNA, 15 nt, Human
uggccccaggaccug

SEQ ID NO: 1404564 - RNA, 12 nt, Human
uggccccaggac

SEQ ID NO: 1404565 - RNA, 19 nt, Human
uggccccagcacagcuuga

SEQ ID NO: 1404566 - RNA, 18 nt, Human
uggccccagcacagcuug

SEQ ID NO: 1404567 - RNA, 17 nt, Human
uggccccagcacagcuu

SEQ ID NO: 1404568 - RNA, 14 nt, Human
uggccccagcacag

SEQ ID NO: 1404569 - RNA, 13 nt, Human
uggccccagcaca

SEQ ID NO: 1404570 - RNA, 22 nt, Human
uggcagcucuggacagccccac

SEQ ID NO: 1404571 - RNA, 21 nt, Human
uggcagcucuggacagcccca

SEQ ID NO: 1404572 - RNA, 11 nt, Human
uggcagcucug

SEQ ID NO: 1404573 - RNA, 15 nt, Human
uggccucucucuagg

SEQ ID NO: 1404574 - RNA, 23 nt, Human
uggccucucuauccucucuuccu

SEQ ID NO: 1404575 - RNA, 17 nt, Human
uggccucucuauccucu

SEQ ID NO: 1404576 - RNA, 14 nt, Human
uggccucucuaucc

SEQ ID NO: 1404577 - RNA, 21 nt, Human
uggccuccugccucuacuggg

SEQ ID NO: 1404578 - RNA, 16 nt, Human
uggccuccugccucua

SEQ ID NO: 1404579 - RNA, 15 nt, Human
uggccuccugccucu

SEQ ID NO: 1404580 - RNA, 14 nt, Human
uggccuccugccuc

SEQ ID NO: 1404581 - RNA, 13 nt, Human
uggccuccugccu

SEQ ID NO: 1404582 - RNA, 20 nt, Human
uggccucccaaaugagccau

SEQ ID NO: 1404583 - RNA, 22 nt, Human
uggccucacccaccccugcaca

SEQ ID NO: 1404584 - RNA, 15 nt, Human
uggccucacccaccc

SEQ ID NO: 1404585 - RNA, 21 nt, Human
uggccuagaccagcagacaga

SEQ ID NO: 1404586 - RNA, 18 nt, Human
uggccuagaccagcagac

SEQ ID NO: 1404587 - RNA, 23 nt, Human
uggccuagcauacguacacauuu

SEQ ID NO: 1404588 - RNA, 21 nt, Human
uggcuccagaugcagggcagu

SEQ ID NO: 1404589 - RNA, 20 nt, Human
uggcuccagaugcagggcag

SEQ ID NO: 1404590 - RNA, 23 nt, Human
uggcuccagaugcagggcaguca

SEQ ID NO: 1404591 - RNA, 22 nt, Human
uggccucucucuaggguacaug

SEQ ID NO: 1404592 - RNA, 23 nt, Human
uggcugggacguggcucagccag

SEQ ID NO: 1404593 - RNA, 19 nt, Human
uggcugggacguggcucag

SEQ ID NO: 1404594 - RNA, 15 nt, Human
uggcugggacguggc

SEQ ID NO: 1404595 - RNA, 17 nt, Human
uggcuggcugagggcag

SEQ ID NO: 1404596 - RNA, 18 nt, Human
uggcuggcugagggcagu

SEQ ID NO: 1404597 - RNA, 15 nt, Human
uggcuggcugagggc

SEQ ID NO: 1404598 - RNA, 14 nt, Human
uggcuggcugaggg

SEQ ID NO: 1404599 - RNA, 13 nt, Human
uggcuggcugagg

SEQ ID NO: 1404600 - RNA, 12 nt, Human
uggcuggcugag

SEQ ID NO: 1404601 - RNA, 15 nt, Human
uggcuggccucaccc

SEQ ID NO: 1404602 - RNA, 19 nt, Human
uggcuggccucacccaccc

SEQ ID NO: 1404603 - RNA, 23 nt, Human
uggcuugggacuaaaugcccugc

SEQ ID NO: 1404604 - RNA, 18 nt, Human
uggcuugggacuaaaugc

SEQ ID NO: 1404605 - RNA, 22 nt, Human
uggcuuggccacagccagggga

SEQ ID NO: 1404606 - RNA, 23 nt, Human
uggcuuggccacagccaggggag

SEQ ID NO: 1404607 - RNA, 20 nt, Human
uggcuuggccacagccaggg

SEQ ID NO: 1404608 - RNA, 19 nt, Human
uggcuuggccacagccagg

SEQ ID NO: 1404609 - RNA, 18 nt, Human
uggcuuggccacagccag

SEQ ID NO: 1404610 - RNA, 17 nt, Human
uggcuuggccacagcca

SEQ ID NO: 1404611 - RNA, 16 nt, Human
uggcuugggcagcauc

SEQ ID NO: 1404612 - RNA, 14 nt, Human
ugggaaugaagcaa

SEQ ID NO: 1404613 - RNA, 14 nt, Human
uggcuuuaaugaau

SEQ ID NO: 1404614 - RNA, 16 nt, Human
uggggcagcuccucug

SEQ ID NO: 1404615 - RNA, 15 nt, Human
uggggcagcuccucu

SEQ ID NO: 1404616 - RNA, 18 nt, Human
ugggccugcugcugagaa

SEQ ID NO: 1404617 - RNA, 17 nt, Human
ugggccugcugcugaga

SEQ ID NO: 1404618 - RNA, 16 nt, Human
ugggccugcugcugag

SEQ ID NO: 1404619 - RNA, 15 nt, Human
ugggccugcugcuga

SEQ ID NO: 1404620 - RNA, 14 nt, Human
ugggccugcugcug

SEQ ID NO: 1404621 - RNA, 13 nt, Human
ugggccugcugcu

SEQ ID NO: 1404622 - RNA, 12 nt, Human
ugggccugcugc

SEQ ID NO: 1404623 - RNA, 20 nt, Human
ugggccugcuccagaccuga

SEQ ID NO: 1404624 - RNA, 19 nt, Human
ugggccugcuccagaccug

SEQ ID NO: 1404625 - RNA, 18 nt, Human
ugggccugcuccagaccu

SEQ ID NO: 1404626 - RNA, 16 nt, Human
ugggccugcuccagac

SEQ ID NO: 1404627 - RNA, 15 nt, Human
ugggccugcuccaga

SEQ ID NO: 1404628 - RNA, 14 nt, Human
ugggccugcuccag

SEQ ID NO: 1404629 - RNA, 13 nt, Human
ugggccugcagaa

SEQ ID NO: 1404630 - RNA, 21 nt, Human
ugggccuauggagagcccugg

SEQ ID NO: 1404631 - RNA, 23 nt, Human
ugggccugcugcugagaaccugg

SEQ ID NO: 1404632 - RNA, 21 nt, Human
uggggccagauccagccuggg

SEQ ID NO: 1404633 - RNA, 18 nt, Human
ugggggcagcacaggagg

SEQ ID NO: 1404634 - RNA, 15 nt, Human
ugggggccuggcugg

SEQ ID NO: 1404635 - RNA, 13 nt, Human
ugggggccuggcu

SEQ ID NO: 1404636 - RNA, 12 nt, Human
ugggggccuggc

SEQ ID NO: 1404637 - RNA, 11 nt, Human
ugggggccugg

SEQ ID NO: 1404638 - RNA, 18 nt, Human
uggggccagauccagccu

SEQ ID NO: 1404639 - RNA, 16 nt, Human
uggggccagauccagc

SEQ ID NO: 1404640 - RNA, 15 nt, Human
uggggccagauccag

SEQ ID NO: 1404641 - RNA, 14 nt, Human
uggggccagaucca

SEQ ID NO: 1404642 - RNA, 13 nt, Human
uggggccagaucc

SEQ ID NO: 1404643 - RNA, 20 nt, Human
uggggcagcuccucugucuc

SEQ ID NO: 1404644 - RNA, 17 nt, Human
uggggccaggcuggguc

SEQ ID NO: 1404645 - RNA, 20 nt, Human
uggggccagauccagccugg

SEQ ID NO: 1404646 - RNA, 19 nt, Human
uggggccagauccagccug

SEQ ID NO: 1404647 - RNA, 20 nt, Human
uggggccaggcugggucgcc

SEQ ID NO: 1404648 - RNA, 19 nt, Human
ugggggccuggcuggcuga

SEQ ID NO: 1404649 - RNA, 17 nt, Human
ugggggccuggcuggcu

SEQ ID NO: 1404650 - RNA, 20 nt, Human
ugggggccuggcuggcugag

SEQ ID NO: 1404651 - RNA, 21 nt, Human
ugggggcggggugggaaagau

SEQ ID NO: 1404652 - RNA, 18 nt, Human
ugggguuaucucuguguu

SEQ ID NO: 1404653 - RNA, 15 nt, Human
uggggugugcuggga

SEQ ID NO: 1404654 - RNA, 13 nt, Human
uggggugugcugg

SEQ ID NO: 1404655 - RNA, 13 nt, Human
uggggggggugcu

SEQ ID NO: 1404656 - RNA, 15 nt, Human
ugggguggguauaaa

SEQ ID NO: 1404657 - RNA, 19 nt, Human
ugggguggguauaaaagau

SEQ ID NO: 1404658 - RNA, 19 nt, Human
ugggguuaucucuguguua

SEQ ID NO: 1404659 - RNA, 22 nt, Human
ugggccuauggagagcccuggg

SEQ ID NO: 1404660 - RNA, 20 nt, Human
ugggccuauggagagcccug

SEQ ID NO: 1404661 - RNA, 19 nt, Human
ugggccuauggagagcccu

SEQ ID NO: 1404662 - RNA, 18 nt, Human
ugggccuauggagagccc

SEQ ID NO: 1404663 - RNA, 17 nt, Human
ugggccuauggagagcc

SEQ ID NO: 1404664 - RNA, 15 nt, Human
ugggccuauggagag

SEQ ID NO: 1404665 - RNA, 15 nt, Human
ugggccuaggcugca

SEQ ID NO: 1404666 - RNA, 14 nt, Human
ugggccuaggcugc

SEQ ID NO: 1404667 - RNA, 21 nt, Human
ugggccggcuucaugccagcu

SEQ ID NO: 1404668 - RNA, 14 nt, Human
ugggccgcugccac

SEQ ID NO: 1404669 - RNA, 13 nt, Human
ugggccgcugcca

SEQ ID NO: 1404670 - RNA, 13 nt, Human
ugggcccuuugag

SEQ ID NO: 1404671 - RNA, 22 nt, Human
ugggcccuggggccuguacugc

SEQ ID NO: 1404672 - RNA, 19 nt, Human
ugggcccuggggccuguac

SEQ ID NO: 1404673 - RNA, 16 nt, Human
ugggcccuggggccug

SEQ ID NO: 1404674 - RNA, 14 nt, Human
ugggcccuggggcc

SEQ ID NO: 1404675 - RNA, 13 nt, Human
ugggcccuggggc

SEQ ID NO: 1404676 - RNA, 17 nt, Human
ugggcccugggcuggaa

SEQ ID NO: 1404677 - RNA, 16 nt, Human
ugggcccugggcugga

SEQ ID NO: 1404678 - RNA, 14 nt, Human
ugggcccugggcug

SEQ ID NO: 1404679 - RNA, 17 nt, Human
ugggaugguggagggcc

SEQ ID NO: 1404680 - RNA, 16 nt, Human
ugggaugguggagggc

SEQ ID NO: 1404681 - RNA, 18 nt, Human
ugggaugguggagggcca

SEQ ID NO: 1404682 - RNA, 17 nt, Human
ugggcagcaauuuaaau

SEQ ID NO: 1404683 - RNA, 18 nt, Human
ugggcagcaauuuaaaug

SEQ ID NO: 1404684 - RNA, 19 nt, Human
ugggcagcaauuuaaaugu

SEQ ID NO: 1404685 - RNA, 21 nt, Human
ugggcagcaauuuaaauguua

SEQ ID NO: 1404686 - RNA, 16 nt, Human
ugggacagcaaccugu

SEQ ID NO: 1404687 - RNA, 17 nt, Human
ugggaggagggcaggca

SEQ ID NO: 1404688 - RNA, 14 nt, Human
ugggaggagggcag

SEQ ID NO: 1404689 - RNA, 20 nt, Human
ugggaguuuuuaugagaaac

SEQ ID NO: 1404690 - RNA, 19 nt, Human
ugggaugagaguuuuggau

SEQ ID NO: 1404691 - RNA, 14 nt, Human
ugggaguuguaguu

SEQ ID NO: 1404692 - RNA, 22 nt, Human
ugggaguugaucgccuuuccca

SEQ ID NO: 1404693 - RNA, 18 nt, Human
ugggaguguugagcaucu

SEQ ID NO: 1404694 - RNA, 18 nt, Human
ugggaggagggcaggcau

SEQ ID NO: 1404695 - RNA, 16 nt, Human
ugggaguugucauuaa

SEQ ID NO: 1404696 - RNA, 17 nt, Human
uguaugacugcacauga

SEQ ID NO: 1404697 - RNA, 16 nt, Human
uguaugacugcacaug

SEQ ID NO: 1404698 - RNA, 17 nt, Human
uguauaagauccuagau

SEQ ID NO: 1404699 - RNA, 15 nt, Human
uguauaacuaggagc

SEQ ID NO: 1404700 - RNA, 16 nt, Human
uguauaacuaggagcu

SEQ ID NO: 1404701 - RNA, 19 nt, Human
uguauaaaugucuuuaaug

SEQ ID NO: 1404702 - RNA, 23 nt, Human
uguauaaacaagaaaaauaaaga

SEQ ID NO: 1404703 - RNA, 17 nt, Human
uguauaaacaagaaaaa

SEQ ID NO: 1404704 - RNA, 16 nt, Human
uguauaaacaagaaaa

SEQ ID NO: 1404705 - RNA, 15 nt, Human
uguauaguaaaucac

SEQ ID NO: 1404706 - RNA, 15 nt, Human
uguauagcugcuucc

SEQ ID NO: 1404707 - RNA, 23 nt, Human
uguagcuuuggaaguuuagcucu

SEQ ID NO: 1404708 - RNA, 15 nt, Human
uguagcuuugcucuu

SEQ ID NO: 1404709 - RNA, 13 nt, Human
uguagcuuugcuc

SEQ ID NO: 1404710 - RNA, 12 nt, Human
uguagcuuugcu

SEQ ID NO: 1404711 - RNA, 23 nt, Human
uguagcugugaccugcugagcuc

SEQ ID NO: 1404712 - RNA, 22 nt, Human
uguagcugugaccugcugagcu

SEQ ID NO: 1404713 - RNA, 17 nt, Human
uguacagcuggcucuac

SEQ ID NO: 1404714 - RNA, 23 nt, Human
uguacagcaaggagauuuacaac

SEQ ID NO: 1404715 - RNA, 22 nt, Human
uguacagcaaggagauuuacaa

SEQ ID NO: 1404716 - RNA, 18 nt, Human
uguauaaaagugugaaau

SEQ ID NO: 1404717 - RNA, 13 nt, Human
uguauaaaagugu

SEQ ID NO: 1404718 - RNA, 22 nt, Human
uguaguguuggagaagaacuga

SEQ ID NO: 1404719 - RNA, 13 nt, Human
uguauaaaauaau

SEQ ID NO: 1404720 - RNA, 15 nt, Human
uguauaaaauagaca

SEQ ID NO: 1404721 - RNA, 14 nt, Human
uguauaaaaucagc

SEQ ID NO: 1404722 - RNA, 16 nt, Human
uguauaaaaucagcca

SEQ ID NO: 1404723 - RNA, 13 nt, Human
uguauaaaauaga

SEQ ID NO: 1404724 - RNA, 21 nt, Human
uguauaaaagugugaaauaaa

SEQ ID NO: 1404725 - RNA, 14 nt, Human
uguauaaaauaauu

SEQ ID NO: 1404726 - RNA, 21 nt, Human
uguaguguuggagaagaacug

SEQ ID NO: 1404727 - RNA, 20 nt, Human
uguaguguuggagaagaacu

SEQ ID NO: 1404728 - RNA, 16 nt, Human
ugucauccucaaagaa

SEQ ID NO: 1404729 - RNA, 21 nt, Human
ugucaucaucauggccagcug

SEQ ID NO: 1404730 - RNA, 19 nt, Human
ugucaucaucauggccagc

SEQ ID NO: 1404731 - RNA, 18 nt, Human
ugucaucaucauggccag

SEQ ID NO: 1404732 - RNA, 17 nt, Human
ugucaucaucauggcca

SEQ ID NO: 1404733 - RNA, 21 nt, Human
ugucacugguagaccaaaaua

SEQ ID NO: 1404734 - RNA, 23 nt, Human
ugucacugguagaccaaaauaaa

SEQ ID NO: 1404735 - RNA, 21 nt, Human
ugucacaaugagauugaauuu

SEQ ID NO: 1404736 - RNA, 16 nt, Human
ugucacaaugagauug

SEQ ID NO: 1404737 - RNA, 23 nt, Human
uguaugguuuuugagauauuaau

SEQ ID NO: 1404738 - RNA, 22 nt, Human
uguaugguuuuugagauauuaa

SEQ ID NO: 1404739 - RNA, 21 nt, Human
uguaugguuuuugagauauua

SEQ ID NO: 1404740 - RNA, 22 nt, Human
uguauggguaggguaaaucagu

SEQ ID NO: 1404741 - RNA, 20 nt, Human
uguauggguaggguaaauca

SEQ ID NO: 1404742 - RNA, 23 nt, Human
uguauggaaauaaauguaucaua

SEQ ID NO: 1404743 - RNA, 18 nt, Human
uguauggaaauaaaugua

SEQ ID NO: 1404744 - RNA, 16 nt, Human
ugucaauuucuguguu

SEQ ID NO: 1404745 - RNA, 15 nt, Human
ugucaauuucugugu

SEQ ID NO: 1404746 - RNA, 19 nt, Human
uguauuuuaaaagaaugau

SEQ ID NO: 1404747 - RNA, 18 nt, Human
uguauuuuaaaagaauga

SEQ ID NO: 1404748 - RNA, 14 nt, Human
ugucuauucagcuu

SEQ ID NO: 1404749 - RNA, 13 nt, Human
ugucuauucagcu

SEQ ID NO: 1404750 - RNA, 13 nt, Human
ugucuauaaagca

SEQ ID NO: 1404751 - RNA, 18 nt, Human
ugucuauuaccuguuagu

SEQ ID NO: 1404752 - RNA, 16 nt, Human
ugucucaccuggacuu

SEQ ID NO: 1404753 - RNA, 17 nt, Human
ugucucaggcugccuga

SEQ ID NO: 1404754 - RNA, 16 nt, Human
ugucucaggcugccug

SEQ ID NO: 1404755 - RNA, 13 nt, Human
ugucucaggcugc

SEQ ID NO: 1404756 - RNA, 20 nt, Human
ugucuacauaugaucugucu

SEQ ID NO: 1404757 - RNA, 12 nt, Human
ugucuauaaagc

SEQ ID NO: 1404758 - RNA, 14 nt, Human
ugucuauaaagcau

SEQ ID NO: 1404759 - RNA, 20 nt, Human
ugucuauggauuugccuucu

SEQ ID NO: 1404760 - RNA, 20 nt, Human
ugucuuaaacuaaaugugca

SEQ ID NO: 1404761 - RNA, 14 nt, Human
ugucuuaaugaagu

SEQ ID NO: 1404762 - RNA, 15 nt, Human
ugucuuaaugaaguu

SEQ ID NO: 1404763 - RNA, 18 nt, Human
ugucuuaaugaaguuuga

SEQ ID NO: 1404764 - RNA, 19 nt, Human
ugucuuaaugaaguuugaa

SEQ ID NO: 1404765 - RNA, 20 nt, Human
ugucuuaaugaaguuugaau

SEQ ID NO: 1404766 - RNA, 21 nt, Human
ugucuuaaugaaguuugaaug

SEQ ID NO: 1404767 - RNA, 22 nt, Human
ugucuuaaugaaguuugaaugu

SEQ ID NO: 1404768 - RNA, 16 nt, Human
ugucuguuguauucau

SEQ ID NO: 1404769 - RNA, 21 nt, Human
ugucuguucuacauagaugcu

SEQ ID NO: 1404770 - RNA, 15 nt, Human
ugucuguucuacaua

SEQ ID NO: 1404771 - RNA, 18 nt, Human
ugucuuaaacuaaaugug

SEQ ID NO: 1404772 - RNA, 21 nt, Human
ugucugaucguucaaagcaug

SEQ ID NO: 1404773 - RNA, 20 nt, Human
ugucucaggcugccugaguc

SEQ ID NO: 1404774 - RNA, 19 nt, Human
ugucucaggcugccugagu

SEQ ID NO: 1404775 - RNA, 18 nt, Human
ugucucaggcugccugag

SEQ ID NO: 1404776 - RNA, 20 nt, Human
ugucugagacagaaucucag

SEQ ID NO: 1404777 - RNA, 13 nt, Human
ugucuguucuaca

SEQ ID NO: 1404778 - RNA, 20 nt, Human
ugucuguguuuugaaagaau

SEQ ID NO: 1404779 - RNA, 15 nt, Human
ugucuguggauuuuu

SEQ ID NO: 1404780 - RNA, 19 nt, Human
ugucuguggcaaaaguuua

SEQ ID NO: 1404781 - RNA, 20 nt, Human
ugucugugacuuuugugaaa

SEQ ID NO: 1404782 - RNA, 14 nt, Human
ugucugucuguccc

SEQ ID NO: 1404783 - RNA, 15 nt, Human
ugucugucuguccca

SEQ ID NO: 1404784 - RNA, 15 nt, Human
ugucugucugucugu

SEQ ID NO: 1404785 - RNA, 16 nt, Human
ugucugucugucuguc

SEQ ID NO: 1404786 - RNA, 19 nt, Human
uguccugagccccagggag

SEQ ID NO: 1404787 - RNA, 18 nt, Human
uguccugagccccaggga

SEQ ID NO: 1404788 - RNA, 17 nt, Human
uguccugagccccaggg

SEQ ID NO: 1404789 - RNA, 14 nt, Human
uguccugagcccca

SEQ ID NO: 1404790 - RNA, 17 nt, Human
uguccugaccugucuca

SEQ ID NO: 1404791 - RNA, 21 nt, Human
uguccucccgagcuccucuuc

SEQ ID NO: 1404792 - RNA, 17 nt, Human
uguccucccgagcuccu

SEQ ID NO: 1404793 - RNA, 13 nt, Human
uguccucagcccc

SEQ ID NO: 1404794 - RNA, 23 nt, Human
uguccuccaacaccaagcacagc

SEQ ID NO: 1404795 - RNA, 20 nt, Human
uguccuaucuccagcggccc

SEQ ID NO: 1404796 - RNA, 22 nt, Human
uguccuagcacagauggccagc

SEQ ID NO: 1404797 - RNA, 21 nt, Human
uguccuagcacagauggccag

SEQ ID NO: 1404798 - RNA, 18 nt, Human
uguccuagcacagauggc

SEQ ID NO: 1404799 - RNA, 22 nt, Human
ugucauccucaaagaaagugua

SEQ ID NO: 1404800 - RNA, 21 nt, Human
ugucauccucaaagaaagugu

SEQ ID NO: 1404801 - RNA, 20 nt, Human
ugucauccucaaagaaagug

SEQ ID NO: 1404802 - RNA, 19 nt, Human
ugucauccucaaagaaagu

SEQ ID NO: 1404803 - RNA, 14 nt, Human
ugucauccucacag

SEQ ID NO: 1404804 - RNA, 23 nt, Human
ugucauccucaaagaaaguguau

SEQ ID NO: 1404805 - RNA, 12 nt, Human
uguccugccugu

SEQ ID NO: 1404806 - RNA, 24 nt, Human
uguccugccacccagccccagcca

SEQ ID NO: 1404807 - RNA, 24 nt, Human
uguccugccuauuaucugucagcu

SEQ ID NO: 1404808 - RNA, 17 nt, Human
uguccugccuauuaucu

SEQ ID NO: 1404809 - RNA, 22 nt, Human
uguccugccacccagccccagc

SEQ ID NO: 1404810 - RNA, 18 nt, Human
uguccugccacccagccc

SEQ ID NO: 1404811 - RNA, 16 nt, Human
uguccugagcucagcg

SEQ ID NO: 1404812 - RNA, 17 nt, Human
uguccugagcucagcgu

SEQ ID NO: 1404813 - RNA, 15 nt, Human
uguccugagcucagc

SEQ ID NO: 1404814 - RNA, 14 nt, Human
uguccugagcucag

SEQ ID NO: 1404815 - RNA, 12 nt, Human
uguccugagcuc

SEQ ID NO: 1404816 - RNA, 21 nt, Human
uguccugagccccagggagag

SEQ ID NO: 1404817 - RNA, 18 nt, Human
uguccugcaccggggccu

SEQ ID NO: 1404818 - RNA, 16 nt, Human
uguccugccuguggcc

SEQ ID NO: 1404819 - RNA, 17 nt, Human
uguccugggccugcaga

SEQ ID NO: 1404820 - RNA, 15 nt, Human
uguccugggccugca

SEQ ID NO: 1404821 - RNA, 14 nt, Human
uguccugggccugc

SEQ ID NO: 1404822 - RNA, 18 nt, Human
ugucuaagauucuagauc

SEQ ID NO: 1404823 - RNA, 13 nt, Human
uguccugguggua

SEQ ID NO: 1404824 - RNA, 17 nt, Human
ugucuaagauucuagau

SEQ ID NO: 1404825 - RNA, 22 nt, Human
ugucuacacuaagagagaauga

SEQ ID NO: 1404826 - RNA, 23 nt, Human
ugucuacacagauguucacccaa

SEQ ID NO: 1404827 - RNA, 17 nt, Human
ugucuacacuaagagag

SEQ ID NO: 1404828 - RNA, 22 nt, Human
uggugcaaguugaggacuucuu

SEQ ID NO: 1404829 - RNA, 19 nt, Human
uggugcaaguugaggacuu

SEQ ID NO: 1404830 - RNA, 16 nt, Human
uggugcaaguugagga

SEQ ID NO: 1404831 - RNA, 15 nt, Human
ugguggccaugcucc

SEQ ID NO: 1404832 - RNA, 14 nt, Human
ugguggccaugcuc

SEQ ID NO: 1404833 - RNA, 23 nt, Human
uggugcaaguugaggacuucuug

SEQ ID NO: 1404834 - RNA, 21 nt, Human
uggguagaaagagauacagag

SEQ ID NO: 1404835 - RNA, 14 nt, Human
uggguagacacaca

SEQ ID NO: 1404836 - RNA, 23 nt, Human
uggugggccaacaaagaacacua

SEQ ID NO: 1404837 - RNA, 20 nt, Human
uggugggccaacaaagaaca

SEQ ID NO: 1404838 - RNA, 16 nt, Human
ugguggccuggucccu

SEQ ID NO: 1404839 - RNA, 22 nt, Human
ugguggcccucuccccugcccc

SEQ ID NO: 1404840 - RNA, 23 nt, Human
ugguggcccucuccccugccccc

SEQ ID NO: 1404841 - RNA, 21 nt, Human
ugguggcccucuccccugccc

SEQ ID NO: 1404842 - RNA, 19 nt, Human
ugguggcccucuccccugc

SEQ ID NO: 1404843 - RNA, 16 nt, Human
ugguggcccucucccc

SEQ ID NO: 1404844 - RNA, 14 nt, Human
ugguggcccucucc

SEQ ID NO: 1404845 - RNA, 21 nt, Human
ugguggccaugcuccucuucc

SEQ ID NO: 1404846 - RNA, 20 nt, Human
ugguggccaugcuccucuuc

SEQ ID NO: 1404847 - RNA, 15 nt, Human
ugguggccugguccc

SEQ ID NO: 1404848 - RNA, 18 nt, Human
ugguguaagguacuuuca

SEQ ID NO: 1404849 - RNA, 19 nt, Human
uggugguuuucuguucuuu

SEQ ID NO: 1404850 - RNA, 17 nt, Human
uggugguuucagaaaug

SEQ ID NO: 1404851 - RNA, 18 nt, Human
uggugguuucagaaaugu

SEQ ID NO: 1404852 - RNA, 18 nt, Human
ugguggguccaugggcag

SEQ ID NO: 1404853 - RNA, 17 nt, Human
ugguggguccaugggca

SEQ ID NO: 1404854 - RNA, 16 nt, Human
ugguggguccaugggc

SEQ ID NO: 1404855 - RNA, 14 nt, Human
ugguggggcagcuc

SEQ ID NO: 1404856 - RNA, 15 nt, Human
ugguggucuguuggc

SEQ ID NO: 1404857 - RNA, 15 nt, Human
ugguggucccugggu

SEQ ID NO: 1404858 - RNA, 14 nt, Human
ugguggucccuggg

SEQ ID NO: 1404859 - RNA, 16 nt, Human
uggugguauuuucaau

SEQ ID NO: 1404860 - RNA, 23 nt, Human
uggugggugccuaggccugggca

SEQ ID NO: 1404861 - RNA, 14 nt, Human
uggugguagagaag

SEQ ID NO: 1404862 - RNA, 22 nt, Human
ugguuccagggucccucugugu

SEQ ID NO: 1404863 - RNA, 21 nt, Human
ugguuccagggucccucugug

SEQ ID NO: 1404864 - RNA, 12 nt, Human
ugguuccagggu

SEQ ID NO: 1404865 - RNA, 16 nt, Human
ugguucauuaauucua

SEQ ID NO: 1404866 - RNA, 21 nt, Human
ugguguccagacagagcccug

SEQ ID NO: 1404867 - RNA, 18 nt, Human
ugguguccagacagagcc

SEQ ID NO: 1404868 - RNA, 19 nt, Human
uggugucagacccuggagg

SEQ ID NO: 1404869 - RNA, 18 nt, Human
uggugucagacccuggag

SEQ ID NO: 1404870 - RNA, 20 nt, Human
ugguguagcuacagagaaac

SEQ ID NO: 1404871 - RNA, 18 nt, Human
ugguguagcuacagagaa

SEQ ID NO: 1404872 - RNA, 17 nt, Human
ugguguagcuacagaga

SEQ ID NO: 1404873 - RNA, 16 nt, Human
ugguguagcuacagag

SEQ ID NO: 1404874 - RNA, 15 nt, Human
ugguguagcuacaga

SEQ ID NO: 1404875 - RNA, 17 nt, Human
ugguguagaacacuaau

SEQ ID NO: 1404876 - RNA, 21 nt, Human
ugguguagaacacuaauucau

SEQ ID NO: 1404877 - RNA, 15 nt, Human
ugguguagaacacua

SEQ ID NO: 1404878 - RNA, 22 nt, Human
ugguguagcuacagagaaacca

SEQ ID NO: 1404879 - RNA, 23 nt, Human
ugguucuugaggggaccaggagu

SEQ ID NO: 1404880 - RNA, 21 nt, Human
ugguucuugaggggaccagga

SEQ ID NO: 1404881 - RNA, 15 nt, Human
ugguucuugagggga

SEQ ID NO: 1404882 - RNA, 17 nt, Human
ugguucuggcuguuuga

SEQ ID NO: 1404883 - RNA, 22 nt, Human
ugguucugagauggcucccagg

SEQ ID NO: 1404884 - RNA, 18 nt, Human
ugguucugagauggcucc

SEQ ID NO: 1404885 - RNA, 18 nt, Human
ugguucucaauuccaaca

SEQ ID NO: 1404886 - RNA, 23 nt, Human
ugguucucaauuccaacaguuua

SEQ ID NO: 1404887 - RNA, 16 nt, Human
ugguucucaauuccaa

SEQ ID NO: 1404888 - RNA, 23 nt, Human
ugguugaacucugguggcacagg

SEQ ID NO: 1404889 - RNA, 16 nt, Human
ugguugaaaauaaaaa

SEQ ID NO: 1404890 - RNA, 19 nt, Human
ugguucuuguguuggcugu

SEQ ID NO: 1404891 - RNA, 22 nt, Human
ugguucuugaggggaccaggag

SEQ ID NO: 1404892 - RNA, 12 nt, Human
ugguugaggaaa

SEQ ID NO: 1404893 - RNA, 22 nt, Human
ugguucuaaggaccugaaauuc

SEQ ID NO: 1404894 - RNA, 17 nt, Human
ugguucuaaggaccuga

SEQ ID NO: 1404895 - RNA, 16 nt, Human
ugguuccccaguagag

SEQ ID NO: 1404896 - RNA, 20 nt, Human
ugguucccuugaugaagaag

SEQ ID NO: 1404897 - RNA, 17 nt, Human
ugguucccuugaugaag

SEQ ID NO: 1404898 - RNA, 20 nt, Human
ugguucccguuucuccaccu

SEQ ID NO: 1404899 - RNA, 18 nt, Human
ugguucccguuucuccac

SEQ ID NO: 1404900 - RNA, 16 nt, Human
ugguucccuugaugaa

SEQ ID NO: 1404901 - RNA, 20 nt, Human
uguaaaauauuuugaaucaa

SEQ ID NO: 1404902 - RNA, 19 nt, Human
uguaaaauauuuugaauca

SEQ ID NO: 1404903 - RNA, 16 nt, Human
uguaaaauaauucuga

SEQ ID NO: 1404904 - RNA, 12 nt, Human
uguaaaauaauu

SEQ ID NO: 1404905 - RNA, 19 nt, Human
uguaaaagcauuuuguaau

SEQ ID NO: 1404906 - RNA, 18 nt, Human
uguaaaagcauuuuguaa

SEQ ID NO: 1404907 - RNA, 17 nt, Human
uguaaaagcauuuugua

SEQ ID NO: 1404908 - RNA, 19 nt, Human
uguaaaacauuuauuuuga

SEQ ID NO: 1404909 - RNA, 22 nt, Human
uguaaaacagguagaauuaucu

SEQ ID NO: 1404910 - RNA, 14 nt, Human
uguaaaacagguag

SEQ ID NO: 1404911 - RNA, 13 nt, Human
uguaaaacaggua

SEQ ID NO: 1404912 - RNA, 12 nt, Human
uguaaaacaggu

SEQ ID NO: 1404913 - RNA, 20 nt, Human
uguaaaaucuugucaugugu

SEQ ID NO: 1404914 - RNA, 19 nt, Human
uguaaaaucuugucaugug

SEQ ID NO: 1404915 - RNA, 13 nt, Human
uguaaaaucuuuc

SEQ ID NO: 1404916 - RNA, 14 nt, Human
uguaaaaucuuucu

SEQ ID NO: 1404917 - RNA, 21 nt, Human
uguaaaaucuuucuuucuuag

SEQ ID NO: 1404918 - RNA, 18 nt, Human
uguaaaaucuugucaugu

SEQ ID NO: 1404919 - RNA, 16 nt, Human
uguaaaaucuugucau

SEQ ID NO: 1404920 - RNA, 15 nt, Human
uguaaaaucuuguca

SEQ ID NO: 1404921 - RNA, 12 nt, Human
uguaaaaucuug

SEQ ID NO: 1404922 - RNA, 21 nt, Human
uguaaaauauuuugaaucaau

SEQ ID NO: 1404923 - RNA, 12 nt, Human
uguaaaaugaca

SEQ ID NO: 1404924 - RNA, 22 nt, Human
uguaaaaucuugucauguguau

SEQ ID NO: 1404925 - RNA, 22 nt, Human
uguaaaaucuuucuuucuuaga

SEQ ID NO: 1404926 - RNA, 23 nt, Human
uguaaaaucuuucuuucuuagaa

SEQ ID NO: 1404927 - RNA, 20 nt, Human
uguaaacucaaaauauuugu

SEQ ID NO: 1404928 - RNA, 15 nt, Human
uguaaacucaaaaua

SEQ ID NO: 1404929 - RNA, 19 nt, Human
uguaaaccugagucguaca

SEQ ID NO: 1404930 - RNA, 21 nt, Human
uguaaaaugacaaucaugugu

SEQ ID NO: 1404931 - RNA, 19 nt, Human
uguaaaaugacaaucaugu

SEQ ID NO: 1404932 - RNA, 16 nt, Human
uguaaaaugacaauca

SEQ ID NO: 1404933 - RNA, 20 nt, Human
ugguuuuuacugcucugaga

SEQ ID NO: 1404934 - RNA, 21 nt, Human
ugguuuuuacugcucugagaa

SEQ ID NO: 1404935 - RNA, 18 nt, Human
ugguuuuuacugcucuga

SEQ ID NO: 1404936 - RNA, 19 nt, Human
ugguuuucuuuugccauga

SEQ ID NO: 1404937 - RNA, 18 nt, Human
ugguuuucuuuugccaug

SEQ ID NO: 1404938 - RNA, 21 nt, Human
ugguuuucuucuucucguccu

SEQ ID NO: 1404939 - RNA, 16 nt, Human
ugguugguuuucuucu

SEQ ID NO: 1404940 - RNA, 18 nt, Human
ugguugaugccaaaaaaa

SEQ ID NO: 1404941 - RNA, 14 nt, Human
ugguugaugccaaa

SEQ ID NO: 1404942 - RNA, 17 nt, Human
ugguugguuuucuucuu

SEQ ID NO: 1404943 - RNA, 12 nt, Human
ugguuguauuag

SEQ ID NO: 1404944 - RNA, 14 nt, Human
ugguuguauuagau

SEQ ID NO: 1404945 - RNA, 16 nt, Human
ugguuguauuagaugu

SEQ ID NO: 1404946 - RNA, 20 nt, Human
ugguuguacauauaagugau

SEQ ID NO: 1404947 - RNA, 16 nt, Human
ugguuuucuguucuuu

SEQ ID NO: 1404948 - RNA, 18 nt, Human
ugguuguauuagauguuc

SEQ ID NO: 1404949 - RNA, 11 nt, Human
uguaacaugua

SEQ ID NO: 1404950 - RNA, 17 nt, Human
uguaacauacuggccug

SEQ ID NO: 1404951 - RNA, 18 nt, Human
uguaaacuguguauucca

SEQ ID NO: 1404952 - RNA, 14 nt, Human
uguaaacuguguau

SEQ ID NO: 1404953 - RNA, 13 nt, Human
uguaaacugugua

SEQ ID NO: 1404954 - RNA, 15 nt, Human
uguaaacugugcacc

SEQ ID NO: 1404955 - RNA, 14 nt, Human
uguaaacugugcac

SEQ ID NO: 1404956 - RNA, 23 nt, Human
uguaaacucaaaauauuuguaca

SEQ ID NO: 1404957 - RNA, 13 nt, Human
uguaaauuuguac

SEQ ID NO: 1404958 - RNA, 22 nt, Human
uguaacaauuguguagccuuuu

SEQ ID NO: 1404959 - RNA, 21 nt, Human
uguaacaauuguguagccuuu

SEQ ID NO: 1404960 - RNA, 20 nt, Human
uguaacaauuguguagccuu

SEQ ID NO: 1404961 - RNA, 19 nt, Human
uguaacaauuguguagccu

SEQ ID NO: 1404962 - RNA, 16 nt, Human
uguaacaauuguguag

SEQ ID NO: 1404963 - RNA, 15 nt, Human
uguaacaauugugua

SEQ ID NO: 1404964 - RNA, 18 nt, Human
uguaacaagccagauuuu

SEQ ID NO: 1404965 - RNA, 14 nt, Human
uguaacaagccaga

SEQ ID NO: 1404966 - RNA, 14 nt, Human
uguaaauuuguacu

SEQ ID NO: 1404967 - RNA, 18 nt, Human
uguaaauuuguacuauuu

SEQ ID NO: 1404968 - RNA, 16 nt, Human
uguacaagaugaagga

SEQ ID NO: 1404969 - RNA, 11 nt, Human
uguaaugaaaa

SEQ ID NO: 1404970 - RNA, 19 nt, Human
uguaauaauaaagaauagc

SEQ ID NO: 1404971 - RNA, 12 nt, Human
uguaaugaaaac

SEQ ID NO: 1404972 - RNA, 13 nt, Human
uguaaugaaaacc

SEQ ID NO: 1404973 - RNA, 17 nt, Human
uguaaugaaaaccacau

SEQ ID NO: 1404974 - RNA, 11 nt, Human
uguaauacaau

SEQ ID NO: 1404975 - RNA, 23 nt, Human
uuguaaauuauuaauuuaugcag

SEQ ID NO: 1404976 - RNA, 16 nt, Human
uuguaaauuauuaauu

SEQ ID NO: 1404977 - RNA, 14 nt, Human
uuguaaauuggcau

SEQ ID NO: 1404978 - RNA, 13 nt, Human
uuguaaauuggca

SEQ ID NO: 1404979 - RNA, 12 nt, Human
uuguaaauuggc

SEQ ID NO: 1404980 - RNA, 18 nt, Human
uuguacauaaugcgugca

SEQ ID NO: 1404981 - RNA, 15 nt, Human
uuguaaauuaacuuu

SEQ ID NO: 1404982 - RNA, 16 nt, Human
uuguaaauuaacuuuu

SEQ ID NO: 1404983 - RNA, 18 nt, Human
uuguaaauuaacuuuuau

SEQ ID NO: 1404984 - RNA, 23 nt, Human
uuguaaauuaacuuuuauaaacu

SEQ ID NO: 1404985 - RNA, 20 nt, Human
uuguaaaagcauuuuguaau

SEQ ID NO: 1404986 - RNA, 19 nt, Human
uuguaaaagcauuuuguaa

SEQ ID NO: 1404987 - RNA, 18 nt, Human
uuguaaaagcauuuugua

SEQ ID NO: 1404988 - RNA, 17 nt, Human
uuguaaaagcauuuugu

SEQ ID NO: 1404989 - RNA, 14 nt, Human
uuguaaaacaggua

SEQ ID NO: 1404990 - RNA, 15 nt, Human
uuguaaaacagguag

SEQ ID NO: 1404991 - RNA, 16 nt, Human
uuguaaauauaaagac

SEQ ID NO: 1404992 - RNA, 17 nt, Human
uuguaaauauaaagacg

SEQ ID NO: 1404993 - RNA, 13 nt, Human
uuguaaauauaaa

SEQ ID NO: 1404994 - RNA, 12 nt, Human
uuguaaauauaa

SEQ ID NO: 1404995 - RNA, 11 nt, Human
uuguaaauaua

SEQ ID NO: 1404996 - RNA, 13 nt, Human
uuguaaaacaggu

SEQ ID NO: 1404997 - RNA, 15 nt, Human
uugguccaagauucc

SEQ ID NO: 1404998 - RNA, 21 nt, Human
uugguauuguauuuauucaau

SEQ ID NO: 1404999 - RNA, 12 nt, Human
uugguauuguau

SEQ ID NO: 1405000 - RNA, 13 nt, Human
uugguauuguauu

SEQ ID NO: 1405001 - RNA, 14 nt, Human
uugguauuguauuu

SEQ ID NO: 1405002 - RNA, 15 nt, Human
uugcacuaucuuuca

SEQ ID NO: 1405003 - RNA, 22 nt, Human
uugcacguguguuuuucuauua

SEQ ID NO: 1405004 - RNA, 23 nt, Human
uugcacguguguuuuucuauuaa

SEQ ID NO: 1405005 - RNA, 21 nt, Human
uugcacguguguuuuucuauu

SEQ ID NO: 1405006 - RNA, 20 nt, Human
uugcacguguguuuuucuau

SEQ ID NO: 1405007 - RNA, 18 nt, Human
uugcacguguguuuuucu

SEQ ID NO: 1405008 - RNA, 14 nt, Human
uugcacguguguuu

SEQ ID NO: 1405009 - RNA, 15 nt, Human
uugcacguggccucu

SEQ ID NO: 1405010 - RNA, 18 nt, Human
uuggguuagaccuacagg

SEQ ID NO: 1405011 - RNA, 16 nt, Human
uuggguuagaccuaca

SEQ ID NO: 1405012 - RNA, 19 nt, Human
uugguaccagauaacuuuu

SEQ ID NO: 1405013 - RNA, 15 nt, Human
uuggguuagaccuac

SEQ ID NO: 1405014 - RNA, 12 nt, Human
uuggguuagacc

SEQ ID NO: 1405015 - RNA, 15 nt, Human
uugucucaugccagu

SEQ ID NO: 1405016 - RNA, 15 nt, Human
uugucuagugaaacu

SEQ ID NO: 1405017 - RNA, 16 nt, Human
uugucucaaugcucau

SEQ ID NO: 1405018 - RNA, 17 nt, Human
uugucucaaugcucaua

SEQ ID NO: 1405019 - RNA, 13 nt, Human
uugucucagagca

SEQ ID NO: 1405020 - RNA, 18 nt, Human
uugucucaaugcucauaa

SEQ ID NO: 1405021 - RNA, 13 nt, Human
uugucuuuuuaga

SEQ ID NO: 1405022 - RNA, 20 nt, Human
uugucuggcaaggacuuugu

SEQ ID NO: 1405023 - RNA, 19 nt, Human
uugucuuuuuagaugccca

SEQ ID NO: 1405024 - RNA, 20 nt, Human
uugucuuuguucuucuacca

SEQ ID NO: 1405025 - RNA, 21 nt, Human
uugucuggcaaggacuuugua

SEQ ID NO: 1405026 - RNA, 13 nt, Human
uugugaaauuauu

SEQ ID NO: 1405027 - RNA, 12 nt, Human
uugugauuuuug

SEQ ID NO: 1405028 - RNA, 16 nt, Human
uugugauuuuuguaau

SEQ ID NO: 1405029 - RNA, 17 nt, Human
uugugauuuuuguaauu

SEQ ID NO: 1405030 - RNA, 14 nt, Human
uuguauuacaaauc

SEQ ID NO: 1405031 - RNA, 15 nt, Human
uuguauucucuccug

SEQ ID NO: 1405032 - RNA, 16 nt, Human
uuguauucucuccugu

SEQ ID NO: 1405033 - RNA, 17 nt, Human
uugucguaaagauuugg

SEQ ID NO: 1405034 - RNA, 21 nt, Human
uuguauucucuccuguaccuc

SEQ ID NO: 1405035 - RNA, 19 nt, Human
uuguauucucuccuguacc

SEQ ID NO: 1405036 - RNA, 18 nt, Human
uugucuacacacccugca

SEQ ID NO: 1405037 - RNA, 21 nt, Human
uugucuaagaaauugaauacu

SEQ ID NO: 1405038 - RNA, 19 nt, Human
uugucuaagaaauugaaua

SEQ ID NO: 1405039 - RNA, 13 nt, Human
uugucuaagaaau

SEQ ID NO: 1405040 - RNA, 16 nt, Human
uuguacauaguuauuu

SEQ ID NO: 1405041 - RNA, 18 nt, Human
uuguaaauuggcauggaa

SEQ ID NO: 1405042 - RNA, 13 nt, Human
uuguacuauuuaa

SEQ ID NO: 1405043 - RNA, 16 nt, Human
uuguacuaaagccaaa

SEQ ID NO: 1405044 - RNA, 23 nt, Human
uuguacuaaagccaaacauauau

SEQ ID NO: 1405045 - RNA, 22 nt, Human
uuguacuauuuaacugacuauu

SEQ ID NO: 1405046 - RNA, 19 nt, Human
uuguacuauuuaacugacu

SEQ ID NO: 1405047 - RNA, 16 nt, Human
uuguacuauuuaacug

SEQ ID NO: 1405048 - RNA, 14 nt, Human
uuguuucuccccca

SEQ ID NO: 1405049 - RNA, 23 nt, Human
uuguuucuacuuugauaugacug

SEQ ID NO: 1405050 - RNA, 14 nt, Human
uuguuucuacuuug

SEQ ID NO: 1405051 - RNA, 16 nt, Human
uuguuucguggggagg

SEQ ID NO: 1405052 - RNA, 22 nt, Human
uuguuucgcucuuugagaaaua

SEQ ID NO: 1405053 - RNA, 19 nt, Human
uuguuucgcucuuugagaa

SEQ ID NO: 1405054 - RNA, 18 nt, Human
uuguuucgcucuuugaga

SEQ ID NO: 1405055 - RNA, 15 nt, Human
uuguuucgcucuuug

SEQ ID NO: 1405056 - RNA, 13 nt, Human
uuguuucgcucuu

SEQ ID NO: 1405057 - RNA, 23 nt, Human
uuguuuccuccccuaucuguauu

SEQ ID NO: 1405058 - RNA, 23 nt, Human
uuguuucaaugagguguccaacu

SEQ ID NO: 1405059 - RNA, 16 nt, Human
uuguuucaauugcauc

SEQ ID NO: 1405060 - RNA, 21 nt, Human
uuguuucaaugagguguccaa

SEQ ID NO: 1405061 - RNA, 15 nt, Human
uuguuuaaaaaguaa

SEQ ID NO: 1405062 - RNA, 22 nt, Human
uuguuaucagucaauauuuuua

SEQ ID NO: 1405063 - RNA, 16 nt, Human
uuguuaucagucaaua

SEQ ID NO: 1405064 - RNA, 15 nt, Human
uuguuauauaauuua

SEQ ID NO: 1405065 - RNA, 16 nt, Human
uuguuauauaaucauu

SEQ ID NO: 1405066 - RNA, 13 nt, Human
uuguuauauaauc

SEQ ID NO: 1405067 - RNA, 22 nt, Human
uuguuaguaugaggcauuuguu

SEQ ID NO: 1405068 - RNA, 14 nt, Human
uuguugugcuuuua

SEQ ID NO: 1405069 - RNA, 18 nt, Human
uuguuauguagauaacaa

SEQ ID NO: 1405070 - RNA, 15 nt, Human
uuguuguuucuugcc

SEQ ID NO: 1405071 - RNA, 21 nt, Human
uuguuguucuguuaacugaau

SEQ ID NO: 1405072 - RNA, 14 nt, Human
uuguuguucuguua

SEQ ID NO: 1405073 - RNA, 13 nt, Human
uuguuguucuguu

SEQ ID NO: 1405074 - RNA, 15 nt, Human
uuguuguucuguuaa

SEQ ID NO: 1405075 - RNA, 22 nt, Human
uuguuaauuuuuccuauauugc

SEQ ID NO: 1405076 - RNA, 21 nt, Human
uuguuaauuuagaaaacuuua

SEQ ID NO: 1405077 - RNA, 22 nt, Human
uuguuaauuuagaaaacuuuaa

SEQ ID NO: 1405078 - RNA, 20 nt, Human
uuguuaauuuagaaaacuuu

SEQ ID NO: 1405079 - RNA, 19 nt, Human
uuguuaauuuagaaaacuu

SEQ ID NO: 1405080 - RNA, 14 nt, Human
uuguuacauuuuua

SEQ ID NO: 1405081 - RNA, 14 nt, Human
uuguuacuucugag

SEQ ID NO: 1405082 - RNA, 16 nt, Human
uuguuacguagccuaa

SEQ ID NO: 1405083 - RNA, 19 nt, Human
uuguuaguaugaggcauuu

SEQ ID NO: 1405084 - RNA, 21 nt, Human
uuguuaguaugaggcauuugu

SEQ ID NO: 1405085 - RNA, 17 nt, Human
uuguguuuguguauuua

SEQ ID NO: 1405086 - RNA, 15 nt, Human
uuguguuugucauua

SEQ ID NO: 1405087 - RNA, 20 nt, Human
uuguguuugucauuagccug

SEQ ID NO: 1405088 - RNA, 18 nt, Human
uuguguuuugcaagccag

SEQ ID NO: 1405089 - RNA, 14 nt, Human
uuguguuugucauu

SEQ ID NO: 1405090 - RNA, 12 nt, Human
uuguuaaauuuu

SEQ ID NO: 1405091 - RNA, 15 nt, Human
uuguuaaaaauguca

SEQ ID NO: 1405092 - RNA, 16 nt, Human
uuguuaauaguuccug

SEQ ID NO: 1405093 - RNA, 18 nt, Human
uuguuaaucuucaauagu

SEQ ID NO: 1405094 - RNA, 14 nt, Human
uugugcauucugga

SEQ ID NO: 1405095 - RNA, 11 nt, Human
uugugcagaga

SEQ ID NO: 1405096 - RNA, 12 nt, Human
uugugcauuugg

SEQ ID NO: 1405097 - RNA, 22 nt, Human
uugugcauuaucuagauacugu

SEQ ID NO: 1405098 - RNA, 23 nt, Human
uugugcauuaucuagauacugua

SEQ ID NO: 1405099 - RNA, 21 nt, Human
uugugcaauguguauaaacaa

SEQ ID NO: 1405100 - RNA, 20 nt, Human
uugugcaauguguauaaaca

SEQ ID NO: 1405101 - RNA, 19 nt, Human
uugugcaauguguauaaac

SEQ ID NO: 1405102 - RNA, 23 nt, Human
uugugcaauguaaauauuuuaaa

SEQ ID NO: 1405103 - RNA, 22 nt, Human
uugugcaauguaaauauuuuaa

SEQ ID NO: 1405104 - RNA, 18 nt, Human
uugugcaauguaaauauu

SEQ ID NO: 1405105 - RNA, 17 nt, Human
uugugcaauguaaauau

SEQ ID NO: 1405106 - RNA, 16 nt, Human
uugugcacauuuauuu

SEQ ID NO: 1405107 - RNA, 18 nt, Human
uugugcacauuuauuucc

SEQ ID NO: 1405108 - RNA, 17 nt, Human
uugugcauuaucuagau

SEQ ID NO: 1405109 - RNA, 21 nt, Human
uugugccaugucaaacaaaua

SEQ ID NO: 1405110 - RNA, 22 nt, Human
uugugcccccaaccauuuccuc

SEQ ID NO: 1405111 - RNA, 23 nt, Human
uugugcuucuuucuuugggaaua

SEQ ID NO: 1405112 - RNA, 21 nt, Human
uuguggaauugggagcuuggg

SEQ ID NO: 1405113 - RNA, 22 nt, Human
uuguggaauggagauucaguuu

SEQ ID NO: 1405114 - RNA, 20 nt, Human
uuguggauuuaacagaaaug

SEQ ID NO: 1405115 - RNA, 21 nt, Human
uuguggauuuaacagaaaugu

SEQ ID NO: 1405116 - RNA, 13 nt, Human
uuguggacuaaaa

SEQ ID NO: 1405117 - RNA, 16 nt, Human
uuguggacuaaaagau

SEQ ID NO: 1405118 - RNA, 18 nt, Human
uuguggacuaaaagauau

SEQ ID NO: 1405119 - RNA, 22 nt, Human
uuguggacuaaaagauauaagu

SEQ ID NO: 1405120 - RNA, 15 nt, Human
uuguguucuguuuug

SEQ ID NO: 1405121 - RNA, 18 nt, Human
uuguggcaagugaauuug

SEQ ID NO: 1405122 - RNA, 20 nt, Human
uuguguucccauuucagcug

SEQ ID NO: 1405123 - RNA, 22 nt, Human
uuguggcaagugaauuugccug

SEQ ID NO: 1405124 - RNA, 16 nt, Human
uuguggcaagugaauu

SEQ ID NO: 1405125 - RNA, 22 nt, Human
uuguggauuuaacagaaaugua

SEQ ID NO: 1405126 - RNA, 23 nt, Human
uuguggauuuaacagaaauguac

SEQ ID NO: 1405127 - RNA, 20 nt, Human
uuguguugaagagguuuuaa

SEQ ID NO: 1405128 - RNA, 13 nt, Human
uuuaacuuaaaua

SEQ ID NO: 1405129 - RNA, 14 nt, Human
uuuaacuuaaauag

SEQ ID NO: 1405130 - RNA, 18 nt, Human
uuuaacuguggauauugu

SEQ ID NO: 1405131 - RNA, 17 nt, Human
uuuaacuguggauauug

SEQ ID NO: 1405132 - RNA, 21 nt, Human
uuuaacuuuguuuuauuuuca

SEQ ID NO: 1405133 - RNA, 17 nt, Human
uuuaacuuuguuuuauu

SEQ ID NO: 1405134 - RNA, 12 nt, Human
uuuaacuuuguu

SEQ ID NO: 1405135 - RNA, 18 nt, Human
uuuaagaaaaaggaugca

SEQ ID NO: 1405136 - RNA, 15 nt, Human
uuuaagaauugagua

SEQ ID NO: 1405137 - RNA, 20 nt, Human
uuuaagaauugaguaauggu

SEQ ID NO: 1405138 - RNA, 21 nt, Human
uuuaagaauaucuguaauggu

SEQ ID NO: 1405139 - RNA, 15 nt, Human
uuuaagaauaucugu

SEQ ID NO: 1405140 - RNA, 14 nt, Human
uuuaagaaauagaa

SEQ ID NO: 1405141 - RNA, 22 nt, Human
uuuaagaaaaaggaugcacaga

SEQ ID NO: 1405142 - RNA, 13 nt, Human
uuuaauaauguuu

SEQ ID NO: 1405143 - RNA, 15 nt, Human
uuuaauaauauacuu

SEQ ID NO: 1405144 - RNA, 14 nt, Human
uuuaauaaauuuau

SEQ ID NO: 1405145 - RNA, 12 nt, Human
uuuaauaaaaga

SEQ ID NO: 1405146 - RNA, 20 nt, Human
uuuaagacgaaacauuuguu

SEQ ID NO: 1405147 - RNA, 15 nt, Human
uuuaacuguggauau

SEQ ID NO: 1405148 - RNA, 13 nt, Human
uuuaacuguggau

SEQ ID NO: 1405149 - RNA, 12 nt, Human
uuuaacugugga

SEQ ID NO: 1405150 - RNA, 21 nt, Human
uuuaacugccguaauuuaacu

SEQ ID NO: 1405151 - RNA, 12 nt, Human
uuuaacugccgu

SEQ ID NO: 1405152 - RNA, 11 nt, Human
uuuaacugacu

SEQ ID NO: 1405153 - RNA, 14 nt, Human
uuuaacugccuugu

SEQ ID NO: 1405154 - RNA, 23 nt, Human
uuuaacugacuauucuugaugua

SEQ ID NO: 1405155 - RNA, 19 nt, Human
uuuaacugacaagccaucu

SEQ ID NO: 1405156 - RNA, 14 nt, Human
uuuaacugacaagc

SEQ ID NO: 1405157 - RNA, 20 nt, Human
uuuaacucccauuaccaugu

SEQ ID NO: 1405158 - RNA, 12 nt, Human
uuuaacauuccu

SEQ ID NO: 1405159 - RNA, 16 nt, Human
uuuaaccuuugauaga

SEQ ID NO: 1405160 - RNA, 18 nt, Human
uuuaacauaagcuauuuu

SEQ ID NO: 1405161 - RNA, 19 nt, Human
uuuaacauaagcuauuuuu

SEQ ID NO: 1405162 - RNA, 17 nt, Human
uuuaacauaagcuauuu

SEQ ID NO: 1405163 - RNA, 16 nt, Human
uuuaacauaagcuauu

SEQ ID NO: 1405164 - RNA, 14 nt, Human
uuuaacauaagcua

SEQ ID NO: 1405165 - RNA, 13 nt, Human
uuuaacauaagcu

SEQ ID NO: 1405166 - RNA, 19 nt, Human
uuuaacucuauaauguguu

SEQ ID NO: 1405167 - RNA, 21 nt, Human
uuuaacagaaauuguauauug

SEQ ID NO: 1405168 - RNA, 19 nt, Human
uuuaacagaaauuguauau

SEQ ID NO: 1405169 - RNA, 16 nt, Human
uuuaacagaaauugua

SEQ ID NO: 1405170 - RNA, 14 nt, Human
uuuaacagaaauug

SEQ ID NO: 1405171 - RNA, 13 nt, Human
uuuaacagaaauu

SEQ ID NO: 1405172 - RNA, 20 nt, Human
uuuaacaacauguuuccagc

SEQ ID NO: 1405173 - RNA, 18 nt, Human
uuuaacagaaauguacag

SEQ ID NO: 1405174 - RNA, 18 nt, Human
uuuaaauuuuuuuccuua

SEQ ID NO: 1405175 - RNA, 14 nt, Human
uuuaacaacauguu

SEQ ID NO: 1405176 - RNA, 21 nt, Human
uuuagaaagauaauucacugu

SEQ ID NO: 1405177 - RNA, 13 nt, Human
uuuagaaagcauu

SEQ ID NO: 1405178 - RNA, 15 nt, Human
uuuagaaagauaauu

SEQ ID NO: 1405179 - RNA, 15 nt, Human
uuuagaaagaauauu

SEQ ID NO: 1405180 - RNA, 14 nt, Human
uuuagaaagcauuu

SEQ ID NO: 1405181 - RNA, 16 nt, Human
uuuagaaagcauuuga

SEQ ID NO: 1405182 - RNA, 18 nt, Human
uuuagaaagcauuugaau

SEQ ID NO: 1405183 - RNA, 19 nt, Human
uuuagaaagcauuugaaug

SEQ ID NO: 1405184 - RNA, 16 nt, Human
uuuagaaaucauuuug

SEQ ID NO: 1405185 - RNA, 13 nt, Human
uuuagaaaucauu

SEQ ID NO: 1405186 - RNA, 22 nt, Human
uuuagaaagcauuugaaugcau

SEQ ID NO: 1405187 - RNA, 15 nt, Human
uuuacuuguuucaga

SEQ ID NO: 1405188 - RNA, 17 nt, Human
uuuacuuguuucagagu

SEQ ID NO: 1405189 - RNA, 13 nt, Human
uuuaccagaaagc

SEQ ID NO: 1405190 - RNA, 18 nt, Human
uuuagaaaucauuuugca

SEQ ID NO: 1405191 - RNA, 16 nt, Human
uuuaguuuuucauuaa

SEQ ID NO: 1405192 - RNA, 15 nt, Human
uuuaguuuuucauua

SEQ ID NO: 1405193 - RNA, 13 nt, Human
uuuaguuuuucau

SEQ ID NO: 1405194 - RNA, 12 nt, Human
uuuaguuuuuca

SEQ ID NO: 1405195 - RNA, 21 nt, Human
uuuauaaaaauaaaaaacacu

SEQ ID NO: 1405196 - RNA, 23 nt, Human
uuuauaaaaauaaaaaacacugg

SEQ ID NO: 1405197 - RNA, 16 nt, Human
uuuacacucuuuguaa

SEQ ID NO: 1405198 - RNA, 16 nt, Human
uuuacacgcuuuugug

SEQ ID NO: 1405199 - RNA, 17 nt, Human
uuuacacgcuuuuguga

SEQ ID NO: 1405200 - RNA, 15 nt, Human
uuuacacgcuuuugu

SEQ ID NO: 1405201 - RNA, 19 nt, Human
uuuacacaauagaauuaua

SEQ ID NO: 1405202 - RNA, 17 nt, Human
uuuaauagcaaagaauu

SEQ ID NO: 1405203 - RNA, 18 nt, Human
uuuacacaauagaauuau

SEQ ID NO: 1405204 - RNA, 18 nt, Human
uuuaauagcaaagaauug

SEQ ID NO: 1405205 - RNA, 21 nt, Human
uuuaauagguuuggacaaaau

SEQ ID NO: 1405206 - RNA, 14 nt, Human
uuuaauaauguuuc

SEQ ID NO: 1405207 - RNA, 11 nt, Human
uuuaauaauuu

SEQ ID NO: 1405208 - RNA, 17 nt, Human
uuuaauaauauacuugu

SEQ ID NO: 1405209 - RNA, 19 nt, Human
uuuacaggaacuucaucau

SEQ ID NO: 1405210 - RNA, 18 nt, Human
uuuacaggaacuucauca

SEQ ID NO: 1405211 - RNA, 14 nt, Human
uuuacaggaacuuc

SEQ ID NO: 1405212 - RNA, 19 nt, Human
uuuacagaauugcuuguuu

SEQ ID NO: 1405213 - RNA, 14 nt, Human
uuuacagaauugcu

SEQ ID NO: 1405214 - RNA, 13 nt, Human
uuuacagaauuuu

SEQ ID NO: 1405215 - RNA, 16 nt, Human
uuuacauuguugagcu

SEQ ID NO: 1405216 - RNA, 13 nt, Human
uuuaccacuugug

SEQ ID NO: 1405217 - RNA, 22 nt, Human
uuucaaggcacucuagauucca

SEQ ID NO: 1405218 - RNA, 21 nt, Human
uuucaaggcacucuagauucc

SEQ ID NO: 1405219 - RNA, 20 nt, Human
uuucaaggcacucuagauuc

SEQ ID NO: 1405220 - RNA, 19 nt, Human
uuucaaggcacucuagauu

SEQ ID NO: 1405221 - RNA, 18 nt, Human
uuucaaggcacucuagau

SEQ ID NO: 1405222 - RNA, 17 nt, Human
uuucaaggcacucuaga

SEQ ID NO: 1405223 - RNA, 15 nt, Human
uuucaaggcacucua

SEQ ID NO: 1405224 - RNA, 19 nt, Human
uuucaaggaaguagaaaca

SEQ ID NO: 1405225 - RNA, 11 nt, Human
uuucaaggaag

SEQ ID NO: 1405226 - RNA, 23 nt, Human
uuucaagcagucgugccuguguc

SEQ ID NO: 1405227 - RNA, 22 nt, Human
uuucaagcagucgugccugugu

SEQ ID NO: 1405228 - RNA, 23 nt, Human
uuucaagaggagcccccacccug

SEQ ID NO: 1405229 - RNA, 23 nt, Human
uuucaagaauaaucacgcuuucc

SEQ ID NO: 1405230 - RNA, 17 nt, Human
uuucaagaaacugagga

SEQ ID NO: 1405231 - RNA, 19 nt, Human
uuucaagaaacugaggaau

SEQ ID NO: 1405232 - RNA, 23 nt, Human
uuucaacggaaagugcugucuua

SEQ ID NO: 1405233 - RNA, 15 nt, Human
uuucaacggaaagug

SEQ ID NO: 1405234 - RNA, 15 nt, Human
uuuauugacacagaa

SEQ ID NO: 1405235 - RNA, 14 nt, Human
uuuauugacacaga

SEQ ID NO: 1405236 - RNA, 13 nt, Human
uuuauugacacag

SEQ ID NO: 1405237 - RNA, 12 nt, Human
uuuauugacaca

SEQ ID NO: 1405238 - RNA, 18 nt, Human
uuuauucuucuagaguuc

SEQ ID NO: 1405239 - RNA, 16 nt, Human
uuuauucuucuagagu

SEQ ID NO: 1405240 - RNA, 15 nt, Human
uuuauucuucuagag

SEQ ID NO: 1405241 - RNA, 14 nt, Human
uuuauucuucuaga

SEQ ID NO: 1405242 - RNA, 16 nt, Human
uuuauuaugcauuaua

SEQ ID NO: 1405243 - RNA, 17 nt, Human
uuuauuaugcauuauau

SEQ ID NO: 1405244 - RNA, 22 nt, Human
uuuauuuaaaaaacuaaaaacu

SEQ ID NO: 1405245 - RNA, 22 nt, Human
uuuauuuaacuuuuaguaaagu

SEQ ID NO: 1405246 - RNA, 19 nt, Human
uuuauuuaaugcuguggca

SEQ ID NO: 1405247 - RNA, 14 nt, Human
uuuauggcuuuugu

SEQ ID NO: 1405248 - RNA, 16 nt, Human
uuuauggcuuuugugc

SEQ ID NO: 1405249 - RNA, 20 nt, Human
uuuauggcuuuugugcauua

SEQ ID NO: 1405250 - RNA, 13 nt, Human
uuuauuauggcac

SEQ ID NO: 1405251 - RNA, 16 nt, Human
uuuauaagcaucauua

SEQ ID NO: 1405252 - RNA, 14 nt, Human
uuuauaagcaucau

SEQ ID NO: 1405253 - RNA, 13 nt, Human
uuuauaagcauca

SEQ ID NO: 1405254 - RNA, 12 nt, Human
uuuauaagcauc

SEQ ID NO: 1405255 - RNA, 16 nt, Human
uuuauaagaaagccug

SEQ ID NO: 1405256 - RNA, 23 nt, Human
uuuauaagaaagccugaguacuc

SEQ ID NO: 1405257 - RNA, 15 nt, Human
uuuauaagaaagccu

SEQ ID NO: 1405258 - RNA, 20 nt, Human
uuuauaauucucauuaaaag

SEQ ID NO: 1405259 - RNA, 22 nt, Human
uuuauaagcaucauuauuuaug

SEQ ID NO: 1405260 - RNA, 23 nt, Human
uuuauaagcaucauuauuuaugu

SEQ ID NO: 1405261 - RNA, 21 nt, Human
uuuauaagcaucauuauuuau

SEQ ID NO: 1405262 - RNA, 20 nt, Human
uuuauaagcaucauuauuua

SEQ ID NO: 1405263 - RNA, 18 nt, Human
uuuauaagcaucauuauu

SEQ ID NO: 1405264 - RNA, 17 nt, Human
uuuauaagcaucauuau

SEQ ID NO: 1405265 - RNA, 17 nt, Human
uuuauaauucucauuaa

SEQ ID NO: 1405266 - RNA, 22 nt, Human
uuuauaauuuugugaagcaaaa

SEQ ID NO: 1405267 - RNA, 19 nt, Human
uuuccaacuacuaauagaa

SEQ ID NO: 1405268 - RNA, 18 nt, Human
uuuccaacuacuaauaga

SEQ ID NO: 1405269 - RNA, 17 nt, Human
uuucauuuaucuauaau

SEQ ID NO: 1405270 - RNA, 12 nt, Human
uuuccaacuacu

SEQ ID NO: 1405271 - RNA, 19 nt, Human
uuuccaaccggcuuugugg

SEQ ID NO: 1405272 - RNA, 14 nt, Human
uuucauuuaucuau

SEQ ID NO: 1405273 - RNA, 19 nt, Human
uuucauuuagucaugugac

SEQ ID NO: 1405274 - RNA, 18 nt, Human
uuucaguucuaggaaaau

SEQ ID NO: 1405275 - RNA, 20 nt, Human
uuucagauucccagagcaaa

SEQ ID NO: 1405276 - RNA, 18 nt, Human
uuucagaugugaaccauu

SEQ ID NO: 1405277 - RNA, 11 nt, Human
uuucagaugug

SEQ ID NO: 1405278 - RNA, 20 nt, Human
uuucagcacuagccaaaccu

SEQ ID NO: 1405279 - RNA, 12 nt, Human
uuucagcacuag

SEQ ID NO: 1405280 - RNA, 22 nt, Human
uuucagcacuagccaaaccuca

SEQ ID NO: 1405281 - RNA, 23 nt, Human
uuucagcacuagccaaaccucac

SEQ ID NO: 1405282 - RNA, 15 nt, Human
uuucaguucuaggaa

SEQ ID NO: 1405283 - RNA, 21 nt, Human
uuucaguggggcagucauuau

SEQ ID NO: 1405284 - RNA, 11 nt, Human
uuucagugagg

SEQ ID NO: 1405285 - RNA, 13 nt, Human
uuucaauagccac

SEQ ID NO: 1405286 - RNA, 15 nt, Human
uuucaauagcacaua

SEQ ID NO: 1405287 - RNA, 16 nt, Human
uuucaauacagauaua

SEQ ID NO: 1405288 - RNA, 22 nt, Human
uuucaaguuccaaguugcuaau

SEQ ID NO: 1405289 - RNA, 16 nt, Human
uuucaagguucuaacc

SEQ ID NO: 1405290 - RNA, 14 nt, Human
uuucaagguucuaa

SEQ ID NO: 1405291 - RNA, 13 nt, Human
uuucaagguucua

SEQ ID NO: 1405292 - RNA, 21 nt, Human
uuucaauagccacuaaccuug

SEQ ID NO: 1405293 - RNA, 14 nt, Human
uuucaauagccacu

SEQ ID NO: 1405294 - RNA, 23 nt, Human
uuucacaacagccugacaacauu

SEQ ID NO: 1405295 - RNA, 23 nt, Human
uuucagauaucuuggacaaauca

SEQ ID NO: 1405296 - RNA, 14 nt, Human
uuucacaaggucuu

SEQ ID NO: 1405297 - RNA, 22 nt, Human
uucagcuucguuuauuuucaag

SEQ ID NO: 1405298 - RNA, 20 nt, Human
uucagcugucuuuuggagga

SEQ ID NO: 1405299 - RNA, 16 nt, Human
uucagcugucuuuugg

SEQ ID NO: 1405300 - RNA, 20 nt, Human
uucaguguauggaaauaaau

SEQ ID NO: 1405301 - RNA, 14 nt, Human
uucaguggggcagu

SEQ ID NO: 1405302 - RNA, 20 nt, Human
uucaucgaaucuacuaauuc

SEQ ID NO: 1405303 - RNA, 23 nt, Human
uucaucgaaucuacuaauuccac

SEQ ID NO: 1405304 - RNA, 18 nt, Human
uucaucgaaucuacuaau

SEQ ID NO: 1405305 - RNA, 22 nt, Human
uucaguguuaaaugugaugaau

SEQ ID NO: 1405306 - RNA, 18 nt, Human
uucaguguuaaaugugau

SEQ ID NO: 1405307 - RNA, 12 nt, Human
uucaguguuaaa

SEQ ID NO: 1405308 - RNA, 23 nt, Human
uucaguuauuauauuuacaaaug

SEQ ID NO: 1405309 - RNA, 16 nt, Human
uucaguucuaggaaaa

SEQ ID NO: 1405310 - RNA, 19 nt, Human
uucaguucuaggaaaauaa

SEQ ID NO: 1405311 - RNA, 16 nt, Human
uucaguuuugauauuu

SEQ ID NO: 1405312 - RNA, 20 nt, Human
uucauaaauaaaguuuguug

SEQ ID NO: 1405313 - RNA, 21 nt, Human
uuccaugcguguuucugacuc

SEQ ID NO: 1405314 - RNA, 18 nt, Human
uuccaugcguguuucuga

SEQ ID NO: 1405315 - RNA, 20 nt, Human
uuccauccauggccagcagc

SEQ ID NO: 1405316 - RNA, 18 nt, Human
uuccauccauggccagca

SEQ ID NO: 1405317 - RNA, 17 nt, Human
uuccauccauggccagc

SEQ ID NO: 1405318 - RNA, 15 nt, Human
uuccauccauggcca

SEQ ID NO: 1405319 - RNA, 19 nt, Human
uuccauccaccuuucccaa

SEQ ID NO: 1405320 - RNA, 19 nt, Human
uuccagauccuggaaauca

SEQ ID NO: 1405321 - RNA, 14 nt, Human
uuccagaccugaag

SEQ ID NO: 1405322 - RNA, 19 nt, Human
uuccagaaugcuguacauc

SEQ ID NO: 1405323 - RNA, 18 nt, Human
uuccagaaugcuguacau

SEQ ID NO: 1405324 - RNA, 16 nt, Human
uuccagaaugcuguac

SEQ ID NO: 1405325 - RNA, 15 nt, Human
uuccagaaugcugua

SEQ ID NO: 1405326 - RNA, 14 nt, Human
uuccagaaugcugu

SEQ ID NO: 1405327 - RNA, 20 nt, Human
uuccagaagugugacuggcu

SEQ ID NO: 1405328 - RNA, 23 nt, Human
uuccagacugcuuccaauuuucu

SEQ ID NO: 1405329 - RNA, 17 nt, Human
uuccagaccugaagaau

SEQ ID NO: 1405330 - RNA, 16 nt, Human
uuccagaccugaagaa

SEQ ID NO: 1405331 - RNA, 18 nt, Human
uuccagagcacugcucca

SEQ ID NO: 1405332 - RNA, 20 nt, Human
uuccagaggcuauuauuuuc

SEQ ID NO: 1405333 - RNA, 19 nt, Human
uuccagaggcuauuauuuu

SEQ ID NO: 1405334 - RNA, 18 nt, Human
uuccagauccuggaaauc

SEQ ID NO: 1405335 - RNA, 20 nt, Human
uuccaacaagaagggacuga

SEQ ID NO: 1405336 - RNA, 17 nt, Human
uuccaaagucucuaauu

SEQ ID NO: 1405337 - RNA, 16 nt, Human
uuccaaagucucuaau

SEQ ID NO: 1405338 - RNA, 14 nt, Human
uuccaaagucucua

SEQ ID NO: 1405339 - RNA, 16 nt, Human
uuccaaaguacacugu

SEQ ID NO: 1405340 - RNA, 22 nt, Human
uuccaaagaguagaauugcauu

SEQ ID NO: 1405341 - RNA, 13 nt, Human
uuccaaaguacac

SEQ ID NO: 1405342 - RNA, 18 nt, Human
uucaugcuaucucugugu

SEQ ID NO: 1405343 - RNA, 17 nt, Human
uucaugcuaucucugug

SEQ ID NO: 1405344 - RNA, 22 nt, Human
uucaugccagcuacuuccuccu

SEQ ID NO: 1405345 - RNA, 21 nt, Human
uucaugccagcuacuuccucc

SEQ ID NO: 1405346 - RNA, 20 nt, Human
uucaugcuguucaugaaaga

SEQ ID NO: 1405347 - RNA, 12 nt, Human
uucaucuggaac

SEQ ID NO: 1405348 - RNA, 23 nt, Human
uucaucuggaaccaucagaaaca

SEQ ID NO: 1405349 - RNA, 19 nt, Human
uucaucuggcaacaucuuu

SEQ ID NO: 1405350 - RNA, 17 nt, Human
uucaucuggaaccauca

SEQ ID NO: 1405351 - RNA, 14 nt, Human
uucaugcauggaaa

SEQ ID NO: 1405352 - RNA, 17 nt, Human
uucaucuucaguugucu

SEQ ID NO: 1405353 - RNA, 21 nt, Human
uucaugccaauuagcaauuga

SEQ ID NO: 1405354 - RNA, 15 nt, Human
uucaugcauggaaau

SEQ ID NO: 1405355 - RNA, 16 nt, Human
uucaugcauggaaauu

SEQ ID NO: 1405356 - RNA, 22 nt, Human
uucacaacagccugacaacauu

SEQ ID NO: 1405357 - RNA, 22 nt, Human
uucacaaacuuuuauacucuuu

SEQ ID NO: 1405358 - RNA, 17 nt, Human
uucacaaacuuuuauac

SEQ ID NO: 1405359 - RNA, 16 nt, Human
uucacaaacuuuuaua

SEQ ID NO: 1405360 - RNA, 19 nt, Human
uucaauauaagcuuuucuu

SEQ ID NO: 1405361 - RNA, 18 nt, Human
uucaauauaagcuuuucu

SEQ ID NO: 1405362 - RNA, 17 nt, Human
uucaauagccacuaacc

SEQ ID NO: 1405363 - RNA, 15 nt, Human
uucaauagccacuaa

SEQ ID NO: 1405364 - RNA, 14 nt, Human
uucaauagccacua

SEQ ID NO: 1405365 - RNA, 17 nt, Human
uucaauagcacauaugg

SEQ ID NO: 1405366 - RNA, 18 nt, Human
uucaauacagauauauuu

SEQ ID NO: 1405367 - RNA, 17 nt, Human
uucaauacagauauauu

SEQ ID NO: 1405368 - RNA, 16 nt, Human
uucaauacagauauau

SEQ ID NO: 1405369 - RNA, 14 nt, Human
uucaauacagauau

SEQ ID NO: 1405370 - RNA, 12 nt, Human
uucaauacagau

SEQ ID NO: 1405371 - RNA, 18 nt, Human
uucaccuaccgaguucaa

SEQ ID NO: 1405372 - RNA, 22 nt, Human
uucacccuguccaaacugccua

SEQ ID NO: 1405373 - RNA, 19 nt, Human
uucacgccugaggcaauua

SEQ ID NO: 1405374 - RNA, 17 nt, Human
uuauuagagugucuuuc

SEQ ID NO: 1405375 - RNA, 21 nt, Human
uuauuagagauuaccuccuga

SEQ ID NO: 1405376 - RNA, 21 nt, Human
uuauuagaaucaaacauuuug

SEQ ID NO: 1405377 - RNA, 20 nt, Human
uuauuagaaucaaacauuuu

SEQ ID NO: 1405378 - RNA, 18 nt, Human
uuauuuguaauagauguu

SEQ ID NO: 1405379 - RNA, 17 nt, Human
uuauuuguaauagaugu

SEQ ID NO: 1405380 - RNA, 16 nt, Human
uuauuuguaauagaug

SEQ ID NO: 1405381 - RNA, 12 nt, Human
uuauuuguaaua

SEQ ID NO: 1405382 - RNA, 23 nt, Human
uuauuuggaaccuuguuuuggac

SEQ ID NO: 1405383 - RNA, 18 nt, Human
uuauuuggaaccuuguuu

SEQ ID NO: 1405384 - RNA, 11 nt, Human
uuauuugcaua

SEQ ID NO: 1405385 - RNA, 13 nt, Human
uuauuugcaugug

SEQ ID NO: 1405386 - RNA, 20 nt, Human
uuauuuuaauaauguuucaa

SEQ ID NO: 1405387 - RNA, 18 nt, Human
uuauuuuauuaugcauga

SEQ ID NO: 1405388 - RNA, 22 nt, Human
uuauuuguguuuuaauuuaaac

SEQ ID NO: 1405389 - RNA, 14 nt, Human
uuauuuguugagag

SEQ ID NO: 1405390 - RNA, 12 nt, Human
uuauuuguugag

SEQ ID NO: 1405391 - RNA, 19 nt, Human
uuauuuguugagaguguga

SEQ ID NO: 1405392 - RNA, 19 nt, Human
uuauuuuaauaauguuuca

SEQ ID NO: 1405393 - RNA, 22 nt, Human
uuauuuugugaugcaaauaaau

SEQ ID NO: 1405394 - RNA, 22 nt, Human
uuauuuugccaagggcauaaau

SEQ ID NO: 1405395 - RNA, 12 nt, Human
uuauuuugcaac

SEQ ID NO: 1405396 - RNA, 17 nt, Human
uuauuuucaaaaccagg

SEQ ID NO: 1405397 - RNA, 13 nt, Human
uuauuuucaagaa

SEQ ID NO: 1405398 - RNA, 18 nt, Human
uuauuuucaagaaacuga

SEQ ID NO: 1405399 - RNA, 21 nt, Human
uucaacauguuauuuguaaua

SEQ ID NO: 1405400 - RNA, 17 nt, Human
uucaacauguuauuugu

SEQ ID NO: 1405401 - RNA, 19 nt, Human
uucaacagugaagacagaa

SEQ ID NO: 1405402 - RNA, 18 nt, Human
uucaacagugaagacaga

SEQ ID NO: 1405403 - RNA, 16 nt, Human
uucaacagugaagaca

SEQ ID NO: 1405404 - RNA, 19 nt, Human
uucaaauucuucugaacuc

SEQ ID NO: 1405405 - RNA, 16 nt, Human
uucaaauucuucugaa

SEQ ID NO: 1405406 - RNA, 18 nt, Human
uucaaauguauuacagug

SEQ ID NO: 1405407 - RNA, 23 nt, Human
uucaaauuguaagcaugcacaaa

SEQ ID NO: 1405408 - RNA, 21 nt, Human
uuaucuaaguuaauuuaaagu

SEQ ID NO: 1405409 - RNA, 16 nt, Human
uuaucguuuucuuaaa

SEQ ID NO: 1405410 - RNA, 18 nt, Human
uuaucguuuucuuaaagu

SEQ ID NO: 1405411 - RNA, 17 nt, Human
uuaucuaauuuauaaaa

SEQ ID NO: 1405412 - RNA, 16 nt, Human
uuaucuaauuuauaaa

SEQ ID NO: 1405413 - RNA, 11 nt, Human
uuaucuaauuu

SEQ ID NO: 1405414 - RNA, 22 nt, Human
uuaucuaaucaugaaacucccu

SEQ ID NO: 1405415 - RNA, 18 nt, Human
uuaucuaaucaugaaacu

SEQ ID NO: 1405416 - RNA, 20 nt, Human
uuaucuacuuccaaacuaau

SEQ ID NO: 1405417 - RNA, 19 nt, Human
uuaucuacuuccaaacuaa

SEQ ID NO: 1405418 - RNA, 14 nt, Human
uuaucuagauacug

SEQ ID NO: 1405419 - RNA, 18 nt, Human
uuaucuauagcuaaguac

SEQ ID NO: 1405420 - RNA, 16 nt, Human
uuaucuuaaaacuccu

SEQ ID NO: 1405421 - RNA, 16 nt, Human
uuaucuugaauaaugu

SEQ ID NO: 1405422 - RNA, 19 nt, Human
uuaucuucucaaguucuaa

SEQ ID NO: 1405423 - RNA, 22 nt, Human
uuaucuucucaaguucuaagau

SEQ ID NO: 1405424 - RNA, 18 nt, Human
uuaucuucucaaguucua

SEQ ID NO: 1405425 - RNA, 20 nt, Human
uuaucuucaggacacucacu

SEQ ID NO: 1405426 - RNA, 14 nt, Human
uuaucuugaauaau

SEQ ID NO: 1405427 - RNA, 14 nt, Human
uuaucgaaacucau

SEQ ID NO: 1405428 - RNA, 15 nt, Human
uuauccuuucauaua

SEQ ID NO: 1405429 - RNA, 16 nt, Human
uuauccugaaauuuca

SEQ ID NO: 1405430 - RNA, 17 nt, Human
uuauccugaaauuucag

SEQ ID NO: 1405431 - RNA, 18 nt, Human
uuauccucuuuagaguua

SEQ ID NO: 1405432 - RNA, 20 nt, Human
uuauccucuuuagaguuaga

SEQ ID NO: 1405433 - RNA, 14 nt, Human
uuauccucccugua

SEQ ID NO: 1405434 - RNA, 18 nt, Human
uuauccucccuguaacuu

SEQ ID NO: 1405435 - RNA, 14 nt, Human
uuauccucuuuaga

SEQ ID NO: 1405436 - RNA, 15 nt, Human
uuauccucuuuagag

SEQ ID NO: 1405437 - RNA, 17 nt, Human
uuauccucuuuagaguu

SEQ ID NO: 1405438 - RNA, 13 nt, Human
uuauccucccugu

SEQ ID NO: 1405439 - RNA, 11 nt, Human
uuauccucccu

SEQ ID NO: 1405440 - RNA, 16 nt, Human
uuauccuccaccgucu

SEQ ID NO: 1405441 - RNA, 22 nt, Human
uuauauuucuauuuuauuauga

SEQ ID NO: 1405442 - RNA, 15 nt, Human
uuauauuugaaauau

SEQ ID NO: 1405443 - RNA, 13 nt, Human
uuauauuugaaau

SEQ ID NO: 1405444 - RNA, 12 nt, Human
uuauauuugaaa

SEQ ID NO: 1405445 - RNA, 13 nt, Human
uuauauuuaacuc

SEQ ID NO: 1405446 - RNA, 20 nt, Human
uuauauuuauuacuguaaga

SEQ ID NO: 1405447 - RNA, 17 nt, Human
uuauauugauaagaucu

SEQ ID NO: 1405448 - RNA, 16 nt, Human
uuauauuuacaaaugg

SEQ ID NO: 1405449 - RNA, 17 nt, Human
uuauguugcauagaaua

SEQ ID NO: 1405450 - RNA, 19 nt, Human
uuauggagucauuuuuaca

SEQ ID NO: 1405451 - RNA, 18 nt, Human
uuauggcuuuugugcauu

SEQ ID NO: 1405452 - RNA, 17 nt, Human
uuauggcuuuugugcau

SEQ ID NO: 1405453 - RNA, 18 nt, Human
uuauggagucauuuuuac

SEQ ID NO: 1405454 - RNA, 23 nt, Human
uuauggaauugauuugcauugaa

SEQ ID NO: 1405455 - RNA, 21 nt, Human
uuauggaauugauuugcauug

SEQ ID NO: 1405456 - RNA, 20 nt, Human
uuauggaauugauuugcauu

SEQ ID NO: 1405457 - RNA, 14 nt, Human
uuauggcacaucag

SEQ ID NO: 1405458 - RNA, 16 nt, Human
uuauggcuuuugugca

SEQ ID NO: 1405459 - RNA, 19 nt, Human
uuauggaauugauuugcau

SEQ ID NO: 1405460 - RNA, 14 nt, Human
uuauggaauugauu

SEQ ID NO: 1405461 - RNA, 17 nt, Human
uuaugcaaaagcaagcu

SEQ ID NO: 1405462 - RNA, 21 nt, Human
uuaugcaaaagcaagcugauu

SEQ ID NO: 1405463 - RNA, 15 nt, Human
uuaugcaaaagcaag

SEQ ID NO: 1405464 - RNA, 19 nt, Human
uuaugauuuuuuuuucaua

SEQ ID NO: 1405465 - RNA, 18 nt, Human
uuaugauuuuuuuuucau

SEQ ID NO: 1405466 - RNA, 15 nt, Human
uuauuaacuuuaaug

SEQ ID NO: 1405467 - RNA, 21 nt, Human
uuauuaacgauguccaacccg

SEQ ID NO: 1405468 - RNA, 18 nt, Human
uuauuaacauaggugaaa

SEQ ID NO: 1405469 - RNA, 19 nt, Human
uuauuaacaauuaggcaga

SEQ ID NO: 1405470 - RNA, 16 nt, Human
uuauuaacaauuaggc

SEQ ID NO: 1405471 - RNA, 22 nt, Human
uuauguuuucgaaaaucaaaug

SEQ ID NO: 1405472 - RNA, 23 nt, Human
uuauuaaaaaucucaaauuucua

SEQ ID NO: 1405473 - RNA, 21 nt, Human
uuauuacguaugucugguucu

SEQ ID NO: 1405474 - RNA, 18 nt, Human
uuauuacguaugucuggu

SEQ ID NO: 1405475 - RNA, 18 nt, Human
uuauuagaaucaaacauu

SEQ ID NO: 1405476 - RNA, 20 nt, Human
uuauuacuuguaaauauaaa

SEQ ID NO: 1405477 - RNA, 18 nt, Human
uuauuacuuguaaauaua

SEQ ID NO: 1405478 - RNA, 16 nt, Human
uuauuacuuguaaaua

SEQ ID NO: 1405479 - RNA, 14 nt, Human
uuauuacuuuugcu

SEQ ID NO: 1405480 - RNA, 15 nt, Human
uuauuacuuguaaau

SEQ ID NO: 1405481 - RNA, 23 nt, Human
uuauuacguaugucugguucuca

SEQ ID NO: 1405482 - RNA, 19 nt, Human
uuauuaauauauauuaucu

SEQ ID NO: 1405483 - RNA, 20 nt, Human
uuauuaauauauauuaucuu

SEQ ID NO: 1405484 - RNA, 13 nt, Human
uuauuacaguguu

SEQ ID NO: 1405485 - RNA, 12 nt, Human
uuauuacagugu

SEQ ID NO: 1405486 - RNA, 19 nt, Human
uuauuacaguguuuauccu

SEQ ID NO: 1405487 - RNA, 18 nt, Human
uuaguguaugauuacugg

SEQ ID NO: 1405488 - RNA, 13 nt, Human
uuaguguauccau

SEQ ID NO: 1405489 - RNA, 23 nt, Human
uuaguggcucaacauuguguucc

SEQ ID NO: 1405490 - RNA, 20 nt, Human
uuaguggcucaacauugugu

SEQ ID NO: 1405491 - RNA, 16 nt, Human
uuaguggcucaacauu

SEQ ID NO: 1405492 - RNA, 21 nt, Human
uuagugcuaagugugaacugg

SEQ ID NO: 1405493 - RNA, 16 nt, Human
uuagugcuaaguguga

SEQ ID NO: 1405494 - RNA, 17 nt, Human
uuagugcuaagugugaa

SEQ ID NO: 1405495 - RNA, 19 nt, Human
uuagugcuaagugugaacu

SEQ ID NO: 1405496 - RNA, 20 nt, Human
uuagugcuaagugugaacug

SEQ ID NO: 1405497 - RNA, 19 nt, Human
uuauaagcaucauuauuua

SEQ ID NO: 1405498 - RNA, 17 nt, Human
uuauaagcaucauuauu

SEQ ID NO: 1405499 - RNA, 13 nt, Human
uuauaagcaucau

SEQ ID NO: 1405500 - RNA, 14 nt, Human
uuauaagacucuca

SEQ ID NO: 1405501 - RNA, 20 nt, Human
uuauaagacucucacacuca

SEQ ID NO: 1405502 - RNA, 13 nt, Human
uuauaagacucuc

SEQ ID NO: 1405503 - RNA, 12 nt, Human
uuauaagacucu

SEQ ID NO: 1405504 - RNA, 16 nt, Human
uuauaagaaagccuga

SEQ ID NO: 1405505 - RNA, 15 nt, Human
uuauaagaaagccug

SEQ ID NO: 1405506 - RNA, 18 nt, Human
uuauaaguagcaggccaa

SEQ ID NO: 1405507 - RNA, 21 nt, Human
uuauaagcaucauuauuuaug

SEQ ID NO: 1405508 - RNA, 22 nt, Human
uuauaagcaucauuauuuaugu

SEQ ID NO: 1405509 - RNA, 19 nt, Human
uuagugccacuuaauguau

SEQ ID NO: 1405510 - RNA, 18 nt, Human
uuagugccacuuaaugua

SEQ ID NO: 1405511 - RNA, 12 nt, Human
uuagugcuaagu

SEQ ID NO: 1405512 - RNA, 15 nt, Human
uuagugcuaagugug

SEQ ID NO: 1405513 - RNA, 19 nt, Human
ugucuuuucccauuuaucu

SEQ ID NO: 1405514 - RNA, 20 nt, Human
ugucuuuucccauuuaucua

SEQ ID NO: 1405515 - RNA, 18 nt, Human
uuauaauaaaggacugua

SEQ ID NO: 1405516 - RNA, 19 nt, Human
uuauaauaaaggacuguaa

SEQ ID NO: 1405517 - RNA, 13 nt, Human
uuauaauauacua

SEQ ID NO: 1405518 - RNA, 21 nt, Human
uuauaauaaaggacuguaauc

SEQ ID NO: 1405519 - RNA, 14 nt, Human
uuauaauucucauu

SEQ ID NO: 1405520 - RNA, 18 nt, Human
uuauaaucuuauaauugu

SEQ ID NO: 1405521 - RNA, 11 nt, Human
uuauaaucuuu

SEQ ID NO: 1405522 - RNA, 15 nt, Human
uuauaauuuugugaa

SEQ ID NO: 1405523 - RNA, 14 nt, Human
uuauaauuuuguga

SEQ ID NO: 1405524 - RNA, 17 nt, Human
uuauaauuuuaaauguu

SEQ ID NO: 1405525 - RNA, 21 nt, Human
uuauaauuuuaaauguuuuuu

SEQ ID NO: 1405526 - RNA, 12 nt, Human
uuauaauuuaaa

SEQ ID NO: 1405527 - RNA, 23 nt, Human
uuauaauucuuucaauacagaua

SEQ ID NO: 1405528 - RNA, 21 nt, Human
uuauaauucuuucaauacaga

SEQ ID NO: 1405529 - RNA, 14 nt, Human
uuauaauucuuuca

SEQ ID NO: 1405530 - RNA, 17 nt, Human
uuauaauucucauuaaa

SEQ ID NO: 1405531 - RNA, 12 nt, Human
uuauaauuuuaa

SEQ ID NO: 1405532 - RNA, 19 nt, Human
uuauauauuauauggaaau

SEQ ID NO: 1405533 - RNA, 16 nt, Human
uuauauauuauaugga

SEQ ID NO: 1405534 - RNA, 13 nt, Human
uuauauauuauau

SEQ ID NO: 1405535 - RNA, 21 nt, Human
uuauacagcuguauugucuga

SEQ ID NO: 1405536 - RNA, 13 nt, Human
uuauacauaaaca

SEQ ID NO: 1405537 - RNA, 15 nt, Human
uuauacagcuguauu

SEQ ID NO: 1405538 - RNA, 13 nt, Human
uuauacagcugua

SEQ ID NO: 1405539 - RNA, 11 nt, Human
uuauacauaaa

SEQ ID NO: 1405540 - RNA, 17 nt, Human
uuauauauuauauggaa

SEQ ID NO: 1405541 - RNA, 16 nt, Human
uuauauauuuaaaagu

SEQ ID NO: 1405542 - RNA, 23 nt, Human
uuauaucuauauuuuacauaaau

SEQ ID NO: 1405543 - RNA, 19 nt, Human
uuauaucuauauuuuacau

SEQ ID NO: 1405544 - RNA, 20 nt, Human
uuauacacuguguaaauacc

SEQ ID NO: 1405545 - RNA, 13 nt, Human
uuauacacugugu

SEQ ID NO: 1405546 - RNA, 16 nt, Human
uuauaauuuuccuaau

SEQ ID NO: 1405547 - RNA, 14 nt, Human
uuauaauuuuccua

SEQ ID NO: 1405548 - RNA, 18 nt, Human
uuauaauuuugugaagca

SEQ ID NO: 1405549 - RNA, 17 nt, Human
uuauaauuuugugaagc

SEQ ID NO: 1405550 - RNA, 16 nt, Human
uuauaauuuugugaag

SEQ ID NO: 1405551 - RNA, 16 nt, Human
uuauaucuggccucug

SEQ ID NO: 1405552 - RNA, 19 nt, Human
uuauaugaagaaaaucacu

SEQ ID NO: 1405553 - RNA, 15 nt, Human
uuauaugaagaaaau

SEQ ID NO: 1405554 - RNA, 22 nt, Human
uuauauggaaauauauauuaua

SEQ ID NO: 1405555 - RNA, 20 nt, Human
uuauauggaaauauauauua

SEQ ID NO: 1405556 - RNA, 19 nt, Human
uuauauggaaauauauauu

SEQ ID NO: 1405557 - RNA, 18 nt, Human
uuauauggaaauauauau

SEQ ID NO: 1405558 - RNA, 15 nt, Human
uuauauggaaauaua

SEQ ID NO: 1405559 - RNA, 10 nt, Human
uuauauggaa

SEQ ID NO: 1405560 - RNA, 19 nt, Human
uuauaugcuuacugauaua

SEQ ID NO: 1405561 - RNA, 13 nt, Human
uuauaugcuuacu

SEQ ID NO: 1405562 - RNA, 18 nt, Human
uuauauguuguaauauuu

SEQ ID NO: 1405563 - RNA, 18 nt, Human
uuauauguuguaagcaac

SEQ ID NO: 1405564 - RNA, 19 nt, Human
uuauauguacaugagaagg

SEQ ID NO: 1405565 - RNA, 16 nt, Human
uuauauguacaugaga

SEQ ID NO: 1405566 - RNA, 13 nt, Human
uuauauggaaauu

SEQ ID NO: 1405567 - RNA, 14 nt, Human
uuauauggaaauuc

SEQ ID NO: 1405568 - RNA, 24 nt, Human
uuauauguacccucugaaauacau

SEQ ID NO: 1405569 - RNA, 22 nt, Human
uuauauguacccucugaaauac

SEQ ID NO: 1405570 - RNA, 19 nt, Human
uuauauguacccucugaaa

SEQ ID NO: 1405571 - RNA, 14 nt, Human
uuauauguaccgua

SEQ ID NO: 1405572 - RNA, 16 nt, Human
uuauauguaccguagg

SEQ ID NO: 1405573 - RNA, 17 nt, Human
uuauauuaaccagauau

SEQ ID NO: 1405574 - RNA, 16 nt, Human
uuauauuaugaagcuu

SEQ ID NO: 1405575 - RNA, 15 nt, Human
uugcaaagaaagaaa

SEQ ID NO: 1405576 - RNA, 19 nt, Human
uugcaaagaaagaaaaaaa

SEQ ID NO: 1405577 - RNA, 13 nt, Human
uugcaaagaaaga

SEQ ID NO: 1405578 - RNA, 20 nt, Human
uugauuuuagccuucucugu

SEQ ID NO: 1405579 - RNA, 19 nt, Human
uugauuugcauugaacaca

SEQ ID NO: 1405580 - RNA, 17 nt, Human
uugauuugcauugaaca

SEQ ID NO: 1405581 - RNA, 15 nt, Human
uugauuugcauugaa

SEQ ID NO: 1405582 - RNA, 14 nt, Human
uugauuugcauuga

SEQ ID NO: 1405583 - RNA, 13 nt, Human
uugauuugcauug

SEQ ID NO: 1405584 - RNA, 18 nt, Human
uugauuugaagaacaugu

SEQ ID NO: 1405585 - RNA, 15 nt, Human
uugcaccuuucuagu

SEQ ID NO: 1405586 - RNA, 17 nt, Human
uugcaaaucuugaaauu

SEQ ID NO: 1405587 - RNA, 16 nt, Human
uugcaaaucuugaaau

SEQ ID NO: 1405588 - RNA, 15 nt, Human
uugcaaaucuugaaa

SEQ ID NO: 1405589 - RNA, 12 nt, Human
uugcaaaucuug

SEQ ID NO: 1405590 - RNA, 21 nt, Human
uugcaaaguaucccuacugua

SEQ ID NO: 1405591 - RNA, 14 nt, Human
uugauuugaagaac

SEQ ID NO: 1405592 - RNA, 13 nt, Human
uugauuugaagaa

SEQ ID NO: 1405593 - RNA, 14 nt, Human
uugauugauuugaa

SEQ ID NO: 1405594 - RNA, 13 nt, Human
uugauugauuuga

SEQ ID NO: 1405595 - RNA, 20 nt, Human
uugauucugcaguaaaucuu

SEQ ID NO: 1405596 - RNA, 12 nt, Human
uugauucugcag

SEQ ID NO: 1405597 - RNA, 13 nt, Human
uugaggucucagc

SEQ ID NO: 1405598 - RNA, 18 nt, Human
uugauauagaaguauaaa

SEQ ID NO: 1405599 - RNA, 15 nt, Human
uugaggucucagccc

SEQ ID NO: 1405600 - RNA, 15 nt, Human
uugaggucuguucuu

SEQ ID NO: 1405601 - RNA, 20 nt, Human
uugaugaccaaaguccuuuu

SEQ ID NO: 1405602 - RNA, 20 nt, Human
uugauauagaaguauaaaga

SEQ ID NO: 1405603 - RNA, 22 nt, Human
uugauauagaaguauaaagaau

SEQ ID NO: 1405604 - RNA, 23 nt, Human
uugaugaagaaguugauaugccu

SEQ ID NO: 1405605 - RNA, 14 nt, Human
uugaugaagaaguu

SEQ ID NO: 1405606 - RNA, 21 nt, Human
uugacucuuuugccauuaaac

SEQ ID NO: 1405607 - RNA, 15 nt, Human
uugacucuuuugcca

SEQ ID NO: 1405608 - RNA, 20 nt, Human
uugacucaggagccugugac

SEQ ID NO: 1405609 - RNA, 14 nt, Human
uugacucaggagcc

SEQ ID NO: 1405610 - RNA, 13 nt, Human
uugacucaggagc

SEQ ID NO: 1405611 - RNA, 16 nt, Human
uugaccucugcagcaa

SEQ ID NO: 1405612 - RNA, 20 nt, Human
uugaccgcgacuaauuucaa

SEQ ID NO: 1405613 - RNA, 16 nt, Human
uugacccuugcuguga

SEQ ID NO: 1405614 - RNA, 14 nt, Human
uugaccucugcagc

SEQ ID NO: 1405615 - RNA, 15 nt, Human
uugaccucugcagca

SEQ ID NO: 1405616 - RNA, 13 nt, Human
uugaacugauuca

SEQ ID NO: 1405617 - RNA, 13 nt, Human
uugaacuuugacc

SEQ ID NO: 1405618 - RNA, 22 nt, Human
uugaauuuuuuuuaacauuccu

SEQ ID NO: 1405619 - RNA, 19 nt, Human
uugaauuuuuuuuaacauu

SEQ ID NO: 1405620 - RNA, 18 nt, Human
uugacaacuggcaggcag

SEQ ID NO: 1405621 - RNA, 16 nt, Human
uugacaaccaugagac

SEQ ID NO: 1405622 - RNA, 18 nt, Human
uugacaaaggcaagcacu

SEQ ID NO: 1405623 - RNA, 17 nt, Human
uugaauuucacugucuu

SEQ ID NO: 1405624 - RNA, 12 nt, Human
uugaauuuuaca

SEQ ID NO: 1405625 - RNA, 23 nt, Human
uucugugucuuucacagcuccuc

SEQ ID NO: 1405626 - RNA, 22 nt, Human
uucugugucuuucacagcuccu

SEQ ID NO: 1405627 - RNA, 12 nt, Human
uucugugucuuu

SEQ ID NO: 1405628 - RNA, 22 nt, Human
uucugugguuucauguuaguua

SEQ ID NO: 1405629 - RNA, 18 nt, Human
uucugugguuucauguua

SEQ ID NO: 1405630 - RNA, 17 nt, Human
uucugucuucuacagau

SEQ ID NO: 1405631 - RNA, 13 nt, Human
uucugucccuagg

SEQ ID NO: 1405632 - RNA, 21 nt, Human
uucugucccuagguguuuugu

SEQ ID NO: 1405633 - RNA, 21 nt, Human
uucuggauuccccaucucagg

SEQ ID NO: 1405634 - RNA, 17 nt, Human
uucuggaccucuggguu

SEQ ID NO: 1405635 - RNA, 16 nt, Human
uucuggaccucugggu

SEQ ID NO: 1405636 - RNA, 18 nt, Human
uucuggaccucuggguug

SEQ ID NO: 1405637 - RNA, 15 nt, Human
uucuggaccucuggg

SEQ ID NO: 1405638 - RNA, 19 nt, Human
uucuggacccguucaacuu

SEQ ID NO: 1405639 - RNA, 22 nt, Human
uucuggaauguaaucaauguuu

SEQ ID NO: 1405640 - RNA, 20 nt, Human
uucuggaauguaaucaaugu

SEQ ID NO: 1405641 - RNA, 16 nt, Human
uucuggaauguaauca

SEQ ID NO: 1405642 - RNA, 15 nt, Human
uucuggaauguaauc

SEQ ID NO: 1405643 - RNA, 19 nt, Human
uucuggaauacaugaaaua

SEQ ID NO: 1405644 - RNA, 17 nt, Human
uucuggaauacaugaaa

SEQ ID NO: 1405645 - RNA, 14 nt, Human
uucugcuuugcucu

SEQ ID NO: 1405646 - RNA, 21 nt, Human
uucugcuggggccugggacaa

SEQ ID NO: 1405647 - RNA, 20 nt, Human
uucugcuggggccugggaca

SEQ ID NO: 1405648 - RNA, 18 nt, Human
uucugcuggccucugcga

SEQ ID NO: 1405649 - RNA, 15 nt, Human
uucugcuggccucug

SEQ ID NO: 1405650 - RNA, 23 nt, Human
uucugcucugguuguuucuguuc

SEQ ID NO: 1405651 - RNA, 22 nt, Human
uucugcucugguuguuucuguu

SEQ ID NO: 1405652 - RNA, 21 nt, Human
uucugcucugguuguuucugu

SEQ ID NO: 1405653 - RNA, 17 nt, Human
uucugcucugguuguuu

SEQ ID NO: 1405654 - RNA, 16 nt, Human
uucugcuccuucccca

SEQ ID NO: 1405655 - RNA, 20 nt, Human
uucugcuggccucugcgagu

SEQ ID NO: 1405656 - RNA, 13 nt, Human
uucuuccucagcc

SEQ ID NO: 1405657 - RNA, 12 nt, Human
uucuuccucagc

SEQ ID NO: 1405658 - RNA, 18 nt, Human
uucuuccuaccaagucaa

SEQ ID NO: 1405659 - RNA, 15 nt, Human
uucuuccggccccuc

SEQ ID NO: 1405660 - RNA, 14 nt, Human
uucuuccaucugau

SEQ ID NO: 1405661 - RNA, 13 nt, Human
uucuuccaucuga

SEQ ID NO: 1405662 - RNA, 17 nt, Human
uucuuguuggugcacag

SEQ ID NO: 1405663 - RNA, 14 nt, Human
uucuuguuggugca

SEQ ID NO: 1405664 - RNA, 17 nt, Human
uucuuccucagccagcc

SEQ ID NO: 1405665 - RNA, 20 nt, Human
uucuuccucagccagccucg

SEQ ID NO: 1405666 - RNA, 16 nt, Human
uucuuccucagccagc

SEQ ID NO: 1405667 - RNA, 14 nt, Human
uucuuccucagcca

SEQ ID NO: 1405668 - RNA, 23 nt, Human
uucuuuaaaaaacaacuauggau

SEQ ID NO: 1405669 - RNA, 20 nt, Human
uucuuuaaaauguaaagcca

SEQ ID NO: 1405670 - RNA, 15 nt, Human
uucuuuaaaauuaca

SEQ ID NO: 1405671 - RNA, 14 nt, Human
uucuuuccaaagua

SEQ ID NO: 1405672 - RNA, 20 nt, Human
uugaaaaaauagagccugag

SEQ ID NO: 1405673 - RNA, 13 nt, Human
uugaaaaaaaaua

SEQ ID NO: 1405674 - RNA, 14 nt, Human
uucuuucauuucuu

SEQ ID NO: 1405675 - RNA, 18 nt, Human
uucuuuccacagaagcuc

SEQ ID NO: 1405676 - RNA, 21 nt, Human
uucuuuccaaaguacacuguu

SEQ ID NO: 1405677 - RNA, 15 nt, Human
uugaaaaaguuuguu

SEQ ID NO: 1405678 - RNA, 13 nt, Human
uugaaaaagcgaa

SEQ ID NO: 1405679 - RNA, 16 nt, Human
uugaaaaagacauuca

SEQ ID NO: 1405680 - RNA, 14 nt, Human
uugaaaaagacauu

SEQ ID NO: 1405681 - RNA, 13 nt, Human
uucuuucauuucu

SEQ ID NO: 1405682 - RNA, 22 nt, Human
uugaaaaaauagagccugaggg

SEQ ID NO: 1405683 - RNA, 15 nt, Human
uugaaaaaugcaugu

SEQ ID NO: 1405684 - RNA, 21 nt, Human
uugaacguuuucuaauugcuu

SEQ ID NO: 1405685 - RNA, 17 nt, Human
uugaaaagcagacauuu

SEQ ID NO: 1405686 - RNA, 13 nt, Human
uugaaaagagcug

SEQ ID NO: 1405687 - RNA, 15 nt, Human
uugaaaagcagacau

SEQ ID NO: 1405688 - RNA, 22 nt, Human
uucucauuuuuuaaaaaagcuu

SEQ ID NO: 1405689 - RNA, 21 nt, Human
uucuccaccuagacuguaaac

SEQ ID NO: 1405690 - RNA, 23 nt, Human
uucucauuuuuuaaaaaagcuua

SEQ ID NO: 1405691 - RNA, 17 nt, Human
uucucauuuuuuaaaaa

SEQ ID NO: 1405692 - RNA, 18 nt, Human
uucucauuggaaauuuag

SEQ ID NO: 1405693 - RNA, 15 nt, Human
uucucauuaaaagaa

SEQ ID NO: 1405694 - RNA, 21 nt, Human
uucucauuggaaauuuagcau

SEQ ID NO: 1405695 - RNA, 20 nt, Human
uucucauguugaagccacug

SEQ ID NO: 1405696 - RNA, 21 nt, Human
uucuaugaaauauuauguuaa

SEQ ID NO: 1405697 - RNA, 15 nt, Human
uucuauccucuguaa

SEQ ID NO: 1405698 - RNA, 14 nt, Human
uucuauccucugua

SEQ ID NO: 1405699 - RNA, 14 nt, Human
uucuaugaaauauu

SEQ ID NO: 1405700 - RNA, 20 nt, Human
uucucugaggacaagagaaa

SEQ ID NO: 1405701 - RNA, 16 nt, Human
uucucugaggacaaga

SEQ ID NO: 1405702 - RNA, 13 nt, Human
uucucugaggaca

SEQ ID NO: 1405703 - RNA, 18 nt, Human
uucucugagcugugcagg

SEQ ID NO: 1405704 - RNA, 17 nt, Human
uucucugagcugugcag

SEQ ID NO: 1405705 - RNA, 16 nt, Human
uucucugagcugugca

SEQ ID NO: 1405706 - RNA, 20 nt, Human
uucuccagcugggcucugca

SEQ ID NO: 1405707 - RNA, 22 nt, Human
uucucuccuguaccucuugagc

SEQ ID NO: 1405708 - RNA, 19 nt, Human
uucucuccuguaccucuug

SEQ ID NO: 1405709 - RNA, 15 nt, Human
uucuccagcugggcu

SEQ ID NO: 1405710 - RNA, 14 nt, Human
uucuccagcugggc

SEQ ID NO: 1405711 - RNA, 12 nt, Human
uucuccagcugg

SEQ ID NO: 1405712 - RNA, 19 nt, Human
uucuccagccucagccucc

SEQ ID NO: 1405713 - RNA, 14 nt, Human
uucucuccuguacc

SEQ ID NO: 1405714 - RNA, 18 nt, Human
uucucuccuguaccucuu

SEQ ID NO: 1405715 - RNA, 16 nt, Human
uucugcuccagacagg

SEQ ID NO: 1405716 - RNA, 15 nt, Human
uucugcuccagacag

SEQ ID NO: 1405717 - RNA, 21 nt, Human
uucugcucaucauucucuguc

SEQ ID NO: 1405718 - RNA, 20 nt, Human
uucugcucaucauucucugu

SEQ ID NO: 1405719 - RNA, 19 nt, Human
uucugcucaucauucucug

SEQ ID NO: 1405720 - RNA, 14 nt, Human
uucugcucaucauu

SEQ ID NO: 1405721 - RNA, 13 nt, Human
uucugcucaucau

SEQ ID NO: 1405722 - RNA, 20 nt, Human
uucugcucagcucugggcca

SEQ ID NO: 1405723 - RNA, 15 nt, Human
uucugcucagcucug

SEQ ID NO: 1405724 - RNA, 14 nt, Human
uucugcucagcucu

SEQ ID NO: 1405725 - RNA, 21 nt, Human
uucugcuacuuugcugcuaug

SEQ ID NO: 1405726 - RNA, 22 nt, Human
uucugccuuuggggacuuuucu

SEQ ID NO: 1405727 - RNA, 21 nt, Human
uucugccuuugccaggugacu

SEQ ID NO: 1405728 - RNA, 15 nt, Human
uucugccuuugccag

SEQ ID NO: 1405729 - RNA, 14 nt, Human
uucugccuuugcca

SEQ ID NO: 1405730 - RNA, 13 nt, Human
uucugccuuugcc

SEQ ID NO: 1405731 - RNA, 16 nt, Human
uucugccuucucauga

SEQ ID NO: 1405732 - RNA, 14 nt, Human
uucugccuucucau

SEQ ID NO: 1405733 - RNA, 24 nt, Human
uucugauuuuaggagcuaaggcuc

SEQ ID NO: 1405734 - RNA, 23 nt, Human
uucugauuuuaggagcuaaggcu

SEQ ID NO: 1405735 - RNA, 17 nt, Human
uucugauuuuaggagcu

SEQ ID NO: 1405736 - RNA, 21 nt, Human
uucugauucgaaugacacugu

SEQ ID NO: 1405737 - RNA, 22 nt, Human
uucugaucaaggccuuauugga

SEQ ID NO: 1405738 - RNA, 15 nt, Human
uucugaucaaggccu

SEQ ID NO: 1405739 - RNA, 14 nt, Human
uucugaucaaggcc

SEQ ID NO: 1405740 - RNA, 15 nt, Human
uucugaguuccugca

SEQ ID NO: 1405741 - RNA, 12 nt, Human
uucugaguuccu

SEQ ID NO: 1405742 - RNA, 13 nt, Human
uucugaguacaga

SEQ ID NO: 1405743 - RNA, 17 nt, Human
uucugaggugcacuggg

SEQ ID NO: 1405744 - RNA, 16 nt, Human
uucugaggcuuuauga

SEQ ID NO: 1405745 - RNA, 23 nt, Human
uucugagauggcucccaggggcu

SEQ ID NO: 1405746 - RNA, 19 nt, Human
uucugagauggcucccagg

SEQ ID NO: 1405747 - RNA, 16 nt, Human
uucugagaucuguuga

SEQ ID NO: 1405748 - RNA, 22 nt, Human
uucugagacgucaugaggagau

SEQ ID NO: 1405749 - RNA, 19 nt, Human
uucugagacgucaugagga

SEQ ID NO: 1405750 - RNA, 17 nt, Human
uucugagacgucaugag

SEQ ID NO: 1405751 - RNA, 18 nt, Human
uucugauaaaagauggcc

SEQ ID NO: 1405752 - RNA, 23 nt, Human
uucugaguuuuguguuuguugua

SEQ ID NO: 1405753 - RNA, 22 nt, Human
uucugaguuuuguguuuguugu

SEQ ID NO: 1405754 - RNA, 21 nt, Human
uucugaguuuuguguuuguug

SEQ ID NO: 1405755 - RNA, 19 nt, Human
uucugaguuuuguguuugu

SEQ ID NO: 1405756 - RNA, 16 nt, Human
uucugaguuuuguguu

SEQ ID NO: 1405757 - RNA, 15 nt, Human
uucugaguuuugugu

SEQ ID NO: 1405758 - RNA, 14 nt, Human
uucugaguuuugug

SEQ ID NO: 1405759 - RNA, 19 nt, Human
uucugauaaaagauggcca

SEQ ID NO: 1405760 - RNA, 16 nt, Human
uucugauaaugaaaau

SEQ ID NO: 1405761 - RNA, 15 nt, Human
uucuaauuuuuaaga

SEQ ID NO: 1405762 - RNA, 21 nt, Human
uucuacaacucauacacucgu

SEQ ID NO: 1405763 - RNA, 15 nt, Human
uucuacauagaugcu

SEQ ID NO: 1405764 - RNA, 14 nt, Human
uucuaccauuucag

SEQ ID NO: 1405765 - RNA, 19 nt, Human
uucuaccaaggucuucuua

SEQ ID NO: 1405766 - RNA, 12 nt, Human
uucgucuguugu

SEQ ID NO: 1405767 - RNA, 15 nt, Human
uucguagauauugga

SEQ ID NO: 1405768 - RNA, 13 nt, Human
uucguaacacagc

SEQ ID NO: 1405769 - RNA, 13 nt, Human
uucggugugcacc

SEQ ID NO: 1405770 - RNA, 16 nt, Human
uucuaauugcuuauuu

SEQ ID NO: 1405771 - RNA, 17 nt, Human
uucuaauuggcaugaag

SEQ ID NO: 1405772 - RNA, 14 nt, Human
uucuaauugcuuau

SEQ ID NO: 1405773 - RNA, 13 nt, Human
uucuaauugcuua

SEQ ID NO: 1405774 - RNA, 15 nt, Human
uucuaauugccaugu

SEQ ID NO: 1405775 - RNA, 14 nt, Human
uucuaauugccaug

SEQ ID NO: 1405776 - RNA, 23 nt, Human
uucuaauuauguagcucuuuguc

SEQ ID NO: 1405777 - RNA, 16 nt, Human
uucuaauuauguagcu

SEQ ID NO: 1405778 - RNA, 13 nt, Human
uucguggggaggu

SEQ ID NO: 1405779 - RNA, 13 nt, Human
uucguuaucuaau

SEQ ID NO: 1405780 - RNA, 18 nt, Human
uucuaccauuucagagag

SEQ ID NO: 1405781 - RNA, 15 nt, Human
uucuaccauuucaga

SEQ ID NO: 1405782 - RNA, 21 nt, Human
uucuacucacuuuucccacuc

SEQ ID NO: 1405783 - RNA, 20 nt, Human
uucuacucacuuuucccacu

SEQ ID NO: 1405784 - RNA, 19 nt, Human
uucuacucacuuuucccac

SEQ ID NO: 1405785 - RNA, 20 nt, Human
uucuacugcucuccuccacc

SEQ ID NO: 1405786 - RNA, 19 nt, Human
uucuacuuugauaugacug

SEQ ID NO: 1405787 - RNA, 13 nt, Human
uucuacugcucuc

SEQ ID NO: 1405788 - RNA, 16 nt, Human
uucuauaguucuagac

SEQ ID NO: 1405789 - RNA, 17 nt, Human
uucuauaguucuagaca

SEQ ID NO: 1405790 - RNA, 15 nt, Human
uucuauaguucuaga

SEQ ID NO: 1405791 - RNA, 14 nt, Human
uucuauaguucuag

SEQ ID NO: 1405792 - RNA, 16 nt, Human
uucuauaguuauuaag

SEQ ID NO: 1405793 - RNA, 23 nt, Human
uucuauagccaaaaauagcuaaa

SEQ ID NO: 1405794 - RNA, 21 nt, Human
uucuauagccaaaaauagcua

SEQ ID NO: 1405795 - RNA, 17 nt, Human
uucuauagccaaaaaua

SEQ ID NO: 1405796 - RNA, 15 nt, Human
uucuauagccaaaaa

SEQ ID NO: 1405797 - RNA, 14 nt, Human
uucuauagccaaaa

SEQ ID NO: 1405798 - RNA, 14 nt, Human
uucuauagcuuuuc

SEQ ID NO: 1405799 - RNA, 21 nt, Human
uuccugcugcugucugggugc

SEQ ID NO: 1405800 - RNA, 20 nt, Human
uuccugcugcugucugggug

SEQ ID NO: 1405801 - RNA, 18 nt, Human
uuccugcugcugucuggg

SEQ ID NO: 1405802 - RNA, 17 nt, Human
uuccugcugcugucugg

SEQ ID NO: 1405803 - RNA, 15 nt, Human
uuccugcugcugucu

SEQ ID NO: 1405804 - RNA, 14 nt, Human
uuccugcugcuguc

SEQ ID NO: 1405805 - RNA, 13 nt, Human
uuccugcugcugu

SEQ ID NO: 1405806 - RNA, 12 nt, Human
uuccugcugcug

SEQ ID NO: 1405807 - RNA, 11 nt, Human
uuccugcugcu

SEQ ID NO: 1405808 - RNA, 21 nt, Human
uuccugccuuggccucccaag

SEQ ID NO: 1405809 - RNA, 13 nt, Human
uuccugcuugcca

SEQ ID NO: 1405810 - RNA, 19 nt, Human
uuccuggacacucagaccu

SEQ ID NO: 1405811 - RNA, 15 nt, Human
uuccuggacacucag

SEQ ID NO: 1405812 - RNA, 15 nt, Human
uuccugcuuuucccc

SEQ ID NO: 1405813 - RNA, 22 nt, Human
uuccuuuaacaacauguuucca

SEQ ID NO: 1405814 - RNA, 17 nt, Human
uuccuuuaacaacaugu

SEQ ID NO: 1405815 - RNA, 16 nt, Human
uuccuugucacuggua

SEQ ID NO: 1405816 - RNA, 17 nt, Human
uucggggcugggaaguc

SEQ ID NO: 1405817 - RNA, 13 nt, Human
uucggggcuggga

SEQ ID NO: 1405818 - RNA, 21 nt, Human
uuccuuuaacaacauguuucc

SEQ ID NO: 1405819 - RNA, 19 nt, Human
uuccuuuaacaacauguuu

SEQ ID NO: 1405820 - RNA, 18 nt, Human
uuccuuuaacaacauguu

SEQ ID NO: 1405821 - RNA, 18 nt, Human
uucggugagcuacaaaug

SEQ ID NO: 1405822 - RNA, 22 nt, Human
uuccugacacuuuaauuaccaa

SEQ ID NO: 1405823 - RNA, 13 nt, Human
uuccugacacuuu

SEQ ID NO: 1405824 - RNA, 18 nt, Human
uuccugaauccaaacuaa

SEQ ID NO: 1405825 - RNA, 13 nt, Human
uuccugaauccaa

SEQ ID NO: 1405826 - RNA, 21 nt, Human
uuccauggugugaucgucuga

SEQ ID NO: 1405827 - RNA, 12 nt, Human
uuccaugggaau

SEQ ID NO: 1405828 - RNA, 22 nt, Human
uuccaugggaccacaacuauuu

SEQ ID NO: 1405829 - RNA, 16 nt, Human
uuccauggccucuuca

SEQ ID NO: 1405830 - RNA, 17 nt, Human
uuccauggcaggaaggc

SEQ ID NO: 1405831 - RNA, 19 nt, Human
uuccauggcaggaaggcuu

SEQ ID NO: 1405832 - RNA, 23 nt, Human
uuccaugcugugcgcccagggcu

SEQ ID NO: 1405833 - RNA, 14 nt, Human
uuccaugcugugcg

SEQ ID NO: 1405834 - RNA, 12 nt, Human
uuccauggccuc

SEQ ID NO: 1405835 - RNA, 20 nt, Human
uuccugcaacucaaggacuu

SEQ ID NO: 1405836 - RNA, 19 nt, Human
uuccugcaacucaaggacu

SEQ ID NO: 1405837 - RNA, 20 nt, Human
uuccugaccuccgccaucca

SEQ ID NO: 1405838 - RNA, 22 nt, Human
uuccugagucccaucccugcgu

SEQ ID NO: 1405839 - RNA, 14 nt, Human
uuuuuuuuguuugu

SEQ ID NO: 1405840 - RNA, 12 nt, Human
uuuuuuuugcag

SEQ ID NO: 1405841 - RNA, 11 nt, Human
uuuuuuuugca

SEQ ID NO: 1405842 - RNA, 13 nt, Human
uuuuuuuguuugu

SEQ ID NO: 1405843 - RNA, 14 nt, Human
uuuuuuuuaaacua

SEQ ID NO: 1405844 - RNA, 13 nt, Human
uuuuuuuugacaa

SEQ ID NO: 1405845 - RNA, 16 nt, Human
uuuuuuguuuguuugu

SEQ ID NO: 1405846 - RNA, 10 nt, Human
uuuuuuccuu

SEQ ID NO: 1405847 - RNA, 11 nt, Human
uuuuuuuacua

SEQ ID NO: 1405848 - RNA, 22 nt, Human
uuuuuuccaucuuuacaaaacu

SEQ ID NO: 1405849 - RNA, 13 nt, Human
uuuuuuccaucuu

SEQ ID NO: 1405850 - RNA, 12 nt, Human
uuuuuuccccag

SEQ ID NO: 1405851 - RNA, 10 nt, Human
uuuuuuugca

SEQ ID NO: 1405852 - RNA, 11 nt, Human
uuuuuuugcag

SEQ ID NO: 1405853 - RNA, 12 nt, Human
uuuuuuugugug

SEQ ID NO: 1405854 - RNA, 14 nt, Human
uuuuuuuguuauua

SEQ ID NO: 1405855 - RNA, 12 nt, Human
uuuuuuuuaaga

SEQ ID NO: 1405856 - RNA, 12 nt, Human
uuuuuuucuuua

SEQ ID NO: 1405857 - RNA, 10 nt, Human
uuuuuuuccu

SEQ ID NO: 1405858 - RNA, 12 nt, Human
uuuuuuucaguu

SEQ ID NO: 1405859 - RNA, 12 nt, Human
uuuuuuuacauu

SEQ ID NO: 1405860 - RNA, 17 nt, Human
uuuuuuaagaauaucug

SEQ ID NO: 1405861 - RNA, 10 nt, Human
uuuuuuaaga

SEQ ID NO: 1405862 - RNA, 12 nt, Human
uuuuuuaacauu

SEQ ID NO: 1405863 - RNA, 15 nt, Human
uuuuuccguaaaaau

SEQ ID NO: 1405864 - RNA, 16 nt, Human
uuuuuccguaaaaaug

SEQ ID NO: 1405865 - RNA, 14 nt, Human
uuuuuccguaaaaa

SEQ ID NO: 1405866 - RNA, 18 nt, Human
uuuuucccuaucacugaa

SEQ ID NO: 1405867 - RNA, 21 nt, Human
uuuuuccccagacuuguuggc

SEQ ID NO: 1405868 - RNA, 17 nt, Human
uuuuuccccagacuugu

SEQ ID NO: 1405869 - RNA, 13 nt, Human
uuuuuccaucuuu

SEQ ID NO: 1405870 - RNA, 14 nt, Human
uuuuuuccaaaauc

SEQ ID NO: 1405871 - RNA, 12 nt, Human
uuuuuuccaaaa

SEQ ID NO: 1405872 - RNA, 13 nt, Human
uuuuuucaucuuc

SEQ ID NO: 1405873 - RNA, 11 nt, Human
uuuuuucaucu

SEQ ID NO: 1405874 - RNA, 12 nt, Human
uuuuuucaguug

SEQ ID NO: 1405875 - RNA, 12 nt, Human
uuuuuuacuaau

SEQ ID NO: 1405876 - RNA, 12 nt, Human
uuuuuuaauuga

SEQ ID NO: 1405877 - RNA, 19 nt, Human
uuuuuuaauccgccaauau

SEQ ID NO: 1405878 - RNA, 15 nt, Human
uuuuuuaauaaauuu

SEQ ID NO: 1405879 - RNA, 11 nt, Human
uuuuuuacauu

SEQ ID NO: 1405880 - RNA, 12 nt, Human
uuuuuuacauuu

SEQ ID NO: 1405881 - RNA, 23 nt, Human
uuuugacaguguugaaaauguuc

SEQ ID NO: 1405882 - RNA, 19 nt, Human
uuuugacaguguugaaaau

SEQ ID NO: 1405883 - RNA, 14 nt, Human
uuuugaaguauuua

SEQ ID NO: 1405884 - RNA, 14 nt, Human
uuuugaaggcaaaa

SEQ ID NO: 1405885 - RNA, 13 nt, Human
uuuugaaggcaaa

SEQ ID NO: 1405886 - RNA, 13 nt, Human
uuuugacugcuug

SEQ ID NO: 1405887 - RNA, 15 nt, Human
uuuugacauaaaguu

SEQ ID NO: 1405888 - RNA, 24 nt, Human
uuuugacaguguugaaaauguuca

SEQ ID NO: 1405889 - RNA, 20 nt, Human
uuuuuaaauguaaagauauu

SEQ ID NO: 1405890 - RNA, 15 nt, Human
uuuuuaaauguauac

SEQ ID NO: 1405891 - RNA, 23 nt, Human
uuuuuaaauguauacuauaguac

SEQ ID NO: 1405892 - RNA, 12 nt, Human
uuuuuaagaaaa

SEQ ID NO: 1405893 - RNA, 23 nt, Human
uuuuuaagaaaaaggaugcacag

SEQ ID NO: 1405894 - RNA, 16 nt, Human
uuuuuaagugcugcau

SEQ ID NO: 1405895 - RNA, 17 nt, Human
uuuuuaagugcugcauu

SEQ ID NO: 1405896 - RNA, 18 nt, Human
uuuuuaagugcugcauuu

SEQ ID NO: 1405897 - RNA, 19 nt, Human
uuuuuaagugcugcauuua

SEQ ID NO: 1405898 - RNA, 22 nt, Human
uuuuuaagugcugcauuuaaaa

SEQ ID NO: 1405899 - RNA, 23 nt, Human
uuuuuaagugcugcauuuaaaag

SEQ ID NO: 1405900 - RNA, 13 nt, Human
uuuuucacauuuu

SEQ ID NO: 1405901 - RNA, 18 nt, Human
uuuuuaauguauaguaaa

SEQ ID NO: 1405902 - RNA, 19 nt, Human
uuuuuaauccgccaauauu

SEQ ID NO: 1405903 - RNA, 14 nt, Human
uuuuuaauaugcuu

SEQ ID NO: 1405904 - RNA, 14 nt, Human
uuuuuaauaauuua

SEQ ID NO: 1405905 - RNA, 16 nt, Human
uuuuuaauaaauuuca

SEQ ID NO: 1405906 - RNA, 13 nt, Human
uuuuuaaucuuua

SEQ ID NO: 1405907 - RNA, 16 nt, Human
uuuuucaugauaauga

SEQ ID NO: 1405908 - RNA, 23 nt, Human
uuuuucaucuucaguugucucug

SEQ ID NO: 1405909 - RNA, 20 nt, Human
uuuuucaucuucaguugucu

SEQ ID NO: 1405910 - RNA, 16 nt, Human
uuuuucaucuucaguu

SEQ ID NO: 1405911 - RNA, 15 nt, Human
uuuuucaucuucagu

SEQ ID NO: 1405912 - RNA, 16 nt, Human
uuuuucaguuguucuu

SEQ ID NO: 1405913 - RNA, 20 nt, Human
uuuuucaguuguucuuuuua

SEQ ID NO: 1405914 - RNA, 11 nt, Human
uuuuucaguug

SEQ ID NO: 1405915 - RNA, 18 nt, Human
uuuuucaguauuauaugu

SEQ ID NO: 1405916 - RNA, 17 nt, Human
uuuuucaguauuauaug

SEQ ID NO: 1405917 - RNA, 23 nt, Human
uuuuuccaacuacuaauagaaua

SEQ ID NO: 1405918 - RNA, 21 nt, Human
uuuuuccaacuacuaauagaa

SEQ ID NO: 1405919 - RNA, 11 nt, Human
uuuuuccaaca

SEQ ID NO: 1405920 - RNA, 22 nt, Human
uuuuucauuaaauaaauuugac

SEQ ID NO: 1405921 - RNA, 20 nt, Human
uuuuucauuaaauaaauuug

SEQ ID NO: 1405922 - RNA, 17 nt, Human
uuuguauaaaauaauuu

SEQ ID NO: 1405923 - RNA, 19 nt, Human
uuuguauaaaauaauuuuu

SEQ ID NO: 1405924 - RNA, 18 nt, Human
uuuguauaaaauaauuuu

SEQ ID NO: 1405925 - RNA, 21 nt, Human
uuugguccuucaaaggcuugu

SEQ ID NO: 1405926 - RNA, 15 nt, Human
uuuggucaacacuaa

SEQ ID NO: 1405927 - RNA, 13 nt, Human
uuugguauuguau

SEQ ID NO: 1405928 - RNA, 14 nt, Human
uuugguauuguauu

SEQ ID NO: 1405929 - RNA, 13 nt, Human
uuugugugucuua

SEQ ID NO: 1405930 - RNA, 16 nt, Human
uuuguguguauuugcu

SEQ ID NO: 1405931 - RNA, 14 nt, Human
uuugugugcucucc

SEQ ID NO: 1405932 - RNA, 16 nt, Human
uuugugugcucuccau

SEQ ID NO: 1405933 - RNA, 20 nt, Human
uuugugucucuuauggaugu

SEQ ID NO: 1405934 - RNA, 21 nt, Human
uuuguauuguuucaauugcau

SEQ ID NO: 1405935 - RNA, 19 nt, Human
uuuggucgaggaguaacaa

SEQ ID NO: 1405936 - RNA, 18 nt, Human
uuuggucgaggaguaaca

SEQ ID NO: 1405937 - RNA, 16 nt, Human
uuuggucgaggaguaa

SEQ ID NO: 1405938 - RNA, 17 nt, Human
uuugguccgucauaacc

SEQ ID NO: 1405939 - RNA, 16 nt, Human
uuuguauucucugagc

SEQ ID NO: 1405940 - RNA, 14 nt, Human
uuuguauucucuga

SEQ ID NO: 1405941 - RNA, 22 nt, Human
uuuggucgaggaguaacaauac

SEQ ID NO: 1405942 - RNA, 14 nt, Human
uuuguauuguauau

SEQ ID NO: 1405943 - RNA, 20 nt, Human
uuuguugacauucugaaugc

SEQ ID NO: 1405944 - RNA, 19 nt, Human
uuuguugacauucugaaug

SEQ ID NO: 1405945 - RNA, 18 nt, Human
uuuguugacauucugaau

SEQ ID NO: 1405946 - RNA, 15 nt, Human
uuuguuauuuugcaa

SEQ ID NO: 1405947 - RNA, 14 nt, Human
uuuguugcuguuuu

SEQ ID NO: 1405948 - RNA, 22 nt, Human
uuuguugcguuccuuucuuuuc

SEQ ID NO: 1405949 - RNA, 22 nt, Human
uuuguuaauuuagaaaacuuua

SEQ ID NO: 1405950 - RNA, 23 nt, Human
uuuguuaauuuagaaaacuuuaa

SEQ ID NO: 1405951 - RNA, 17 nt, Human
uuuguguguugucucuu

SEQ ID NO: 1405952 - RNA, 18 nt, Human
uuuguuauauaauuuaga

SEQ ID NO: 1405953 - RNA, 22 nt, Human
uuuguuaguaugaggcauuugu

SEQ ID NO: 1405954 - RNA, 13 nt, Human
uuuguugguuggu

SEQ ID NO: 1405955 - RNA, 22 nt, Human
uuuuaaaaucagcuauuuugug

SEQ ID NO: 1405956 - RNA, 14 nt, Human
uuuuaaaaucagcu

SEQ ID NO: 1405957 - RNA, 21 nt, Human
uuuuaaaauagcguucuugua

SEQ ID NO: 1405958 - RNA, 14 nt, Human
uuuuaaaauccacu

SEQ ID NO: 1405959 - RNA, 16 nt, Human
uuuuaaacuguacagu

SEQ ID NO: 1405960 - RNA, 15 nt, Human
uuuuaaacuguacag

SEQ ID NO: 1405961 - RNA, 14 nt, Human
uuuuaaacuguaca

SEQ ID NO: 1405962 - RNA, 13 nt, Human
uuuuaaacuguac

SEQ ID NO: 1405963 - RNA, 23 nt, Human
uuuuaaacauuaauagcagccuu

SEQ ID NO: 1405964 - RNA, 21 nt, Human
uuuuaaacaucaaucuuuaaa

SEQ ID NO: 1405965 - RNA, 18 nt, Human
uuuuaaacacauuaggaa

SEQ ID NO: 1405966 - RNA, 19 nt, Human
uuuuaaacagugagccuga

SEQ ID NO: 1405967 - RNA, 13 nt, Human
uuuuaaacaguga

SEQ ID NO: 1405968 - RNA, 13 nt, Human
uuuuaaacacauu

SEQ ID NO: 1405969 - RNA, 23 nt, Human
uuuuaaaauccacuuuaucuuga

SEQ ID NO: 1405970 - RNA, 18 nt, Human
uuugcacugauauaucau

SEQ ID NO: 1405971 - RNA, 21 nt, Human
uuugcaccuuucuaguugaaa

SEQ ID NO: 1405972 - RNA, 20 nt, Human
uuugcaccuuucuaguugaa

SEQ ID NO: 1405973 - RNA, 17 nt, Human
uuugcaccuuucuaguu

SEQ ID NO: 1405974 - RNA, 16 nt, Human
uuugcaccuuucuagu

SEQ ID NO: 1405975 - RNA, 14 nt, Human
uuugagugcucuga

SEQ ID NO: 1405976 - RNA, 13 nt, Human
uuugagugcucug

SEQ ID NO: 1405977 - RNA, 22 nt, Human
uuuccguaaaaaugauuucagu

SEQ ID NO: 1405978 - RNA, 15 nt, Human
uuucccuuugccuuc

SEQ ID NO: 1405979 - RNA, 20 nt, Human
uuucccuuguagcuccuccc

SEQ ID NO: 1405980 - RNA, 15 nt, Human
uuuccguuaaaauac

SEQ ID NO: 1405981 - RNA, 20 nt, Human
uuuccuaaauauauuuuaag

SEQ ID NO: 1405982 - RNA, 17 nt, Human
uuuccguuaaaauacca

SEQ ID NO: 1405983 - RNA, 18 nt, Human
uuucccuuguagcuccuc

SEQ ID NO: 1405984 - RNA, 17 nt, Human
uuucccuuguagcuccu

SEQ ID NO: 1405985 - RNA, 19 nt, Human
uuuccaccacagccagcac

SEQ ID NO: 1405986 - RNA, 15 nt, Human
uuuccacagaagcuc

SEQ ID NO: 1405987 - RNA, 22 nt, Human
uuuggaaaguacacucugcugu

SEQ ID NO: 1405988 - RNA, 21 nt, Human
uuuggaaaguacacucugcug

SEQ ID NO: 1405989 - RNA, 20 nt, Human
uuuggaaaguacacucugcu

SEQ ID NO: 1405990 - RNA, 15 nt, Human
uuuggaaaguacacu

SEQ ID NO: 1405991 - RNA, 13 nt, Human
uuuggaaaguaca

SEQ ID NO: 1405992 - RNA, 16 nt, Human
uuuggaaagacuggac

SEQ ID NO: 1405993 - RNA, 23 nt, Human
uuugcauuuaaaacagacacugg

SEQ ID NO: 1405994 - RNA, 16 nt, Human
uuuggacaguuuacca

SEQ ID NO: 1405995 - RNA, 13 nt, Human
uuuggacaguuua

SEQ ID NO: 1405996 - RNA, 21 nt, Human
uuugcauuuaaaacagacacu

SEQ ID NO: 1405997 - RNA, 19 nt, Human
uuugcauuuaaaacagaca

SEQ ID NO: 1405998 - RNA, 17 nt, Human
uuugcauuuaaaacaga

SEQ ID NO: 1405999 - RNA, 16 nt, Human
uuugcauuuaaaacag

SEQ ID NO: 1406000 - RNA, 19 nt, Human
uuugcauugaacacaaacu

SEQ ID NO: 1406001 - RNA, 22 nt, Human
uuugcauuaaauucacaaacuu

SEQ ID NO: 1406002 - RNA, 21 nt, Human
uuugcauuaaauucacaaacu

SEQ ID NO: 1406003 - RNA, 18 nt, Human
uuugcauuaaauucacaa

SEQ ID NO: 1406004 - RNA, 17 nt, Human
uuugcauuaaauucaca

SEQ ID NO: 1406005 - RNA, 22 nt, Human
uuugcauaacaauuccucuacu

SEQ ID NO: 1406006 - RNA, 20 nt, Human
uuugcauaacaauuccucua

SEQ ID NO: 1406007 - RNA, 14 nt, Human
uuugcaguaacugu

SEQ ID NO: 1406008 - RNA, 12 nt, Human
uuugcaguaacu

SEQ ID NO: 1406009 - RNA, 10 nt, Human
uuugcaguaa

SEQ ID NO: 1406010 - RNA, 9 nt, Human
uuugcagua

SEQ ID NO: 1406011 - RNA, 22 nt, Human
uuugcagguggccaaguuccuc

SEQ ID NO: 1406012 - RNA, 22 nt, Human
uuugcaggguccucuucugggc

SEQ ID NO: 1406013 - RNA, 18 nt, Human
uuugcauaacaauuccuc

SEQ ID NO: 1406014 - RNA, 17 nt, Human
uuugcauaacaauuccu

SEQ ID NO: 1406015 - RNA, 16 nt, Human
uuugcauaacaauucc

SEQ ID NO: 1406016 - RNA, 17 nt, Human
uuugcaguaacuguuuu

SEQ ID NO: 1406017 - RNA, 18 nt, Human
uuugcauaacguauaaaa

SEQ ID NO: 1406018 - RNA, 17 nt, Human
uuuuccuagcccucuca

SEQ ID NO: 1406019 - RNA, 14 nt, Human
uuuucccuuugccu

SEQ ID NO: 1406020 - RNA, 15 nt, Human
uuuucccuguacagu

SEQ ID NO: 1406021 - RNA, 22 nt, Human
uuuucccucuuuggcuccccug

SEQ ID NO: 1406022 - RNA, 20 nt, Human
uuuuccuaauaaaguucugu

SEQ ID NO: 1406023 - RNA, 13 nt, Human
uuuucuugucuau

SEQ ID NO: 1406024 - RNA, 20 nt, Human
uuuucuuuacaaaacaaacu

SEQ ID NO: 1406025 - RNA, 18 nt, Human
uuuucuuuaacugccgua

SEQ ID NO: 1406026 - RNA, 14 nt, Human
uuuucuuuaacugc

SEQ ID NO: 1406027 - RNA, 20 nt, Human
uuuucuugucuauaaagcau

SEQ ID NO: 1406028 - RNA, 19 nt, Human
uuuucuuuauaagaaagcc

SEQ ID NO: 1406029 - RNA, 13 nt, Human
uuuucuuuauaag

SEQ ID NO: 1406030 - RNA, 17 nt, Human
uuuugaaauuaaccucu

SEQ ID NO: 1406031 - RNA, 20 nt, Human
uuuugaaauuaugugacauu

SEQ ID NO: 1406032 - RNA, 16 nt, Human
uuuucccccuuugugc

SEQ ID NO: 1406033 - RNA, 14 nt, Human
uuuuccccagacuu

SEQ ID NO: 1406034 - RNA, 22 nt, Human
uuuucccauuuaucuaaauaug

SEQ ID NO: 1406035 - RNA, 20 nt, Human
uuuucccauuuaucuaaaua

SEQ ID NO: 1406036 - RNA, 23 nt, Human
uuuucaccuggaagcauuuguuu

SEQ ID NO: 1406037 - RNA, 19 nt, Human
uuuucaccagauuugcuaa

SEQ ID NO: 1406038 - RNA, 12 nt, Human
uuuucacauuuu

SEQ ID NO: 1406039 - RNA, 18 nt, Human
uuuucacauuagaagaca

SEQ ID NO: 1406040 - RNA, 16 nt, Human
uuuucacauuggaaac

SEQ ID NO: 1406041 - RNA, 22 nt, Human
uuuucaacagugaagacagaag

SEQ ID NO: 1406042 - RNA, 18 nt, Human
uuuucaacagugaagaca

SEQ ID NO: 1406043 - RNA, 20 nt, Human
uuuucaaacaaagaugccac

SEQ ID NO: 1406044 - RNA, 16 nt, Human
uuuucaaacaaagaug

SEQ ID NO: 1406045 - RNA, 14 nt, Human
uuuucaaaauggag

SEQ ID NO: 1406046 - RNA, 22 nt, Human
uuuucaaaaccagguccaauga

SEQ ID NO: 1406047 - RNA, 21 nt, Human
uuuucaaaauuguuacaaauu

SEQ ID NO: 1406048 - RNA, 21 nt, Human
uuuuauaauuuugugaagcaa

SEQ ID NO: 1406049 - RNA, 15 nt, Human
uuuuacuaauagaca

SEQ ID NO: 1406050 - RNA, 23 nt, Human
uuuuauaauuuugugaagcaaaa

SEQ ID NO: 1406051 - RNA, 16 nt, Human
uuuuacaauguaauua

SEQ ID NO: 1406052 - RNA, 22 nt, Human
uuuuacccuggccccucucccu

SEQ ID NO: 1406053 - RNA, 14 nt, Human
uuuuaccuuucaua

SEQ ID NO: 1406054 - RNA, 19 nt, Human
uuuuacguccaucucuugu

SEQ ID NO: 1406055 - RNA, 18 nt, Human
uuuuacaaguaacaaaaa

SEQ ID NO: 1406056 - RNA, 12 nt, Human
uuuuacaaguaa

SEQ ID NO: 1406057 - RNA, 14 nt, Human
uuuuacaaauguua

SEQ ID NO: 1406058 - RNA, 22 nt, Human
uuuuacaaauguuaaaaugugu

SEQ ID NO: 1406059 - RNA, 12 nt, Human
uuuuacaaaugu

SEQ ID NO: 1406060 - RNA, 23 nt, Human
uuuuacaauguaauuauuuaugu

SEQ ID NO: 1406061 - RNA, 17 nt, Human
uuuuacaaguaacaaaa

SEQ ID NO: 1406062 - RNA, 17 nt, Human
uuuuaaaguuaguaucu

SEQ ID NO: 1406063 - RNA, 12 nt, Human
uuuuacaaagcc

SEQ ID NO: 1406064 - RNA, 23 nt, Human
uuuuaaagaaaaaaauugaaaug

SEQ ID NO: 1406065 - RNA, 23 nt, Human
uuuuaaacuguguacauaacuga

SEQ ID NO: 1406066 - RNA, 20 nt, Human
uuuuaaacuguguacauaac

SEQ ID NO: 1406067 - RNA, 13 nt, Human
uuuuaaacugugu

SEQ ID NO: 1406068 - RNA, 20 nt, Human
uuuuaaacuguacagugucu

SEQ ID NO: 1406069 - RNA, 17 nt, Human
uuuuaaacuguacagug

SEQ ID NO: 1406070 - RNA, 21 nt, Human
uuuuaaaguaacccuacaaaa

SEQ ID NO: 1406071 - RNA, 19 nt, Human
uuuuauacucuuucuguau

SEQ ID NO: 1406072 - RNA, 18 nt, Human
uuuuauacucuuucugua

SEQ ID NO: 1406073 - RNA, 13 nt, Human
uuuuauacucuuu

SEQ ID NO: 1406074 - RNA, 13 nt, Human
uuuuauacauaaa

SEQ ID NO: 1406075 - RNA, 21 nt, Human
uuuuauacauaaacaagacca

SEQ ID NO: 1406076 - RNA, 18 nt, Human
uuuuauauuugaaauauu

SEQ ID NO: 1406077 - RNA, 13 nt, Human
uuuuauauuugaa

SEQ ID NO: 1406078 - RNA, 18 nt, Human
uuuuauacuuucccuacc

SEQ ID NO: 1406079 - RNA, 9 nt, Human
uuuuauaua

SEQ ID NO: 1406080 - RNA, 19 nt, Human
uuuuaugagaaagccuucu

SEQ ID NO: 1406081 - RNA, 20 nt, Human
uuuuaucugaguuacagaaa

SEQ ID NO: 1406082 - RNA, 23 nt, Human
uuuuaucugaauuuuuaaacaag

SEQ ID NO: 1406083 - RNA, 21 nt, Human
uuuuaucugaaaucaauuaaa

SEQ ID NO: 1406084 - RNA, 20 nt, Human
uuuuaucugaaaucaauuaa

SEQ ID NO: 1406085 - RNA, 19 nt, Human
uuuuaucugaaaucaauua

SEQ ID NO: 1406086 - RNA, 14 nt, Human
uuuuauuuugccaa

SEQ ID NO: 1406087 - RNA, 14 nt, Human
uuuucaaaagaaag

SEQ ID NO: 1406088 - RNA, 15 nt, Human
auaacaauuccucua

SEQ ID NO: 1406089 - RNA, 14 nt, Human
auaacaauuccucu

SEQ ID NO: 1406090 - RNA, 16 nt, Human
auaacaaugugcucuc

SEQ ID NO: 1406091 - RNA, 21 nt, Human
auaacaaugcuguauuuuaaa

SEQ ID NO: 1406092 - RNA, 20 nt, Human
auaacaaugcuguauuuuaa

SEQ ID NO: 1406093 - RNA, 19 nt, Human
auaacaaugcuguauuuua

SEQ ID NO: 1406094 - RNA, 17 nt, Human
auaacaaugcuguauuu

SEQ ID NO: 1406095 - RNA, 15 nt, Human
auaacaaugcuguau

SEQ ID NO: 1406096 - RNA, 14 nt, Human
auaacaaugaaagu

SEQ ID NO: 1406097 - RNA, 21 nt, Human
auaaauuugacuuuucuguaa

SEQ ID NO: 1406098 - RNA, 20 nt, Human
auaaauuugacuuuucugua

SEQ ID NO: 1406099 - RNA, 18 nt, Human
auaaauuugacuuuucug

SEQ ID NO: 1406100 - RNA, 12 nt, Human
auaaauuugacu

SEQ ID NO: 1406101 - RNA, 18 nt, Human
auaaauuucuauuuuuau

SEQ ID NO: 1406102 - RNA, 21 nt, Human
auaaagauuuuuuaauaauuu

SEQ ID NO: 1406103 - RNA, 17 nt, Human
auaaagauuuuuuaaua

SEQ ID NO: 1406104 - RNA, 16 nt, Human
auaaagauuuuuuaau

SEQ ID NO: 1406105 - RNA, 13 nt, Human
auaaagauuuuuu

SEQ ID NO: 1406106 - RNA, 18 nt, Human
auaaagauuuuuuaauaa

SEQ ID NO: 1406107 - RNA, 11 nt, Human
auaaagcaauu

SEQ ID NO: 1406108 - RNA, 16 nt, Human
auaaauuguauauuca

SEQ ID NO: 1406109 - RNA, 17 nt, Human
auaaauuguauauucac

SEQ ID NO: 1406110 - RNA, 18 nt, Human
auaaauuguauauucacu

SEQ ID NO: 1406111 - RNA, 19 nt, Human
auaaauuguauauucacuu

SEQ ID NO: 1406112 - RNA, 12 nt, Human
aguuugaauguu

SEQ ID NO: 1406113 - RNA, 14 nt, Human
aguuugaauguuaa

SEQ ID NO: 1406114 - RNA, 15 nt, Human
aguuugaauguuaaa

SEQ ID NO: 1406115 - RNA, 18 nt, Human
aguuugaaauaagcuauu

SEQ ID NO: 1406116 - RNA, 13 nt, Human
aguuugaaauaag

SEQ ID NO: 1406117 - RNA, 12 nt, Human
aguuugaaauaa

SEQ ID NO: 1406118 - RNA, 13 nt, Human
aguuucuugcuug

SEQ ID NO: 1406119 - RNA, 15 nt, Human
aguuguuagauuaag

SEQ ID NO: 1406120 - RNA, 20 nt, Human
aguuguuacauuuuuaagug

SEQ ID NO: 1406121 - RNA, 22 nt, Human
aguuguuacauuuuuaagugcu

SEQ ID NO: 1406122 - RNA, 16 nt, Human
aguuugaauguuaaau

SEQ ID NO: 1406123 - RNA, 21 nt, Human
aguuugaauguuaaauaaauu

SEQ ID NO: 1406124 - RNA, 17 nt, Human
aguuugauuaaauucuu

SEQ ID NO: 1406125 - RNA, 18 nt, Human
aguuugauuaaauucuug

SEQ ID NO: 1406126 - RNA, 20 nt, Human
aguuugauuaaauucuugca

SEQ ID NO: 1406127 - RNA, 22 nt, Human
aguuugauuaaauucuugcaaa

SEQ ID NO: 1406128 - RNA, 14 nt, Human
aguuuggauaugua

SEQ ID NO: 1406129 - RNA, 12 nt, Human
aguuuggaggaa

SEQ ID NO: 1406130 - RNA, 22 nt, Human
aguuuggagagagcagacuggc

SEQ ID NO: 1406131 - RNA, 15 nt, Human
aguuugcuuugcccu

SEQ ID NO: 1406132 - RNA, 22 nt, Human
aguuuggauauguaaaacauuu

SEQ ID NO: 1406133 - RNA, 17 nt, Human
aguuuggauauguaaaa

SEQ ID NO: 1406134 - RNA, 16 nt, Human
aguuuggauauguaaa

SEQ ID NO: 1406135 - RNA, 20 nt, Human
aguuuggauauguaaaacau

SEQ ID NO: 1406136 - RNA, 17 nt, Human
aguuugcaaaaaauguu

SEQ ID NO: 1406137 - RNA, 23 nt, Human
aguuugauuauucagugucacug

SEQ ID NO: 1406138 - RNA, 18 nt, Human
aguuugauuauucagugu

SEQ ID NO: 1406139 - RNA, 17 nt, Human
aguuugauuauucagug

SEQ ID NO: 1406140 - RNA, 14 nt, Human
aguuugauuauuca

SEQ ID NO: 1406141 - RNA, 23 nt, Human
aguuugauuaaauucuugcaaag

SEQ ID NO: 1406142 - RNA, 21 nt, Human
auaaaaagcuuccaugauucu

SEQ ID NO: 1406143 - RNA, 17 nt, Human
auaaaaagcuuccauga

SEQ ID NO: 1406144 - RNA, 11 nt, Human
auaaaaaggac

SEQ ID NO: 1406145 - RNA, 14 nt, Human
auaaaaaggacauc

SEQ ID NO: 1406146 - RNA, 13 nt, Human
auaaaacauuaau

SEQ ID NO: 1406147 - RNA, 19 nt, Human
auaaaaaggacaucagcaa

SEQ ID NO: 1406148 - RNA, 11 nt, Human
auaaggcuuca

SEQ ID NO: 1406149 - RNA, 14 nt, Human
auaauguuguuauu

SEQ ID NO: 1406150 - RNA, 19 nt, Human
auaauguaaacaauaucag

SEQ ID NO: 1406151 - RNA, 13 nt, Human
auaauguuucaaa

SEQ ID NO: 1406152 - RNA, 16 nt, Human
auaagguaaaaugcca

SEQ ID NO: 1406153 - RNA, 23 nt, Human
auaagggucccccacucuaaagc

SEQ ID NO: 1406154 - RNA, 17 nt, Human
auaaggugcucucuuuc

SEQ ID NO: 1406155 - RNA, 20 nt, Human
auaaggugcucucuuucugu

SEQ ID NO: 1406156 - RNA, 18 nt, Human
auaagguaaaaugccaug

SEQ ID NO: 1406157 - RNA, 13 nt, Human
auaauggucagag

SEQ ID NO: 1406158 - RNA, 19 nt, Human
auaauguuguuauuuaaag

SEQ ID NO: 1406159 - RNA, 18 nt, Human
auaauguuucaaacauau

SEQ ID NO: 1406160 - RNA, 14 nt, Human
auacaaugcugugc

SEQ ID NO: 1406161 - RNA, 17 nt, Human
auacaaugcugugcccu

SEQ ID NO: 1406162 - RNA, 22 nt, Human
auacacuuauuggaacucugcu

SEQ ID NO: 1406163 - RNA, 13 nt, Human
auaccccccucug

SEQ ID NO: 1406164 - RNA, 23 nt, Human
auacacuuuuucucuuuccauga

SEQ ID NO: 1406165 - RNA, 13 nt, Human
auacagaaaaguu

SEQ ID NO: 1406166 - RNA, 21 nt, Human
auaucauaauggggguaaagu

SEQ ID NO: 1406167 - RNA, 14 nt, Human
auaugcacuuauaa

SEQ ID NO: 1406168 - RNA, 13 nt, Human
auaugcacuuaua

SEQ ID NO: 1406169 - RNA, 19 nt, Human
auaugcuuaaaauaagcag

SEQ ID NO: 1406170 - RNA, 18 nt, Human
auaugcuuaaaauaagca

SEQ ID NO: 1406171 - RNA, 16 nt, Human
auaugcuuaaaauaag

SEQ ID NO: 1406172 - RNA, 13 nt, Human
auauggccacagu

SEQ ID NO: 1406173 - RNA, 13 nt, Human
auauuauguuaaa

SEQ ID NO: 1406174 - RNA, 13 nt, Human
auauucaauaaag

SEQ ID NO: 1406175 - RNA, 15 nt, Human
auauucaauaaagcu

SEQ ID NO: 1406176 - RNA, 20 nt, Human
auauucaauaaagcugcuga

SEQ ID NO: 1406177 - RNA, 16 nt, Human
auauuauguuaaaacu

SEQ ID NO: 1406178 - RNA, 14 nt, Human
auauuauguuaaaa

SEQ ID NO: 1406179 - RNA, 15 nt, Human
auauuauuuuauguu

SEQ ID NO: 1406180 - RNA, 22 nt, Human
auauuauuuuauguugcauaga

SEQ ID NO: 1406181 - RNA, 18 nt, Human
auauauuuuuuucugaaa

SEQ ID NO: 1406182 - RNA, 14 nt, Human
auacuuguaauuau

SEQ ID NO: 1406183 - RNA, 13 nt, Human
auacuuguaauua

SEQ ID NO: 1406184 - RNA, 22 nt, Human
auacuuggauuuaguuucagua

SEQ ID NO: 1406185 - RNA, 17 nt, Human
auacuuggauuuaguuu

SEQ ID NO: 1406186 - RNA, 16 nt, Human
auacuuggauuuaguu

SEQ ID NO: 1406187 - RNA, 13 nt, Human
auacuuggauuua

SEQ ID NO: 1406188 - RNA, 12 nt, Human
auacuuggauuu

SEQ ID NO: 1406189 - RNA, 23 nt, Human
auacuugaagggccagagccagg

SEQ ID NO: 1406190 - RNA, 22 nt, Human
auagaaaaguauguucuaaccu

SEQ ID NO: 1406191 - RNA, 22 nt, Human
auacuuugcagcacagcugaga

SEQ ID NO: 1406192 - RNA, 23 nt, Human
auacuuugaauguguuucacagu

SEQ ID NO: 1406193 - RNA, 22 nt, Human
auacuuugaauguguuucacag

SEQ ID NO: 1406194 - RNA, 20 nt, Human
auacuuugaauguguuucac

SEQ ID NO: 1406195 - RNA, 19 nt, Human
auacuuugaauguguuuca

SEQ ID NO: 1406196 - RNA, 17 nt, Human
auacuuugaauguguuu

SEQ ID NO: 1406197 - RNA, 15 nt, Human
auacuuugaaugugu

SEQ ID NO: 1406198 - RNA, 13 nt, Human
auacuuugaaugu

SEQ ID NO: 1406199 - RNA, 12 nt, Human
auacuuugaaug

SEQ ID NO: 1406200 - RNA, 23 nt, Human
auacuuugaaaggagaugucuug

SEQ ID NO: 1406201 - RNA, 22 nt, Human
auacuuugaaaggagaugucuu

SEQ ID NO: 1406202 - RNA, 24 nt, Human
auacuuucccuacccucuagagaa

SEQ ID NO: 1406203 - RNA, 23 nt, Human
auacuuucccuacccucuagaga

SEQ ID NO: 1406204 - RNA, 22 nt, Human
auacuuucccuacccucuagag

SEQ ID NO: 1406205 - RNA, 21 nt, Human
auacuuucccuacccucuaga

SEQ ID NO: 1406206 - RNA, 15 nt, Human
auacuuucccuaccc

SEQ ID NO: 1406207 - RNA, 21 nt, Human
auacuuguaauuauggaguca

SEQ ID NO: 1406208 - RNA, 16 nt, Human
auacuuguaauuaugg

SEQ ID NO: 1406209 - RNA, 15 nt, Human
auacuuguaauuaug

SEQ ID NO: 1406210 - RNA, 17 nt, Human
auacuuguaauuaugga

SEQ ID NO: 1406211 - RNA, 13 nt, Human
auacuuguggacu

SEQ ID NO: 1406212 - RNA, 14 nt, Human
auacuuguggacua

SEQ ID NO: 1406213 - RNA, 20 nt, Human
auacuuguggacuaaaagau

SEQ ID NO: 1406214 - RNA, 21 nt, Human
auacuuguggacuaaaagaua

SEQ ID NO: 1406215 - RNA, 16 nt, Human
auagcccuguccuggu

SEQ ID NO: 1406216 - RNA, 15 nt, Human
auagcccuguccugg

SEQ ID NO: 1406217 - RNA, 14 nt, Human
auagcccuguccug

SEQ ID NO: 1406218 - RNA, 15 nt, Human
auagcauuguaaaag

SEQ ID NO: 1406219 - RNA, 19 nt, Human
auagcagccuuucucucuu

SEQ ID NO: 1406220 - RNA, 13 nt, Human
auagcagccuuuc

SEQ ID NO: 1406221 - RNA, 14 nt, Human
auagcacaggcuaa

SEQ ID NO: 1406222 - RNA, 13 nt, Human
auagcaugcaucu

SEQ ID NO: 1406223 - RNA, 16 nt, Human
auagcagacaguguuu

SEQ ID NO: 1406224 - RNA, 17 nt, Human
auagcacaggcuaauuu

SEQ ID NO: 1406225 - RNA, 17 nt, Human
auagaaaugccaagcac

SEQ ID NO: 1406226 - RNA, 16 nt, Human
auagaaaugccaagca

SEQ ID NO: 1406227 - RNA, 12 nt, Human
auagaaaugcca

SEQ ID NO: 1406228 - RNA, 19 nt, Human
auagaaaugccaagcacuu

SEQ ID NO: 1406229 - RNA, 22 nt, Human
auagaaauaaaggaugugauug

SEQ ID NO: 1406230 - RNA, 12 nt, Human
auagaaagcuau

SEQ ID NO: 1406231 - RNA, 15 nt, Human
auauacagcucagaa

SEQ ID NO: 1406232 - RNA, 21 nt, Human
auaguaacuucuuauggaauu

SEQ ID NO: 1406233 - RNA, 19 nt, Human
auaguaacuucuuauggaa

SEQ ID NO: 1406234 - RNA, 13 nt, Human
auaguaaaucacg

SEQ ID NO: 1406235 - RNA, 19 nt, Human
auaguaaaucacgcuuuuu

SEQ ID NO: 1406236 - RNA, 18 nt, Human
auagcccuguccuggugg

SEQ ID NO: 1406237 - RNA, 23 nt, Human
auagcccuguccuggugguauuu

SEQ ID NO: 1406238 - RNA, 23 nt, Human
auagccucugucuggcaaugcca

SEQ ID NO: 1406239 - RNA, 16 nt, Human
auagccucugucuggc

SEQ ID NO: 1406240 - RNA, 15 nt, Human
auagccucugucugg

SEQ ID NO: 1406241 - RNA, 24 nt, Human
auagguuuggacaaaauggaauac

SEQ ID NO: 1406242 - RNA, 17 nt, Human
auauaaucaucaaguaa

SEQ ID NO: 1406243 - RNA, 14 nt, Human
auauaaucauuauu

SEQ ID NO: 1406244 - RNA, 21 nt, Human
auauaauaaauguacauuaau

SEQ ID NO: 1406245 - RNA, 23 nt, Human
auaguagaacgcuaucugggaag

SEQ ID NO: 1406246 - RNA, 17 nt, Human
auaguaccaaucauuuu

SEQ ID NO: 1406247 - RNA, 20 nt, Human
auaguacaugauaaaugaua

SEQ ID NO: 1406248 - RNA, 20 nt, Human
aguucagaguccuuaaaaug

SEQ ID NO: 1406249 - RNA, 21 nt, Human
aguucagcauccgcaggugcu

SEQ ID NO: 1406250 - RNA, 21 nt, Human
aguucagcgcugucaggauug

SEQ ID NO: 1406251 - RNA, 22 nt, Human
aguugugaguuuaccuuguaua

SEQ ID NO: 1406252 - RNA, 17 nt, Human
aguugucucugaugcag

SEQ ID NO: 1406253 - RNA, 22 nt, Human
aguugucucugaugcagcuuau

SEQ ID NO: 1406254 - RNA, 16 nt, Human
aguugucucugaugca

SEQ ID NO: 1406255 - RNA, 13 nt, Human
aguugucucugau

SEQ ID NO: 1406256 - RNA, 12 nt, Human
aguugucucuga

SEQ ID NO: 1406257 - RNA, 11 nt, Human
aguugucucug

SEQ ID NO: 1406258 - RNA, 20 nt, Human
aguugucccgauuguaacuc

SEQ ID NO: 1406259 - RNA, 19 nt, Human
aguugucccgauuguaacu

SEQ ID NO: 1406260 - RNA, 13 nt, Human
aguugaggccacu

SEQ ID NO: 1406261 - RNA, 11 nt, Human
aguugaggcca

SEQ ID NO: 1406262 - RNA, 15 nt, Human
aguugaggacuucuu

SEQ ID NO: 1406263 - RNA, 16 nt, Human
aguugaggacuucuug

SEQ ID NO: 1406264 - RNA, 23 nt, Human
aguugauaaagauuuuuuaauaa

SEQ ID NO: 1406265 - RNA, 21 nt, Human
aguugauaaagauuuuuuaau

SEQ ID NO: 1406266 - RNA, 17 nt, Human
aguugauaaagauuuuu

SEQ ID NO: 1406267 - RNA, 16 nt, Human
aguugauacuacaguu

SEQ ID NO: 1406268 - RNA, 21 nt, Human
aguugaauuuuuuuuaacauu

SEQ ID NO: 1406269 - RNA, 18 nt, Human
aguugaauuuuuuuuaac

SEQ ID NO: 1406270 - RNA, 13 nt, Human
aguugaauuuuuu

SEQ ID NO: 1406271 - RNA, 22 nt, Human
aguugaauuuuuuuuaacauuc

SEQ ID NO: 1406272 - RNA, 23 nt, Human
aguugaauuuuuuuuaacauucc

SEQ ID NO: 1406273 - RNA, 15 nt, Human
aguugacuuauagua

SEQ ID NO: 1406274 - RNA, 17 nt, Human
aguugagacaagaaaau

SEQ ID NO: 1406275 - RNA, 18 nt, Human
aguugagauaguuuucau

SEQ ID NO: 1406276 - RNA, 14 nt, Human
aguugagacaagaa

SEQ ID NO: 1406277 - RNA, 17 nt, Human
aguugacuuauaguaca

SEQ ID NO: 1406278 - RNA, 18 nt, Human
aguugacuuauaguacau

SEQ ID NO: 1406279 - RNA, 21 nt, Human
aguugacuuauaguacaugau

SEQ ID NO: 1406280 - RNA, 18 nt, Human
agugggaaaaauguagga

SEQ ID NO: 1406281 - RNA, 17 nt, Human
agugggaaaaauguagg

SEQ ID NO: 1406282 - RNA, 14 nt, Human
agugggaaaaaugu

SEQ ID NO: 1406283 - RNA, 22 nt, Human
agugggaagcccauccugacca

SEQ ID NO: 1406284 - RNA, 21 nt, Human
agugggaagcccauccugacc

SEQ ID NO: 1406285 - RNA, 17 nt, Human
agugggaagcccauccu

SEQ ID NO: 1406286 - RNA, 12 nt, Human
agugggaagccc

SEQ ID NO: 1406287 - RNA, 19 nt, Human
agugggaaaaauguaggag

SEQ ID NO: 1406288 - RNA, 15 nt, Human
agugucaggcacugg

SEQ ID NO: 1406289 - RNA, 14 nt, Human
agugucaggcacug

SEQ ID NO: 1406290 - RNA, 14 nt, Human
agugucaggaggaa

SEQ ID NO: 1406291 - RNA, 16 nt, Human
agugucacucaaggcg

SEQ ID NO: 1406292 - RNA, 18 nt, Human
agugucauuucucaucca

SEQ ID NO: 1406293 - RNA, 22 nt, Human
aguguccuuggcaggcugauuu

SEQ ID NO: 1406294 - RNA, 20 nt, Human
agugucauuucucauccaca

SEQ ID NO: 1406295 - RNA, 14 nt, Human
agugggcaaaagcu

SEQ ID NO: 1406296 - RNA, 24 nt, Human
agugggcaaaagcuuacaaauacu

SEQ ID NO: 1406297 - RNA, 22 nt, Human
agugggaggguaccagcagaaa

SEQ ID NO: 1406298 - RNA, 16 nt, Human
agugauccuuacaagu

SEQ ID NO: 1406299 - RNA, 17 nt, Human
agugaucugcccgccuc

SEQ ID NO: 1406300 - RNA, 15 nt, Human
agugcuaauuuugaa

SEQ ID NO: 1406301 - RNA, 15 nt, Human
agugcuaagugugaa

SEQ ID NO: 1406302 - RNA, 16 nt, Human
agugcuaagugugaac

SEQ ID NO: 1406303 - RNA, 17 nt, Human
agugcuaagugugaacu

SEQ ID NO: 1406304 - RNA, 18 nt, Human
agugcuaagugugaacug

SEQ ID NO: 1406305 - RNA, 15 nt, Human
agugcugaacagugg

SEQ ID NO: 1406306 - RNA, 14 nt, Human
agugcugaacagug

SEQ ID NO: 1406307 - RNA, 17 nt, Human
agugcucuuuucuccuc

SEQ ID NO: 1406308 - RNA, 14 nt, Human
agugcucuuuucuc

SEQ ID NO: 1406309 - RNA, 21 nt, Human
agugcucugaucccucuacag

SEQ ID NO: 1406310 - RNA, 17 nt, Human
agugcucugaucccucu

SEQ ID NO: 1406311 - RNA, 16 nt, Human
agugcucugaucccuc

SEQ ID NO: 1406312 - RNA, 11 nt, Human
agugcucugau

SEQ ID NO: 1406313 - RNA, 22 nt, Human
agugcucgcuguugcugaauag

SEQ ID NO: 1406314 - RNA, 23 nt, Human
agugcucgcuguugcugaauagg

SEQ ID NO: 1406315 - RNA, 18 nt, Human
agugcuaauuuugaaaaa

SEQ ID NO: 1406316 - RNA, 20 nt, Human
agugcuaauuuugaaaaacu

SEQ ID NO: 1406317 - RNA, 19 nt, Human
agugcuaagugugaacugg

SEQ ID NO: 1406318 - RNA, 22 nt, Human
agugcuaagugugaacuggacc

SEQ ID NO: 1406319 - RNA, 15 nt, Human
agugcucgcuguugc

SEQ ID NO: 1406320 - RNA, 16 nt, Human
agugcucgcuguugcu

SEQ ID NO: 1406321 - RNA, 17 nt, Human
agugcucgcuguugcug

SEQ ID NO: 1406322 - RNA, 18 nt, Human
agugcucgcuguugcuga

SEQ ID NO: 1406323 - RNA, 19 nt, Human
agugcucgcuguugcugaa

SEQ ID NO: 1406324 - RNA, 20 nt, Human
agugcucgcuguugcugaau

SEQ ID NO: 1406325 - RNA, 23 nt, Human
aguacuuagcuaguuuuauucuu

SEQ ID NO: 1406326 - RNA, 16 nt, Human
aguacugggauuacag

SEQ ID NO: 1406327 - RNA, 20 nt, Human
aguacugggauuacaggcgu

SEQ ID NO: 1406328 - RNA, 20 nt, Human
aguacuggcugauggaguaa

SEQ ID NO: 1406329 - RNA, 16 nt, Human
aguacguugugcauuu

SEQ ID NO: 1406330 - RNA, 17 nt, Human
aguacguugugcauuug

SEQ ID NO: 1406331 - RNA, 18 nt, Human
aguacguugugcauuugg

SEQ ID NO: 1406332 - RNA, 15 nt, Human
aguaacauuugcugu

SEQ ID NO: 1406333 - RNA, 17 nt, Human
aguaacauuugcuguuu

SEQ ID NO: 1406334 - RNA, 17 nt, Human
aguaacacuaauauauu

SEQ ID NO: 1406335 - RNA, 23 nt, Human
aguaacacuaauauauuuaaaaa

SEQ ID NO: 1406336 - RNA, 16 nt, Human
aguaacacuaauauau

SEQ ID NO: 1406337 - RNA, 13 nt, Human
aguaacacuaaua

SEQ ID NO: 1406338 - RNA, 12 nt, Human
aguaacacuaau

SEQ ID NO: 1406339 - RNA, 19 nt, Human
aguaacaauacaaauggau

SEQ ID NO: 1406340 - RNA, 13 nt, Human
aguaacaaaaaua

SEQ ID NO: 1406341 - RNA, 15 nt, Human
aguaacaaaaauaaa

SEQ ID NO: 1406342 - RNA, 12 nt, Human
aguaacaaaaau

SEQ ID NO: 1406343 - RNA, 14 nt, Human
aguaagagguguua

SEQ ID NO: 1406344 - RNA, 15 nt, Human
aguacguugugcauu

SEQ ID NO: 1406345 - RNA, 15 nt, Human
aguaaaucuuuuaca

SEQ ID NO: 1406346 - RNA, 20 nt, Human
aguaacaauacaaauggauu

SEQ ID NO: 1406347 - RNA, 20 nt, Human
aguaaaugugauucaccucu

SEQ ID NO: 1406348 - RNA, 18 nt, Human
aguaaaugggggugcauu

SEQ ID NO: 1406349 - RNA, 19 nt, Human
aguaaaucacgcuuuuuga

SEQ ID NO: 1406350 - RNA, 20 nt, Human
aguaaaucacgcuuuuugaa

SEQ ID NO: 1406351 - RNA, 16 nt, Human
aggucuguucuuucca

SEQ ID NO: 1406352 - RNA, 13 nt, Human
aggucuguucuuu

SEQ ID NO: 1406353 - RNA, 15 nt, Human
aggucuguucuuucc

SEQ ID NO: 1406354 - RNA, 11 nt, Human
agucacacagu

SEQ ID NO: 1406355 - RNA, 18 nt, Human
agucaaugacaugaauuu

SEQ ID NO: 1406356 - RNA, 15 nt, Human
agucaaugacaugaa

SEQ ID NO: 1406357 - RNA, 18 nt, Human
agucaaucaagucuguuu

SEQ ID NO: 1406358 - RNA, 12 nt, Human
agucaaucaagu

SEQ ID NO: 1406359 - RNA, 24 nt, Human
agucaaucaagucuguuuacugca

SEQ ID NO: 1406360 - RNA, 17 nt, Human
agucaaaacuacaaauc

SEQ ID NO: 1406361 - RNA, 14 nt, Human
agucaaaaagaacc

SEQ ID NO: 1406362 - RNA, 12 nt, Human
agucaaaaagaa

SEQ ID NO: 1406363 - RNA, 22 nt, Human
aguauuuuuuguauaauuggau

SEQ ID NO: 1406364 - RNA, 19 nt, Human
agucaaaacacuuguaauu

SEQ ID NO: 1406365 - RNA, 15 nt, Human
agucaaaaauuaaac

SEQ ID NO: 1406366 - RNA, 14 nt, Human
aguauccacuuugc

SEQ ID NO: 1406367 - RNA, 14 nt, Human
aguacuuguaguuc

SEQ ID NO: 1406368 - RNA, 17 nt, Human
aguacuuguaguuccac

SEQ ID NO: 1406369 - RNA, 13 nt, Human
aguacuuguaguu

SEQ ID NO: 1406370 - RNA, 23 nt, Human
aguacuugggagaccuguaauca

SEQ ID NO: 1406371 - RNA, 20 nt, Human
aguaugaggcauuuguuuga

SEQ ID NO: 1406372 - RNA, 21 nt, Human
aguaugaggcauuuguuugaa

SEQ ID NO: 1406373 - RNA, 20 nt, Human
aguauuuuuuguauaauugg

SEQ ID NO: 1406374 - RNA, 19 nt, Human
aguauuuuuuguauaauug

SEQ ID NO: 1406375 - RNA, 13 nt, Human
aguauuuuuugua

SEQ ID NO: 1406376 - RNA, 21 nt, Human
aguauuuuuucaguauuauau

SEQ ID NO: 1406377 - RNA, 16 nt, Human
aguauuuuuucaguau

SEQ ID NO: 1406378 - RNA, 19 nt, Human
aguauuuuuauauuuaaau

SEQ ID NO: 1406379 - RNA, 21 nt, Human
aguauuuuuauauuuaaaugu

SEQ ID NO: 1406380 - RNA, 14 nt, Human
aguauuuuguuuca

SEQ ID NO: 1406381 - RNA, 23 nt, Human
aguaugaggcauuuguuugaacu

SEQ ID NO: 1406382 - RNA, 17 nt, Human
aguauuuuguuucagug

SEQ ID NO: 1406383 - RNA, 22 nt, Human
agucauuuuuacaauguaauua

SEQ ID NO: 1406384 - RNA, 14 nt, Human
agucauuuuuacaa

SEQ ID NO: 1406385 - RNA, 19 nt, Human
agucauguuuaucugcuua

SEQ ID NO: 1406386 - RNA, 14 nt, Human
agucauguuuaucu

SEQ ID NO: 1406387 - RNA, 12 nt, Human
agucaugugacc

SEQ ID NO: 1406388 - RNA, 20 nt, Human
aguccugaucagagccgugg

SEQ ID NO: 1406389 - RNA, 14 nt, Human
aguccugaaggaca

SEQ ID NO: 1406390 - RNA, 14 nt, Human
aguccaagaaucca

SEQ ID NO: 1406391 - RNA, 21 nt, Human
agucauuuuuacaauguaauu

SEQ ID NO: 1406392 - RNA, 15 nt, Human
agugacuaauggcau

SEQ ID NO: 1406393 - RNA, 15 nt, Human
agugacccuggcucc

SEQ ID NO: 1406394 - RNA, 17 nt, Human
agucuguggaucagaga

SEQ ID NO: 1406395 - RNA, 14 nt, Human
agucuguggaucag

SEQ ID NO: 1406396 - RNA, 20 nt, Human
agucugugccacguguuugu

SEQ ID NO: 1406397 - RNA, 20 nt, Human
agucugagguccugagcacu

SEQ ID NO: 1406398 - RNA, 22 nt, Human
agucugagguccugagcacugc

SEQ ID NO: 1406399 - RNA, 19 nt, Human
agucugagguccugagcac

SEQ ID NO: 1406400 - RNA, 18 nt, Human
agucugagguccugagca

SEQ ID NO: 1406401 - RNA, 17 nt, Human
agucugagguccugagc

SEQ ID NO: 1406402 - RNA, 16 nt, Human
agucugagguccugag

SEQ ID NO: 1406403 - RNA, 15 nt, Human
agucugagguccuga

SEQ ID NO: 1406404 - RNA, 14 nt, Human
agucugagguccug

SEQ ID NO: 1406405 - RNA, 23 nt, Human
agucugagagaggccauucuuuc

SEQ ID NO: 1406406 - RNA, 16 nt, Human
agucugaauuuuuaaa

SEQ ID NO: 1406407 - RNA, 16 nt, Human
agucugagagaggcca

SEQ ID NO: 1406408 - RNA, 23 nt, Human
agugaauucccucacucgucucc

SEQ ID NO: 1406409 - RNA, 14 nt, Human
agugaauucccuca

SEQ ID NO: 1406410 - RNA, 19 nt, Human
agugaaugcugggacucag

SEQ ID NO: 1406411 - RNA, 17 nt, Human
agucuguuuacugcaag

SEQ ID NO: 1406412 - RNA, 16 nt, Human
agucuguugauuaaag

SEQ ID NO: 1406413 - RNA, 14 nt, Human
agugaauuugccug

SEQ ID NO: 1406414 - RNA, 17 nt, Human
agugaauucccucacuc

SEQ ID NO: 1406415 - RNA, 16 nt, Human
agugaauucccucacu

SEQ ID NO: 1406416 - RNA, 15 nt, Human
agugaauucccucac

SEQ ID NO: 1406417 - RNA, 14 nt, Human
agugacccugcucu

SEQ ID NO: 1406418 - RNA, 16 nt, Human
agugacccuggcuccu

SEQ ID NO: 1406419 - RNA, 17 nt, Human
agugacccugcucucac

SEQ ID NO: 1406420 - RNA, 19 nt, Human
augaaaacagaaugucucu

SEQ ID NO: 1406421 - RNA, 15 nt, Human
augaaaacagaaugu

SEQ ID NO: 1406422 - RNA, 16 nt, Human
augaaaacacauuuuu

SEQ ID NO: 1406423 - RNA, 14 nt, Human
augaaaacacauuu

SEQ ID NO: 1406424 - RNA, 15 nt, Human
augaaaacacauuuu

SEQ ID NO: 1406425 - RNA, 22 nt, Human
augagggguuccuccccuccag

SEQ ID NO: 1406426 - RNA, 17 nt, Human
augagggguuccucccc

SEQ ID NO: 1406427 - RNA, 22 nt, Human
augagggcagcagccagcccug

SEQ ID NO: 1406428 - RNA, 23 nt, Human
augagggcagcagccagcccugc

SEQ ID NO: 1406429 - RNA, 20 nt, Human
augagggcagcagccagccc

SEQ ID NO: 1406430 - RNA, 19 nt, Human
augagggcagcagccagcc

SEQ ID NO: 1406431 - RNA, 18 nt, Human
augagggcagcagccagc

SEQ ID NO: 1406432 - RNA, 17 nt, Human
augagggcagcagccag

SEQ ID NO: 1406433 - RNA, 16 nt, Human
augagggcagcagcca

SEQ ID NO: 1406434 - RNA, 15 nt, Human
augagggcagcagcc

SEQ ID NO: 1406435 - RNA, 14 nt, Human
augagggcagcagc

SEQ ID NO: 1406436 - RNA, 13 nt, Human
augagggcagcag

SEQ ID NO: 1406437 - RNA, 21 nt, Human
augacuguuuuucggacaguu

SEQ ID NO: 1406438 - RNA, 22 nt, Human
augacuguuuuucggacaguuu

SEQ ID NO: 1406439 - RNA, 15 nt, Human
augagggaaaagaaa

SEQ ID NO: 1406440 - RNA, 20 nt, Human
augagggguuccuccccucc

SEQ ID NO: 1406441 - RNA, 19 nt, Human
augacuguuuuucggacag

SEQ ID NO: 1406442 - RNA, 21 nt, Human
augacugcuugcccuaagcag

SEQ ID NO: 1406443 - RNA, 17 nt, Human
augacugcuugcccuaa

SEQ ID NO: 1406444 - RNA, 22 nt, Human
augacugcuugcccuaagcaga

SEQ ID NO: 1406445 - RNA, 13 nt, Human
augacugcuugcc

SEQ ID NO: 1406446 - RNA, 12 nt, Human
augacugcuugc

SEQ ID NO: 1406447 - RNA, 21 nt, Human
augacugccaagacugcugug

SEQ ID NO: 1406448 - RNA, 16 nt, Human
augacugccaagacug

SEQ ID NO: 1406449 - RNA, 15 nt, Human
augacugccaagacu

SEQ ID NO: 1406450 - RNA, 13 nt, Human
augacugaauggg

SEQ ID NO: 1406451 - RNA, 13 nt, Human
augacugcacaug

SEQ ID NO: 1406452 - RNA, 13 nt, Human
augaggcauuugu

SEQ ID NO: 1406453 - RNA, 14 nt, Human
augaggcauuuguu

SEQ ID NO: 1406454 - RNA, 21 nt, Human
augaggcauuuguuugaacug

SEQ ID NO: 1406455 - RNA, 22 nt, Human
augaggcauuuguuugaacuga

SEQ ID NO: 1406456 - RNA, 13 nt, Human
augaaaaugucuu

SEQ ID NO: 1406457 - RNA, 14 nt, Human
augaaaauguccau

SEQ ID NO: 1406458 - RNA, 17 nt, Human
augaaaacagaaugucu

SEQ ID NO: 1406459 - RNA, 15 nt, Human
augaaaaugucuugu

SEQ ID NO: 1406460 - RNA, 12 nt, Human
augaaguauuuu

SEQ ID NO: 1406461 - RNA, 14 nt, Human
augaaaaugucuug

SEQ ID NO: 1406462 - RNA, 23 nt, Human
augaaguccaagcauuuagaugu

SEQ ID NO: 1406463 - RNA, 20 nt, Human
augaaguccaagcauuuaga

SEQ ID NO: 1406464 - RNA, 15 nt, Human
augaaguuguaggua

SEQ ID NO: 1406465 - RNA, 19 nt, Human
augaccacuuuuuagaaag

SEQ ID NO: 1406466 - RNA, 13 nt, Human
augaccaguaaag

SEQ ID NO: 1406467 - RNA, 21 nt, Human
aucuucuaaacccaauccaaa

SEQ ID NO: 1406468 - RNA, 13 nt, Human
aucuucuaaaugg

SEQ ID NO: 1406469 - RNA, 22 nt, Human
aucuggggagcaggcagccagc

SEQ ID NO: 1406470 - RNA, 23 nt, Human
aucuggggagcaggcagccagca

SEQ ID NO: 1406471 - RNA, 18 nt, Human
aucugggggccucuucug

SEQ ID NO: 1406472 - RNA, 20 nt, Human
aucuuauucauuuucucuaa

SEQ ID NO: 1406473 - RNA, 18 nt, Human
aucuuauucauuuucucu

SEQ ID NO: 1406474 - RNA, 13 nt, Human
aucuuauucauuu

SEQ ID NO: 1406475 - RNA, 13 nt, Human
aucuuauuuagga

SEQ ID NO: 1406476 - RNA, 18 nt, Human
aucucugaagccacaaau

SEQ ID NO: 1406477 - RNA, 19 nt, Human
aucucugaagccacaaaua

SEQ ID NO: 1406478 - RNA, 14 nt, Human
aucuggagagaaca

SEQ ID NO: 1406479 - RNA, 16 nt, Human
aucuggagagaacagg

SEQ ID NO: 1406480 - RNA, 21 nt, Human
aucuggggagcaggcagccag

SEQ ID NO: 1406481 - RNA, 19 nt, Human
aucuggggagcaggcagcc

SEQ ID NO: 1406482 - RNA, 18 nt, Human
aucuggggagcaggcagc

SEQ ID NO: 1406483 - RNA, 16 nt, Human
aucuggggagcaggca

SEQ ID NO: 1406484 - RNA, 16 nt, Human
aucuggcaacaucuuu

SEQ ID NO: 1406485 - RNA, 15 nt, Human
aucuggauuccagag

SEQ ID NO: 1406486 - RNA, 20 nt, Human
aucucuccacuuucagcugu

SEQ ID NO: 1406487 - RNA, 21 nt, Human
aucucuccacuuucagcuguc

SEQ ID NO: 1406488 - RNA, 19 nt, Human
aucucuccacuuucagcug

SEQ ID NO: 1406489 - RNA, 18 nt, Human
aucucuccacuuucagcu

SEQ ID NO: 1406490 - RNA, 17 nt, Human
aucucuccacuuucagc

SEQ ID NO: 1406491 - RNA, 20 nt, Human
aucuccugccuuccuccugg

SEQ ID NO: 1406492 - RNA, 17 nt, Human
aucuccugccuuccucc

SEQ ID NO: 1406493 - RNA, 16 nt, Human
aucuccugccuuccuc

SEQ ID NO: 1406494 - RNA, 12 nt, Human
aucuccugaaaa

SEQ ID NO: 1406495 - RNA, 22 nt, Human
aucuauuuuggauuguauauug

SEQ ID NO: 1406496 - RNA, 14 nt, Human
aucuauuuuggauu

SEQ ID NO: 1406497 - RNA, 15 nt, Human
aucuccguggcuuug

SEQ ID NO: 1406498 - RNA, 20 nt, Human
aucuccgucaacucauauuu

SEQ ID NO: 1406499 - RNA, 19 nt, Human
aucuauuucauguuuuuga

SEQ ID NO: 1406500 - RNA, 14 nt, Human
aucuauauuuuaca

SEQ ID NO: 1406501 - RNA, 15 nt, Human
aucuauauuuaacaa

SEQ ID NO: 1406502 - RNA, 21 nt, Human
aucuauaggaagauugaaccu

SEQ ID NO: 1406503 - RNA, 16 nt, Human
aucuauagaacugaau

SEQ ID NO: 1406504 - RNA, 17 nt, Human
aucuauagaaagcuaua

SEQ ID NO: 1406505 - RNA, 22 nt, Human
aucuaguuauuuacaggaacuu

SEQ ID NO: 1406506 - RNA, 15 nt, Human
aucuauaaacuauaa

SEQ ID NO: 1406507 - RNA, 13 nt, Human
aucuauaauuuac

SEQ ID NO: 1406508 - RNA, 11 nt, Human
aucuauaauuu

SEQ ID NO: 1406509 - RNA, 23 nt, Human
aucuauaaggugcucucuuucug

SEQ ID NO: 1406510 - RNA, 23 nt, Human
aucuauaauuuaccuaagauuac

SEQ ID NO: 1406511 - RNA, 16 nt, Human
aucuauaauuuaccua

SEQ ID NO: 1406512 - RNA, 16 nt, Human
aucuauagaaagcuau

SEQ ID NO: 1406513 - RNA, 21 nt, Human
aucaugaauuaguuuuauaug

SEQ ID NO: 1406514 - RNA, 17 nt, Human
aucaugaauuaguuuua

SEQ ID NO: 1406515 - RNA, 14 nt, Human
aucaugugaaauca

SEQ ID NO: 1406516 - RNA, 12 nt, Human
aucaugugaaau

SEQ ID NO: 1406517 - RNA, 22 nt, Human
aucaccucagauggcagcuuuu

SEQ ID NO: 1406518 - RNA, 19 nt, Human
aucaccucagauggcagcu

SEQ ID NO: 1406519 - RNA, 16 nt, Human
aucaccucagauggca

SEQ ID NO: 1406520 - RNA, 15 nt, Human
aucaccucagauggc

SEQ ID NO: 1406521 - RNA, 22 nt, Human
aucaccuauuuccauucaacaa

SEQ ID NO: 1406522 - RNA, 15 nt, Human
aucaccuauuuccau

SEQ ID NO: 1406523 - RNA, 14 nt, Human
aucaccuauuucca

SEQ ID NO: 1406524 - RNA, 23 nt, Human
aucaccuagcugaauguuuuucu

SEQ ID NO: 1406525 - RNA, 21 nt, Human
aucaccuagcugaauguuuuu

SEQ ID NO: 1406526 - RNA, 20 nt, Human
aucaccuagcugaauguuuu

SEQ ID NO: 1406527 - RNA, 16 nt, Human
aucaccuagcugaaug

SEQ ID NO: 1406528 - RNA, 19 nt, Human
aucaccuacucacacaggc

SEQ ID NO: 1406529 - RNA, 13 nt, Human
aucagcuuauugu

SEQ ID NO: 1406530 - RNA, 23 nt, Human
aucaccucagauggcagcuuuua

SEQ ID NO: 1406531 - RNA, 14 nt, Human
aucaggaagagaag

SEQ ID NO: 1406532 - RNA, 17 nt, Human
aucaggaagagaaggag

SEQ ID NO: 1406533 - RNA, 19 nt, Human
aucaggaagagaaggagca

SEQ ID NO: 1406534 - RNA, 16 nt, Human
aucacagcccagcccg

SEQ ID NO: 1406535 - RNA, 15 nt, Human
aucacagcccagccc

SEQ ID NO: 1406536 - RNA, 13 nt, Human
aucacagcccagc

SEQ ID NO: 1406537 - RNA, 20 nt, Human
aucacacacauugcugugaa

SEQ ID NO: 1406538 - RNA, 13 nt, Human
aucacacacauug

SEQ ID NO: 1406539 - RNA, 22 nt, Human
aucaaauauauucagccuggcu

SEQ ID NO: 1406540 - RNA, 22 nt, Human
aucacaugaauuauuacagugu

SEQ ID NO: 1406541 - RNA, 20 nt, Human
aucacaugaauuauuacagu

SEQ ID NO: 1406542 - RNA, 23 nt, Human
aucaccacaaacuguaauacaau

SEQ ID NO: 1406543 - RNA, 22 nt, Human
aucaccgugggcucccugacug

SEQ ID NO: 1406544 - RNA, 20 nt, Human
aucaccgugggcucccugac

SEQ ID NO: 1406545 - RNA, 19 nt, Human
aucaccgugggcucccuga

SEQ ID NO: 1406546 - RNA, 23 nt, Human
aucacccagacauaaaggaaaag

SEQ ID NO: 1406547 - RNA, 15 nt, Human
aucacccagacauaa

SEQ ID NO: 1406548 - RNA, 16 nt, Human
aucacccaacgcucca

SEQ ID NO: 1406549 - RNA, 16 nt, Human
aucaccgacugaaaau

SEQ ID NO: 1406550 - RNA, 17 nt, Human
aucaaaaucucuccacu

SEQ ID NO: 1406551 - RNA, 16 nt, Human
aucaaaaucucuccac

SEQ ID NO: 1406552 - RNA, 15 nt, Human
aucaaaaucucucca

SEQ ID NO: 1406553 - RNA, 13 nt, Human
aucaaaaucucuc

SEQ ID NO: 1406554 - RNA, 23 nt, Human
aucaaaaucucuccacuuucagc

SEQ ID NO: 1406555 - RNA, 22 nt, Human
aucaaaaugcuuuuuauuucug

SEQ ID NO: 1406556 - RNA, 12 nt, Human
aucaaaaugcuu

SEQ ID NO: 1406557 - RNA, 16 nt, Human
aucaaacauuuucugg

SEQ ID NO: 1406558 - RNA, 15 nt, Human
aucaaacauuuucug

SEQ ID NO: 1406559 - RNA, 23 nt, Human
aucaaacaccaacauaaaaauga

SEQ ID NO: 1406560 - RNA, 13 nt, Human
aucaaaaugcuuu

SEQ ID NO: 1406561 - RNA, 22 nt, Human
aucaaacaccaacauaaaaaug

SEQ ID NO: 1406562 - RNA, 18 nt, Human
aucaaagcaucuugcauu

SEQ ID NO: 1406563 - RNA, 12 nt, Human
aucaaagaugaa

SEQ ID NO: 1406564 - RNA, 14 nt, Human
aucaaauauauuca

SEQ ID NO: 1406565 - RNA, 13 nt, Human
aucgccuucccca

SEQ ID NO: 1406566 - RNA, 12 nt, Human
aucgccuucccc

SEQ ID NO: 1406567 - RNA, 17 nt, Human
auccuuucauauaguua

SEQ ID NO: 1406568 - RNA, 20 nt, Human
auccuuucauauaguuagcu

SEQ ID NO: 1406569 - RNA, 14 nt, Human
auccuugucuuauu

SEQ ID NO: 1406570 - RNA, 12 nt, Human
aucgccuuuccc

SEQ ID NO: 1406571 - RNA, 17 nt, Human
aucgcuccaccuugcag

SEQ ID NO: 1406572 - RNA, 21 nt, Human
aucgcuccaccuugcagcucu

SEQ ID NO: 1406573 - RNA, 22 nt, Human
aucgcuccugcagccccagccc

SEQ ID NO: 1406574 - RNA, 15 nt, Human
aucgccuuccccacc

SEQ ID NO: 1406575 - RNA, 14 nt, Human
auccuuagaucugg

SEQ ID NO: 1406576 - RNA, 18 nt, Human
auccuuagaucuggcaug

SEQ ID NO: 1406577 - RNA, 13 nt, Human
auccuuacaaguu

SEQ ID NO: 1406578 - RNA, 15 nt, Human
auccucaauccagcu

SEQ ID NO: 1406579 - RNA, 12 nt, Human
auccucaaucca

SEQ ID NO: 1406580 - RNA, 16 nt, Human
auccucacagugaaca

SEQ ID NO: 1406581 - RNA, 18 nt, Human
auccucaaaugcggggug

SEQ ID NO: 1406582 - RNA, 22 nt, Human
auccuugccaauagugucaucc

SEQ ID NO: 1406583 - RNA, 16 nt, Human
auccuugagucaaaaa

SEQ ID NO: 1406584 - RNA, 22 nt, Human
auccuucaucuggauuccagag

SEQ ID NO: 1406585 - RNA, 17 nt, Human
auccaccugccuuggcu

SEQ ID NO: 1406586 - RNA, 21 nt, Human
auccagagucccugccuggac

SEQ ID NO: 1406587 - RNA, 20 nt, Human
auccagagucccugccugga

SEQ ID NO: 1406588 - RNA, 19 nt, Human
auccagagucccugccugg

SEQ ID NO: 1406589 - RNA, 17 nt, Human
auccccaaggcacuuga

SEQ ID NO: 1406590 - RNA, 12 nt, Human
aucccuacaugu

SEQ ID NO: 1406591 - RNA, 16 nt, Human
aucccguguucuccuu

SEQ ID NO: 1406592 - RNA, 13 nt, Human
aucccguguucuc

SEQ ID NO: 1406593 - RNA, 18 nt, Human
aucccuacauguauugca

SEQ ID NO: 1406594 - RNA, 15 nt, Human
aucccuacauguauu

SEQ ID NO: 1406595 - RNA, 14 nt, Human
aucccuacauguau

SEQ ID NO: 1406596 - RNA, 13 nt, Human
aucccuacaugua

SEQ ID NO: 1406597 - RNA, 19 nt, Human
auccucaguuuuugugaaa

SEQ ID NO: 1406598 - RNA, 23 nt, Human
auggucccacaucccugggccug

SEQ ID NO: 1406599 - RNA, 22 nt, Human
auggucccacaucccugggccu

SEQ ID NO: 1406600 - RNA, 20 nt, Human
auggucccacaucccugggc

SEQ ID NO: 1406601 - RNA, 19 nt, Human
auggucccacaucccuggg

SEQ ID NO: 1406602 - RNA, 17 nt, Human
auggucccacaucccug

SEQ ID NO: 1406603 - RNA, 20 nt, Human
augguccaauuaguuuccuu

SEQ ID NO: 1406604 - RNA, 19 nt, Human
augguccaggagaaggcca

SEQ ID NO: 1406605 - RNA, 18 nt, Human
augguccaggagaaggcc

SEQ ID NO: 1406606 - RNA, 16 nt, Human
augguccaggagaagg

SEQ ID NO: 1406607 - RNA, 13 nt, Human
augguccaggaga

SEQ ID NO: 1406608 - RNA, 18 nt, Human
augguaggcauuuccuau

SEQ ID NO: 1406609 - RNA, 17 nt, Human
augguaggcauuuccua

SEQ ID NO: 1406610 - RNA, 23 nt, Human
augguacuguacagcuggcucua

SEQ ID NO: 1406611 - RNA, 21 nt, Human
augguacugacuuugcuugcu

SEQ ID NO: 1406612 - RNA, 16 nt, Human
augguaccagaugcag

SEQ ID NO: 1406613 - RNA, 14 nt, Human
augguaauuguugc

SEQ ID NO: 1406614 - RNA, 23 nt, Human
augguaacugcuuucuguuccaa

SEQ ID NO: 1406615 - RNA, 20 nt, Human
augguaacugcuuucuguuc

SEQ ID NO: 1406616 - RNA, 15 nt, Human
augguaacugcuuuc

SEQ ID NO: 1406617 - RNA, 14 nt, Human
augguaacugcuuu

SEQ ID NO: 1406618 - RNA, 18 nt, Human
augguaaaaaauuuauaa

SEQ ID NO: 1406619 - RNA, 22 nt, Human
auggguuuuucccuguacagua

SEQ ID NO: 1406620 - RNA, 16 nt, Human
augguaaaaaauuuau

SEQ ID NO: 1406621 - RNA, 13 nt, Human
auggguggaaagg

SEQ ID NO: 1406622 - RNA, 22 nt, Human
auggguuagggaaaacauucca

SEQ ID NO: 1406623 - RNA, 24 nt, Human
auguauugugcaauguguauaaac

SEQ ID NO: 1406624 - RNA, 22 nt, Human
auguauugugcaauguguauaa

SEQ ID NO: 1406625 - RNA, 20 nt, Human
auguauugugcaauguguau

SEQ ID NO: 1406626 - RNA, 19 nt, Human
auguauugugcaaugugua

SEQ ID NO: 1406627 - RNA, 18 nt, Human
auguauugugcaaugugu

SEQ ID NO: 1406628 - RNA, 17 nt, Human
auguauugugcaaugug

SEQ ID NO: 1406629 - RNA, 15 nt, Human
auguauugugcaaug

SEQ ID NO: 1406630 - RNA, 20 nt, Human
auguacaaaaaaaaaacccu

SEQ ID NO: 1406631 - RNA, 23 nt, Human
auguaauuuuguguaagaaauac

SEQ ID NO: 1406632 - RNA, 22 nt, Human
auguaauuuuguguaagaaaua

SEQ ID NO: 1406633 - RNA, 17 nt, Human
auguaauuuuguguaag

SEQ ID NO: 1406634 - RNA, 16 nt, Human
auguaauuuuguguaa

SEQ ID NO: 1406635 - RNA, 15 nt, Human
auguaauuuugugua

SEQ ID NO: 1406636 - RNA, 17 nt, Human
auguauuuauaaauaua

SEQ ID NO: 1406637 - RNA, 21 nt, Human
augucaaucagccuaguugau

SEQ ID NO: 1406638 - RNA, 12 nt, Human
auguaauuuugu

SEQ ID NO: 1406639 - RNA, 21 nt, Human
auguaauuucaggaggaauac

SEQ ID NO: 1406640 - RNA, 23 nt, Human
auguaauuauuuauguauggugc

SEQ ID NO: 1406641 - RNA, 17 nt, Human
auguaauuauuuaugua

SEQ ID NO: 1406642 - RNA, 15 nt, Human
auguaauuauuuaug

SEQ ID NO: 1406643 - RNA, 14 nt, Human
auguaacuuuugua

SEQ ID NO: 1406644 - RNA, 18 nt, Human
auguaacugccuagaaac

SEQ ID NO: 1406645 - RNA, 19 nt, Human
auguaacugccuagaaaca

SEQ ID NO: 1406646 - RNA, 17 nt, Human
auguaacugccuagaaa

SEQ ID NO: 1406647 - RNA, 15 nt, Human
auguaacugccuaga

SEQ ID NO: 1406648 - RNA, 19 nt, Human
auguaaauuuguacuauuu

SEQ ID NO: 1406649 - RNA, 21 nt, Human
auguaaauuuguacuauuuaa

SEQ ID NO: 1406650 - RNA, 17 nt, Human
auguaaauuuguacuau

SEQ ID NO: 1406651 - RNA, 15 nt, Human
auguaaauuuguacu

SEQ ID NO: 1406652 - RNA, 14 nt, Human
auguaaauuuguac

SEQ ID NO: 1406653 - RNA, 19 nt, Human
augucaauuucuguguugc

SEQ ID NO: 1406654 - RNA, 16 nt, Human
augucaauuucugugu

SEQ ID NO: 1406655 - RNA, 14 nt, Human
augugaaacauguu

SEQ ID NO: 1406656 - RNA, 21 nt, Human
augugaaaaugguccaggaga

SEQ ID NO: 1406657 - RNA, 15 nt, Human
augugaaacauguuu

SEQ ID NO: 1406658 - RNA, 23 nt, Human
augugaaauuuacaucauuucuu

SEQ ID NO: 1406659 - RNA, 22 nt, Human
augugaaaaugguccaggagaa

SEQ ID NO: 1406660 - RNA, 20 nt, Human
augugaaauuuacaucauuu

SEQ ID NO: 1406661 - RNA, 17 nt, Human
augugaaaucauucauu

SEQ ID NO: 1406662 - RNA, 18 nt, Human
augugaaaucauucauuu

SEQ ID NO: 1406663 - RNA, 15 nt, Human
auguuucuucuaggu

SEQ ID NO: 1406664 - RNA, 12 nt, Human
auguuucuggau

SEQ ID NO: 1406665 - RNA, 20 nt, Human
auguuuccucuaguucuuug

SEQ ID NO: 1406666 - RNA, 14 nt, Human
auguuuccucuagu

SEQ ID NO: 1406667 - RNA, 21 nt, Human
auguuuccagcauucccaggu

SEQ ID NO: 1406668 - RNA, 20 nt, Human
auguuuccagcauucccagg

SEQ ID NO: 1406669 - RNA, 19 nt, Human
auguuuccagcauucccag

SEQ ID NO: 1406670 - RNA, 18 nt, Human
auguuuccagcauuccca

SEQ ID NO: 1406671 - RNA, 16 nt, Human
auguuuccagcauucc

SEQ ID NO: 1406672 - RNA, 15 nt, Human
auguuuccagcauuc

SEQ ID NO: 1406673 - RNA, 13 nt, Human
auguuuccagcau

SEQ ID NO: 1406674 - RNA, 17 nt, Human
auguucuguuugcugug

SEQ ID NO: 1406675 - RNA, 16 nt, Human
auguucuguuugcugu

SEQ ID NO: 1406676 - RNA, 13 nt, Human
auguucuguuugc

SEQ ID NO: 1406677 - RNA, 14 nt, Human
auguucuuaauucu

SEQ ID NO: 1406678 - RNA, 23 nt, Human
auguucugucccuugccccccug

SEQ ID NO: 1406679 - RNA, 20 nt, Human
auguucugucccuugccccc

SEQ ID NO: 1406680 - RNA, 14 nt, Human
auguucugucccuu

SEQ ID NO: 1406681 - RNA, 13 nt, Human
auguucugucccu

SEQ ID NO: 1406682 - RNA, 14 nt, Human
auguguauaaacaa

SEQ ID NO: 1406683 - RNA, 13 nt, Human
auguguauaaaca

SEQ ID NO: 1406684 - RNA, 12 nt, Human
auguguauaaac

SEQ ID NO: 1406685 - RNA, 23 nt, Human
auguguauaaaaauaaaaaagau

SEQ ID NO: 1406686 - RNA, 13 nt, Human
auguguauaaaaa

SEQ ID NO: 1406687 - RNA, 19 nt, Human
auguguaguucauguaaau

SEQ ID NO: 1406688 - RNA, 20 nt, Human
auguguaguucauguaaaua

SEQ ID NO: 1406689 - RNA, 18 nt, Human
auguguaguucauguaaa

SEQ ID NO: 1406690 - RNA, 16 nt, Human
auguguaguucaugua

SEQ ID NO: 1406691 - RNA, 15 nt, Human
auguguauaaacaag

SEQ ID NO: 1406692 - RNA, 15 nt, Human
auguguaugcacagu

SEQ ID NO: 1406693 - RNA, 19 nt, Human
auguguaugcacaguaaaa

SEQ ID NO: 1406694 - RNA, 14 nt, Human
auguuccauuaaac

SEQ ID NO: 1406695 - RNA, 15 nt, Human
auguuccauuaaacg

SEQ ID NO: 1406696 - RNA, 20 nt, Human
auguguaugcacaguaaaaa

SEQ ID NO: 1406697 - RNA, 16 nt, Human
augugguuuuagauuu

SEQ ID NO: 1406698 - RNA, 21 nt, Human
auguguaaacaauuuuauaua

SEQ ID NO: 1406699 - RNA, 19 nt, Human
auguguaagacaaaaagcu

SEQ ID NO: 1406700 - RNA, 17 nt, Human
auguguaagacaaaaag

SEQ ID NO: 1406701 - RNA, 23 nt, Human
augcugccuuauucagggaagga

SEQ ID NO: 1406702 - RNA, 20 nt, Human
augcugacauucaccugccc

SEQ ID NO: 1406703 - RNA, 19 nt, Human
augcugacauucaccugcc

SEQ ID NO: 1406704 - RNA, 23 nt, Human
augcugaauauacagcaggugcu

SEQ ID NO: 1406705 - RNA, 22 nt, Human
augcugacauucaccugcccca

SEQ ID NO: 1406706 - RNA, 22 nt, Human
augcugaggccugggccgcugc

SEQ ID NO: 1406707 - RNA, 18 nt, Human
augcugaggccugggccg

SEQ ID NO: 1406708 - RNA, 17 nt, Human
augcugaggccugggcc

SEQ ID NO: 1406709 - RNA, 15 nt, Human
augcugaggccuggg

SEQ ID NO: 1406710 - RNA, 14 nt, Human
augcugaggccugg

SEQ ID NO: 1406711 - RNA, 21 nt, Human
augcugagauuacagguguga

SEQ ID NO: 1406712 - RNA, 16 nt, Human
augcuuguacauaaug

SEQ ID NO: 1406713 - RNA, 12 nt, Human
auggaggccugu

SEQ ID NO: 1406714 - RNA, 16 nt, Human
auggagggaauaauac

SEQ ID NO: 1406715 - RNA, 15 nt, Human
auggaggccuguccu

SEQ ID NO: 1406716 - RNA, 14 nt, Human
auggaggggcagag

SEQ ID NO: 1406717 - RNA, 15 nt, Human
auggaggggcagagc

SEQ ID NO: 1406718 - RNA, 17 nt, Human
auggagguucuaaggcc

SEQ ID NO: 1406719 - RNA, 16 nt, Human
auggagguucuaaggc

SEQ ID NO: 1406720 - RNA, 15 nt, Human
auggagguucuaagg

SEQ ID NO: 1406721 - RNA, 13 nt, Human
auggagguucuaa

SEQ ID NO: 1406722 - RNA, 12 nt, Human
auggagguucua

SEQ ID NO: 1406723 - RNA, 19 nt, Human
auggaggggcagagccagg

SEQ ID NO: 1406724 - RNA, 16 nt, Human
auggauccuggaggau

SEQ ID NO: 1406725 - RNA, 22 nt, Human
auggauauaguuuuacuuuuaa

SEQ ID NO: 1406726 - RNA, 16 nt, Human
auggaucacaagaugg

SEQ ID NO: 1406727 - RNA, 15 nt, Human
auggaucacaagaug

SEQ ID NO: 1406728 - RNA, 18 nt, Human
auggauaggcacaggaaa

SEQ ID NO: 1406729 - RNA, 15 nt, Human
auggagucuugcucu

SEQ ID NO: 1406730 - RNA, 17 nt, Human
auggauaggcacaggaa

SEQ ID NO: 1406731 - RNA, 17 nt, Human
auggcuuugugauucaa

SEQ ID NO: 1406732 - RNA, 18 nt, Human
auggcuuuugugcauuau

SEQ ID NO: 1406733 - RNA, 16 nt, Human
auggcuuuugugcauu

SEQ ID NO: 1406734 - RNA, 17 nt, Human
auggcuuuugugcauua

SEQ ID NO: 1406735 - RNA, 17 nt, Human
augcauucuucucuguu

SEQ ID NO: 1406736 - RNA, 19 nt, Human
augcauucuucucuguugu

SEQ ID NO: 1406737 - RNA, 14 nt, Human
augcauucuucucu

SEQ ID NO: 1406738 - RNA, 22 nt, Human
augcauuauaggaucauuuguu

SEQ ID NO: 1406739 - RNA, 18 nt, Human
augcauuauaucaaaucu

SEQ ID NO: 1406740 - RNA, 21 nt, Human
augcauuauaggaucauuugu

SEQ ID NO: 1406741 - RNA, 13 nt, Human
augcacacauuuu

SEQ ID NO: 1406742 - RNA, 14 nt, Human
augcacacauuuuu

SEQ ID NO: 1406743 - RNA, 15 nt, Human
augcacacauuuuuu

SEQ ID NO: 1406744 - RNA, 19 nt, Human
augcacagaguuguuacau

SEQ ID NO: 1406745 - RNA, 21 nt, Human
augcacagaguuguuacauuu

SEQ ID NO: 1406746 - RNA, 22 nt, Human
augcacagaguuguuacauuuu

SEQ ID NO: 1406747 - RNA, 23 nt, Human
augcacagaguuguuacauuuuu

SEQ ID NO: 1406748 - RNA, 18 nt, Human
augccuuacucuucuuga

SEQ ID NO: 1406749 - RNA, 16 nt, Human
augccuuacucuucuu

SEQ ID NO: 1406750 - RNA, 19 nt, Human
augccugucuuaauuuucu

SEQ ID NO: 1406751 - RNA, 24 nt, Human
augccuugguuuuuacugcucuga

SEQ ID NO: 1406752 - RNA, 18 nt, Human
augccuuguuucauauuu

SEQ ID NO: 1406753 - RNA, 20 nt, Human
augaugaucaauuauaguuu

SEQ ID NO: 1406754 - RNA, 15 nt, Human
augaugaaugagaau

SEQ ID NO: 1406755 - RNA, 12 nt, Human
augaugaaugag

SEQ ID NO: 1406756 - RNA, 19 nt, Human
augauggcaauuuuguaac

SEQ ID NO: 1406757 - RNA, 19 nt, Human
augauggaugccaauauua

SEQ ID NO: 1406758 - RNA, 15 nt, Human
augauggaugccaau

SEQ ID NO: 1406759 - RNA, 16 nt, Human
augauggguguuuuua

SEQ ID NO: 1406760 - RNA, 16 nt, Human
augcacaagaauggau

SEQ ID NO: 1406761 - RNA, 21 nt, Human
augcacaauguagauaagugu

SEQ ID NO: 1406762 - RNA, 23 nt, Human
augcacaaauucugucucuggau

SEQ ID NO: 1406763 - RNA, 15 nt, Human
augcacaaauucugu

SEQ ID NO: 1406764 - RNA, 22 nt, Human
augcacaaauucugucucugga

SEQ ID NO: 1406765 - RNA, 14 nt, Human
agggcgcaggccgu

SEQ ID NO: 1406766 - RNA, 13 nt, Human
agggcgcaggccg

SEQ ID NO: 1406767 - RNA, 13 nt, Human
agggccugcugga

SEQ ID NO: 1406768 - RNA, 14 nt, Human
aggggccuggagau

SEQ ID NO: 1406769 - RNA, 13 nt, Human
aggggccuggaga

SEQ ID NO: 1406770 - RNA, 13 nt, Human
aggggccugccca

SEQ ID NO: 1406771 - RNA, 22 nt, Human
aggggccugccaccuggacccc

SEQ ID NO: 1406772 - RNA, 21 nt, Human
aggggccugccaccuggaccc

SEQ ID NO: 1406773 - RNA, 20 nt, Human
aggggccugccaccuggacc

SEQ ID NO: 1406774 - RNA, 19 nt, Human
aggggccugccaccuggac

SEQ ID NO: 1406775 - RNA, 17 nt, Human
aggggccugccaccugg

SEQ ID NO: 1406776 - RNA, 15 nt, Human
aggggccugccaccu

SEQ ID NO: 1406777 - RNA, 14 nt, Human
aggggccugagcag

SEQ ID NO: 1406778 - RNA, 13 nt, Human
aggggccugagca

SEQ ID NO: 1406779 - RNA, 12 nt, Human
aggggccugagc

SEQ ID NO: 1406780 - RNA, 19 nt, Human
aggggccccucucagcccu

SEQ ID NO: 1406781 - RNA, 14 nt, Human
aggggccccucuca

SEQ ID NO: 1406782 - RNA, 13 nt, Human
aggggccccucuc

SEQ ID NO: 1406783 - RNA, 15 nt, Human
agggucggugccuuc

SEQ ID NO: 1406784 - RNA, 22 nt, Human
agggucgaaagcucuagaaucu

SEQ ID NO: 1406785 - RNA, 18 nt, Human
agggucgaaagcucuaga

SEQ ID NO: 1406786 - RNA, 16 nt, Human
agggucgaaagcucua

SEQ ID NO: 1406787 - RNA, 15 nt, Human
agggucgaaagcucu

SEQ ID NO: 1406788 - RNA, 14 nt, Human
agggucgaaagcuc

SEQ ID NO: 1406789 - RNA, 22 nt, Human
aggguccuuuugacacugcucu

SEQ ID NO: 1406790 - RNA, 17 nt, Human
aggguccuuuugacacu

SEQ ID NO: 1406791 - RNA, 19 nt, Human
agggucagacgccugagga

SEQ ID NO: 1406792 - RNA, 16 nt, Human
aggguaugaagagugu

SEQ ID NO: 1406793 - RNA, 21 nt, Human
aggguauggacuaucugucug

SEQ ID NO: 1406794 - RNA, 15 nt, Human
aggguaugaagagug

SEQ ID NO: 1406795 - RNA, 14 nt, Human
aggggccugcccag

SEQ ID NO: 1406796 - RNA, 22 nt, Human
aggggccuggagauccuccugc

SEQ ID NO: 1406797 - RNA, 21 nt, Human
aggggccuggagauccuccug

SEQ ID NO: 1406798 - RNA, 18 nt, Human
aggggccuggagauccuc

SEQ ID NO: 1406799 - RNA, 22 nt, Human
agggacugucgcugcuucgugg

SEQ ID NO: 1406800 - RNA, 16 nt, Human
agggacugucgcugcu

SEQ ID NO: 1406801 - RNA, 20 nt, Human
agggacuguaaacacagaca

SEQ ID NO: 1406802 - RNA, 19 nt, Human
agggauuaaccucugcacu

SEQ ID NO: 1406803 - RNA, 21 nt, Human
agggcaaagccaggucccucu

SEQ ID NO: 1406804 - RNA, 14 nt, Human
agggcaaagccagg

SEQ ID NO: 1406805 - RNA, 13 nt, Human
agggcaaagccag

SEQ ID NO: 1406806 - RNA, 11 nt, Human
agggcaaagcc

SEQ ID NO: 1406807 - RNA, 17 nt, Human
agggauuuucagcccuc

SEQ ID NO: 1406808 - RNA, 22 nt, Human
agggauuuucagcccucagaau

SEQ ID NO: 1406809 - RNA, 22 nt, Human
agggaucccucaucugucccuc

SEQ ID NO: 1406810 - RNA, 19 nt, Human
agggaucccucaucugucc

SEQ ID NO: 1406811 - RNA, 16 nt, Human
agggaucccucaucug

SEQ ID NO: 1406812 - RNA, 15 nt, Human
agggaucccucaucu

SEQ ID NO: 1406813 - RNA, 18 nt, Human
agggauuaaccucugcac

SEQ ID NO: 1406814 - RNA, 17 nt, Human
agggauuaaccucugca

SEQ ID NO: 1406815 - RNA, 22 nt, Human
agggauguggguuccacagacg

SEQ ID NO: 1406816 - RNA, 21 nt, Human
agggauguggguuccacagac

SEQ ID NO: 1406817 - RNA, 13 nt, Human
agggauguggguu

SEQ ID NO: 1406818 - RNA, 21 nt, Human
agggccugaugggguggaagg

SEQ ID NO: 1406819 - RNA, 18 nt, Human
agggcaacagaucaguaa

SEQ ID NO: 1406820 - RNA, 20 nt, Human
agggcaaagccaggucccuc

SEQ ID NO: 1406821 - RNA, 18 nt, Human
agggcaaagccagguccc

SEQ ID NO: 1406822 - RNA, 15 nt, Human
agggcaaagccaggu

SEQ ID NO: 1406823 - RNA, 19 nt, Human
agggccugaugggguggaa

SEQ ID NO: 1406824 - RNA, 14 nt, Human
agggccugaugggg

SEQ ID NO: 1406825 - RNA, 16 nt, Human
agggucggugccuuca

SEQ ID NO: 1406826 - RNA, 15 nt, Human
aggguuuuaacuuug

SEQ ID NO: 1406827 - RNA, 16 nt, Human
aggguuuuaacuuugu

SEQ ID NO: 1406828 - RNA, 21 nt, Human
aggguuugugacagggcgggg

SEQ ID NO: 1406829 - RNA, 13 nt, Human
aggucucccugga

SEQ ID NO: 1406830 - RNA, 13 nt, Human
aggucucagcccc

SEQ ID NO: 1406831 - RNA, 14 nt, Human
aggucucagccccu

SEQ ID NO: 1406832 - RNA, 12 nt, Human
aggucucagccc

SEQ ID NO: 1406833 - RNA, 22 nt, Human
aggucgguagguucagccaagg

SEQ ID NO: 1406834 - RNA, 18 nt, Human
agguccugagcacugcca

SEQ ID NO: 1406835 - RNA, 17 nt, Human
agguccugagcacugcc

SEQ ID NO: 1406836 - RNA, 16 nt, Human
agguccugagcacugc

SEQ ID NO: 1406837 - RNA, 15 nt, Human
agguccugagcacug

SEQ ID NO: 1406838 - RNA, 13 nt, Human
agguccugagcac

SEQ ID NO: 1406839 - RNA, 12 nt, Human
agguccugagca

SEQ ID NO: 1406840 - RNA, 23 nt, Human
agguccucugucagucacagcca

SEQ ID NO: 1406841 - RNA, 19 nt, Human
agguccucugucagucaca

SEQ ID NO: 1406842 - RNA, 14 nt, Human
agguccucugucag

SEQ ID NO: 1406843 - RNA, 13 nt, Human
agguccucuguca

SEQ ID NO: 1406844 - RNA, 15 nt, Human
agguccucagagaau

SEQ ID NO: 1406845 - RNA, 21 nt, Human
agguccucaguguccucaggg

SEQ ID NO: 1406846 - RNA, 19 nt, Human
agguacgaugacaguguuc

SEQ ID NO: 1406847 - RNA, 19 nt, Human
agguaacuaacugcauaca

SEQ ID NO: 1406848 - RNA, 18 nt, Human
agguaacuaacugcauac

SEQ ID NO: 1406849 - RNA, 19 nt, Human
agguccgguguucuaagau

SEQ ID NO: 1406850 - RNA, 18 nt, Human
agguccgguguucuaaga

SEQ ID NO: 1406851 - RNA, 12 nt, Human
agguacuauuau

SEQ ID NO: 1406852 - RNA, 22 nt, Human
aggccauggacucuguccugaa

SEQ ID NO: 1406853 - RNA, 21 nt, Human
aggccauggacucuguccuga

SEQ ID NO: 1406854 - RNA, 20 nt, Human
aggccauggacucuguccug

SEQ ID NO: 1406855 - RNA, 19 nt, Human
aggccauggacucuguccu

SEQ ID NO: 1406856 - RNA, 18 nt, Human
aggccauggacucugucc

SEQ ID NO: 1406857 - RNA, 17 nt, Human
aggccauggacucuguc

SEQ ID NO: 1406858 - RNA, 13 nt, Human
aggccauggacuc

SEQ ID NO: 1406859 - RNA, 22 nt, Human
aggccaucugggcuccuccagg

SEQ ID NO: 1406860 - RNA, 21 nt, Human
aggccaucugggcuccuccag

SEQ ID NO: 1406861 - RNA, 16 nt, Human
aggccauaaaacaggu

SEQ ID NO: 1406862 - RNA, 15 nt, Human
aggccagguccagag

SEQ ID NO: 1406863 - RNA, 16 nt, Human
aggccagguccagaga

SEQ ID NO: 1406864 - RNA, 17 nt, Human
aggccagguccagagag

SEQ ID NO: 1406865 - RNA, 22 nt, Human
aggccaggacucugcagccuca

SEQ ID NO: 1406866 - RNA, 11 nt, Human
aggccaggcau

SEQ ID NO: 1406867 - RNA, 23 nt, Human
aggccaggacucugcagccucag

SEQ ID NO: 1406868 - RNA, 21 nt, Human
aggccaggacucugcagccuc

SEQ ID NO: 1406869 - RNA, 20 nt, Human
aggccaggacucugcagccu

SEQ ID NO: 1406870 - RNA, 19 nt, Human
aggccaggacucugcagcc

SEQ ID NO: 1406871 - RNA, 18 nt, Human
aggccaggacucugcagc

SEQ ID NO: 1406872 - RNA, 17 nt, Human
aggccaggacucugcag

SEQ ID NO: 1406873 - RNA, 15 nt, Human
aggccaggacucugc

SEQ ID NO: 1406874 - RNA, 23 nt, Human
aggccagcugugguuuucuuuug

SEQ ID NO: 1406875 - RNA, 21 nt, Human
aggccagcugugguuuucuuu

SEQ ID NO: 1406876 - RNA, 20 nt, Human
aggccagcugugguuuucuu

SEQ ID NO: 1406877 - RNA, 16 nt, Human
aggccagcugugguuu

SEQ ID NO: 1406878 - RNA, 13 nt, Human
aggcccugugccc

SEQ ID NO: 1406879 - RNA, 23 nt, Human
aggcccuggccuccccugccacc

SEQ ID NO: 1406880 - RNA, 22 nt, Human
aggcccuggccuccccugccac

SEQ ID NO: 1406881 - RNA, 21 nt, Human
aggcccuggccuccccugcca

SEQ ID NO: 1406882 - RNA, 15 nt, Human
aggcccuggccuccc

SEQ ID NO: 1406883 - RNA, 14 nt, Human
aggcccuggccucc

SEQ ID NO: 1406884 - RNA, 23 nt, Human
aggcccuggaucagcguggccuu

SEQ ID NO: 1406885 - RNA, 21 nt, Human
aggcccuggaucagcguggcc

SEQ ID NO: 1406886 - RNA, 18 nt, Human
aggcccuggaucagcgug

SEQ ID NO: 1406887 - RNA, 13 nt, Human
aggcccuggauca

SEQ ID NO: 1406888 - RNA, 23 nt, Human
aggccaugggcacuguggguaga

SEQ ID NO: 1406889 - RNA, 21 nt, Human
aggccaugggcacugugggua

SEQ ID NO: 1406890 - RNA, 23 nt, Human
aggcagcagugugaggccagggc

SEQ ID NO: 1406891 - RNA, 22 nt, Human
aggcagcagugugaggccaggg

SEQ ID NO: 1406892 - RNA, 20 nt, Human
aggcagcagugugaggccag

SEQ ID NO: 1406893 - RNA, 19 nt, Human
aggcagcagugugaggcca

SEQ ID NO: 1406894 - RNA, 23 nt, Human
aggcagcaaggcccgagcagcug

SEQ ID NO: 1406895 - RNA, 18 nt, Human
aggcagcaaggcccgagc

SEQ ID NO: 1406896 - RNA, 17 nt, Human
aggcagcaaggcccgag

SEQ ID NO: 1406897 - RNA, 16 nt, Human
aggcagcaaggcccga

SEQ ID NO: 1406898 - RNA, 15 nt, Human
aggcagcaaggcccg

SEQ ID NO: 1406899 - RNA, 17 nt, Human
aggcagaggccugggcu

SEQ ID NO: 1406900 - RNA, 12 nt, Human
aggcauggugga

SEQ ID NO: 1406901 - RNA, 20 nt, Human
aggcaccugguggccaugcu

SEQ ID NO: 1406902 - RNA, 21 nt, Human
aggcaccugguggccaugcuc

SEQ ID NO: 1406903 - RNA, 20 nt, Human
aggagaggcaacauccaaaa

SEQ ID NO: 1406904 - RNA, 21 nt, Human
aggagaggcaacauccaaaau

SEQ ID NO: 1406905 - RNA, 20 nt, Human
aggagagggcgcuccucucu

SEQ ID NO: 1406906 - RNA, 23 nt, Human
aggcacugagauaccagcgagga

SEQ ID NO: 1406907 - RNA, 17 nt, Human
aggcacugaagugcuua

SEQ ID NO: 1406908 - RNA, 22 nt, Human
aggcagacucuuuaugcuugca

SEQ ID NO: 1406909 - RNA, 17 nt, Human
aggcacucuagauucca

SEQ ID NO: 1406910 - RNA, 15 nt, Human
aggcacucuagauuc

SEQ ID NO: 1406911 - RNA, 14 nt, Human
aggcacucuagauu

SEQ ID NO: 1406912 - RNA, 18 nt, Human
aggcagaggccugggcug

SEQ ID NO: 1406913 - RNA, 14 nt, Human
aggcagaggccugg

SEQ ID NO: 1406914 - RNA, 22 nt, Human
aggcagaggcccaggcugccgu

SEQ ID NO: 1406915 - RNA, 21 nt, Human
aggcagaggcccaggcugccg

SEQ ID NO: 1406916 - RNA, 20 nt, Human
aggcagaggcccaggcugcc

SEQ ID NO: 1406917 - RNA, 19 nt, Human
aggcagaggcccaggcugc

SEQ ID NO: 1406918 - RNA, 17 nt, Human
aggcagaggcccaggcu

SEQ ID NO: 1406919 - RNA, 14 nt, Human
aggcagaggcccag

SEQ ID NO: 1406920 - RNA, 13 nt, Human
aggcagagaagaa

SEQ ID NO: 1406921 - RNA, 14 nt, Human
aggcagagaagaaa

SEQ ID NO: 1406922 - RNA, 15 nt, Human
aggcagagaagaaag

SEQ ID NO: 1406923 - RNA, 22 nt, Human
aggcuacagagaagccuucaag

SEQ ID NO: 1406924 - RNA, 20 nt, Human
aggcuacagagaagccuuca

SEQ ID NO: 1406925 - RNA, 19 nt, Human
aggcuacagagaagccuuc

SEQ ID NO: 1406926 - RNA, 18 nt, Human
aggcuacagagaagccuu

SEQ ID NO: 1406927 - RNA, 17 nt, Human
aggcuacagagaagccu

SEQ ID NO: 1406928 - RNA, 16 nt, Human
aggcuacagagaagcc

SEQ ID NO: 1406929 - RNA, 15 nt, Human
aggcuacagagaagc

SEQ ID NO: 1406930 - RNA, 14 nt, Human
aggcuacagagaag

SEQ ID NO: 1406931 - RNA, 13 nt, Human
aggcuacagagaa

SEQ ID NO: 1406932 - RNA, 12 nt, Human
aggcuacagaga

SEQ ID NO: 1406933 - RNA, 22 nt, Human
aggcuaauuuuuuuguauuuua

SEQ ID NO: 1406934 - RNA, 23 nt, Human
aggcuaauuuuuuuguauuuuag

SEQ ID NO: 1406935 - RNA, 12 nt, Human
aggcuaauuuuu

SEQ ID NO: 1406936 - RNA, 14 nt, Human
aggcugaccacagc

SEQ ID NO: 1406937 - RNA, 13 nt, Human
aggcugaccacag

SEQ ID NO: 1406938 - RNA, 15 nt, Human
aggcuaccuuuguau

SEQ ID NO: 1406939 - RNA, 13 nt, Human
aggcuaccuuugu

SEQ ID NO: 1406940 - RNA, 14 nt, Human
aggcuaccuuugua

SEQ ID NO: 1406941 - RNA, 21 nt, Human
aggcugaccacagcacagcca

SEQ ID NO: 1406942 - RNA, 18 nt, Human
aggcugaccacagcacag

SEQ ID NO: 1406943 - RNA, 17 nt, Human
aggcugaccacagcaca

SEQ ID NO: 1406944 - RNA, 16 nt, Human
aggcugaccacagcac

SEQ ID NO: 1406945 - RNA, 17 nt, Human
aggcugaggccuggacu

SEQ ID NO: 1406946 - RNA, 16 nt, Human
aggcugaggccuggac

SEQ ID NO: 1406947 - RNA, 15 nt, Human
aggcugaggccugga

SEQ ID NO: 1406948 - RNA, 14 nt, Human
aggcugaggccugg

SEQ ID NO: 1406949 - RNA, 13 nt, Human
aggcugaggccug

SEQ ID NO: 1406950 - RNA, 17 nt, Human
aggcugaggcuggcaca

SEQ ID NO: 1406951 - RNA, 16 nt, Human
aggcugaggcuggcac

SEQ ID NO: 1406952 - RNA, 15 nt, Human
aggcugaggcuggca

SEQ ID NO: 1406953 - RNA, 14 nt, Human
aggcugaggcuggc

SEQ ID NO: 1406954 - RNA, 22 nt, Human
aggcuggucucaaacuccugac

SEQ ID NO: 1406955 - RNA, 17 nt, Human
aggcugguccuauggcc

SEQ ID NO: 1406956 - RNA, 17 nt, Human
aggcuggucuaaaacuc

SEQ ID NO: 1406957 - RNA, 23 nt, Human
aggcugguccuauggccucaugu

SEQ ID NO: 1406958 - RNA, 13 nt, Human
agggacccagcua

SEQ ID NO: 1406959 - RNA, 18 nt, Human
agggaccacacccuguac

SEQ ID NO: 1406960 - RNA, 20 nt, Human
agggacugagagaugcagaa

SEQ ID NO: 1406961 - RNA, 13 nt, Human
agggacugagaga

SEQ ID NO: 1406962 - RNA, 14 nt, Human
agggaccggcggac

SEQ ID NO: 1406963 - RNA, 14 nt, Human
aggcuaagcugccg

SEQ ID NO: 1406964 - RNA, 21 nt, Human
aggcuaaagcccagagacagc

SEQ ID NO: 1406965 - RNA, 16 nt, Human
aggcggugggccuggu

SEQ ID NO: 1406966 - RNA, 18 nt, Human
aggcggggcuugccuucu

SEQ ID NO: 1406967 - RNA, 16 nt, Human
aggcggggcuugccuu

SEQ ID NO: 1406968 - RNA, 15 nt, Human
aggcggggcuugccu

SEQ ID NO: 1406969 - RNA, 14 nt, Human
aggcggggcuugcc

SEQ ID NO: 1406970 - RNA, 19 nt, Human
aggcggggcuugccuucug

SEQ ID NO: 1406971 - RNA, 19 nt, Human
aggccggcuugccacaccc

SEQ ID NO: 1406972 - RNA, 20 nt, Human
aggccggcuugccacacccc

SEQ ID NO: 1406973 - RNA, 21 nt, Human
aggccggcuugccacaccccc

SEQ ID NO: 1406974 - RNA, 21 nt, Human
agcucagcacugccugcuccc

SEQ ID NO: 1406975 - RNA, 23 nt, Human
agcucagcacugccugcucccau

SEQ ID NO: 1406976 - RNA, 20 nt, Human
agcucagcacugccugcucc

SEQ ID NO: 1406977 - RNA, 17 nt, Human
agcucagcacugccugc

SEQ ID NO: 1406978 - RNA, 15 nt, Human
agcuccccuccccaa

SEQ ID NO: 1406979 - RNA, 18 nt, Human
agcuccccuccccaacug

SEQ ID NO: 1406980 - RNA, 14 nt, Human
agcuccccucccca

SEQ ID NO: 1406981 - RNA, 22 nt, Human
agcuccuguggccccacccugg

SEQ ID NO: 1406982 - RNA, 19 nt, Human
agcuccuguggccccaccc

SEQ ID NO: 1406983 - RNA, 16 nt, Human
agcuccuguggcccca

SEQ ID NO: 1406984 - RNA, 15 nt, Human
agcuccuguggcccc

SEQ ID NO: 1406985 - RNA, 13 nt, Human
agcuccuguggcc

SEQ ID NO: 1406986 - RNA, 12 nt, Human
agcuccuguggc

SEQ ID NO: 1406987 - RNA, 18 nt, Human
agcuccuuaaggcucuuu

SEQ ID NO: 1406988 - RNA, 17 nt, Human
agcuccuuaaggcucuu

SEQ ID NO: 1406989 - RNA, 16 nt, Human
agcuccuuaaggcucu

SEQ ID NO: 1406990 - RNA, 17 nt, Human
agcugaggccacacuca

SEQ ID NO: 1406991 - RNA, 13 nt, Human
agcugaggccaca

SEQ ID NO: 1406992 - RNA, 17 nt, Human
agcugaggcagcagugu

SEQ ID NO: 1406993 - RNA, 16 nt, Human
agcugaggcagcagug

SEQ ID NO: 1406994 - RNA, 15 nt, Human
agcugaggcagcagu

SEQ ID NO: 1406995 - RNA, 21 nt, Human
agcugagcucacaaggcagca

SEQ ID NO: 1406996 - RNA, 20 nt, Human
agcugagcucacaaggcagc

SEQ ID NO: 1406997 - RNA, 22 nt, Human
agcugagcucacaaggcagcaa

SEQ ID NO: 1406998 - RNA, 19 nt, Human
agcugagcucacaaggcag

SEQ ID NO: 1406999 - RNA, 18 nt, Human
agcugagcucacaaggca

SEQ ID NO: 1407000 - RNA, 17 nt, Human
agcugagcucacaaggc

SEQ ID NO: 1407001 - RNA, 17 nt, Human
agcugagcgccaggaug

SEQ ID NO: 1407002 - RNA, 15 nt, Human
agcugagcgccagga

SEQ ID NO: 1407003 - RNA, 14 nt, Human
agcugagcgccagg

SEQ ID NO: 1407004 - RNA, 12 nt, Human
agcugagcgcca

SEQ ID NO: 1407005 - RNA, 18 nt, Human
agcugaauguuuuucuaa

SEQ ID NO: 1407006 - RNA, 17 nt, Human
agcugaauguuuuucua

SEQ ID NO: 1407007 - RNA, 16 nt, Human
agcugaauguuuuucu

SEQ ID NO: 1407008 - RNA, 15 nt, Human
agcugaauguuuuuc

SEQ ID NO: 1407009 - RNA, 23 nt, Human
agcugaagguuguggccuuugcg

SEQ ID NO: 1407010 - RNA, 20 nt, Human
agcugguuuaauguuuuggc

SEQ ID NO: 1407011 - RNA, 21 nt, Human
agcugaggccacacucagcac

SEQ ID NO: 1407012 - RNA, 17 nt, Human
agcgacuccguuggcca

SEQ ID NO: 1407013 - RNA, 16 nt, Human
agcgacuccguuggcc

SEQ ID NO: 1407014 - RNA, 22 nt, Human
agcgaccuuccucauccacccc

SEQ ID NO: 1407015 - RNA, 17 nt, Human
agcgaccgcccccuccu

SEQ ID NO: 1407016 - RNA, 16 nt, Human
agcgaccgcccccucc

SEQ ID NO: 1407017 - RNA, 15 nt, Human
agcgaccgcccccuc

SEQ ID NO: 1407018 - RNA, 14 nt, Human
agcgaccgcccccu

SEQ ID NO: 1407019 - RNA, 23 nt, Human
agccuuuucccucuuuggcuccc

SEQ ID NO: 1407020 - RNA, 18 nt, Human
agccuuuucccucuuugg

SEQ ID NO: 1407021 - RNA, 23 nt, Human
agccuuuguuccccacuggagca

SEQ ID NO: 1407022 - RNA, 24 nt, Human
agccuuuguuccccacuggagcag

SEQ ID NO: 1407023 - RNA, 22 nt, Human
agccuuuguuccccacuggagc

SEQ ID NO: 1407024 - RNA, 21 nt, Human
agccuuuguuccccacuggag

SEQ ID NO: 1407025 - RNA, 20 nt, Human
agccuuuguuccccacugga

SEQ ID NO: 1407026 - RNA, 14 nt, Human
agccuuuguucccc

SEQ ID NO: 1407027 - RNA, 14 nt, Human
agccuggggcuggc

SEQ ID NO: 1407028 - RNA, 22 nt, Human
agcgauucccucucccaggccc

SEQ ID NO: 1407029 - RNA, 21 nt, Human
agcgauucccucucccaggcc

SEQ ID NO: 1407030 - RNA, 20 nt, Human
agcgauucccucucccaggc

SEQ ID NO: 1407031 - RNA, 19 nt, Human
agcgauucccucucccagg

SEQ ID NO: 1407032 - RNA, 21 nt, Human
agcgaguggagucugccaccc

SEQ ID NO: 1407033 - RNA, 22 nt, Human
agcgaguggagucugccaccca

SEQ ID NO: 1407034 - RNA, 19 nt, Human
agcgaguggagucugccac

SEQ ID NO: 1407035 - RNA, 15 nt, Human
agcgagggcgugucu

SEQ ID NO: 1407036 - RNA, 19 nt, Human
agcgaggaggcuccagagg

SEQ ID NO: 1407037 - RNA, 15 nt, Human
agcgaggaggcucca

SEQ ID NO: 1407038 - RNA, 20 nt, Human
agcgaggagaugcuccuugg

SEQ ID NO: 1407039 - RNA, 19 nt, Human
agcgagcgcccagcuccug

SEQ ID NO: 1407040 - RNA, 21 nt, Human
agcgacuccguuggccacucc

SEQ ID NO: 1407041 - RNA, 20 nt, Human
agcgacuccguuggccacuc

SEQ ID NO: 1407042 - RNA, 19 nt, Human
agcgacuccguuggccacu

SEQ ID NO: 1407043 - RNA, 19 nt, Human
agccugggaaagccccugc

SEQ ID NO: 1407044 - RNA, 24 nt, Human
agccugggccuauggagagcccug

SEQ ID NO: 1407045 - RNA, 22 nt, Human
agccugggccuauggagagccc

SEQ ID NO: 1407046 - RNA, 21 nt, Human
agccugggccuauggagagcc

SEQ ID NO: 1407047 - RNA, 20 nt, Human
agccugggccuauggagagc

SEQ ID NO: 1407048 - RNA, 19 nt, Human
agccugggccuauggagag

SEQ ID NO: 1407049 - RNA, 12 nt, Human
agccugggccua

SEQ ID NO: 1407050 - RNA, 17 nt, Human
agccugggaaagccccu

SEQ ID NO: 1407051 - RNA, 13 nt, Human
agccuggggcucu

SEQ ID NO: 1407052 - RNA, 23 nt, Human
agccugggccuauggagagcccu

SEQ ID NO: 1407053 - RNA, 18 nt, Human
agccugggcgcugguccu

SEQ ID NO: 1407054 - RNA, 21 nt, Human
agccuggggcucuaacgccug

SEQ ID NO: 1407055 - RNA, 16 nt, Human
agccuggggcucuaac

SEQ ID NO: 1407056 - RNA, 15 nt, Human
agccuggggcucuaa

SEQ ID NO: 1407057 - RNA, 14 nt, Human
agccuggggcucua

SEQ ID NO: 1407058 - RNA, 23 nt, Human
agccuggggcucuaacgccugag

SEQ ID NO: 1407059 - RNA, 22 nt, Human
agccuggggcucuaacgccuga

SEQ ID NO: 1407060 - RNA, 17 nt, Human
agccuggggcugaggcu

SEQ ID NO: 1407061 - RNA, 17 nt, Human
agccuggcuucaaauug

SEQ ID NO: 1407062 - RNA, 18 nt, Human
agccuggcuucaaauugu

SEQ ID NO: 1407063 - RNA, 15 nt, Human
agcucacaaggcagc

SEQ ID NO: 1407064 - RNA, 16 nt, Human
agcucacaaggcagca

SEQ ID NO: 1407065 - RNA, 13 nt, Human
agcucagcacugc

SEQ ID NO: 1407066 - RNA, 22 nt, Human
agcucagaggcgcacugugacc

SEQ ID NO: 1407067 - RNA, 19 nt, Human
agcucagaggcgcacugug

SEQ ID NO: 1407068 - RNA, 21 nt, Human
agcucagaaaauaucccuccu

SEQ ID NO: 1407069 - RNA, 19 nt, Human
agcucacuccccaaccccc

SEQ ID NO: 1407070 - RNA, 20 nt, Human
agcucacguccugagaaagc

SEQ ID NO: 1407071 - RNA, 21 nt, Human
agcucacguccugagaaagcu

SEQ ID NO: 1407072 - RNA, 19 nt, Human
agcucagaaaauaucccuc

SEQ ID NO: 1407073 - RNA, 18 nt, Human
agcucagaaaauaucccu

SEQ ID NO: 1407074 - RNA, 23 nt, Human
agcucacuucugggcuucaucug

SEQ ID NO: 1407075 - RNA, 13 nt, Human
agcucacuucugg

SEQ ID NO: 1407076 - RNA, 19 nt, Human
agcucacugcaaccuccac

SEQ ID NO: 1407077 - RNA, 12 nt, Human
agcucaaugagc

SEQ ID NO: 1407078 - RNA, 23 nt, Human
agcucaacucucuuauugccuca

SEQ ID NO: 1407079 - RNA, 22 nt, Human
agcucaacucucuuauugccuc

SEQ ID NO: 1407080 - RNA, 14 nt, Human
agcucaacucucuu

SEQ ID NO: 1407081 - RNA, 21 nt, Human
agcucaaagguuuggaaggag

SEQ ID NO: 1407082 - RNA, 23 nt, Human
agcucaaagguuuggaaggagca

SEQ ID NO: 1407083 - RNA, 20 nt, Human
agcucaaagguuuggaagga

SEQ ID NO: 1407084 - RNA, 14 nt, Human
agcucaaagguuug

SEQ ID NO: 1407085 - RNA, 14 nt, Human
agcucacaaggcag

SEQ ID NO: 1407086 - RNA, 23 nt, Human
agcucaaugagcauguuuagacu

SEQ ID NO: 1407087 - RNA, 14 nt, Human
agcucaauggacug

SEQ ID NO: 1407088 - RNA, 17 nt, Human
agcucaaugagcauguu

SEQ ID NO: 1407089 - RNA, 15 nt, Human
agcucaaugagcaug

SEQ ID NO: 1407090 - RNA, 14 nt, Human
agcucaaugagcau

SEQ ID NO: 1407091 - RNA, 13 nt, Human
agcucaaugagca

SEQ ID NO: 1407092 - RNA, 21 nt, Human
agcuaauucuacucacagugc

SEQ ID NO: 1407093 - RNA, 14 nt, Human
agcuaauuugcauu

SEQ ID NO: 1407094 - RNA, 13 nt, Human
agcuaauuugcau

SEQ ID NO: 1407095 - RNA, 17 nt, Human
agcuauuuuucuaacua

SEQ ID NO: 1407096 - RNA, 20 nt, Human
agcuauuuuucuaacuacaa

SEQ ID NO: 1407097 - RNA, 15 nt, Human
agcuauuuuucuaac

SEQ ID NO: 1407098 - RNA, 22 nt, Human
agcuaauuugcauuaaauucac

SEQ ID NO: 1407099 - RNA, 20 nt, Human
agcuaauuugcauuaaauuc

SEQ ID NO: 1407100 - RNA, 12 nt, Human
agcuacaaaugc

SEQ ID NO: 1407101 - RNA, 18 nt, Human
agcuaauaacaugugaaa

SEQ ID NO: 1407102 - RNA, 23 nt, Human
agcuaauaaaaagcuuuugucua

SEQ ID NO: 1407103 - RNA, 21 nt, Human
agcuaauaaaaagcuuuuguc

SEQ ID NO: 1407104 - RNA, 19 nt, Human
agcuaauaaaaagcuuuug

SEQ ID NO: 1407105 - RNA, 18 nt, Human
agcuaauaaaaagcuuuu

SEQ ID NO: 1407106 - RNA, 16 nt, Human
agcuaauaaaaagcuu

SEQ ID NO: 1407107 - RNA, 16 nt, Human
agcuaauaacugaucu

SEQ ID NO: 1407108 - RNA, 18 nt, Human
agcguucuuguaauuuua

SEQ ID NO: 1407109 - RNA, 12 nt, Human
agcguucuugua

SEQ ID NO: 1407110 - RNA, 11 nt, Human
agcguucuugu

SEQ ID NO: 1407111 - RNA, 11 nt, Human
agcguuuuuua

SEQ ID NO: 1407112 - RNA, 14 nt, Human
agcguuuuuuaaau

SEQ ID NO: 1407113 - RNA, 17 nt, Human
agcguuuuuuaaaugua

SEQ ID NO: 1407114 - RNA, 17 nt, Human
agcuaaacggauuccaa

SEQ ID NO: 1407115 - RNA, 19 nt, Human
agcuaaaauaaagaaauag

SEQ ID NO: 1407116 - RNA, 12 nt, Human
agcuaaaauaaa

SEQ ID NO: 1407117 - RNA, 18 nt, Human
agcguuuuuuaaauguau

SEQ ID NO: 1407118 - RNA, 19 nt, Human
agcguuuuuuaaauguaua

SEQ ID NO: 1407119 - RNA, 20 nt, Human
agcguuuuuuaaauguauac

SEQ ID NO: 1407120 - RNA, 23 nt, Human
agcguuuuuuaaauguauacuau

SEQ ID NO: 1407121 - RNA, 20 nt, Human
aggaauauuuuccaaagagu

SEQ ID NO: 1407122 - RNA, 16 nt, Human
aggaauauuuuccaaa

SEQ ID NO: 1407123 - RNA, 15 nt, Human
aggaauauuuuccaa

SEQ ID NO: 1407124 - RNA, 18 nt, Human
aggaauagcaugucacua

SEQ ID NO: 1407125 - RNA, 24 nt, Human
aggaccagcucaggacagaugcca

SEQ ID NO: 1407126 - RNA, 14 nt, Human
aggagagaguugaa

SEQ ID NO: 1407127 - RNA, 14 nt, Human
aggagagacacugg

SEQ ID NO: 1407128 - RNA, 20 nt, Human
aggagacuguuuggaaauug

SEQ ID NO: 1407129 - RNA, 17 nt, Human
aggaccuggcugccaua

SEQ ID NO: 1407130 - RNA, 16 nt, Human
aggaccuggcugccau

SEQ ID NO: 1407131 - RNA, 13 nt, Human
aggaccuggcugc

SEQ ID NO: 1407132 - RNA, 19 nt, Human
aggaccugagccugccgag

SEQ ID NO: 1407133 - RNA, 21 nt, Human
aggaccugagccugccgagca

SEQ ID NO: 1407134 - RNA, 17 nt, Human
aggaccagucccagagc

SEQ ID NO: 1407135 - RNA, 20 nt, Human
aggaccagucaaccugggca

SEQ ID NO: 1407136 - RNA, 19 nt, Human
aggaccagucaaccugggc

SEQ ID NO: 1407137 - RNA, 18 nt, Human
aggaccugagccugccga

SEQ ID NO: 1407138 - RNA, 17 nt, Human
aggaccugagccugccg

SEQ ID NO: 1407139 - RNA, 16 nt, Human
aggaccugagccugcc

SEQ ID NO: 1407140 - RNA, 15 nt, Human
aggaccugagccugc

SEQ ID NO: 1407141 - RNA, 14 nt, Human
aggaccugagccug

SEQ ID NO: 1407142 - RNA, 13 nt, Human
aggaccugagccu

SEQ ID NO: 1407143 - RNA, 12 nt, Human
aggaccugagcc

SEQ ID NO: 1407144 - RNA, 16 nt, Human
aggaccugagaccuga

SEQ ID NO: 1407145 - RNA, 20 nt, Human
aggaccugaaauuccaaagu

SEQ ID NO: 1407146 - RNA, 18 nt, Human
aggaccugaaauuccaaa

SEQ ID NO: 1407147 - RNA, 17 nt, Human
aggaccugaaauuccaa

SEQ ID NO: 1407148 - RNA, 19 nt, Human
aggacccugaaggggccau

SEQ ID NO: 1407149 - RNA, 15 nt, Human
aggacccugaagggg

SEQ ID NO: 1407150 - RNA, 16 nt, Human
aggaccagucccagag

SEQ ID NO: 1407151 - RNA, 22 nt, Human
agcuguaaacuuccaauuucua

SEQ ID NO: 1407152 - RNA, 13 nt, Human
agcuucugagacg

SEQ ID NO: 1407153 - RNA, 12 nt, Human
agcuucugagac

SEQ ID NO: 1407154 - RNA, 17 nt, Human
agcuucugcccccugca

SEQ ID NO: 1407155 - RNA, 19 nt, Human
agcuucugcccccugcaga

SEQ ID NO: 1407156 - RNA, 15 nt, Human
agcuucugcccccug

SEQ ID NO: 1407157 - RNA, 19 nt, Human
agcuucugagacgucauga

SEQ ID NO: 1407158 - RNA, 16 nt, Human
agcuuuuaaaagauuu

SEQ ID NO: 1407159 - RNA, 19 nt, Human
agcuucauggcagaaggca

SEQ ID NO: 1407160 - RNA, 18 nt, Human
agcuucacaguacccaaa

SEQ ID NO: 1407161 - RNA, 18 nt, Human
agcuucacuguaaaauaa

SEQ ID NO: 1407162 - RNA, 20 nt, Human
agcuuauuuccucauuuuua

SEQ ID NO: 1407163 - RNA, 20 nt, Human
aggaagucucaucuggggag

SEQ ID NO: 1407164 - RNA, 19 nt, Human
aggaagucucaucugggga

SEQ ID NO: 1407165 - RNA, 16 nt, Human
aggaagucucaucugg

SEQ ID NO: 1407166 - RNA, 18 nt, Human
aggaagucaaagcaagga

SEQ ID NO: 1407167 - RNA, 15 nt, Human
aggaaguaggaagua

SEQ ID NO: 1407168 - RNA, 14 nt, Human
aggaaguaggaagu

SEQ ID NO: 1407169 - RNA, 20 nt, Human
aggaagggguuggauugcaa

SEQ ID NO: 1407170 - RNA, 20 nt, Human
aggaaggggccagaggcucg

SEQ ID NO: 1407171 - RNA, 18 nt, Human
aggaaggggccagaggcu

SEQ ID NO: 1407172 - RNA, 16 nt, Human
aggaaggggccagagg

SEQ ID NO: 1407173 - RNA, 21 nt, Human
aggaaggcuuguugugcuuuu

SEQ ID NO: 1407174 - RNA, 22 nt, Human
aggaaggcuuguugugcuuuua

SEQ ID NO: 1407175 - RNA, 19 nt, Human
aggaaggcuuguugugcuu

SEQ ID NO: 1407176 - RNA, 23 nt, Human
aggaacuuaaauaaugugaaacu

SEQ ID NO: 1407177 - RNA, 17 nt, Human
aggaauacugaacaucu

SEQ ID NO: 1407178 - RNA, 18 nt, Human
aggaaguugacuuauagu

SEQ ID NO: 1407179 - RNA, 22 nt, Human
aggaaguugacuuauaguacau

SEQ ID NO: 1407180 - RNA, 23 nt, Human
aggaaguugacuuauaguacaug

SEQ ID NO: 1407181 - RNA, 19 nt, Human
aggaacccuuacaguagga

SEQ ID NO: 1407182 - RNA, 16 nt, Human
aggaaccgaggcaggg

SEQ ID NO: 1407183 - RNA, 21 nt, Human
aggaacuuaaauaaugugaaa

SEQ ID NO: 1407184 - RNA, 13 nt, Human
aggaaccaacaau

SEQ ID NO: 1407185 - RNA, 21 nt, Human
aggaaccaacaaucuuccugu

SEQ ID NO: 1407186 - RNA, 22 nt, Human
aggaaauucuuucccagucugu

SEQ ID NO: 1407187 - RNA, 15 nt, Human
agcuuuuaugugaaa

SEQ ID NO: 1407188 - RNA, 21 nt, Human
agcuuuuaugugaaacauguu

SEQ ID NO: 1407189 - RNA, 23 nt, Human
aggaaauguuuuuaauaaaagaa

SEQ ID NO: 1407190 - RNA, 20 nt, Human
agccaaggagucacugagac

SEQ ID NO: 1407191 - RNA, 16 nt, Human
agccaagcucugcagu

SEQ ID NO: 1407192 - RNA, 21 nt, Human
agccaaggagucacugagacc

SEQ ID NO: 1407193 - RNA, 19 nt, Human
agccaaggagucacugaga

SEQ ID NO: 1407194 - RNA, 15 nt, Human
agccaagcucugcag

SEQ ID NO: 1407195 - RNA, 11 nt, Human
agccaaagagu

SEQ ID NO: 1407196 - RNA, 21 nt, Human
agccaaaccucaccaacuccu

SEQ ID NO: 1407197 - RNA, 22 nt, Human
agcccaccauuuggcaucccug

SEQ ID NO: 1407198 - RNA, 21 nt, Human
agcccaccauuuggcaucccu

SEQ ID NO: 1407199 - RNA, 16 nt, Human
agcccaaugaaaugaa

SEQ ID NO: 1407200 - RNA, 21 nt, Human
agcccacuccaucugguagaa

SEQ ID NO: 1407201 - RNA, 16 nt, Human
agcccacuccaucugg

SEQ ID NO: 1407202 - RNA, 18 nt, Human
agcccacgcucacccccu

SEQ ID NO: 1407203 - RNA, 20 nt, Human
agcccacgacacugcagccc

SEQ ID NO: 1407204 - RNA, 19 nt, Human
agcccacgacacugcagcc

SEQ ID NO: 1407205 - RNA, 21 nt, Human
agcaggaaaugaaaaugucuu

SEQ ID NO: 1407206 - RNA, 15 nt, Human
agcaggaaaugaaaa

SEQ ID NO: 1407207 - RNA, 21 nt, Human
agcagcuuuagaaucccagcc

SEQ ID NO: 1407208 - RNA, 23 nt, Human
agcaggaaaugaaaaugucuugu

SEQ ID NO: 1407209 - RNA, 23 nt, Human
agccccacaccagggccagccuc

SEQ ID NO: 1407210 - RNA, 22 nt, Human
agccccacaccagggccagccu

SEQ ID NO: 1407211 - RNA, 16 nt, Human
agcagcuuccagauug

SEQ ID NO: 1407212 - RNA, 14 nt, Human
agcagcuuccagau

SEQ ID NO: 1407213 - RNA, 12 nt, Human
agcagcuuccag

SEQ ID NO: 1407214 - RNA, 19 nt, Human
agcagccugagcaacucuu

SEQ ID NO: 1407215 - RNA, 13 nt, Human
agcagccugagca

SEQ ID NO: 1407216 - RNA, 23 nt, Human
agcagccucgccccuggcagaga

SEQ ID NO: 1407217 - RNA, 21 nt, Human
agcagccucuccccaggucca

SEQ ID NO: 1407218 - RNA, 20 nt, Human
agcagccucuccccaggucc

SEQ ID NO: 1407219 - RNA, 18 nt, Human
agcagccucuccccaggu

SEQ ID NO: 1407220 - RNA, 15 nt, Human
agcagccucucccca

SEQ ID NO: 1407221 - RNA, 22 nt, Human
agcagccucgccccuggcagag

SEQ ID NO: 1407222 - RNA, 21 nt, Human
agcagccucgccccuggcaga

SEQ ID NO: 1407223 - RNA, 20 nt, Human
agcagccucgccccuggcag

SEQ ID NO: 1407224 - RNA, 17 nt, Human
agcagccucgccccugg

SEQ ID NO: 1407225 - RNA, 15 nt, Human
agcacuucuuuuucu

SEQ ID NO: 1407226 - RNA, 22 nt, Human
agcacuugcaaccgucuguuau

SEQ ID NO: 1407227 - RNA, 15 nt, Human
agcacuuauuuaaug

SEQ ID NO: 1407228 - RNA, 21 nt, Human
agcacggcucuguccccagcc

SEQ ID NO: 1407229 - RNA, 20 nt, Human
agcacggcucuguccccagc

SEQ ID NO: 1407230 - RNA, 15 nt, Human
agcacggcucugucc

SEQ ID NO: 1407231 - RNA, 14 nt, Human
agcacacagggcag

SEQ ID NO: 1407232 - RNA, 17 nt, Human
agcacgauuucuguuua

SEQ ID NO: 1407233 - RNA, 19 nt, Human
agcacgauuucuguuuaga

SEQ ID NO: 1407234 - RNA, 21 nt, Human
agcacgauuucuguuuagaua

SEQ ID NO: 1407235 - RNA, 15 nt, Human
agcaauccucccacu

SEQ ID NO: 1407236 - RNA, 15 nt, Human
agcaaugccugccca

SEQ ID NO: 1407237 - RNA, 18 nt, Human
agcacaauaaauggcugu

SEQ ID NO: 1407238 - RNA, 17 nt, Human
agcacaauaaauggcug

SEQ ID NO: 1407239 - RNA, 21 nt, Human
agcacaaguuauuuaaaucug

SEQ ID NO: 1407240 - RNA, 13 nt, Human
agcacaaauuagu

SEQ ID NO: 1407241 - RNA, 19 nt, Human
agcacaaguuauuuaaauc

SEQ ID NO: 1407242 - RNA, 18 nt, Human
agcacaaguuauuuaaau

SEQ ID NO: 1407243 - RNA, 17 nt, Human
agcacaaguuauuuaaa

SEQ ID NO: 1407244 - RNA, 19 nt, Human
agcacaaauuaguuauaua

SEQ ID NO: 1407245 - RNA, 19 nt, Human
agcacaaagacccuggcuu

SEQ ID NO: 1407246 - RNA, 18 nt, Human
agcacaaagacccuggcu

SEQ ID NO: 1407247 - RNA, 21 nt, Human
agcaauuacaacggagucaaa

SEQ ID NO: 1407248 - RNA, 21 nt, Human
agcaaaugucaugcugccuua

SEQ ID NO: 1407249 - RNA, 20 nt, Human
agcaaaugucaugcugccuu

SEQ ID NO: 1407250 - RNA, 19 nt, Human
agcaaaugucaugcugccu

SEQ ID NO: 1407251 - RNA, 20 nt, Human
agcaaauggccucaugucaa

SEQ ID NO: 1407252 - RNA, 15 nt, Human
agcaaauggccucau

SEQ ID NO: 1407253 - RNA, 22 nt, Human
agcaaaugcaaaaacucuuuga

SEQ ID NO: 1407254 - RNA, 14 nt, Human
agcaaaugcaaaaa

SEQ ID NO: 1407255 - RNA, 13 nt, Human
agcaaaugcaaaa

SEQ ID NO: 1407256 - RNA, 22 nt, Human
agcaaaucgaaugaaauuaacu

SEQ ID NO: 1407257 - RNA, 20 nt, Human
agcaaaucgaaugaaauuaa

SEQ ID NO: 1407258 - RNA, 22 nt, Human
agcaaagccuguucauggcaga

SEQ ID NO: 1407259 - RNA, 21 nt, Human
agcaaagccuguucauggcag

SEQ ID NO: 1407260 - RNA, 12 nt, Human
agcaaagccugu

SEQ ID NO: 1407261 - RNA, 23 nt, Human
agauugaccuggauggggcaggc

SEQ ID NO: 1407262 - RNA, 20 nt, Human
agauugaaccugaauauugc

SEQ ID NO: 1407263 - RNA, 22 nt, Human
agcaaagcccccagagcccagg

SEQ ID NO: 1407264 - RNA, 21 nt, Human
agcaaagcccccagagcccag

SEQ ID NO: 1407265 - RNA, 17 nt, Human
agcaaagcccccagagc

SEQ ID NO: 1407266 - RNA, 16 nt, Human
agcaaagcccccagag

SEQ ID NO: 1407267 - RNA, 15 nt, Human
agcaaagcccccaga

SEQ ID NO: 1407268 - RNA, 13 nt, Human
agcaaaccuguaa

SEQ ID NO: 1407269 - RNA, 21 nt, Human
agcaaaagaauggcagaaaag

SEQ ID NO: 1407270 - RNA, 17 nt, Human
agcaaaagaauggcaga

SEQ ID NO: 1407271 - RNA, 14 nt, Human
agcaaaagaagaag

SEQ ID NO: 1407272 - RNA, 13 nt, Human
agauugaccugga

SEQ ID NO: 1407273 - RNA, 21 nt, Human
agcaaaauaauuuuaaacaaa

SEQ ID NO: 1407274 - RNA, 24 nt, Human
agcaaaauuuuuucucuaggaaau

SEQ ID NO: 1407275 - RNA, 21 nt, Human
agagugcuguccgguggagau

SEQ ID NO: 1407276 - RNA, 22 nt, Human
agagugauagucuuuugcuuuu

SEQ ID NO: 1407277 - RNA, 20 nt, Human
agagugauagucuuuugcuu

SEQ ID NO: 1407278 - RNA, 15 nt, Human
agaugaaguuuuaca

SEQ ID NO: 1407279 - RNA, 16 nt, Human
agaugaaggagaggca

SEQ ID NO: 1407280 - RNA, 17 nt, Human
agaucuguccucagccu

SEQ ID NO: 1407281 - RNA, 15 nt, Human
agaucuguccucagc

SEQ ID NO: 1407282 - RNA, 18 nt, Human
agaucuguccucagccuu

SEQ ID NO: 1407283 - RNA, 14 nt, Human
agaucuguccucag

SEQ ID NO: 1407284 - RNA, 13 nt, Human
agaucuggcaugu

SEQ ID NO: 1407285 - RNA, 20 nt, Human
agaucuggaaccucagccug

SEQ ID NO: 1407286 - RNA, 19 nt, Human
agaucuggaaccucagccu

SEQ ID NO: 1407287 - RNA, 17 nt, Human
agaucuggaaccucagc

SEQ ID NO: 1407288 - RNA, 15 nt, Human
agaucuggaaccuca

SEQ ID NO: 1407289 - RNA, 14 nt, Human
agaucuggaaccuc

SEQ ID NO: 1407290 - RNA, 13 nt, Human
agaucuggaaccu

SEQ ID NO: 1407291 - RNA, 14 nt, Human
agaugguggcagua

SEQ ID NO: 1407292 - RNA, 20 nt, Human
agaugauacauccaaagcag

SEQ ID NO: 1407293 - RNA, 16 nt, Human
agaugauacauccaaa

SEQ ID NO: 1407294 - RNA, 18 nt, Human
agaugauaaagagacagu

SEQ ID NO: 1407295 - RNA, 16 nt, Human
agaugauaaagagaca

SEQ ID NO: 1407296 - RNA, 14 nt, Human
agaugauaaagaga

SEQ ID NO: 1407297 - RNA, 19 nt, Human
agaugaaguuuuacauugu

SEQ ID NO: 1407298 - RNA, 14 nt, Human
agaugagugagcau

SEQ ID NO: 1407299 - RNA, 17 nt, Human
agauguaaaagguauua

SEQ ID NO: 1407300 - RNA, 13 nt, Human
agauucugccuuu

SEQ ID NO: 1407301 - RNA, 14 nt, Human
agauucugauuuua

SEQ ID NO: 1407302 - RNA, 23 nt, Human
agauucucugugucuaagauucu

SEQ ID NO: 1407303 - RNA, 22 nt, Human
agauucucugugucuaagauuc

SEQ ID NO: 1407304 - RNA, 20 nt, Human
agauucucugugucuaagau

SEQ ID NO: 1407305 - RNA, 19 nt, Human
agauucucugugucuaaga

SEQ ID NO: 1407306 - RNA, 19 nt, Human
agauucugccuuugccagg

SEQ ID NO: 1407307 - RNA, 17 nt, Human
agauucucugugucuaa

SEQ ID NO: 1407308 - RNA, 16 nt, Human
agauucucugugucua

SEQ ID NO: 1407309 - RNA, 23 nt, Human
agauucucuggcuguaaggcucu

SEQ ID NO: 1407310 - RNA, 20 nt, Human
agauucucauaacuugagac

SEQ ID NO: 1407311 - RNA, 21 nt, Human
agauucucuggcuguaaggcu

SEQ ID NO: 1407312 - RNA, 17 nt, Human
agauucucccuugcucu

SEQ ID NO: 1407313 - RNA, 19 nt, Human
agauucucauaacuugaga

SEQ ID NO: 1407314 - RNA, 13 nt, Human
agauucucaaagg

SEQ ID NO: 1407315 - RNA, 21 nt, Human
agauguagccccucuccugga

SEQ ID NO: 1407316 - RNA, 19 nt, Human
agacaaauagaaaaugguc

SEQ ID NO: 1407317 - RNA, 21 nt, Human
agacaaacuuugcaucucagu

SEQ ID NO: 1407318 - RNA, 18 nt, Human
agacaaagguuuuccucu

SEQ ID NO: 1407319 - RNA, 15 nt, Human
agacaaacuuugcau

SEQ ID NO: 1407320 - RNA, 19 nt, Human
agacaaacaccucccagga

SEQ ID NO: 1407321 - RNA, 20 nt, Human
agacaaugacuuacuguaca

SEQ ID NO: 1407322 - RNA, 21 nt, Human
agacaaugacuuacuguacau

SEQ ID NO: 1407323 - RNA, 22 nt, Human
agacaaugacuuacuguacaug

SEQ ID NO: 1407324 - RNA, 23 nt, Human
agacaaugacuuacuguacauga

SEQ ID NO: 1407325 - RNA, 13 nt, Human
agacgccuggcug

SEQ ID NO: 1407326 - RNA, 15 nt, Human
agacgccugaggaac

SEQ ID NO: 1407327 - RNA, 13 nt, Human
agacgccugagga

SEQ ID NO: 1407328 - RNA, 23 nt, Human
agacgcacuuuggcuuauaauuc

SEQ ID NO: 1407329 - RNA, 14 nt, Human
agacccagcggaca

SEQ ID NO: 1407330 - RNA, 19 nt, Human
agacccagcccucaucccg

SEQ ID NO: 1407331 - RNA, 18 nt, Human
agacccagcccucauccc

SEQ ID NO: 1407332 - RNA, 17 nt, Human
agacccagcccucaucc

SEQ ID NO: 1407333 - RNA, 20 nt, Human
agaccagcagacagagccag

SEQ ID NO: 1407334 - RNA, 21 nt, Human
agaccagcagacagagccagg

SEQ ID NO: 1407335 - RNA, 16 nt, Human
agaccagcagacagag

SEQ ID NO: 1407336 - RNA, 15 nt, Human
agaccagcagacaga

SEQ ID NO: 1407337 - RNA, 18 nt, Human
agacagaggcccucaagu

SEQ ID NO: 1407338 - RNA, 16 nt, Human
agacagaggcccucaa

SEQ ID NO: 1407339 - RNA, 15 nt, Human
agacagaggcccuca

SEQ ID NO: 1407340 - RNA, 14 nt, Human
agaccacugccaua

SEQ ID NO: 1407341 - RNA, 22 nt, Human
agacagccaacuauggccugug

SEQ ID NO: 1407342 - RNA, 20 nt, Human
agaauggaucacaagaugga

SEQ ID NO: 1407343 - RNA, 16 nt, Human
agaauggcagaaaagu

SEQ ID NO: 1407344 - RNA, 19 nt, Human
agaauggaucacaagaugg

SEQ ID NO: 1407345 - RNA, 14 nt, Human
agaaugcuuaauca

SEQ ID NO: 1407346 - RNA, 20 nt, Human
agaaugcuuaaucagauaga

SEQ ID NO: 1407347 - RNA, 20 nt, Human
agaaugcuguacaucuauuu

SEQ ID NO: 1407348 - RNA, 15 nt, Human
agaaugcuguacauc

SEQ ID NO: 1407349 - RNA, 14 nt, Human
agaaugcuguacau

SEQ ID NO: 1407350 - RNA, 13 nt, Human
agaaugcuguaca

SEQ ID NO: 1407351 - RNA, 14 nt, Human
agaaugauuucaug

SEQ ID NO: 1407352 - RNA, 13 nt, Human
agaaugauuucau

SEQ ID NO: 1407353 - RNA, 23 nt, Human
agaauggcuuuggucucuugcuu

SEQ ID NO: 1407354 - RNA, 18 nt, Human
agaauggcuuuggucucu

SEQ ID NO: 1407355 - RNA, 14 nt, Human
agaaugagacaucc

SEQ ID NO: 1407356 - RNA, 17 nt, Human
agaaugauuaugaauua

SEQ ID NO: 1407357 - RNA, 22 nt, Human
agaaugagagacacacugaaga

SEQ ID NO: 1407358 - RNA, 17 nt, Human
agaaugagagacacacu

SEQ ID NO: 1407359 - RNA, 21 nt, Human
agaagugaaugcugggacuca

SEQ ID NO: 1407360 - RNA, 19 nt, Human
agaagugaaugcugggacu

SEQ ID NO: 1407361 - RNA, 17 nt, Human
agaagugaaugcuggga

SEQ ID NO: 1407362 - RNA, 16 nt, Human
agaagugaaugcuggg

SEQ ID NO: 1407363 - RNA, 15 nt, Human
agaagugaagaaugc

SEQ ID NO: 1407364 - RNA, 22 nt, Human
agaagucaucuugcuaccagua

SEQ ID NO: 1407365 - RNA, 16 nt, Human
agaagucaucuugcua

SEQ ID NO: 1407366 - RNA, 15 nt, Human
agaagucaucuugcu

SEQ ID NO: 1407367 - RNA, 22 nt, Human
agaagucacauuccugaacagg

SEQ ID NO: 1407368 - RNA, 13 nt, Human
agaagacaggcug

SEQ ID NO: 1407369 - RNA, 18 nt, Human
agaagacaggcuggaaga

SEQ ID NO: 1407370 - RNA, 15 nt, Human
agaagacaauugaca

SEQ ID NO: 1407371 - RNA, 19 nt, Human
acuuuccuccugaggcuuu

SEQ ID NO: 1407372 - RNA, 23 nt, Human
acuuuccccaccagaugcugaaa

SEQ ID NO: 1407373 - RNA, 21 nt, Human
acuuucccuacccucuagaga

SEQ ID NO: 1407374 - RNA, 21 nt, Human
acuuuccccaccagaugcuga

SEQ ID NO: 1407375 - RNA, 20 nt, Human
acuuuccccaccagaugcug

SEQ ID NO: 1407376 - RNA, 19 nt, Human
acuuuccccaccagaugcu

SEQ ID NO: 1407377 - RNA, 17 nt, Human
acuuuccccaccagaug

SEQ ID NO: 1407378 - RNA, 21 nt, Human
acuuuccauuacaaguauuuu

SEQ ID NO: 1407379 - RNA, 17 nt, Human
acuuuccauuacaagua

SEQ ID NO: 1407380 - RNA, 15 nt, Human
acuuuccauuacaag

SEQ ID NO: 1407381 - RNA, 13 nt, Human
acuuucccuaccc

SEQ ID NO: 1407382 - RNA, 17 nt, Human
agaagaccugagaaugu

SEQ ID NO: 1407383 - RNA, 18 nt, Human
agaagacugcauuauauu

SEQ ID NO: 1407384 - RNA, 20 nt, Human
agaagguugcucuagauuga

SEQ ID NO: 1407385 - RNA, 16 nt, Human
agaagguugcucuaga

SEQ ID NO: 1407386 - RNA, 16 nt, Human
agaaguaccagacuag

SEQ ID NO: 1407387 - RNA, 14 nt, Human
agaaguaccagacu

SEQ ID NO: 1407388 - RNA, 15 nt, Human
agaaguaaaagcaaa

SEQ ID NO: 1407389 - RNA, 22 nt, Human
agaaguaaaagcaaaaaagaaa

SEQ ID NO: 1407390 - RNA, 13 nt, Human
agaaguauacaua

SEQ ID NO: 1407391 - RNA, 19 nt, Human
agaaguauaaagaauugug

SEQ ID NO: 1407392 - RNA, 16 nt, Human
agaaguauaaagaauu

SEQ ID NO: 1407393 - RNA, 15 nt, Human
agaaguauaaagaau

SEQ ID NO: 1407394 - RNA, 17 nt, Human
agaaguagaaaucauag

SEQ ID NO: 1407395 - RNA, 21 nt, Human
agaagucacauuccugaacag

SEQ ID NO: 1407396 - RNA, 20 nt, Human
agaagucacauuccugaaca

SEQ ID NO: 1407397 - RNA, 18 nt, Human
agaagucacauuccugaa

SEQ ID NO: 1407398 - RNA, 17 nt, Human
agaagagaucaggaaga

SEQ ID NO: 1407399 - RNA, 15 nt, Human
agaaggggagaugga

SEQ ID NO: 1407400 - RNA, 18 nt, Human
agagccggguguccccaa

SEQ ID NO: 1407401 - RNA, 23 nt, Human
agagccggggugggguggcugca

SEQ ID NO: 1407402 - RNA, 22 nt, Human
agagccggggugggguggcugc

SEQ ID NO: 1407403 - RNA, 19 nt, Human
agagccaugucuucucccu

SEQ ID NO: 1407404 - RNA, 22 nt, Human
agagccaugucuucucccugga

SEQ ID NO: 1407405 - RNA, 11 nt, Human
agagccugagg

SEQ ID NO: 1407406 - RNA, 20 nt, Human
agagccuccuuucuggcuuu

SEQ ID NO: 1407407 - RNA, 20 nt, Human
agagaggccuuuuggaaugu

SEQ ID NO: 1407408 - RNA, 14 nt, Human
agagaggccuuuug

SEQ ID NO: 1407409 - RNA, 23 nt, Human
agagagagggccugcuggagagc

SEQ ID NO: 1407410 - RNA, 14 nt, Human
agagagagagggcc

SEQ ID NO: 1407411 - RNA, 17 nt, Human
agacuggacagcuugug

SEQ ID NO: 1407412 - RNA, 16 nt, Human
agacuggacagcuugu

SEQ ID NO: 1407413 - RNA, 15 nt, Human
agacuggacagcuug

SEQ ID NO: 1407414 - RNA, 14 nt, Human
agacuggacagcuu

SEQ ID NO: 1407415 - RNA, 13 nt, Human
agacuggacagcu

SEQ ID NO: 1407416 - RNA, 11 nt, Human
agacuggacag

SEQ ID NO: 1407417 - RNA, 23 nt, Human
agacuggaacuugaacugauuca

SEQ ID NO: 1407418 - RNA, 21 nt, Human
agacuggaagcuaauuugcau

SEQ ID NO: 1407419 - RNA, 15 nt, Human
agacuggaacacuag

SEQ ID NO: 1407420 - RNA, 18 nt, Human
agacuggaacuugaacug

SEQ ID NO: 1407421 - RNA, 17 nt, Human
agacuggaacuugaacu

SEQ ID NO: 1407422 - RNA, 13 nt, Human
agacuggaacuug

SEQ ID NO: 1407423 - RNA, 18 nt, Human
agacuggaacacuagaca

SEQ ID NO: 1407424 - RNA, 20 nt, Human
agacuggauaguccgucucu

SEQ ID NO: 1407425 - RNA, 16 nt, Human
agacuggauaguccgu

SEQ ID NO: 1407426 - RNA, 19 nt, Human
agacugcuuccaauuuucu

SEQ ID NO: 1407427 - RNA, 21 nt, Human
agacugcuguggccaggaggu

SEQ ID NO: 1407428 - RNA, 20 nt, Human
agacugcuguggccaggagg

SEQ ID NO: 1407429 - RNA, 19 nt, Human
agacugcuguggccaggag

SEQ ID NO: 1407430 - RNA, 18 nt, Human
agacugcuguggccagga

SEQ ID NO: 1407431 - RNA, 17 nt, Human
agacugcuguggccagg

SEQ ID NO: 1407432 - RNA, 16 nt, Human
agacugcuguggccag

SEQ ID NO: 1407433 - RNA, 22 nt, Human
agacugaguacguugugcauuu

SEQ ID NO: 1407434 - RNA, 23 nt, Human
agacugaguacguugugcauuug

SEQ ID NO: 1407435 - RNA, 22 nt, Human
agacucuugccuguuucccagg

SEQ ID NO: 1407436 - RNA, 18 nt, Human
agacucuugccuguuucc

SEQ ID NO: 1407437 - RNA, 17 nt, Human
agacucuugccuguuuc

SEQ ID NO: 1407438 - RNA, 14 nt, Human
agacugacgccagg

SEQ ID NO: 1407439 - RNA, 14 nt, Human
agacucuuuaugcu

SEQ ID NO: 1407440 - RNA, 20 nt, Human
agacugaguacguugugcau

SEQ ID NO: 1407441 - RNA, 18 nt, Human
agacgccuuucuccucca

SEQ ID NO: 1407442 - RNA, 15 nt, Human
agacgccuggcugcu

SEQ ID NO: 1407443 - RNA, 14 nt, Human
agacgccuggcugc

SEQ ID NO: 1407444 - RNA, 15 nt, Human
agacgcugcugucac

SEQ ID NO: 1407445 - RNA, 20 nt, Human
agaggaaggggccagaggcu

SEQ ID NO: 1407446 - RNA, 18 nt, Human
agaggaaggggccagagg

SEQ ID NO: 1407447 - RNA, 16 nt, Human
agaggaaggggccaga

SEQ ID NO: 1407448 - RNA, 23 nt, Human
agaggaaggggccagaggcucgu

SEQ ID NO: 1407449 - RNA, 20 nt, Human
agagggcucgaggggugggc

SEQ ID NO: 1407450 - RNA, 16 nt, Human
agagggcgcaggccgu

SEQ ID NO: 1407451 - RNA, 14 nt, Human
agagggcgcaggcc

SEQ ID NO: 1407452 - RNA, 10 nt, Human
agagggcugc

SEQ ID NO: 1407453 - RNA, 16 nt, Human
agagggggcugguggg

SEQ ID NO: 1407454 - RNA, 19 nt, Human
agagggggcuggugggugc

SEQ ID NO: 1407455 - RNA, 14 nt, Human
agagggggcuggug

SEQ ID NO: 1407456 - RNA, 19 nt, Human
agagggcuggaggcccagg

SEQ ID NO: 1407457 - RNA, 18 nt, Human
agagggcuggaggcccag

SEQ ID NO: 1407458 - RNA, 17 nt, Human
agagggcuggaggccca

SEQ ID NO: 1407459 - RNA, 12 nt, Human
agagggcuggag

SEQ ID NO: 1407460 - RNA, 11 nt, Human
agagggcugga

SEQ ID NO: 1407461 - RNA, 12 nt, Human
agaggaggcagc

SEQ ID NO: 1407462 - RNA, 16 nt, Human
agaggaggcagcagga

SEQ ID NO: 1407463 - RNA, 18 nt, Human
agaggaauuacgugcucu

SEQ ID NO: 1407464 - RNA, 20 nt, Human
aaaucugacccagugccccc

SEQ ID NO: 1407465 - RNA, 14 nt, Human
aaaucugacccagu

SEQ ID NO: 1407466 - RNA, 23 nt, Human
aaaucucuccacuuucagcuguc

SEQ ID NO: 1407467 - RNA, 21 nt, Human
aaaucucuccacuuucagcug

SEQ ID NO: 1407468 - RNA, 20 nt, Human
aaaucucuccacuuucagcu

SEQ ID NO: 1407469 - RNA, 19 nt, Human
aaaucucuccacuuucagc

SEQ ID NO: 1407470 - RNA, 17 nt, Human
aaaucucuccacuuuca

SEQ ID NO: 1407471 - RNA, 13 nt, Human
aaaucucuccacu

SEQ ID NO: 1407472 - RNA, 20 nt, Human
aaaucucccauuuuggaauu

SEQ ID NO: 1407473 - RNA, 18 nt, Human
aaaucucccauuuuggaa

SEQ ID NO: 1407474 - RNA, 21 nt, Human
aaaucucccauuuuggaauuu

SEQ ID NO: 1407475 - RNA, 16 nt, Human
aaaucucccauuuugg

SEQ ID NO: 1407476 - RNA, 22 nt, Human
aaaucuccaaaauaaaacuuuu

SEQ ID NO: 1407477 - RNA, 18 nt, Human
aaaugcuagguucuaccu

SEQ ID NO: 1407478 - RNA, 16 nt, Human
aaaugcuagguucuac

SEQ ID NO: 1407479 - RNA, 15 nt, Human
aaaugcuagguucua

SEQ ID NO: 1407480 - RNA, 19 nt, Human
aaaucugugccugagaaca

SEQ ID NO: 1407481 - RNA, 11 nt, Human
aaaucugccac

SEQ ID NO: 1407482 - RNA, 18 nt, Human
aaaucugacccagugccc

SEQ ID NO: 1407483 - RNA, 20 nt, Human
aaaucugcuggaguuucaug

SEQ ID NO: 1407484 - RNA, 19 nt, Human
aaaucugccacaaaaacag

SEQ ID NO: 1407485 - RNA, 22 nt, Human
aaaucugcuggaguuucaugua

SEQ ID NO: 1407486 - RNA, 16 nt, Human
aacaaauagucuauca

SEQ ID NO: 1407487 - RNA, 16 nt, Human
aacaaagguugagaug

SEQ ID NO: 1407488 - RNA, 22 nt, Human
aacaaaggccuaauucuaugcc

SEQ ID NO: 1407489 - RNA, 16 nt, Human
aacaaacucguuuuuu

SEQ ID NO: 1407490 - RNA, 20 nt, Human
aacaaacucguuuuuuacaa

SEQ ID NO: 1407491 - RNA, 23 nt, Human
aacaaaugccaaauuaaaaaaga

SEQ ID NO: 1407492 - RNA, 17 nt, Human
aacaaaugccaaauuaa

SEQ ID NO: 1407493 - RNA, 19 nt, Human
aacaaaugccaaauuaaaa

SEQ ID NO: 1407494 - RNA, 16 nt, Human
aacacuaauucauaau

SEQ ID NO: 1407495 - RNA, 15 nt, Human
aacacuaauucauaa

SEQ ID NO: 1407496 - RNA, 14 nt, Human
aacacuaauucaua

SEQ ID NO: 1407497 - RNA, 23 nt, Human
aacacuaauauauuuaaaaauaa

SEQ ID NO: 1407498 - RNA, 22 nt, Human
aacacuaauauauuuaaaaaua

SEQ ID NO: 1407499 - RNA, 20 nt, Human
aacacuaauauauuuaaaaa

SEQ ID NO: 1407500 - RNA, 14 nt, Human
aacacuaauauauu

SEQ ID NO: 1407501 - RNA, 13 nt, Human
aacacuaauauau

SEQ ID NO: 1407502 - RNA, 18 nt, Human
aacacuaacuaugcaugg

SEQ ID NO: 1407503 - RNA, 17 nt, Human
aacacccauuuuuccuu

SEQ ID NO: 1407504 - RNA, 16 nt, Human
aacaccuccucaugua

SEQ ID NO: 1407505 - RNA, 23 nt, Human
aacaccucccaggagacaguuca

SEQ ID NO: 1407506 - RNA, 13 nt, Human
aacaccucccagg

SEQ ID NO: 1407507 - RNA, 21 nt, Human
aacacccauuuuuccuuuugc

SEQ ID NO: 1407508 - RNA, 16 nt, Human
aacacccauuuuuccu

SEQ ID NO: 1407509 - RNA, 16 nt, Human
aacacccuauauuuug

SEQ ID NO: 1407510 - RNA, 17 nt, Human
aacacccucacacuggg

SEQ ID NO: 1407511 - RNA, 21 nt, Human
aacacccucacacugggacuu

SEQ ID NO: 1407512 - RNA, 21 nt, Human
aaauuaacuggguaaugaaac

SEQ ID NO: 1407513 - RNA, 20 nt, Human
aaauuaacuggguaaugaaa

SEQ ID NO: 1407514 - RNA, 16 nt, Human
aaauuaaaaaagauaa

SEQ ID NO: 1407515 - RNA, 20 nt, Human
aaauuaaaaaagauaaacac

SEQ ID NO: 1407516 - RNA, 12 nt, Human
aaauuaacuuuu

SEQ ID NO: 1407517 - RNA, 15 nt, Human
aaauuaaaaaagaua

SEQ ID NO: 1407518 - RNA, 14 nt, Human
aaauuaaaaaagau

SEQ ID NO: 1407519 - RNA, 12 nt, Human
aaauuaaaaaag

SEQ ID NO: 1407520 - RNA, 23 nt, Human
aaauguuuuuggucuuuuauaau

SEQ ID NO: 1407521 - RNA, 22 nt, Human
aaauguuuuuuuuuaaagacuu

SEQ ID NO: 1407522 - RNA, 13 nt, Human
aaauuaacuuuua

SEQ ID NO: 1407523 - RNA, 14 nt, Human
aaauuaacuuuuau

SEQ ID NO: 1407524 - RNA, 19 nt, Human
aaauuaacuuuuauaaacu

SEQ ID NO: 1407525 - RNA, 18 nt, Human
aacaaacauuugcugaau

SEQ ID NO: 1407526 - RNA, 23 nt, Human
aaauugagcuggaccucaccaag

SEQ ID NO: 1407527 - RNA, 18 nt, Human
aaauugaugggauuuggu

SEQ ID NO: 1407528 - RNA, 23 nt, Human
aaauguugaaauaugauguuaaa

SEQ ID NO: 1407529 - RNA, 11 nt, Human
aaauguucuuu

SEQ ID NO: 1407530 - RNA, 15 nt, Human
aaauguucuguuugc

SEQ ID NO: 1407531 - RNA, 21 nt, Human
aaauguucuaaguuucuaaga

SEQ ID NO: 1407532 - RNA, 19 nt, Human
aaauguucuaaguuucuaa

SEQ ID NO: 1407533 - RNA, 17 nt, Human
aaauguucuaaguuucu

SEQ ID NO: 1407534 - RNA, 14 nt, Human
aaauguucuaaguu

SEQ ID NO: 1407535 - RNA, 13 nt, Human
aaauguucuaagu

SEQ ID NO: 1407536 - RNA, 18 nt, Human
aaauguuuuuuuuuaaag

SEQ ID NO: 1407537 - RNA, 21 nt, Human
aaauguuuuuuuuuaaagacu

SEQ ID NO: 1407538 - RNA, 12 nt, Human
aacgccugagcc

SEQ ID NO: 1407539 - RNA, 11 nt, Human
aacgccugagc

SEQ ID NO: 1407540 - RNA, 21 nt, Human
aacgagacuuuccauuacaag

SEQ ID NO: 1407541 - RNA, 16 nt, Human
aacgagacuuuccauu

SEQ ID NO: 1407542 - RNA, 16 nt, Human
aacgaaaaugaaagcu

SEQ ID NO: 1407543 - RNA, 21 nt, Human
aacucaaaugugaguguuuuu

SEQ ID NO: 1407544 - RNA, 23 nt, Human
aacucaaauggggccagauccag

SEQ ID NO: 1407545 - RNA, 22 nt, Human
aacucaaauggggccagaucca

SEQ ID NO: 1407546 - RNA, 21 nt, Human
aacucaaauggggccagaucc

SEQ ID NO: 1407547 - RNA, 18 nt, Human
aacucaaauggggccaga

SEQ ID NO: 1407548 - RNA, 22 nt, Human
aacucaaacugaggaauuucac

SEQ ID NO: 1407549 - RNA, 16 nt, Human
aacucaaaauauuugu

SEQ ID NO: 1407550 - RNA, 13 nt, Human
aacggugcucagg

SEQ ID NO: 1407551 - RNA, 15 nt, Human
aacguauaaaagccu

SEQ ID NO: 1407552 - RNA, 18 nt, Human
aacgccugagcccaggga

SEQ ID NO: 1407553 - RNA, 17 nt, Human
aacgccugagcccaggg

SEQ ID NO: 1407554 - RNA, 13 nt, Human
aacgccugagccc

SEQ ID NO: 1407555 - RNA, 19 nt, Human
aacgccugagcccagggag

SEQ ID NO: 1407556 - RNA, 20 nt, Human
aacgcuccaaagucauaauu

SEQ ID NO: 1407557 - RNA, 16 nt, Human
aacgcuccaaagucau

SEQ ID NO: 1407558 - RNA, 16 nt, Human
aacgcuaucugggaag

SEQ ID NO: 1407559 - RNA, 16 nt, Human
aacugaggaauuuucu

SEQ ID NO: 1407560 - RNA, 18 nt, Human
aacugaggaauuucaccu

SEQ ID NO: 1407561 - RNA, 13 nt, Human
aacugaggaauuu

SEQ ID NO: 1407562 - RNA, 12 nt, Human
aacugaggaauu

SEQ ID NO: 1407563 - RNA, 14 nt, Human
aacugaauaccacu

SEQ ID NO: 1407564 - RNA, 13 nt, Human
aacugaauaccac

SEQ ID NO: 1407565 - RNA, 19 nt, Human
aacugaagggggcggccua

SEQ ID NO: 1407566 - RNA, 21 nt, Human
aacugaauaccacucuguaau

SEQ ID NO: 1407567 - RNA, 18 nt, Human
aacugaauaccacucugu

SEQ ID NO: 1407568 - RNA, 17 nt, Human
aacugaauaccacucug

SEQ ID NO: 1407569 - RNA, 15 nt, Human
aacugaauaccacuc

SEQ ID NO: 1407570 - RNA, 24 nt, Human
aacugaauaccacucuguaauugc

SEQ ID NO: 1407571 - RNA, 12 nt, Human
aacugaaugaga

SEQ ID NO: 1407572 - RNA, 18 nt, Human
aacucauauuuucaugcu

SEQ ID NO: 1407573 - RNA, 16 nt, Human
aacucauauuuucaug

SEQ ID NO: 1407574 - RNA, 15 nt, Human
aacucauauuuucau

SEQ ID NO: 1407575 - RNA, 21 nt, Human
aacugaagcagccucucccca

SEQ ID NO: 1407576 - RNA, 22 nt, Human
aacucaucuagguaaauuacag

SEQ ID NO: 1407577 - RNA, 16 nt, Human
aaccgcuaaaagaaac

SEQ ID NO: 1407578 - RNA, 22 nt, Human
aaccgccagcucuguucuuccu

SEQ ID NO: 1407579 - RNA, 17 nt, Human
aaccgccagcucuguuc

SEQ ID NO: 1407580 - RNA, 15 nt, Human
aaccgccagcucugu

SEQ ID NO: 1407581 - RNA, 14 nt, Human
aaccgccagcucug

SEQ ID NO: 1407582 - RNA, 16 nt, Human
aacaucugaguccugg

SEQ ID NO: 1407583 - RNA, 21 nt, Human
aacaucugagaaaagcuuuga

SEQ ID NO: 1407584 - RNA, 22 nt, Human
aaccagguccaaugagcuuucu

SEQ ID NO: 1407585 - RNA, 21 nt, Human
aaccagguccaaugagcuuuc

SEQ ID NO: 1407586 - RNA, 17 nt, Human
aaccagguccaaugagc

SEQ ID NO: 1407587 - RNA, 16 nt, Human
aaccagguccaaugag

SEQ ID NO: 1407588 - RNA, 22 nt, Human
aaccauagcacaggcuaauuuu

SEQ ID NO: 1407589 - RNA, 22 nt, Human
aaccauacaaaaauuccuuuuc

SEQ ID NO: 1407590 - RNA, 18 nt, Human
aaccauaacaacuucaua

SEQ ID NO: 1407591 - RNA, 19 nt, Human
aaccaguguuguggauuua

SEQ ID NO: 1407592 - RNA, 19 nt, Human
aacacuagacaagccagaa

SEQ ID NO: 1407593 - RNA, 18 nt, Human
aacacuagacaagccaga

SEQ ID NO: 1407594 - RNA, 17 nt, Human
aacacuaauucauaauc

SEQ ID NO: 1407595 - RNA, 15 nt, Human
aacagauuuggaaag

SEQ ID NO: 1407596 - RNA, 14 nt, Human
aacagauuuggaaa

SEQ ID NO: 1407597 - RNA, 13 nt, Human
aacagauuuggaa

SEQ ID NO: 1407598 - RNA, 16 nt, Human
aacagauuguuugcaa

SEQ ID NO: 1407599 - RNA, 15 nt, Human
aacagauuguuugca

SEQ ID NO: 1407600 - RNA, 13 nt, Human
aacagcgcccaaa

SEQ ID NO: 1407601 - RNA, 20 nt, Human
aacagcaaaugcaaaaacuc

SEQ ID NO: 1407602 - RNA, 23 nt, Human
aacagcguuccuagagaagacag

SEQ ID NO: 1407603 - RNA, 19 nt, Human
aacagcguuccuagagaag

SEQ ID NO: 1407604 - RNA, 20 nt, Human
aacaggaaacuccugugacc

SEQ ID NO: 1407605 - RNA, 17 nt, Human
aacaucccuuuuucaau

SEQ ID NO: 1407606 - RNA, 20 nt, Human
aacaggaucaguuaacuauu

SEQ ID NO: 1407607 - RNA, 13 nt, Human
aaaauuaagaaag

SEQ ID NO: 1407608 - RNA, 20 nt, Human
aaaauuaagaaaggauaaag

SEQ ID NO: 1407609 - RNA, 19 nt, Human
aaaauccauacauuugugu

SEQ ID NO: 1407610 - RNA, 20 nt, Human
aaaauuaaaccggaccaucu

SEQ ID NO: 1407611 - RNA, 22 nt, Human
aaaauuaacaugaauauuuagu

SEQ ID NO: 1407612 - RNA, 12 nt, Human
aaaauuaagaaa

SEQ ID NO: 1407613 - RNA, 23 nt, Human
aaaauuagacugugauucagaaa

SEQ ID NO: 1407614 - RNA, 14 nt, Human
aaaauuacuguuua

SEQ ID NO: 1407615 - RNA, 14 nt, Human
aaaauuacaacuaa

SEQ ID NO: 1407616 - RNA, 14 nt, Human
aaaauuauuugcau

SEQ ID NO: 1407617 - RNA, 13 nt, Human
aaaauuauuugca

SEQ ID NO: 1407618 - RNA, 13 nt, Human
aaaauuauuuaaa

SEQ ID NO: 1407619 - RNA, 16 nt, Human
aaaauuauagaaguuu

SEQ ID NO: 1407620 - RNA, 13 nt, Human
aaaauuaucuaua

SEQ ID NO: 1407621 - RNA, 13 nt, Human
aaaaucaaauggu

SEQ ID NO: 1407622 - RNA, 16 nt, Human
aaaauaaaaaagaucc

SEQ ID NO: 1407623 - RNA, 20 nt, Human
aaaauaaaaagaucacuuuc

SEQ ID NO: 1407624 - RNA, 21 nt, Human
aaaauccacuuuaucuugaau

SEQ ID NO: 1407625 - RNA, 14 nt, Human
aaaaucagccaauu

SEQ ID NO: 1407626 - RNA, 17 nt, Human
aaaaucagccaauuaug

SEQ ID NO: 1407627 - RNA, 18 nt, Human
aaaaucagccaauuaugu

SEQ ID NO: 1407628 - RNA, 19 nt, Human
aaaaucagccaauuauguu

SEQ ID NO: 1407629 - RNA, 20 nt, Human
aaaaucagccaauuauguua

SEQ ID NO: 1407630 - RNA, 21 nt, Human
aaaaucagccaauuauguuaa

SEQ ID NO: 1407631 - RNA, 20 nt, Human
aaaaguuuuuuauuaugcau

SEQ ID NO: 1407632 - RNA, 12 nt, Human
aaaaguuuguuu

SEQ ID NO: 1407633 - RNA, 21 nt, Human
aaaauaaaaaagaucccaaau

SEQ ID NO: 1407634 - RNA, 15 nt, Human
aaaauaaaaaacacu

SEQ ID NO: 1407635 - RNA, 14 nt, Human
aaaauuccacucaa

SEQ ID NO: 1407636 - RNA, 13 nt, Human
aaaauuccacuca

SEQ ID NO: 1407637 - RNA, 13 nt, Human
aaaauucauuuuu

SEQ ID NO: 1407638 - RNA, 21 nt, Human
aaaauugaaugcaaaccauag

SEQ ID NO: 1407639 - RNA, 21 nt, Human
aaaauugaaauguaaggcugu

SEQ ID NO: 1407640 - RNA, 18 nt, Human
aaaauugaaauguaaggc

SEQ ID NO: 1407641 - RNA, 17 nt, Human
aaaauugaaauguaagg

SEQ ID NO: 1407642 - RNA, 16 nt, Human
aaaauugaaauguaag

SEQ ID NO: 1407643 - RNA, 14 nt, Human
aaaauugaaaugua

SEQ ID NO: 1407644 - RNA, 23 nt, Human
aaaauucugugccuuguuuuuug

SEQ ID NO: 1407645 - RNA, 14 nt, Human
aaaauucugugccu

SEQ ID NO: 1407646 - RNA, 14 nt, Human
aaaauugaaugcaa

SEQ ID NO: 1407647 - RNA, 12 nt, Human
aaaauugaaugc

SEQ ID NO: 1407648 - RNA, 23 nt, Human
aaacaggcacuuggcagccuugu

SEQ ID NO: 1407649 - RNA, 15 nt, Human
aaacaggcacuuggc

SEQ ID NO: 1407650 - RNA, 17 nt, Human
aaacaggcacugcccug

SEQ ID NO: 1407651 - RNA, 16 nt, Human
aaacaggcacugcccu

SEQ ID NO: 1407652 - RNA, 12 nt, Human
aaacaggaucag

SEQ ID NO: 1407653 - RNA, 21 nt, Human
aaagauacagaacucuuucaa

SEQ ID NO: 1407654 - RNA, 20 nt, Human
aaagaggugaccccagggca

SEQ ID NO: 1407655 - RNA, 15 nt, Human
aaagauacaguuacu

SEQ ID NO: 1407656 - RNA, 18 nt, Human
aaagaggucgcuugggaa

SEQ ID NO: 1407657 - RNA, 23 nt, Human
aaagaggcugccccucucaccaa

SEQ ID NO: 1407658 - RNA, 22 nt, Human
aaagaggcugccccucucacca

SEQ ID NO: 1407659 - RNA, 21 nt, Human
aaagaggugaccccagggcac

SEQ ID NO: 1407660 - RNA, 19 nt, Human
aaagaggugaccccagggc

SEQ ID NO: 1407661 - RNA, 18 nt, Human
aaagaggugaccccaggg

SEQ ID NO: 1407662 - RNA, 17 nt, Human
aaacccaguugccaucu

SEQ ID NO: 1407663 - RNA, 15 nt, Human
aaaccccccagauau

SEQ ID NO: 1407664 - RNA, 22 nt, Human
aaacccauauuguaaaacaggu

SEQ ID NO: 1407665 - RNA, 20 nt, Human
aaaccccaccuuuauuccuu

SEQ ID NO: 1407666 - RNA, 21 nt, Human
aaaccgcuaaaagaaacuuuc

SEQ ID NO: 1407667 - RNA, 23 nt, Human
aaaccgcuaaaagaaacuuucuu

SEQ ID NO: 1407668 - RNA, 18 nt, Human
aaaccgcuaaaagaaacu

SEQ ID NO: 1407669 - RNA, 16 nt, Human
aaaccgcuaaaagaaa

SEQ ID NO: 1407670 - RNA, 15 nt, Human
aaaccgcuaaaagaa

SEQ ID NO: 1407671 - RNA, 14 nt, Human
aaaccgcuaaaaga

SEQ ID NO: 1407672 - RNA, 19 nt, Human
aaaccgccagcucuguucu

SEQ ID NO: 1407673 - RNA, 19 nt, Human
aaacccuugccaugugcua

SEQ ID NO: 1407674 - RNA, 18 nt, Human
aaaccgccagcucuguuc

SEQ ID NO: 1407675 - RNA, 21 nt, Human
aaacugaagcagccucucccc

SEQ ID NO: 1407676 - RNA, 18 nt, Human
aaacugaagcagccucuc

SEQ ID NO: 1407677 - RNA, 13 nt, Human
aaacucuuuuccc

SEQ ID NO: 1407678 - RNA, 21 nt, Human
aaacucuuuggucguuuuuuu

SEQ ID NO: 1407679 - RNA, 20 nt, Human
aaacucuuuggucguuuuuu

SEQ ID NO: 1407680 - RNA, 13 nt, Human
aaacugagugacu

SEQ ID NO: 1407681 - RNA, 22 nt, Human
aaacugaagcagccucucccca

SEQ ID NO: 1407682 - RNA, 22 nt, Human
aaacugauccaguauaagacua

SEQ ID NO: 1407683 - RNA, 13 nt, Human
aaagaaaauuaca

SEQ ID NO: 1407684 - RNA, 18 nt, Human
aaagaaaaugauacagca

SEQ ID NO: 1407685 - RNA, 12 nt, Human
aaagaaaauuuu

SEQ ID NO: 1407686 - RNA, 19 nt, Human
aaagaaaauuuuuguagua

SEQ ID NO: 1407687 - RNA, 20 nt, Human
aaagaggcugccccucucac

SEQ ID NO: 1407688 - RNA, 18 nt, Human
aaagaggcugccccucuc

SEQ ID NO: 1407689 - RNA, 14 nt, Human
aaagaggcugcccc

SEQ ID NO: 1407690 - RNA, 19 nt, Human
aaagaggcugaggcuggca

SEQ ID NO: 1407691 - RNA, 21 nt, Human
aaagaggcugaggccuggacu

SEQ ID NO: 1407692 - RNA, 20 nt, Human
aaagaggcugaggccuggac

SEQ ID NO: 1407693 - RNA, 19 nt, Human
aaagaggcugaggccugga

SEQ ID NO: 1407694 - RNA, 12 nt, Human
aaagaggcugag

SEQ ID NO: 1407695 - RNA, 15 nt, Human
aaagaagacaaacuu

SEQ ID NO: 1407696 - RNA, 12 nt, Human
aaagaaacuuuc

SEQ ID NO: 1407697 - RNA, 13 nt, Human
aaagaaacauuug

SEQ ID NO: 1407698 - RNA, 18 nt, Human
aaagaacgcugauuuaaa

SEQ ID NO: 1407699 - RNA, 15 nt, Human
aaagaacgcugauuu

SEQ ID NO: 1407700 - RNA, 13 nt, Human
aaagaaccacuug

SEQ ID NO: 1407701 - RNA, 23 nt, Human
aaagaaccaacaaccucaacugc

SEQ ID NO: 1407702 - RNA, 20 nt, Human
aaagaacgcugauuuaaaga

SEQ ID NO: 1407703 - RNA, 15 nt, Human
aaagaacggaagaag

SEQ ID NO: 1407704 - RNA, 23 nt, Human
aaagaacguggucagaguagaac

SEQ ID NO: 1407705 - RNA, 19 nt, Human
aaagaacggaagaagagau

SEQ ID NO: 1407706 - RNA, 23 nt, Human
aaagcauuuaaccccccuguaca

SEQ ID NO: 1407707 - RNA, 13 nt, Human
aaagcauuugaau

SEQ ID NO: 1407708 - RNA, 14 nt, Human
aaagcauuugaaug

SEQ ID NO: 1407709 - RNA, 15 nt, Human
aaagcauuugaaugc

SEQ ID NO: 1407710 - RNA, 15 nt, Human
aaagcauuuuguaau

SEQ ID NO: 1407711 - RNA, 14 nt, Human
aaagcauuuuguaa

SEQ ID NO: 1407712 - RNA, 13 nt, Human
aaagcauuuugua

SEQ ID NO: 1407713 - RNA, 23 nt, Human
aaagcauuugaaugcauuuuguu

SEQ ID NO: 1407714 - RNA, 17 nt, Human
aaagcauuugaaugcau

SEQ ID NO: 1407715 - RNA, 19 nt, Human
aaagcauuugaaugcauuu

SEQ ID NO: 1407716 - RNA, 20 nt, Human
aaagcauuugaaugcauuuu

SEQ ID NO: 1407717 - RNA, 22 nt, Human
aaagcauuugaaugcauuuugu

SEQ ID NO: 1407718 - RNA, 15 nt, Human
aaagccaaacauaua

SEQ ID NO: 1407719 - RNA, 21 nt, Human
aaagcauuuuguaauaauaaa

SEQ ID NO: 1407720 - RNA, 20 nt, Human
aaaggcuaugauugucuuug

SEQ ID NO: 1407721 - RNA, 19 nt, Human
aaaggcuagguacacagcu

SEQ ID NO: 1407722 - RNA, 17 nt, Human
aaaggcuaccuuuguau

SEQ ID NO: 1407723 - RNA, 14 nt, Human
aaaggcuaccuuug

SEQ ID NO: 1407724 - RNA, 22 nt, Human
aaagcccccagagcccaggcuc

SEQ ID NO: 1407725 - RNA, 21 nt, Human
aaagcccccagagcccaggcu

SEQ ID NO: 1407726 - RNA, 14 nt, Human
aaagcccccagagc

SEQ ID NO: 1407727 - RNA, 23 nt, Human
aaaggcaguuugcaaaaaauguu

SEQ ID NO: 1407728 - RNA, 16 nt, Human
aaaggcaguuuucuaa

SEQ ID NO: 1407729 - RNA, 14 nt, Human
aaaggcaguuuucu

SEQ ID NO: 1407730 - RNA, 13 nt, Human
aaaggcaguuuuc

SEQ ID NO: 1407731 - RNA, 23 nt, Human
aaaggcaguuaccauuaaaccau

SEQ ID NO: 1407732 - RNA, 15 nt, Human
aaaggcaguuaccau

SEQ ID NO: 1407733 - RNA, 15 nt, Human
aaagcccagagacag

SEQ ID NO: 1407734 - RNA, 22 nt, Human
aaagcccauaugcuaccaccag

SEQ ID NO: 1407735 - RNA, 16 nt, Human
aaagcccauucauucc

SEQ ID NO: 1407736 - RNA, 17 nt, Human
aaagcccauucauucca

SEQ ID NO: 1407737 - RNA, 16 nt, Human
aaauaaauguaucaua

SEQ ID NO: 1407738 - RNA, 13 nt, Human
aaauaaauuguau

SEQ ID NO: 1407739 - RNA, 21 nt, Human
aaauaaauguaucauagaaau

SEQ ID NO: 1407740 - RNA, 14 nt, Human
aaauaaauuguaua

SEQ ID NO: 1407741 - RNA, 15 nt, Human
aaauaaauuguauau

SEQ ID NO: 1407742 - RNA, 18 nt, Human
aaauaaauuguauauuca

SEQ ID NO: 1407743 - RNA, 19 nt, Human
aaauaaauuguauauucac

SEQ ID NO: 1407744 - RNA, 17 nt, Human
aaauaaacgucuuaaau

SEQ ID NO: 1407745 - RNA, 20 nt, Human
aaauaaauuguauauucacu

SEQ ID NO: 1407746 - RNA, 21 nt, Human
aaauaaauuguauauucacuu

SEQ ID NO: 1407747 - RNA, 22 nt, Human
aaauaaauuguauauucacuuu

SEQ ID NO: 1407748 - RNA, 20 nt, Human
aaagugccugacacacuaac

SEQ ID NO: 1407749 - RNA, 19 nt, Human
aaagugccaguauuuuaaa

SEQ ID NO: 1407750 - RNA, 15 nt, Human
aaagugccaguauuu

SEQ ID NO: 1407751 - RNA, 19 nt, Human
aaagugccauuaacaaaug

SEQ ID NO: 1407752 - RNA, 17 nt, Human
aaagucauaauugcauu

SEQ ID NO: 1407753 - RNA, 15 nt, Human
aaaggcuguuaaaua

SEQ ID NO: 1407754 - RNA, 15 nt, Human
aaagucauaauugca

SEQ ID NO: 1407755 - RNA, 14 nt, Human
aaauaaaaccagcu

SEQ ID NO: 1407756 - RNA, 13 nt, Human
aaagugcuaaggu

SEQ ID NO: 1407757 - RNA, 22 nt, Human
aaagugccuuucaggaucuauu

SEQ ID NO: 1407758 - RNA, 23 nt, Human
aaagugccuuucaggaucuauuu

SEQ ID NO: 1407759 - RNA, 20 nt, Human
aaagugccuuucaggaucua

SEQ ID NO: 1407760 - RNA, 19 nt, Human
aaagugccuuucaggaucu

SEQ ID NO: 1407761 - RNA, 17 nt, Human
aaagugccuuucaggau

SEQ ID NO: 1407762 - RNA, 16 nt, Human
aaagugccuuucagga

SEQ ID NO: 1407763 - RNA, 15 nt, Human
aaagugccuuucagg

SEQ ID NO: 1407764 - RNA, 14 nt, Human
aaagugccuuucag

SEQ ID NO: 1407765 - RNA, 18 nt, Human
aaauaaacaaauaacaau

SEQ ID NO: 1407766 - RNA, 19 nt, Human
aaauaaaauuuguugcaua

SEQ ID NO: 1407767 - RNA, 18 nt, Human
aaauaaaauuuguugcau

SEQ ID NO: 1407768 - RNA, 21 nt, Human
aaauaaaacccguugauuacu

SEQ ID NO: 1407769 - RNA, 16 nt, Human
aaauaaacgucuuaaa

SEQ ID NO: 1407770 - RNA, 15 nt, Human
aaauaaacgucuuaa

SEQ ID NO: 1407771 - RNA, 14 nt, Human
aaugcccuucacug

SEQ ID NO: 1407772 - RNA, 17 nt, Human
aaugcccuucacuguca

SEQ ID NO: 1407773 - RNA, 13 nt, Human
aaugcccuucacu

SEQ ID NO: 1407774 - RNA, 22 nt, Human
aaugccugacuagggagccaug

SEQ ID NO: 1407775 - RNA, 21 nt, Human
aaugcgugcauaccacuuuug

SEQ ID NO: 1407776 - RNA, 23 nt, Human
aaugcgugcauaccacuuuuguu

SEQ ID NO: 1407777 - RNA, 17 nt, Human
aauggggccagauccag

SEQ ID NO: 1407778 - RNA, 19 nt, Human
aaugggcacuuaaagcuuu

SEQ ID NO: 1407779 - RNA, 14 nt, Human
aaugggcacuuaaa

SEQ ID NO: 1407780 - RNA, 21 nt, Human
aaugggagcugaggccacacu

SEQ ID NO: 1407781 - RNA, 16 nt, Human
aaugcucauaacggau

SEQ ID NO: 1407782 - RNA, 22 nt, Human
aauggggccagauccagccugg

SEQ ID NO: 1407783 - RNA, 12 nt, Human
aaugguaucuuu

SEQ ID NO: 1407784 - RNA, 16 nt, Human
aauggguuuuucccug

SEQ ID NO: 1407785 - RNA, 15 nt, Human
aauggguuacuugau

SEQ ID NO: 1407786 - RNA, 15 nt, Human
aaugggggugcauuu

SEQ ID NO: 1407787 - RNA, 17 nt, Human
aaugggggugcauuuga

SEQ ID NO: 1407788 - RNA, 19 nt, Human
aaugguccaggagaaggcc

SEQ ID NO: 1407789 - RNA, 14 nt, Human
aaugguccaggaga

SEQ ID NO: 1407790 - RNA, 20 nt, Human
aaugguccaauuaguuuccu

SEQ ID NO: 1407791 - RNA, 22 nt, Human
aauggucacguuuggugcuucu

SEQ ID NO: 1407792 - RNA, 23 nt, Human
aauggucacguuuggugcuucuc

SEQ ID NO: 1407793 - RNA, 18 nt, Human
aaugauaugcuuguaacu

SEQ ID NO: 1407794 - RNA, 19 nt, Human
aaugauaugcuuguaacua

SEQ ID NO: 1407795 - RNA, 17 nt, Human
aaugauaugcuuguaac

SEQ ID NO: 1407796 - RNA, 15 nt, Human
aaugauaugcuugua

SEQ ID NO: 1407797 - RNA, 18 nt, Human
aaugaacacucuuuugcu

SEQ ID NO: 1407798 - RNA, 15 nt, Human
aaugaacacucuuuu

SEQ ID NO: 1407799 - RNA, 21 nt, Human
aaugaacacucuuuugcuuua

SEQ ID NO: 1407800 - RNA, 17 nt, Human
aaugauaacuggaaacu

SEQ ID NO: 1407801 - RNA, 12 nt, Human
aaugaacagaac

SEQ ID NO: 1407802 - RNA, 21 nt, Human
aaugauagacaauugagguaa

SEQ ID NO: 1407803 - RNA, 16 nt, Human
aaugauaacuggaaac

SEQ ID NO: 1407804 - RNA, 15 nt, Human
aaugauaacuggaaa

SEQ ID NO: 1407805 - RNA, 16 nt, Human
aaugaacaagagaagc

SEQ ID NO: 1407806 - RNA, 14 nt, Human
aaugaacaagagaa

SEQ ID NO: 1407807 - RNA, 13 nt, Human
aaugaacaagaga

SEQ ID NO: 1407808 - RNA, 12 nt, Human
aaugaacaagag

SEQ ID NO: 1407809 - RNA, 12 nt, Human
aaugaacaaaug

SEQ ID NO: 1407810 - RNA, 14 nt, Human
aaugaaauuaacug

SEQ ID NO: 1407811 - RNA, 22 nt, Human
aaugaacaagagaagcauucuc

SEQ ID NO: 1407812 - RNA, 18 nt, Human
aaugaacaagagaagcau

SEQ ID NO: 1407813 - RNA, 17 nt, Human
aaugaacaagagaagca

SEQ ID NO: 1407814 - RNA, 14 nt, Human
aaugauaacuggaa

SEQ ID NO: 1407815 - RNA, 22 nt, Human
aaucucccauuuuggaauuugc

SEQ ID NO: 1407816 - RNA, 16 nt, Human
aaucucccauuuugga

SEQ ID NO: 1407817 - RNA, 18 nt, Human
aaucucccauuuuggaau

SEQ ID NO: 1407818 - RNA, 17 nt, Human
aauccauacauuugugu

SEQ ID NO: 1407819 - RNA, 16 nt, Human
aauccauacauuugug

SEQ ID NO: 1407820 - RNA, 16 nt, Human
aauccacauuucuaaa

SEQ ID NO: 1407821 - RNA, 15 nt, Human
aauccacauuucuaa

SEQ ID NO: 1407822 - RNA, 22 nt, Human
aauccaagauauuuuaaaaucu

SEQ ID NO: 1407823 - RNA, 13 nt, Human
aauccaaauggcg

SEQ ID NO: 1407824 - RNA, 20 nt, Human
aauccaaauggcgucuggaa

SEQ ID NO: 1407825 - RNA, 22 nt, Human
aaucauuuuaauuauuauucuu

SEQ ID NO: 1407826 - RNA, 20 nt, Human
aaucauuuuaauuauuauuc

SEQ ID NO: 1407827 - RNA, 19 nt, Human
aaucauuuuaauuauuauu

SEQ ID NO: 1407828 - RNA, 17 nt, Human
aaucauuuuaauuauua

SEQ ID NO: 1407829 - RNA, 16 nt, Human
aaucauuuuaauuauu

SEQ ID NO: 1407830 - RNA, 15 nt, Human
aaucauuuuaauuau

SEQ ID NO: 1407831 - RNA, 17 nt, Human
aaucauuuguuuaaaaa

SEQ ID NO: 1407832 - RNA, 13 nt, Human
aaucauuuugcaa

SEQ ID NO: 1407833 - RNA, 15 nt, Human
aaucauuuguuuaaa

SEQ ID NO: 1407834 - RNA, 19 nt, Human
aaucaaauuuguaggguuu

SEQ ID NO: 1407835 - RNA, 12 nt, Human
aaucaaaugaau

SEQ ID NO: 1407836 - RNA, 22 nt, Human
aauauaaaugcaaauaacaaau

SEQ ID NO: 1407837 - RNA, 20 nt, Human
aauauaaaugcaaauaacaa

SEQ ID NO: 1407838 - RNA, 19 nt, Human
aauauaaaugcaaauaaca

SEQ ID NO: 1407839 - RNA, 18 nt, Human
aauauaaaugcaaauaac

SEQ ID NO: 1407840 - RNA, 17 nt, Human
aauauaaaugcaaauaa

SEQ ID NO: 1407841 - RNA, 16 nt, Human
aauauaaaugcaaaua

SEQ ID NO: 1407842 - RNA, 15 nt, Human
aauauaaaugcaaau

SEQ ID NO: 1407843 - RNA, 14 nt, Human
aauauaaaugcaaa

SEQ ID NO: 1407844 - RNA, 13 nt, Human
aauauaaaugcaa

SEQ ID NO: 1407845 - RNA, 12 nt, Human
aauauaaaugca

SEQ ID NO: 1407846 - RNA, 11 nt, Human
aauauaaaugc

SEQ ID NO: 1407847 - RNA, 22 nt, Human
aauauaaaguuuuauauauuau

SEQ ID NO: 1407848 - RNA, 21 nt, Human
aauauaaaguuuuauauauua

SEQ ID NO: 1407849 - RNA, 20 nt, Human
aauauaaaguuuuauauauu

SEQ ID NO: 1407850 - RNA, 15 nt, Human
aauauaaaguuuuau

SEQ ID NO: 1407851 - RNA, 18 nt, Human
aauauaaagacguuuuau

SEQ ID NO: 1407852 - RNA, 23 nt, Human
aauauaaagacguuuuauaagca

SEQ ID NO: 1407853 - RNA, 12 nt, Human
aauauaaagacg

SEQ ID NO: 1407854 - RNA, 11 nt, Human
aauauaaagac

SEQ ID NO: 1407855 - RNA, 21 nt, Human
aauauagaucaguuauaagua

SEQ ID NO: 1407856 - RNA, 18 nt, Human
aauauacuuuuacaagua

SEQ ID NO: 1407857 - RNA, 19 nt, Human
aauauacuuuuacaaguaa

SEQ ID NO: 1407858 - RNA, 17 nt, Human
aauauacuuguggacua

SEQ ID NO: 1407859 - RNA, 22 nt, Human
aauauacuuguggacuaaaaga

SEQ ID NO: 1407860 - RNA, 23 nt, Human
aauauacuuguggacuaaaagau

SEQ ID NO: 1407861 - RNA, 16 nt, Human
aauauaggaacuuaaa

SEQ ID NO: 1407862 - RNA, 22 nt, Human
aauaugcuuaaaauaagcaggu

SEQ ID NO: 1407863 - RNA, 19 nt, Human
aauaugcuuaaaauaagca

SEQ ID NO: 1407864 - RNA, 16 nt, Human
aauaugcuuaaaauaa

SEQ ID NO: 1407865 - RNA, 23 nt, Human
aauaugcuuaaaauaagcaggug

SEQ ID NO: 1407866 - RNA, 23 nt, Human
aauauaaaauaugaagacauaaa

SEQ ID NO: 1407867 - RNA, 14 nt, Human
aauauaaaauauga

SEQ ID NO: 1407868 - RNA, 14 nt, Human
aauaguuuggauau

SEQ ID NO: 1407869 - RNA, 22 nt, Human
aauagaagcuaagguuuagaua

SEQ ID NO: 1407870 - RNA, 13 nt, Human
aauagaacacagu

SEQ ID NO: 1407871 - RNA, 17 nt, Human
aauagaacaaggcugag

SEQ ID NO: 1407872 - RNA, 17 nt, Human
aauagaaauggggaacu

SEQ ID NO: 1407873 - RNA, 22 nt, Human
aauagaaauaaaggaugugauu

SEQ ID NO: 1407874 - RNA, 15 nt, Human
aauagaaaauggucc

SEQ ID NO: 1407875 - RNA, 14 nt, Human
aauagaaaaugguc

SEQ ID NO: 1407876 - RNA, 13 nt, Human
aauagaaaauggu

SEQ ID NO: 1407877 - RNA, 21 nt, Human
aauacuucuuguguguaugca

SEQ ID NO: 1407878 - RNA, 19 nt, Human
aauacuucuuguguguaug

SEQ ID NO: 1407879 - RNA, 17 nt, Human
aauacuucuugugugua

SEQ ID NO: 1407880 - RNA, 14 nt, Human
aauacuucuugugu

SEQ ID NO: 1407881 - RNA, 13 nt, Human
aauacuucuugug

SEQ ID NO: 1407882 - RNA, 22 nt, Human
aauacuucucauuuuuuaaaaa

SEQ ID NO: 1407883 - RNA, 16 nt, Human
aauacuucucauuuuu

SEQ ID NO: 1407884 - RNA, 14 nt, Human
aauacuucucauuu

SEQ ID NO: 1407885 - RNA, 13 nt, Human
aauacuaaugaaa

SEQ ID NO: 1407886 - RNA, 16 nt, Human
aauacuaccuugaaaa

SEQ ID NO: 1407887 - RNA, 15 nt, Human
aauacuaccuugaaa

SEQ ID NO: 1407888 - RNA, 14 nt, Human
aauacuaccuugaa

SEQ ID NO: 1407889 - RNA, 15 nt, Human
aauacuaaggaacca

SEQ ID NO: 1407890 - RNA, 20 nt, Human
aauacgugggcauucaaaug

SEQ ID NO: 1407891 - RNA, 19 nt, Human
aauacgugggcauucaaau

SEQ ID NO: 1407892 - RNA, 15 nt, Human
aaguauacauaaguu

SEQ ID NO: 1407893 - RNA, 13 nt, Human
aaguaggaaguaa

SEQ ID NO: 1407894 - RNA, 13 nt, Human
aagugcugagauu

SEQ ID NO: 1407895 - RNA, 21 nt, Human
aagugcuaagguucuaaggcc

SEQ ID NO: 1407896 - RNA, 20 nt, Human
aagugcuaagguucuaaggc

SEQ ID NO: 1407897 - RNA, 19 nt, Human
aagugcuaagguucuaagg

SEQ ID NO: 1407898 - RNA, 18 nt, Human
aagugcuaagguucuaag

SEQ ID NO: 1407899 - RNA, 17 nt, Human
aagugcuaagguucuaa

SEQ ID NO: 1407900 - RNA, 16 nt, Human
aagugcuaagguucua

SEQ ID NO: 1407901 - RNA, 15 nt, Human
aagugcuaagguucu

SEQ ID NO: 1407902 - RNA, 19 nt, Human
aagugcugcacucaaauga

SEQ ID NO: 1407903 - RNA, 15 nt, Human
aagugcugcacucaa

SEQ ID NO: 1407904 - RNA, 14 nt, Human
aagugcugcacuca

SEQ ID NO: 1407905 - RNA, 14 nt, Human
aagugcugagauua

SEQ ID NO: 1407906 - RNA, 14 nt, Human
aagugcugcauuua

SEQ ID NO: 1407907 - RNA, 13 nt, Human
aagugcugcauuu

SEQ ID NO: 1407908 - RNA, 19 nt, Human
aaguggguacccccaggac

SEQ ID NO: 1407909 - RNA, 15 nt, Human
aaguggguaccccca

SEQ ID NO: 1407910 - RNA, 16 nt, Human
aagugggcuugauucu

SEQ ID NO: 1407911 - RNA, 12 nt, Human
aagugggcuuga

SEQ ID NO: 1407912 - RNA, 11 nt, Human
aagugggacag

SEQ ID NO: 1407913 - RNA, 22 nt, Human
aagugggcuugauucugcagua

SEQ ID NO: 1407914 - RNA, 19 nt, Human
aaguucuguacucaaaugu

SEQ ID NO: 1407915 - RNA, 22 nt, Human
aaguugauaugccuuuucccaa

SEQ ID NO: 1407916 - RNA, 15 nt, Human
aauaaacgucuuaaa

SEQ ID NO: 1407917 - RNA, 11 nt, Human
aauaaagcugu

SEQ ID NO: 1407918 - RNA, 19 nt, Human
aauaaagcuguguggcagu

SEQ ID NO: 1407919 - RNA, 14 nt, Human
aauaaagcugcuga

SEQ ID NO: 1407920 - RNA, 11 nt, Human
aauaaaggacu

SEQ ID NO: 1407921 - RNA, 18 nt, Human
aauaaaggacuguaaucu

SEQ ID NO: 1407922 - RNA, 16 nt, Human
aauaaaggaugugauu

SEQ ID NO: 1407923 - RNA, 22 nt, Human
aauaaaggacuguaaucuuauu

SEQ ID NO: 1407924 - RNA, 14 nt, Human
aauaaaauuuguug

SEQ ID NO: 1407925 - RNA, 13 nt, Human
aauaaaauuuguu

SEQ ID NO: 1407926 - RNA, 12 nt, Human
aauaaaauuugu

SEQ ID NO: 1407927 - RNA, 11 nt, Human
aauaaaauuug

SEQ ID NO: 1407928 - RNA, 19 nt, Human
aaguugcagcuguuuuguu

SEQ ID NO: 1407929 - RNA, 21 nt, Human
aaguugcagcuguuuuguuga

SEQ ID NO: 1407930 - RNA, 17 nt, Human
aaguugcagcuguuuug

SEQ ID NO: 1407931 - RNA, 15 nt, Human
aaguugcagcuguuu

SEQ ID NO: 1407932 - RNA, 14 nt, Human
aaguugcagcuguu

SEQ ID NO: 1407933 - RNA, 14 nt, Human
aaguugauuagaaa

SEQ ID NO: 1407934 - RNA, 13 nt, Human
aauaaacaaauaa

SEQ ID NO: 1407935 - RNA, 16 nt, Human
aauaaaauuuguugca

SEQ ID NO: 1407936 - RNA, 17 nt, Human
aauaaaauuuguugcau

SEQ ID NO: 1407937 - RNA, 12 nt, Human
aauaaaauuuuu

SEQ ID NO: 1407938 - RNA, 13 nt, Human
aauaauauacuug

SEQ ID NO: 1407939 - RNA, 16 nt, Human
aauaauauacuugugg

SEQ ID NO: 1407940 - RNA, 16 nt, Human
aauaauacugcugaga

SEQ ID NO: 1407941 - RNA, 12 nt, Human
aauaauauacuu

SEQ ID NO: 1407942 - RNA, 18 nt, Human
aauaauaccuaagccuuc

SEQ ID NO: 1407943 - RNA, 17 nt, Human
aauaauacauuauauuu

SEQ ID NO: 1407944 - RNA, 19 nt, Human
aauaauauauuuucuguuu

SEQ ID NO: 1407945 - RNA, 17 nt, Human
aauaauauauuuucugu

SEQ ID NO: 1407946 - RNA, 15 nt, Human
aauaauauauuuucu

SEQ ID NO: 1407947 - RNA, 12 nt, Human
aauaauguuuca

SEQ ID NO: 1407948 - RNA, 19 nt, Human
aauaauguuucaaacauau

SEQ ID NO: 1407949 - RNA, 14 nt, Human
aauaauguuucaaa

SEQ ID NO: 1407950 - RNA, 19 nt, Human
aagcagguucccaagcuca

SEQ ID NO: 1407951 - RNA, 18 nt, Human
aagcagguucccaagcuc

SEQ ID NO: 1407952 - RNA, 23 nt, Human
aagccagauuuuuuaaaauuuau

SEQ ID NO: 1407953 - RNA, 22 nt, Human
aagccagcaccggaccagccug

SEQ ID NO: 1407954 - RNA, 17 nt, Human
aagccagcaccggacca

SEQ ID NO: 1407955 - RNA, 23 nt, Human
aagccagcaccggaccagccugg

SEQ ID NO: 1407956 - RNA, 12 nt, Human
aaggcaaaauug

SEQ ID NO: 1407957 - RNA, 19 nt, Human
aaggacuaauagaaaagua

SEQ ID NO: 1407958 - RNA, 15 nt, Human
aaggacuaauagaaa

SEQ ID NO: 1407959 - RNA, 14 nt, Human
aaggacgcacugag

SEQ ID NO: 1407960 - RNA, 19 nt, Human
aaggaccugaaauuccaaa

SEQ ID NO: 1407961 - RNA, 18 nt, Human
aaggaccugaaauuccaa

SEQ ID NO: 1407962 - RNA, 12 nt, Human
aaggaccuaaaa

SEQ ID NO: 1407963 - RNA, 14 nt, Human
aaggacccugugag

SEQ ID NO: 1407964 - RNA, 23 nt, Human
aaggaauuucuuaacuucuugcu

SEQ ID NO: 1407965 - RNA, 20 nt, Human
aaggaauuucuuaacuucuu

SEQ ID NO: 1407966 - RNA, 19 nt, Human
aaggaauuucuuaacuucu

SEQ ID NO: 1407967 - RNA, 17 nt, Human
aaggaauuucuuaacuu

SEQ ID NO: 1407968 - RNA, 16 nt, Human
aaggaauuucuuaacu

SEQ ID NO: 1407969 - RNA, 12 nt, Human
aaggaauuuuau

SEQ ID NO: 1407970 - RNA, 19 nt, Human
aaggcacucuagauuccau

SEQ ID NO: 1407971 - RNA, 16 nt, Human
aaggcacucuagauuc

SEQ ID NO: 1407972 - RNA, 15 nt, Human
aaggcacucuagauu

SEQ ID NO: 1407973 - RNA, 14 nt, Human
aaggcacucuagau

SEQ ID NO: 1407974 - RNA, 20 nt, Human
aaggcaaagcacgaaauguu

SEQ ID NO: 1407975 - RNA, 20 nt, Human
aaggcaaacccaucaacaaa

SEQ ID NO: 1407976 - RNA, 15 nt, Human
aaggcaaacccauca

SEQ ID NO: 1407977 - RNA, 18 nt, Human
aaggacuaauagaaaagu

SEQ ID NO: 1407978 - RNA, 19 nt, Human
aaggcaaaauugcaaaucu

SEQ ID NO: 1407979 - RNA, 15 nt, Human
aaggcaaaauugcaa

SEQ ID NO: 1407980 - RNA, 14 nt, Human
aaggcaaaauugca

SEQ ID NO: 1407981 - RNA, 18 nt, Human
aaggcagaggccugggcu

SEQ ID NO: 1407982 - RNA, 17 nt, Human
aaggcagaggccugggc

SEQ ID NO: 1407983 - RNA, 16 nt, Human
aaggcagaggccuggg

SEQ ID NO: 1407984 - RNA, 15 nt, Human
aaggcagaggccugg

SEQ ID NO: 1407985 - RNA, 14 nt, Human
aaggcagaggccug

SEQ ID NO: 1407986 - RNA, 16 nt, Human
aaggcacuugaggggg

SEQ ID NO: 1407987 - RNA, 19 nt, Human
aaggcagccgugggcccca

SEQ ID NO: 1407988 - RNA, 16 nt, Human
aaggcagcaaggcccg

SEQ ID NO: 1407989 - RNA, 19 nt, Human
aaggcagcaaggcccgagc

SEQ ID NO: 1407990 - RNA, 14 nt, Human
aaggcagcaaggcc

SEQ ID NO: 1407991 - RNA, 19 nt, Human
aaggcagaggccugggcug

SEQ ID NO: 1407992 - RNA, 23 nt, Human
aaggcagccgugggccccacccu

SEQ ID NO: 1407993 - RNA, 18 nt, Human
aagcugcaucuagaggcu

SEQ ID NO: 1407994 - RNA, 14 nt, Human
aaggaauuucuuaa

SEQ ID NO: 1407995 - RNA, 15 nt, Human
aagcugcccugccca

SEQ ID NO: 1407996 - RNA, 21 nt, Human
aagcugcugagaaucuagccu

SEQ ID NO: 1407997 - RNA, 17 nt, Human
aagcuggagugcagugg

SEQ ID NO: 1407998 - RNA, 17 nt, Human
aagggauggacaucuug

SEQ ID NO: 1407999 - RNA, 16 nt, Human
aagggauggacaucuu

SEQ ID NO: 1408000 - RNA, 15 nt, Human
aagggauuuucagcc

SEQ ID NO: 1408001 - RNA, 20 nt, Human
aagggcaacagaucaguaaa

SEQ ID NO: 1408002 - RNA, 22 nt, Human
aagggcaacagaucaguaaaga

SEQ ID NO: 1408003 - RNA, 21 nt, Human
aagggauuuucagcccucaga

SEQ ID NO: 1408004 - RNA, 23 nt, Human
aagggauuuucagcccucagaau

SEQ ID NO: 1408005 - RNA, 16 nt, Human
aagggagucugccagg

SEQ ID NO: 1408006 - RNA, 15 nt, Human
aagggagucugccag

SEQ ID NO: 1408007 - RNA, 17 nt, Human
aagggaggugggccgug

SEQ ID NO: 1408008 - RNA, 12 nt, Human
aagggagguggg

SEQ ID NO: 1408009 - RNA, 21 nt, Human
aagggacugagagaugcagaa

SEQ ID NO: 1408010 - RNA, 13 nt, Human
aagggagggggag

SEQ ID NO: 1408011 - RNA, 15 nt, Human
aagggacugagaaau

SEQ ID NO: 1408012 - RNA, 17 nt, Human
aagggacugagaaauuu

SEQ ID NO: 1408013 - RNA, 21 nt, Human
aagguucucagguguugccaa

SEQ ID NO: 1408014 - RNA, 13 nt, Human
aagguucuagguu

SEQ ID NO: 1408015 - RNA, 12 nt, Human
aagguucuaggu

SEQ ID NO: 1408016 - RNA, 14 nt, Human
aagguucuaaggcc

SEQ ID NO: 1408017 - RNA, 13 nt, Human
aagguucuaaggc

SEQ ID NO: 1408018 - RNA, 11 nt, Human
aagguucuaag

SEQ ID NO: 1408019 - RNA, 23 nt, Human
aagguuccgcuuggagcagaggg

SEQ ID NO: 1408020 - RNA, 17 nt, Human
aagguucccguugcauu

SEQ ID NO: 1408021 - RNA, 18 nt, Human
aagguuaucagugcuucc

SEQ ID NO: 1408022 - RNA, 15 nt, Human
aagguuaucagugcu

SEQ ID NO: 1408023 - RNA, 18 nt, Human
aagguuagagaauaaauu

SEQ ID NO: 1408024 - RNA, 15 nt, Human
aaggugugagacugg

SEQ ID NO: 1408025 - RNA, 15 nt, Human
aaguagaugcauuug

SEQ ID NO: 1408026 - RNA, 20 nt, Human
aagguguccuacagaaaaac

SEQ ID NO: 1408027 - RNA, 18 nt, Human
aagguguccuacagaaaa

SEQ ID NO: 1408028 - RNA, 16 nt, Human
aagguguccuacagaa

SEQ ID NO: 1408029 - RNA, 15 nt, Human
aagguguccuacaga

SEQ ID NO: 1408030 - RNA, 20 nt, Human
aagguguagccacaccagga

SEQ ID NO: 1408031 - RNA, 15 nt, Human
aaggugguguuucug

SEQ ID NO: 1408032 - RNA, 13 nt, Human
aagguggggugga

SEQ ID NO: 1408033 - RNA, 19 nt, Human
aaggugacaucggaaaaau

SEQ ID NO: 1408034 - RNA, 15 nt, Human
aaggugaauagccau

SEQ ID NO: 1408035 - RNA, 19 nt, Human
aaggucuuugguucagcua

SEQ ID NO: 1408036 - RNA, 13 nt, Human
aaggucuuugguu

SEQ ID NO: 1408037 - RNA, 12 nt, Human
aaggucugcuuu

SEQ ID NO: 1408038 - RNA, 14 nt, Human
aagcagguggaucu

SEQ ID NO: 1408039 - RNA, 22 nt, Human
aagcagguggaucuauuucaug

SEQ ID NO: 1408040 - RNA, 20 nt, Human
aagcagguggaucuauuuca

SEQ ID NO: 1408041 - RNA, 19 nt, Human
aagcagguggaucuauuuc

SEQ ID NO: 1408042 - RNA, 16 nt, Human
aagcagaaauccaagc

SEQ ID NO: 1408043 - RNA, 15 nt, Human
aagcagaaauccaag

SEQ ID NO: 1408044 - RNA, 23 nt, Human
aagcagaaagugccuuucaggau

SEQ ID NO: 1408045 - RNA, 20 nt, Human
aagcagaaagugccuuucag

SEQ ID NO: 1408046 - RNA, 19 nt, Human
aagcagaaagugccuuuca

SEQ ID NO: 1408047 - RNA, 18 nt, Human
aagcagaaagugccuuuc

SEQ ID NO: 1408048 - RNA, 17 nt, Human
aagcagaaagugccuuu

SEQ ID NO: 1408049 - RNA, 15 nt, Human
aagcagaaagugccu

SEQ ID NO: 1408050 - RNA, 13 nt, Human
aagcagaaagugc

SEQ ID NO: 1408051 - RNA, 12 nt, Human
aagcagaaagug

SEQ ID NO: 1408052 - RNA, 15 nt, Human
aagauugcugaaauu

SEQ ID NO: 1408053 - RNA, 12 nt, Human
aagauugcugaa

SEQ ID NO: 1408054 - RNA, 19 nt, Human
aagauugagcucucugccc

SEQ ID NO: 1408055 - RNA, 13 nt, Human
aagauucuuuccc

SEQ ID NO: 1408056 - RNA, 16 nt, Human
aagauucuuucccaau

SEQ ID NO: 1408057 - RNA, 21 nt, Human
aagauuauagauucuaaagau

SEQ ID NO: 1408058 - RNA, 21 nt, Human
aagauucaaugccccugaauu

SEQ ID NO: 1408059 - RNA, 20 nt, Human
aagauucaaugccccugaau

SEQ ID NO: 1408060 - RNA, 14 nt, Human
aagauuauagauuc

SEQ ID NO: 1408061 - RNA, 20 nt, Human
aagauuauagauucuaaaga

SEQ ID NO: 1408062 - RNA, 17 nt, Human
aagauuauagauucuaa

SEQ ID NO: 1408063 - RNA, 16 nt, Human
aagauuauagauucua

SEQ ID NO: 1408064 - RNA, 15 nt, Human
aagauuauagauucu

SEQ ID NO: 1408065 - RNA, 17 nt, Human
aagauacuuaagugcug

SEQ ID NO: 1408066 - RNA, 14 nt, Human
aagauacuuaagug

SEQ ID NO: 1408067 - RNA, 20 nt, Human
aagauacugaaauaaacguc

SEQ ID NO: 1408068 - RNA, 16 nt, Human
aagauacugaaauaaa

SEQ ID NO: 1408069 - RNA, 19 nt, Human
aagacaugucuguucuaca

SEQ ID NO: 1408070 - RNA, 17 nt, Human
aagacaugucuguucua

SEQ ID NO: 1408071 - RNA, 16 nt, Human
aagacaugucuguucu

SEQ ID NO: 1408072 - RNA, 16 nt, Human
aagacauucaggacug

SEQ ID NO: 1408073 - RNA, 13 nt, Human
aagacaugucugu

SEQ ID NO: 1408074 - RNA, 12 nt, Human
aagacaugucug

SEQ ID NO: 1408075 - RNA, 14 nt, Human
aagacaguggcccc

SEQ ID NO: 1408076 - RNA, 23 nt, Human
aagacagugaaagaaaauaacaa

SEQ ID NO: 1408077 - RNA, 22 nt, Human
aagacagcuucucauccugcag

SEQ ID NO: 1408078 - RNA, 19 nt, Human
aacuuagauuuuacaugaa

SEQ ID NO: 1408079 - RNA, 16 nt, Human
aacuuagauuuuacau

SEQ ID NO: 1408080 - RNA, 21 nt, Human
aacuuaccaggcaccaaaaga

SEQ ID NO: 1408081 - RNA, 19 nt, Human
aacuuaccugggcauucuu

SEQ ID NO: 1408082 - RNA, 19 nt, Human
aacuguuggaauggauuuu

SEQ ID NO: 1408083 - RNA, 18 nt, Human
aacuguuguagaagacaa

SEQ ID NO: 1408084 - RNA, 19 nt, Human
aacuguuguagaagacaaa

SEQ ID NO: 1408085 - RNA, 18 nt, Human
aagagagccugcaggauc

SEQ ID NO: 1408086 - RNA, 21 nt, Human
aagagacaaacaccucccagg

SEQ ID NO: 1408087 - RNA, 19 nt, Human
aagagacaaacaccuccca

SEQ ID NO: 1408088 - RNA, 22 nt, Human
aagagaaugcccuucuccuuau

SEQ ID NO: 1408089 - RNA, 15 nt, Human
aagagaacuuccaga

SEQ ID NO: 1408090 - RNA, 15 nt, Human
aagacuuuuaugaua

SEQ ID NO: 1408091 - RNA, 23 nt, Human
aagagaaugcccuucuccuuauu

SEQ ID NO: 1408092 - RNA, 21 nt, Human
aagagaaguuguaaaguaugu

SEQ ID NO: 1408093 - RNA, 13 nt, Human
aagagaaguagaa

SEQ ID NO: 1408094 - RNA, 13 nt, Human
aagagaaggagca

SEQ ID NO: 1408095 - RNA, 18 nt, Human
acuggaaggggaagggac

SEQ ID NO: 1408096 - RNA, 20 nt, Human
acuggaagcuaauuugcauu

SEQ ID NO: 1408097 - RNA, 18 nt, Human
acugccaggcucucuuug

SEQ ID NO: 1408098 - RNA, 17 nt, Human
acugccaggcucucuuu

SEQ ID NO: 1408099 - RNA, 14 nt, Human
acugccaggcucuc

SEQ ID NO: 1408100 - RNA, 13 nt, Human
acugccaggcucu

SEQ ID NO: 1408101 - RNA, 21 nt, Human
acugccauauuaaauuuuuug

SEQ ID NO: 1408102 - RNA, 16 nt, Human
acugccauauuaaauu

SEQ ID NO: 1408103 - RNA, 19 nt, Human
acugccauaugauuuacau

SEQ ID NO: 1408104 - RNA, 13 nt, Human
acugccauaugau

SEQ ID NO: 1408105 - RNA, 21 nt, Human
acucuaagaucuuagauucuc

SEQ ID NO: 1408106 - RNA, 20 nt, Human
acucuaagaucuuagauucu

SEQ ID NO: 1408107 - RNA, 17 nt, Human
acucuaagaucuuagau

SEQ ID NO: 1408108 - RNA, 13 nt, Human
acucuaagaucuu

SEQ ID NO: 1408109 - RNA, 12 nt, Human
acucuaagaucu

SEQ ID NO: 1408110 - RNA, 15 nt, Human
acucuaagaaagaac

SEQ ID NO: 1408111 - RNA, 14 nt, Human
acucuaagaaagaa

SEQ ID NO: 1408112 - RNA, 13 nt, Human
acucuaagaaaga

SEQ ID NO: 1408113 - RNA, 14 nt, Human
acucuaaagucugu

SEQ ID NO: 1408114 - RNA, 18 nt, Human
acucuaaagcaaauuuau

SEQ ID NO: 1408115 - RNA, 14 nt, Human
acucuaaagcaaau

SEQ ID NO: 1408116 - RNA, 13 nt, Human
acucuaaagcaaa

SEQ ID NO: 1408117 - RNA, 22 nt, Human
acuauuuucagaugugaaccau

SEQ ID NO: 1408118 - RNA, 12 nt, Human
acuauuuucaga

SEQ ID NO: 1408119 - RNA, 14 nt, Human
acuauuuuucagaa

SEQ ID NO: 1408120 - RNA, 21 nt, Human
acucuacuuaauccaaugggu

SEQ ID NO: 1408121 - RNA, 19 nt, Human
acucuacuuaauccaaugg

SEQ ID NO: 1408122 - RNA, 22 nt, Human
acucuagaugaaguuuuacauu

SEQ ID NO: 1408123 - RNA, 21 nt, Human
acucuagaugaaguuuuacau

SEQ ID NO: 1408124 - RNA, 20 nt, Human
acucuagaguccaagguuua

SEQ ID NO: 1408125 - RNA, 14 nt, Human
acucuagaguccaa

SEQ ID NO: 1408126 - RNA, 20 nt, Human
acugaauaccacucuguaau

SEQ ID NO: 1408127 - RNA, 19 nt, Human
acugaauaccacucuguaa

SEQ ID NO: 1408128 - RNA, 18 nt, Human
acugaauaccacucugua

SEQ ID NO: 1408129 - RNA, 17 nt, Human
acugaauaccacucugu

SEQ ID NO: 1408130 - RNA, 14 nt, Human
acugaauaccacuc

SEQ ID NO: 1408131 - RNA, 13 nt, Human
acugaauaccacu

SEQ ID NO: 1408132 - RNA, 23 nt, Human
acugaauaaauuguacagccggc

SEQ ID NO: 1408133 - RNA, 22 nt, Human
acugaauaaauuguacagccgg

SEQ ID NO: 1408134 - RNA, 20 nt, Human
acucuuaagaagacugcauu

SEQ ID NO: 1408135 - RNA, 20 nt, Human
acucuguucauuccuccagg

SEQ ID NO: 1408136 - RNA, 15 nt, Human
acucuuaagaagacu

SEQ ID NO: 1408137 - RNA, 14 nt, Human
acucuuaagaagac

SEQ ID NO: 1408138 - RNA, 14 nt, Human
acucuagauuccau

SEQ ID NO: 1408139 - RNA, 13 nt, Human
acucuagauucca

SEQ ID NO: 1408140 - RNA, 19 nt, Human
acucuagaguccaagguuu

SEQ ID NO: 1408141 - RNA, 15 nt, Human
acucuguucauuccu

SEQ ID NO: 1408142 - RNA, 16 nt, Human
acucuguucauuccuc

SEQ ID NO: 1408143 - RNA, 18 nt, Human
acucuguucauuccucca

SEQ ID NO: 1408144 - RNA, 19 nt, Human
acucuguucauuccuccag

SEQ ID NO: 1408145 - RNA, 15 nt, Human
acugaugcuuagaug

SEQ ID NO: 1408146 - RNA, 20 nt, Human
acugaugcugccccucaucu

SEQ ID NO: 1408147 - RNA, 19 nt, Human
acugaugcugccccucauc

SEQ ID NO: 1408148 - RNA, 15 nt, Human
acugaugcugccccu

SEQ ID NO: 1408149 - RNA, 14 nt, Human
acugaugcugcccc

SEQ ID NO: 1408150 - RNA, 12 nt, Human
acugaugcugcc

SEQ ID NO: 1408151 - RNA, 11 nt, Human
acugaugcugc

SEQ ID NO: 1408152 - RNA, 14 nt, Human
acugaccagaacua

SEQ ID NO: 1408153 - RNA, 12 nt, Human
acugaccagaac

SEQ ID NO: 1408154 - RNA, 15 nt, Human
acugaccagcagcuu

SEQ ID NO: 1408155 - RNA, 14 nt, Human
acugaccagcagcu

SEQ ID NO: 1408156 - RNA, 21 nt, Human
acugaauaccacucuguaauu

SEQ ID NO: 1408157 - RNA, 22 nt, Human
acugaauaccacucuguaauug

SEQ ID NO: 1408158 - RNA, 21 nt, Human
acugcaaaucaggcuuuuguu

SEQ ID NO: 1408159 - RNA, 20 nt, Human
acugcaaaucaggcuuuugu

SEQ ID NO: 1408160 - RNA, 18 nt, Human
acugcaaaucaggcuuuu

SEQ ID NO: 1408161 - RNA, 22 nt, Human
acugcaaaaagaaaaucuuuau

SEQ ID NO: 1408162 - RNA, 15 nt, Human
acugauuucagagug

SEQ ID NO: 1408163 - RNA, 12 nt, Human
acugauuucaga

SEQ ID NO: 1408164 - RNA, 20 nt, Human
acugauucacaucucauuuu

SEQ ID NO: 1408165 - RNA, 19 nt, Human
acugauucacaucucauuu

SEQ ID NO: 1408166 - RNA, 14 nt, Human
acuuuccauuacaa

SEQ ID NO: 1408167 - RNA, 22 nt, Human
acuuucagcugucuuuuggagg

SEQ ID NO: 1408168 - RNA, 15 nt, Human
acuuucagcugucuu

SEQ ID NO: 1408169 - RNA, 13 nt, Human
acuuucagcuguc

SEQ ID NO: 1408170 - RNA, 11 nt, Human
acuuucagcug

SEQ ID NO: 1408171 - RNA, 13 nt, Human
acuuuauguaguu

SEQ ID NO: 1408172 - RNA, 15 nt, Human
acuuuauuuuguguu

SEQ ID NO: 1408173 - RNA, 20 nt, Human
acuugggagaccuguaauca

SEQ ID NO: 1408174 - RNA, 13 nt, Human
acuugggaauaua

SEQ ID NO: 1408175 - RNA, 20 nt, Human
acuggaccacugggcaauga

SEQ ID NO: 1408176 - RNA, 16 nt, Human
acuggaccacugggca

SEQ ID NO: 1408177 - RNA, 15 nt, Human
acuggacagcuugug

SEQ ID NO: 1408178 - RNA, 14 nt, Human
acuggacagcuugu

SEQ ID NO: 1408179 - RNA, 13 nt, Human
acuggacagcuug

SEQ ID NO: 1408180 - RNA, 12 nt, Human
acuggacagcuu

SEQ ID NO: 1408181 - RNA, 17 nt, Human
acuggaauccuuucagc

SEQ ID NO: 1408182 - RNA, 16 nt, Human
acuggaauccuuucag

SEQ ID NO: 1408183 - RNA, 21 nt, Human
acuggaaucagcucaggacug

SEQ ID NO: 1408184 - RNA, 21 nt, Human
acuggaccacugggcaaugau

SEQ ID NO: 1408185 - RNA, 15 nt, Human
acuggacccuguugc

SEQ ID NO: 1408186 - RNA, 22 nt, Human
acuuaaagcuuucagaauaugu

SEQ ID NO: 1408187 - RNA, 16 nt, Human
acuuaaagcuuucaga

SEQ ID NO: 1408188 - RNA, 19 nt, Human
acuuaaacuugcaucacuu

SEQ ID NO: 1408189 - RNA, 14 nt, Human
acuuaaauaaugug

SEQ ID NO: 1408190 - RNA, 15 nt, Human
acuuaaauaauguga

SEQ ID NO: 1408191 - RNA, 16 nt, Human
acuucugccuggagac

SEQ ID NO: 1408192 - RNA, 13 nt, Human
acuucugccugga

SEQ ID NO: 1408193 - RNA, 12 nt, Human
acuucugccugg

SEQ ID NO: 1408194 - RNA, 23 nt, Human
acuuggcuggugugguacagaga

SEQ ID NO: 1408195 - RNA, 22 nt, Human
acuuggcuggugugguacagag

SEQ ID NO: 1408196 - RNA, 19 nt, Human
acuuggcuggugugguaca

SEQ ID NO: 1408197 - RNA, 14 nt, Human
acuuggcuggugug

SEQ ID NO: 1408198 - RNA, 13 nt, Human
acuuggcuggugu

SEQ ID NO: 1408199 - RNA, 16 nt, Human
acuuggcugcaggaau

SEQ ID NO: 1408200 - RNA, 23 nt, Human
acuuggcucgaaucucugugccu

SEQ ID NO: 1408201 - RNA, 22 nt, Human
acuuggcucgaaucucugugcc

SEQ ID NO: 1408202 - RNA, 19 nt, Human
acuucagcgguuuauauaa

SEQ ID NO: 1408203 - RNA, 18 nt, Human
acuucagcgguuuauaua

SEQ ID NO: 1408204 - RNA, 23 nt, Human
acuucaagcauggcuauuuuaua

SEQ ID NO: 1408205 - RNA, 19 nt, Human
acuucaagcauggcuauuu

SEQ ID NO: 1408206 - RNA, 20 nt, Human
acuucaaauccuugaagauu

SEQ ID NO: 1408207 - RNA, 15 nt, Human
accucaucuucuuca

SEQ ID NO: 1408208 - RNA, 18 nt, Human
accucaguuuuaucauuu

SEQ ID NO: 1408209 - RNA, 17 nt, Human
accucaguuuuaucauu

SEQ ID NO: 1408210 - RNA, 18 nt, Human
accccaaccugcucuccu

SEQ ID NO: 1408211 - RNA, 15 nt, Human
accucaggugaucca

SEQ ID NO: 1408212 - RNA, 13 nt, Human
accccaauccucc

SEQ ID NO: 1408213 - RNA, 21 nt, Human
accccaauuucggauuuuuuc

SEQ ID NO: 1408214 - RNA, 20 nt, Human
accccaauuucggauuuuuu

SEQ ID NO: 1408215 - RNA, 19 nt, Human
accccaaccugcucuccuc

SEQ ID NO: 1408216 - RNA, 20 nt, Human
accccaaccugcucuccucu

SEQ ID NO: 1408217 - RNA, 19 nt, Human
acccuuacaguaggagccc

SEQ ID NO: 1408218 - RNA, 13 nt, Human
acccuuacaguag

SEQ ID NO: 1408219 - RNA, 18 nt, Human
acccuguuccugcugcug

SEQ ID NO: 1408220 - RNA, 14 nt, Human
acccuguugcuaag

SEQ ID NO: 1408221 - RNA, 15 nt, Human
acccuguugcuaagc

SEQ ID NO: 1408222 - RNA, 21 nt, Human
acccuguuccugcugcugucu

SEQ ID NO: 1408223 - RNA, 12 nt, Human
acccuguugcua

SEQ ID NO: 1408224 - RNA, 17 nt, Human
acccuguuccugcugcu

SEQ ID NO: 1408225 - RNA, 16 nt, Human
acccuguuccugcugc

SEQ ID NO: 1408226 - RNA, 15 nt, Human
acccuguuccugcug

SEQ ID NO: 1408227 - RNA, 14 nt, Human
acccuguuccugcu

SEQ ID NO: 1408228 - RNA, 13 nt, Human
acccuguuccugc

SEQ ID NO: 1408229 - RNA, 17 nt, Human
acccuguggucuuccuc

SEQ ID NO: 1408230 - RNA, 14 nt, Human
accgguggggcugg

SEQ ID NO: 1408231 - RNA, 16 nt, Human
accggcucucaccugg

SEQ ID NO: 1408232 - RNA, 19 nt, Human
accggggccugggcaggag

SEQ ID NO: 1408233 - RNA, 17 nt, Human
accggccugccaggagg

SEQ ID NO: 1408234 - RNA, 15 nt, Human
accggccugccagga

SEQ ID NO: 1408235 - RNA, 13 nt, Human
accggccugccag

SEQ ID NO: 1408236 - RNA, 21 nt, Human
accggcucucaccuggcccug

SEQ ID NO: 1408237 - RNA, 14 nt, Human
accggcucucaccu

SEQ ID NO: 1408238 - RNA, 16 nt, Human
accggccugccaggag

SEQ ID NO: 1408239 - RNA, 23 nt, Human
accggcggaccccagccauccag

SEQ ID NO: 1408240 - RNA, 20 nt, Human
accucugccucagaaaacaa

SEQ ID NO: 1408241 - RNA, 19 nt, Human
accugcccuaccugcccca

SEQ ID NO: 1408242 - RNA, 12 nt, Human
accugcccugcc

SEQ ID NO: 1408243 - RNA, 13 nt, Human
accugcccugccc

SEQ ID NO: 1408244 - RNA, 16 nt, Human
accugcccugcccugc

SEQ ID NO: 1408245 - RNA, 17 nt, Human
accugcccugcccugcc

SEQ ID NO: 1408246 - RNA, 18 nt, Human
accugcccugcccugcca

SEQ ID NO: 1408247 - RNA, 20 nt, Human
accugcccugcccugccacc

SEQ ID NO: 1408248 - RNA, 21 nt, Human
accugcccugcccugccaccu

SEQ ID NO: 1408249 - RNA, 22 nt, Human
accugcccugcccugccaccug

SEQ ID NO: 1408250 - RNA, 18 nt, Human
accugcccuaccugcccc

SEQ ID NO: 1408251 - RNA, 23 nt, Human
accugcccugcccugccaccugu

SEQ ID NO: 1408252 - RNA, 14 nt, Human
accugucugucugu

SEQ ID NO: 1408253 - RNA, 18 nt, Human
accugucugucugucugu

SEQ ID NO: 1408254 - RNA, 20 nt, Human
accugucugucugucugucc

SEQ ID NO: 1408255 - RNA, 18 nt, Human
accucugccucagaaaac

SEQ ID NO: 1408256 - RNA, 17 nt, Human
accucugccucagaaaa

SEQ ID NO: 1408257 - RNA, 17 nt, Human
accucuugagccuugaa

SEQ ID NO: 1408258 - RNA, 19 nt, Human
accucuugagccuugaacu

SEQ ID NO: 1408259 - RNA, 20 nt, Human
accucuugagccuugaacuu

SEQ ID NO: 1408260 - RNA, 21 nt, Human
accucuugagccuugaacuuu

SEQ ID NO: 1408261 - RNA, 19 nt, Human
accuguguggacaggacua

SEQ ID NO: 1408262 - RNA, 16 nt, Human
accuguguggacagga

SEQ ID NO: 1408263 - RNA, 18 nt, Human
accugugagcccagcugg

SEQ ID NO: 1408264 - RNA, 17 nt, Human
accugugagcccagcug

SEQ ID NO: 1408265 - RNA, 15 nt, Human
accugugagcccagc

SEQ ID NO: 1408266 - RNA, 14 nt, Human
acguggcucagcca

SEQ ID NO: 1408267 - RNA, 16 nt, Human
acguggccucuugagc

SEQ ID NO: 1408268 - RNA, 15 nt, Human
acguggcccagagaa

SEQ ID NO: 1408269 - RNA, 20 nt, Human
acggagccacuccucugacu

SEQ ID NO: 1408270 - RNA, 19 nt, Human
acggagccacuccucugac

SEQ ID NO: 1408271 - RNA, 18 nt, Human
acggagccacuccucuga

SEQ ID NO: 1408272 - RNA, 23 nt, Human
acggaccaaagggagucugccag

SEQ ID NO: 1408273 - RNA, 17 nt, Human
acgucuggguggcccuu

SEQ ID NO: 1408274 - RNA, 19 nt, Human
acuaauauauuuaaaaaua

SEQ ID NO: 1408275 - RNA, 20 nt, Human
acuaauauauuuaaaaauaa

SEQ ID NO: 1408276 - RNA, 18 nt, Human
acuaauauauuuaaaaau

SEQ ID NO: 1408277 - RNA, 17 nt, Human
acuaauauauuuaaaaa

SEQ ID NO: 1408278 - RNA, 23 nt, Human
acuaacuaugcauggugccccag

SEQ ID NO: 1408279 - RNA, 15 nt, Human
acuaacuaugcaugg

SEQ ID NO: 1408280 - RNA, 15 nt, Human
acuaauagacaauuu

SEQ ID NO: 1408281 - RNA, 22 nt, Human
acuaaccuugccugguacagua

SEQ ID NO: 1408282 - RNA, 21 nt, Human
acuaaccuugccugguacagu

SEQ ID NO: 1408283 - RNA, 17 nt, Human
acuaaccuugccuggua

SEQ ID NO: 1408284 - RNA, 15 nt, Human
acuaaccuugccugg

SEQ ID NO: 1408285 - RNA, 18 nt, Human
acuaacguugagccccug

SEQ ID NO: 1408286 - RNA, 22 nt, Human
acuaacuagacaccaaaguucu

SEQ ID NO: 1408287 - RNA, 20 nt, Human
acuaacuagacaccaaaguu

SEQ ID NO: 1408288 - RNA, 19 nt, Human
acguggcucagccagcacu

SEQ ID NO: 1408289 - RNA, 17 nt, Human
acguggcucagccagca

SEQ ID NO: 1408290 - RNA, 18 nt, Human
acgcuggcaacacagagg

SEQ ID NO: 1408291 - RNA, 21 nt, Human
acggacaguuccagaagugug

SEQ ID NO: 1408292 - RNA, 17 nt, Human
acggacagagaccaaga

SEQ ID NO: 1408293 - RNA, 22 nt, Human
acggaaggguaaacaauauagu

SEQ ID NO: 1408294 - RNA, 16 nt, Human
acggaaggguaaacaa

SEQ ID NO: 1408295 - RNA, 23 nt, Human
acgcacugagcaacgcuauucca

SEQ ID NO: 1408296 - RNA, 15 nt, Human
acgcacggcagccac

SEQ ID NO: 1408297 - RNA, 17 nt, Human
acgcaccugccucagga

SEQ ID NO: 1408298 - RNA, 17 nt, Human
acgcacggcagccacag

SEQ ID NO: 1408299 - RNA, 18 nt, Human
acuaaugaaaacagaaug

SEQ ID NO: 1408300 - RNA, 19 nt, Human
acuaaugccuuacucuucu

SEQ ID NO: 1408301 - RNA, 22 nt, Human
acuaggccuugcggcuccucag

SEQ ID NO: 1408302 - RNA, 23 nt, Human
acuaggccuugcggcuccucagg

SEQ ID NO: 1408303 - RNA, 23 nt, Human
acuaggcccccacuugccucuuc

SEQ ID NO: 1408304 - RNA, 19 nt, Human
acuagggagccauuugaga

SEQ ID NO: 1408305 - RNA, 22 nt, Human
acuagggagccauguuucacaa

SEQ ID NO: 1408306 - RNA, 19 nt, Human
acuagggagccauguuuca

SEQ ID NO: 1408307 - RNA, 18 nt, Human
acuagggagccauguuuc

SEQ ID NO: 1408308 - RNA, 15 nt, Human
acuagggagccaugu

SEQ ID NO: 1408309 - RNA, 14 nt, Human
acuagggagccaug

SEQ ID NO: 1408310 - RNA, 14 nt, Human
acuauuguuacauu

SEQ ID NO: 1408311 - RNA, 22 nt, Human
acuauucuugauguaaaaucuu

SEQ ID NO: 1408312 - RNA, 20 nt, Human
acuauucuugauguaaaauc

SEQ ID NO: 1408313 - RNA, 23 nt, Human
acuauucuugauguaaaaucuug

SEQ ID NO: 1408314 - RNA, 15 nt, Human
acuauugcauuuaua

SEQ ID NO: 1408315 - RNA, 17 nt, Human
acuauugcuugcacaaa

SEQ ID NO: 1408316 - RNA, 18 nt, Human
acuagggaucccucaucu

SEQ ID NO: 1408317 - RNA, 16 nt, Human
acuagggaucccucau

SEQ ID NO: 1408318 - RNA, 18 nt, Human
acuaguauuucuaugaaa

SEQ ID NO: 1408319 - RNA, 19 nt, Human
acuauucuugauguaaaau

SEQ ID NO: 1408320 - RNA, 17 nt, Human
acuauucuugauguaaa

SEQ ID NO: 1408321 - RNA, 19 nt, Human
acuaguauuucuaugaaau

SEQ ID NO: 1408322 - RNA, 23 nt, Human
acacggucggggcaucuggccug

SEQ ID NO: 1408323 - RNA, 15 nt, Human
acacgggccugucca

SEQ ID NO: 1408324 - RNA, 20 nt, Human
acacggccacaucaaagagg

SEQ ID NO: 1408325 - RNA, 13 nt, Human
acacgggccuguc

SEQ ID NO: 1408326 - RNA, 14 nt, Human
acacggccacauca

SEQ ID NO: 1408327 - RNA, 12 nt, Human
acacggccacau

SEQ ID NO: 1408328 - RNA, 21 nt, Human
acaccacuacauucuguuaau

SEQ ID NO: 1408329 - RNA, 18 nt, Human
acaauuuuuuuuauuagu

SEQ ID NO: 1408330 - RNA, 24 nt, Human
acaauuuuuuuuauuaguauuguu

SEQ ID NO: 1408331 - RNA, 17 nt, Human
acaauuuuuuuuauuag

SEQ ID NO: 1408332 - RNA, 22 nt, Human
acaauuuuuuaucaugcauguc

SEQ ID NO: 1408333 - RNA, 16 nt, Human
acaauuuuuuaucaug

SEQ ID NO: 1408334 - RNA, 14 nt, Human
acacauuuuuuaaa

SEQ ID NO: 1408335 - RNA, 16 nt, Human
acacauuuuuuaaaug

SEQ ID NO: 1408336 - RNA, 18 nt, Human
acacauuuuuuaaaugca

SEQ ID NO: 1408337 - RNA, 19 nt, Human
acacauuuuuuaaaugcac

SEQ ID NO: 1408338 - RNA, 15 nt, Human
acaccacuacauucu

SEQ ID NO: 1408339 - RNA, 17 nt, Human
acaccacuacauucugu

SEQ ID NO: 1408340 - RNA, 20 nt, Human
acaccacuacauucuguuaa

SEQ ID NO: 1408341 - RNA, 21 nt, Human
acaauuaggcagacucuuuau

SEQ ID NO: 1408342 - RNA, 24 nt, Human
acaauucuaaaaugauuguaguaa

SEQ ID NO: 1408343 - RNA, 23 nt, Human
acaauucuaaaaugauuguagua

SEQ ID NO: 1408344 - RNA, 17 nt, Human
acaauucuaaaaugauu

SEQ ID NO: 1408345 - RNA, 14 nt, Human
acaauucuaaaaug

SEQ ID NO: 1408346 - RNA, 12 nt, Human
acaauucuaaaa

SEQ ID NO: 1408347 - RNA, 23 nt, Human
acaauuccucuacuaacaaucag

SEQ ID NO: 1408348 - RNA, 22 nt, Human
acaauuccucuacuaacaauca

SEQ ID NO: 1408349 - RNA, 18 nt, Human
acaauuuaugaauugaau

SEQ ID NO: 1408350 - RNA, 13 nt, Human
acaauuuauuaug

SEQ ID NO: 1408351 - RNA, 14 nt, Human
acaauuuauuaugg

SEQ ID NO: 1408352 - RNA, 22 nt, Human
acaaggauagaugcuggcccag

SEQ ID NO: 1408353 - RNA, 14 nt, Human
acagaacuucagaa

SEQ ID NO: 1408354 - RNA, 20 nt, Human
acagaacucuuucaaaaccu

SEQ ID NO: 1408355 - RNA, 18 nt, Human
acagaacucuuucaaaac

SEQ ID NO: 1408356 - RNA, 16 nt, Human
acagaacauagacaga

SEQ ID NO: 1408357 - RNA, 17 nt, Human
acagaaccccuacauga

SEQ ID NO: 1408358 - RNA, 18 nt, Human
acacuguguacugcaguu

SEQ ID NO: 1408359 - RNA, 18 nt, Human
acacuggggacuuggccu

SEQ ID NO: 1408360 - RNA, 22 nt, Human
acacuggggacuuggccucucu

SEQ ID NO: 1408361 - RNA, 17 nt, Human
acacuggggacuuggcc

SEQ ID NO: 1408362 - RNA, 23 nt, Human
acacuguguaaauacccauaugu

SEQ ID NO: 1408363 - RNA, 13 nt, Human
acacugggacuug

SEQ ID NO: 1408364 - RNA, 18 nt, Human
acacugggacuugcaaaa

SEQ ID NO: 1408365 - RNA, 19 nt, Human
acacugggacuugcaaaaa

SEQ ID NO: 1408366 - RNA, 20 nt, Human
acacugggagaaaugaaaaa

SEQ ID NO: 1408367 - RNA, 16 nt, Human
acagaggacacagaga

SEQ ID NO: 1408368 - RNA, 13 nt, Human
acagaggcagccc

SEQ ID NO: 1408369 - RNA, 23 nt, Human
acagaagggagggcagagcuggu

SEQ ID NO: 1408370 - RNA, 22 nt, Human
acagaagggagggcagagcugg

SEQ ID NO: 1408371 - RNA, 21 nt, Human
acagaagggagggcagagcug

SEQ ID NO: 1408372 - RNA, 19 nt, Human
acagaagggagggcagagc

SEQ ID NO: 1408373 - RNA, 17 nt, Human
acagaagggagggcaga

SEQ ID NO: 1408374 - RNA, 16 nt, Human
acagaagggagggcag

SEQ ID NO: 1408375 - RNA, 12 nt, Human
acagaagaaaca

SEQ ID NO: 1408376 - RNA, 21 nt, Human
acagaacuucagaaagacuug

SEQ ID NO: 1408377 - RNA, 20 nt, Human
acagaacuucagaaagacuu

SEQ ID NO: 1408378 - RNA, 19 nt, Human
acagaacuucagaaagacu

SEQ ID NO: 1408379 - RNA, 18 nt, Human
acagaacuucagaaagac

SEQ ID NO: 1408380 - RNA, 17 nt, Human
acagaacuucagaaaga

SEQ ID NO: 1408381 - RNA, 16 nt, Human
acagaagcuccaggua

SEQ ID NO: 1408382 - RNA, 12 nt, Human
aauuuuggauuu

SEQ ID NO: 1408383 - RNA, 14 nt, Human
aauuuugauguuuu

SEQ ID NO: 1408384 - RNA, 18 nt, Human
aauuuugugaagcaaaau

SEQ ID NO: 1408385 - RNA, 17 nt, Human
aauuuugugaagcaaaa

SEQ ID NO: 1408386 - RNA, 18 nt, Human
aauuuucaucuaggauuu

SEQ ID NO: 1408387 - RNA, 15 nt, Human
acaaacuuugcaucu

SEQ ID NO: 1408388 - RNA, 13 nt, Human
acaaacuuugcau

SEQ ID NO: 1408389 - RNA, 15 nt, Human
acaaaauggaauacu

SEQ ID NO: 1408390 - RNA, 14 nt, Human
acaaaauggaauac

SEQ ID NO: 1408391 - RNA, 13 nt, Human
acaaaauggaaua

SEQ ID NO: 1408392 - RNA, 20 nt, Human
acaaagaaacaaagauguua

SEQ ID NO: 1408393 - RNA, 17 nt, Human
acaaagaaacaaagaug

SEQ ID NO: 1408394 - RNA, 19 nt, Human
acaaacuuugcaucucagu

SEQ ID NO: 1408395 - RNA, 13 nt, Human
acaaacuuuuaua

SEQ ID NO: 1408396 - RNA, 12 nt, Human
acaaagaaauua

SEQ ID NO: 1408397 - RNA, 14 nt, Human
acaaagaaauuaug

SEQ ID NO: 1408398 - RNA, 16 nt, Human
acaaagaaauuaugug

SEQ ID NO: 1408399 - RNA, 16 nt, Human
acaaccucaacugccu

SEQ ID NO: 1408400 - RNA, 18 nt, Human
acaaagaaacaaagaugu

SEQ ID NO: 1408401 - RNA, 15 nt, Human
acaaccucaacugcc

SEQ ID NO: 1408402 - RNA, 21 nt, Human
acaaggaugaauuaaguuuuu

SEQ ID NO: 1408403 - RNA, 16 nt, Human
aauuguauuuuaguaa

SEQ ID NO: 1408404 - RNA, 14 nt, Human
aauuguauauugua

SEQ ID NO: 1408405 - RNA, 13 nt, Human
aauuguauauuca

SEQ ID NO: 1408406 - RNA, 14 nt, Human
aauuguauauucac

SEQ ID NO: 1408407 - RNA, 16 nt, Human
aauuguauauucacuu

SEQ ID NO: 1408408 - RNA, 17 nt, Human
aauuguauauucacuuu

SEQ ID NO: 1408409 - RNA, 16 nt, Human
aauuguaacuguucuu

SEQ ID NO: 1408410 - RNA, 14 nt, Human
aauuguaacuguuc

SEQ ID NO: 1408411 - RNA, 12 nt, Human
aauuguauauuc

SEQ ID NO: 1408412 - RNA, 21 nt, Human
aauuguaaaguaaaagcuaua

SEQ ID NO: 1408413 - RNA, 20 nt, Human
aauugugauuagacagaaca

SEQ ID NO: 1408414 - RNA, 18 nt, Human
aauugugauuagacagaa

SEQ ID NO: 1408415 - RNA, 21 nt, Human
aauugugcaguacuuugugca

SEQ ID NO: 1408416 - RNA, 16 nt, Human
aauuguguagccuuuu

SEQ ID NO: 1408417 - RNA, 15 nt, Human
aauuguguagccuuu

SEQ ID NO: 1408418 - RNA, 17 nt, Human
aauugugguuuauauau

SEQ ID NO: 1408419 - RNA, 16 nt, Human
aauugugguuuauaua

SEQ ID NO: 1408420 - RNA, 21 nt, Human
aauugugauuagacagaacac

SEQ ID NO: 1408421 - RNA, 17 nt, Human
aauuguguagccuuuuu

SEQ ID NO: 1408422 - RNA, 21 nt, Human
aauuguguagccuuuuuguau

SEQ ID NO: 1408423 - RNA, 12 nt, Human
aauugucugaaa

SEQ ID NO: 1408424 - RNA, 18 nt, Human
aauugucccuuaaacaaa

SEQ ID NO: 1408425 - RNA, 16 nt, Human
aauugucccuuaaaca

SEQ ID NO: 1408426 - RNA, 11 nt, Human
aauugucccuu

SEQ ID NO: 1408427 - RNA, 23 nt, Human
aauuuauuugaaugauuuuucuu

SEQ ID NO: 1408428 - RNA, 19 nt, Human
aauuuauuuccuaguucug

SEQ ID NO: 1408429 - RNA, 22 nt, Human
aauuuauuuccuaguucuguag

SEQ ID NO: 1408430 - RNA, 16 nt, Human
aauuuauuuccuaguu

SEQ ID NO: 1408431 - RNA, 13 nt, Human
aauuuauuauuaa

SEQ ID NO: 1408432 - RNA, 20 nt, Human
aauuucggauuuuuuccaaa

SEQ ID NO: 1408433 - RNA, 18 nt, Human
aauuucggauuuuuucca

SEQ ID NO: 1408434 - RNA, 17 nt, Human
aauuucggauuuuuucc

SEQ ID NO: 1408435 - RNA, 21 nt, Human
aauuucggauuuuuuccaaaa

SEQ ID NO: 1408436 - RNA, 16 nt, Human
aauuucaccuguaaac

SEQ ID NO: 1408437 - RNA, 17 nt, Human
aauuucaagguucuaac

SEQ ID NO: 1408438 - RNA, 16 nt, Human
aauuucaagguucuaa

SEQ ID NO: 1408439 - RNA, 15 nt, Human
aauuucaagguucua

SEQ ID NO: 1408440 - RNA, 14 nt, Human
aauuucaagguucu

SEQ ID NO: 1408441 - RNA, 16 nt, Human
aauuucaaaaugcuuu

SEQ ID NO: 1408442 - RNA, 12 nt, Human
aauuucaaaaug

SEQ ID NO: 1408443 - RNA, 13 nt, Human
aauuuauuuucuu

SEQ ID NO: 1408444 - RNA, 21 nt, Human
aauuucaggaggaauacugaa

SEQ ID NO: 1408445 - RNA, 23 nt, Human
aauuucacugucuuuaauucugu

SEQ ID NO: 1408446 - RNA, 23 nt, Human
aauuucagacucccauuccugaa

SEQ ID NO: 1408447 - RNA, 13 nt, Human
aauuucagacucc

SEQ ID NO: 1408448 - RNA, 18 nt, Human
aauuucaagguucuaacc

SEQ ID NO: 1408449 - RNA, 20 nt, Human
aauuucaccuguaaaccuga

SEQ ID NO: 1408450 - RNA, 19 nt, Human
aauuucaccuguaaaccug

SEQ ID NO: 1408451 - RNA, 21 nt, Human
aauuuccugggagcuuuugua

SEQ ID NO: 1408452 - RNA, 18 nt, Human
aauuuccugggagcuuuu

SEQ ID NO: 1408453 - RNA, 18 nt, Human
acaugccauuuguacuga

SEQ ID NO: 1408454 - RNA, 17 nt, Human
acaugccauuuguacug

SEQ ID NO: 1408455 - RNA, 21 nt, Human
acaugccauuuguacugaccc

SEQ ID NO: 1408456 - RNA, 14 nt, Human
acaugccacaagga

SEQ ID NO: 1408457 - RNA, 23 nt, Human
acaugauuuccuugaauguggcu

SEQ ID NO: 1408458 - RNA, 18 nt, Human
acaugcaaggucauuuuu

SEQ ID NO: 1408459 - RNA, 17 nt, Human
acaugcaaggucauuuu

SEQ ID NO: 1408460 - RNA, 15 nt, Human
acaucauucauuuuu

SEQ ID NO: 1408461 - RNA, 21 nt, Human
acaucauuacuauaagaacuu

SEQ ID NO: 1408462 - RNA, 18 nt, Human
acaucauuacuauaagaa

SEQ ID NO: 1408463 - RNA, 15 nt, Human
acaucauuacuauaa

SEQ ID NO: 1408464 - RNA, 15 nt, Human
acauccuccucccac

SEQ ID NO: 1408465 - RNA, 13 nt, Human
acauccuccuccc

SEQ ID NO: 1408466 - RNA, 21 nt, Human
acauccuccacguucugcuca

SEQ ID NO: 1408467 - RNA, 21 nt, Human
acaugauuuccuugaaugugg

SEQ ID NO: 1408468 - RNA, 16 nt, Human
acaugcaaggucauuu

SEQ ID NO: 1408469 - RNA, 17 nt, Human
acauaauucacucugag

SEQ ID NO: 1408470 - RNA, 16 nt, Human
acauaauucacucuga

SEQ ID NO: 1408471 - RNA, 23 nt, Human
acauaauuauccaggaagggaau

SEQ ID NO: 1408472 - RNA, 17 nt, Human
acauaauuauccaggaa

SEQ ID NO: 1408473 - RNA, 19 nt, Human
acauaagcuauuuuucuaa

SEQ ID NO: 1408474 - RNA, 20 nt, Human
acauaagcuauuuuucuaac

SEQ ID NO: 1408475 - RNA, 18 nt, Human
acauaagcuauuuuucua

SEQ ID NO: 1408476 - RNA, 17 nt, Human
acauaagcuauuuuucu

SEQ ID NO: 1408477 - RNA, 13 nt, Human
acauaagcuauuu

SEQ ID NO: 1408478 - RNA, 12 nt, Human
acauaagcuauu

SEQ ID NO: 1408479 - RNA, 18 nt, Human
acauaagccauuauucac

SEQ ID NO: 1408480 - RNA, 15 nt, Human
acauaagccauuauu

SEQ ID NO: 1408481 - RNA, 16 nt, Human
acaucagguuuuuccc

SEQ ID NO: 1408482 - RNA, 15 nt, Human
acaucagguuuuucc

SEQ ID NO: 1408483 - RNA, 12 nt, Human
acaucagcccuu

SEQ ID NO: 1408484 - RNA, 21 nt, Human
acauaauuuaguuucauauaa

SEQ ID NO: 1408485 - RNA, 20 nt, Human
acauaauucacucugagugu

SEQ ID NO: 1408486 - RNA, 18 nt, Human
acauaauucacucugagu

SEQ ID NO: 1408487 - RNA, 14 nt, Human
acagcugccucuuc

SEQ ID NO: 1408488 - RNA, 21 nt, Human
acagugagccugaauuuuguu

SEQ ID NO: 1408489 - RNA, 18 nt, Human
acagugagccugaauuuu

SEQ ID NO: 1408490 - RNA, 23 nt, Human
acagugagcuuggaaaggaccag

SEQ ID NO: 1408491 - RNA, 18 nt, Human
acaggugcuaauuuguuu

SEQ ID NO: 1408492 - RNA, 16 nt, Human
acaggucuucaucgaa

SEQ ID NO: 1408493 - RNA, 15 nt, Human
acagcugccucuucc

SEQ ID NO: 1408494 - RNA, 16 nt, Human
acagggcggggguggc

SEQ ID NO: 1408495 - RNA, 21 nt, Human
acagggccuuuggcaggugca

SEQ ID NO: 1408496 - RNA, 14 nt, Human
acagugcagugcgc

SEQ ID NO: 1408497 - RNA, 19 nt, Human
acaguggggaaugaagaua

SEQ ID NO: 1408498 - RNA, 15 nt, Human
acaguggggaaugaa

SEQ ID NO: 1408499 - RNA, 22 nt, Human
accagcagacagagccaggaga

SEQ ID NO: 1408500 - RNA, 20 nt, Human
accagcagacagagccagga

SEQ ID NO: 1408501 - RNA, 19 nt, Human
accagcagacagagccagg

SEQ ID NO: 1408502 - RNA, 19 nt, Human
accacgacuggccagggcc

SEQ ID NO: 1408503 - RNA, 24 nt, Human
accacgacuggccagggccacgcu

SEQ ID NO: 1408504 - RNA, 16 nt, Human
accacgacuggccagg

SEQ ID NO: 1408505 - RNA, 13 nt, Human
accacgacuggcc

SEQ ID NO: 1408506 - RNA, 22 nt, Human
accaccuuuguuucucccccau

SEQ ID NO: 1408507 - RNA, 20 nt, Human
accaccuuuguuucuccccc

SEQ ID NO: 1408508 - RNA, 14 nt, Human
accagcagaaaugc

SEQ ID NO: 1408509 - RNA, 14 nt, Human
accacccugagccg

SEQ ID NO: 1408510 - RNA, 13 nt, Human
accacccugagcc

SEQ ID NO: 1408511 - RNA, 12 nt, Human
accacccugagc

SEQ ID NO: 1408512 - RNA, 19 nt, Human
accacccucacuggcucuc

SEQ ID NO: 1408513 - RNA, 20 nt, Human
accacccucacuggcucucc

SEQ ID NO: 1408514 - RNA, 13 nt, Human
accacccucacug

SEQ ID NO: 1408515 - RNA, 22 nt, Human
accaccccgccugcccucaugg

SEQ ID NO: 1408516 - RNA, 20 nt, Human
accaagauacuuaagugcug

SEQ ID NO: 1408517 - RNA, 15 nt, Human
accaagauacuuaag

SEQ ID NO: 1408518 - RNA, 21 nt, Human
accaagauacuuaagugcugc

SEQ ID NO: 1408519 - RNA, 22 nt, Human
accaacuuuucuauuaaaagug

SEQ ID NO: 1408520 - RNA, 21 nt, Human
accaacuuuucuauuaaaagu

SEQ ID NO: 1408521 - RNA, 23 nt, Human
acauuucucuaagagaacaaugu

SEQ ID NO: 1408522 - RNA, 12 nt, Human
acauuucucaau

SEQ ID NO: 1408523 - RNA, 20 nt, Human
acauuucuauagccaaaaau

SEQ ID NO: 1408524 - RNA, 13 nt, Human
acauuucuaaaau

SEQ ID NO: 1408525 - RNA, 18 nt, Human
acauuuccuuacagaacu

SEQ ID NO: 1408526 - RNA, 18 nt, Human
acaugugaaaagaauaga

SEQ ID NO: 1408527 - RNA, 17 nt, Human
acaugugaaaagaauag

SEQ ID NO: 1408528 - RNA, 14 nt, Human
acaugugaaaagaa

SEQ ID NO: 1408529 - RNA, 16 nt, Human
acauuuccuaaauaua

SEQ ID NO: 1408530 - RNA, 17 nt, Human
acauuuccuaaauauau

SEQ ID NO: 1408531 - RNA, 15 nt, Human
acccaucaacaaaaa

SEQ ID NO: 1408532 - RNA, 20 nt, Human
acccauauuguaaaacaggu

SEQ ID NO: 1408533 - RNA, 16 nt, Human
acccauauuguaaaac

SEQ ID NO: 1408534 - RNA, 23 nt, Human
acccauauccuuacccuccuugg

SEQ ID NO: 1408535 - RNA, 22 nt, Human
acccaguuucuaaacuggagac

SEQ ID NO: 1408536 - RNA, 23 nt, Human
acccaguuucuaaacuggagacu

SEQ ID NO: 1408537 - RNA, 22 nt, Human
acccaccgggccacuccuuccu

SEQ ID NO: 1408538 - RNA, 19 nt, Human
acccaccgggccacuccuu

SEQ ID NO: 1408539 - RNA, 18 nt, Human
acccaccgggccacuccu

SEQ ID NO: 1408540 - RNA, 16 nt, Human
acccaccgggccacuc

SEQ ID NO: 1408541 - RNA, 14 nt, Human
acccaccgggccac

SEQ ID NO: 1408542 - RNA, 17 nt, Human
acccaccaacccucagg

SEQ ID NO: 1408543 - RNA, 14 nt, Human
acccacaugcucca

SEQ ID NO: 1408544 - RNA, 23 nt, Human
acccacaugccauuuguacugac

SEQ ID NO: 1408545 - RNA, 22 nt, Human
acccacacucagauccuccuca

SEQ ID NO: 1408546 - RNA, 23 nt, Human
acccacacucagauccuccucau

SEQ ID NO: 1408547 - RNA, 18 nt, Human
acccaccaacccucaggg

SEQ ID NO: 1408548 - RNA, 19 nt, Human
acccaccaacccucagggc

SEQ ID NO: 1408549 - RNA, 16 nt, Human
acccaccaguugaauu

SEQ ID NO: 1408550 - RNA, 12 nt, Human
acccacccagaa

SEQ ID NO: 1408551 - RNA, 12 nt, Human
acccaccccugc

SEQ ID NO: 1408552 - RNA, 15 nt, Human
acccaccccugcaca

SEQ ID NO: 1408553 - RNA, 15 nt, Human
acccacccagaauga

SEQ ID NO: 1408554 - RNA, 22 nt, Human
accauagcacaggcuaauuuuu

SEQ ID NO: 1408555 - RNA, 17 nt, Human
accaucaaguugugcca

SEQ ID NO: 1408556 - RNA, 22 nt, Human
accaucaccagaauuaauuuua

SEQ ID NO: 1408557 - RNA, 13 nt, Human
accaucacugagu

SEQ ID NO: 1408558 - RNA, 20 nt, Human
accaucagaaacacccucac

SEQ ID NO: 1408559 - RNA, 23 nt, Human
accaucagaaacacccucacacu

SEQ ID NO: 1408560 - RNA, 15 nt, Human
accauccaccaggcc

SEQ ID NO: 1408561 - RNA, 15 nt, Human
accaucucuccaacu

SEQ ID NO: 1408562 - RNA, 22 nt, Human
ggcucagccccaccccagggca

SEQ ID NO: 1408563 - RNA, 23 nt, Human
ggcucagccccaccccagggcag

SEQ ID NO: 1408564 - RNA, 15 nt, Human
ggcucagccagcacu

SEQ ID NO: 1408565 - RNA, 22 nt, Human
ggcguaggcuacagagaagccu

SEQ ID NO: 1408566 - RNA, 21 nt, Human
ggcguaggcuacagagaagcc

SEQ ID NO: 1408567 - RNA, 20 nt, Human
ggcguaggcuacagagaagc

SEQ ID NO: 1408568 - RNA, 19 nt, Human
ggcguaggcuacagagaag

SEQ ID NO: 1408569 - RNA, 17 nt, Human
ggcguaggcuacagaga

SEQ ID NO: 1408570 - RNA, 15 nt, Human
ggcguaggcuacaga

SEQ ID NO: 1408571 - RNA, 21 nt, Human
ggcguaaguacagagaagcca

SEQ ID NO: 1408572 - RNA, 22 nt, Human
ggcguaaguacagagaagccau

SEQ ID NO: 1408573 - RNA, 20 nt, Human
ggcguaaguacagagaagcc

SEQ ID NO: 1408574 - RNA, 19 nt, Human
ggcguaaguacagagaagc

SEQ ID NO: 1408575 - RNA, 18 nt, Human
ggcguaaguacagagaag

SEQ ID NO: 1408576 - RNA, 16 nt, Human
ggcguaaguacagaga

SEQ ID NO: 1408577 - RNA, 15 nt, Human
ggcguaaguacagag

SEQ ID NO: 1408578 - RNA, 14 nt, Human
ggcguaaguacaga

SEQ ID NO: 1408579 - RNA, 11 nt, Human
ggcgaccuccu

SEQ ID NO: 1408580 - RNA, 18 nt, Human
ggcgagaagggcugcuuc

SEQ ID NO: 1408581 - RNA, 22 nt, Human
ggcgaagcguuguccucagccc

SEQ ID NO: 1408582 - RNA, 15 nt, Human
ggccuuuuucauuua

SEQ ID NO: 1408583 - RNA, 23 nt, Human
ggccuuugcgcuccuggcccagc

SEQ ID NO: 1408584 - RNA, 14 nt, Human
ggccuuugcgcucc

SEQ ID NO: 1408585 - RNA, 16 nt, Human
ggccuuugagcucaga

SEQ ID NO: 1408586 - RNA, 14 nt, Human
ggccuuggccugga

SEQ ID NO: 1408587 - RNA, 19 nt, Human
ggccuugcggcuccucagg

SEQ ID NO: 1408588 - RNA, 18 nt, Human
ggccuugcggcuccucag

SEQ ID NO: 1408589 - RNA, 17 nt, Human
ggccuugcggcuccuca

SEQ ID NO: 1408590 - RNA, 18 nt, Human
ggccuuguucugucacca

SEQ ID NO: 1408591 - RNA, 14 nt, Human
ggccuuuaaaauuu

SEQ ID NO: 1408592 - RNA, 22 nt, Human
ggccuuuaaaauuuuuuuagaa

SEQ ID NO: 1408593 - RNA, 16 nt, Human
ggccuuguucugucac

SEQ ID NO: 1408594 - RNA, 13 nt, Human
ggccuuguucugu

SEQ ID NO: 1408595 - RNA, 12 nt, Human
ggccuugggcuc

SEQ ID NO: 1408596 - RNA, 13 nt, Human
ggccuugggcucc

SEQ ID NO: 1408597 - RNA, 18 nt, Human
ggccuuggccuggagcac

SEQ ID NO: 1408598 - RNA, 17 nt, Human
ggccuuggccuggagca

SEQ ID NO: 1408599 - RNA, 16 nt, Human
ggccuuggccuggagc

SEQ ID NO: 1408600 - RNA, 15 nt, Human
ggccuuggccuggag

SEQ ID NO: 1408601 - RNA, 13 nt, Human
ggccuuugagcuc

SEQ ID NO: 1408602 - RNA, 22 nt, Human
ggccuguguucuuccuggccgc

SEQ ID NO: 1408603 - RNA, 21 nt, Human
ggccuguguucuuccuggccg

SEQ ID NO: 1408604 - RNA, 19 nt, Human
ggccuguguucuuccuggc

SEQ ID NO: 1408605 - RNA, 16 nt, Human
ggccuguguucuuccu

SEQ ID NO: 1408606 - RNA, 23 nt, Human
ggccuguguagcugugaccugcu

SEQ ID NO: 1408607 - RNA, 22 nt, Human
ggccuguguagcugugaccugc

SEQ ID NO: 1408608 - RNA, 21 nt, Human
ggccuguguagcugugaccug

SEQ ID NO: 1408609 - RNA, 20 nt, Human
ggccuggccagugcccugau

SEQ ID NO: 1408610 - RNA, 19 nt, Human
ggccuggccagugcccuga

SEQ ID NO: 1408611 - RNA, 16 nt, Human
ggccuggccagugccc

SEQ ID NO: 1408612 - RNA, 14 nt, Human
ggccuggccagugc

SEQ ID NO: 1408613 - RNA, 20 nt, Human
ggccuguguagcugugaccu

SEQ ID NO: 1408614 - RNA, 19 nt, Human
ggccuguguagcugugacc

SEQ ID NO: 1408615 - RNA, 17 nt, Human
ggccuguguagcuguga

SEQ ID NO: 1408616 - RNA, 21 nt, Human
ggccuggacuuuccugcaacu

SEQ ID NO: 1408617 - RNA, 18 nt, Human
ggccuggacuuuccugca

SEQ ID NO: 1408618 - RNA, 20 nt, Human
ggccugaucagaccacggcu

SEQ ID NO: 1408619 - RNA, 18 nt, Human
ggccugaucagaccacgg

SEQ ID NO: 1408620 - RNA, 15 nt, Human
ggccugaucagacca

SEQ ID NO: 1408621 - RNA, 18 nt, Human
ggccuggagauccuccug

SEQ ID NO: 1408622 - RNA, 19 nt, Human
ggccuggagauccuccugc

SEQ ID NO: 1408623 - RNA, 17 nt, Human
ggccuggagauccuccu

SEQ ID NO: 1408624 - RNA, 15 nt, Human
ggccuggagauccuc

SEQ ID NO: 1408625 - RNA, 14 nt, Human
ggccuggagauccu

SEQ ID NO: 1408626 - RNA, 11 nt, Human
ggccuggagau

SEQ ID NO: 1408627 - RNA, 20 nt, Human
ggccucauguggcuggaaga

SEQ ID NO: 1408628 - RNA, 19 nt, Human
ggccucauguggcuggaag

SEQ ID NO: 1408629 - RNA, 17 nt, Human
ggccucauguggcugga

SEQ ID NO: 1408630 - RNA, 16 nt, Human
ggccucauguggcugg

SEQ ID NO: 1408631 - RNA, 15 nt, Human
ggccucauguggcug

SEQ ID NO: 1408632 - RNA, 15 nt, Human
ggccggccagccccu

SEQ ID NO: 1408633 - RNA, 19 nt, Human
ggcccuucccacaggacau

SEQ ID NO: 1408634 - RNA, 20 nt, Human
ggcccuuaugacugccaaga

SEQ ID NO: 1408635 - RNA, 12 nt, Human
ggccgcugccac

SEQ ID NO: 1408636 - RNA, 17 nt, Human
ggccgcugaguggcagg

SEQ ID NO: 1408637 - RNA, 23 nt, Human
ggccgcccccagcccccuccugg

SEQ ID NO: 1408638 - RNA, 12 nt, Human
ggccgcccccug

SEQ ID NO: 1408639 - RNA, 15 nt, Human
ggccgaugcccagag

SEQ ID NO: 1408640 - RNA, 16 nt, Human
ggccgaguccaagcug

SEQ ID NO: 1408641 - RNA, 13 nt, Human
ggccgaguccaag

SEQ ID NO: 1408642 - RNA, 18 nt, Human
ggcccagggcccagagcc

SEQ ID NO: 1408643 - RNA, 17 nt, Human
ggcccagggcccagagc

SEQ ID NO: 1408644 - RNA, 16 nt, Human
ggcccagggcccagag

SEQ ID NO: 1408645 - RNA, 15 nt, Human
ggccccagcacagcu

SEQ ID NO: 1408646 - RNA, 17 nt, Human
ggccccacccucgggga

SEQ ID NO: 1408647 - RNA, 23 nt, Human
ggccccacccugggcccugggcu

SEQ ID NO: 1408648 - RNA, 21 nt, Human
ggccccacccugggcccuggg

SEQ ID NO: 1408649 - RNA, 17 nt, Human
ggccccacccugggccc

SEQ ID NO: 1408650 - RNA, 15 nt, Human
ggccccacccugggc

SEQ ID NO: 1408651 - RNA, 20 nt, Human
ggcccaggucagccacuguu

SEQ ID NO: 1408652 - RNA, 18 nt, Human
ggcccaggucagccacug

SEQ ID NO: 1408653 - RNA, 22 nt, Human
ggcccagggcccagagcccagc

SEQ ID NO: 1408654 - RNA, 21 nt, Human
ggcccagggcccagagcccag

SEQ ID NO: 1408655 - RNA, 19 nt, Human
ggcccagggcccagagccc

SEQ ID NO: 1408656 - RNA, 12 nt, Human
ggccccacccuc

SEQ ID NO: 1408657 - RNA, 13 nt, Human
ggccccacccugg

SEQ ID NO: 1408658 - RNA, 23 nt, Human
ggccccacccucguggacaccug

SEQ ID NO: 1408659 - RNA, 22 nt, Human
ggccaugacccugccucuccca

SEQ ID NO: 1408660 - RNA, 20 nt, Human
ggccaugacccugccucucc

SEQ ID NO: 1408661 - RNA, 18 nt, Human
ggccaugacccugccucu

SEQ ID NO: 1408662 - RNA, 17 nt, Human
ggccaugacccugccuc

SEQ ID NO: 1408663 - RNA, 16 nt, Human
ggccaugacccugccu

SEQ ID NO: 1408664 - RNA, 22 nt, Human
ggccaucugggcuccuccaggg

SEQ ID NO: 1408665 - RNA, 17 nt, Human
ggccaucugcuccugga

SEQ ID NO: 1408666 - RNA, 16 nt, Human
ggccaucugcuccugg

SEQ ID NO: 1408667 - RNA, 14 nt, Human
ggccaucugcuccu

SEQ ID NO: 1408668 - RNA, 13 nt, Human
ggccaucugcucc

SEQ ID NO: 1408669 - RNA, 22 nt, Human
ggccaugauggcaacagaucug

SEQ ID NO: 1408670 - RNA, 18 nt, Human
ggccaugauggcaacaga

SEQ ID NO: 1408671 - RNA, 15 nt, Human
ggccaugauggcaac

SEQ ID NO: 1408672 - RNA, 23 nt, Human
ggccagggccccucacccugccu

SEQ ID NO: 1408673 - RNA, 21 nt, Human
ggccagggccacgcuccagcu

SEQ ID NO: 1408674 - RNA, 20 nt, Human
ggccagggccacgcuccagc

SEQ ID NO: 1408675 - RNA, 13 nt, Human
ggccagggcagag

SEQ ID NO: 1408676 - RNA, 20 nt, Human
ggccagugcccugaucccag

SEQ ID NO: 1408677 - RNA, 19 nt, Human
ggccagugcccugauccca

SEQ ID NO: 1408678 - RNA, 22 nt, Human
ggccauauuuaccucagccugg

SEQ ID NO: 1408679 - RNA, 21 nt, Human
ggccauauuuaccucagccug

SEQ ID NO: 1408680 - RNA, 20 nt, Human
ggccauauuuaccucagccu

SEQ ID NO: 1408681 - RNA, 19 nt, Human
ggccauauuuaccucagcc

SEQ ID NO: 1408682 - RNA, 18 nt, Human
ggccauauuuaccucagc

SEQ ID NO: 1408683 - RNA, 21 nt, Human
ggccagugcccugaucccaga

SEQ ID NO: 1408684 - RNA, 19 nt, Human
ggccagcagcaccugcccu

SEQ ID NO: 1408685 - RNA, 18 nt, Human
ggccagcagcaccugccc

SEQ ID NO: 1408686 - RNA, 12 nt, Human
ggccagcagcac

SEQ ID NO: 1408687 - RNA, 19 nt, Human
ggccagaggcccccagccc

SEQ ID NO: 1408688 - RNA, 18 nt, Human
ggccagaggcccccagcc

SEQ ID NO: 1408689 - RNA, 16 nt, Human
ggccagaggcccccag

SEQ ID NO: 1408690 - RNA, 15 nt, Human
ggccagagcccacuc

SEQ ID NO: 1408691 - RNA, 17 nt, Human
ggccagagcccacucca

SEQ ID NO: 1408692 - RNA, 22 nt, Human
ggccagagcuacccgcagaguu

SEQ ID NO: 1408693 - RNA, 13 nt, Human
ggccagagcccac

SEQ ID NO: 1408694 - RNA, 12 nt, Human
ggccagagccca

SEQ ID NO: 1408695 - RNA, 14 nt, Human
ggccagagccaggg

SEQ ID NO: 1408696 - RNA, 13 nt, Human
ggccagagccagg

SEQ ID NO: 1408697 - RNA, 12 nt, Human
ggccagagccag

SEQ ID NO: 1408698 - RNA, 14 nt, Human
ggccagagccaagg

SEQ ID NO: 1408699 - RNA, 11 nt, Human
ggccagagcca

SEQ ID NO: 1408700 - RNA, 21 nt, Human
ggcauuuuuaccaucacugag

SEQ ID NO: 1408701 - RNA, 18 nt, Human
ggccagggagaagcuccu

SEQ ID NO: 1408702 - RNA, 17 nt, Human
ggccagggagaagcucc

SEQ ID NO: 1408703 - RNA, 16 nt, Human
ggccagggagaagcuc

SEQ ID NO: 1408704 - RNA, 15 nt, Human
ggccagggagaagcu

SEQ ID NO: 1408705 - RNA, 19 nt, Human
ggccaggcuggucuaaaac

SEQ ID NO: 1408706 - RNA, 18 nt, Human
ggccaggcuugucucgaa

SEQ ID NO: 1408707 - RNA, 15 nt, Human
ggcauuuuuauuuua

SEQ ID NO: 1408708 - RNA, 21 nt, Human
ggcaucuggccuggccagugc

SEQ ID NO: 1408709 - RNA, 18 nt, Human
ggcaucuggccuggccag

SEQ ID NO: 1408710 - RNA, 16 nt, Human
ggcaucuggccuggcc

SEQ ID NO: 1408711 - RNA, 16 nt, Human
ggcaucucugggcugg

SEQ ID NO: 1408712 - RNA, 17 nt, Human
ggcaucucugggcugga

SEQ ID NO: 1408713 - RNA, 14 nt, Human
ggcaucucugggcu

SEQ ID NO: 1408714 - RNA, 13 nt, Human
ggcaucucugggc

SEQ ID NO: 1408715 - RNA, 12 nt, Human
ggcaucucuggg

SEQ ID NO: 1408716 - RNA, 20 nt, Human
ggcauccuuccucacaccag

SEQ ID NO: 1408717 - RNA, 17 nt, Human
ggcauccucuuuuucca

SEQ ID NO: 1408718 - RNA, 16 nt, Human
ggcauccuccagcccc

SEQ ID NO: 1408719 - RNA, 14 nt, Human
ggcauccuccagcc

SEQ ID NO: 1408720 - RNA, 13 nt, Human
ggcaucccugggc

SEQ ID NO: 1408721 - RNA, 14 nt, Human
ggcaucccugggcc

SEQ ID NO: 1408722 - RNA, 12 nt, Human
ggcaucccuggg

SEQ ID NO: 1408723 - RNA, 22 nt, Human
ggcauccagagucccugccugg

SEQ ID NO: 1408724 - RNA, 15 nt, Human
ggcauagcucugggg

SEQ ID NO: 1408725 - RNA, 13 nt, Human
ggcauagcucugg

SEQ ID NO: 1408726 - RNA, 20 nt, Human
ggcaccagacacccaggacu

SEQ ID NO: 1408727 - RNA, 19 nt, Human
ggcaccagacacccaggac

SEQ ID NO: 1408728 - RNA, 18 nt, Human
ggcaccagacacccagga

SEQ ID NO: 1408729 - RNA, 17 nt, Human
ggcaccagacacccagg

SEQ ID NO: 1408730 - RNA, 16 nt, Human
ggcacugggcaugagg

SEQ ID NO: 1408731 - RNA, 15 nt, Human
ggcacugggcaugag

SEQ ID NO: 1408732 - RNA, 15 nt, Human
ggcacuggggcaggg

SEQ ID NO: 1408733 - RNA, 16 nt, Human
ggcacuggcgaggaga

SEQ ID NO: 1408734 - RNA, 22 nt, Human
ggagcccaggccaggacucugc

SEQ ID NO: 1408735 - RNA, 24 nt, Human
ggagcccaggccaggacucugcag

SEQ ID NO: 1408736 - RNA, 16 nt, Human
ggagcccaggccagga

SEQ ID NO: 1408737 - RNA, 15 nt, Human
ggagcccaggccagg

SEQ ID NO: 1408738 - RNA, 14 nt, Human
ggagcccaggccag

SEQ ID NO: 1408739 - RNA, 16 nt, Human
ggagcccagcucugaa

SEQ ID NO: 1408740 - RNA, 23 nt, Human
ggagcccacuguccugggccugc

SEQ ID NO: 1408741 - RNA, 22 nt, Human
ggagcccacuguccugggccug

SEQ ID NO: 1408742 - RNA, 20 nt, Human
ggagcccacuguccugggcc

SEQ ID NO: 1408743 - RNA, 18 nt, Human
ggagcccacuguccuggg

SEQ ID NO: 1408744 - RNA, 17 nt, Human
ggagcccacuguccugg

SEQ ID NO: 1408745 - RNA, 14 nt, Human
ggagcccacugucc

SEQ ID NO: 1408746 - RNA, 12 nt, Human
ggagccagcucu

SEQ ID NO: 1408747 - RNA, 14 nt, Human
ggagccagccgagc

SEQ ID NO: 1408748 - RNA, 21 nt, Human
ggagccacuccucugacucag

SEQ ID NO: 1408749 - RNA, 19 nt, Human
ggagccacuccucugacuc

SEQ ID NO: 1408750 - RNA, 16 nt, Human
ggagccacuccucuga

SEQ ID NO: 1408751 - RNA, 15 nt, Human
ggagccaccaguucu

SEQ ID NO: 1408752 - RNA, 14 nt, Human
ggagccaccaguuc

SEQ ID NO: 1408753 - RNA, 16 nt, Human
ggagccaagggaugga

SEQ ID NO: 1408754 - RNA, 18 nt, Human
ggagccaagggauggaca

SEQ ID NO: 1408755 - RNA, 16 nt, Human
ggagcugccuggaccc

SEQ ID NO: 1408756 - RNA, 15 nt, Human
ggagcugccuggacc

SEQ ID NO: 1408757 - RNA, 14 nt, Human
ggagcugccuggac

SEQ ID NO: 1408758 - RNA, 13 nt, Human
ggagcugccugga

SEQ ID NO: 1408759 - RNA, 11 nt, Human
ggagcugccug

SEQ ID NO: 1408760 - RNA, 18 nt, Human
ggagcccccagccuguca

SEQ ID NO: 1408761 - RNA, 17 nt, Human
ggagcccccagccuguc

SEQ ID NO: 1408762 - RNA, 16 nt, Human
ggagcccccagccugu

SEQ ID NO: 1408763 - RNA, 15 nt, Human
ggagcccccagccug

SEQ ID NO: 1408764 - RNA, 14 nt, Human
ggagcccccagccu

SEQ ID NO: 1408765 - RNA, 13 nt, Human
ggagcccccagcc

SEQ ID NO: 1408766 - RNA, 22 nt, Human
ggagcccccacccuguuccugc

SEQ ID NO: 1408767 - RNA, 20 nt, Human
ggagcugugaguucucccug

SEQ ID NO: 1408768 - RNA, 23 nt, Human
ggagcugguuagaaaugcagaau

SEQ ID NO: 1408769 - RNA, 18 nt, Human
ggagcugguuagaaaugc

SEQ ID NO: 1408770 - RNA, 17 nt, Human
ggagcuggggaucccuc

SEQ ID NO: 1408771 - RNA, 14 nt, Human
ggagcugggccugg

SEQ ID NO: 1408772 - RNA, 13 nt, Human
ggagcugggccug

SEQ ID NO: 1408773 - RNA, 18 nt, Human
ggagcugggcagaaggcc

SEQ ID NO: 1408774 - RNA, 19 nt, Human
ggagcugggcagaaggcca

SEQ ID NO: 1408775 - RNA, 17 nt, Human
ggagcugccuggacccg

SEQ ID NO: 1408776 - RNA, 21 nt, Human
ggaggaaggcuuacacccaca

SEQ ID NO: 1408777 - RNA, 20 nt, Human
ggagcuucauggcagaaggc

SEQ ID NO: 1408778 - RNA, 18 nt, Human
ggaggaaggaggacccag

SEQ ID NO: 1408779 - RNA, 12 nt, Human
ggaggaauacug

SEQ ID NO: 1408780 - RNA, 23 nt, Human
ggaggaauaagcucccagggccu

SEQ ID NO: 1408781 - RNA, 12 nt, Human
ggaggacccagg

SEQ ID NO: 1408782 - RNA, 13 nt, Human
ggaggacccagga

SEQ ID NO: 1408783 - RNA, 22 nt, Human
ggaggccccaacccuguccucc

SEQ ID NO: 1408784 - RNA, 15 nt, Human
ggagggguguggcuc

SEQ ID NO: 1408785 - RNA, 16 nt, Human
ggagggguaggggcug

SEQ ID NO: 1408786 - RNA, 18 nt, Human
ggagggguaggggcuggg

SEQ ID NO: 1408787 - RNA, 15 nt, Human
ggagggguaggggcu

SEQ ID NO: 1408788 - RNA, 22 nt, Human
ggagggggucguggagagcuag

SEQ ID NO: 1408789 - RNA, 13 nt, Human
ggaggguaggcag

SEQ ID NO: 1408790 - RNA, 15 nt, Human
ggaggguaggcagga

SEQ ID NO: 1408791 - RNA, 20 nt, Human
ggaggccuaggaggguccuc

SEQ ID NO: 1408792 - RNA, 23 nt, Human
ggaggcccugugccccuugacaa

SEQ ID NO: 1408793 - RNA, 12 nt, Human
ggaggccgaagc

SEQ ID NO: 1408794 - RNA, 15 nt, Human
ggaggcccugugccc

SEQ ID NO: 1408795 - RNA, 16 nt, Human
ggaggugccacuggag

SEQ ID NO: 1408796 - RNA, 17 nt, Human
ggaggugagaccaccuc

SEQ ID NO: 1408797 - RNA, 18 nt, Human
ggagcaugagaggaggca

SEQ ID NO: 1408798 - RNA, 15 nt, Human
ggcacaggcccccuu

SEQ ID NO: 1408799 - RNA, 14 nt, Human
ggcacaggcccccu

SEQ ID NO: 1408800 - RNA, 20 nt, Human
ggcacaggaguguccucuuc

SEQ ID NO: 1408801 - RNA, 19 nt, Human
ggcacaggaguguccucuu

SEQ ID NO: 1408802 - RNA, 19 nt, Human
ggcacaggagcuaccugug

SEQ ID NO: 1408803 - RNA, 16 nt, Human
ggcaccagacacccag

SEQ ID NO: 1408804 - RNA, 13 nt, Human
ggcaccagacacc

SEQ ID NO: 1408805 - RNA, 20 nt, Human
ggcacaggagcuaccugugu

SEQ ID NO: 1408806 - RNA, 17 nt, Human
ggcacaggagcuaccug

SEQ ID NO: 1408807 - RNA, 16 nt, Human
ggcacaggagcuaccu

SEQ ID NO: 1408808 - RNA, 13 nt, Human
ggcacaggagcua

SEQ ID NO: 1408809 - RNA, 13 nt, Human
ggcacagccuggc

SEQ ID NO: 1408810 - RNA, 12 nt, Human
ggcacagccugg

SEQ ID NO: 1408811 - RNA, 14 nt, Human
ggcacaagacugac

SEQ ID NO: 1408812 - RNA, 14 nt, Human
ggcaauuuuguaac

SEQ ID NO: 1408813 - RNA, 15 nt, Human
ggcaauuuugugguu

SEQ ID NO: 1408814 - RNA, 13 nt, Human
ggcacaagacuga

SEQ ID NO: 1408815 - RNA, 14 nt, Human
ggcacacaccacca

SEQ ID NO: 1408816 - RNA, 22 nt, Human
ggcaauguuaauuuaguggaaa

SEQ ID NO: 1408817 - RNA, 17 nt, Human
ggcaauuaauuccuuca

SEQ ID NO: 1408818 - RNA, 20 nt, Human
ggcaauuaauuccuucagca

SEQ ID NO: 1408819 - RNA, 11 nt, Human
ggcaauuuugu

SEQ ID NO: 1408820 - RNA, 19 nt, Human
ggcaauuaauuccuucagc

SEQ ID NO: 1408821 - RNA, 13 nt, Human
ggauguccccagc

SEQ ID NO: 1408822 - RNA, 13 nt, Human
ggauggggcuccc

SEQ ID NO: 1408823 - RNA, 12 nt, Human
ggaugucccugg

SEQ ID NO: 1408824 - RNA, 15 nt, Human
ggauguccccagcag

SEQ ID NO: 1408825 - RNA, 14 nt, Human
ggauguccccagca

SEQ ID NO: 1408826 - RNA, 16 nt, Human
ggauguccccagcaga

SEQ ID NO: 1408827 - RNA, 14 nt, Human
ggauggccccagca

SEQ ID NO: 1408828 - RNA, 13 nt, Human
ggauggccccagc

SEQ ID NO: 1408829 - RNA, 16 nt, Human
ggauggccccagcaca

SEQ ID NO: 1408830 - RNA, 22 nt, Human
ggaguugaucuggaacccagac

SEQ ID NO: 1408831 - RNA, 21 nt, Human
ggaguugaucuggaacccaga

SEQ ID NO: 1408832 - RNA, 17 nt, Human
ggaguugaucuggaacc

SEQ ID NO: 1408833 - RNA, 14 nt, Human
ggaguugaucugga

SEQ ID NO: 1408834 - RNA, 23 nt, Human
ggaguugaucgccuuucccaggu

SEQ ID NO: 1408835 - RNA, 20 nt, Human
ggaguugaucgccuuuccca

SEQ ID NO: 1408836 - RNA, 20 nt, Human
ggaguggcagcccagccagc

SEQ ID NO: 1408837 - RNA, 19 nt, Human
ggaguggcagcccagccag

SEQ ID NO: 1408838 - RNA, 17 nt, Human
ggaguggcagcccagcc

SEQ ID NO: 1408839 - RNA, 16 nt, Human
ggaguggcagcccagc

SEQ ID NO: 1408840 - RNA, 18 nt, Human
ggagugcggaccacccuc

SEQ ID NO: 1408841 - RNA, 21 nt, Human
ggagugcuguuuuguuauaua

SEQ ID NO: 1408842 - RNA, 22 nt, Human
ggagugcggaccacccucacug

SEQ ID NO: 1408843 - RNA, 12 nt, Human
ggagugcagugg

SEQ ID NO: 1408844 - RNA, 14 nt, Human
ggaguuucuaaggu

SEQ ID NO: 1408845 - RNA, 12 nt, Human
ggaguuucuaag

SEQ ID NO: 1408846 - RNA, 21 nt, Human
ggaguuuauguuccauuaaac

SEQ ID NO: 1408847 - RNA, 20 nt, Human
ggaguuuagggaacaauuug

SEQ ID NO: 1408848 - RNA, 18 nt, Human
ggaguuuuuaugagaaac

SEQ ID NO: 1408849 - RNA, 16 nt, Human
ggaguuuuuuguacca

SEQ ID NO: 1408850 - RNA, 17 nt, Human
ggaguuuuguuuccucu

SEQ ID NO: 1408851 - RNA, 15 nt, Human
ggaguuuugcaaagu

SEQ ID NO: 1408852 - RNA, 18 nt, Human
aaaacagguauauacuuu

SEQ ID NO: 1408853 - RNA, 21 nt, Human
aaaacaggucuucaucgaauc

SEQ ID NO: 1408854 - RNA, 19 nt, Human
aaaacagguauauacuuug

SEQ ID NO: 1408855 - RNA, 14 nt, Human
aaaaaucucaaauu

SEQ ID NO: 1408856 - RNA, 17 nt, Human
aaaaaucucaaauuucu

SEQ ID NO: 1408857 - RNA, 19 nt, Human
aaaacauguuuauuuuucu

SEQ ID NO: 1408858 - RNA, 24 nt, Human
aaaacauaaucuucugccuucuca

SEQ ID NO: 1408859 - RNA, 20 nt, Human
aaaacauaaucuucugccuu

SEQ ID NO: 1408860 - RNA, 18 nt, Human
aaaacauaaucuucugcc

SEQ ID NO: 1408861 - RNA, 17 nt, Human
aaaacauaaucuucugc

SEQ ID NO: 1408862 - RNA, 19 nt, Human
aaaacaguggaucacaaag

SEQ ID NO: 1408863 - RNA, 22 nt, Human
aaaacauuuauuuugacauaaa

SEQ ID NO: 1408864 - RNA, 12 nt, Human
aaaacauuuauu

SEQ ID NO: 1408865 - RNA, 15 nt, Human
aaaacauguuuauuu

SEQ ID NO: 1408866 - RNA, 16 nt, Human
aaaacauuccauccuu

SEQ ID NO: 1408867 - RNA, 15 nt, Human
aaaacucuacuuaau

SEQ ID NO: 1408868 - RNA, 12 nt, Human
aaaacucuacuu

SEQ ID NO: 1408869 - RNA, 16 nt, Human
aaaacuccaccuuccc

SEQ ID NO: 1408870 - RNA, 17 nt, Human
aaaacuccaccuuccca

SEQ ID NO: 1408871 - RNA, 19 nt, Human
aaaacucuacuuaauccaa

SEQ ID NO: 1408872 - RNA, 18 nt, Human
aaaacucuacuuaaucca

SEQ ID NO: 1408873 - RNA, 18 nt, Human
aaaaccugagauuuauua

SEQ ID NO: 1408874 - RNA, 19 nt, Human
aaaacuauauguaugguuu

SEQ ID NO: 1408875 - RNA, 22 nt, Human
aaaacuagaggugagaaauuua

SEQ ID NO: 1408876 - RNA, 15 nt, Human
aaaaccugagauuua

SEQ ID NO: 1408877 - RNA, 20 nt, Human
aaaacccuugggccagaagu

SEQ ID NO: 1408878 - RNA, 19 nt, Human
aaaacccuugggccagaag

SEQ ID NO: 1408879 - RNA, 16 nt, Human
aaaacccuugggccag

SEQ ID NO: 1408880 - RNA, 20 nt, Human
aaaaccccccagauaucauc

SEQ ID NO: 1408881 - RNA, 18 nt, Human
aaaaccccccagauauca

SEQ ID NO: 1408882 - RNA, 17 nt, Human
aaaaccccccagauauc

SEQ ID NO: 1408883 - RNA, 13 nt, Human
aaaacccccaaac

SEQ ID NO: 1408884 - RNA, 16 nt, Human
aaaacauuuauuuuga

SEQ ID NO: 1408885 - RNA, 13 nt, Human
aaaacauuuauuu

SEQ ID NO: 1408886 - RNA, 15 nt, Human
aaaacccagauaaag

SEQ ID NO: 1408887 - RNA, 18 nt, Human
gggaagcccauccugacc

SEQ ID NO: 1408888 - RNA, 17 nt, Human
gggaagcagcagccucg

SEQ ID NO: 1408889 - RNA, 13 nt, Human
gggaagcagcagc

SEQ ID NO: 1408890 - RNA, 12 nt, Human
gggaagaggccu

SEQ ID NO: 1408891 - RNA, 22 nt, Human
gggaagagagccugcaggaucu

SEQ ID NO: 1408892 - RNA, 15 nt, Human
gggaaggaggagccu

SEQ ID NO: 1408893 - RNA, 15 nt, Human
gggaagcuagucuuu

SEQ ID NO: 1408894 - RNA, 19 nt, Human
gggaagcccauccugacca

SEQ ID NO: 1408895 - RNA, 13 nt, Human
gggaaggauacaa

SEQ ID NO: 1408896 - RNA, 16 nt, Human
gggaaggauacaaaag

SEQ ID NO: 1408897 - RNA, 14 nt, Human
aaaaauaguuugga

SEQ ID NO: 1408898 - RNA, 23 nt, Human
aaaaauaguuuggauauguaaaa

SEQ ID NO: 1408899 - RNA, 21 nt, Human
aaaaauagcuaaauaccucaa

SEQ ID NO: 1408900 - RNA, 21 nt, Human
gggacauuugcucauggaauu

SEQ ID NO: 1408901 - RNA, 20 nt, Human
gggacauuugcucauggaau

SEQ ID NO: 1408902 - RNA, 17 nt, Human
aaaaauauauguauaua

SEQ ID NO: 1408903 - RNA, 15 nt, Human
aaaaauauauacuaa

SEQ ID NO: 1408904 - RNA, 22 nt, Human
gggcagcuccucugucucgagc

SEQ ID NO: 1408905 - RNA, 21 nt, Human
gggcagcuccucugucucgag

SEQ ID NO: 1408906 - RNA, 17 nt, Human
gggcagcuccucugucu

SEQ ID NO: 1408907 - RNA, 14 nt, Human
gggcagcuccucug

SEQ ID NO: 1408908 - RNA, 12 nt, Human
gggcagcuccuc

SEQ ID NO: 1408909 - RNA, 16 nt, Human
gggcagcgccaggcug

SEQ ID NO: 1408910 - RNA, 15 nt, Human
gggcagcgccaggcu

SEQ ID NO: 1408911 - RNA, 13 nt, Human
gggcagcgccagg

SEQ ID NO: 1408912 - RNA, 22 nt, Human
gggcagccagggagagcccagg

SEQ ID NO: 1408913 - RNA, 13 nt, Human
gggcagccccagg

SEQ ID NO: 1408914 - RNA, 12 nt, Human
gggcaaagccag

SEQ ID NO: 1408915 - RNA, 20 nt, Human
gggcagccagggagagccca

SEQ ID NO: 1408916 - RNA, 16 nt, Human
gggcagauuuucagca

SEQ ID NO: 1408917 - RNA, 17 nt, Human
gggcagagugagaccca

SEQ ID NO: 1408918 - RNA, 22 nt, Human
gggcagagggcuggaggcccag

SEQ ID NO: 1408919 - RNA, 16 nt, Human
gggcagagggcuggag

SEQ ID NO: 1408920 - RNA, 15 nt, Human
gggcagagggcugga

SEQ ID NO: 1408921 - RNA, 14 nt, Human
gggcagagggcugg

SEQ ID NO: 1408922 - RNA, 13 nt, Human
gggcagagggcug

SEQ ID NO: 1408923 - RNA, 21 nt, Human
gggcagaggcaguaccugggc

SEQ ID NO: 1408924 - RNA, 16 nt, Human
gggcaggcugggccau

SEQ ID NO: 1408925 - RNA, 15 nt, Human
gggcaggcugggcca

SEQ ID NO: 1408926 - RNA, 14 nt, Human
gggcaggcugggcc

SEQ ID NO: 1408927 - RNA, 13 nt, Human
gggcaggcugggc

SEQ ID NO: 1408928 - RNA, 12 nt, Human
gggcaggcuggg

SEQ ID NO: 1408929 - RNA, 23 nt, Human
gggcaggccaccuggcucucacc

SEQ ID NO: 1408930 - RNA, 15 nt, Human
gggcaggccagagcu

SEQ ID NO: 1408931 - RNA, 21 nt, Human
gggcaggccaccuggcucuca

SEQ ID NO: 1408932 - RNA, 20 nt, Human
gggcaggaguagcugagcuc

SEQ ID NO: 1408933 - RNA, 12 nt, Human
gggcagggagcg

SEQ ID NO: 1408934 - RNA, 14 nt, Human
aaaagggaggggga

SEQ ID NO: 1408935 - RNA, 22 nt, Human
aaaagggccaaagaaccaaaga

SEQ ID NO: 1408936 - RNA, 14 nt, Human
gggcaaagccuagu

SEQ ID NO: 1408937 - RNA, 20 nt, Human
gggcaaagccaggucccucu

SEQ ID NO: 1408938 - RNA, 16 nt, Human
gggcaaagccaggucc

SEQ ID NO: 1408939 - RNA, 13 nt, Human
gggcaaagccagg

SEQ ID NO: 1408940 - RNA, 17 nt, Human
gggauuaugggucacag

SEQ ID NO: 1408941 - RNA, 20 nt, Human
gggauuacaggcgugagcca

SEQ ID NO: 1408942 - RNA, 14 nt, Human
gggaugguaguuuu

SEQ ID NO: 1408943 - RNA, 19 nt, Human
gggauggacgaucucccac

SEQ ID NO: 1408944 - RNA, 16 nt, Human
gggauggacaucuugu

SEQ ID NO: 1408945 - RNA, 15 nt, Human
gggaggcucaggucc

SEQ ID NO: 1408946 - RNA, 16 nt, Human
gggauuaaccucugca

SEQ ID NO: 1408947 - RNA, 22 nt, Human
gggauguucagcacugucccuu

SEQ ID NO: 1408948 - RNA, 18 nt, Human
gggauguguccugacacu

SEQ ID NO: 1408949 - RNA, 13 nt, Human
gggauguguccug

SEQ ID NO: 1408950 - RNA, 12 nt, Human
gggauguguccu

SEQ ID NO: 1408951 - RNA, 17 nt, Human
gggaugguggagggcca

SEQ ID NO: 1408952 - RNA, 18 nt, Human
gggaugguggagggccac

SEQ ID NO: 1408953 - RNA, 22 nt, Human
gggaggcucuggagcccacugu

SEQ ID NO: 1408954 - RNA, 13 nt, Human
gggaggcucaggu

SEQ ID NO: 1408955 - RNA, 13 nt, Human
gggagcaggcagc

SEQ ID NO: 1408956 - RNA, 14 nt, Human
gggagcaggcagcc

SEQ ID NO: 1408957 - RNA, 12 nt, Human
gggagcaggcag

SEQ ID NO: 1408958 - RNA, 19 nt, Human
gggagcaaacugcaugccc

SEQ ID NO: 1408959 - RNA, 17 nt, Human
gggagauucaagggacc

SEQ ID NO: 1408960 - RNA, 20 nt, Human
gggagagggcgcaggccgug

SEQ ID NO: 1408961 - RNA, 17 nt, Human
gggagaggggccucaaa

SEQ ID NO: 1408962 - RNA, 19 nt, Human
gggagaccucagaaguaaa

SEQ ID NO: 1408963 - RNA, 22 nt, Human
gggagaccggccugccaggagg

SEQ ID NO: 1408964 - RNA, 21 nt, Human
gggagaccggccugccaggag

SEQ ID NO: 1408965 - RNA, 20 nt, Human
gggagaccggccugccagga

SEQ ID NO: 1408966 - RNA, 17 nt, Human
gggagaccggccugcca

SEQ ID NO: 1408967 - RNA, 15 nt, Human
gggagacaugugaca

SEQ ID NO: 1408968 - RNA, 12 nt, Human
gggagacagcau

SEQ ID NO: 1408969 - RNA, 19 nt, Human
gggagacacuggccccuca

SEQ ID NO: 1408970 - RNA, 14 nt, Human
gggagacacuggcc

SEQ ID NO: 1408971 - RNA, 12 nt, Human
gggagaagcucc

SEQ ID NO: 1408972 - RNA, 14 nt, Human
aaaagcagacauuu

SEQ ID NO: 1408973 - RNA, 19 nt, Human
aaaagaugcuuuuaacaga

SEQ ID NO: 1408974 - RNA, 19 nt, Human
aaaagauggggucuguaaa

SEQ ID NO: 1408975 - RNA, 21 nt, Human
aaaagauggggucuguaaaau

SEQ ID NO: 1408976 - RNA, 13 nt, Human
aaaagaugcuuuu

SEQ ID NO: 1408977 - RNA, 22 nt, Human
aaaagaugcacuuugcuuuaau

SEQ ID NO: 1408978 - RNA, 18 nt, Human
aaaagaugcacuuugcuu

SEQ ID NO: 1408979 - RNA, 18 nt, Human
aaaagaugaaagagcagu

SEQ ID NO: 1408980 - RNA, 14 nt, Human
aaaagcaacauuca

SEQ ID NO: 1408981 - RNA, 14 nt, Human
aaaagcaaaucauu

SEQ ID NO: 1408982 - RNA, 13 nt, Human
aaaagcagacauu

SEQ ID NO: 1408983 - RNA, 19 nt, Human
aaaaugaaagcuacucaua

SEQ ID NO: 1408984 - RNA, 14 nt, Human
aaaaugaaagcuac

SEQ ID NO: 1408985 - RNA, 17 nt, Human
aaaaucuuucuuucuua

SEQ ID NO: 1408986 - RNA, 19 nt, Human
aaaaucuuucuuucuuaga

SEQ ID NO: 1408987 - RNA, 20 nt, Human
aaaaucuuucuuucuuagaa

SEQ ID NO: 1408988 - RNA, 21 nt, Human
aaaaucuuucuuucuuagaaa

SEQ ID NO: 1408989 - RNA, 22 nt, Human
aaaaucuuucuuucuuagaaau

SEQ ID NO: 1408990 - RNA, 23 nt, Human
aaaaucuuucuuucuuagaaauu

SEQ ID NO: 1408991 - RNA, 14 nt, Human
aaaaugauacagca

SEQ ID NO: 1408992 - RNA, 19 nt, Human
aaaaucuugucauguguau

SEQ ID NO: 1408993 - RNA, 13 nt, Human
aaaaucuugucau

SEQ ID NO: 1408994 - RNA, 12 nt, Human
aaaaucuuguca

SEQ ID NO: 1408995 - RNA, 11 nt, Human
aaaaucuuguc

SEQ ID NO: 1408996 - RNA, 15 nt, Human
aaaaucuugaucagu

SEQ ID NO: 1408997 - RNA, 18 nt, Human
aaaaucuugaucaguuaa

SEQ ID NO: 1408998 - RNA, 20 nt, Human
aaaaucuuauaguucuaggc

SEQ ID NO: 1408999 - RNA, 19 nt, Human
aaaaucuuauaguucuagg

SEQ ID NO: 1409000 - RNA, 18 nt, Human
aaaaucuuauaguucuag

SEQ ID NO: 1409001 - RNA, 23 nt, Human
aaaaguauguucuaaccuuuaca

SEQ ID NO: 1409002 - RNA, 19 nt, Human
aaaaguauguuagugcaaa

SEQ ID NO: 1409003 - RNA, 15 nt, Human
aaaaugcuagguucu

SEQ ID NO: 1409004 - RNA, 13 nt, Human
aaaaugcuagguu

SEQ ID NO: 1409005 - RNA, 22 nt, Human
aaaaugcgguuauaaaaaaugg

SEQ ID NO: 1409006 - RNA, 18 nt, Human
aaaaugcgguuauaaaaa

SEQ ID NO: 1409007 - RNA, 16 nt, Human
aaaaugcuagguucua

SEQ ID NO: 1409008 - RNA, 19 nt, Human
aaaaugcuggcuauagaug

SEQ ID NO: 1409009 - RNA, 19 nt, Human
gggccagauccagccuggg

SEQ ID NO: 1409010 - RNA, 12 nt, Human
gggccagccucu

SEQ ID NO: 1409011 - RNA, 11 nt, Human
gggccagccuc

SEQ ID NO: 1409012 - RNA, 22 nt, Human
gggccagucuguggaucagaga

SEQ ID NO: 1409013 - RNA, 21 nt, Human
gggccaggcugggucgcccug

SEQ ID NO: 1409014 - RNA, 14 nt, Human
gggccaggcugggu

SEQ ID NO: 1409015 - RNA, 15 nt, Human
gggccaggcuggguc

SEQ ID NO: 1409016 - RNA, 21 nt, Human
gggccuauggagagcccuggg

SEQ ID NO: 1409017 - RNA, 20 nt, Human
gggccuauggagagcccugg

SEQ ID NO: 1409018 - RNA, 19 nt, Human
gggccuauggagagcccug

SEQ ID NO: 1409019 - RNA, 18 nt, Human
gggccuauggagagcccu

SEQ ID NO: 1409020 - RNA, 16 nt, Human
gggccuauggagagcc

SEQ ID NO: 1409021 - RNA, 14 nt, Human
gggccuauggagag

SEQ ID NO: 1409022 - RNA, 15 nt, Human
gggccuaggcugcau

SEQ ID NO: 1409023 - RNA, 17 nt, Human
gggccuacuagagucug

SEQ ID NO: 1409024 - RNA, 16 nt, Human
gggccgaugcccagag

SEQ ID NO: 1409025 - RNA, 17 nt, Human
gggccgaugcccagaga

SEQ ID NO: 1409026 - RNA, 15 nt, Human
gggccgaugcccaga

SEQ ID NO: 1409027 - RNA, 14 nt, Human
gggccgacuaagag

SEQ ID NO: 1409028 - RNA, 17 nt, Human
gggcccuuugagugcag

SEQ ID NO: 1409029 - RNA, 20 nt, Human
gggcccuggggccuguacug

SEQ ID NO: 1409030 - RNA, 17 nt, Human
gggcccuggggccugua

SEQ ID NO: 1409031 - RNA, 15 nt, Human
gggcccuggggccug

SEQ ID NO: 1409032 - RNA, 14 nt, Human
gggcccuggggccu

SEQ ID NO: 1409033 - RNA, 12 nt, Human
gggcccuggggc

SEQ ID NO: 1409034 - RNA, 17 nt, Human
gggccaugcugaggccu

SEQ ID NO: 1409035 - RNA, 18 nt, Human
gggcccuggggccuguac

SEQ ID NO: 1409036 - RNA, 22 nt, Human
gggcccuggugguggcucggga

SEQ ID NO: 1409037 - RNA, 15 nt, Human
gggccaugcugaggc

SEQ ID NO: 1409038 - RNA, 14 nt, Human
gggccaugcugagg

SEQ ID NO: 1409039 - RNA, 23 nt, Human
gggccaugauggcaacagaucug

SEQ ID NO: 1409040 - RNA, 22 nt, Human
gggccaugauggcaacagaucu

SEQ ID NO: 1409041 - RNA, 21 nt, Human
gggccugagcaguccuuggcc

SEQ ID NO: 1409042 - RNA, 20 nt, Human
gggccugagcaguccuuggc

SEQ ID NO: 1409043 - RNA, 12 nt, Human
gggccugagcag

SEQ ID NO: 1409044 - RNA, 20 nt, Human
gggccuccaugggccccagg

SEQ ID NO: 1409045 - RNA, 20 nt, Human
gggccucaaaggcccgcucu

SEQ ID NO: 1409046 - RNA, 19 nt, Human
gggccucaaaggcccgcuc

SEQ ID NO: 1409047 - RNA, 22 nt, Human
gggccuauggagagcccuggga

SEQ ID NO: 1409048 - RNA, 22 nt, Human
gggcggccuaugacuugggcac

SEQ ID NO: 1409049 - RNA, 21 nt, Human
gggcggcaggggccuggagau

SEQ ID NO: 1409050 - RNA, 17 nt, Human
gggcggcaggggccugg

SEQ ID NO: 1409051 - RNA, 14 nt, Human
gggcggggguggcg

SEQ ID NO: 1409052 - RNA, 17 nt, Human
gggcgggcagagggcug

SEQ ID NO: 1409053 - RNA, 13 nt, Human
gggcuaauuuaac

SEQ ID NO: 1409054 - RNA, 21 nt, Human
gggcuacccugagcugaggca

SEQ ID NO: 1409055 - RNA, 19 nt, Human
gggcuacccugagcugagg

SEQ ID NO: 1409056 - RNA, 16 nt, Human
gggcuacccugagcug

SEQ ID NO: 1409057 - RNA, 12 nt, Human
gggcuaccagga

SEQ ID NO: 1409058 - RNA, 13 nt, Human
gggcuacccugag

SEQ ID NO: 1409059 - RNA, 15 nt, Human
gggcuaccaggaaag

SEQ ID NO: 1409060 - RNA, 14 nt, Human
gggcucacacaccu

SEQ ID NO: 1409061 - RNA, 19 nt, Human
gggcugcaguucgacucug

SEQ ID NO: 1409062 - RNA, 18 nt, Human
gggcucaaucucuggggg

SEQ ID NO: 1409063 - RNA, 21 nt, Human
gggcuauuuuguuugcuucau

SEQ ID NO: 1409064 - RNA, 20 nt, Human
gggcuacccugagcugaggc

SEQ ID NO: 1409065 - RNA, 11 nt, Human
gggcuggcugg

SEQ ID NO: 1409066 - RNA, 13 nt, Human
gggcugggaaguc

SEQ ID NO: 1409067 - RNA, 14 nt, Human
aaaauuuguugcau

SEQ ID NO: 1409068 - RNA, 13 nt, Human
aaaauuuguugca

SEQ ID NO: 1409069 - RNA, 14 nt, Human
aaaauuuuuuuaga

SEQ ID NO: 1409070 - RNA, 20 nt, Human
aaaauuuguucuuguauuua

SEQ ID NO: 1409071 - RNA, 19 nt, Human
aaaauuuguucuuguauuu

SEQ ID NO: 1409072 - RNA, 16 nt, Human
aaaauuuguucuugua

SEQ ID NO: 1409073 - RNA, 18 nt, Human
aaaauuuguuauuuugca

SEQ ID NO: 1409074 - RNA, 18 nt, Human
aaaauguuaucuucucaa

SEQ ID NO: 1409075 - RNA, 21 nt, Human
aaaaugugggauuauggguca

SEQ ID NO: 1409076 - RNA, 22 nt, Human
aaaaugugggauuaugggucac

SEQ ID NO: 1409077 - RNA, 20 nt, Human
aaaaugugcuauacugcaua

SEQ ID NO: 1409078 - RNA, 19 nt, Human
aaaaugugcuauacugcau

SEQ ID NO: 1409079 - RNA, 21 nt, Human
aaaaugugauguucuaaggcu

SEQ ID NO: 1409080 - RNA, 20 nt, Human
aaaaugugauguucuaaggc

SEQ ID NO: 1409081 - RNA, 19 nt, Human
aaaaugugauguucuaagg

SEQ ID NO: 1409082 - RNA, 17 nt, Human
aaaaugugauguucuaa

SEQ ID NO: 1409083 - RNA, 15 nt, Human
aaaaugugauguucu

SEQ ID NO: 1409084 - RNA, 18 nt, Human
aaaaugucuuguguuacc

SEQ ID NO: 1409085 - RNA, 14 nt, Human
gggcugguucugua

SEQ ID NO: 1409086 - RNA, 19 nt, Human
gggcuggugggugccuagg

SEQ ID NO: 1409087 - RNA, 17 nt, Human
aaacaucuuugaaauua

SEQ ID NO: 1409088 - RNA, 16 nt, Human
aaacaucuuugaaauu

SEQ ID NO: 1409089 - RNA, 19 nt, Human
aaacaucauucauuuuugu

SEQ ID NO: 1409090 - RNA, 21 nt, Human
aaacaugacccuaaaucuuga

SEQ ID NO: 1409091 - RNA, 19 nt, Human
aaacaugacccuaaaucuu

SEQ ID NO: 1409092 - RNA, 22 nt, Human
aaacaucuuugaaauuauguaa

SEQ ID NO: 1409093 - RNA, 12 nt, Human
ggggccagaggc

SEQ ID NO: 1409094 - RNA, 15 nt, Human
ggggcaucuggccug

SEQ ID NO: 1409095 - RNA, 16 nt, Human
ggggcaucuggccugg

SEQ ID NO: 1409096 - RNA, 16 nt, Human
aaacaugcuacacacu

SEQ ID NO: 1409097 - RNA, 19 nt, Human
ggggccuggagauccuccu

SEQ ID NO: 1409098 - RNA, 23 nt, Human
ggggccugcccagugcacuugcu

SEQ ID NO: 1409099 - RNA, 20 nt, Human
ggggccugccaccuggaccc

SEQ ID NO: 1409100 - RNA, 19 nt, Human
ggggccugccaccuggacc

SEQ ID NO: 1409101 - RNA, 18 nt, Human
ggggccugccaccuggac

SEQ ID NO: 1409102 - RNA, 12 nt, Human
ggggccugccac

SEQ ID NO: 1409103 - RNA, 23 nt, Human
ggggccugagcaguccuuggccu

SEQ ID NO: 1409104 - RNA, 17 nt, Human
ggggccugagcaguccu

SEQ ID NO: 1409105 - RNA, 12 nt, Human
ggggccugagca

SEQ ID NO: 1409106 - RNA, 17 nt, Human
ggggccagauccagccu

SEQ ID NO: 1409107 - RNA, 14 nt, Human
ggggccagauccag

SEQ ID NO: 1409108 - RNA, 13 nt, Human
ggggccagaucca

SEQ ID NO: 1409109 - RNA, 13 nt, Human
ggggccagaggcu

SEQ ID NO: 1409110 - RNA, 21 nt, Human
ggggccuccaugggccccagg

SEQ ID NO: 1409111 - RNA, 12 nt, Human
ggggccucccug

SEQ ID NO: 1409112 - RNA, 19 nt, Human
ggggccagauccagccugg

SEQ ID NO: 1409113 - RNA, 13 nt, Human
ggggccaggcugg

SEQ ID NO: 1409114 - RNA, 19 nt, Human
aaacaaaaauuaaaauccu

SEQ ID NO: 1409115 - RNA, 13 nt, Human
aaacaaaaacacu

SEQ ID NO: 1409116 - RNA, 16 nt, Human
aaaauuuuuuuagaaa

SEQ ID NO: 1409117 - RNA, 20 nt, Human
aaacaagaccacguuucuaa

SEQ ID NO: 1409118 - RNA, 20 nt, Human
aaacaagcacuaaacaaaga

SEQ ID NO: 1409119 - RNA, 16 nt, Human
aaacacauuuuucuua

SEQ ID NO: 1409120 - RNA, 20 nt, Human
aaacaguugcauguaguaac

SEQ ID NO: 1409121 - RNA, 23 nt, Human
aaacaguggaucacaaaguggaa

SEQ ID NO: 1409122 - RNA, 19 nt, Human
aaacaguugcauguaguaa

SEQ ID NO: 1409123 - RNA, 18 nt, Human
aaacaguugcauguagua

SEQ ID NO: 1409124 - RNA, 14 nt, Human
aaacagugagccug

SEQ ID NO: 1409125 - RNA, 19 nt, Human
aaacaccaacauguuggga

SEQ ID NO: 1409126 - RNA, 19 nt, Human
aaacaccaacauaaaaaug

SEQ ID NO: 1409127 - RNA, 15 nt, Human
aaacaccaacauaaa

SEQ ID NO: 1409128 - RNA, 18 nt, Human
aaacaccuccucauguac

SEQ ID NO: 1409129 - RNA, 15 nt, Human
aaacacccucacacu

SEQ ID NO: 1409130 - RNA, 22 nt, Human
gguagcgggggaggguaggcag

SEQ ID NO: 1409131 - RNA, 17 nt, Human
gguaccagauaacuuuu

SEQ ID NO: 1409132 - RNA, 14 nt, Human
gguaccagaugcag

SEQ ID NO: 1409133 - RNA, 18 nt, Human
gguacaugguguuugugg

SEQ ID NO: 1409134 - RNA, 16 nt, Human
gguacauggugcuggg

SEQ ID NO: 1409135 - RNA, 17 nt, Human
gguacaguauggggguu

SEQ ID NO: 1409136 - RNA, 21 nt, Human
gguacagagaagccagcuugu

SEQ ID NO: 1409137 - RNA, 16 nt, Human
gguacagagaagccag

SEQ ID NO: 1409138 - RNA, 15 nt, Human
gguacagagaagcca

SEQ ID NO: 1409139 - RNA, 14 nt, Human
gguacagagaagcc

SEQ ID NO: 1409140 - RNA, 13 nt, Human
gguacagagaagc

SEQ ID NO: 1409141 - RNA, 12 nt, Human
gguacagagaag

SEQ ID NO: 1409142 - RNA, 10 nt, Human
gguacagaga

SEQ ID NO: 1409143 - RNA, 22 nt, Human
gguaauuguugcuaaucuucuu

SEQ ID NO: 1409144 - RNA, 15 nt, Human
ggguuuuaacuuugu

SEQ ID NO: 1409145 - RNA, 16 nt, Human
ggguuuuaacuuuguu

SEQ ID NO: 1409146 - RNA, 17 nt, Human
ggguuugugacagggcg

SEQ ID NO: 1409147 - RNA, 15 nt, Human
ggguuucugcccugc

SEQ ID NO: 1409148 - RNA, 19 nt, Human
ggguuucugcccugcccac

SEQ ID NO: 1409149 - RNA, 15 nt, Human
gggugggcaguuuuu

SEQ ID NO: 1409150 - RNA, 22 nt, Human
ggggccugccaccuggaccccu

SEQ ID NO: 1409151 - RNA, 21 nt, Human
gggugucuugggcagagcugg

SEQ ID NO: 1409152 - RNA, 15 nt, Human
gggugucuugggcag

SEQ ID NO: 1409153 - RNA, 23 nt, Human
ggguguccugcaccggggccugg

SEQ ID NO: 1409154 - RNA, 13 nt, Human
gggugugcuggga

SEQ ID NO: 1409155 - RNA, 23 nt, Human
gggugucuugggcagagcuggcu

SEQ ID NO: 1409156 - RNA, 16 nt, Human
gggugggguggcugca

SEQ ID NO: 1409157 - RNA, 12 nt, Human
ggguggguauaa

SEQ ID NO: 1409158 - RNA, 18 nt, Human
ggguggggggggugcugg

SEQ ID NO: 1409159 - RNA, 13 nt, Human
gguccaugggcag

SEQ ID NO: 1409160 - RNA, 22 nt, Human
aaacuuuaccuuuuuuauacau

SEQ ID NO: 1409161 - RNA, 24 nt, Human
aaagaaguguggggauuuucacug

SEQ ID NO: 1409162 - RNA, 16 nt, Human
gguccaugggcagagc

SEQ ID NO: 1409163 - RNA, 14 nt, Human
gguccaugggcaga

SEQ ID NO: 1409164 - RNA, 18 nt, Human
aaacuuuacuauggcccu

SEQ ID NO: 1409165 - RNA, 12 nt, Human
aaacuuuacuau

SEQ ID NO: 1409166 - RNA, 22 nt, Human
aaagacacauuuuuuaggaaau

SEQ ID NO: 1409167 - RNA, 16 nt, Human
aaagaauagaagcuaa

SEQ ID NO: 1409168 - RNA, 16 nt, Human
aaagaaugauuaugaa

SEQ ID NO: 1409169 - RNA, 12 nt, Human
gguccagggcua

SEQ ID NO: 1409170 - RNA, 13 nt, Human
gguccaggcugug

SEQ ID NO: 1409171 - RNA, 18 nt, Human
gguccacaggucuagacu

SEQ ID NO: 1409172 - RNA, 18 nt, Human
gguccaauuaguuuccuu

SEQ ID NO: 1409173 - RNA, 17 nt, Human
gguccaauuaguuuccu

SEQ ID NO: 1409174 - RNA, 13 nt, Human
gguaugaagagug

SEQ ID NO: 1409175 - RNA, 23 nt, Human
gguaugaacuugaggacacaugu

SEQ ID NO: 1409176 - RNA, 12 nt, Human
gguaggaaaugu

SEQ ID NO: 1409177 - RNA, 17 nt, Human
gguaugaagaguguuau

SEQ ID NO: 1409178 - RNA, 21 nt, Human
gguaugaacuugaggacacau

SEQ ID NO: 1409179 - RNA, 22 nt, Human
gguaugaacuugaggacacaug

SEQ ID NO: 1409180 - RNA, 21 nt, Human
ggugcuucuaguucugccagg

SEQ ID NO: 1409181 - RNA, 22 nt, Human
gguggauggccccagcacagcu

SEQ ID NO: 1409182 - RNA, 14 nt, Human
gguggauggcccca

SEQ ID NO: 1409183 - RNA, 18 nt, Human
gguggcacaggcccccuu

SEQ ID NO: 1409184 - RNA, 23 nt, Human
gguggcacaggaguguccucuuc

SEQ ID NO: 1409185 - RNA, 17 nt, Human
gguggcacaggcccccu

SEQ ID NO: 1409186 - RNA, 16 nt, Human
aaagcagcguuucuau

SEQ ID NO: 1409187 - RNA, 18 nt, Human
aaagcagcguuucuauga

SEQ ID NO: 1409188 - RNA, 22 nt, Human
aaagcagcguuucuaugacaca

SEQ ID NO: 1409189 - RNA, 19 nt, Human
aaagcaggcagaacucauc

SEQ ID NO: 1409190 - RNA, 17 nt, Human
aaagcaggcagaacuca

SEQ ID NO: 1409191 - RNA, 20 nt, Human
aaagcaucauggcuaucugu

SEQ ID NO: 1409192 - RNA, 12 nt, Human
aaagcaucccuc

SEQ ID NO: 1409193 - RNA, 15 nt, Human
aaagcaucccucacc

SEQ ID NO: 1409194 - RNA, 22 nt, Human
aaagcaucuugcauuaugcaau

SEQ ID NO: 1409195 - RNA, 17 nt, Human
aaagcaucccucaccca

SEQ ID NO: 1409196 - RNA, 24 nt, Human
aaagcaucccucacccauccuaga

SEQ ID NO: 1409197 - RNA, 15 nt, Human
ggucuuacagcaggc

SEQ ID NO: 1409198 - RNA, 12 nt, Human
ggucuguuugca

SEQ ID NO: 1409199 - RNA, 20 nt, Human
ggucuguuggcaggcuggcc

SEQ ID NO: 1409200 - RNA, 19 nt, Human
ggucuguuggcaggcuggc

SEQ ID NO: 1409201 - RNA, 12 nt, Human
ggugccagaagc

SEQ ID NO: 1409202 - RNA, 10 nt, Human
ggugccaccu

SEQ ID NO: 1409203 - RNA, 23 nt, Human
ggugccaauuucaaguuccaagu

SEQ ID NO: 1409204 - RNA, 23 nt, Human
ggugccaaacaaaaagguucuca

SEQ ID NO: 1409205 - RNA, 13 nt, Human
ggugcaauuucaa

SEQ ID NO: 1409206 - RNA, 22 nt, Human
ggugcaauguguguauauggac

SEQ ID NO: 1409207 - RNA, 21 nt, Human
ggugcaauguguguauaugga

SEQ ID NO: 1409208 - RNA, 13 nt, Human
ggugcuggucccg

SEQ ID NO: 1409209 - RNA, 16 nt, Human
ggugcuggggccuggu

SEQ ID NO: 1409210 - RNA, 20 nt, Human
ggugcugggccccugccucu

SEQ ID NO: 1409211 - RNA, 21 nt, Human
aaagauugcugaaauuuuaua

SEQ ID NO: 1409212 - RNA, 19 nt, Human
aaagauugcugaaauuuua

SEQ ID NO: 1409213 - RNA, 15 nt, Human
aaagauugagagaau

SEQ ID NO: 1409214 - RNA, 23 nt, Human
aaagauugaaguauuuugcugga

SEQ ID NO: 1409215 - RNA, 22 nt, Human
aaagauucugaccuuaaaugca

SEQ ID NO: 1409216 - RNA, 21 nt, Human
aaagauucuauaguucuagac

SEQ ID NO: 1409217 - RNA, 20 nt, Human
aaagacguuuuauaagcauc

SEQ ID NO: 1409218 - RNA, 14 nt, Human
aaagcaaaucauuu

SEQ ID NO: 1409219 - RNA, 17 nt, Human
aaagcaaagcacagaga

SEQ ID NO: 1409220 - RNA, 11 nt, Human
aaagcaaagca

SEQ ID NO: 1409221 - RNA, 15 nt, Human
aaagcaaaccuguaa

SEQ ID NO: 1409222 - RNA, 19 nt, Human
gguccuccuccagggacag

SEQ ID NO: 1409223 - RNA, 17 nt, Human
gguccuccuccagggac

SEQ ID NO: 1409224 - RNA, 14 nt, Human
gguccuccuccagg

SEQ ID NO: 1409225 - RNA, 16 nt, Human
gguccuauggccucau

SEQ ID NO: 1409226 - RNA, 14 nt, Human
gguccucagagaau

SEQ ID NO: 1409227 - RNA, 21 nt, Human
gguccucagagaauuucuacc

SEQ ID NO: 1409228 - RNA, 20 nt, Human
aaagcaagcauucagaagaa

SEQ ID NO: 1409229 - RNA, 14 nt, Human
aaagcaagaaucag

SEQ ID NO: 1409230 - RNA, 18 nt, Human
aaagcaagaaucagagaa

SEQ ID NO: 1409231 - RNA, 19 nt, Human
gguccugagcacugccagg

SEQ ID NO: 1409232 - RNA, 18 nt, Human
gguccugagcacugccag

SEQ ID NO: 1409233 - RNA, 16 nt, Human
gguccugagcacugcc

SEQ ID NO: 1409234 - RNA, 15 nt, Human
gguccugagcacugc

SEQ ID NO: 1409235 - RNA, 19 nt, Human
gguccucuucugggccuga

SEQ ID NO: 1409236 - RNA, 22 nt, Human
gguccucuucugggccugacca

SEQ ID NO: 1409237 - RNA, 23 nt, Human
gguccucugucagucacagccac

SEQ ID NO: 1409238 - RNA, 21 nt, Human
gguccucugucagucacagcc

SEQ ID NO: 1409239 - RNA, 13 nt, Human
gguccucugucag

SEQ ID NO: 1409240 - RNA, 18 nt, Human
gguccuccuccagggaca

SEQ ID NO: 1409241 - RNA, 15 nt, Human
gguccugggaggaga

SEQ ID NO: 1409242 - RNA, 21 nt, Human
gguccuggagcagaccacccc

SEQ ID NO: 1409243 - RNA, 17 nt, Human
gguccuggagcagacca

SEQ ID NO: 1409244 - RNA, 19 nt, Human
gguccugguggggcagcuc

SEQ ID NO: 1409245 - RNA, 14 nt, Human
ggucgcuccugccc

SEQ ID NO: 1409246 - RNA, 13 nt, Human
ggucgcuccugcc

SEQ ID NO: 1409247 - RNA, 12 nt, Human
ggucgcuccugc

SEQ ID NO: 1409248 - RNA, 18 nt, Human
gguccugguggggcagcu

SEQ ID NO: 1409249 - RNA, 17 nt, Human
gguccugguggggcagc

SEQ ID NO: 1409250 - RNA, 13 nt, Human
ggucggaaaacau

SEQ ID NO: 1409251 - RNA, 19 nt, Human
ggucguggagagcuaggag

SEQ ID NO: 1409252 - RNA, 14 nt, Human
ggucguuuuuuuca

SEQ ID NO: 1409253 - RNA, 18 nt, Human
ggucgcuugggaauuuua

SEQ ID NO: 1409254 - RNA, 19 nt, Human
ggucgcccuuugcugcaug

SEQ ID NO: 1409255 - RNA, 13 nt, Human
ggucggaccagcu

SEQ ID NO: 1409256 - RNA, 14 nt, Human
ggucggaaaacaug

SEQ ID NO: 1409257 - RNA, 20 nt, Human
ggucguggagagcuaggagc

SEQ ID NO: 1409258 - RNA, 15 nt, Human
ggucguggagagcua

SEQ ID NO: 1409259 - RNA, 14 nt, Human
ggucguggagagcu

SEQ ID NO: 1409260 - RNA, 15 nt, Human
ggucggugccuucaa

SEQ ID NO: 1409261 - RNA, 14 nt, Human
ggucggugccuuca

SEQ ID NO: 1409262 - RNA, 20 nt, Human
ggucgguagguucagccaag

SEQ ID NO: 1409263 - RNA, 20 nt, Human
ggucggggcaucuggccugg

SEQ ID NO: 1409264 - RNA, 14 nt, Human
ggucggggcaucug

SEQ ID NO: 1409265 - RNA, 14 nt, Human
ggucggaccagcuu

SEQ ID NO: 1409266 - RNA, 17 nt, Human
ggugugcaccaggguug

SEQ ID NO: 1409267 - RNA, 16 nt, Human
ggugugcaccaggguu

SEQ ID NO: 1409268 - RNA, 18 nt, Human
ggugugaucgucugacug

SEQ ID NO: 1409269 - RNA, 15 nt, Human
ggugugaucgucuga

SEQ ID NO: 1409270 - RNA, 20 nt, Human
ggugucuugggcagagcugg

SEQ ID NO: 1409271 - RNA, 21 nt, Human
ggugucucaggcugccugagu

SEQ ID NO: 1409272 - RNA, 16 nt, Human
ggugugacugaauuuc

SEQ ID NO: 1409273 - RNA, 20 nt, Human
ggugucucaggcugccugag

SEQ ID NO: 1409274 - RNA, 18 nt, Human
ggugucucaggcugccug

SEQ ID NO: 1409275 - RNA, 17 nt, Human
ggugucucaggcugccu

SEQ ID NO: 1409276 - RNA, 16 nt, Human
ggugucucaggcugcc

SEQ ID NO: 1409277 - RNA, 15 nt, Human
ggugucucaggcugc

SEQ ID NO: 1409278 - RNA, 20 nt, Human
gguggggguagggggcugga

SEQ ID NO: 1409279 - RNA, 23 nt, Human
gguggggguaggguuucccuacu

SEQ ID NO: 1409280 - RNA, 10 nt, Human
ggugggggua

SEQ ID NO: 1409281 - RNA, 15 nt, Human
gguggggcagcuccu

SEQ ID NO: 1409282 - RNA, 13 nt, Human
gguggggcagcuc

SEQ ID NO: 1409283 - RNA, 12 nt, Human
gguggggcagcu

SEQ ID NO: 1409284 - RNA, 17 nt, Human
gguggggggggugcugg

SEQ ID NO: 1409285 - RNA, 16 nt, Human
aaagcgaaaaaaucag

SEQ ID NO: 1409286 - RNA, 12 nt, Human
aaagcgaaaaaa

SEQ ID NO: 1409287 - RNA, 16 nt, Human
aaagccuuuauuuguu

SEQ ID NO: 1409288 - RNA, 11 nt, Human
aaagccuucuu

SEQ ID NO: 1409289 - RNA, 18 nt, Human
aaagccuucuuuuggggg

SEQ ID NO: 1409290 - RNA, 15 nt, Human
aaagcaucuugcauu

SEQ ID NO: 1409291 - RNA, 16 nt, Human
aaagccuguuuaagag

SEQ ID NO: 1409292 - RNA, 18 nt, Human
aaagccuguuuaagagac

SEQ ID NO: 1409293 - RNA, 17 nt, Human
gguucccguuucuccac

SEQ ID NO: 1409294 - RNA, 12 nt, Human
gguuccacagac

SEQ ID NO: 1409295 - RNA, 19 nt, Human
gguuccguguccaccccca

SEQ ID NO: 1409296 - RNA, 17 nt, Human
gguuccguguccacccc

SEQ ID NO: 1409297 - RNA, 16 nt, Human
gguuccggcauggaca

SEQ ID NO: 1409298 - RNA, 13 nt, Human
gguucaggcccgg

SEQ ID NO: 1409299 - RNA, 12 nt, Human
gguucaggcccg

SEQ ID NO: 1409300 - RNA, 22 nt, Human
ggugugcugggagcuccacucu

SEQ ID NO: 1409301 - RNA, 19 nt, Human
ggugugcugggagcuccac

SEQ ID NO: 1409302 - RNA, 12 nt, Human
ggugugcuggga

SEQ ID NO: 1409303 - RNA, 13 nt, Human
gguucuggcuguu

SEQ ID NO: 1409304 - RNA, 19 nt, Human
gguucugccugccagcugc

SEQ ID NO: 1409305 - RNA, 20 nt, Human
gguucugccugccagcugca

SEQ ID NO: 1409306 - RNA, 18 nt, Human
gguucugagauggcuccc

SEQ ID NO: 1409307 - RNA, 17 nt, Human
gguucugagauggcucc

SEQ ID NO: 1409308 - RNA, 21 nt, Human
gguucuccguuagcuccugug

SEQ ID NO: 1409309 - RNA, 20 nt, Human
gguucuccguuagcuccugu

SEQ ID NO: 1409310 - RNA, 19 nt, Human
gguucuccguuagcuccug

SEQ ID NO: 1409311 - RNA, 18 nt, Human
gguucucagguguugcca

SEQ ID NO: 1409312 - RNA, 22 nt, Human
gguucucaauuccaacaguuua

SEQ ID NO: 1409313 - RNA, 23 nt, Human
gguucucacagugggagccaggg

SEQ ID NO: 1409314 - RNA, 18 nt, Human
gguuccuccccuccagcu

SEQ ID NO: 1409315 - RNA, 14 nt, Human
gguuucugcccugc

SEQ ID NO: 1409316 - RNA, 17 nt, Human
gguuucugaguuccugc

SEQ ID NO: 1409317 - RNA, 20 nt, Human
gguuucaccauguuggccag

SEQ ID NO: 1409318 - RNA, 21 nt, Human
gguuucucgcauaggaccuuu

SEQ ID NO: 1409319 - RNA, 14 nt, Human
gguuucagaaaugu

SEQ ID NO: 1409320 - RNA, 15 nt, Human
gguuucagaaaugug

SEQ ID NO: 1409321 - RNA, 19 nt, Human
gguuucaccauguugccca

SEQ ID NO: 1409322 - RNA, 20 nt, Human
gguuucaaagaugcugugag

SEQ ID NO: 1409323 - RNA, 18 nt, Human
gguuucaaagaugcugug

SEQ ID NO: 1409324 - RNA, 16 nt, Human
gguuucaaagaugcug

SEQ ID NO: 1409325 - RNA, 19 nt, Human
gguuucaccauguuggcca

SEQ ID NO: 1409326 - RNA, 12 nt, Human
gguuucagaaau

SEQ ID NO: 1409327 - RNA, 13 nt, Human
gguuucagaaaug

SEQ ID NO: 1409328 - RNA, 19 nt, Human
aaaguuuagccccugaaag

SEQ ID NO: 1409329 - RNA, 18 nt, Human
aaaguuuuauauauuaua

SEQ ID NO: 1409330 - RNA, 17 nt, Human
aaaguuuuauauauuau

SEQ ID NO: 1409331 - RNA, 16 nt, Human
aaaguuuuauauauua

SEQ ID NO: 1409332 - RNA, 15 nt, Human
aaaguuuuauauauu

SEQ ID NO: 1409333 - RNA, 14 nt, Human
aaaguuuuauauau

SEQ ID NO: 1409334 - RNA, 13 nt, Human
aaaguuuuauaua

SEQ ID NO: 1409335 - RNA, 14 nt, Human
aaaguuuguuugcu

SEQ ID NO: 1409336 - RNA, 16 nt, Human
aaaguuuguugaaaca

SEQ ID NO: 1409337 - RNA, 23 nt, Human
aaaguugauaaagauuuuuuaau

SEQ ID NO: 1409338 - RNA, 18 nt, Human
aaaguugauaaagauuuu

SEQ ID NO: 1409339 - RNA, 17 nt, Human
aaaguugauaaagauuu

SEQ ID NO: 1409340 - RNA, 16 nt, Human
aaaguugaauuuuaca

SEQ ID NO: 1409341 - RNA, 12 nt, Human
aaaguucuaaga

SEQ ID NO: 1409342 - RNA, 11 nt, Human
aaaguucuaag

SEQ ID NO: 1409343 - RNA, 22 nt, Human
aaaguuccaagagucuaaagau

SEQ ID NO: 1409344 - RNA, 20 nt, Human
aaaguugcagcuguuuuguu

SEQ ID NO: 1409345 - RNA, 18 nt, Human
aaaguugcagcuguuuug

SEQ ID NO: 1409346 - RNA, 17 nt, Human
aaaguugcagcuguuuu

SEQ ID NO: 1409347 - RNA, 20 nt, Human
aaaguugauaaagauuuuuu

SEQ ID NO: 1409348 - RNA, 19 nt, Human
aaaguugcagcuguuuugu

SEQ ID NO: 1409349 - RNA, 15 nt, Human
aaaguuuaaucagag

SEQ ID NO: 1409350 - RNA, 21 nt, Human
aaagugugaaauaaauuuuuu

SEQ ID NO: 1409351 - RNA, 23 nt, Human
aaaguguauuuggaaauaaaguc

SEQ ID NO: 1409352 - RNA, 22 nt, Human
aaaguguauuuggaaauaaagu

SEQ ID NO: 1409353 - RNA, 15 nt, Human
aaaguguauuuggaa

SEQ ID NO: 1409354 - RNA, 14 nt, Human
aaaguguauuugga

SEQ ID NO: 1409355 - RNA, 10 nt, Human
aaaguguauu

SEQ ID NO: 1409356 - RNA, 18 nt, Human
aaaguucaacauguuauu

SEQ ID NO: 1409357 - RNA, 21 nt, Human
aaaguuccaagagucuaaaga

SEQ ID NO: 1409358 - RNA, 20 nt, Human
aaaguuccaagagucuaaag

SEQ ID NO: 1409359 - RNA, 18 nt, Human
aaaguuccaagagucuaa

SEQ ID NO: 1409360 - RNA, 16 nt, Human
aaaguuccaagagucu

SEQ ID NO: 1409361 - RNA, 18 nt, Human
gguuucugcccugcccac

SEQ ID NO: 1409362 - RNA, 17 nt, Human
gguuucugcccugccca

SEQ ID NO: 1409363 - RNA, 15 nt, Human
gguuucugcccugcc

SEQ ID NO: 1409364 - RNA, 20 nt, Human
gguuuggacaaaauggaaua

SEQ ID NO: 1409365 - RNA, 13 nt, Human
aaauaagucaaca

SEQ ID NO: 1409366 - RNA, 19 nt, Human
aaauaaggcacccaucugu

SEQ ID NO: 1409367 - RNA, 22 nt, Human
aaauaaggcacccaucugucug

SEQ ID NO: 1409368 - RNA, 22 nt, Human
aaauaagcuauuugauguaaua

SEQ ID NO: 1409369 - RNA, 16 nt, Human
aaauaaggaaaagcuu

SEQ ID NO: 1409370 - RNA, 18 nt, Human
aaauaagcuauuugaugu

SEQ ID NO: 1409371 - RNA, 17 nt, Human
aaauaagcuauuugaug

SEQ ID NO: 1409372 - RNA, 12 nt, Human
aaauaagcuauu

SEQ ID NO: 1409373 - RNA, 22 nt, Human
aaauaagcagguggaucuauuu

SEQ ID NO: 1409374 - RNA, 15 nt, Human
aaauaagcaggugga

SEQ ID NO: 1409375 - RNA, 13 nt, Human
aaauaagcaggug

SEQ ID NO: 1409376 - RNA, 16 nt, Human
aaauaagauucuaacg

SEQ ID NO: 1409377 - RNA, 15 nt, Human
aaauaagauucuaac

SEQ ID NO: 1409378 - RNA, 14 nt, Human
aaauaagauucuaa

SEQ ID NO: 1409379 - RNA, 13 nt, Human
aaauaagauucua

SEQ ID NO: 1409380 - RNA, 15 nt, Human
aaauaaaaaagaucc

SEQ ID NO: 1409381 - RNA, 16 nt, Human
aaauaaaaaagauccc

SEQ ID NO: 1409382 - RNA, 22 nt, Human
aaaguuuuuuauuaugcauuau

SEQ ID NO: 1409383 - RNA, 22 nt, Human
aaaguuuuauauauuauaugga

SEQ ID NO: 1409384 - RNA, 23 nt, Human
aaaguuuuauauauuauauggaa

SEQ ID NO: 1409385 - RNA, 21 nt, Human
aaaguuuuauauauuauaugg

SEQ ID NO: 1409386 - RNA, 20 nt, Human
aaaguuuuauauauuauaug

SEQ ID NO: 1409387 - RNA, 11 nt, Human
aaaguuuuuua

SEQ ID NO: 1409388 - RNA, 13 nt, Human
aaauaaugcuuug

SEQ ID NO: 1409389 - RNA, 12 nt, Human
aaauaaugcuuu

SEQ ID NO: 1409390 - RNA, 12 nt, Human
aaauaaugugaa

SEQ ID NO: 1409391 - RNA, 18 nt, Human
aaauaagucaacaguaaa

SEQ ID NO: 1409392 - RNA, 21 nt, Human
aaauaagucaacaguaaacca

SEQ ID NO: 1409393 - RNA, 15 nt, Human
aaauaagucaacagu

SEQ ID NO: 1409394 - RNA, 14 nt, Human
aaauaagucaacag

SEQ ID NO: 1409395 - RNA, 19 nt, Human
aaauaagugcccucuccca

SEQ ID NO: 1409396 - RNA, 19 nt, Human
aaauaaugaauacauuucc

SEQ ID NO: 1409397 - RNA, 20 nt, Human
aaauaauuuuuauauuugaa

SEQ ID NO: 1409398 - RNA, 18 nt, Human
aaauaauuuuuauauuug

SEQ ID NO: 1409399 - RNA, 13 nt, Human
aaauaaugugaaa

SEQ ID NO: 1409400 - RNA, 21 nt, Human
guaaagauguuuauuucaggc

SEQ ID NO: 1409401 - RNA, 16 nt, Human
guaaagaucaauaaaa

SEQ ID NO: 1409402 - RNA, 22 nt, Human
guaaagauauuuuuaucuuuau

SEQ ID NO: 1409403 - RNA, 19 nt, Human
guaaagauauuuuuaucuu

SEQ ID NO: 1409404 - RNA, 15 nt, Human
guaaagaauuauuuu

SEQ ID NO: 1409405 - RNA, 15 nt, Human
guaaagacuggcuuu

SEQ ID NO: 1409406 - RNA, 19 nt, Human
guaaagacuggcuuuuauu

SEQ ID NO: 1409407 - RNA, 14 nt, Human
guaaagacuggcuu

SEQ ID NO: 1409408 - RNA, 14 nt, Human
guaaagaauuauuu

SEQ ID NO: 1409409 - RNA, 13 nt, Human
guaaagaauuauu

SEQ ID NO: 1409410 - RNA, 18 nt, Human
guaaaaugugggauuaug

SEQ ID NO: 1409411 - RNA, 19 nt, Human
guaaauuggcauggaaauu

SEQ ID NO: 1409412 - RNA, 22 nt, Human
guaaauuauuaauuuaugcaga

SEQ ID NO: 1409413 - RNA, 12 nt, Human
guaaagccaugc

SEQ ID NO: 1409414 - RNA, 19 nt, Human
guaacaauacaaauggauu

SEQ ID NO: 1409415 - RNA, 21 nt, Human
guaaaaugacaaucaugugug

SEQ ID NO: 1409416 - RNA, 22 nt, Human
guaaaaugacaaucaugugugu

SEQ ID NO: 1409417 - RNA, 16 nt, Human
guaaaaugacaaucau

SEQ ID NO: 1409418 - RNA, 14 nt, Human
guaaaaucuuucuu

SEQ ID NO: 1409419 - RNA, 15 nt, Human
guaaaaucuuucuuu

SEQ ID NO: 1409420 - RNA, 21 nt, Human
guaaaaucuuucuuucuuaga

SEQ ID NO: 1409421 - RNA, 23 nt, Human
guaaaaucuugucauguguauaa

SEQ ID NO: 1409422 - RNA, 22 nt, Human
guaaaaucuugucauguguaua

SEQ ID NO: 1409423 - RNA, 21 nt, Human
guaaaaucuugucauguguau

SEQ ID NO: 1409424 - RNA, 20 nt, Human
guaaaaucuugucaugugua

SEQ ID NO: 1409425 - RNA, 19 nt, Human
guaaaaucuugucaugugu

SEQ ID NO: 1409426 - RNA, 18 nt, Human
guaaaaucuugucaugug

SEQ ID NO: 1409427 - RNA, 16 nt, Human
guaaaaucuugucaug

SEQ ID NO: 1409428 - RNA, 15 nt, Human
guaaaaucuugucau

SEQ ID NO: 1409429 - RNA, 12 nt, Human
guaaaaucuugu

SEQ ID NO: 1409430 - RNA, 21 nt, Human
guaaaauauuuugaaucaaua

SEQ ID NO: 1409431 - RNA, 19 nt, Human
guaaaauauuuugaaucaa

SEQ ID NO: 1409432 - RNA, 18 nt, Human
guaaaauauuuugaauca

SEQ ID NO: 1409433 - RNA, 15 nt, Human
guaaaauauuuugaa

SEQ ID NO: 1409434 - RNA, 13 nt, Human
guaaaauacuuuu

SEQ ID NO: 1409435 - RNA, 22 nt, Human
guaaaauacuuuuacucugccu

SEQ ID NO: 1409436 - RNA, 12 nt, Human
guaaaauacuuu

SEQ ID NO: 1409437 - RNA, 16 nt, Human
aaauaaugcuuugaaa

SEQ ID NO: 1409438 - RNA, 21 nt, Human
aaauaauuuuuauauuugaaa

SEQ ID NO: 1409439 - RNA, 14 nt, Human
aaauaaugugaaac

SEQ ID NO: 1409440 - RNA, 18 nt, Human
gcuggagaugaggccaga

SEQ ID NO: 1409441 - RNA, 20 nt, Human
gcuggagaugaggccagacc

SEQ ID NO: 1409442 - RNA, 21 nt, Human
gcuggagaugaggccagacca

SEQ ID NO: 1409443 - RNA, 24 nt, Human
gcugcugucugggugcuacugggg

SEQ ID NO: 1409444 - RNA, 22 nt, Human
gcugcugucugggugcuacugg

SEQ ID NO: 1409445 - RNA, 21 nt, Human
gcugcugucugggugcuacug

SEQ ID NO: 1409446 - RNA, 20 nt, Human
gcugcuccgaggacccagga

SEQ ID NO: 1409447 - RNA, 21 nt, Human
gcugcucccucagacuggggc

SEQ ID NO: 1409448 - RNA, 19 nt, Human
gcugcucccucagacuggg

SEQ ID NO: 1409449 - RNA, 16 nt, Human
gcugcucccucagacu

SEQ ID NO: 1409450 - RNA, 15 nt, Human
gcugcucccucagac

SEQ ID NO: 1409451 - RNA, 14 nt, Human
gcugcucccucaga

SEQ ID NO: 1409452 - RNA, 13 nt, Human
gcugcucccucag

SEQ ID NO: 1409453 - RNA, 12 nt, Human
gcugcucccuca

SEQ ID NO: 1409454 - RNA, 22 nt, Human
gcugcuccccacgucagcuggg

SEQ ID NO: 1409455 - RNA, 13 nt, Human
gcugcuccccacg

SEQ ID NO: 1409456 - RNA, 21 nt, Human
gcugcuggggaagacaguggc

SEQ ID NO: 1409457 - RNA, 20 nt, Human
gcugcuggggaagacagugg

SEQ ID NO: 1409458 - RNA, 19 nt, Human
gcugcuggggaagacagug

SEQ ID NO: 1409459 - RNA, 18 nt, Human
gcugcuggggaagacagu

SEQ ID NO: 1409460 - RNA, 20 nt, Human
gcugcugggcucagugaagu

SEQ ID NO: 1409461 - RNA, 19 nt, Human
gcugcugggcucagugaag

SEQ ID NO: 1409462 - RNA, 16 nt, Human
gcugcugggcucagug

SEQ ID NO: 1409463 - RNA, 13 nt, Human
gcugcugggcuca

SEQ ID NO: 1409464 - RNA, 20 nt, Human
gcugcugucugggugcuacu

SEQ ID NO: 1409465 - RNA, 16 nt, Human
gcugcugucugggugc

SEQ ID NO: 1409466 - RNA, 13 nt, Human
gcugcugucuggg

SEQ ID NO: 1409467 - RNA, 23 nt, Human
gcugcugucccucccccuugucc

SEQ ID NO: 1409468 - RNA, 22 nt, Human
gcugcugucccucccccuuguc

SEQ ID NO: 1409469 - RNA, 18 nt, Human
gcugcugucccucccccu

SEQ ID NO: 1409470 - RNA, 16 nt, Human
gcugcugucccucccc

SEQ ID NO: 1409471 - RNA, 15 nt, Human
gcugcugucccuccc

SEQ ID NO: 1409472 - RNA, 21 nt, Human
gcugcugagaaccuggccuuc

SEQ ID NO: 1409473 - RNA, 22 nt, Human
gcugcugagaaccuggccuuca

SEQ ID NO: 1409474 - RNA, 20 nt, Human
gcugcugagaaccuggccuu

SEQ ID NO: 1409475 - RNA, 19 nt, Human
gcugcugagaaccuggccu

SEQ ID NO: 1409476 - RNA, 18 nt, Human
gcugcugagaaccuggcc

SEQ ID NO: 1409477 - RNA, 17 nt, Human
gcugcugagaaccuggc

SEQ ID NO: 1409478 - RNA, 16 nt, Human
gcugcugagaaccugg

SEQ ID NO: 1409479 - RNA, 15 nt, Human
gcugcugagaaccug

SEQ ID NO: 1409480 - RNA, 14 nt, Human
gcugcugagaaccu

SEQ ID NO: 1409481 - RNA, 13 nt, Human
gcugcugagaacc

SEQ ID NO: 1409482 - RNA, 20 nt, Human
gcugcacugaugcugccccu

SEQ ID NO: 1409483 - RNA, 17 nt, Human
gcugcaggaaucuuuaa

SEQ ID NO: 1409484 - RNA, 22 nt, Human
gcugcaggaaucuuuaaaagau

SEQ ID NO: 1409485 - RNA, 21 nt, Human
gcugcagccugcgccaccgcc

SEQ ID NO: 1409486 - RNA, 22 nt, Human
gcugcagaggccagaggccccc

SEQ ID NO: 1409487 - RNA, 18 nt, Human
gcugcagaggccagaggc

SEQ ID NO: 1409488 - RNA, 15 nt, Human
gcugcagaggccaga

SEQ ID NO: 1409489 - RNA, 19 nt, Human
gcugccaguguccugagcc

SEQ ID NO: 1409490 - RNA, 18 nt, Human
gcugccaguguccugagc

SEQ ID NO: 1409491 - RNA, 13 nt, Human
gcugaggcuggca

SEQ ID NO: 1409492 - RNA, 23 nt, Human
gcugaggccugggccgcugccac

SEQ ID NO: 1409493 - RNA, 20 nt, Human
gcugaggccugggccgcugc

SEQ ID NO: 1409494 - RNA, 17 nt, Human
gcugaggccugggccgc

SEQ ID NO: 1409495 - RNA, 16 nt, Human
gcugaguauuaaaaug

SEQ ID NO: 1409496 - RNA, 17 nt, Human
gcugaguauuaaaaugu

SEQ ID NO: 1409497 - RNA, 21 nt, Human
gcucuuuguuuugugucucuu

SEQ ID NO: 1409498 - RNA, 22 nt, Human
gcugaacaguggaggaagaggg

SEQ ID NO: 1409499 - RNA, 13 nt, Human
gcugaacagugga

SEQ ID NO: 1409500 - RNA, 12 nt, Human
gcugaacaucac

SEQ ID NO: 1409501 - RNA, 18 nt, Human
gcugaaaauguccuugug

SEQ ID NO: 1409502 - RNA, 19 nt, Human
gcucugucuacuugcucag

SEQ ID NO: 1409503 - RNA, 13 nt, Human
gcucugucuacuu

SEQ ID NO: 1409504 - RNA, 17 nt, Human
gcucuguccccagccug

SEQ ID NO: 1409505 - RNA, 15 nt, Human
gcucuguccccagcc

SEQ ID NO: 1409506 - RNA, 21 nt, Human
gcucugucuacuugcucaggu

SEQ ID NO: 1409507 - RNA, 23 nt, Human
gcucuguaucaggacccagagga

SEQ ID NO: 1409508 - RNA, 22 nt, Human
gcucuguaucaggacccagagg

SEQ ID NO: 1409509 - RNA, 19 nt, Human
gcucuguaucaggacccag

SEQ ID NO: 1409510 - RNA, 18 nt, Human
gcucuguaucaggaccca

SEQ ID NO: 1409511 - RNA, 14 nt, Human
gcucuguccccagc

SEQ ID NO: 1409512 - RNA, 13 nt, Human
gcucuguccccag

SEQ ID NO: 1409513 - RNA, 23 nt, Human
gcucuguagugcuacagggucca

SEQ ID NO: 1409514 - RNA, 17 nt, Human
gcucuguagugcuacag

SEQ ID NO: 1409515 - RNA, 22 nt, Human
gcucugguuguuucuguuccaa

SEQ ID NO: 1409516 - RNA, 23 nt, Human
gcucuguaaguagaugcauuugg

SEQ ID NO: 1409517 - RNA, 21 nt, Human
gcucugguuguuucuguucca

SEQ ID NO: 1409518 - RNA, 20 nt, Human
gcucugguuguuucuguucc

SEQ ID NO: 1409519 - RNA, 19 nt, Human
gcucugguuguuucuguuc

SEQ ID NO: 1409520 - RNA, 17 nt, Human
gcucuggagcccacugu

SEQ ID NO: 1409521 - RNA, 16 nt, Human
gcugaggccugggccg

SEQ ID NO: 1409522 - RNA, 15 nt, Human
gcugaggccugggcc

SEQ ID NO: 1409523 - RNA, 14 nt, Human
gcugaggccugggc

SEQ ID NO: 1409524 - RNA, 13 nt, Human
gcugaggccuggg

SEQ ID NO: 1409525 - RNA, 21 nt, Human
gcugaggccuggacuuuccug

SEQ ID NO: 1409526 - RNA, 14 nt, Human
gcugaggccuggac

SEQ ID NO: 1409527 - RNA, 13 nt, Human
gcugaggccugga

SEQ ID NO: 1409528 - RNA, 12 nt, Human
gcugaggccugg

SEQ ID NO: 1409529 - RNA, 23 nt, Human
gcugagcgaggagaugcuccuug

SEQ ID NO: 1409530 - RNA, 17 nt, Human
gcugacaccuaacucuu

SEQ ID NO: 1409531 - RNA, 16 nt, Human
gcugacaccuaacucu

SEQ ID NO: 1409532 - RNA, 17 nt, Human
gcugaagguuguggccu

SEQ ID NO: 1409533 - RNA, 20 nt, Human
gcugaagguuguggccuuug

SEQ ID NO: 1409534 - RNA, 18 nt, Human
gcugaagaauuauuuuuu

SEQ ID NO: 1409535 - RNA, 17 nt, Human
gcugaauuucccucucu

SEQ ID NO: 1409536 - RNA, 24 nt, Human
gcugaauuucccucucucauaccc

SEQ ID NO: 1409537 - RNA, 20 nt, Human
gcucucugugggcuggcagu

SEQ ID NO: 1409538 - RNA, 17 nt, Human
gcucugaaagagaaaca

SEQ ID NO: 1409539 - RNA, 16 nt, Human
gcucugaaaccagugu

SEQ ID NO: 1409540 - RNA, 15 nt, Human
gcucucuuucugucu

SEQ ID NO: 1409541 - RNA, 14 nt, Human
gcucucuuucuguc

SEQ ID NO: 1409542 - RNA, 19 nt, Human
gcucucugugggcuggcag

SEQ ID NO: 1409543 - RNA, 13 nt, Human
gcucugccagucc

SEQ ID NO: 1409544 - RNA, 17 nt, Human
gcucugccaguccuguc

SEQ ID NO: 1409545 - RNA, 16 nt, Human
gcucugccaguccugu

SEQ ID NO: 1409546 - RNA, 18 nt, Human
gcucugccaguccugucc

SEQ ID NO: 1409547 - RNA, 15 nt, Human
gcucuggagcccacu

SEQ ID NO: 1409548 - RNA, 16 nt, Human
gcucuggagcccacug

SEQ ID NO: 1409549 - RNA, 14 nt, Human
gcuccucccucuca

SEQ ID NO: 1409550 - RNA, 17 nt, Human
gcucccauccugugugu

SEQ ID NO: 1409551 - RNA, 22 nt, Human
gcuccucccucucaacacccag

SEQ ID NO: 1409552 - RNA, 17 nt, Human
gcuccuccuucugcugc

SEQ ID NO: 1409553 - RNA, 18 nt, Human
gcuccucgagaucccaac

SEQ ID NO: 1409554 - RNA, 15 nt, Human
gcuccucuccccagc

SEQ ID NO: 1409555 - RNA, 20 nt, Human
gcucccaggggcucccuccg

SEQ ID NO: 1409556 - RNA, 21 nt, Human
gcucccaggggcucccuccgc

SEQ ID NO: 1409557 - RNA, 19 nt, Human
gcucccaggggcucccucc

SEQ ID NO: 1409558 - RNA, 22 nt, Human
gcucccagggacaccugggaga

SEQ ID NO: 1409559 - RNA, 11 nt, Human
gcucccagggc

SEQ ID NO: 1409560 - RNA, 17 nt, Human
gcuccagccugacauca

SEQ ID NO: 1409561 - RNA, 13 nt, Human
gcuccagccugac

SEQ ID NO: 1409562 - RNA, 12 nt, Human
gcuccagccuga

SEQ ID NO: 1409563 - RNA, 16 nt, Human
gcuccagccccucuug

SEQ ID NO: 1409564 - RNA, 22 nt, Human
gcuccagaugcagggcagucau

SEQ ID NO: 1409565 - RNA, 21 nt, Human
gcuccagaugcagggcaguca

SEQ ID NO: 1409566 - RNA, 19 nt, Human
gcuccagaugcagggcagu

SEQ ID NO: 1409567 - RNA, 18 nt, Human
gcuccagaugcagggcag

SEQ ID NO: 1409568 - RNA, 17 nt, Human
gcuccagaugcagggca

SEQ ID NO: 1409569 - RNA, 21 nt, Human
gcuccagagggcacucugcuu

SEQ ID NO: 1409570 - RNA, 20 nt, Human
gcuccagagggcacucugcu

SEQ ID NO: 1409571 - RNA, 12 nt, Human
gcuccagagggc

SEQ ID NO: 1409572 - RNA, 23 nt, Human
gcuccagaccugauccuggaggc

SEQ ID NO: 1409573 - RNA, 22 nt, Human
gcuccagaccugauccuggagg

SEQ ID NO: 1409574 - RNA, 21 nt, Human
gcuccagaccugauccuggag

SEQ ID NO: 1409575 - RNA, 20 nt, Human
gcuccagaccugauccugga

SEQ ID NO: 1409576 - RNA, 13 nt, Human
gcuccagaccuga

SEQ ID NO: 1409577 - RNA, 12 nt, Human
gcuccagaccug

SEQ ID NO: 1409578 - RNA, 14 nt, Human
gcuccagacaggga

SEQ ID NO: 1409579 - RNA, 16 nt, Human
gcucuauuaugaaugu

SEQ ID NO: 1409580 - RNA, 21 nt, Human
gcucuaugagucuagauguuu

SEQ ID NO: 1409581 - RNA, 18 nt, Human
gcucuaugagucuagaug

SEQ ID NO: 1409582 - RNA, 14 nt, Human
gcucuaugagucua

SEQ ID NO: 1409583 - RNA, 13 nt, Human
gcucuaugagucu

SEQ ID NO: 1409584 - RNA, 19 nt, Human
gcucuagguacgaugacag

SEQ ID NO: 1409585 - RNA, 20 nt, Human
gcucuagaucauaaggcuuc

SEQ ID NO: 1409586 - RNA, 23 nt, Human
gcucuagauugagagaagagaca

SEQ ID NO: 1409587 - RNA, 22 nt, Human
gcucuagaucauaaggcuucaa

SEQ ID NO: 1409588 - RNA, 21 nt, Human
gcucucacggccacacagcug

SEQ ID NO: 1409589 - RNA, 23 nt, Human
gcucucacggccacacagcugcc

SEQ ID NO: 1409590 - RNA, 12 nt, Human
gcucucaccucu

SEQ ID NO: 1409591 - RNA, 17 nt, Human
gcucucaccuggcccug

SEQ ID NO: 1409592 - RNA, 22 nt, Human
gcucuauuaugaaugugaagcc

SEQ ID NO: 1409593 - RNA, 23 nt, Human
gcucuauuaugaaugugaagccu

SEQ ID NO: 1409594 - RNA, 21 nt, Human
gcucuauuaugaaugugaagc

SEQ ID NO: 1409595 - RNA, 18 nt, Human
gcucuauuaugaauguga

SEQ ID NO: 1409596 - RNA, 13 nt, Human
gcucuagaaucug

SEQ ID NO: 1409597 - RNA, 23 nt, Human
gcucuacuuccccauggcccuga

SEQ ID NO: 1409598 - RNA, 22 nt, Human
gcucuacuuccccauggcccug

SEQ ID NO: 1409599 - RNA, 16 nt, Human
gcucuacuuccccaug

SEQ ID NO: 1409600 - RNA, 15 nt, Human
gcucuacuuccccau

SEQ ID NO: 1409601 - RNA, 21 nt, Human
gcucuacuggucuuguggaau

SEQ ID NO: 1409602 - RNA, 20 nt, Human
gcucuacaucuucugccuua

SEQ ID NO: 1409603 - RNA, 19 nt, Human
gcucuacaucuucugccuu

SEQ ID NO: 1409604 - RNA, 18 nt, Human
gcucuacaucuucugccu

SEQ ID NO: 1409605 - RNA, 23 nt, Human
gcuccucuccccagcccagagac

SEQ ID NO: 1409606 - RNA, 22 nt, Human
gcuccucuccccagcccagaga

SEQ ID NO: 1409607 - RNA, 21 nt, Human
gcuccucuccccagcccagag

SEQ ID NO: 1409608 - RNA, 20 nt, Human
gcuccucuccccagcccaga

SEQ ID NO: 1409609 - RNA, 19 nt, Human
gcuccucuccccagcccag

SEQ ID NO: 1409610 - RNA, 18 nt, Human
gcuccucuccccagccca

SEQ ID NO: 1409611 - RNA, 16 nt, Human
gcuccucuccccagcc

SEQ ID NO: 1409612 - RNA, 16 nt, Human
gcuggaguuucaugua

SEQ ID NO: 1409613 - RNA, 21 nt, Human
gcuggaguuagggacugacca

SEQ ID NO: 1409614 - RNA, 17 nt, Human
gcuggaguuagggacug

SEQ ID NO: 1409615 - RNA, 20 nt, Human
gcuggagugcagugguguga

SEQ ID NO: 1409616 - RNA, 19 nt, Human
gcuggagugcaguggugca

SEQ ID NO: 1409617 - RNA, 20 nt, Human
gcuggagugcaguggcgcga

SEQ ID NO: 1409618 - RNA, 15 nt, Human
gcugguuuaauguuu

SEQ ID NO: 1409619 - RNA, 12 nt, Human
gcugguucugua

SEQ ID NO: 1409620 - RNA, 22 nt, Human
gcuguacaucuauuuuggauug

SEQ ID NO: 1409621 - RNA, 20 nt, Human
gcuguacaucuauuuuggau

SEQ ID NO: 1409622 - RNA, 16 nt, Human
gcuguacaucuauuuu

SEQ ID NO: 1409623 - RNA, 12 nt, Human
gcuguacaucua

SEQ ID NO: 1409624 - RNA, 16 nt, Human
gcuguacccaguuucu

SEQ ID NO: 1409625 - RNA, 13 nt, Human
gcuguacccaguu

SEQ ID NO: 1409626 - RNA, 23 nt, Human
gcuguacaucuauuuuggauugu

SEQ ID NO: 1409627 - RNA, 13 nt, Human
gcuguagaaaaaa

SEQ ID NO: 1409628 - RNA, 15 nt, Human
gcuguauugucugaa

SEQ ID NO: 1409629 - RNA, 14 nt, Human
gcuguauugucuga

SEQ ID NO: 1409630 - RNA, 12 nt, Human
gcuguauugucu

SEQ ID NO: 1409631 - RNA, 18 nt, Human
gcuguauuuuaaaagaau

SEQ ID NO: 1409632 - RNA, 13 nt, Human
gcuguauuuuaaa

SEQ ID NO: 1409633 - RNA, 12 nt, Human
gcuguauuuuaa

SEQ ID NO: 1409634 - RNA, 23 nt, Human
gcugugccucgcuccccacucug

SEQ ID NO: 1409635 - RNA, 18 nt, Human
gcugugccucgcucccca

SEQ ID NO: 1409636 - RNA, 15 nt, Human
gcugugccucgcucc

SEQ ID NO: 1409637 - RNA, 14 nt, Human
gcuguugcugaaua

SEQ ID NO: 1409638 - RNA, 15 nt, Human
gcuguugcugaauag

SEQ ID NO: 1409639 - RNA, 16 nt, Human
gcuguugcugaauagg

SEQ ID NO: 1409640 - RNA, 19 nt, Human
gcuguugcugaauaggcga

SEQ ID NO: 1409641 - RNA, 16 nt, Human
gcuguuuuguuauaua

SEQ ID NO: 1409642 - RNA, 14 nt, Human
gcuguuuuguuaua

SEQ ID NO: 1409643 - RNA, 13 nt, Human
gcuguuuuguuau

SEQ ID NO: 1409644 - RNA, 16 nt, Human
gcuguuuuaaacauua

SEQ ID NO: 1409645 - RNA, 19 nt, Human
gcuguuuuguugacauucu

SEQ ID NO: 1409646 - RNA, 14 nt, Human
gcuguuuuguugac

SEQ ID NO: 1409647 - RNA, 19 nt, Human
gcuguuuuguuauauaauu

SEQ ID NO: 1409648 - RNA, 23 nt, Human
gcuguuuuguuauauaauuuaga

SEQ ID NO: 1409649 - RNA, 23 nt, Human
gcuguuuuguugacauucugaau

SEQ ID NO: 1409650 - RNA, 13 nt, Human
gcuguuuuuuugu

SEQ ID NO: 1409651 - RNA, 20 nt, Human
gcuuaauggcugauaauuuu

SEQ ID NO: 1409652 - RNA, 14 nt, Human
gcuuaauucaaaua

SEQ ID NO: 1409653 - RNA, 15 nt, Human
gcuuaauucaaauaa

SEQ ID NO: 1409654 - RNA, 15 nt, Human
gcuucagguccaggc

SEQ ID NO: 1409655 - RNA, 21 nt, Human
gcuucagguccaggcuguguu

SEQ ID NO: 1409656 - RNA, 23 nt, Human
gcuucaggcccccgccuuggccu

SEQ ID NO: 1409657 - RNA, 16 nt, Human
gcuucaaauuguaagc

SEQ ID NO: 1409658 - RNA, 20 nt, Human
gcuuucugaacagcuggugu

SEQ ID NO: 1409659 - RNA, 17 nt, Human
gcuuucugaucaaggcc

SEQ ID NO: 1409660 - RNA, 21 nt, Human
gcuuucugaacagcuggugua

SEQ ID NO: 1409661 - RNA, 19 nt, Human
gcuuucugaacagcuggug

SEQ ID NO: 1409662 - RNA, 18 nt, Human
gcuuucugaacagcuggu

SEQ ID NO: 1409663 - RNA, 15 nt, Human
gcuuucuguuccaaa

SEQ ID NO: 1409664 - RNA, 14 nt, Human
gcuuucuguuccaa

SEQ ID NO: 1409665 - RNA, 13 nt, Human
gcuuucuguucca

SEQ ID NO: 1409666 - RNA, 12 nt, Human
gcuuucuguucc

SEQ ID NO: 1409667 - RNA, 22 nt, Human
gcuuugagagagaaaggacucc

SEQ ID NO: 1409668 - RNA, 16 nt, Human
gcuuucuguuccaaau

SEQ ID NO: 1409669 - RNA, 15 nt, Human
gcuuucccugccucu

SEQ ID NO: 1409670 - RNA, 16 nt, Human
gcuuucugaacagcug

SEQ ID NO: 1409671 - RNA, 19 nt, Human
gcuuucuccuuuaauugua

SEQ ID NO: 1409672 - RNA, 15 nt, Human
gcuugguuccuuccc

SEQ ID NO: 1409673 - RNA, 16 nt, Human
gcuugguuccuuccca

SEQ ID NO: 1409674 - RNA, 14 nt, Human
gcuugaccugaggc

SEQ ID NO: 1409675 - RNA, 22 nt, Human
gcuuccuucagagagcagugcu

SEQ ID NO: 1409676 - RNA, 19 nt, Human
gcuuccaugauucuauuua

SEQ ID NO: 1409677 - RNA, 18 nt, Human
gcuuccaugauucuauuu

SEQ ID NO: 1409678 - RNA, 15 nt, Human
gcuuccaugauucua

SEQ ID NO: 1409679 - RNA, 14 nt, Human
gcuuccaugauucu

SEQ ID NO: 1409680 - RNA, 13 nt, Human
gcuuccuucauuu

SEQ ID NO: 1409681 - RNA, 20 nt, Human
gcuuccuucagagagcagug

SEQ ID NO: 1409682 - RNA, 19 nt, Human
gcuuccuucagagagcagu

SEQ ID NO: 1409683 - RNA, 17 nt, Human
gcuuccuucagagagca

SEQ ID NO: 1409684 - RNA, 16 nt, Human
gcuuccuucagagagc

SEQ ID NO: 1409685 - RNA, 14 nt, Human
gcuuccuucagaga

SEQ ID NO: 1409686 - RNA, 13 nt, Human
gcuuccuucagag

SEQ ID NO: 1409687 - RNA, 16 nt, Human
gcuuccuggugcugga

SEQ ID NO: 1409688 - RNA, 14 nt, Human
gcuuccuggugcug

SEQ ID NO: 1409689 - RNA, 11 nt, Human
gcuuccuggug

SEQ ID NO: 1409690 - RNA, 22 nt, Human
gcuuccuggagcagaagcagca

SEQ ID NO: 1409691 - RNA, 18 nt, Human
gcuuccuggagcagaagc

SEQ ID NO: 1409692 - RNA, 15 nt, Human
gcuuccuggagcaga

SEQ ID NO: 1409693 - RNA, 13 nt, Human
gcuuccuggagca

SEQ ID NO: 1409694 - RNA, 12 nt, Human
gcuuccuggagc

SEQ ID NO: 1409695 - RNA, 21 nt, Human
gcuuccugcuugccaaggcag

SEQ ID NO: 1409696 - RNA, 14 nt, Human
gcuuccugcuugcc

SEQ ID NO: 1409697 - RNA, 13 nt, Human
gcuuccugcuugc

SEQ ID NO: 1409698 - RNA, 19 nt, Human
gcuuccuggcaauagucaa

SEQ ID NO: 1409699 - RNA, 18 nt, Human
ggaacaaggagucagaca

SEQ ID NO: 1409700 - RNA, 19 nt, Human
ggaaauucccuucaucugg

SEQ ID NO: 1409701 - RNA, 17 nt, Human
ggaaauuuagcauugua

SEQ ID NO: 1409702 - RNA, 14 nt, Human
ggaaauuuagcauu

SEQ ID NO: 1409703 - RNA, 21 nt, Human
ggaaauuuaaagcagguucuu

SEQ ID NO: 1409704 - RNA, 17 nt, Human
ggaaauuggaagagcac

SEQ ID NO: 1409705 - RNA, 16 nt, Human
ggaaauugauuuugaa

SEQ ID NO: 1409706 - RNA, 22 nt, Human
ggaaauucccuucaucuggaac

SEQ ID NO: 1409707 - RNA, 16 nt, Human
ggaaauucugcucaga

SEQ ID NO: 1409708 - RNA, 20 nt, Human
ggaaauucccuucaucugga

SEQ ID NO: 1409709 - RNA, 18 nt, Human
ggaaaccuuccacccagu

SEQ ID NO: 1409710 - RNA, 15 nt, Human
ggaaacgagacuuuc

SEQ ID NO: 1409711 - RNA, 21 nt, Human
ggaaacuaggugcauauuuau

SEQ ID NO: 1409712 - RNA, 14 nt, Human
ggaacugcugccac

SEQ ID NO: 1409713 - RNA, 13 nt, Human
ggaacugcugcca

SEQ ID NO: 1409714 - RNA, 12 nt, Human
ggaacugcugcc

SEQ ID NO: 1409715 - RNA, 20 nt, Human
ggaacugaagggggcggccu

SEQ ID NO: 1409716 - RNA, 21 nt, Human
ggaacugaagggggcggccua

SEQ ID NO: 1409717 - RNA, 12 nt, Human
ggaacugaaggg

SEQ ID NO: 1409718 - RNA, 21 nt, Human
ggaacaauugaaguaaacuuu

SEQ ID NO: 1409719 - RNA, 19 nt, Human
ggaacaauugaaguaaacu

SEQ ID NO: 1409720 - RNA, 15 nt, Human
ggaacaauugaagua

SEQ ID NO: 1409721 - RNA, 21 nt, Human
ggaacacuagacaagccagaa

SEQ ID NO: 1409722 - RNA, 20 nt, Human
ggaacacuagacaagccaga

SEQ ID NO: 1409723 - RNA, 14 nt, Human
ggaacacggccaca

SEQ ID NO: 1409724 - RNA, 15 nt, Human
ggaagaaagaagaca

SEQ ID NO: 1409725 - RNA, 21 nt, Human
ggaacugcugccacugagggg

SEQ ID NO: 1409726 - RNA, 17 nt, Human
ggaacugcugccacuga

SEQ ID NO: 1409727 - RNA, 16 nt, Human
ggaacugcugccacug

SEQ ID NO: 1409728 - RNA, 15 nt, Human
ggaacugcugccacu

SEQ ID NO: 1409729 - RNA, 23 nt, Human
ggaacuuggggaguuaagaccug

SEQ ID NO: 1409730 - RNA, 20 nt, Human
ggaagaagagaucaggaaga

SEQ ID NO: 1409731 - RNA, 21 nt, Human
ggaagaagagaucaggaagag

SEQ ID NO: 1409732 - RNA, 22 nt, Human
ggaagaagagaucaggaagaga

SEQ ID NO: 1409733 - RNA, 20 nt, Human
ggaagacccauuccuuccca

SEQ ID NO: 1409734 - RNA, 17 nt, Human
ggaagacccauuccuuc

SEQ ID NO: 1409735 - RNA, 18 nt, Human
ggaagacgcaagggccug

SEQ ID NO: 1409736 - RNA, 13 nt, Human
gcuuuuuccagag

SEQ ID NO: 1409737 - RNA, 17 nt, Human
gcuuuuuauuucugcau

SEQ ID NO: 1409738 - RNA, 21 nt, Human
gcuuuuuauuucugcauaugu

SEQ ID NO: 1409739 - RNA, 15 nt, Human
gcuuuuuauuucugc

SEQ ID NO: 1409740 - RNA, 19 nt, Human
gcuuuuuauuccuccugcu

SEQ ID NO: 1409741 - RNA, 19 nt, Human
gcuuuugugauggagugcu

SEQ ID NO: 1409742 - RNA, 20 nt, Human
gcuuuugucuacacacccug

SEQ ID NO: 1409743 - RNA, 21 nt, Human
gcuuuuggcggggaggaggaa

SEQ ID NO: 1409744 - RNA, 22 nt, Human
gcuuuuggcggggaggaggaaa

SEQ ID NO: 1409745 - RNA, 12 nt, Human
gcuuuugugcau

SEQ ID NO: 1409746 - RNA, 15 nt, Human
gcuuuuuuaucaugu

SEQ ID NO: 1409747 - RNA, 18 nt, Human
gcuuuuuuaucaugugaa

SEQ ID NO: 1409748 - RNA, 20 nt, Human
gcuuuuuuaucaugugaaau

SEQ ID NO: 1409749 - RNA, 17 nt, Human
ggaaaccuuccacccag

SEQ ID NO: 1409750 - RNA, 17 nt, Human
gcuuuuuuguuuuggcu

SEQ ID NO: 1409751 - RNA, 16 nt, Human
gcuuuuuguguuuuuu

SEQ ID NO: 1409752 - RNA, 23 nt, Human
gcuuuuugugauaugcacaaugu

SEQ ID NO: 1409753 - RNA, 22 nt, Human
gcuuuuuucucugauacagaaa

SEQ ID NO: 1409754 - RNA, 20 nt, Human
gcuuugauguuccuuccagu

SEQ ID NO: 1409755 - RNA, 19 nt, Human
gcuuugauguuccuuccag

SEQ ID NO: 1409756 - RNA, 15 nt, Human
gcuuugauguuccuu

SEQ ID NO: 1409757 - RNA, 14 nt, Human
gcgagagaugugug

SEQ ID NO: 1409758 - RNA, 13 nt, Human
gcgagagaugugu

SEQ ID NO: 1409759 - RNA, 12 nt, Human
gcgagagaugug

SEQ ID NO: 1409760 - RNA, 19 nt, Human
gcgagagaucaaagaugaa

SEQ ID NO: 1409761 - RNA, 17 nt, Human
gcgacuuucugccugga

SEQ ID NO: 1409762 - RNA, 16 nt, Human
gcgacuuucugccugg

SEQ ID NO: 1409763 - RNA, 22 nt, Human
gcgagagauguguguugauacu

SEQ ID NO: 1409764 - RNA, 16 nt, Human
gcgagagauguguguu

SEQ ID NO: 1409765 - RNA, 15 nt, Human
gcgagagaugugugu

SEQ ID NO: 1409766 - RNA, 18 nt, Human
gcgagcaugucguggaca

SEQ ID NO: 1409767 - RNA, 19 nt, Human
gcgagauaccccaccuccc

SEQ ID NO: 1409768 - RNA, 13 nt, Human
gcgauagagucuc

SEQ ID NO: 1409769 - RNA, 17 nt, Human
gcgauucuccugccuca

SEQ ID NO: 1409770 - RNA, 23 nt, Human
gcgauucuccugccucagccucc

SEQ ID NO: 1409771 - RNA, 18 nt, Human
gcgauucucuugccucaa

SEQ ID NO: 1409772 - RNA, 22 nt, Human
gcgauucccucucccaggcccc

SEQ ID NO: 1409773 - RNA, 22 nt, Human
gcggcccaauccaagguggggu

SEQ ID NO: 1409774 - RNA, 16 nt, Human
gcggcccaauccaagg

SEQ ID NO: 1409775 - RNA, 17 nt, Human
gcggaggggacagagcg

SEQ ID NO: 1409776 - RNA, 18 nt, Human
gcggccuaugacuugggc

SEQ ID NO: 1409777 - RNA, 13 nt, Human
gcggccggccagc

SEQ ID NO: 1409778 - RNA, 13 nt, Human
gcggcccugucau

SEQ ID NO: 1409779 - RNA, 14 nt, Human
gcggcccugucauc

SEQ ID NO: 1409780 - RNA, 13 nt, Human
gcggcccucagua

SEQ ID NO: 1409781 - RNA, 22 nt, Human
gcggcugggaggagggcaggca

SEQ ID NO: 1409782 - RNA, 19 nt, Human
gcggcugggaggagggcag

SEQ ID NO: 1409783 - RNA, 18 nt, Human
gcggcugggaggagggca

SEQ ID NO: 1409784 - RNA, 17 nt, Human
gcggcugggaggagggc

SEQ ID NO: 1409785 - RNA, 14 nt, Human
gcggcugggaggag

SEQ ID NO: 1409786 - RNA, 13 nt, Human
gcggcugggagga

SEQ ID NO: 1409787 - RNA, 14 nt, Human
gcggccuccuucug

SEQ ID NO: 1409788 - RNA, 19 nt, Human
gcggccuaugacuugggca

SEQ ID NO: 1409789 - RNA, 23 nt, Human
gcggccuaugacuugggcacccc

SEQ ID NO: 1409790 - RNA, 19 nt, Human
gcggccuccuucugagcuc

SEQ ID NO: 1409791 - RNA, 12 nt, Human
gcguggcugacu

SEQ ID NO: 1409792 - RNA, 21 nt, Human
gcguggccuuguucugucacc

SEQ ID NO: 1409793 - RNA, 22 nt, Human
gcguggagggguaggggcuggg

SEQ ID NO: 1409794 - RNA, 16 nt, Human
gcgugguggucccugg

SEQ ID NO: 1409795 - RNA, 16 nt, Human
gcggcuggggucccag

SEQ ID NO: 1409796 - RNA, 12 nt, Human
gcgugaucucag

SEQ ID NO: 1409797 - RNA, 15 nt, Human
gcgugaucucagcuc

SEQ ID NO: 1409798 - RNA, 15 nt, Human
gcggccuccuucuga

SEQ ID NO: 1409799 - RNA, 16 nt, Human
gcgugaucucagcuca

SEQ ID NO: 1409800 - RNA, 21 nt, Human
gcggagguguggagccgaggc

SEQ ID NO: 1409801 - RNA, 23 nt, Human
gcggaggaaggaggacccaggac

SEQ ID NO: 1409802 - RNA, 22 nt, Human
gcuacugccgucagugcugugc

SEQ ID NO: 1409803 - RNA, 18 nt, Human
gcuacugccgucagugcu

SEQ ID NO: 1409804 - RNA, 19 nt, Human
gcuaauuuuuuuguauuuu

SEQ ID NO: 1409805 - RNA, 20 nt, Human
gcuaauuuuuuguuguuucu

SEQ ID NO: 1409806 - RNA, 20 nt, Human
gcuaauuuuuguauuuuuag

SEQ ID NO: 1409807 - RNA, 18 nt, Human
gcuaauuuuuauuaauuu

SEQ ID NO: 1409808 - RNA, 21 nt, Human
gcuaauuuuuuuguauuuuag

SEQ ID NO: 1409809 - RNA, 17 nt, Human
gcuaauuuuuguaauuu

SEQ ID NO: 1409810 - RNA, 16 nt, Human
gcuaauuuuuguaauu

SEQ ID NO: 1409811 - RNA, 15 nt, Human
gcuaauuuuuguaau

SEQ ID NO: 1409812 - RNA, 12 nt, Human
gcuaauuuuuau

SEQ ID NO: 1409813 - RNA, 13 nt, Human
gcguggugcgagu

SEQ ID NO: 1409814 - RNA, 17 nt, Human
gcguuucuaugacacau

SEQ ID NO: 1409815 - RNA, 20 nt, Human
gcuaauuuguuuuggauaua

SEQ ID NO: 1409816 - RNA, 15 nt, Human
gcuaauuugcauuaa

SEQ ID NO: 1409817 - RNA, 13 nt, Human
gcuaauuugcauu

SEQ ID NO: 1409818 - RNA, 12 nt, Human
gcuaauuugcau

SEQ ID NO: 1409819 - RNA, 20 nt, Human
gcuaauuuauccugaaauuu

SEQ ID NO: 1409820 - RNA, 18 nt, Human
gcuaauuuugaaaaacug

SEQ ID NO: 1409821 - RNA, 21 nt, Human
gcuacugugugugugaaugaa

SEQ ID NO: 1409822 - RNA, 19 nt, Human
gcuacugugugugugaaug

SEQ ID NO: 1409823 - RNA, 18 nt, Human
gcuacugugugugugaau

SEQ ID NO: 1409824 - RNA, 15 nt, Human
gcuacugugugugug

SEQ ID NO: 1409825 - RNA, 23 nt, Human
gcuacuggggaaacuggccaugg

SEQ ID NO: 1409826 - RNA, 21 nt, Human
gcuacuggggaaacuggccau

SEQ ID NO: 1409827 - RNA, 20 nt, Human
gcuacuggggaaacuggcca

SEQ ID NO: 1409828 - RNA, 18 nt, Human
gcuacuggggaaacuggc

SEQ ID NO: 1409829 - RNA, 17 nt, Human
gcuacuggggaaacugg

SEQ ID NO: 1409830 - RNA, 16 nt, Human
gcuacuggggaaacug

SEQ ID NO: 1409831 - RNA, 18 nt, Human
gcuacuguaaggcaauca

SEQ ID NO: 1409832 - RNA, 19 nt, Human
gcuacuguaaggcaaucau

SEQ ID NO: 1409833 - RNA, 16 nt, Human
gcuacuuugcugcuau

SEQ ID NO: 1409834 - RNA, 23 nt, Human
gcuacuuugcugcuaugguuuuc

SEQ ID NO: 1409835 - RNA, 18 nt, Human
gcuacuucggggcuggga

SEQ ID NO: 1409836 - RNA, 19 nt, Human
gcuacuuccuccuccccac

SEQ ID NO: 1409837 - RNA, 18 nt, Human
gcuacuuccuccucccca

SEQ ID NO: 1409838 - RNA, 14 nt, Human
gcuagaacccucug

SEQ ID NO: 1409839 - RNA, 15 nt, Human
gcuagaacccucugu

SEQ ID NO: 1409840 - RNA, 14 nt, Human
gcuagaacaugguu

SEQ ID NO: 1409841 - RNA, 18 nt, Human
gccuccuucugagcuccu

SEQ ID NO: 1409842 - RNA, 12 nt, Human
gccuccuucuga

SEQ ID NO: 1409843 - RNA, 19 nt, Human
gccucauguggcuggaaga

SEQ ID NO: 1409844 - RNA, 18 nt, Human
gccucauguggcuggaag

SEQ ID NO: 1409845 - RNA, 19 nt, Human
gccucauuuuuuuccuugc

SEQ ID NO: 1409846 - RNA, 21 nt, Human
gccucauuuuuuuccuugcaa

SEQ ID NO: 1409847 - RNA, 15 nt, Human
gccucauuuuuuucc

SEQ ID NO: 1409848 - RNA, 16 nt, Human
gccuccaacccuagca

SEQ ID NO: 1409849 - RNA, 22 nt, Human
gccuccagaggggcucagguca

SEQ ID NO: 1409850 - RNA, 22 nt, Human
gccuccaauuuuuuaagugaaa

SEQ ID NO: 1409851 - RNA, 23 nt, Human
gccuccaaggaggggcuguaaaa

SEQ ID NO: 1409852 - RNA, 22 nt, Human
gccuccaaggaggggcuguaaa

SEQ ID NO: 1409853 - RNA, 20 nt, Human
gccuccaacccuagcaaaag

SEQ ID NO: 1409854 - RNA, 21 nt, Human
gccugcuccagaccugauccu

SEQ ID NO: 1409855 - RNA, 17 nt, Human
gccugcuccagaccuga

SEQ ID NO: 1409856 - RNA, 16 nt, Human
gccucgcuccccacuc

SEQ ID NO: 1409857 - RNA, 14 nt, Human
gccucgcuccccac

SEQ ID NO: 1409858 - RNA, 18 nt, Human
gccucgccccuggcagag

SEQ ID NO: 1409859 - RNA, 17 nt, Human
gccucgccccuggcaga

SEQ ID NO: 1409860 - RNA, 16 nt, Human
gccucgccccuggcag

SEQ ID NO: 1409861 - RNA, 14 nt, Human
gccucgccccuggc

SEQ ID NO: 1409862 - RNA, 13 nt, Human
gccucgccccugg

SEQ ID NO: 1409863 - RNA, 16 nt, Human
gccucgcccauccccu

SEQ ID NO: 1409864 - RNA, 20 nt, Human
gccucgcaacccgugccaag

SEQ ID NO: 1409865 - RNA, 23 nt, Human
gccucgcaacccgugccaagucc

SEQ ID NO: 1409866 - RNA, 18 nt, Human
gccucgcaacccgugcca

SEQ ID NO: 1409867 - RNA, 12 nt, Human
gccucgcaaccc

SEQ ID NO: 1409868 - RNA, 22 nt, Human
gccuccuucugagcuccugucc

SEQ ID NO: 1409869 - RNA, 21 nt, Human
gccuccuucugagcuccuguc

SEQ ID NO: 1409870 - RNA, 20 nt, Human
gccuccuucugagcuccugu

SEQ ID NO: 1409871 - RNA, 22 nt, Human
gccugcccucauggccccucug

SEQ ID NO: 1409872 - RNA, 21 nt, Human
gccugcccucauggccccucu

SEQ ID NO: 1409873 - RNA, 20 nt, Human
gccugcccucauggccccuc

SEQ ID NO: 1409874 - RNA, 24 nt, Human
gccucgcuccccacucugcucuga

SEQ ID NO: 1409875 - RNA, 23 nt, Human
gccucgcuccccacucugcucug

SEQ ID NO: 1409876 - RNA, 20 nt, Human
gccucgcuccccacucugcu

SEQ ID NO: 1409877 - RNA, 19 nt, Human
gccucgcuccccacucugc

SEQ ID NO: 1409878 - RNA, 18 nt, Human
gccucgcuccccacucug

SEQ ID NO: 1409879 - RNA, 14 nt, Human
gccugcccugguga

SEQ ID NO: 1409880 - RNA, 12 nt, Human
gccugcccuggu

SEQ ID NO: 1409881 - RNA, 16 nt, Human
gccugcuccagaccug

SEQ ID NO: 1409882 - RNA, 15 nt, Human
gccugcuccagaccu

SEQ ID NO: 1409883 - RNA, 14 nt, Human
gccugcuccagacc

SEQ ID NO: 1409884 - RNA, 13 nt, Human
gccugcuccagac

SEQ ID NO: 1409885 - RNA, 12 nt, Human
gccugcuccaga

SEQ ID NO: 1409886 - RNA, 20 nt, Human
gccugcuauuugaaguguaa

SEQ ID NO: 1409887 - RNA, 20 nt, Human
gccugcuaaggucuuggaac

SEQ ID NO: 1409888 - RNA, 16 nt, Human
gccaguguccugagcc

SEQ ID NO: 1409889 - RNA, 17 nt, Human
gccaguguuuaaaacuu

SEQ ID NO: 1409890 - RNA, 22 nt, Human
gccauaaaacagguaauauaaa

SEQ ID NO: 1409891 - RNA, 14 nt, Human
gccauacugugucc

SEQ ID NO: 1409892 - RNA, 17 nt, Human
gccauauuuucaccauu

SEQ ID NO: 1409893 - RNA, 18 nt, Human
gccauauuuguaaaauga

SEQ ID NO: 1409894 - RNA, 14 nt, Human
gccauauuuguaaa

SEQ ID NO: 1409895 - RNA, 13 nt, Human
gccauauuuguaa

SEQ ID NO: 1409896 - RNA, 21 nt, Human
gccauauuuaccucagccugg

SEQ ID NO: 1409897 - RNA, 22 nt, Human
gccauauuuaccucagccuggg

SEQ ID NO: 1409898 - RNA, 20 nt, Human
gccauauuuaccucagccug

SEQ ID NO: 1409899 - RNA, 19 nt, Human
gccauauuuaccucagccu

SEQ ID NO: 1409900 - RNA, 18 nt, Human
gccauauuuaccucagcc

SEQ ID NO: 1409901 - RNA, 17 nt, Human
gccauauuuaccucagc

SEQ ID NO: 1409902 - RNA, 16 nt, Human
gccauauuuaccucag

SEQ ID NO: 1409903 - RNA, 16 nt, Human
gccauaugaaaaggcu

SEQ ID NO: 1409904 - RNA, 14 nt, Human
gccaggcccagccg

SEQ ID NO: 1409905 - RNA, 14 nt, Human
gccaggcauguggc

SEQ ID NO: 1409906 - RNA, 16 nt, Human
gcccccucccuggaug

SEQ ID NO: 1409907 - RNA, 15 nt, Human
gcccccucccuggau

SEQ ID NO: 1409908 - RNA, 17 nt, Human
gccccugccucucugca

SEQ ID NO: 1409909 - RNA, 18 nt, Human
gccccugccucucugcag

SEQ ID NO: 1409910 - RNA, 16 nt, Human
gcccccuccgcccugc

SEQ ID NO: 1409911 - RNA, 14 nt, Human
gcccccucccugga

SEQ ID NO: 1409912 - RNA, 23 nt, Human
gcccccucacaguauugcucacc

SEQ ID NO: 1409913 - RNA, 17 nt, Human
gcccccgccuuggccug

SEQ ID NO: 1409914 - RNA, 15 nt, Human
gccccugccucucug

SEQ ID NO: 1409915 - RNA, 16 nt, Human
gccccugccucucugc

SEQ ID NO: 1409916 - RNA, 22 nt, Human
gccccaccccagggcagccagg

SEQ ID NO: 1409917 - RNA, 21 nt, Human
gccccaccccagggcagccag

SEQ ID NO: 1409918 - RNA, 20 nt, Human
gccccaccccagggcagcca

SEQ ID NO: 1409919 - RNA, 19 nt, Human
gccccaccccagggcagcc

SEQ ID NO: 1409920 - RNA, 18 nt, Human
gccccaccccagggcagc

SEQ ID NO: 1409921 - RNA, 17 nt, Human
gccccaccccagggcag

SEQ ID NO: 1409922 - RNA, 15 nt, Human
gccccaccccagggc

SEQ ID NO: 1409923 - RNA, 15 nt, Human
gccccacccucagau

SEQ ID NO: 1409924 - RNA, 18 nt, Human
gccccacccucagaugca

SEQ ID NO: 1409925 - RNA, 16 nt, Human
gccccacccaggccag

SEQ ID NO: 1409926 - RNA, 22 nt, Human
gccccacaccagggccagccuc

SEQ ID NO: 1409927 - RNA, 21 nt, Human
gccccacaccagggccagccu

SEQ ID NO: 1409928 - RNA, 20 nt, Human
gccccccugguccccuccuu

SEQ ID NO: 1409929 - RNA, 18 nt, Human
gccccccugguccccucc

SEQ ID NO: 1409930 - RNA, 19 nt, Human
gccccccuggccuccccca

SEQ ID NO: 1409931 - RNA, 13 nt, Human
gccccccuggccu

SEQ ID NO: 1409932 - RNA, 12 nt, Human
gccccccuggcc

SEQ ID NO: 1409933 - RNA, 22 nt, Human
gccccacccucggggauguguc

SEQ ID NO: 1409934 - RNA, 16 nt, Human
gccccacccucgggga

SEQ ID NO: 1409935 - RNA, 13 nt, Human
gccccacccucgg

SEQ ID NO: 1409936 - RNA, 12 nt, Human
gccccacccucg

SEQ ID NO: 1409937 - RNA, 20 nt, Human
gccccacccucguggacacc

SEQ ID NO: 1409938 - RNA, 21 nt, Human
gccccacccucguggacaccu

SEQ ID NO: 1409939 - RNA, 12 nt, Human
gccccacccugg

SEQ ID NO: 1409940 - RNA, 22 nt, Human
gccccacccucguggacaccug

SEQ ID NO: 1409941 - RNA, 23 nt, Human
gccccacccucguggacaccugc

SEQ ID NO: 1409942 - RNA, 20 nt, Human
gccccaacuccuuccagcua

SEQ ID NO: 1409943 - RNA, 21 nt, Human
gccccaacucuccccugaccu

SEQ ID NO: 1409944 - RNA, 21 nt, Human
gccccaacuccuuccagcuag

SEQ ID NO: 1409945 - RNA, 19 nt, Human
gccccaacuccuuccagcu

SEQ ID NO: 1409946 - RNA, 18 nt, Human
gccccaacuccuuccagc

SEQ ID NO: 1409947 - RNA, 17 nt, Human
gccccaacuccuuccag

SEQ ID NO: 1409948 - RNA, 14 nt, Human
gccccaacuccuuc

SEQ ID NO: 1409949 - RNA, 16 nt, Human
gcccauucauuccauu

SEQ ID NO: 1409950 - RNA, 19 nt, Human
gcccauucauuccauucug

SEQ ID NO: 1409951 - RNA, 23 nt, Human
gcccauucauuccauucuggaag

SEQ ID NO: 1409952 - RNA, 18 nt, Human
gcccucauggccccucug

SEQ ID NO: 1409953 - RNA, 16 nt, Human
gcccucauggccccuc

SEQ ID NO: 1409954 - RNA, 12 nt, Human
gcccucaucccg

SEQ ID NO: 1409955 - RNA, 23 nt, Human
gcccucaguagucccugcacagu

SEQ ID NO: 1409956 - RNA, 19 nt, Human
gcccucaguagucccugca

SEQ ID NO: 1409957 - RNA, 21 nt, Human
gcccuauuuagaugauaaaga

SEQ ID NO: 1409958 - RNA, 24 nt, Human
gcccaggagcuccccuccccaacu

SEQ ID NO: 1409959 - RNA, 16 nt, Human
gccaucaagagacuga

SEQ ID NO: 1409960 - RNA, 15 nt, Human
gccaucaagagacug

SEQ ID NO: 1409961 - RNA, 20 nt, Human
gccauauuuguaaaaugaca

SEQ ID NO: 1409962 - RNA, 19 nt, Human
gccaucaaaaugcuuuuua

SEQ ID NO: 1409963 - RNA, 18 nt, Human
gccaucaaaaugcuuuuu

SEQ ID NO: 1409964 - RNA, 16 nt, Human
gccaucaaaaugcuuu

SEQ ID NO: 1409965 - RNA, 15 nt, Human
gccaucaaaaugcuu

SEQ ID NO: 1409966 - RNA, 14 nt, Human
gccaucaaaaugcu

SEQ ID NO: 1409967 - RNA, 22 nt, Human
gccaugugcuaguaauuggaaa

SEQ ID NO: 1409968 - RNA, 21 nt, Human
gcccaggagcuccccucccca

SEQ ID NO: 1409969 - RNA, 20 nt, Human
gcccaggagcuccccucccc

SEQ ID NO: 1409970 - RNA, 17 nt, Human
gcccaggagcuccccuc

SEQ ID NO: 1409971 - RNA, 15 nt, Human
gcccaggagcucccc

SEQ ID NO: 1409972 - RNA, 14 nt, Human
gcccaggagcuccc

SEQ ID NO: 1409973 - RNA, 11 nt, Human
gcccaggagcu

SEQ ID NO: 1409974 - RNA, 17 nt, Human
gccauguguuuauccua

SEQ ID NO: 1409975 - RNA, 17 nt, Human
gacauuaugugguuuua

SEQ ID NO: 1409976 - RNA, 17 nt, Human
gacauucaccugcccca

SEQ ID NO: 1409977 - RNA, 16 nt, Human
gacauucaccugcccc

SEQ ID NO: 1409978 - RNA, 15 nt, Human
gacauucaccugccc

SEQ ID NO: 1409979 - RNA, 14 nt, Human
gacauucaccugcc

SEQ ID NO: 1409980 - RNA, 23 nt, Human
gacauuaugugguuuuagauuuu

SEQ ID NO: 1409981 - RNA, 22 nt, Human
gacauuaacucauuagacugga

SEQ ID NO: 1409982 - RNA, 21 nt, Human
gacauuaacucauuagacugg

SEQ ID NO: 1409983 - RNA, 14 nt, Human
gacauuaacucauu

SEQ ID NO: 1409984 - RNA, 22 nt, Human
gacagaaguuugcacuaucuuu

SEQ ID NO: 1409985 - RNA, 20 nt, Human
gacagaaguuugcacuaucu

SEQ ID NO: 1409986 - RNA, 15 nt, Human
gacagaaguuugcac

SEQ ID NO: 1409987 - RNA, 20 nt, Human
gacacuuaauacuaccuuga

SEQ ID NO: 1409988 - RNA, 23 nt, Human
gacacuguucuuagcucaaugag

SEQ ID NO: 1409989 - RNA, 22 nt, Human
gacacuguucuuagcucaauga

SEQ ID NO: 1409990 - RNA, 18 nt, Human
gacacuguucuuagcuca

SEQ ID NO: 1409991 - RNA, 12 nt, Human
gacacuguucuu

SEQ ID NO: 1409992 - RNA, 16 nt, Human
gacacugccacacagg

SEQ ID NO: 1409993 - RNA, 18 nt, Human
gacagcuccacccuggcc

SEQ ID NO: 1409994 - RNA, 16 nt, Human
gacaggucccuccccu

SEQ ID NO: 1409995 - RNA, 16 nt, Human
gacagguuagcugcuc

SEQ ID NO: 1409996 - RNA, 12 nt, Human
gacagcuccacc

SEQ ID NO: 1409997 - RNA, 15 nt, Human
gacagucaaaaccaa

SEQ ID NO: 1409998 - RNA, 17 nt, Human
gacagucaccucaugga

SEQ ID NO: 1409999 - RNA, 13 nt, Human
gacagucucacuu

SEQ ID NO: 1410000 - RNA, 17 nt, Human
gacagucguucccagug

SEQ ID NO: 1410001 - RNA, 14 nt, Human
gacagugaaagaaa

SEQ ID NO: 1410002 - RNA, 22 nt, Human
gaauuuugcaaagauuuaaucu

SEQ ID NO: 1410003 - RNA, 21 nt, Human
gaauuuugcaaagauuuaauc

SEQ ID NO: 1410004 - RNA, 18 nt, Human
gaauuuuuaaacaaguau

SEQ ID NO: 1410005 - RNA, 17 nt, Human
gaauuuuuaaacaagua

SEQ ID NO: 1410006 - RNA, 15 nt, Human
gaauuuuguugcugu

SEQ ID NO: 1410007 - RNA, 17 nt, Human
gacaaacaccucccagg

SEQ ID NO: 1410008 - RNA, 15 nt, Human
gacaaaacuagagac

SEQ ID NO: 1410009 - RNA, 23 nt, Human
gacaaaaccccccagauaucauc

SEQ ID NO: 1410010 - RNA, 20 nt, Human
gacaaaaccccccagauauc

SEQ ID NO: 1410011 - RNA, 15 nt, Human
gacaaaauggaauac

SEQ ID NO: 1410012 - RNA, 23 nt, Human
gaauuuuauacuuucccuacccu

SEQ ID NO: 1410013 - RNA, 22 nt, Human
gaauuuuauacuuucccuaccc

SEQ ID NO: 1410014 - RNA, 21 nt, Human
gaauuuuauacuuucccuacc

SEQ ID NO: 1410015 - RNA, 20 nt, Human
gaauuuuauacuuucccuac

SEQ ID NO: 1410016 - RNA, 19 nt, Human
gaauuuuauacuuucccua

SEQ ID NO: 1410017 - RNA, 18 nt, Human
gaauuuuauacuuucccu

SEQ ID NO: 1410018 - RNA, 16 nt, Human
gaauuuuagcuuuugu

SEQ ID NO: 1410019 - RNA, 15 nt, Human
gaauuuuagcuuuug

SEQ ID NO: 1410020 - RNA, 18 nt, Human
gaauuuuauugacacagu

SEQ ID NO: 1410021 - RNA, 23 nt, Human
gaauuuucuuuguguagcuuugc

SEQ ID NO: 1410022 - RNA, 21 nt, Human
gaauuuucuuuguguagcuuu

SEQ ID NO: 1410023 - RNA, 14 nt, Human
gaauuauaacugua

SEQ ID NO: 1410024 - RNA, 13 nt, Human
gaauuauaacugu

SEQ ID NO: 1410025 - RNA, 20 nt, Human
gaauuauaacuggaaagaag

SEQ ID NO: 1410026 - RNA, 21 nt, Human
gaauuauaacuguaaagaugu

SEQ ID NO: 1410027 - RNA, 19 nt, Human
gaauuauaacuggaaagaa

SEQ ID NO: 1410028 - RNA, 14 nt, Human
gaauuaugaaacuu

SEQ ID NO: 1410029 - RNA, 20 nt, Human
gaauuaucuugguugaaaau

SEQ ID NO: 1410030 - RNA, 14 nt, Human
gaauuaucuaauuu

SEQ ID NO: 1410031 - RNA, 12 nt, Human
gaauuaugaaac

SEQ ID NO: 1410032 - RNA, 11 nt, Human
gaauuaguuuu

SEQ ID NO: 1410033 - RNA, 12 nt, Human
gacacacaugaa

SEQ ID NO: 1410034 - RNA, 15 nt, Human
gacacaccaggcgcu

SEQ ID NO: 1410035 - RNA, 16 nt, Human
gacaaacaccucccag

SEQ ID NO: 1410036 - RNA, 18 nt, Human
gacacaccaggcgcuaau

SEQ ID NO: 1410037 - RNA, 13 nt, Human
gacacacugaaga

SEQ ID NO: 1410038 - RNA, 19 nt, Human
gacacacuaaccaagcuga

SEQ ID NO: 1410039 - RNA, 18 nt, Human
gacacacuaaccaagcug

SEQ ID NO: 1410040 - RNA, 15 nt, Human
gacacacuaaccaag

SEQ ID NO: 1410041 - RNA, 14 nt, Human
gacacacugaagaa

SEQ ID NO: 1410042 - RNA, 22 nt, Human
gaaggcuacuucggggcuggga

SEQ ID NO: 1410043 - RNA, 21 nt, Human
gaaggcuacuucggggcuggg

SEQ ID NO: 1410044 - RNA, 19 nt, Human
gaaggcuacuucggggcug

SEQ ID NO: 1410045 - RNA, 16 nt, Human
gaagcugcccugccca

SEQ ID NO: 1410046 - RNA, 21 nt, Human
gaagcucccccagcaaagccc

SEQ ID NO: 1410047 - RNA, 12 nt, Human
gaagcuccccca

SEQ ID NO: 1410048 - RNA, 20 nt, Human
gaagcucccccagcaaagcc

SEQ ID NO: 1410049 - RNA, 15 nt, Human
gaagcucccccagca

SEQ ID NO: 1410050 - RNA, 14 nt, Human
gaagggacugagag

SEQ ID NO: 1410051 - RNA, 17 nt, Human
gaagggaauaagguaca

SEQ ID NO: 1410052 - RNA, 22 nt, Human
gaagggaauaagguacaagaag

SEQ ID NO: 1410053 - RNA, 19 nt, Human
gaaggcuuguugugcuuuu

SEQ ID NO: 1410054 - RNA, 17 nt, Human
gaaggcuuguugugcuu

SEQ ID NO: 1410055 - RNA, 20 nt, Human
gaaggcuuguugugcuuuua

SEQ ID NO: 1410056 - RNA, 21 nt, Human
gaaggcuugggauuugcugug

SEQ ID NO: 1410057 - RNA, 20 nt, Human
gaaggcuugggauuugcugu

SEQ ID NO: 1410058 - RNA, 17 nt, Human
gaaggcuugggauuugc

SEQ ID NO: 1410059 - RNA, 16 nt, Human
gaaggcuugggauuug

SEQ ID NO: 1410060 - RNA, 23 nt, Human
gaagggagccaagggauggacau

SEQ ID NO: 1410061 - RNA, 22 nt, Human
gaagggagccaagggauggaca

SEQ ID NO: 1410062 - RNA, 20 nt, Human
gaagggagccaagggaugga

SEQ ID NO: 1410063 - RNA, 16 nt, Human
gaagggagccaaggga

SEQ ID NO: 1410064 - RNA, 15 nt, Human
gaagggagccaaggg

SEQ ID NO: 1410065 - RNA, 14 nt, Human
gaagggagccaagg

SEQ ID NO: 1410066 - RNA, 13 nt, Human
gaagggagccaag

SEQ ID NO: 1410067 - RNA, 12 nt, Human
gaagggagccaa

SEQ ID NO: 1410068 - RNA, 16 nt, Human
gaagggaggggcugug

SEQ ID NO: 1410069 - RNA, 21 nt, Human
gaagggagggcagagcuggug

SEQ ID NO: 1410070 - RNA, 20 nt, Human
gaagggagggcagagcuggu

SEQ ID NO: 1410071 - RNA, 17 nt, Human
gaagggagggcagagcu

SEQ ID NO: 1410072 - RNA, 16 nt, Human
gaagggagggcagagc

SEQ ID NO: 1410073 - RNA, 15 nt, Human
gaagggagggcagag

SEQ ID NO: 1410074 - RNA, 14 nt, Human
gaagggagggcaga

SEQ ID NO: 1410075 - RNA, 23 nt, Human
gaagggagggcagagcuggugcg

SEQ ID NO: 1410076 - RNA, 13 nt, Human
gaagggcaaguuu

SEQ ID NO: 1410077 - RNA, 17 nt, Human
gaagugaaugcugggac

SEQ ID NO: 1410078 - RNA, 16 nt, Human
gaagugaaugcuggga

SEQ ID NO: 1410079 - RNA, 15 nt, Human
gaagugaaugcuggg

SEQ ID NO: 1410080 - RNA, 15 nt, Human
gaagugaagaaugca

SEQ ID NO: 1410081 - RNA, 14 nt, Human
gaagucuuuuguuc

SEQ ID NO: 1410082 - RNA, 13 nt, Human
gaagggccagagc

SEQ ID NO: 1410083 - RNA, 21 nt, Human
gaagugcuuaguguacuugga

SEQ ID NO: 1410084 - RNA, 20 nt, Human
gaagugcuguuuauuaaucu

SEQ ID NO: 1410085 - RNA, 18 nt, Human
gaagugcuguuuauuaau

SEQ ID NO: 1410086 - RNA, 21 nt, Human
gaagugcugccgcgcagugug

SEQ ID NO: 1410087 - RNA, 23 nt, Human
gaagugcaucuggagagaacagg

SEQ ID NO: 1410088 - RNA, 22 nt, Human
gaagugagggcucacucagcca

SEQ ID NO: 1410089 - RNA, 13 nt, Human
gaagugacuuugg

SEQ ID NO: 1410090 - RNA, 15 nt, Human
gaagugacuuuggcu

SEQ ID NO: 1410091 - RNA, 20 nt, Human
gaagugacuuuggcugcaug

SEQ ID NO: 1410092 - RNA, 16 nt, Human
gaagugagcacagccu

SEQ ID NO: 1410093 - RNA, 21 nt, Human
gaagugacuuuggcugcaugc

SEQ ID NO: 1410094 - RNA, 21 nt, Human
gaagcucagcugcauuccgca

SEQ ID NO: 1410095 - RNA, 17 nt, Human
gaagcuaauuugcauua

SEQ ID NO: 1410096 - RNA, 16 nt, Human
gaagcuaauuugcauu

SEQ ID NO: 1410097 - RNA, 15 nt, Human
gaagcuaauuugcau

SEQ ID NO: 1410098 - RNA, 14 nt, Human
gaagcuaauuugca

SEQ ID NO: 1410099 - RNA, 12 nt, Human
gaagcucagcug

SEQ ID NO: 1410100 - RNA, 23 nt, Human
gaagcuacugugugugugaauga

SEQ ID NO: 1410101 - RNA, 22 nt, Human
gaagcuacugugugugugaaug

SEQ ID NO: 1410102 - RNA, 20 nt, Human
gaagcuacugugugugugaa

SEQ ID NO: 1410103 - RNA, 15 nt, Human
gaagcuacugugugu

SEQ ID NO: 1410104 - RNA, 14 nt, Human
gaaauccauucaca

SEQ ID NO: 1410105 - RNA, 20 nt, Human
gaagugugccuucucucucc

SEQ ID NO: 1410106 - RNA, 15 nt, Human
gaagugugacuggcu

SEQ ID NO: 1410107 - RNA, 23 nt, Human
gaaugagagacacacugaagaag

SEQ ID NO: 1410108 - RNA, 22 nt, Human
gaaugagagacacacugaagaa

SEQ ID NO: 1410109 - RNA, 13 nt, Human
gaaugagccucgg

SEQ ID NO: 1410110 - RNA, 11 nt, Human
gaaugagccuc

SEQ ID NO: 1410111 - RNA, 13 nt, Human
gaaugagacaucc

SEQ ID NO: 1410112 - RNA, 15 nt, Human
gaaugagacauccag

SEQ ID NO: 1410113 - RNA, 12 nt, Human
gaaugacacugu

SEQ ID NO: 1410114 - RNA, 16 nt, Human
gaaugaauuaaauaaa

SEQ ID NO: 1410115 - RNA, 14 nt, Human
gaaugaauuaaaua

SEQ ID NO: 1410116 - RNA, 20 nt, Human
gaaugagagacacacugaag

SEQ ID NO: 1410117 - RNA, 16 nt, Human
gacuagggagccaugu

SEQ ID NO: 1410118 - RNA, 23 nt, Human
gacuaggccuugcggcuccucag

SEQ ID NO: 1410119 - RNA, 17 nt, Human
gacuagccuggcuuggg

SEQ ID NO: 1410120 - RNA, 22 nt, Human
gacuauucuugauguaaaaucu

SEQ ID NO: 1410121 - RNA, 21 nt, Human
gacuauucuugauguaaaauc

SEQ ID NO: 1410122 - RNA, 19 nt, Human
gacuaugaaaaugcuggcu

SEQ ID NO: 1410123 - RNA, 15 nt, Human
gacuaugaaaagcua

SEQ ID NO: 1410124 - RNA, 19 nt, Human
gacuaucuuacuauuucac

SEQ ID NO: 1410125 - RNA, 17 nt, Human
gacuaucuuacuauuuc

SEQ ID NO: 1410126 - RNA, 22 nt, Human
gacuauauuugggccugcucca

SEQ ID NO: 1410127 - RNA, 18 nt, Human
gacuaucugucugguggc

SEQ ID NO: 1410128 - RNA, 14 nt, Human
gacucaaaccaaau

SEQ ID NO: 1410129 - RNA, 17 nt, Human
gacucuuuugccauuaa

SEQ ID NO: 1410130 - RNA, 17 nt, Human
gacucuuuuccuucccu

SEQ ID NO: 1410131 - RNA, 16 nt, Human
gacucuuuaugcuugc

SEQ ID NO: 1410132 - RNA, 24 nt, Human
gacucuguccugaaggccugaggu

SEQ ID NO: 1410133 - RNA, 13 nt, Human
gacucuguccuga

SEQ ID NO: 1410134 - RNA, 18 nt, Human
gacucuggugccuccaga

SEQ ID NO: 1410135 - RNA, 16 nt, Human
gacucuuaagaagacu

SEQ ID NO: 1410136 - RNA, 18 nt, Human
gacucuuaagaagacugc

SEQ ID NO: 1410137 - RNA, 17 nt, Human
gacucuuaagaagacug

SEQ ID NO: 1410138 - RNA, 12 nt, Human
gacuuuugugaa

SEQ ID NO: 1410139 - RNA, 15 nt, Human
gacuuucugccugga

SEQ ID NO: 1410140 - RNA, 14 nt, Human
gacuuucugccugg

SEQ ID NO: 1410141 - RNA, 12 nt, Human
gacuuucugccu

SEQ ID NO: 1410142 - RNA, 20 nt, Human
gacuuuccccaccagaugcu

SEQ ID NO: 1410143 - RNA, 12 nt, Human
gacuuuccugca

SEQ ID NO: 1410144 - RNA, 11 nt, Human
gacuuuccugc

SEQ ID NO: 1410145 - RNA, 21 nt, Human
gacuuuccccaccagaugcug

SEQ ID NO: 1410146 - RNA, 18 nt, Human
gacuuuccccaccagaug

SEQ ID NO: 1410147 - RNA, 12 nt, Human
gacuuuccccac

SEQ ID NO: 1410148 - RNA, 11 nt, Human
gacuuucccca

SEQ ID NO: 1410149 - RNA, 14 nt, Human
gacuuuccauuaca

SEQ ID NO: 1410150 - RNA, 15 nt, Human
gacugaaaauauugu

SEQ ID NO: 1410151 - RNA, 21 nt, Human
gacuggguaggaaagaggaag

SEQ ID NO: 1410152 - RNA, 20 nt, Human
gagaagugaaugcugggacu

SEQ ID NO: 1410153 - RNA, 19 nt, Human
gagaagugaaugcugggac

SEQ ID NO: 1410154 - RNA, 17 nt, Human
gagaagugaaugcuggg

SEQ ID NO: 1410155 - RNA, 22 nt, Human
gagaagucucagcuaagcucac

SEQ ID NO: 1410156 - RNA, 21 nt, Human
gagaagucucagcuaagcuca

SEQ ID NO: 1410157 - RNA, 14 nt, Human
gagaagucucagcu

SEQ ID NO: 1410158 - RNA, 18 nt, Human
gagacccagcggacacac

SEQ ID NO: 1410159 - RNA, 11 nt, Human
gagacccagcg

SEQ ID NO: 1410160 - RNA, 18 nt, Human
gagaccccaccagccuca

SEQ ID NO: 1410161 - RNA, 18 nt, Human
gagacccagcccucaucc

SEQ ID NO: 1410162 - RNA, 14 nt, Human
gagaaucagacuga

SEQ ID NO: 1410163 - RNA, 15 nt, Human
gagaagucacagggc

SEQ ID NO: 1410164 - RNA, 14 nt, Human
gagaaucaucagga

SEQ ID NO: 1410165 - RNA, 18 nt, Human
gagaccucagaaguaaag

SEQ ID NO: 1410166 - RNA, 13 nt, Human
gagaccucagaag

SEQ ID NO: 1410167 - RNA, 21 nt, Human
gagaagccuucaagcucugag

SEQ ID NO: 1410168 - RNA, 22 nt, Human
gagaagccuucaagcucugagg

SEQ ID NO: 1410169 - RNA, 20 nt, Human
gagaagccuucaagcucuga

SEQ ID NO: 1410170 - RNA, 19 nt, Human
gagaagccuucaagcucug

SEQ ID NO: 1410171 - RNA, 13 nt, Human
gagaagucucagc

SEQ ID NO: 1410172 - RNA, 22 nt, Human
gagaagucacagggcaguaccu

SEQ ID NO: 1410173 - RNA, 18 nt, Human
gagaagucacagggcagu

SEQ ID NO: 1410174 - RNA, 17 nt, Human
gagaagucacagggcag

SEQ ID NO: 1410175 - RNA, 16 nt, Human
gagaagucacagggca

SEQ ID NO: 1410176 - RNA, 18 nt, Human
gagaaggaaaauuuuagc

SEQ ID NO: 1410177 - RNA, 18 nt, Human
gagaagccuucaagcucu

SEQ ID NO: 1410178 - RNA, 16 nt, Human
gagaagccuucaagcu

SEQ ID NO: 1410179 - RNA, 13 nt, Human
gagaagccuucaa

SEQ ID NO: 1410180 - RNA, 18 nt, Human
gagauggagucuugcucu

SEQ ID NO: 1410181 - RNA, 12 nt, Human
gagaugcuggcu

SEQ ID NO: 1410182 - RNA, 19 nt, Human
gagaugcuggcuugggcag

SEQ ID NO: 1410183 - RNA, 21 nt, Human
gagaugcaccaccaagccaag

SEQ ID NO: 1410184 - RNA, 18 nt, Human
gagaugcaccaccaagcc

SEQ ID NO: 1410185 - RNA, 21 nt, Human
gagaggcagcccaggaagucu

SEQ ID NO: 1410186 - RNA, 17 nt, Human
gagauuuauuaaagaaa

SEQ ID NO: 1410187 - RNA, 16 nt, Human
gagauuuauuaaagaa

SEQ ID NO: 1410188 - RNA, 14 nt, Human
gagauugaccugga

SEQ ID NO: 1410189 - RNA, 22 nt, Human
gagauugaauuucacugucuuu

SEQ ID NO: 1410190 - RNA, 14 nt, Human
gagauugaauuuca

SEQ ID NO: 1410191 - RNA, 13 nt, Human
gagauuuacaacu

SEQ ID NO: 1410192 - RNA, 21 nt, Human
gagauucugccuuugccaggu

SEQ ID NO: 1410193 - RNA, 15 nt, Human
gagauucugccuuug

SEQ ID NO: 1410194 - RNA, 14 nt, Human
gagauucugccuuu

SEQ ID NO: 1410195 - RNA, 23 nt, Human
gagauucucauaacuugagaccu

SEQ ID NO: 1410196 - RNA, 20 nt, Human
gagauucucauaacuugaga

SEQ ID NO: 1410197 - RNA, 21 nt, Human
gagauugcaccacugcacucc

SEQ ID NO: 1410198 - RNA, 17 nt, Human
gagaugggcuucccaag

SEQ ID NO: 1410199 - RNA, 14 nt, Human
gagaugggcuuccc

SEQ ID NO: 1410200 - RNA, 15 nt, Human
gagauggcucccagg

SEQ ID NO: 1410201 - RNA, 14 nt, Human
gagauggcucccag

SEQ ID NO: 1410202 - RNA, 17 nt, Human
gagauguaaaagguauu

SEQ ID NO: 1410203 - RNA, 16 nt, Human
gagauguaaaagguau

SEQ ID NO: 1410204 - RNA, 16 nt, Human
gagaugggcuucccaa

SEQ ID NO: 1410205 - RNA, 14 nt, Human
gagauguagccccu

SEQ ID NO: 1410206 - RNA, 18 nt, Human
gagcccccagccugucag

SEQ ID NO: 1410207 - RNA, 17 nt, Human
gagcccccagccuguca

SEQ ID NO: 1410208 - RNA, 16 nt, Human
gagcccccagccuguc

SEQ ID NO: 1410209 - RNA, 15 nt, Human
gagcccccagccugu

SEQ ID NO: 1410210 - RNA, 14 nt, Human
gagcccccagccug

SEQ ID NO: 1410211 - RNA, 13 nt, Human
gagcccccagccu

SEQ ID NO: 1410212 - RNA, 23 nt, Human
gagcccccacccuguuccugcug

SEQ ID NO: 1410213 - RNA, 22 nt, Human
gagcccccacccuguuccugcu

SEQ ID NO: 1410214 - RNA, 15 nt, Human
gagcccccacccugu

SEQ ID NO: 1410215 - RNA, 14 nt, Human
gagcccccacccug

SEQ ID NO: 1410216 - RNA, 18 nt, Human
gagccccauuccugggaa

SEQ ID NO: 1410217 - RNA, 17 nt, Human
gagccccauuccuggga

SEQ ID NO: 1410218 - RNA, 16 nt, Human
gagccccauuccuggg

SEQ ID NO: 1410219 - RNA, 18 nt, Human
gagccccaucagcuccag

SEQ ID NO: 1410220 - RNA, 23 nt, Human
gagccccagggagagggggcugg

SEQ ID NO: 1410221 - RNA, 14 nt, Human
gagccccagggaga

SEQ ID NO: 1410222 - RNA, 16 nt, Human
gagccccagcuacccu

SEQ ID NO: 1410223 - RNA, 22 nt, Human
gagcauguacugagccuuguaa

SEQ ID NO: 1410224 - RNA, 18 nt, Human
gagcauggaacacuucga

SEQ ID NO: 1410225 - RNA, 19 nt, Human
gagcauggaacacuucgag

SEQ ID NO: 1410226 - RNA, 14 nt, Human
gagcaucacagaau

SEQ ID NO: 1410227 - RNA, 13 nt, Human
gagcaucacagaa

SEQ ID NO: 1410228 - RNA, 12 nt, Human
gagcaucacaga

SEQ ID NO: 1410229 - RNA, 22 nt, Human
gagcauaggugauccauguaac

SEQ ID NO: 1410230 - RNA, 21 nt, Human
gagcauaggugauccauguaa

SEQ ID NO: 1410231 - RNA, 22 nt, Human
gagcagggccggggaacuggcc

SEQ ID NO: 1410232 - RNA, 21 nt, Human
gagcagggccggggaacuggc

SEQ ID NO: 1410233 - RNA, 16 nt, Human
gagcagggccggggaa

SEQ ID NO: 1410234 - RNA, 15 nt, Human
gagcagggccgggga

SEQ ID NO: 1410235 - RNA, 22 nt, Human
gagcagggauuaaccucugcac

SEQ ID NO: 1410236 - RNA, 21 nt, Human
gagcagggauuaaccucugca

SEQ ID NO: 1410237 - RNA, 20 nt, Human
gagcagggauuaaccucugc

SEQ ID NO: 1410238 - RNA, 17 nt, Human
gagcuggcucugagcgc

SEQ ID NO: 1410239 - RNA, 13 nt, Human
gagcuggcucuga

SEQ ID NO: 1410240 - RNA, 15 nt, Human
gagcgggucugcucc

SEQ ID NO: 1410241 - RNA, 17 nt, Human
gagcgggucugcuccca

SEQ ID NO: 1410242 - RNA, 23 nt, Human
gagccuuuucccucuuuggcucc

SEQ ID NO: 1410243 - RNA, 22 nt, Human
gagccuugaacuuugaccucug

SEQ ID NO: 1410244 - RNA, 15 nt, Human
gagcuggggaccugg

SEQ ID NO: 1410245 - RNA, 13 nt, Human
gagcuggggaccu

SEQ ID NO: 1410246 - RNA, 17 nt, Human
gagcugggccuggucuc

SEQ ID NO: 1410247 - RNA, 21 nt, Human
gagcugggccuggucucaccc

SEQ ID NO: 1410248 - RNA, 16 nt, Human
gagcugggccuggucu

SEQ ID NO: 1410249 - RNA, 14 nt, Human
gagcugggccuggu

SEQ ID NO: 1410250 - RNA, 13 nt, Human
gagcugggccugg

SEQ ID NO: 1410251 - RNA, 12 nt, Human
gagcugggccug

SEQ ID NO: 1410252 - RNA, 19 nt, Human
gagcugggcagaaggccaa

SEQ ID NO: 1410253 - RNA, 22 nt, Human
gagcuggcucugagcgccucca

SEQ ID NO: 1410254 - RNA, 17 nt, Human
gagcugggcagaaggcc

SEQ ID NO: 1410255 - RNA, 19 nt, Human
gagcuggggaccugguacc

SEQ ID NO: 1410256 - RNA, 13 nt, Human
gaugagaguuuug

SEQ ID NO: 1410257 - RNA, 18 nt, Human
gaugagaguuuuggaugc

SEQ ID NO: 1410258 - RNA, 13 nt, Human
gaugagcucccac

SEQ ID NO: 1410259 - RNA, 12 nt, Human
gaugagcuccca

SEQ ID NO: 1410260 - RNA, 21 nt, Human
gaugagaguuuuggaugcagu

SEQ ID NO: 1410261 - RNA, 15 nt, Human
gaugcuggcccaggg

SEQ ID NO: 1410262 - RNA, 14 nt, Human
gaugcuggcccagg

SEQ ID NO: 1410263 - RNA, 13 nt, Human
gaugcuggcccag

SEQ ID NO: 1410264 - RNA, 12 nt, Human
gaugcuggccca

SEQ ID NO: 1410265 - RNA, 17 nt, Human
gauauuuuuaucuuuau

SEQ ID NO: 1410266 - RNA, 15 nt, Human
gauauuuuuuucuuu

SEQ ID NO: 1410267 - RNA, 16 nt, Human
gauauuuugcuuugug

SEQ ID NO: 1410268 - RNA, 16 nt, Human
gauccaguauaagacu

SEQ ID NO: 1410269 - RNA, 20 nt, Human
gauccagggaggcugguccu

SEQ ID NO: 1410270 - RNA, 19 nt, Human
gauccagggaggcuggucc

SEQ ID NO: 1410271 - RNA, 22 nt, Human
gauccagggacagaggccccag

SEQ ID NO: 1410272 - RNA, 18 nt, Human
gauccagggacagaggcc

SEQ ID NO: 1410273 - RNA, 15 nt, Human
gauccagggacagag

SEQ ID NO: 1410274 - RNA, 14 nt, Human
gauccagggacaga

SEQ ID NO: 1410275 - RNA, 13 nt, Human
gauccagggacag

SEQ ID NO: 1410276 - RNA, 12 nt, Human
gauccagggaca

SEQ ID NO: 1410277 - RNA, 12 nt, Human
gauccaggacua

SEQ ID NO: 1410278 - RNA, 21 nt, Human
gauccagccuggggucuggag

SEQ ID NO: 1410279 - RNA, 13 nt, Human
gauccagccuggg

SEQ ID NO: 1410280 - RNA, 17 nt, Human
gauauuuuuuucuuuuc

SEQ ID NO: 1410281 - RNA, 19 nt, Human
gauccaggagcuccagugu

SEQ ID NO: 1410282 - RNA, 16 nt, Human
gauccaggagcuccag

SEQ ID NO: 1410283 - RNA, 15 nt, Human
gauccaggagcucca

SEQ ID NO: 1410284 - RNA, 13 nt, Human
gauccaggagcuc

SEQ ID NO: 1410285 - RNA, 23 nt, Human
gauccaggagcuccaguguccug

SEQ ID NO: 1410286 - RNA, 23 nt, Human
gauccaggccggcuugccacacc

SEQ ID NO: 1410287 - RNA, 21 nt, Human
gaucucauuggacccuuccau

SEQ ID NO: 1410288 - RNA, 15 nt, Human
gauccauuucuaauu

SEQ ID NO: 1410289 - RNA, 15 nt, Human
gaucucccugagaug

SEQ ID NO: 1410290 - RNA, 16 nt, Human
gaucucccugagaugg

SEQ ID NO: 1410291 - RNA, 15 nt, Human
gaucucuaacuucac

SEQ ID NO: 1410292 - RNA, 14 nt, Human
gauccauuucuaau

SEQ ID NO: 1410293 - RNA, 17 nt, Human
gauccauguaacugccu

SEQ ID NO: 1410294 - RNA, 14 nt, Human
gauccauguaacug

SEQ ID NO: 1410295 - RNA, 16 nt, Human
gaucccaacacugcca

SEQ ID NO: 1410296 - RNA, 12 nt, Human
gaucccaacacu

SEQ ID NO: 1410297 - RNA, 12 nt, Human
gauccaguuuug

SEQ ID NO: 1410298 - RNA, 17 nt, Human
gauccaguauaagacua

SEQ ID NO: 1410299 - RNA, 15 nt, Human
gauucucuugccuca

SEQ ID NO: 1410300 - RNA, 16 nt, Human
gauucucuugccucaa

SEQ ID NO: 1410301 - RNA, 14 nt, Human
gauucucuugccuc

SEQ ID NO: 1410302 - RNA, 23 nt, Human
gauucucugugucuaagauucua

SEQ ID NO: 1410303 - RNA, 22 nt, Human
gauucucugugucuaagauucu

SEQ ID NO: 1410304 - RNA, 18 nt, Human
gauucucugugucuaaga

SEQ ID NO: 1410305 - RNA, 15 nt, Human
gauucucugugucua

SEQ ID NO: 1410306 - RNA, 23 nt, Human
gauucucuggcuguaaggcucua

SEQ ID NO: 1410307 - RNA, 22 nt, Human
gauucucuggcuguaaggcucu

SEQ ID NO: 1410308 - RNA, 14 nt, Human
gauuacauuuuaaa

SEQ ID NO: 1410309 - RNA, 17 nt, Human
gauuaccuccugagaaa

SEQ ID NO: 1410310 - RNA, 14 nt, Human
gauuaccuccugag

SEQ ID NO: 1410311 - RNA, 13 nt, Human
gauuaccuccuga

SEQ ID NO: 1410312 - RNA, 18 nt, Human
gauuacugccuauuuuaa

SEQ ID NO: 1410313 - RNA, 15 nt, Human
gauuagaaauuaccu

SEQ ID NO: 1410314 - RNA, 22 nt, Human
gauuacuggccuuuuucauuua

SEQ ID NO: 1410315 - RNA, 22 nt, Human
gauuagaaauuaccuguggaua

SEQ ID NO: 1410316 - RNA, 20 nt, Human
gauuagaaauuaccugugga

SEQ ID NO: 1410317 - RNA, 20 nt, Human
gauuagacuggacagcuugu

SEQ ID NO: 1410318 - RNA, 19 nt, Human
gauuagacuggacagcuug

SEQ ID NO: 1410319 - RNA, 18 nt, Human
gauuagacuggacagcuu

SEQ ID NO: 1410320 - RNA, 19 nt, Human
gauuagacagaacaccuau

SEQ ID NO: 1410321 - RNA, 16 nt, Human
gauuagacagaacacc

SEQ ID NO: 1410322 - RNA, 14 nt, Human
gauuagacagaaca

SEQ ID NO: 1410323 - RNA, 23 nt, Human
gaugcuggcccagggcccagagc

SEQ ID NO: 1410324 - RNA, 22 nt, Human
gaugcuggcccagggcccagag

SEQ ID NO: 1410325 - RNA, 21 nt, Human
gaugcuggcccagggcccaga

SEQ ID NO: 1410326 - RNA, 19 nt, Human
gaugcuggcccagggccca

SEQ ID NO: 1410327 - RNA, 17 nt, Human
gaugcuggcccagggcc

SEQ ID NO: 1410328 - RNA, 16 nt, Human
gaugcuggcccagggc

SEQ ID NO: 1410329 - RNA, 23 nt, Human
gaugugaagccaauucagacagg

SEQ ID NO: 1410330 - RNA, 14 nt, Human
gaugugaagccaau

SEQ ID NO: 1410331 - RNA, 13 nt, Human
gaugugaagccaa

SEQ ID NO: 1410332 - RNA, 12 nt, Human
gaugugaagcca

SEQ ID NO: 1410333 - RNA, 22 nt, Human
gauuacaggugugagccaccac

SEQ ID NO: 1410334 - RNA, 19 nt, Human
gauuauuaacgauguccaa

SEQ ID NO: 1410335 - RNA, 19 nt, Human
gauuauguagcaaaauaca

SEQ ID NO: 1410336 - RNA, 18 nt, Human
gauuaugggucacaggaa

SEQ ID NO: 1410337 - RNA, 17 nt, Human
gauuaugggucacagga

SEQ ID NO: 1410338 - RNA, 16 nt, Human
gauuaugggucacagg

SEQ ID NO: 1410339 - RNA, 14 nt, Human
gauuaugggucaca

SEQ ID NO: 1410340 - RNA, 17 nt, Human
gauuagagccuguaaac

SEQ ID NO: 1410341 - RNA, 21 nt, Human
gauuauuuucuacacauacau

SEQ ID NO: 1410342 - RNA, 14 nt, Human
gagugcaguccuga

SEQ ID NO: 1410343 - RNA, 16 nt, Human
gaguccaucagccucc

SEQ ID NO: 1410344 - RNA, 15 nt, Human
gaguccaucagccuc

SEQ ID NO: 1410345 - RNA, 14 nt, Human
gaguccaucagccu

SEQ ID NO: 1410346 - RNA, 13 nt, Human
gaguccaucagcc

SEQ ID NO: 1410347 - RNA, 22 nt, Human
gaguccacuuuguuucgugggg

SEQ ID NO: 1410348 - RNA, 13 nt, Human
gaguccacuuugu

SEQ ID NO: 1410349 - RNA, 19 nt, Human
gaguccaagguuuaaagag

SEQ ID NO: 1410350 - RNA, 12 nt, Human
gagucacacagu

SEQ ID NO: 1410351 - RNA, 14 nt, Human
gagucaaguuguuc

SEQ ID NO: 1410352 - RNA, 13 nt, Human
gagucaauacaua

SEQ ID NO: 1410353 - RNA, 16 nt, Human
gaggugcccaggagaa

SEQ ID NO: 1410354 - RNA, 15 nt, Human
gaggugcccaggaga

SEQ ID NO: 1410355 - RNA, 14 nt, Human
gaggugcccaggag

SEQ ID NO: 1410356 - RNA, 13 nt, Human
gaggugcccagga

SEQ ID NO: 1410357 - RNA, 13 nt, Human
gaggugccacugg

SEQ ID NO: 1410358 - RNA, 14 nt, Human
gaggugccacugga

SEQ ID NO: 1410359 - RNA, 21 nt, Human
gaggugccugucccaccccca

SEQ ID NO: 1410360 - RNA, 15 nt, Human
gaggugccuguccca

SEQ ID NO: 1410361 - RNA, 13 nt, Human
gaggugccugucc

SEQ ID NO: 1410362 - RNA, 16 nt, Human
gaggugcacugggagg

SEQ ID NO: 1410363 - RNA, 18 nt, Human
gaggugcacugggaggcu

SEQ ID NO: 1410364 - RNA, 14 nt, Human
gaggugcacuggga

SEQ ID NO: 1410365 - RNA, 16 nt, Human
gaggucuguuccuuuu

SEQ ID NO: 1410366 - RNA, 14 nt, Human
gaggucuguuccuu

SEQ ID NO: 1410367 - RNA, 13 nt, Human
gaggucuguucuu

SEQ ID NO: 1410368 - RNA, 14 nt, Human
gaggucuguucuuu

SEQ ID NO: 1410369 - RNA, 22 nt, Human
gaguuugucgcucaugugugca

SEQ ID NO: 1410370 - RNA, 18 nt, Human
gaguuugucgcucaugug

SEQ ID NO: 1410371 - RNA, 17 nt, Human
gaguuugucgcucaugu

SEQ ID NO: 1410372 - RNA, 19 nt, Human
gaguuuggagagagcagac

SEQ ID NO: 1410373 - RNA, 22 nt, Human
gaguuuggagagagcagacugg

SEQ ID NO: 1410374 - RNA, 18 nt, Human
gagugcuugcuuuucaug

SEQ ID NO: 1410375 - RNA, 16 nt, Human
gaguuguuacauuuuu

SEQ ID NO: 1410376 - RNA, 20 nt, Human
gaguuguuacauuuuuaagu

SEQ ID NO: 1410377 - RNA, 22 nt, Human
gagugcaguccugaucagagcc

SEQ ID NO: 1410378 - RNA, 18 nt, Human
gagugcaguccugaucag

SEQ ID NO: 1410379 - RNA, 17 nt, Human
gagugcaguccugauca

SEQ ID NO: 1410380 - RNA, 15 nt, Human
gagugcguggugcga

SEQ ID NO: 1410381 - RNA, 18 nt, Human
gagugcggaccacccuca

SEQ ID NO: 1410382 - RNA, 21 nt, Human
gagugcucaguagucagacug

SEQ ID NO: 1410383 - RNA, 19 nt, Human
gagugcuugcuuuucaugc

SEQ ID NO: 1410384 - RNA, 15 nt, Human
gagugcuguuuuguu

SEQ ID NO: 1410385 - RNA, 12 nt, Human
gagugcuguuuu

SEQ ID NO: 1410386 - RNA, 19 nt, Human
gagugcugaaggaauggaa

SEQ ID NO: 1410387 - RNA, 17 nt, Human
gaguuugaugaggcccu

SEQ ID NO: 1410388 - RNA, 16 nt, Human
gaguuucuaagguccg

SEQ ID NO: 1410389 - RNA, 13 nt, Human
gaguuucuaaggu

SEQ ID NO: 1410390 - RNA, 12 nt, Human
gaguuucuaagg

SEQ ID NO: 1410391 - RNA, 17 nt, Human
gaguuuccuaugggaac

SEQ ID NO: 1410392 - RNA, 18 nt, Human
gaguuuauguuccauuaa

SEQ ID NO: 1410393 - RNA, 18 nt, Human
gaguuucauguacaagau

SEQ ID NO: 1410394 - RNA, 15 nt, Human
gaguuucauguacaa

SEQ ID NO: 1410395 - RNA, 22 nt, Human
gaguuuauguuccauuaaacga

SEQ ID NO: 1410396 - RNA, 22 nt, Human
gaguuuagggaacaauuuggca

SEQ ID NO: 1410397 - RNA, 20 nt, Human
gaguuuagggaacaauuugg

SEQ ID NO: 1410398 - RNA, 15 nt, Human
gaguuuagggugggg

SEQ ID NO: 1410399 - RNA, 14 nt, Human
gaguuuaggguggg

SEQ ID NO: 1410400 - RNA, 16 nt, Human
gaguuuagcuggaaaa

SEQ ID NO: 1410401 - RNA, 22 nt, Human
gaguuguuacauuuuuaagugc

SEQ ID NO: 1410402 - RNA, 22 nt, Human
gauacuaauaaacuaauaauug

SEQ ID NO: 1410403 - RNA, 13 nt, Human
gauacuaaggacg

SEQ ID NO: 1410404 - RNA, 16 nt, Human
gauacgcaucagacag

SEQ ID NO: 1410405 - RNA, 16 nt, Human
gauacuacaguuuguu

SEQ ID NO: 1410406 - RNA, 17 nt, Human
gauacgacaguacacug

SEQ ID NO: 1410407 - RNA, 16 nt, Human
gauacgacaguacacu

SEQ ID NO: 1410408 - RNA, 11 nt, Human
gauacuacagu

SEQ ID NO: 1410409 - RNA, 21 nt, Human
gauaccccccucugucuugug

SEQ ID NO: 1410410 - RNA, 13 nt, Human
gauaccccccucu

SEQ ID NO: 1410411 - RNA, 19 nt, Human
gauaccaugcuguaaggau

SEQ ID NO: 1410412 - RNA, 15 nt, Human
gauauuggaacuugc

SEQ ID NO: 1410413 - RNA, 13 nt, Human
gauauucuaagac

SEQ ID NO: 1410414 - RNA, 22 nt, Human
gauauuccuauugugcaaugua

SEQ ID NO: 1410415 - RNA, 12 nt, Human
gauauucuaaga

SEQ ID NO: 1410416 - RNA, 17 nt, Human
gauauuaaugcccagac

SEQ ID NO: 1410417 - RNA, 19 nt, Human
gauauuaaauuuuuuaaaa

SEQ ID NO: 1410418 - RNA, 18 nt, Human
gauauguauggguagggu

SEQ ID NO: 1410419 - RNA, 17 nt, Human
gauauguauggguaggg

SEQ ID NO: 1410420 - RNA, 18 nt, Human
gauauguaaaacauuuau

SEQ ID NO: 1410421 - RNA, 19 nt, Human
gauauguaaaacauuuauu

SEQ ID NO: 1410422 - RNA, 17 nt, Human
gauauguaaaacauuua

SEQ ID NO: 1410423 - RNA, 16 nt, Human
gauauguaaaacauuu

SEQ ID NO: 1410424 - RNA, 14 nt, Human
gauaugugaacagu

SEQ ID NO: 1410425 - RNA, 13 nt, Human
gauaugugaacag

SEQ ID NO: 1410426 - RNA, 20 nt, Human
gauacuuaagugcugcaauu

SEQ ID NO: 1410427 - RNA, 18 nt, Human
gauacuguugcacgugug

SEQ ID NO: 1410428 - RNA, 17 nt, Human
gauacuguugcacgugu

SEQ ID NO: 1410429 - RNA, 16 nt, Human
gauacuguugcacgug

SEQ ID NO: 1410430 - RNA, 15 nt, Human
gauacuguugcacgu

SEQ ID NO: 1410431 - RNA, 14 nt, Human
gauacuguugcacg

SEQ ID NO: 1410432 - RNA, 13 nt, Human
gauacuguugcac

SEQ ID NO: 1410433 - RNA, 12 nt, Human
gauacuguugca

SEQ ID NO: 1410434 - RNA, 19 nt, Human
gauacuucgacacuguucu

SEQ ID NO: 1410435 - RNA, 21 nt, Human
gauacuguugcacguguguuu

SEQ ID NO: 1410436 - RNA, 19 nt, Human
gauacuguugcacgugugu

SEQ ID NO: 1410437 - RNA, 16 nt, Human
gauacuugaaaauuaa

SEQ ID NO: 1410438 - RNA, 22 nt, Human
gauaugcuuguaacuaaaauaa

SEQ ID NO: 1410439 - RNA, 12 nt, Human
gauaugcuugua

SEQ ID NO: 1410440 - RNA, 14 nt, Human
gauaugcguauuau

SEQ ID NO: 1410441 - RNA, 17 nt, Human
gauaugcauauuuguuu

SEQ ID NO: 1410442 - RNA, 23 nt, Human
gauacuucgacacuguucuuagc

SEQ ID NO: 1410443 - RNA, 22 nt, Human
gauacuucgacacuguucuuag

SEQ ID NO: 1410444 - RNA, 20 nt, Human
gauacuucgacacuguucuu

SEQ ID NO: 1410445 - RNA, 17 nt, Human
gauacuugaaaauuaac

SEQ ID NO: 1410446 - RNA, 16 nt, Human
gcagcccaggaagucu

SEQ ID NO: 1410447 - RNA, 14 nt, Human
gcagcccagccagc

SEQ ID NO: 1410448 - RNA, 13 nt, Human
gcagcccagccag

SEQ ID NO: 1410449 - RNA, 22 nt, Human
gcagccccacaccagggccagc

SEQ ID NO: 1410450 - RNA, 14 nt, Human
gcagccccacccag

SEQ ID NO: 1410451 - RNA, 14 nt, Human
gcagcccaggaagu

SEQ ID NO: 1410452 - RNA, 12 nt, Human
gcagccccaggc

SEQ ID NO: 1410453 - RNA, 12 nt, Human
gcagcccagcca

SEQ ID NO: 1410454 - RNA, 15 nt, Human
gcagccagcaucugg

SEQ ID NO: 1410455 - RNA, 14 nt, Human
gcagccagcaucug

SEQ ID NO: 1410456 - RNA, 13 nt, Human
gcagccagcaucu

SEQ ID NO: 1410457 - RNA, 21 nt, Human
gcagccacccugaggagucug

SEQ ID NO: 1410458 - RNA, 20 nt, Human
gcagccacccugaggagucu

SEQ ID NO: 1410459 - RNA, 17 nt, Human
gcagccacccugaggag

SEQ ID NO: 1410460 - RNA, 16 nt, Human
gcagccacccugagga

SEQ ID NO: 1410461 - RNA, 15 nt, Human
gcagccacccugagg

SEQ ID NO: 1410462 - RNA, 14 nt, Human
gcagccacccugag

SEQ ID NO: 1410463 - RNA, 12 nt, Human
gcagccacccug

SEQ ID NO: 1410464 - RNA, 18 nt, Human
gcagagcugauggagaag

SEQ ID NO: 1410465 - RNA, 19 nt, Human
gcagagcugauggagaagg

SEQ ID NO: 1410466 - RNA, 16 nt, Human
gcagagcccaagggaa

SEQ ID NO: 1410467 - RNA, 16 nt, Human
gcagagccaggaagau

SEQ ID NO: 1410468 - RNA, 15 nt, Human
gcaguaccugagggu

SEQ ID NO: 1410469 - RNA, 14 nt, Human
gcaguaccugaggg

SEQ ID NO: 1410470 - RNA, 19 nt, Human
gcaguaccugggcaagcug

SEQ ID NO: 1410471 - RNA, 13 nt, Human
gcaguaauaaaaa

SEQ ID NO: 1410472 - RNA, 21 nt, Human
gcaguagaggcuauggacagg

SEQ ID NO: 1410473 - RNA, 22 nt, Human
gcagucacucuagucaaugaca

SEQ ID NO: 1410474 - RNA, 21 nt, Human
gcaguaucaugcccugugcaa

SEQ ID NO: 1410475 - RNA, 23 nt, Human
gcagguucuuguuggugcacagc

SEQ ID NO: 1410476 - RNA, 22 nt, Human
gcagguucuuguuggugcacag

SEQ ID NO: 1410477 - RNA, 17 nt, Human
gcagguucuuguuggug

SEQ ID NO: 1410478 - RNA, 13 nt, Human
gcagguucuuguu

SEQ ID NO: 1410479 - RNA, 17 nt, Human
gcagggagcugggcuuc

SEQ ID NO: 1410480 - RNA, 16 nt, Human
gcagggagcugggcuu

SEQ ID NO: 1410481 - RNA, 19 nt, Human
gcagggagcggccggccag

SEQ ID NO: 1410482 - RNA, 21 nt, Human
gcagggaaaauuauuugcaua

SEQ ID NO: 1410483 - RNA, 23 nt, Human
gcaggcugggccauguccaaaga

SEQ ID NO: 1410484 - RNA, 15 nt, Human
gcaggcugggccaug

SEQ ID NO: 1410485 - RNA, 14 nt, Human
gcaggcugggccau

SEQ ID NO: 1410486 - RNA, 13 nt, Human
gcaggcugggcca

SEQ ID NO: 1410487 - RNA, 12 nt, Human
gcaggcugggcc

SEQ ID NO: 1410488 - RNA, 11 nt, Human
gcaggcugggc

SEQ ID NO: 1410489 - RNA, 10 nt, Human
gcaggcuggg

SEQ ID NO: 1410490 - RNA, 20 nt, Human
gcauacgagagcagaggucu

SEQ ID NO: 1410491 - RNA, 18 nt, Human
gcauaccuccuauggguu

SEQ ID NO: 1410492 - RNA, 23 nt, Human
gcauaccagguuuuacacuugca

SEQ ID NO: 1410493 - RNA, 14 nt, Human
gcauacguacacau

SEQ ID NO: 1410494 - RNA, 16 nt, Human
gcaguuugcaaaaaau

SEQ ID NO: 1410495 - RNA, 12 nt, Human
gcaguuugcaaa

SEQ ID NO: 1410496 - RNA, 20 nt, Human
gcaguuuaucauucaagugu

SEQ ID NO: 1410497 - RNA, 16 nt, Human
gcaguuuaucauucaa

SEQ ID NO: 1410498 - RNA, 15 nt, Human
gcagucgugccugug

SEQ ID NO: 1410499 - RNA, 13 nt, Human
gcagucgugccug

SEQ ID NO: 1410500 - RNA, 18 nt, Human
gcaguccuuggccugcua

SEQ ID NO: 1410501 - RNA, 15 nt, Human
gcaguccuuggccug

SEQ ID NO: 1410502 - RNA, 14 nt, Human
gcaguccuuggccu

SEQ ID NO: 1410503 - RNA, 20 nt, Human
gcaguccuggaagccagcuu

SEQ ID NO: 1410504 - RNA, 18 nt, Human
gcaguccuggaagccagc

SEQ ID NO: 1410505 - RNA, 19 nt, Human
gcaguccugaucagagccg

SEQ ID NO: 1410506 - RNA, 23 nt, Human
gcaguccccuucccuccaagaag

SEQ ID NO: 1410507 - RNA, 21 nt, Human
gcaguccccuucccuccaaga

SEQ ID NO: 1410508 - RNA, 14 nt, Human
gcaguccccuuccc

SEQ ID NO: 1410509 - RNA, 16 nt, Human
gcagucccaagcggug

SEQ ID NO: 1410510 - RNA, 22 nt, Human
gcaguccacuucugacagccuc

SEQ ID NO: 1410511 - RNA, 23 nt, Human
gcaguccacuucugacagccuca

SEQ ID NO: 1410512 - RNA, 21 nt, Human
gcaguccacuucugacagccu

SEQ ID NO: 1410513 - RNA, 20 nt, Human
gcaguccacuucugacagcc

SEQ ID NO: 1410514 - RNA, 19 nt, Human
gcaguccacuucugacagc

SEQ ID NO: 1410515 - RNA, 18 nt, Human
gcaguccacuucugacag

SEQ ID NO: 1410516 - RNA, 19 nt, Human
gcagucauuauccagguaa

SEQ ID NO: 1410517 - RNA, 17 nt, Human
gcaguuuuuuuuuucuu

SEQ ID NO: 1410518 - RNA, 19 nt, Human
gcauaaccugucucaccug

SEQ ID NO: 1410519 - RNA, 14 nt, Human
gcauaaccugucuc

SEQ ID NO: 1410520 - RNA, 11 nt, Human
gcaguuuuuuu

SEQ ID NO: 1410521 - RNA, 17 nt, Human
gcauaccacuuuuguuc

SEQ ID NO: 1410522 - RNA, 20 nt, Human
gcauaccacuuuuguucuug

SEQ ID NO: 1410523 - RNA, 20 nt, Human
gcaguuuuuuuuuucuuguc

SEQ ID NO: 1410524 - RNA, 18 nt, Human
gcaguuuuuugaaaaugg

SEQ ID NO: 1410525 - RNA, 12 nt, Human
gcaguuuuuuga

SEQ ID NO: 1410526 - RNA, 13 nt, Human
gcaguuugcaaaa

SEQ ID NO: 1410527 - RNA, 22 nt, Human
gcauaacguauaaaagccuguu

SEQ ID NO: 1410528 - RNA, 16 nt, Human
gcagagaugccucccu

SEQ ID NO: 1410529 - RNA, 17 nt, Human
gcagagaugccucccug

SEQ ID NO: 1410530 - RNA, 15 nt, Human
gcagagaugccuccc

SEQ ID NO: 1410531 - RNA, 22 nt, Human
gcagagagguuugcagucccaa

SEQ ID NO: 1410532 - RNA, 21 nt, Human
gcagagagguuugcaguccca

SEQ ID NO: 1410533 - RNA, 14 nt, Human
gcagagccaggaag

SEQ ID NO: 1410534 - RNA, 15 nt, Human
gcagagccaggaaga

SEQ ID NO: 1410535 - RNA, 16 nt, Human
gcacuuguccagcuga

SEQ ID NO: 1410536 - RNA, 22 nt, Human
gcacuuggggguucaggcccgg

SEQ ID NO: 1410537 - RNA, 20 nt, Human
gcacugacugggaccaggca

SEQ ID NO: 1410538 - RNA, 19 nt, Human
gcacugacggacucaugau

SEQ ID NO: 1410539 - RNA, 18 nt, Human
gcacuuuagaauaugccu

SEQ ID NO: 1410540 - RNA, 19 nt, Human
gcacuuuagaauaugccuu

SEQ ID NO: 1410541 - RNA, 20 nt, Human
gcacuuuagaauaugccuug

SEQ ID NO: 1410542 - RNA, 16 nt, Human
gcagaaauccaagcac

SEQ ID NO: 1410543 - RNA, 20 nt, Human
gcagaaagugccuuucagga

SEQ ID NO: 1410544 - RNA, 23 nt, Human
gcagaaagugccuuucaggaucu

SEQ ID NO: 1410545 - RNA, 19 nt, Human
gcagaaagugccuuucagg

SEQ ID NO: 1410546 - RNA, 14 nt, Human
gcagaaagugccuu

SEQ ID NO: 1410547 - RNA, 13 nt, Human
gcagaaagugccu

SEQ ID NO: 1410548 - RNA, 20 nt, Human
gcagaaagcaucccucaccc

SEQ ID NO: 1410549 - RNA, 22 nt, Human
gcacugaauaaauuguacagcc

SEQ ID NO: 1410550 - RNA, 21 nt, Human
gcacugaauaaauuguacagc

SEQ ID NO: 1410551 - RNA, 16 nt, Human
gcaccuaauccaggca

SEQ ID NO: 1410552 - RNA, 15 nt, Human
gcaccuaauccaggc

SEQ ID NO: 1410553 - RNA, 14 nt, Human
gcaccuaaagaaaa

SEQ ID NO: 1410554 - RNA, 17 nt, Human
gcaccuaaagaaaaaca

SEQ ID NO: 1410555 - RNA, 15 nt, Human
gcaccguucugugca

SEQ ID NO: 1410556 - RNA, 14 nt, Human
gcaccguucugugc

SEQ ID NO: 1410557 - RNA, 20 nt, Human
gcaccggggccugggcagga

SEQ ID NO: 1410558 - RNA, 23 nt, Human
gcaccgaagcccagagggucugg

SEQ ID NO: 1410559 - RNA, 16 nt, Human
gcaccgaagcccagag

SEQ ID NO: 1410560 - RNA, 15 nt, Human
gcaccgaagcccaga

SEQ ID NO: 1410561 - RNA, 14 nt, Human
gcaccgaagcccag

SEQ ID NO: 1410562 - RNA, 22 nt, Human
gcacaucuguaaaucuacacac

SEQ ID NO: 1410563 - RNA, 16 nt, Human
gcacaugaacuuagau

SEQ ID NO: 1410564 - RNA, 21 nt, Human
gcacaugagcuggcgggauug

SEQ ID NO: 1410565 - RNA, 18 nt, Human
gcacaucugugucuuguu

SEQ ID NO: 1410566 - RNA, 17 nt, Human
gcacaucugugucuugu

SEQ ID NO: 1410567 - RNA, 21 nt, Human
gcacaucuguaaaucuacaca

SEQ ID NO: 1410568 - RNA, 13 nt, Human
gcacaugacucgg

SEQ ID NO: 1410569 - RNA, 19 nt, Human
gcacaucagcacgauuucu

SEQ ID NO: 1410570 - RNA, 20 nt, Human
gcacaucagcacgauuucug

SEQ ID NO: 1410571 - RNA, 21 nt, Human
gcacaucagcacgauuucugu

SEQ ID NO: 1410572 - RNA, 21 nt, Human
gcacaguugaagggaggggcu

SEQ ID NO: 1410573 - RNA, 19 nt, Human
gcacaauguagauaagugu

SEQ ID NO: 1410574 - RNA, 21 nt, Human
gauucugaccuuaaaugcaac

SEQ ID NO: 1410575 - RNA, 20 nt, Human
gauucugaccuuaaaugcaa

SEQ ID NO: 1410576 - RNA, 23 nt, Human
gauucugaccuuaaaugcaacca

SEQ ID NO: 1410577 - RNA, 21 nt, Human
gcaauaacguuuaagccaaaa

SEQ ID NO: 1410578 - RNA, 21 nt, Human
gcaauaaaucugacccagugc

SEQ ID NO: 1410579 - RNA, 19 nt, Human
gcaauaaaucugacccagu

SEQ ID NO: 1410580 - RNA, 18 nt, Human
gcaauaaaucugacccag

SEQ ID NO: 1410581 - RNA, 16 nt, Human
gcaauaaaucugaccc

SEQ ID NO: 1410582 - RNA, 13 nt, Human
gcaagugaauuug

SEQ ID NO: 1410583 - RNA, 21 nt, Human
gcaaguccuaagccuguuagc

SEQ ID NO: 1410584 - RNA, 16 nt, Human
gaaacuuucuuucuca

SEQ ID NO: 1410585 - RNA, 21 nt, Human
gaaacuuuucuuaaaaaguua

SEQ ID NO: 1410586 - RNA, 11 nt, Human
gaaacuuuucu

SEQ ID NO: 1410587 - RNA, 15 nt, Human
gaaacuuuuggaagg

SEQ ID NO: 1410588 - RNA, 13 nt, Human
gaaacuuuuggaa

SEQ ID NO: 1410589 - RNA, 18 nt, Human
gaaacuuuuuuauuuaaa

SEQ ID NO: 1410590 - RNA, 17 nt, Human
gaaacuuuuuuauuuaa

SEQ ID NO: 1410591 - RNA, 22 nt, Human
gaaaggcuguuaaauacaggaa

SEQ ID NO: 1410592 - RNA, 17 nt, Human
gaaaggggucggcugac

SEQ ID NO: 1410593 - RNA, 16 nt, Human
gaaaggugguguuucu

SEQ ID NO: 1410594 - RNA, 14 nt, Human
gaaaggugguguuu

SEQ ID NO: 1410595 - RNA, 17 nt, Human
gaaauauuuauuuuaau

SEQ ID NO: 1410596 - RNA, 20 nt, Human
gaaagguuagagaauaaauu

SEQ ID NO: 1410597 - RNA, 20 nt, Human
gaaaggugugagacugggaa

SEQ ID NO: 1410598 - RNA, 22 nt, Human
gaaaggugguguuucuguaaga

SEQ ID NO: 1410599 - RNA, 17 nt, Human
gaaaggugguguuucug

SEQ ID NO: 1410600 - RNA, 22 nt, Human
gaaauauuuauuuuaauaaugu

SEQ ID NO: 1410601 - RNA, 18 nt, Human
gaaauauuuauuuuaaua

SEQ ID NO: 1410602 - RNA, 21 nt, Human
gaaaauuuguuauuuugcaac

SEQ ID NO: 1410603 - RNA, 17 nt, Human
gaaaauuuguuauuuug

SEQ ID NO: 1410604 - RNA, 20 nt, Human
gaaaauucugugccuuguuu

SEQ ID NO: 1410605 - RNA, 22 nt, Human
gaaaauucugugccuuguuuuu

SEQ ID NO: 1410606 - RNA, 13 nt, Human
gaaaauucugugc

SEQ ID NO: 1410607 - RNA, 14 nt, Human
gaaaauucauuuuu

SEQ ID NO: 1410608 - RNA, 13 nt, Human
gaaaauucauuuu

SEQ ID NO: 1410609 - RNA, 23 nt, Human
gaaaaugguccaauuaguuuccu

SEQ ID NO: 1410610 - RNA, 22 nt, Human
gaaaauggucgagaaagaggca

SEQ ID NO: 1410611 - RNA, 18 nt, Human
gaaaaugguccaggagaa

SEQ ID NO: 1410612 - RNA, 22 nt, Human
gaaaaugguccaauuaguuucc

SEQ ID NO: 1410613 - RNA, 12 nt, Human
gaaaagaaaaag

SEQ ID NO: 1410614 - RNA, 15 nt, Human
gaaaaugcgguuaua

SEQ ID NO: 1410615 - RNA, 19 nt, Human
cuuuuuuucuguaccaguu

SEQ ID NO: 1410616 - RNA, 16 nt, Human
cuuuuuuucuguacca

SEQ ID NO: 1410617 - RNA, 14 nt, Human
cuuuuuuucuguac

SEQ ID NO: 1410618 - RNA, 19 nt, Human
cuuuuuuuccaucuuuaca

SEQ ID NO: 1410619 - RNA, 16 nt, Human
cuuuuuuuagagaagu

SEQ ID NO: 1410620 - RNA, 18 nt, Human
cuuuuuuuuuucuuuaua

SEQ ID NO: 1410621 - RNA, 16 nt, Human
cuuuuuuuuuucuuua

SEQ ID NO: 1410622 - RNA, 14 nt, Human
cuuuuuuuuuucuu

SEQ ID NO: 1410623 - RNA, 13 nt, Human
cuuuuuuguuuug

SEQ ID NO: 1410624 - RNA, 12 nt, Human
cuuuugugcauu

SEQ ID NO: 1410625 - RNA, 13 nt, Human
cuuuugugcauua

SEQ ID NO: 1410626 - RNA, 18 nt, Human
gaaaaacaggcacuuggc

SEQ ID NO: 1410627 - RNA, 11 nt, Human
gaaaaacaggu

SEQ ID NO: 1410628 - RNA, 13 nt, Human
gaaaaacaggcac

SEQ ID NO: 1410629 - RNA, 23 nt, Human
gaaaaacaaacucguuuuuuaca

SEQ ID NO: 1410630 - RNA, 21 nt, Human
gaaaaacaaacucguuuuuua

SEQ ID NO: 1410631 - RNA, 21 nt, Human
gaaaaaaaaccugagauuuau

SEQ ID NO: 1410632 - RNA, 18 nt, Human
gaaaaaaaaccugagauu

SEQ ID NO: 1410633 - RNA, 16 nt, Human
gaaaaaaaacagugga

SEQ ID NO: 1410634 - RNA, 18 nt, Human
gaaaaaaaaauucacaug

SEQ ID NO: 1410635 - RNA, 23 nt, Human
cuuuuuuuuuucuuuauaagaaa

SEQ ID NO: 1410636 - RNA, 13 nt, Human
gaaaaaaaauuau

SEQ ID NO: 1410637 - RNA, 15 nt, Human
cuuuugcccuuugau

SEQ ID NO: 1410638 - RNA, 16 nt, Human
cuuuugcccauuuuga

SEQ ID NO: 1410639 - RNA, 17 nt, Human
cuuuugcccauuuugaa

SEQ ID NO: 1410640 - RNA, 17 nt, Human
cuuuugccauuaaacuu

SEQ ID NO: 1410641 - RNA, 12 nt, Human
cuuuuggaggac

SEQ ID NO: 1410642 - RNA, 16 nt, Human
cuuuugccguuauuaa

SEQ ID NO: 1410643 - RNA, 22 nt, Human
cuuuugugauggagugcuguuu

SEQ ID NO: 1410644 - RNA, 21 nt, Human
cuuuugugauggagugcuguu

SEQ ID NO: 1410645 - RNA, 20 nt, Human
cuuuugugauggagugcugu

SEQ ID NO: 1410646 - RNA, 13 nt, Human
cuuuugugaauua

SEQ ID NO: 1410647 - RNA, 20 nt, Human
cuuuuguaagacaaagguuu

SEQ ID NO: 1410648 - RNA, 13 nt, Human
cuuuuguaagaca

SEQ ID NO: 1410649 - RNA, 10 nt, Human
cuuuuguaag

SEQ ID NO: 1410650 - RNA, 19 nt, Human
cuuuuguagaagucacauu

SEQ ID NO: 1410651 - RNA, 21 nt, Human
cuuuugguuaugaauacuuug

SEQ ID NO: 1410652 - RNA, 17 nt, Human
cuuuuggcggggaggag

SEQ ID NO: 1410653 - RNA, 15 nt, Human
cuuuuggcauuuuac

SEQ ID NO: 1410654 - RNA, 23 nt, Human
cuuuccuguauuuguucccaaga

SEQ ID NO: 1410655 - RNA, 23 nt, Human
cuuuccuggacacucagaccuga

SEQ ID NO: 1410656 - RNA, 20 nt, Human
cuuuccuggacacucagacc

SEQ ID NO: 1410657 - RNA, 19 nt, Human
cuuuccugccccaggccug

SEQ ID NO: 1410658 - RNA, 18 nt, Human
cuuuccugccccaggccu

SEQ ID NO: 1410659 - RNA, 14 nt, Human
cuuuccugccccag

SEQ ID NO: 1410660 - RNA, 13 nt, Human
cuuuccugcccca

SEQ ID NO: 1410661 - RNA, 12 nt, Human
cuuuccugcccc

SEQ ID NO: 1410662 - RNA, 10 nt, Human
cuuuccugcc

SEQ ID NO: 1410663 - RNA, 21 nt, Human
cuuuccugcaacucaaggacu

SEQ ID NO: 1410664 - RNA, 18 nt, Human
cuuuccugagucccaucc

SEQ ID NO: 1410665 - RNA, 20 nt, Human
cuuuccugagucccaucccu

SEQ ID NO: 1410666 - RNA, 22 nt, Human
cuuuccugagucccaucccugc

SEQ ID NO: 1410667 - RNA, 17 nt, Human
cuuucaggaucuauuuu

SEQ ID NO: 1410668 - RNA, 21 nt, Human
cuuucaggaucuauuuuugga

SEQ ID NO: 1410669 - RNA, 16 nt, Human
cuuucaggaucuauuu

SEQ ID NO: 1410670 - RNA, 15 nt, Human
cuuucaggaucuauu

SEQ ID NO: 1410671 - RNA, 22 nt, Human
cuuucagcugucuuuuggagga

SEQ ID NO: 1410672 - RNA, 17 nt, Human
cuuucagcugucuuuug

SEQ ID NO: 1410673 - RNA, 13 nt, Human
cuuucagcugucu

SEQ ID NO: 1410674 - RNA, 12 nt, Human
cuuucagcuguc

SEQ ID NO: 1410675 - RNA, 21 nt, Human
cuuucagcuccugaccaguug

SEQ ID NO: 1410676 - RNA, 19 nt, Human
cuuucagcuccugaccagu

SEQ ID NO: 1410677 - RNA, 17 nt, Human
cuuucagcuccugacca

SEQ ID NO: 1410678 - RNA, 15 nt, Human
cuuucagcuccugac

SEQ ID NO: 1410679 - RNA, 14 nt, Human
cuuucagcuccuga

SEQ ID NO: 1410680 - RNA, 13 nt, Human
cuuucagcuccug

SEQ ID NO: 1410681 - RNA, 12 nt, Human
cuuucagcuccu

SEQ ID NO: 1410682 - RNA, 17 nt, Human
cuuuccuugaguaguuu

SEQ ID NO: 1410683 - RNA, 15 nt, Human
cuuugauauuucaau

SEQ ID NO: 1410684 - RNA, 16 nt, Human
cuuucuagccuggcua

SEQ ID NO: 1410685 - RNA, 17 nt, Human
cuuucuagaccaauaaa

SEQ ID NO: 1410686 - RNA, 22 nt, Human
cuuucuagaaagagaaacaguu

SEQ ID NO: 1410687 - RNA, 16 nt, Human
cuuugggcuucagcug

SEQ ID NO: 1410688 - RNA, 13 nt, Human
cuuuguaaugaaa

SEQ ID NO: 1410689 - RNA, 13 nt, Human
cuuuuauaaacuu

SEQ ID NO: 1410690 - RNA, 14 nt, Human
cuuuuauaaacuuu

SEQ ID NO: 1410691 - RNA, 22 nt, Human
cuuuuaucccaaaguuguugua

SEQ ID NO: 1410692 - RNA, 14 nt, Human
cuuuuauaucccau

SEQ ID NO: 1410693 - RNA, 21 nt, Human
cuuuuauaggauuuauuuaaa

SEQ ID NO: 1410694 - RNA, 15 nt, Human
cuuuuauacugacac

SEQ ID NO: 1410695 - RNA, 20 nt, Human
cuuuuauacucuuucuguau

SEQ ID NO: 1410696 - RNA, 19 nt, Human
cuuuuauacucuuucugua

SEQ ID NO: 1410697 - RNA, 17 nt, Human
cuuuuauacucuuucug

SEQ ID NO: 1410698 - RNA, 12 nt, Human
cuuuuauacucu

SEQ ID NO: 1410699 - RNA, 23 nt, Human
cuuuuauguaguaauugacaugu

SEQ ID NO: 1410700 - RNA, 22 nt, Human
cuuuuauguaguaauugacaug

SEQ ID NO: 1410701 - RNA, 18 nt, Human
cuuuuauguaguaauuga

SEQ ID NO: 1410702 - RNA, 15 nt, Human
cuuuuauguaguaau

SEQ ID NO: 1410703 - RNA, 14 nt, Human
cuuuuaugugaaac

SEQ ID NO: 1410704 - RNA, 18 nt, Human
cuuuuaugugaaacaugu

SEQ ID NO: 1410705 - RNA, 22 nt, Human
cuucugagcuccuguccccugc

SEQ ID NO: 1410706 - RNA, 23 nt, Human
cuucugagcuccuguccccugcu

SEQ ID NO: 1410707 - RNA, 19 nt, Human
cuucugagcuccugucccc

SEQ ID NO: 1410708 - RNA, 16 nt, Human
cuucugagcuccuguc

SEQ ID NO: 1410709 - RNA, 15 nt, Human
cuucugagcuccugu

SEQ ID NO: 1410710 - RNA, 14 nt, Human
cuucugagcuccug

SEQ ID NO: 1410711 - RNA, 13 nt, Human
cuucugagcuccu

SEQ ID NO: 1410712 - RNA, 21 nt, Human
cuucucaaguucuaagauucu

SEQ ID NO: 1410713 - RNA, 23 nt, Human
cuucucaaguucuaagauucuaa

SEQ ID NO: 1410714 - RNA, 18 nt, Human
cuucucaaguucuaagau

SEQ ID NO: 1410715 - RNA, 17 nt, Human
cuucucaaguucuaaga

SEQ ID NO: 1410716 - RNA, 16 nt, Human
cuucucaaguucuaag

SEQ ID NO: 1410717 - RNA, 15 nt, Human
cuucucaaguucuaa

SEQ ID NO: 1410718 - RNA, 14 nt, Human
cuucucaaguucua

SEQ ID NO: 1410719 - RNA, 14 nt, Human
cuucuucagggacu

SEQ ID NO: 1410720 - RNA, 17 nt, Human
cuuccuccuccccacuu

SEQ ID NO: 1410721 - RNA, 16 nt, Human
cuuccuccuccccacu

SEQ ID NO: 1410722 - RNA, 17 nt, Human
cuucuauuuuguaaacu

SEQ ID NO: 1410723 - RNA, 16 nt, Human
cuucuauuuuguaaac

SEQ ID NO: 1410724 - RNA, 15 nt, Human
cuucuauuuuguaaa

SEQ ID NO: 1410725 - RNA, 14 nt, Human
cuucuauuuuguaa

SEQ ID NO: 1410726 - RNA, 23 nt, Human
cuucuauuuggggcuugaugacu

SEQ ID NO: 1410727 - RNA, 14 nt, Human
cuucuagaguucag

SEQ ID NO: 1410728 - RNA, 13 nt, Human
cuucuagaguuca

SEQ ID NO: 1410729 - RNA, 9 nt, Human
cuucuagag

SEQ ID NO: 1410730 - RNA, 18 nt, Human
cuucuaaguaaauacaau

SEQ ID NO: 1410731 - RNA, 21 nt, Human
cuucuaaguaaauacaauuuu

SEQ ID NO: 1410732 - RNA, 17 nt, Human
cuucuaaguaaauacaa

SEQ ID NO: 1410733 - RNA, 14 nt, Human
cuucuaaguaaaua

SEQ ID NO: 1410734 - RNA, 20 nt, Human
cuuccugccagccccugcca

SEQ ID NO: 1410735 - RNA, 18 nt, Human
cuuccugccagccccugc

SEQ ID NO: 1410736 - RNA, 17 nt, Human
cuuccugccagccccug

SEQ ID NO: 1410737 - RNA, 15 nt, Human
cuuccugccagcccc

SEQ ID NO: 1410738 - RNA, 14 nt, Human
cuuccugccagccc

SEQ ID NO: 1410739 - RNA, 21 nt, Human
cuucuacuuuuaaguugcuga

SEQ ID NO: 1410740 - RNA, 13 nt, Human
cuucuacuuuuaa

SEQ ID NO: 1410741 - RNA, 14 nt, Human
cuuccuccugggcc

SEQ ID NO: 1410742 - RNA, 12 nt, Human
cuuccuccuggg

SEQ ID NO: 1410743 - RNA, 14 nt, Human
cuuccuccuggaaa

SEQ ID NO: 1410744 - RNA, 13 nt, Human
cuuccuccuggaa

SEQ ID NO: 1410745 - RNA, 12 nt, Human
cuuccuccugga

SEQ ID NO: 1410746 - RNA, 22 nt, Human
cuuccuccugggcccucucugc

SEQ ID NO: 1410747 - RNA, 15 nt, Human
cuuccuccugggccc

SEQ ID NO: 1410748 - RNA, 21 nt, Human
cuugauaccccccucugucuu

SEQ ID NO: 1410749 - RNA, 20 nt, Human
cuugauaccccccucugucu

SEQ ID NO: 1410750 - RNA, 19 nt, Human
cuugauaccccccucuguc

SEQ ID NO: 1410751 - RNA, 18 nt, Human
cuugauaccccccucugu

SEQ ID NO: 1410752 - RNA, 17 nt, Human
cuugauaccccccucug

SEQ ID NO: 1410753 - RNA, 16 nt, Human
cuugauaccccccucu

SEQ ID NO: 1410754 - RNA, 21 nt, Human
cuugaguuugucgcucaugug

SEQ ID NO: 1410755 - RNA, 16 nt, Human
cuugauaaagggccaa

SEQ ID NO: 1410756 - RNA, 19 nt, Human
cuugauccauuucuaauua

SEQ ID NO: 1410757 - RNA, 20 nt, Human
cuugauccauuucuaauuau

SEQ ID NO: 1410758 - RNA, 14 nt, Human
cuugauagaaaugc

SEQ ID NO: 1410759 - RNA, 12 nt, Human
cuugauagaaau

SEQ ID NO: 1410760 - RNA, 22 nt, Human
cuugauagaaaugccaagcacu

SEQ ID NO: 1410761 - RNA, 17 nt, Human
cuugauagaaaugccaa

SEQ ID NO: 1410762 - RNA, 18 nt, Human
cuugauccauuucuaauu

SEQ ID NO: 1410763 - RNA, 12 nt, Human
cuugaugaagaa

SEQ ID NO: 1410764 - RNA, 20 nt, Human
cuuggcgaugccagccaagc

SEQ ID NO: 1410765 - RNA, 14 nt, Human
cuuggcagccuugu

SEQ ID NO: 1410766 - RNA, 16 nt, Human
cuuggcagccuuguga

SEQ ID NO: 1410767 - RNA, 21 nt, Human
cuugaugaccaaaguccuuuu

SEQ ID NO: 1410768 - RNA, 18 nt, Human
cuugaugaccaaaguccu

SEQ ID NO: 1410769 - RNA, 13 nt, Human
cuugaugaagaag

SEQ ID NO: 1410770 - RNA, 21 nt, Human
cuugaugcaugcacuguuccc

SEQ ID NO: 1410771 - RNA, 12 nt, Human
cuugaugccugg

SEQ ID NO: 1410772 - RNA, 20 nt, Human
cuugccuuauuagagugucu

SEQ ID NO: 1410773 - RNA, 18 nt, Human
cuugccuuauuagagugu

SEQ ID NO: 1410774 - RNA, 22 nt, Human
cuugccuguuucccaggcccac

SEQ ID NO: 1410775 - RNA, 20 nt, Human
cuugccuguuucccaggccc

SEQ ID NO: 1410776 - RNA, 18 nt, Human
cuugccugugccagguga

SEQ ID NO: 1410777 - RNA, 16 nt, Human
cuugccugugccaggu

SEQ ID NO: 1410778 - RNA, 15 nt, Human
cuugccugugccagg

SEQ ID NO: 1410779 - RNA, 14 nt, Human
cuugccugugccag

SEQ ID NO: 1410780 - RNA, 11 nt, Human
cuugccugugc

SEQ ID NO: 1410781 - RNA, 16 nt, Human
cuugccugguacagua

SEQ ID NO: 1410782 - RNA, 15 nt, Human
cuugccugguacagu

SEQ ID NO: 1410783 - RNA, 16 nt, Human
cuugccugccuuucca

SEQ ID NO: 1410784 - RNA, 15 nt, Human
cuugccugccuuucc

SEQ ID NO: 1410785 - RNA, 13 nt, Human
cuugccugccuuu

SEQ ID NO: 1410786 - RNA, 13 nt, Human
cuugccugcaggc

SEQ ID NO: 1410787 - RNA, 13 nt, Human
cuugaugccuggc

SEQ ID NO: 1410788 - RNA, 13 nt, Human
cuuggcagccuug

SEQ ID NO: 1410789 - RNA, 21 nt, Human
cuuggcaccagacacccagga

SEQ ID NO: 1410790 - RNA, 20 nt, Human
cuuggcaccagacacccagg

SEQ ID NO: 1410791 - RNA, 19 nt, Human
cuuggcaccagacacccag

SEQ ID NO: 1410792 - RNA, 16 nt, Human
cuuggcaccagacacc

SEQ ID NO: 1410793 - RNA, 15 nt, Human
cuugcggcuccucag

SEQ ID NO: 1410794 - RNA, 15 nt, Human
cuugccuucuggugu

SEQ ID NO: 1410795 - RNA, 21 nt, Human
cuugccuuauuagagugucuu

SEQ ID NO: 1410796 - RNA, 16 nt, Human
cuucaugacagccucc

SEQ ID NO: 1410797 - RNA, 13 nt, Human
cuucaugcaugga

SEQ ID NO: 1410798 - RNA, 15 nt, Human
cuucaugcauggaaa

SEQ ID NO: 1410799 - RNA, 17 nt, Human
cuuccagugucauuucu

SEQ ID NO: 1410800 - RNA, 21 nt, Human
cuucauaucauccacacauga

SEQ ID NO: 1410801 - RNA, 20 nt, Human
cuucauaucauccacacaug

SEQ ID NO: 1410802 - RNA, 18 nt, Human
cuucauaucauccacaca

SEQ ID NO: 1410803 - RNA, 17 nt, Human
cuucauaucauccacac

SEQ ID NO: 1410804 - RNA, 16 nt, Human
cuucauaucauccaca

SEQ ID NO: 1410805 - RNA, 23 nt, Human
cuucauacuugaacguuuucuaa

SEQ ID NO: 1410806 - RNA, 16 nt, Human
cuucauacuugaacgu

SEQ ID NO: 1410807 - RNA, 13 nt, Human
cuucauacuugaa

SEQ ID NO: 1410808 - RNA, 12 nt, Human
cuucauaaucca

SEQ ID NO: 1410809 - RNA, 11 nt, Human
cuucaucugga

SEQ ID NO: 1410810 - RNA, 12 nt, Human
cuucaucuggaa

SEQ ID NO: 1410811 - RNA, 13 nt, Human
cuucaucuggaac

SEQ ID NO: 1410812 - RNA, 15 nt, Human
cuucaucuggaacca

SEQ ID NO: 1410813 - RNA, 23 nt, Human
cuucaucuggcaacaucuuuauc

SEQ ID NO: 1410814 - RNA, 19 nt, Human
cuucaucuggcaacaucuu

SEQ ID NO: 1410815 - RNA, 14 nt, Human
cuucaucuggcaac

SEQ ID NO: 1410816 - RNA, 13 nt, Human
cuucaucuggcaa

SEQ ID NO: 1410817 - RNA, 19 nt, Human
cuucaucuggauuccagag

SEQ ID NO: 1410818 - RNA, 20 nt, Human
cuucaguuucacagaaaaua

SEQ ID NO: 1410819 - RNA, 17 nt, Human
cuucaguuucacagaaa

SEQ ID NO: 1410820 - RNA, 15 nt, Human
cuucaguuucacaga

SEQ ID NO: 1410821 - RNA, 20 nt, Human
cuucaguugucucugaugca

SEQ ID NO: 1410822 - RNA, 23 nt, Human
cuucaguugucucugaugcagcu

SEQ ID NO: 1410823 - RNA, 17 nt, Human
cuucaguugucucugau

SEQ ID NO: 1410824 - RNA, 15 nt, Human
cuucaguugucucug

SEQ ID NO: 1410825 - RNA, 14 nt, Human
cuucaguugucucu

SEQ ID NO: 1410826 - RNA, 13 nt, Human
cuucaguugucuc

SEQ ID NO: 1410827 - RNA, 19 nt, Human
cuucauaacaauuuuagga

SEQ ID NO: 1410828 - RNA, 15 nt, Human
cuucauaacaauuuu

SEQ ID NO: 1410829 - RNA, 12 nt, Human
cuucacugucac

SEQ ID NO: 1410830 - RNA, 19 nt, Human
cuucacucuucaaaugccu

SEQ ID NO: 1410831 - RNA, 15 nt, Human
cuucacuguaaaaua

SEQ ID NO: 1410832 - RNA, 21 nt, Human
cuuccaguuugcuuugcccuu

SEQ ID NO: 1410833 - RNA, 17 nt, Human
cuuccaguuugcuuugc

SEQ ID NO: 1410834 - RNA, 14 nt, Human
cuuccaguuugcuu

SEQ ID NO: 1410835 - RNA, 12 nt, Human
cuuaugcucuua

SEQ ID NO: 1410836 - RNA, 18 nt, Human
cuuaugcgguuaauuuug

SEQ ID NO: 1410837 - RNA, 17 nt, Human
cuuaugcgguuaauuuu

SEQ ID NO: 1410838 - RNA, 16 nt, Human
cuuaugcgguuaauuu

SEQ ID NO: 1410839 - RNA, 15 nt, Human
cuuaugcugauuuau

SEQ ID NO: 1410840 - RNA, 22 nt, Human
cuuaugcucuuaauugccaccu

SEQ ID NO: 1410841 - RNA, 19 nt, Human
cuuaugcucuuaauugcca

SEQ ID NO: 1410842 - RNA, 15 nt, Human
cuuaugcucuuaauu

SEQ ID NO: 1410843 - RNA, 18 nt, Human
cuuaugcuguacccaguu

SEQ ID NO: 1410844 - RNA, 14 nt, Human
cuuaugcuuaaauu

SEQ ID NO: 1410845 - RNA, 14 nt, Human
cuuauucccuuccu

SEQ ID NO: 1410846 - RNA, 19 nt, Human
cuuauuccaugacugcuug

SEQ ID NO: 1410847 - RNA, 18 nt, Human
cuuauuccaugacugcuu

SEQ ID NO: 1410848 - RNA, 17 nt, Human
cuuauuccaugacugcu

SEQ ID NO: 1410849 - RNA, 14 nt, Human
cuuauuccaugacu

SEQ ID NO: 1410850 - RNA, 19 nt, Human
cuuauucauuuucucuaau

SEQ ID NO: 1410851 - RNA, 15 nt, Human
cuuauucccuuccug

SEQ ID NO: 1410852 - RNA, 21 nt, Human
cuuauuagagugucuuuccac

SEQ ID NO: 1410853 - RNA, 20 nt, Human
cuuauuagagugucuuucca

SEQ ID NO: 1410854 - RNA, 14 nt, Human
cuuauuauuuuuga

SEQ ID NO: 1410855 - RNA, 18 nt, Human
cuuauucauuuucucuaa

SEQ ID NO: 1410856 - RNA, 17 nt, Human
cuuauucauuuucucua

SEQ ID NO: 1410857 - RNA, 16 nt, Human
cuuauucauuuucucu

SEQ ID NO: 1410858 - RNA, 14 nt, Human
cuuauucauuuucu

SEQ ID NO: 1410859 - RNA, 16 nt, Human
cuuauuauuuuugaga

SEQ ID NO: 1410860 - RNA, 20 nt, Human
cuuauuguagcauccuggaa

SEQ ID NO: 1410861 - RNA, 18 nt, Human
cuuauuggaacucugcuu

SEQ ID NO: 1410862 - RNA, 17 nt, Human
cuuauuggaacucugcu

SEQ ID NO: 1410863 - RNA, 15 nt, Human
cuuauuggaacucug

SEQ ID NO: 1410864 - RNA, 23 nt, Human
cuuauuguagcauccuggaauau

SEQ ID NO: 1410865 - RNA, 18 nt, Human
cugggacguggcucagcc

SEQ ID NO: 1410866 - RNA, 17 nt, Human
cugggacguggcucagc

SEQ ID NO: 1410867 - RNA, 16 nt, Human
cugggacguggcucag

SEQ ID NO: 1410868 - RNA, 15 nt, Human
cugggacguggcuca

SEQ ID NO: 1410869 - RNA, 24 nt, Human
cugggaccgcuacaccacucuggc

SEQ ID NO: 1410870 - RNA, 23 nt, Human
cugggaccgcuacaccacucugg

SEQ ID NO: 1410871 - RNA, 22 nt, Human
cugggaccgcuacaccacucug

SEQ ID NO: 1410872 - RNA, 20 nt, Human
cugggaccgcuacaccacuc

SEQ ID NO: 1410873 - RNA, 17 nt, Human
cugggaccgcuacacca

SEQ ID NO: 1410874 - RNA, 16 nt, Human
cugggaccgcuacacc

SEQ ID NO: 1410875 - RNA, 18 nt, Human
cuggcaggcaggcuccca

SEQ ID NO: 1410876 - RNA, 20 nt, Human
cuggcccccucccuggauga

SEQ ID NO: 1410877 - RNA, 24 nt, Human
cuggcaggcaggcucccagggaca

SEQ ID NO: 1410878 - RNA, 21 nt, Human
cuggcagcucuggacagcccc

SEQ ID NO: 1410879 - RNA, 20 nt, Human
cuggcagcucuggacagccc

SEQ ID NO: 1410880 - RNA, 18 nt, Human
cuggcagcucuggacagc

SEQ ID NO: 1410881 - RNA, 17 nt, Human
cuggcagcucuggacag

SEQ ID NO: 1410882 - RNA, 12 nt, Human
cuggcagcucug

SEQ ID NO: 1410883 - RNA, 15 nt, Human
cuggagacuuagggc

SEQ ID NO: 1410884 - RNA, 23 nt, Human
cuggagacugugugugcccucug

SEQ ID NO: 1410885 - RNA, 22 nt, Human
cuggagacugugugugcccucu

SEQ ID NO: 1410886 - RNA, 20 nt, Human
cuggagacugugugugcccu

SEQ ID NO: 1410887 - RNA, 22 nt, Human
cuggagaccaccagggcaucuc

SEQ ID NO: 1410888 - RNA, 19 nt, Human
cuggagaccaccagggcau

SEQ ID NO: 1410889 - RNA, 15 nt, Human
cuggagaccaccagg

SEQ ID NO: 1410890 - RNA, 19 nt, Human
cuggagaccccaccagccu

SEQ ID NO: 1410891 - RNA, 20 nt, Human
cuggagaccccaccagccuc

SEQ ID NO: 1410892 - RNA, 21 nt, Human
cuggagaccccaccagccuca

SEQ ID NO: 1410893 - RNA, 16 nt, Human
cuggacugugugcuca

SEQ ID NO: 1410894 - RNA, 20 nt, Human
cuggacugucauagaaauua

SEQ ID NO: 1410895 - RNA, 19 nt, Human
cuggacugucauagaaauu

SEQ ID NO: 1410896 - RNA, 21 nt, Human
cuggcuccagaugcagggcag

SEQ ID NO: 1410897 - RNA, 20 nt, Human
cuggcuccagaugcagggca

SEQ ID NO: 1410898 - RNA, 14 nt, Human
cuggcuccagaugc

SEQ ID NO: 1410899 - RNA, 18 nt, Human
cugggaccaggcaccagg

SEQ ID NO: 1410900 - RNA, 10 nt, Human
cugggacagg

SEQ ID NO: 1410901 - RNA, 21 nt, Human
cuggugaucacguggucacgg

SEQ ID NO: 1410902 - RNA, 24 nt, Human
cuggugagucaccacuucagggcu

SEQ ID NO: 1410903 - RNA, 14 nt, Human
cuggugagccaagc

SEQ ID NO: 1410904 - RNA, 23 nt, Human
cuggugcaaguugaggacuucuu

SEQ ID NO: 1410905 - RNA, 16 nt, Human
cuggugcacuggcccc

SEQ ID NO: 1410906 - RNA, 19 nt, Human
cuggugcacuggccccacc

SEQ ID NO: 1410907 - RNA, 13 nt, Human
cugggcagaccuu

SEQ ID NO: 1410908 - RNA, 17 nt, Human
cugggcagaaggccaag

SEQ ID NO: 1410909 - RNA, 14 nt, Human
cugggcagaaggcc

SEQ ID NO: 1410910 - RNA, 16 nt, Human
cugggcagaaggccaa

SEQ ID NO: 1410911 - RNA, 13 nt, Human
cugggcagaaggc

SEQ ID NO: 1410912 - RNA, 18 nt, Human
cuggggaagacaguggcc

SEQ ID NO: 1410913 - RNA, 17 nt, Human
cuggggaagacaguggc

SEQ ID NO: 1410914 - RNA, 16 nt, Human
cuggggaagacagugg

SEQ ID NO: 1410915 - RNA, 15 nt, Human
cuggggaagacagug

SEQ ID NO: 1410916 - RNA, 14 nt, Human
cuggggaagacagu

SEQ ID NO: 1410917 - RNA, 18 nt, Human
cuggggccaggcuggguc

SEQ ID NO: 1410918 - RNA, 17 nt, Human
cugguuugaagaauguu

SEQ ID NO: 1410919 - RNA, 24 nt, Human
cugucagauccaggagcuccagug

SEQ ID NO: 1410920 - RNA, 19 nt, Human
cugucagauccaggagcuc

SEQ ID NO: 1410921 - RNA, 18 nt, Human
cugucagauccaggagcu

SEQ ID NO: 1410922 - RNA, 13 nt, Human
cugucagauccag

SEQ ID NO: 1410923 - RNA, 22 nt, Human
cugucagcaugaauuuguaaug

SEQ ID NO: 1410924 - RNA, 16 nt, Human
cugucagcaugaauuu

SEQ ID NO: 1410925 - RNA, 15 nt, Human
cugucagcaugaauu

SEQ ID NO: 1410926 - RNA, 14 nt, Human
cugucagcaugaau

SEQ ID NO: 1410927 - RNA, 12 nt, Human
cugucagcauga

SEQ ID NO: 1410928 - RNA, 23 nt, Human
cugucagauccaggagcuccagu

SEQ ID NO: 1410929 - RNA, 22 nt, Human
cugucagauccaggagcuccag

SEQ ID NO: 1410930 - RNA, 21 nt, Human
cugucagauccaggagcucca

SEQ ID NO: 1410931 - RNA, 12 nt, Human
cugucagcugca

SEQ ID NO: 1410932 - RNA, 11 nt, Human
cuguccugccu

SEQ ID NO: 1410933 - RNA, 23 nt, Human
cuguccugccacccagccccagc

SEQ ID NO: 1410934 - RNA, 22 nt, Human
cuguccugccacccagccccag

SEQ ID NO: 1410935 - RNA, 17 nt, Human
cuguccugccacccagc

SEQ ID NO: 1410936 - RNA, 18 nt, Human
cuguccugccuguggcca

SEQ ID NO: 1410937 - RNA, 17 nt, Human
cuguccugccuguggcc

SEQ ID NO: 1410938 - RNA, 13 nt, Human
cuguccugccugu

SEQ ID NO: 1410939 - RNA, 20 nt, Human
cuguccugaaggccugaggu

SEQ ID NO: 1410940 - RNA, 18 nt, Human
cuguccugaccugucuca

SEQ ID NO: 1410941 - RNA, 19 nt, Human
cuguccugaaggccugagg

SEQ ID NO: 1410942 - RNA, 16 nt, Human
cuguccugaaggccug

SEQ ID NO: 1410943 - RNA, 15 nt, Human
cuguccugaaggccu

SEQ ID NO: 1410944 - RNA, 22 nt, Human
cuguccucuuucagcuccugac

SEQ ID NO: 1410945 - RNA, 20 nt, Human
cuguagggagggcggcaggg

SEQ ID NO: 1410946 - RNA, 22 nt, Human
cuguaggccucaggugaaacuc

SEQ ID NO: 1410947 - RNA, 13 nt, Human
cuguaggccucag

SEQ ID NO: 1410948 - RNA, 12 nt, Human
cuguaggccuca

SEQ ID NO: 1410949 - RNA, 18 nt, Human
cugucaccacccugcuca

SEQ ID NO: 1410950 - RNA, 16 nt, Human
cugucaccacccugcu

SEQ ID NO: 1410951 - RNA, 21 nt, Human
cuguagggagggcggcagggg

SEQ ID NO: 1410952 - RNA, 23 nt, Human
cugucaccacccugcucauccac

SEQ ID NO: 1410953 - RNA, 22 nt, Human
cugucacccagguuggagugca

SEQ ID NO: 1410954 - RNA, 15 nt, Human
cuguaaacacagaca

SEQ ID NO: 1410955 - RNA, 15 nt, Human
cuguaaaauguggga

SEQ ID NO: 1410956 - RNA, 10 nt, Human
cuguaaaauc

SEQ ID NO: 1410957 - RNA, 11 nt, Human
cuguaaaaucu

SEQ ID NO: 1410958 - RNA, 22 nt, Human
cuguaaaaucuuucuuucuuag

SEQ ID NO: 1410959 - RNA, 15 nt, Human
cuguaaaacagguua

SEQ ID NO: 1410960 - RNA, 13 nt, Human
cuguaaaacuaag

SEQ ID NO: 1410961 - RNA, 17 nt, Human
cuguaaaauaaaagguc

SEQ ID NO: 1410962 - RNA, 20 nt, Human
cuguaaaccucucgagggca

SEQ ID NO: 1410963 - RNA, 21 nt, Human
cuguaaaaugugggauuaugg

SEQ ID NO: 1410964 - RNA, 22 nt, Human
cuguacuugcucuugaugccug

SEQ ID NO: 1410965 - RNA, 23 nt, Human
cuguacuugcucuugaugccugg

SEQ ID NO: 1410966 - RNA, 23 nt, Human
cugucgauuagacuggacagcuu

SEQ ID NO: 1410967 - RNA, 20 nt, Human
cugucgauuagacuggacag

SEQ ID NO: 1410968 - RNA, 19 nt, Human
cugucgauuagacuggaca

SEQ ID NO: 1410969 - RNA, 17 nt, Human
cuguccuuuuuccucuc

SEQ ID NO: 1410970 - RNA, 18 nt, Human
cuguccuuuuuccucucc

SEQ ID NO: 1410971 - RNA, 20 nt, Human
cuguccuuuuuccucuccac

SEQ ID NO: 1410972 - RNA, 19 nt, Human
cuguccuuuuuccucucca

SEQ ID NO: 1410973 - RNA, 17 nt, Human
cugucgauuagacugga

SEQ ID NO: 1410974 - RNA, 15 nt, Human
cugucgauuagacug

SEQ ID NO: 1410975 - RNA, 14 nt, Human
cugugaaggacccu

SEQ ID NO: 1410976 - RNA, 18 nt, Human
cugagacuccagaccuga

SEQ ID NO: 1410977 - RNA, 16 nt, Human
cugagacuccagaccu

SEQ ID NO: 1410978 - RNA, 15 nt, Human
cugagacuccagacc

SEQ ID NO: 1410979 - RNA, 23 nt, Human
cugcauuauuggaauauaauugu

SEQ ID NO: 1410980 - RNA, 15 nt, Human
cugcauguuugugau

SEQ ID NO: 1410981 - RNA, 23 nt, Human
cugcauuggaacuggaggcaggg

SEQ ID NO: 1410982 - RNA, 22 nt, Human
cugcauuggaacuggaggcagg

SEQ ID NO: 1410983 - RNA, 21 nt, Human
cugcauuggaacuggaggcag

SEQ ID NO: 1410984 - RNA, 20 nt, Human
cugcauuuaaaagauacagu

SEQ ID NO: 1410985 - RNA, 22 nt, Human
cugcauuuaaaagauacaguua

SEQ ID NO: 1410986 - RNA, 22 nt, Human
cugcauucuucugagcacuguu

SEQ ID NO: 1410987 - RNA, 18 nt, Human
cugcauucuucugagcac

SEQ ID NO: 1410988 - RNA, 21 nt, Human
cugcauucugccucucuagga

SEQ ID NO: 1410989 - RNA, 13 nt, Human
cugcauuccgcag

SEQ ID NO: 1410990 - RNA, 12 nt, Human
cugcauuccgca

SEQ ID NO: 1410991 - RNA, 19 nt, Human
cugcauugaaaagagcuga

SEQ ID NO: 1410992 - RNA, 22 nt, Human
cugcauugaaaagagcugaagg

SEQ ID NO: 1410993 - RNA, 18 nt, Human
cugcauugaaaagagcug

SEQ ID NO: 1410994 - RNA, 17 nt, Human
cugcauugaaaagagcu

SEQ ID NO: 1410995 - RNA, 19 nt, Human
cugcauuggaacuggaggc

SEQ ID NO: 1410996 - RNA, 16 nt, Human
cugcauuggaacugga

SEQ ID NO: 1410997 - RNA, 15 nt, Human
cugcauuggaacugg

SEQ ID NO: 1410998 - RNA, 16 nt, Human
cugccaaccuaaaacu

SEQ ID NO: 1410999 - RNA, 22 nt, Human
cugccaaccuaaaacucuuucg

SEQ ID NO: 1411000 - RNA, 22 nt, Human
cugccaaaggaugugauauaua

SEQ ID NO: 1411001 - RNA, 19 nt, Human
cugccaaaggaugugauau

SEQ ID NO: 1411002 - RNA, 18 nt, Human
cugccaaaggaugugaua

SEQ ID NO: 1411003 - RNA, 16 nt, Human
cugccaaaggauguga

SEQ ID NO: 1411004 - RNA, 14 nt, Human
cugccaaaggaugu

SEQ ID NO: 1411005 - RNA, 20 nt, Human
cugccaagacugcuguggcc

SEQ ID NO: 1411006 - RNA, 21 nt, Human
cugccaagacugcuguggcca

SEQ ID NO: 1411007 - RNA, 17 nt, Human
cugccaagacugcugug

SEQ ID NO: 1411008 - RNA, 15 nt, Human
cugccccaggccuga

SEQ ID NO: 1411009 - RNA, 14 nt, Human
cugccccaggccug

SEQ ID NO: 1411010 - RNA, 13 nt, Human
cugccccaggccu

SEQ ID NO: 1411011 - RNA, 12 nt, Human
cugccccaggcc

SEQ ID NO: 1411012 - RNA, 21 nt, Human
cugcccuguaccccagcacuu

SEQ ID NO: 1411013 - RNA, 13 nt, Human
cugcccuguaccc

SEQ ID NO: 1411014 - RNA, 15 nt, Human
cugcuguuccagugg

SEQ ID NO: 1411015 - RNA, 23 nt, Human
cugcugugugcuuuuuuugugug

SEQ ID NO: 1411016 - RNA, 22 nt, Human
cugcugugugcuuuuuuugugu

SEQ ID NO: 1411017 - RNA, 21 nt, Human
cugcuguuugacaccucuuuu

SEQ ID NO: 1411018 - RNA, 20 nt, Human
cugcuuaacuucacauauug

SEQ ID NO: 1411019 - RNA, 15 nt, Human
cugcuuaacuucaca

SEQ ID NO: 1411020 - RNA, 17 nt, Human
cugcuuaacuucacaua

SEQ ID NO: 1411021 - RNA, 17 nt, Human
cugcuuuuuauggccug

SEQ ID NO: 1411022 - RNA, 13 nt, Human
cugcuuaacuuca

SEQ ID NO: 1411023 - RNA, 22 nt, Human
cugcuuuuuccaacucagaaau

SEQ ID NO: 1411024 - RNA, 18 nt, Human
cugcuuuuuauggccugu

SEQ ID NO: 1411025 - RNA, 21 nt, Human
cuggaaaucaggguuaguauu

SEQ ID NO: 1411026 - RNA, 20 nt, Human
cuggaacacuagacaagcca

SEQ ID NO: 1411027 - RNA, 21 nt, Human
cugcuguuccagugguaagcu

SEQ ID NO: 1411028 - RNA, 23 nt, Human
cuggaacacuagacaagccagaa

SEQ ID NO: 1411029 - RNA, 22 nt, Human
cuggaacacuagacaagccaga

SEQ ID NO: 1411030 - RNA, 21 nt, Human
cuggaacacuagacaagccag

SEQ ID NO: 1411031 - RNA, 15 nt, Human
cuggaaccaucagaa

SEQ ID NO: 1411032 - RNA, 13 nt, Human
cuggaacccagac

SEQ ID NO: 1411033 - RNA, 16 nt, Human
cuggaaccaucagaaa

SEQ ID NO: 1411034 - RNA, 23 nt, Human
cuggaaccucagccuggccagac

SEQ ID NO: 1411035 - RNA, 22 nt, Human
cuggaaccucagccuggccaga

SEQ ID NO: 1411036 - RNA, 20 nt, Human
cuggaaccucagccuggcca

SEQ ID NO: 1411037 - RNA, 18 nt, Human
cuggaaccucagccuggc

SEQ ID NO: 1411038 - RNA, 17 nt, Human
cuggaaccucagccugg

SEQ ID NO: 1411039 - RNA, 16 nt, Human
cuggaaccucagccug

SEQ ID NO: 1411040 - RNA, 15 nt, Human
cuggaaccucagccu

SEQ ID NO: 1411041 - RNA, 12 nt, Human
cuggaaccucag

SEQ ID NO: 1411042 - RNA, 22 nt, Human
cuggaacccagacucagacauu

SEQ ID NO: 1411043 - RNA, 19 nt, Human
cuggaacccagacucagac

SEQ ID NO: 1411044 - RNA, 18 nt, Human
cuggaacccagacucaga

SEQ ID NO: 1411045 - RNA, 16 nt, Human
cuggaacccagacuca

SEQ ID NO: 1411046 - RNA, 14 nt, Human
cuggaacccagacu

SEQ ID NO: 1411047 - RNA, 19 nt, Human
cuggaacuugaacugauuc

SEQ ID NO: 1411048 - RNA, 16 nt, Human
cuggaacuugaacuga

SEQ ID NO: 1411049 - RNA, 19 nt, Human
cuggaacugucucucauga

SEQ ID NO: 1411050 - RNA, 18 nt, Human
cuggaacugucucucaug

SEQ ID NO: 1411051 - RNA, 16 nt, Human
cuggaacugucucuca

SEQ ID NO: 1411052 - RNA, 18 nt, Human
cuggacugucauagaaau

SEQ ID NO: 1411053 - RNA, 13 nt, Human
cuggacugugugc

SEQ ID NO: 1411054 - RNA, 23 nt, Human
cugccuguggccaugacccugcc

SEQ ID NO: 1411055 - RNA, 23 nt, Human
cugccuguggcgccgucuccagg

SEQ ID NO: 1411056 - RNA, 22 nt, Human
cugccuguggcgccgucuccag

SEQ ID NO: 1411057 - RNA, 12 nt, Human
cugccuguggcg

SEQ ID NO: 1411058 - RNA, 21 nt, Human
cugccuguggccaugacccug

SEQ ID NO: 1411059 - RNA, 14 nt, Human
cugccuguggccau

SEQ ID NO: 1411060 - RNA, 20 nt, Human
cugccugguauauccaaaag

SEQ ID NO: 1411061 - RNA, 23 nt, Human
cugcuaauauuuuccuccugagu

SEQ ID NO: 1411062 - RNA, 24 nt, Human
cugcuaauauuuuccuccugagug

SEQ ID NO: 1411063 - RNA, 16 nt, Human
cugcuaauauuuuccu

SEQ ID NO: 1411064 - RNA, 15 nt, Human
cugcuaauauuuucc

SEQ ID NO: 1411065 - RNA, 22 nt, Human
cugcucagcucugggccauucu

SEQ ID NO: 1411066 - RNA, 16 nt, Human
cugcucagcucugggc

SEQ ID NO: 1411067 - RNA, 14 nt, Human
cugcucagcucugg

SEQ ID NO: 1411068 - RNA, 13 nt, Human
cugcucagcucug

SEQ ID NO: 1411069 - RNA, 21 nt, Human
cugcucagcccugcaccaugc

SEQ ID NO: 1411070 - RNA, 18 nt, Human
cugcucagcccugcacca

SEQ ID NO: 1411071 - RNA, 15 nt, Human
cugcucagcccugca

SEQ ID NO: 1411072 - RNA, 14 nt, Human
cugcucagcccugc

SEQ ID NO: 1411073 - RNA, 13 nt, Human
cugcucagacaga

SEQ ID NO: 1411074 - RNA, 20 nt, Human
cugcuacagcaauuucuaau

SEQ ID NO: 1411075 - RNA, 12 nt, Human
cugcuacagcaa

SEQ ID NO: 1411076 - RNA, 23 nt, Human
cugcuacaccuauuaucccagcu

SEQ ID NO: 1411077 - RNA, 20 nt, Human
cugcuacaccuauuauccca

SEQ ID NO: 1411078 - RNA, 15 nt, Human
cugcuacaauguccu

SEQ ID NO: 1411079 - RNA, 15 nt, Human
ccacacuucucagga

SEQ ID NO: 1411080 - RNA, 14 nt, Human
ccacacuucucagg

SEQ ID NO: 1411081 - RNA, 23 nt, Human
ccacacuucucaggacacaggcc

SEQ ID NO: 1411082 - RNA, 24 nt, Human
ccacacuucucaggacacaggccu

SEQ ID NO: 1411083 - RNA, 22 nt, Human
ccacacuucucaggacacaggc

SEQ ID NO: 1411084 - RNA, 21 nt, Human
ccacacuucucaggacacagg

SEQ ID NO: 1411085 - RNA, 18 nt, Human
ccacacuucucaggacac

SEQ ID NO: 1411086 - RNA, 17 nt, Human
ccacacuucucaggaca

SEQ ID NO: 1411087 - RNA, 14 nt, Human
ccaccagcuguguc

SEQ ID NO: 1411088 - RNA, 12 nt, Human
ccaccagaugcu

SEQ ID NO: 1411089 - RNA, 13 nt, Human
ccaccagaugcug

SEQ ID NO: 1411090 - RNA, 19 nt, Human
ccaccaggccaccucccca

SEQ ID NO: 1411091 - RNA, 13 nt, Human
ccaccaggccacc

SEQ ID NO: 1411092 - RNA, 15 nt, Human
ccaccagcugugucc

SEQ ID NO: 1411093 - RNA, 16 nt, Human
ccaccagcugugucca

SEQ ID NO: 1411094 - RNA, 12 nt, Human
ccacccugggcc

SEQ ID NO: 1411095 - RNA, 22 nt, Human
ccacccuggccgaguccaagcu

SEQ ID NO: 1411096 - RNA, 21 nt, Human
ccacccuggccgaguccaagc

SEQ ID NO: 1411097 - RNA, 20 nt, Human
ccacccuggccgaguccaag

SEQ ID NO: 1411098 - RNA, 21 nt, Human
ccaccaggccaccuccccagc

SEQ ID NO: 1411099 - RNA, 20 nt, Human
ccaccaggcugcucagggcu

SEQ ID NO: 1411100 - RNA, 19 nt, Human
ccaccguugucucaugcca

SEQ ID NO: 1411101 - RNA, 15 nt, Human
ccaccguugucucau

SEQ ID NO: 1411102 - RNA, 13 nt, Human
ccacccugggccc

SEQ ID NO: 1411103 - RNA, 18 nt, Human
ccaagcuguuuucuucua

SEQ ID NO: 1411104 - RNA, 17 nt, Human
ccaagcuguuuucuucu

SEQ ID NO: 1411105 - RNA, 14 nt, Human
ccaagcuguuuucu

SEQ ID NO: 1411106 - RNA, 23 nt, Human
ccaagcuuguccaacccgaggcc

SEQ ID NO: 1411107 - RNA, 20 nt, Human
ccaauuaguuuccuuuuuaa

SEQ ID NO: 1411108 - RNA, 16 nt, Human
ccaauuaguuuccuuu

SEQ ID NO: 1411109 - RNA, 15 nt, Human
ccaauuaguuuccuu

SEQ ID NO: 1411110 - RNA, 14 nt, Human
ccaauuaguuuccu

SEQ ID NO: 1411111 - RNA, 23 nt, Human
ccaauguuucaagaggagccccc

SEQ ID NO: 1411112 - RNA, 19 nt, Human
ccaaaaccgccagcucugu

SEQ ID NO: 1411113 - RNA, 18 nt, Human
ccaaaaccgccagcucug

SEQ ID NO: 1411114 - RNA, 17 nt, Human
ccaaaaccgccagcucu

SEQ ID NO: 1411115 - RNA, 16 nt, Human
ccaaaaccgccagcuc

SEQ ID NO: 1411116 - RNA, 15 nt, Human
ccaaaaccgccagcu

SEQ ID NO: 1411117 - RNA, 21 nt, Human
ccaaaaccgccagcucuguuc

SEQ ID NO: 1411118 - RNA, 22 nt, Human
ccaacuacuaauagaauaaagg

SEQ ID NO: 1411119 - RNA, 14 nt, Human
ccaacuacuaauag

SEQ ID NO: 1411120 - RNA, 20 nt, Human
ccaacuaaugccuuacucuu

SEQ ID NO: 1411121 - RNA, 19 nt, Human
ccaacuaaugccuuacucu

SEQ ID NO: 1411122 - RNA, 19 nt, Human
ccaaauucaguuucauaaa

SEQ ID NO: 1411123 - RNA, 18 nt, Human
ccaaauucaguuucauaa

SEQ ID NO: 1411124 - RNA, 15 nt, Human
ccaaauucaguuuca

SEQ ID NO: 1411125 - RNA, 13 nt, Human
ccaaauucaguuu

SEQ ID NO: 1411126 - RNA, 14 nt, Human
ccaacuaugauuau

SEQ ID NO: 1411127 - RNA, 17 nt, Human
ccaacuagccccugggg

SEQ ID NO: 1411128 - RNA, 15 nt, Human
ccaacuagccccugg

SEQ ID NO: 1411129 - RNA, 22 nt, Human
ccaacuacuguguuaugcaaaa

SEQ ID NO: 1411130 - RNA, 17 nt, Human
ccaacuuggcugcagga

SEQ ID NO: 1411131 - RNA, 17 nt, Human
ccaaauuaaaaaagaua

SEQ ID NO: 1411132 - RNA, 15 nt, Human
ccaaauuaaaaaaga

SEQ ID NO: 1411133 - RNA, 13 nt, Human
ccaaauuaaaaaa

SEQ ID NO: 1411134 - RNA, 18 nt, Human
ccaaauuaaaaaagauaa

SEQ ID NO: 1411135 - RNA, 12 nt, Human
ccaaauuaagag

SEQ ID NO: 1411136 - RNA, 14 nt, Human
ccaaaucuggaagc

SEQ ID NO: 1411137 - RNA, 21 nt, Human
ccaaauccuuagaucuggcau

SEQ ID NO: 1411138 - RNA, 20 nt, Human
ccaaauccuuagaucuggca

SEQ ID NO: 1411139 - RNA, 15 nt, Human
ccaaauccccuaagc

SEQ ID NO: 1411140 - RNA, 18 nt, Human
ccaaagugcugggauuaa

SEQ ID NO: 1411141 - RNA, 17 nt, Human
cauuaugugguuuuaga

SEQ ID NO: 1411142 - RNA, 21 nt, Human
cauuaugugguuuuagauuuu

SEQ ID NO: 1411143 - RNA, 19 nt, Human
cauuaugcaauuuuuauau

SEQ ID NO: 1411144 - RNA, 17 nt, Human
cauuagggaugccuccu

SEQ ID NO: 1411145 - RNA, 18 nt, Human
cauuaucuagauacugua

SEQ ID NO: 1411146 - RNA, 14 nt, Human
cauucuccacagca

SEQ ID NO: 1411147 - RNA, 22 nt, Human
cauucucauuggaaauuuagca

SEQ ID NO: 1411148 - RNA, 17 nt, Human
cauucucauuggaaauu

SEQ ID NO: 1411149 - RNA, 15 nt, Human
cauucucauuggaaa

SEQ ID NO: 1411150 - RNA, 16 nt, Human
cauucuccuuguguua

SEQ ID NO: 1411151 - RNA, 20 nt, Human
cauucuccuuguguuacuaa

SEQ ID NO: 1411152 - RNA, 20 nt, Human
cauuagggaugccuccuuuc

SEQ ID NO: 1411153 - RNA, 12 nt, Human
cauuaucuagau

SEQ ID NO: 1411154 - RNA, 16 nt, Human
cauuaucuagauacug

SEQ ID NO: 1411155 - RNA, 17 nt, Human
cauuaucuagauacugu

SEQ ID NO: 1411156 - RNA, 19 nt, Human
cauuaggaaaaguugcuau

SEQ ID NO: 1411157 - RNA, 23 nt, Human
cauuagccugaguagaaaggccu

SEQ ID NO: 1411158 - RNA, 18 nt, Human
cauuagccugaguagaaa

SEQ ID NO: 1411159 - RNA, 19 nt, Human
cauuagccugaguagaaag

SEQ ID NO: 1411160 - RNA, 9 nt, Human
cauuagccu

SEQ ID NO: 1411161 - RNA, 14 nt, Human
cauuagccugagua

SEQ ID NO: 1411162 - RNA, 17 nt, Human
cauuagccugaguagaa

SEQ ID NO: 1411163 - RNA, 23 nt, Human
cauguuauuuguaauagauguuu

SEQ ID NO: 1411164 - RNA, 14 nt, Human
cauguuauuuguaa

SEQ ID NO: 1411165 - RNA, 16 nt, Human
cauggcuaacuggcga

SEQ ID NO: 1411166 - RNA, 14 nt, Human
cauggcuaacuggc

SEQ ID NO: 1411167 - RNA, 20 nt, Human
cauggccugcaaacugggaa

SEQ ID NO: 1411168 - RNA, 19 nt, Human
cauggccugcaaacuggga

SEQ ID NO: 1411169 - RNA, 16 nt, Human
cauggccugcaaacug

SEQ ID NO: 1411170 - RNA, 16 nt, Human
caugcugcuggggaag

SEQ ID NO: 1411171 - RNA, 22 nt, Human
cauggcuggagcuagaauuuga

SEQ ID NO: 1411172 - RNA, 23 nt, Human
cauugcguuugaccuuuuaugua

SEQ ID NO: 1411173 - RNA, 21 nt, Human
cauugccuuaacuggagcccc

SEQ ID NO: 1411174 - RNA, 17 nt, Human
cauugccuuaacuggag

SEQ ID NO: 1411175 - RNA, 15 nt, Human
cauuucaacuguuug

SEQ ID NO: 1411176 - RNA, 14 nt, Human
cauuuauuuugaca

SEQ ID NO: 1411177 - RNA, 21 nt, Human
cauuucagaaguuaguuugua

SEQ ID NO: 1411178 - RNA, 13 nt, Human
cauuucagaaguu

SEQ ID NO: 1411179 - RNA, 19 nt, Human
cauuucacuugucaggagu

SEQ ID NO: 1411180 - RNA, 14 nt, Human
cauuucauuuccua

SEQ ID NO: 1411181 - RNA, 21 nt, Human
cauuggcaccuaauccaggca

SEQ ID NO: 1411182 - RNA, 20 nt, Human
cauuggcaccuaauccaggc

SEQ ID NO: 1411183 - RNA, 14 nt, Human
cauugcugugaaca

SEQ ID NO: 1411184 - RNA, 19 nt, Human
cauuggcuauuuaaaacuu

SEQ ID NO: 1411185 - RNA, 13 nt, Human
cauuggcuuuauc

SEQ ID NO: 1411186 - RNA, 22 nt, Human
cauuggcuuuauccucuuuaga

SEQ ID NO: 1411187 - RNA, 18 nt, Human
cauuggcuauuuaaaacu

SEQ ID NO: 1411188 - RNA, 14 nt, Human
cauuggcuauuuaa

SEQ ID NO: 1411189 - RNA, 21 nt, Human
cauuugguucauuaauucuau

SEQ ID NO: 1411190 - RNA, 20 nt, Human
cauuugguucauuaauucua

SEQ ID NO: 1411191 - RNA, 16 nt, Human
cauuugguucauuaau

SEQ ID NO: 1411192 - RNA, 12 nt, Human
cauuuccaagca

SEQ ID NO: 1411193 - RNA, 22 nt, Human
cauuuggugguuucagaaaugu

SEQ ID NO: 1411194 - RNA, 23 nt, Human
cauuuggugguuucagaaaugug

SEQ ID NO: 1411195 - RNA, 16 nt, Human
ccaaaaauaaauauau

SEQ ID NO: 1411196 - RNA, 13 nt, Human
ccaaaaauagcua

SEQ ID NO: 1411197 - RNA, 12 nt, Human
ccaaaaauagcu

SEQ ID NO: 1411198 - RNA, 16 nt, Human
ccaaaaagugaaauaa

SEQ ID NO: 1411199 - RNA, 14 nt, Human
ccaaaacaauguuu

SEQ ID NO: 1411200 - RNA, 20 nt, Human
cauuuuuguacuaacuagca

SEQ ID NO: 1411201 - RNA, 15 nt, Human
caguuuaaaagcacg

SEQ ID NO: 1411202 - RNA, 19 nt, Human
caguuguucuuuuuagaaa

SEQ ID NO: 1411203 - RNA, 15 nt, Human
caguuguucuuuuua

SEQ ID NO: 1411204 - RNA, 17 nt, Human
caguuugcaaaaaaugu

SEQ ID NO: 1411205 - RNA, 15 nt, Human
caguuugcaaaaaau

SEQ ID NO: 1411206 - RNA, 11 nt, Human
caguuugcaaa

SEQ ID NO: 1411207 - RNA, 17 nt, Human
caguuuauauuuaacuc

SEQ ID NO: 1411208 - RNA, 13 nt, Human
caguuuaucauuc

SEQ ID NO: 1411209 - RNA, 14 nt, Human
caguuuauauuuaa

SEQ ID NO: 1411210 - RNA, 19 nt, Human
caguuuauauuuaacucuc

SEQ ID NO: 1411211 - RNA, 18 nt, Human
caguuuaccaguugccuu

SEQ ID NO: 1411212 - RNA, 23 nt, Human
caguuuaccaguugccuuuuauc

SEQ ID NO: 1411213 - RNA, 23 nt, Human
caguuuacagacgcugcugucac

SEQ ID NO: 1411214 - RNA, 21 nt, Human
caguuuaaugaagaucuaaau

SEQ ID NO: 1411215 - RNA, 19 nt, Human
caguuuaaugaagaucuaa

SEQ ID NO: 1411216 - RNA, 18 nt, Human
caguuuaaugaagaucua

SEQ ID NO: 1411217 - RNA, 13 nt, Human
caguuuaaugaag

SEQ ID NO: 1411218 - RNA, 14 nt, Human
caguuuaaaagcac

SEQ ID NO: 1411219 - RNA, 16 nt, Human
caguuugcuuugcccu

SEQ ID NO: 1411220 - RNA, 14 nt, Human
caguuugcuuugcc

SEQ ID NO: 1411221 - RNA, 18 nt, Human
caguuuguagugccacug

SEQ ID NO: 1411222 - RNA, 20 nt, Human
caguuuggguaaaauacuuu

SEQ ID NO: 1411223 - RNA, 22 nt, Human
caguuuggguaaaauacuuuua

SEQ ID NO: 1411224 - RNA, 22 nt, Human
cauaaugcauucuucucuguug

SEQ ID NO: 1411225 - RNA, 21 nt, Human
cauaaugcauucuucucuguu

SEQ ID NO: 1411226 - RNA, 20 nt, Human
cauaaugcauucuucucugu

SEQ ID NO: 1411227 - RNA, 22 nt, Human
cauaaucuucugccuucucaug

SEQ ID NO: 1411228 - RNA, 21 nt, Human
cauaaucuucugccuucucau

SEQ ID NO: 1411229 - RNA, 15 nt, Human
cauaaucuucugccu

SEQ ID NO: 1411230 - RNA, 13 nt, Human
cauaaucuucugc

SEQ ID NO: 1411231 - RNA, 14 nt, Human
cauaaugcgugcau

SEQ ID NO: 1411232 - RNA, 17 nt, Human
cauaaugcgugcauacc

SEQ ID NO: 1411233 - RNA, 23 nt, Human
caguuugugugucuuaauuauua

SEQ ID NO: 1411234 - RNA, 21 nt, Human
caguuugugugucuuaauuau

SEQ ID NO: 1411235 - RNA, 16 nt, Human
caguuugugugucuua

SEQ ID NO: 1411236 - RNA, 15 nt, Human
caguuugugugucuu

SEQ ID NO: 1411237 - RNA, 21 nt, Human
caguuuguuaguaugaggcau

SEQ ID NO: 1411238 - RNA, 19 nt, Human
cauaggaguuuggaggaag

SEQ ID NO: 1411239 - RNA, 20 nt, Human
cauaggaguuuggaggaagu

SEQ ID NO: 1411240 - RNA, 17 nt, Human
cauaggaguuuggagga

SEQ ID NO: 1411241 - RNA, 16 nt, Human
cauaggaguuuggagg

SEQ ID NO: 1411242 - RNA, 18 nt, Human
cauaggaccuuuccacca

SEQ ID NO: 1411243 - RNA, 16 nt, Human
cauaggaccuuuccac

SEQ ID NO: 1411244 - RNA, 18 nt, Human
cauagcgggggccuaaaa

SEQ ID NO: 1411245 - RNA, 17 nt, Human
cauauuaccacagacau

SEQ ID NO: 1411246 - RNA, 20 nt, Human
cauauuaccacagacauacu

SEQ ID NO: 1411247 - RNA, 21 nt, Human
cauauuaccacagacauacua

SEQ ID NO: 1411248 - RNA, 22 nt, Human
cauauuaccacagacauacuaa

SEQ ID NO: 1411249 - RNA, 11 nt, Human
cauagcccagu

SEQ ID NO: 1411250 - RNA, 15 nt, Human
cauagccaggaaacu

SEQ ID NO: 1411251 - RNA, 15 nt, Human
cauagcccaguagac

SEQ ID NO: 1411252 - RNA, 21 nt, Human
cauaaugcgugcauaccacuu

SEQ ID NO: 1411253 - RNA, 14 nt, Human
caugcugcugggga

SEQ ID NO: 1411254 - RNA, 22 nt, Human
caugcugccuuauucagggaag

SEQ ID NO: 1411255 - RNA, 14 nt, Human
caugauucuauuua

SEQ ID NO: 1411256 - RNA, 22 nt, Human
caugauuccuuuaacaacaugu

SEQ ID NO: 1411257 - RNA, 16 nt, Human
caugauuccuuuaaca

SEQ ID NO: 1411258 - RNA, 13 nt, Human
caugauuccuuua

SEQ ID NO: 1411259 - RNA, 15 nt, Human
caugacccugccucu

SEQ ID NO: 1411260 - RNA, 18 nt, Human
caugauucauuuuaacau

SEQ ID NO: 1411261 - RNA, 17 nt, Human
caugcaaggucauuuuu

SEQ ID NO: 1411262 - RNA, 18 nt, Human
caugcaaggucauuuuuu

SEQ ID NO: 1411263 - RNA, 19 nt, Human
caugcugaggccugggccg

SEQ ID NO: 1411264 - RNA, 18 nt, Human
caugcugaggccugggcc

SEQ ID NO: 1411265 - RNA, 17 nt, Human
caugcugaggccugggc

SEQ ID NO: 1411266 - RNA, 16 nt, Human
caugcugaggccuggg

SEQ ID NO: 1411267 - RNA, 16 nt, Human
caugcaauacauacca

SEQ ID NO: 1411268 - RNA, 17 nt, Human
caugauuccuuuaacaa

SEQ ID NO: 1411269 - RNA, 21 nt, Human
caugauugguuucuaggcagu

SEQ ID NO: 1411270 - RNA, 22 nt, Human
caugcaaggucauuuuuuuuaa

SEQ ID NO: 1411271 - RNA, 18 nt, Human
caugaauuuguaaugucu

SEQ ID NO: 1411272 - RNA, 12 nt, Human
caugaauuugua

SEQ ID NO: 1411273 - RNA, 22 nt, Human
caugaauuuguaaugucuugag

SEQ ID NO: 1411274 - RNA, 19 nt, Human
caugaauuuguaaugucuu

SEQ ID NO: 1411275 - RNA, 16 nt, Human
caugaauuugugaagg

SEQ ID NO: 1411276 - RNA, 20 nt, Human
caugaauuauuacaguguuu

SEQ ID NO: 1411277 - RNA, 18 nt, Human
caugaauuauuacagugu

SEQ ID NO: 1411278 - RNA, 17 nt, Human
caugaauuauuacagug

SEQ ID NO: 1411279 - RNA, 14 nt, Human
caugaauuugugaa

SEQ ID NO: 1411280 - RNA, 16 nt, Human
caugaauuaguuuuau

SEQ ID NO: 1411281 - RNA, 14 nt, Human
caugauucauuuua

SEQ ID NO: 1411282 - RNA, 13 nt, Human
caugauucauuuu

SEQ ID NO: 1411283 - RNA, 21 nt, Human
caugauucaugccaauuagca

SEQ ID NO: 1411284 - RNA, 16 nt, Human
caugauucaugccaau

SEQ ID NO: 1411285 - RNA, 19 nt, Human
caugaccuaguuuuccaug

SEQ ID NO: 1411286 - RNA, 18 nt, Human
caugaccuaguuuuccau

SEQ ID NO: 1411287 - RNA, 14 nt, Human
caugacccugccuc

SEQ ID NO: 1411288 - RNA, 14 nt, Human
caugaccaguaaag

SEQ ID NO: 1411289 - RNA, 23 nt, Human
caucugucugccaaccuaaaacu

SEQ ID NO: 1411290 - RNA, 20 nt, Human
caucugucccuccgggaccu

SEQ ID NO: 1411291 - RNA, 18 nt, Human
caucugucccuccgggac

SEQ ID NO: 1411292 - RNA, 17 nt, Human
caucugucccuccggga

SEQ ID NO: 1411293 - RNA, 16 nt, Human
caucugucccuccggg

SEQ ID NO: 1411294 - RNA, 21 nt, Human
caucgaaucuacuaauuccac

SEQ ID NO: 1411295 - RNA, 13 nt, Human
cauccuugucuua

SEQ ID NO: 1411296 - RNA, 22 nt, Human
cauccuugucuuauucccuucc

SEQ ID NO: 1411297 - RNA, 14 nt, Human
cauccuugagucaa

SEQ ID NO: 1411298 - RNA, 12 nt, Human
caucccaugcug

SEQ ID NO: 1411299 - RNA, 19 nt, Human
caucagacugugaacccca

SEQ ID NO: 1411300 - RNA, 11 nt, Human
caucagcaaac

SEQ ID NO: 1411301 - RNA, 14 nt, Human
caucaggacccugg

SEQ ID NO: 1411302 - RNA, 15 nt, Human
caucaggacccugga

SEQ ID NO: 1411303 - RNA, 18 nt, Human
caucaggacccuggaccu

SEQ ID NO: 1411304 - RNA, 19 nt, Human
caucagcacgauuucuguu

SEQ ID NO: 1411305 - RNA, 17 nt, Human
caucagcacgauuucug

SEQ ID NO: 1411306 - RNA, 18 nt, Human
caucagcacgauuucugu

SEQ ID NO: 1411307 - RNA, 14 nt, Human
caucagacagaugg

SEQ ID NO: 1411308 - RNA, 14 nt, Human
cagagccuggggcu

SEQ ID NO: 1411309 - RNA, 13 nt, Human
cagagccuggggc

SEQ ID NO: 1411310 - RNA, 12 nt, Human
cagagccugggg

SEQ ID NO: 1411311 - RNA, 16 nt, Human
cagagccuggggcucu

SEQ ID NO: 1411312 - RNA, 22 nt, Human
cagagcgugagcugagcaggcc

SEQ ID NO: 1411313 - RNA, 19 nt, Human
cagagcgugagcugagcag

SEQ ID NO: 1411314 - RNA, 15 nt, Human
cagagcgugagcuga

SEQ ID NO: 1411315 - RNA, 20 nt, Human
cagagcuacccgcagaguuc

SEQ ID NO: 1411316 - RNA, 11 nt, Human
cagagccuggg

SEQ ID NO: 1411317 - RNA, 20 nt, Human
cagagaggacuguagggagg

SEQ ID NO: 1411318 - RNA, 18 nt, Human
cagagaggacuguaggga

SEQ ID NO: 1411319 - RNA, 20 nt, Human
cagagaggccuuuuggaaug

SEQ ID NO: 1411320 - RNA, 17 nt, Human
cagagagcagugcuuuu

SEQ ID NO: 1411321 - RNA, 14 nt, Human
cagagagcagugcu

SEQ ID NO: 1411322 - RNA, 11 nt, Human
cagagagcagu

SEQ ID NO: 1411323 - RNA, 13 nt, Human
cagaggucuccca

SEQ ID NO: 1411324 - RNA, 18 nt, Human
cagagcuggcucugagcg

SEQ ID NO: 1411325 - RNA, 17 nt, Human
cagagcuggcucugagc

SEQ ID NO: 1411326 - RNA, 13 nt, Human
cagagcuggcucu

SEQ ID NO: 1411327 - RNA, 17 nt, Human
cagagcuggagaugagg

SEQ ID NO: 1411328 - RNA, 21 nt, Human
cagagcuggagaugaggccag

SEQ ID NO: 1411329 - RNA, 22 nt, Human
cagagcuggagaugaggccaga

SEQ ID NO: 1411330 - RNA, 23 nt, Human
cagagcuggagaugaggccagac

SEQ ID NO: 1411331 - RNA, 17 nt, Human
cagauccagccuggggu

SEQ ID NO: 1411332 - RNA, 15 nt, Human
cagauccagccuggg

SEQ ID NO: 1411333 - RNA, 14 nt, Human
cagauccagccugg

SEQ ID NO: 1411334 - RNA, 13 nt, Human
cagauccagccug

SEQ ID NO: 1411335 - RNA, 18 nt, Human
cagauccagccugggguc

SEQ ID NO: 1411336 - RNA, 12 nt, Human
cagauccagccu

SEQ ID NO: 1411337 - RNA, 22 nt, Human
cagaucauugugaaauuauuca

SEQ ID NO: 1411338 - RNA, 22 nt, Human
cagauacggacagagaccaaga

SEQ ID NO: 1411339 - RNA, 21 nt, Human
cagauacggacagagaccaag

SEQ ID NO: 1411340 - RNA, 16 nt, Human
cagaucauugugaaau

SEQ ID NO: 1411341 - RNA, 13 nt, Human
cagccagcaccug

SEQ ID NO: 1411342 - RNA, 12 nt, Human
cagccagcaccu

SEQ ID NO: 1411343 - RNA, 16 nt, Human
cagccagcaccuggca

SEQ ID NO: 1411344 - RNA, 14 nt, Human
cagccagcaccugg

SEQ ID NO: 1411345 - RNA, 23 nt, Human
cagcacugccugcucccauccug

SEQ ID NO: 1411346 - RNA, 19 nt, Human
cagcacugcuugaggaaaa

SEQ ID NO: 1411347 - RNA, 18 nt, Human
cagcacugcuugaggaaa

SEQ ID NO: 1411348 - RNA, 16 nt, Human
cagcacugcuugagga

SEQ ID NO: 1411349 - RNA, 18 nt, Human
cagcacugccugcuccca

SEQ ID NO: 1411350 - RNA, 17 nt, Human
cagcacugccugcuccc

SEQ ID NO: 1411351 - RNA, 15 nt, Human
cagcacugccugcuc

SEQ ID NO: 1411352 - RNA, 14 nt, Human
cagcacugccugcu

SEQ ID NO: 1411353 - RNA, 22 nt, Human
cagcacucgcuagcaguggcag

SEQ ID NO: 1411354 - RNA, 19 nt, Human
cagcaccaaaucaaaaucu

SEQ ID NO: 1411355 - RNA, 15 nt, Human
cagcaccaaaucaaa

SEQ ID NO: 1411356 - RNA, 11 nt, Human
cagcaccaaau

SEQ ID NO: 1411357 - RNA, 21 nt, Human
cagcacagcuugaccugaggc

SEQ ID NO: 1411358 - RNA, 20 nt, Human
cagcacagcuugaccugagg

SEQ ID NO: 1411359 - RNA, 17 nt, Human
cagcacagcuugaccug

SEQ ID NO: 1411360 - RNA, 16 nt, Human
cagcacagcuugaccu

SEQ ID NO: 1411361 - RNA, 15 nt, Human
cagcacagcuugacc

SEQ ID NO: 1411362 - RNA, 13 nt, Human
cagcacagcuuga

SEQ ID NO: 1411363 - RNA, 17 nt, Human
cagcacagcuuagauuu

SEQ ID NO: 1411364 - RNA, 23 nt, Human
cagcaccaaaucaaaaucucucc

SEQ ID NO: 1411365 - RNA, 19 nt, Human
cagcacaucucaacaggcc

SEQ ID NO: 1411366 - RNA, 16 nt, Human
cagcacaggagggcgg

SEQ ID NO: 1411367 - RNA, 22 nt, Human
cagcacagcuugaccugaggcu

SEQ ID NO: 1411368 - RNA, 22 nt, Human
cagcacagcuuagauuucauag

SEQ ID NO: 1411369 - RNA, 16 nt, Human
cagcacaucucaacag

SEQ ID NO: 1411370 - RNA, 18 nt, Human
cagauuuggcuugacaaa

SEQ ID NO: 1411371 - RNA, 13 nt, Human
cagauuuggaaag

SEQ ID NO: 1411372 - RNA, 20 nt, Human
cagauuugcuaauuuauccu

SEQ ID NO: 1411373 - RNA, 17 nt, Human
cagccgcgcaucagacu

SEQ ID NO: 1411374 - RNA, 14 nt, Human
cagccucuccccag

SEQ ID NO: 1411375 - RNA, 24 nt, Human
cagccucuccacucaugugacucu

SEQ ID NO: 1411376 - RNA, 16 nt, Human
cagcccugucuuccua

SEQ ID NO: 1411377 - RNA, 18 nt, Human
cagcccugucagcaugaa

SEQ ID NO: 1411378 - RNA, 21 nt, Human
cagcccugucagcaugaauuu

SEQ ID NO: 1411379 - RNA, 17 nt, Human
cagcccugucagcauga

SEQ ID NO: 1411380 - RNA, 16 nt, Human
cagcccugucagcaug

SEQ ID NO: 1411381 - RNA, 18 nt, Human
cagccugcagacucacug

SEQ ID NO: 1411382 - RNA, 23 nt, Human
cagccucuccccagguccagcuc

SEQ ID NO: 1411383 - RNA, 20 nt, Human
cagccucuccccagguccag

SEQ ID NO: 1411384 - RNA, 19 nt, Human
cagccucuccccaggucca

SEQ ID NO: 1411385 - RNA, 16 nt, Human
cagccucuccccaggu

SEQ ID NO: 1411386 - RNA, 18 nt, Human
cagccucuccccugccug

SEQ ID NO: 1411387 - RNA, 21 nt, Human
cagcggcuugccugccugcuc

SEQ ID NO: 1411388 - RNA, 14 nt, Human
cagcggcccuguca

SEQ ID NO: 1411389 - RNA, 19 nt, Human
cagcgugcuuuaaaaaaua

SEQ ID NO: 1411390 - RNA, 21 nt, Human
cagcguuccuagagaagacag

SEQ ID NO: 1411391 - RNA, 19 nt, Human
cagcguuucuaugacacau

SEQ ID NO: 1411392 - RNA, 16 nt, Human
cagcguuucuaugaca

SEQ ID NO: 1411393 - RNA, 18 nt, Human
cagcguggccuuguucug

SEQ ID NO: 1411394 - RNA, 15 nt, Human
cagcguggccuuguu

SEQ ID NO: 1411395 - RNA, 14 nt, Human
cagcguggccuugu

SEQ ID NO: 1411396 - RNA, 13 nt, Human
cagcguggccuug

SEQ ID NO: 1411397 - RNA, 12 nt, Human
cagcguggccuu

SEQ ID NO: 1411398 - RNA, 23 nt, Human
cagcguggagggguaggggcugg

SEQ ID NO: 1411399 - RNA, 22 nt, Human
cagcguggagggguaggggcug

SEQ ID NO: 1411400 - RNA, 14 nt, Human
cagcguuucuauga

SEQ ID NO: 1411401 - RNA, 22 nt, Human
cagccccucuggucgcuccugc

SEQ ID NO: 1411402 - RNA, 21 nt, Human
cagccccucuggucgcuccug

SEQ ID NO: 1411403 - RNA, 18 nt, Human
cagccccucuggucgcuc

SEQ ID NO: 1411404 - RNA, 16 nt, Human
cagccccucuggucgc

SEQ ID NO: 1411405 - RNA, 14 nt, Human
cagccccucugguc

SEQ ID NO: 1411406 - RNA, 13 nt, Human
cagccccucuggu

SEQ ID NO: 1411407 - RNA, 13 nt, Human
cagcccugucagc

SEQ ID NO: 1411408 - RNA, 21 nt, Human
cagccccucuuggagaagucu

SEQ ID NO: 1411409 - RNA, 20 nt, Human
cagccccucuuggagaaguc

SEQ ID NO: 1411410 - RNA, 18 nt, Human
cagccccucuuggagaag

SEQ ID NO: 1411411 - RNA, 23 nt, Human
cagccccucuuggagaagucuca

SEQ ID NO: 1411412 - RNA, 24 nt, Human
cagccccucuuggagaagucucag

SEQ ID NO: 1411413 - RNA, 22 nt, Human
cagcccccugaccacucagaga

SEQ ID NO: 1411414 - RNA, 21 nt, Human
cagcccccugaccacucagag

SEQ ID NO: 1411415 - RNA, 20 nt, Human
cagcccccugaccacucaga

SEQ ID NO: 1411416 - RNA, 18 nt, Human
cagcccccugaccacuca

SEQ ID NO: 1411417 - RNA, 16 nt, Human
cagcccccugaccacu

SEQ ID NO: 1411418 - RNA, 14 nt, Human
cagcccccugacca

SEQ ID NO: 1411419 - RNA, 13 nt, Human
cagcccccugacc

SEQ ID NO: 1411420 - RNA, 12 nt, Human
cagcccccugac

SEQ ID NO: 1411421 - RNA, 22 nt, Human
cagcccccuccuggugccaccu

SEQ ID NO: 1411422 - RNA, 14 nt, Human
cagcccccuccugg

SEQ ID NO: 1411423 - RNA, 14 nt, Human
cagcccccucacag

SEQ ID NO: 1411424 - RNA, 12 nt, Human
cagcccccucac

SEQ ID NO: 1411425 - RNA, 19 nt, Human
cagcccccuaagagagcac

SEQ ID NO: 1411426 - RNA, 17 nt, Human
cagcccccuaagagagc

SEQ ID NO: 1411427 - RNA, 21 nt, Human
cagcccccagcucccaccucc

SEQ ID NO: 1411428 - RNA, 19 nt, Human
cagcccccagcucccaccu

SEQ ID NO: 1411429 - RNA, 18 nt, Human
cagcccccagcucccacc

SEQ ID NO: 1411430 - RNA, 24 nt, Human
cagccccgcguggaacucgugucu

SEQ ID NO: 1411431 - RNA, 18 nt, Human
cagcccccacccccaagg

SEQ ID NO: 1411432 - RNA, 21 nt, Human
cagcccccacugccuuugacc

SEQ ID NO: 1411433 - RNA, 16 nt, Human
caggaaaguggccaag

SEQ ID NO: 1411434 - RNA, 13 nt, Human
caggaaaauugaa

SEQ ID NO: 1411435 - RNA, 17 nt, Human
caggaaaauugaaugca

SEQ ID NO: 1411436 - RNA, 21 nt, Human
caggaaaaggccuggggugac

SEQ ID NO: 1411437 - RNA, 19 nt, Human
caggaaaaggccuggggug

SEQ ID NO: 1411438 - RNA, 18 nt, Human
caggaaaaggccuggggu

SEQ ID NO: 1411439 - RNA, 17 nt, Human
caggaaaaggccugggg

SEQ ID NO: 1411440 - RNA, 16 nt, Human
caggaaaaggccuggg

SEQ ID NO: 1411441 - RNA, 15 nt, Human
caggaaaaggccugg

SEQ ID NO: 1411442 - RNA, 14 nt, Human
caggaaaaggccug

SEQ ID NO: 1411443 - RNA, 13 nt, Human
caggaaaaggccu

SEQ ID NO: 1411444 - RNA, 21 nt, Human
cagcuuauacgaaauaauugu

SEQ ID NO: 1411445 - RNA, 19 nt, Human
cagcuuauacgaaauaauu

SEQ ID NO: 1411446 - RNA, 16 nt, Human
cagcuuauacgaaaua

SEQ ID NO: 1411447 - RNA, 13 nt, Human
cagcuuauacgaa

SEQ ID NO: 1411448 - RNA, 17 nt, Human
cagcuuagauuucauag

SEQ ID NO: 1411449 - RNA, 16 nt, Human
cagcuuagauuucaua

SEQ ID NO: 1411450 - RNA, 15 nt, Human
cagcuuagauuucau

SEQ ID NO: 1411451 - RNA, 19 nt, Human
cagcuuagauuucauaguu

SEQ ID NO: 1411452 - RNA, 14 nt, Human
cagcuuagauuuca

SEQ ID NO: 1411453 - RNA, 18 nt, Human
cagcuuagaguuggccau

SEQ ID NO: 1411454 - RNA, 22 nt, Human
cagcuguguccaaaaccgccag

SEQ ID NO: 1411455 - RNA, 23 nt, Human
cagcuguggcagaguuacaguuc

SEQ ID NO: 1411456 - RNA, 19 nt, Human
cagcuguggcagaguuaca

SEQ ID NO: 1411457 - RNA, 20 nt, Human
caggccaccuccccagcauu

SEQ ID NO: 1411458 - RNA, 19 nt, Human
caggccaccuccccagcau

SEQ ID NO: 1411459 - RNA, 16 nt, Human
caggccaccuccccag

SEQ ID NO: 1411460 - RNA, 15 nt, Human
caggccaccucccca

SEQ ID NO: 1411461 - RNA, 12 nt, Human
caggccaccucc

SEQ ID NO: 1411462 - RNA, 11 nt, Human
caggccaccuc

SEQ ID NO: 1411463 - RNA, 20 nt, Human
caggcacuuggcagccuugu

SEQ ID NO: 1411464 - RNA, 21 nt, Human
caggcacuuggcagccuugug

SEQ ID NO: 1411465 - RNA, 16 nt, Human
caggcacuuggcagcc

SEQ ID NO: 1411466 - RNA, 12 nt, Human
caggcacuuggc

SEQ ID NO: 1411467 - RNA, 18 nt, Human
caggcacugggcaugagg

SEQ ID NO: 1411468 - RNA, 17 nt, Human
caggcacugggcaugag

SEQ ID NO: 1411469 - RNA, 16 nt, Human
caggcacugggcauga

SEQ ID NO: 1411470 - RNA, 15 nt, Human
caggcacugcuaggc

SEQ ID NO: 1411471 - RNA, 22 nt, Human
caggccaccuggcucucaccuc

SEQ ID NO: 1411472 - RNA, 21 nt, Human
caggccaccuggcucucaccu

SEQ ID NO: 1411473 - RNA, 17 nt, Human
caggccaccuggcucuc

SEQ ID NO: 1411474 - RNA, 22 nt, Human
caggcacugcccugguggcccu

SEQ ID NO: 1411475 - RNA, 16 nt, Human
caggcacugcccuggu

SEQ ID NO: 1411476 - RNA, 15 nt, Human
caggcacugcccugg

SEQ ID NO: 1411477 - RNA, 13 nt, Human
caggcacugcccu

SEQ ID NO: 1411478 - RNA, 21 nt, Human
caggcacugcaaaccgccacc

SEQ ID NO: 1411479 - RNA, 14 nt, Human
caggcacugcaaac

SEQ ID NO: 1411480 - RNA, 23 nt, Human
caggcacugagauaccagcgagg

SEQ ID NO: 1411481 - RNA, 17 nt, Human
caggacagaugccacac

SEQ ID NO: 1411482 - RNA, 14 nt, Human
caggacagaugcca

SEQ ID NO: 1411483 - RNA, 13 nt, Human
caggacagaugcc

SEQ ID NO: 1411484 - RNA, 18 nt, Human
caggaggcaggaccuucg

SEQ ID NO: 1411485 - RNA, 15 nt, Human
caggaggcaggaccu

SEQ ID NO: 1411486 - RNA, 18 nt, Human
caggacccuggacccagc

SEQ ID NO: 1411487 - RNA, 22 nt, Human
caggacccuggacccagccaga

SEQ ID NO: 1411488 - RNA, 15 nt, Human
caggacccuggaccu

SEQ ID NO: 1411489 - RNA, 17 nt, Human
caggacccuggaccuga

SEQ ID NO: 1411490 - RNA, 17 nt, Human
caggacccuggacccag

SEQ ID NO: 1411491 - RNA, 14 nt, Human
caggacccuggacc

SEQ ID NO: 1411492 - RNA, 13 nt, Human
caggacccuggac

SEQ ID NO: 1411493 - RNA, 18 nt, Human
caggacccugaaggggcc

SEQ ID NO: 1411494 - RNA, 17 nt, Human
caggacccugaaggggc

SEQ ID NO: 1411495 - RNA, 20 nt, Human
caggaccagcucaggacaga

SEQ ID NO: 1411496 - RNA, 19 nt, Human
caggaccagcucaggacag

SEQ ID NO: 1411497 - RNA, 17 nt, Human
caggaccagcucaggac

SEQ ID NO: 1411498 - RNA, 16 nt, Human
caggaccagcucagga

SEQ ID NO: 1411499 - RNA, 15 nt, Human
caggaccagcucagg

SEQ ID NO: 1411500 - RNA, 23 nt, Human
caggacaugcgguagccagcaca

SEQ ID NO: 1411501 - RNA, 22 nt, Human
caggacaugcgguagccagcac

SEQ ID NO: 1411502 - RNA, 21 nt, Human
caggacaugcgguagccagca

SEQ ID NO: 1411503 - RNA, 20 nt, Human
caggacaugcgguagccagc

SEQ ID NO: 1411504 - RNA, 18 nt, Human
caggacaugcgguagcca

SEQ ID NO: 1411505 - RNA, 24 nt, Human
caggacagcccuucuuuccacaga

SEQ ID NO: 1411506 - RNA, 23 nt, Human
caggacagcccuucuuuccacag

SEQ ID NO: 1411507 - RNA, 16 nt, Human
cagggcugggaggaag

SEQ ID NO: 1411508 - RNA, 19 nt, Human
cagggcugggaggaaggac

SEQ ID NO: 1411509 - RNA, 14 nt, Human
cagggcugggagga

SEQ ID NO: 1411510 - RNA, 13 nt, Human
cagggcugggagg

SEQ ID NO: 1411511 - RNA, 21 nt, Human
cagggcuguaacugccaggcu

SEQ ID NO: 1411512 - RNA, 18 nt, Human
cagggcuguaacugccag

SEQ ID NO: 1411513 - RNA, 19 nt, Human
cagggcuguaacugccagg

SEQ ID NO: 1411514 - RNA, 16 nt, Human
cagggaggucauuuug

SEQ ID NO: 1411515 - RNA, 22 nt, Human
caggcugggccauguccaaaga

SEQ ID NO: 1411516 - RNA, 20 nt, Human
caggcugggccauguccaaa

SEQ ID NO: 1411517 - RNA, 18 nt, Human
caggcugggccaugucca

SEQ ID NO: 1411518 - RNA, 17 nt, Human
caggcugggccaugucc

SEQ ID NO: 1411519 - RNA, 13 nt, Human
caggcugggccau

SEQ ID NO: 1411520 - RNA, 12 nt, Human
caggcugggcca

SEQ ID NO: 1411521 - RNA, 11 nt, Human
caggcugggcc

SEQ ID NO: 1411522 - RNA, 23 nt, Human
caggcugggccauguccaaagag

SEQ ID NO: 1411523 - RNA, 21 nt, Human
cagggaggaggcagagaagaa

SEQ ID NO: 1411524 - RNA, 15 nt, Human
cagggaggaggcaga

SEQ ID NO: 1411525 - RNA, 20 nt, Human
caggccuggcaaguggguga

SEQ ID NO: 1411526 - RNA, 17 nt, Human
caggccuggcaaguggg

SEQ ID NO: 1411527 - RNA, 17 nt, Human
caguauuuaacuaauua

SEQ ID NO: 1411528 - RNA, 14 nt, Human
caguauuuaacuaa

SEQ ID NO: 1411529 - RNA, 13 nt, Human
caguauuuaacua

SEQ ID NO: 1411530 - RNA, 17 nt, Human
caguauuuagaagccaa

SEQ ID NO: 1411531 - RNA, 16 nt, Human
caguauuuagaagcca

SEQ ID NO: 1411532 - RNA, 15 nt, Human
caguauuuguaauua

SEQ ID NO: 1411533 - RNA, 14 nt, Human
caguauuuguaauu

SEQ ID NO: 1411534 - RNA, 13 nt, Human
caguauuuguaau

SEQ ID NO: 1411535 - RNA, 12 nt, Human
caguauuuguaa

SEQ ID NO: 1411536 - RNA, 23 nt, Human
caguauuuguaauuaaaagcaaa

SEQ ID NO: 1411537 - RNA, 18 nt, Human
caguauuuguaauuaaaa

SEQ ID NO: 1411538 - RNA, 14 nt, Human
caguauuauaugua

SEQ ID NO: 1411539 - RNA, 15 nt, Human
caguauuauauguac

SEQ ID NO: 1411540 - RNA, 13 nt, Human
caguauuauaugu

SEQ ID NO: 1411541 - RNA, 23 nt, Human
caguaaauaacuggaaaacagaa

SEQ ID NO: 1411542 - RNA, 19 nt, Human
caguaaaugggggugcauu

SEQ ID NO: 1411543 - RNA, 20 nt, Human
caguaaaugggggugcauuu

SEQ ID NO: 1411544 - RNA, 15 nt, Human
cagguuuuuccuuuu

SEQ ID NO: 1411545 - RNA, 11 nt, Human
caguaaaauug

SEQ ID NO: 1411546 - RNA, 13 nt, Human
cagguuuuuccuu

SEQ ID NO: 1411547 - RNA, 12 nt, Human
cagguuuuuccc

SEQ ID NO: 1411548 - RNA, 15 nt, Human
caguaaaauugccau

SEQ ID NO: 1411549 - RNA, 16 nt, Human
caguaaaauugccaua

SEQ ID NO: 1411550 - RNA, 18 nt, Human
caguaaaauugccauauu

SEQ ID NO: 1411551 - RNA, 20 nt, Human
caguaaaucuuuuacaacug

SEQ ID NO: 1411552 - RNA, 12 nt, Human
caguaaaucuuu

SEQ ID NO: 1411553 - RNA, 22 nt, Human
caguaaauaacuggaaaacaga

SEQ ID NO: 1411554 - RNA, 18 nt, Human
caguaaauaacuggaaaa

SEQ ID NO: 1411555 - RNA, 17 nt, Human
caguaaauaacuggaaa

SEQ ID NO: 1411556 - RNA, 16 nt, Human
caguaaauaacuggaa

SEQ ID NO: 1411557 - RNA, 18 nt, Human
caguaaaugggggugcau

SEQ ID NO: 1411558 - RNA, 19 nt, Human
caggugcucaauaaaugau

SEQ ID NO: 1411559 - RNA, 16 nt, Human
caggguuuuaacuuug

SEQ ID NO: 1411560 - RNA, 19 nt, Human
caggguuucaccauguugc

SEQ ID NO: 1411561 - RNA, 21 nt, Human
cagguucuuguuggugcacag

SEQ ID NO: 1411562 - RNA, 18 nt, Human
cagguucuuguuggugca

SEQ ID NO: 1411563 - RNA, 12 nt, Human
cagguucuuguu

SEQ ID NO: 1411564 - RNA, 24 nt, Human
cagguucuccguuagcuccugugg

SEQ ID NO: 1411565 - RNA, 23 nt, Human
cagguucuccguuagcuccugug

SEQ ID NO: 1411566 - RNA, 22 nt, Human
cagguucuccguuagcuccugu

SEQ ID NO: 1411567 - RNA, 21 nt, Human
cagguucuccguuagcuccug

SEQ ID NO: 1411568 - RNA, 15 nt, Human
caggguuuuaacuuu

SEQ ID NO: 1411569 - RNA, 23 nt, Human
caggugcugacuucaucucccac

SEQ ID NO: 1411570 - RNA, 21 nt, Human
caggugcugacuucaucuccc

SEQ ID NO: 1411571 - RNA, 20 nt, Human
caggugcugacuucaucucc

SEQ ID NO: 1411572 - RNA, 11 nt, Human
cagguuuuucc

SEQ ID NO: 1411573 - RNA, 19 nt, Human
cagggucuccagaaagccc

SEQ ID NO: 1411574 - RNA, 18 nt, Human
cagggucuccagaaagcc

SEQ ID NO: 1411575 - RNA, 20 nt, Human
cagggugcaguaucaugccc

SEQ ID NO: 1411576 - RNA, 12 nt, Human
caggguggcagc

SEQ ID NO: 1411577 - RNA, 22 nt, Human
caagcuaagcacugccacuggg

SEQ ID NO: 1411578 - RNA, 16 nt, Human
caagcuaagcacugcc

SEQ ID NO: 1411579 - RNA, 14 nt, Human
caagcuaagcacug

SEQ ID NO: 1411580 - RNA, 15 nt, Human
caaguccagguccug

SEQ ID NO: 1411581 - RNA, 13 nt, Human
caaguccaggucc

SEQ ID NO: 1411582 - RNA, 16 nt, Human
caaguauuuuuaauua

SEQ ID NO: 1411583 - RNA, 15 nt, Human
caaguauuuuuaauu

SEQ ID NO: 1411584 - RNA, 11 nt, Human
caaguauuuuu

SEQ ID NO: 1411585 - RNA, 22 nt, Human
caaguauuuguuaauuuagaaa

SEQ ID NO: 1411586 - RNA, 22 nt, Human
caaguaugugggcagauuuuca

SEQ ID NO: 1411587 - RNA, 20 nt, Human
caaguauuuguuaauuuaga

SEQ ID NO: 1411588 - RNA, 12 nt, Human
caaggcagccgu

SEQ ID NO: 1411589 - RNA, 13 nt, Human
caaggcagccgug

SEQ ID NO: 1411590 - RNA, 19 nt, Human
caaggcagcaaggcccgag

SEQ ID NO: 1411591 - RNA, 17 nt, Human
caaggcagcaaggcccg

SEQ ID NO: 1411592 - RNA, 16 nt, Human
caaggcagcaaggccc

SEQ ID NO: 1411593 - RNA, 15 nt, Human
caaggcagcaaggcc

SEQ ID NO: 1411594 - RNA, 18 nt, Human
caaguauacuagggagcc

SEQ ID NO: 1411595 - RNA, 14 nt, Human
caaggcagcaaggc

SEQ ID NO: 1411596 - RNA, 20 nt, Human
caaggcagaggccugggcug

SEQ ID NO: 1411597 - RNA, 19 nt, Human
caaggcagaggccugggcu

SEQ ID NO: 1411598 - RNA, 16 nt, Human
caaggcagaggccugg

SEQ ID NO: 1411599 - RNA, 15 nt, Human
caaggcagaggccug

SEQ ID NO: 1411600 - RNA, 14 nt, Human
caaggcagaggccu

SEQ ID NO: 1411601 - RNA, 13 nt, Human
caaggcagaggcc

SEQ ID NO: 1411602 - RNA, 20 nt, Human
caaggcacuugagggggaag

SEQ ID NO: 1411603 - RNA, 18 nt, Human
caaggcacuugaggggga

SEQ ID NO: 1411604 - RNA, 23 nt, Human
caagcucugagggaaagggcccu

SEQ ID NO: 1411605 - RNA, 17 nt, Human
caagcucugagggaaag

SEQ ID NO: 1411606 - RNA, 14 nt, Human
caagcucugaggga

SEQ ID NO: 1411607 - RNA, 14 nt, Human
caagcuccaagccc

SEQ ID NO: 1411608 - RNA, 13 nt, Human
caagcuccaagcc

SEQ ID NO: 1411609 - RNA, 19 nt, Human
caagcuccaagccccaucu

SEQ ID NO: 1411610 - RNA, 21 nt, Human
caagcucagaggcgcacugug

SEQ ID NO: 1411611 - RNA, 21 nt, Human
caagcucacuccccaaccccc

SEQ ID NO: 1411612 - RNA, 21 nt, Human
caagcuaggugcuauuuguca

SEQ ID NO: 1411613 - RNA, 15 nt, Human
caagcuauucaauuc

SEQ ID NO: 1411614 - RNA, 17 nt, Human
caaguccagguccuggu

SEQ ID NO: 1411615 - RNA, 16 nt, Human
caaguccagguccugg

SEQ ID NO: 1411616 - RNA, 24 nt, Human
caaguccagguccugguggggcag

SEQ ID NO: 1411617 - RNA, 13 nt, Human
caauaaagcaaug

SEQ ID NO: 1411618 - RNA, 15 nt, Human
caauaaagcugcuga

SEQ ID NO: 1411619 - RNA, 17 nt, Human
caauaaagcugcugaga

SEQ ID NO: 1411620 - RNA, 19 nt, Human
caauaaagcagcguuucua

SEQ ID NO: 1411621 - RNA, 23 nt, Human
caauaaagcugcugagaaucuag

SEQ ID NO: 1411622 - RNA, 22 nt, Human
caauaaagcugcugagaaucua

SEQ ID NO: 1411623 - RNA, 13 nt, Human
caauaaaguauuu

SEQ ID NO: 1411624 - RNA, 16 nt, Human
caauaaaguauuuaau

SEQ ID NO: 1411625 - RNA, 14 nt, Human
caauuuaugaauug

SEQ ID NO: 1411626 - RNA, 13 nt, Human
caauuuauuaugg

SEQ ID NO: 1411627 - RNA, 15 nt, Human
caauucuugccaaau

SEQ ID NO: 1411628 - RNA, 21 nt, Human
caauucuucccuaucuuugcc

SEQ ID NO: 1411629 - RNA, 22 nt, Human
caauucuucccuaucuuugcca

SEQ ID NO: 1411630 - RNA, 22 nt, Human
caauugaaagugggcaaaagcu

SEQ ID NO: 1411631 - RNA, 19 nt, Human
caauucuuuuaacuguugu

SEQ ID NO: 1411632 - RNA, 11 nt, Human
caauuuaaaug

SEQ ID NO: 1411633 - RNA, 13 nt, Human
caauuuaaauguu

SEQ ID NO: 1411634 - RNA, 14 nt, Human
caauuuaaauguua

SEQ ID NO: 1411635 - RNA, 17 nt, Human
caaugcuguauuuuaaa

SEQ ID NO: 1411636 - RNA, 16 nt, Human
caaugcuguauuuuaa

SEQ ID NO: 1411637 - RNA, 22 nt, Human
caauggaccggagagugggggu

SEQ ID NO: 1411638 - RNA, 23 nt, Human
caaugcuguauuuuaaaagaaug

SEQ ID NO: 1411639 - RNA, 14 nt, Human
caauggaccggaga

SEQ ID NO: 1411640 - RNA, 15 nt, Human
caaugcuguauuuua

SEQ ID NO: 1411641 - RNA, 19 nt, Human
cacaggugcaacagacuug

SEQ ID NO: 1411642 - RNA, 15 nt, Human
cacagggucugcucu

SEQ ID NO: 1411643 - RNA, 18 nt, Human
cacagggucccacagcca

SEQ ID NO: 1411644 - RNA, 17 nt, Human
cacagggucccacagcc

SEQ ID NO: 1411645 - RNA, 15 nt, Human
cacagggucccacag

SEQ ID NO: 1411646 - RNA, 13 nt, Human
cacaggccugugu

SEQ ID NO: 1411647 - RNA, 20 nt, Human
cacagcggagguguggagcc

SEQ ID NO: 1411648 - RNA, 21 nt, Human
cacagccucuuagaugcaguu

SEQ ID NO: 1411649 - RNA, 17 nt, Human
cacagccucuuagaugc

SEQ ID NO: 1411650 - RNA, 14 nt, Human
cacaguauuuguaa

SEQ ID NO: 1411651 - RNA, 15 nt, Human
cacagucacugcucu

SEQ ID NO: 1411652 - RNA, 19 nt, Human
cacaguauugcucacccag

SEQ ID NO: 1411653 - RNA, 15 nt, Human
cacaguauugcucac

SEQ ID NO: 1411654 - RNA, 15 nt, Human
cacaguauuuguaau

SEQ ID NO: 1411655 - RNA, 19 nt, Human
cacaguacgaaccuacagu

SEQ ID NO: 1411656 - RNA, 21 nt, Human
cacaguaaaaauggaaacuau

SEQ ID NO: 1411657 - RNA, 21 nt, Human
cacacaggcauuuccugggug

SEQ ID NO: 1411658 - RNA, 12 nt, Human
cacacagggcag

SEQ ID NO: 1411659 - RNA, 20 nt, Human
cacacaggcauuuccugggu

SEQ ID NO: 1411660 - RNA, 19 nt, Human
cacacaggcauuuccuggg

SEQ ID NO: 1411661 - RNA, 18 nt, Human
cacacaggcauuuccugg

SEQ ID NO: 1411662 - RNA, 17 nt, Human
cacacaggcauuuccug

SEQ ID NO: 1411663 - RNA, 16 nt, Human
cacacaggcauuuccu

SEQ ID NO: 1411664 - RNA, 10 nt, Human
cacacaggca

SEQ ID NO: 1411665 - RNA, 13 nt, Human
cacacagcugccg

SEQ ID NO: 1411666 - RNA, 14 nt, Human
cacacagcugccgg

SEQ ID NO: 1411667 - RNA, 12 nt, Human
cacacagcugcc

SEQ ID NO: 1411668 - RNA, 14 nt, Human
cacacaguauuuuu

SEQ ID NO: 1411669 - RNA, 13 nt, Human
cacacaguauuuu

SEQ ID NO: 1411670 - RNA, 23 nt, Human
cacacagggucugcaaggucuuu

SEQ ID NO: 1411671 - RNA, 18 nt, Human
cacacagugcucaaggcc

SEQ ID NO: 1411672 - RNA, 22 nt, Human
cacacaugaaguccaagcauuu

SEQ ID NO: 1411673 - RNA, 17 nt, Human
cacacaugaaguccaag

SEQ ID NO: 1411674 - RNA, 18 nt, Human
cacacaugcuucccuuuc

SEQ ID NO: 1411675 - RNA, 19 nt, Human
cacagacauacuaaccagc

SEQ ID NO: 1411676 - RNA, 21 nt, Human
cacagacauacuaaccagcag

SEQ ID NO: 1411677 - RNA, 18 nt, Human
caccccacgccuuauccc

SEQ ID NO: 1411678 - RNA, 15 nt, Human
caccccacucccaca

SEQ ID NO: 1411679 - RNA, 12 nt, Human
caccccaccucu

SEQ ID NO: 1411680 - RNA, 15 nt, Human
caccccaccucuucc

SEQ ID NO: 1411681 - RNA, 16 nt, Human
caccccaccucuuccu

SEQ ID NO: 1411682 - RNA, 20 nt, Human
caccugccucaggacugcga

SEQ ID NO: 1411683 - RNA, 14 nt, Human
caccugccucagga

SEQ ID NO: 1411684 - RNA, 13 nt, Human
caccugccucagg

SEQ ID NO: 1411685 - RNA, 17 nt, Human
cacccucauucuacuga

SEQ ID NO: 1411686 - RNA, 13 nt, Human
cacccucaugcug

SEQ ID NO: 1411687 - RNA, 14 nt, Human
cacccucaugcugu

SEQ ID NO: 1411688 - RNA, 16 nt, Human
cacccucaugcugugu

SEQ ID NO: 1411689 - RNA, 21 nt, Human
cacccucaugcugugugacuc

SEQ ID NO: 1411690 - RNA, 23 nt, Human
cacccugggcccugggcuggaau

SEQ ID NO: 1411691 - RNA, 21 nt, Human
cacccucuuccuacuggucuc

SEQ ID NO: 1411692 - RNA, 17 nt, Human
cacccucuuccuacugg

SEQ ID NO: 1411693 - RNA, 16 nt, Human
cacccucuuccuacug

SEQ ID NO: 1411694 - RNA, 15 nt, Human
cacccucuuccuacu

SEQ ID NO: 1411695 - RNA, 14 nt, Human
cacccucuuccuac

SEQ ID NO: 1411696 - RNA, 12 nt, Human
cacccucuuccu

SEQ ID NO: 1411697 - RNA, 11 nt, Human
cacccucuucc

SEQ ID NO: 1411698 - RNA, 21 nt, Human
cacccucguggacaccugccc

SEQ ID NO: 1411699 - RNA, 23 nt, Human
cacccucguggacaccugcccug

SEQ ID NO: 1411700 - RNA, 16 nt, Human
caccucagccucccaa

SEQ ID NO: 1411701 - RNA, 22 nt, Human
caccuaauccaggcagauccag

SEQ ID NO: 1411702 - RNA, 21 nt, Human
caccuaauccaggcagaucca

SEQ ID NO: 1411703 - RNA, 20 nt, Human
caccuaauccaggcagaucc

SEQ ID NO: 1411704 - RNA, 17 nt, Human
caccugcccugcccugc

SEQ ID NO: 1411705 - RNA, 18 nt, Human
caccugcccugcccugcc

SEQ ID NO: 1411706 - RNA, 19 nt, Human
caccugcccugcccugcca

SEQ ID NO: 1411707 - RNA, 20 nt, Human
caccugcccugcccugccac

SEQ ID NO: 1411708 - RNA, 21 nt, Human
caccugcccugcccugccacc

SEQ ID NO: 1411709 - RNA, 22 nt, Human
caccugcccugcccugccaccu

SEQ ID NO: 1411710 - RNA, 23 nt, Human
caccugcccugcccugccaccug

SEQ ID NO: 1411711 - RNA, 16 nt, Human
cacuccaagcccagcc

SEQ ID NO: 1411712 - RNA, 21 nt, Human
cacuccaagcccagcccaugg

SEQ ID NO: 1411713 - RNA, 15 nt, Human
cacuccaagcccagc

SEQ ID NO: 1411714 - RNA, 14 nt, Human
cacuaguauuucua

SEQ ID NO: 1411715 - RNA, 14 nt, Human
cacugaaaaaauau

SEQ ID NO: 1411716 - RNA, 13 nt, Human
cacugaaaaaaua

SEQ ID NO: 1411717 - RNA, 16 nt, Human
cacucuuucuccugcu

SEQ ID NO: 1411718 - RNA, 12 nt, Human
cacugaaaaaau

SEQ ID NO: 1411719 - RNA, 23 nt, Human
cacucuuuugcuuuauuccagaa

SEQ ID NO: 1411720 - RNA, 15 nt, Human
cacucuuuugcuuua

SEQ ID NO: 1411721 - RNA, 12 nt, Human
cacucuuuguaa

SEQ ID NO: 1411722 - RNA, 15 nt, Human
cacucuuuguaagag

SEQ ID NO: 1411723 - RNA, 14 nt, Human
cacucuuucuuuca

SEQ ID NO: 1411724 - RNA, 15 nt, Human
cacucuuucuuucaa

SEQ ID NO: 1411725 - RNA, 23 nt, Human
cacugguggggauaggccagccg

SEQ ID NO: 1411726 - RNA, 21 nt, Human
cacugguggggauaggccagc

SEQ ID NO: 1411727 - RNA, 14 nt, Human
cacugguuugaaga

SEQ ID NO: 1411728 - RNA, 22 nt, Human
cacugguggggauaggccagcc

SEQ ID NO: 1411729 - RNA, 14 nt, Human
cacuuacauuuaca

SEQ ID NO: 1411730 - RNA, 21 nt, Human
cacuuauuggaacucugcuug

SEQ ID NO: 1411731 - RNA, 19 nt, Human
cacuuauguuauacaauac

SEQ ID NO: 1411732 - RNA, 20 nt, Human
cacuuauuccccauucuucc

SEQ ID NO: 1411733 - RNA, 17 nt, Human
cacuuaucugaucagaa

SEQ ID NO: 1411734 - RNA, 16 nt, Human
cacuuaucugaucaga

SEQ ID NO: 1411735 - RNA, 14 nt, Human
cacuuauagccucu

SEQ ID NO: 1411736 - RNA, 16 nt, Human
cacuuauagccucugu

SEQ ID NO: 1411737 - RNA, 15 nt, Human
cacuuguccagcuga

SEQ ID NO: 1411738 - RNA, 14 nt, Human
cacuuguccagcug

SEQ ID NO: 1411739 - RNA, 22 nt, Human
cacuugucaggaguguguguga

SEQ ID NO: 1411740 - RNA, 20 nt, Human
cacuugucaggagugugugu

SEQ ID NO: 1411741 - RNA, 16 nt, Human
cacuugucaggagugu

SEQ ID NO: 1411742 - RNA, 19 nt, Human
cacuuguguuuugcaagcc

SEQ ID NO: 1411743 - RNA, 16 nt, Human
cacuugucaauaaaau

SEQ ID NO: 1411744 - RNA, 18 nt, Human
cacuugucauuguuauau

SEQ ID NO: 1411745 - RNA, 23 nt, Human
cacuuguccagcugagcgccagg

SEQ ID NO: 1411746 - RNA, 22 nt, Human
cacuuguguuuugcaagccaga

SEQ ID NO: 1411747 - RNA, 17 nt, Human
cacugcacucaaccuua

SEQ ID NO: 1411748 - RNA, 21 nt, Human
cacugcacucaaccuuaagac

SEQ ID NO: 1411749 - RNA, 12 nt, Human
cacugccacugg

SEQ ID NO: 1411750 - RNA, 13 nt, Human
cacugccaggagg

SEQ ID NO: 1411751 - RNA, 12 nt, Human
cacugccaggag

SEQ ID NO: 1411752 - RNA, 22 nt, Human
cacugccagcauuucccuuccu

SEQ ID NO: 1411753 - RNA, 18 nt, Human
cacugccagcauuucccu

SEQ ID NO: 1411754 - RNA, 18 nt, Human
cacugcagccccacccag

SEQ ID NO: 1411755 - RNA, 16 nt, Human
cacugcauguuuguga

SEQ ID NO: 1411756 - RNA, 22 nt, Human
cacugccaggagggacaaagga

SEQ ID NO: 1411757 - RNA, 17 nt, Human
cacugccaggagggaca

SEQ ID NO: 1411758 - RNA, 16 nt, Human
cacugccaggagggac

SEQ ID NO: 1411759 - RNA, 15 nt, Human
cacugccaggaggga

SEQ ID NO: 1411760 - RNA, 14 nt, Human
cacugccaggaggg

SEQ ID NO: 1411761 - RNA, 18 nt, Human
cacugggagaaaugaaaa

SEQ ID NO: 1411762 - RNA, 22 nt, Human
cacuggggcucagagccggggu

SEQ ID NO: 1411763 - RNA, 20 nt, Human
cacuggggcucagagccggg

SEQ ID NO: 1411764 - RNA, 19 nt, Human
cacuggggcucagagccgg

SEQ ID NO: 1411765 - RNA, 18 nt, Human
cacuggggcucagagccg

SEQ ID NO: 1411766 - RNA, 17 nt, Human
cacuggggcucagagcc

SEQ ID NO: 1411767 - RNA, 16 nt, Human
cacuggggcucagagc

SEQ ID NO: 1411768 - RNA, 15 nt, Human
cacuggggcucagag

SEQ ID NO: 1411769 - RNA, 12 nt, Human
cacuggggcuca

SEQ ID NO: 1411770 - RNA, 17 nt, Human
cacugggacuugcaaaa

SEQ ID NO: 1411771 - RNA, 19 nt, Human
cacuggggcaggggccggg

SEQ ID NO: 1411772 - RNA, 13 nt, Human
caaagcagccacg

SEQ ID NO: 1411773 - RNA, 12 nt, Human
caaagcagccac

SEQ ID NO: 1411774 - RNA, 19 nt, Human
caaagcagauucagaaaug

SEQ ID NO: 1411775 - RNA, 19 nt, Human
caaagcagacagcuccacc

SEQ ID NO: 1411776 - RNA, 17 nt, Human
caaagcagacagcucca

SEQ ID NO: 1411777 - RNA, 16 nt, Human
caaagcagacagcucc

SEQ ID NO: 1411778 - RNA, 15 nt, Human
caaagcagacagcuc

SEQ ID NO: 1411779 - RNA, 13 nt, Human
caaagcagacagc

SEQ ID NO: 1411780 - RNA, 12 nt, Human
caaagcagacag

SEQ ID NO: 1411781 - RNA, 22 nt, Human
caaagcacgaaauguuauuuuu

SEQ ID NO: 1411782 - RNA, 20 nt, Human
caaagcacgaaauguuauuu

SEQ ID NO: 1411783 - RNA, 14 nt, Human
caaagcacagagag

SEQ ID NO: 1411784 - RNA, 19 nt, Human
caaagcacagagagucugg

SEQ ID NO: 1411785 - RNA, 13 nt, Human
caaagcacagaga

SEQ ID NO: 1411786 - RNA, 11 nt, Human
caaagcacaga

SEQ ID NO: 1411787 - RNA, 23 nt, Human
caaagcaagcauucagaagaaaa

SEQ ID NO: 1411788 - RNA, 15 nt, Human
caaagcaaggaaacu

SEQ ID NO: 1411789 - RNA, 13 nt, Human
caaagcaaggaaa

SEQ ID NO: 1411790 - RNA, 22 nt, Human
caaagcaagcauucagaagaaa

SEQ ID NO: 1411791 - RNA, 14 nt, Human
caaagcaagacccu

SEQ ID NO: 1411792 - RNA, 16 nt, Human
caaagauuuaaucugc

SEQ ID NO: 1411793 - RNA, 13 nt, Human
caaagauuuaauc

SEQ ID NO: 1411794 - RNA, 16 nt, Human
caaagaugcugugagu

SEQ ID NO: 1411795 - RNA, 11 nt, Human
caaagaugcug

SEQ ID NO: 1411796 - RNA, 22 nt, Human
caaagauauuuugcuuugugau

SEQ ID NO: 1411797 - RNA, 23 nt, Human
caaagauauuuugcuuugugauu

SEQ ID NO: 1411798 - RNA, 21 nt, Human
caaagguuuggaaggagcaga

SEQ ID NO: 1411799 - RNA, 22 nt, Human
caaaguacacuguuucaaacuu

SEQ ID NO: 1411800 - RNA, 19 nt, Human
caaagguuuuccucuucua

SEQ ID NO: 1411801 - RNA, 11 nt, Human
caaagguuuuc

SEQ ID NO: 1411802 - RNA, 19 nt, Human
caaagguuuggaaggagca

SEQ ID NO: 1411803 - RNA, 18 nt, Human
caaagguuuggaaggagc

SEQ ID NO: 1411804 - RNA, 17 nt, Human
caaagguuuggaaggag

SEQ ID NO: 1411805 - RNA, 16 nt, Human
caaagguuuggaagga

SEQ ID NO: 1411806 - RNA, 23 nt, Human
caaagguuuaaaugaacaagaga

SEQ ID NO: 1411807 - RNA, 20 nt, Human
caaagguuuaaaugaacaag

SEQ ID NO: 1411808 - RNA, 16 nt, Human
caaagguuuaaaugaa

SEQ ID NO: 1411809 - RNA, 13 nt, Human
caaagguuuaaau

SEQ ID NO: 1411810 - RNA, 15 nt, Human
caaagguugagaugu

SEQ ID NO: 1411811 - RNA, 22 nt, Human
caaagguucuagguuucaaaga

SEQ ID NO: 1411812 - RNA, 21 nt, Human
caaagguucuagguuucaaag

SEQ ID NO: 1411813 - RNA, 19 nt, Human
caaagguucuagguuucaa

SEQ ID NO: 1411814 - RNA, 14 nt, Human
caaagguucuaggu

SEQ ID NO: 1411815 - RNA, 12 nt, Human
caaagguucuag

SEQ ID NO: 1411816 - RNA, 16 nt, Human
caaagugcugagauua

SEQ ID NO: 1411817 - RNA, 15 nt, Human
caaagugcugagauu

SEQ ID NO: 1411818 - RNA, 12 nt, Human
caaagugcaagg

SEQ ID NO: 1411819 - RNA, 16 nt, Human
caaagugcaaggaccu

SEQ ID NO: 1411820 - RNA, 15 nt, Human
caaagucucuaauuc

SEQ ID NO: 1411821 - RNA, 14 nt, Human
caaagucucuaauu

SEQ ID NO: 1411822 - RNA, 13 nt, Human
caaagucucuaau

SEQ ID NO: 1411823 - RNA, 12 nt, Human
caaagucucuaa

SEQ ID NO: 1411824 - RNA, 21 nt, Human
caaagucucuggaauuugaaa

SEQ ID NO: 1411825 - RNA, 13 nt, Human
caacacguuacua

SEQ ID NO: 1411826 - RNA, 16 nt, Human
caacacccauuuuucc

SEQ ID NO: 1411827 - RNA, 19 nt, Human
caacacgcaccugccucag

SEQ ID NO: 1411828 - RNA, 14 nt, Human
caacacuaacauga

SEQ ID NO: 1411829 - RNA, 21 nt, Human
caaauccuuagaucuggcaug

SEQ ID NO: 1411830 - RNA, 17 nt, Human
caaauccuuagaucugg

SEQ ID NO: 1411831 - RNA, 15 nt, Human
caaauccuugaagau

SEQ ID NO: 1411832 - RNA, 17 nt, Human
caacacgcaccugccuc

SEQ ID NO: 1411833 - RNA, 15 nt, Human
caacacgcaccugcc

SEQ ID NO: 1411834 - RNA, 22 nt, Human
caacaccaugauuccuuuaaca

SEQ ID NO: 1411835 - RNA, 19 nt, Human
caacaccaugauuccuuua

SEQ ID NO: 1411836 - RNA, 17 nt, Human
caacaccaugauuccuu

SEQ ID NO: 1411837 - RNA, 22 nt, Human
caacaccaagcacagcagccug

SEQ ID NO: 1411838 - RNA, 15 nt, Human
caacaccaagcacag

SEQ ID NO: 1411839 - RNA, 13 nt, Human
caacaauucuaaa

SEQ ID NO: 1411840 - RNA, 12 nt, Human
caacaauaaaua

SEQ ID NO: 1411841 - RNA, 20 nt, Human
caaaagauugcugaaauuuu

SEQ ID NO: 1411842 - RNA, 19 nt, Human
caaaagauugcugaaauuu

SEQ ID NO: 1411843 - RNA, 16 nt, Human
caaaagauugcugaaa

SEQ ID NO: 1411844 - RNA, 19 nt, Human
auuuuuuuuuuuucucuca

SEQ ID NO: 1411845 - RNA, 23 nt, Human
auuuuuuuuuuuuuuuuuuuaag

SEQ ID NO: 1411846 - RNA, 19 nt, Human
auuuuuuuuuuuuuuuccu

SEQ ID NO: 1411847 - RNA, 21 nt, Human
caaacccaccugcuaguguga

SEQ ID NO: 1411848 - RNA, 13 nt, Human
caaacccaguguu

SEQ ID NO: 1411849 - RNA, 20 nt, Human
caaaagggccaaagaaccaa

SEQ ID NO: 1411850 - RNA, 19 nt, Human
caaaagggccaaagaacca

SEQ ID NO: 1411851 - RNA, 20 nt, Human
caaacagccaacuagccccu

SEQ ID NO: 1411852 - RNA, 14 nt, Human
caaacaggcucaga

SEQ ID NO: 1411853 - RNA, 15 nt, Human
caaacaggcucagag

SEQ ID NO: 1411854 - RNA, 20 nt, Human
caaacaggaucaguuaacua

SEQ ID NO: 1411855 - RNA, 24 nt, Human
caaacccaguguuuuaggagcaug

SEQ ID NO: 1411856 - RNA, 20 nt, Human
caaagauauuuugcuuugug

SEQ ID NO: 1411857 - RNA, 16 nt, Human
auuugauugauuugaa

SEQ ID NO: 1411858 - RNA, 13 nt, Human
auuugauugauuu

SEQ ID NO: 1411859 - RNA, 22 nt, Human
auuugcauaacaauuccucuac

SEQ ID NO: 1411860 - RNA, 21 nt, Human
auuugcauaacaauuccucua

SEQ ID NO: 1411861 - RNA, 14 nt, Human
auuugcaggguccu

SEQ ID NO: 1411862 - RNA, 20 nt, Human
auuugcaagggaaaagucuc

SEQ ID NO: 1411863 - RNA, 15 nt, Human
auuugcaagggaaaa

SEQ ID NO: 1411864 - RNA, 23 nt, Human
auuugcauuaaauucacaaacuu

SEQ ID NO: 1411865 - RNA, 19 nt, Human
auuugcauuaaauucacaa

SEQ ID NO: 1411866 - RNA, 18 nt, Human
auuugcauuaaauucaca

SEQ ID NO: 1411867 - RNA, 22 nt, Human
auuugcauuuguuuauguaauu

SEQ ID NO: 1411868 - RNA, 13 nt, Human
auuugcauuuguu

SEQ ID NO: 1411869 - RNA, 12 nt, Human
auuugcauuugu

SEQ ID NO: 1411870 - RNA, 22 nt, Human
auuugcauugaacacaaacugu

SEQ ID NO: 1411871 - RNA, 21 nt, Human
auuugcauugaacacaaacug

SEQ ID NO: 1411872 - RNA, 16 nt, Human
auuugcauugaacaca

SEQ ID NO: 1411873 - RNA, 23 nt, Human
auuugcauuuguuuauguaauuu

SEQ ID NO: 1411874 - RNA, 21 nt, Human
auuugcauuuguuuauguaau

SEQ ID NO: 1411875 - RNA, 16 nt, Human
auuugcauuuguuuau

SEQ ID NO: 1411876 - RNA, 22 nt, Human
auuugccuguaacaagccagau

SEQ ID NO: 1411877 - RNA, 15 nt, Human
auuugccuguaacaa

SEQ ID NO: 1411878 - RNA, 13 nt, Human
auuugccuguaac

SEQ ID NO: 1411879 - RNA, 11 nt, Human
auuugccugua

SEQ ID NO: 1411880 - RNA, 19 nt, Human
auuugcuaauuuuuauuaa

SEQ ID NO: 1411881 - RNA, 16 nt, Human
auuugcuaauuuuuau

SEQ ID NO: 1411882 - RNA, 14 nt, Human
auuugcuaauuuuu

SEQ ID NO: 1411883 - RNA, 13 nt, Human
auuugcuaauuuu

SEQ ID NO: 1411884 - RNA, 16 nt, Human
auuugccuguaacaag

SEQ ID NO: 1411885 - RNA, 18 nt, Human
auuugcuuuuucaccaga

SEQ ID NO: 1411886 - RNA, 11 nt, Human
auuugcuuuuu

SEQ ID NO: 1411887 - RNA, 15 nt, Human
auuugcuuuggaagu

SEQ ID NO: 1411888 - RNA, 14 nt, Human
auuugcuuuggaag

SEQ ID NO: 1411889 - RNA, 13 nt, Human
auuugcuuuggaa

SEQ ID NO: 1411890 - RNA, 17 nt, Human
auuugcuuuuugugaua

SEQ ID NO: 1411891 - RNA, 17 nt, Human
auuugcucauggaauug

SEQ ID NO: 1411892 - RNA, 14 nt, Human
auuugcucauggaa

SEQ ID NO: 1411893 - RNA, 19 nt, Human
auuugugcccccaaccauu

SEQ ID NO: 1411894 - RNA, 18 nt, Human
auuugcuuuuugugauau

SEQ ID NO: 1411895 - RNA, 20 nt, Human
auuugugauacaaugcugug

SEQ ID NO: 1411896 - RNA, 22 nt, Human
auuuggaaauaaagucagaugg

SEQ ID NO: 1411897 - RNA, 17 nt, Human
auuuggaaauaaaguca

SEQ ID NO: 1411898 - RNA, 15 nt, Human
auuuggaaauaaagu

SEQ ID NO: 1411899 - RNA, 17 nt, Human
auuugugauacaaugcu

SEQ ID NO: 1411900 - RNA, 14 nt, Human
auuuguuggaauga

SEQ ID NO: 1411901 - RNA, 13 nt, Human
auuuguuggaaug

SEQ ID NO: 1411902 - RNA, 11 nt, Human
auuuguugcau

SEQ ID NO: 1411903 - RNA, 22 nt, Human
auuuguugagagugugaccaaa

SEQ ID NO: 1411904 - RNA, 13 nt, Human
auuuguugagagu

SEQ ID NO: 1411905 - RNA, 18 nt, Human
auuuguuuauguaauuuc

SEQ ID NO: 1411906 - RNA, 17 nt, Human
auuuguuuauguaauuu

SEQ ID NO: 1411907 - RNA, 13 nt, Human
auuuguuuaugua

SEQ ID NO: 1411908 - RNA, 22 nt, Human
auuuguuuaugguaaaaaauuu

SEQ ID NO: 1411909 - RNA, 20 nt, Human
auuuguuuaugguaaaaaau

SEQ ID NO: 1411910 - RNA, 16 nt, Human
auuuguuuaaaaagua

SEQ ID NO: 1411911 - RNA, 17 nt, Human
auuuguuuaaaaaguaa

SEQ ID NO: 1411912 - RNA, 15 nt, Human
auuuguuggaaugaa

SEQ ID NO: 1411913 - RNA, 22 nt, Human
auuuguuugaacugauaaagau

SEQ ID NO: 1411914 - RNA, 23 nt, Human
auuuguuugaacugauaaagaug

SEQ ID NO: 1411915 - RNA, 13 nt, Human
auuuguuucuacu

SEQ ID NO: 1411916 - RNA, 19 nt, Human
auuuguuuauguaauuuca

SEQ ID NO: 1411917 - RNA, 18 nt, Human
auuuguuucuuucucuga

SEQ ID NO: 1411918 - RNA, 19 nt, Human
auuuuauagcuacuaauuu

SEQ ID NO: 1411919 - RNA, 22 nt, Human
auuuuauaggcauaccuccuau

SEQ ID NO: 1411920 - RNA, 20 nt, Human
auucacagugcucuuuucuc

SEQ ID NO: 1411921 - RNA, 19 nt, Human
auucacagugcucuuuucu

SEQ ID NO: 1411922 - RNA, 21 nt, Human
auucacagugcucuuuucucc

SEQ ID NO: 1411923 - RNA, 22 nt, Human
auucacaguucuuugggccaga

SEQ ID NO: 1411924 - RNA, 21 nt, Human
auucauaauuauuauuuggcc

SEQ ID NO: 1411925 - RNA, 15 nt, Human
auuagggcccugugu

SEQ ID NO: 1411926 - RNA, 18 nt, Human
auuagggcccugugucug

SEQ ID NO: 1411927 - RNA, 15 nt, Human
auuagggaugccucc

SEQ ID NO: 1411928 - RNA, 16 nt, Human
auuaggugugacugaa

SEQ ID NO: 1411929 - RNA, 18 nt, Human
auuaggugugacugaauu

SEQ ID NO: 1411930 - RNA, 23 nt, Human
auuaucuuuucauacauuuucua

SEQ ID NO: 1411931 - RNA, 22 nt, Human
auuaucuuuucauacauuuucu

SEQ ID NO: 1411932 - RNA, 21 nt, Human
auuaggugugacugaauuucu

SEQ ID NO: 1411933 - RNA, 18 nt, Human
auuaugaaacuuuuggaa

SEQ ID NO: 1411934 - RNA, 17 nt, Human
auuaugaauuacauuug

SEQ ID NO: 1411935 - RNA, 14 nt, Human
auuaugaauuacau

SEQ ID NO: 1411936 - RNA, 14 nt, Human
auucaaaguguuau

SEQ ID NO: 1411937 - RNA, 23 nt, Human
auuaugcaugaaguaauaugcac

SEQ ID NO: 1411938 - RNA, 18 nt, Human
auuaugcaauuuuuauau

SEQ ID NO: 1411939 - RNA, 20 nt, Human
auuaugaaugugaagccuuc

SEQ ID NO: 1411940 - RNA, 19 nt, Human
auuaugaagaaggugaaua

SEQ ID NO: 1411941 - RNA, 18 nt, Human
auuaugaauuacauuugu

SEQ ID NO: 1411942 - RNA, 16 nt, Human
auucaauucaaagcug

SEQ ID NO: 1411943 - RNA, 20 nt, Human
auucaaugccccugaauuua

SEQ ID NO: 1411944 - RNA, 18 nt, Human
auucaaugccccugaauu

SEQ ID NO: 1411945 - RNA, 18 nt, Human
auucaaauguauuacagu

SEQ ID NO: 1411946 - RNA, 16 nt, Human
auucaaauguauuaca

SEQ ID NO: 1411947 - RNA, 13 nt, Human
auguuugguaaga

SEQ ID NO: 1411948 - RNA, 23 nt, Human
auguuuggcugcuagaacauggu

SEQ ID NO: 1411949 - RNA, 22 nt, Human
auguuucuucuagguucuaaaa

SEQ ID NO: 1411950 - RNA, 23 nt, Human
auuacaaaucagaagucaucuug

SEQ ID NO: 1411951 - RNA, 22 nt, Human
auuacaaaucagaagucaucuu

SEQ ID NO: 1411952 - RNA, 21 nt, Human
auuacaaaucagaagucaucu

SEQ ID NO: 1411953 - RNA, 19 nt, Human
auuacaaaucagaagucau

SEQ ID NO: 1411954 - RNA, 18 nt, Human
auuacaaaucagaaguca

SEQ ID NO: 1411955 - RNA, 16 nt, Human
auuacaaaucagaagu

SEQ ID NO: 1411956 - RNA, 14 nt, Human
auuacaaaucagaa

SEQ ID NO: 1411957 - RNA, 15 nt, Human
auuacaacggaguca

SEQ ID NO: 1411958 - RNA, 17 nt, Human
auuacaacggagucaaa

SEQ ID NO: 1411959 - RNA, 20 nt, Human
auuaauuccuguuugucuac

SEQ ID NO: 1411960 - RNA, 14 nt, Human
auuaauucuauaag

SEQ ID NO: 1411961 - RNA, 18 nt, Human
auuaauuccuguuugucu

SEQ ID NO: 1411962 - RNA, 13 nt, Human
auuaauucuauaa

SEQ ID NO: 1411963 - RNA, 22 nt, Human
auuaauuccuucagcacuuuag

SEQ ID NO: 1411964 - RNA, 22 nt, Human
auuacaggcgugagccaccucg

SEQ ID NO: 1411965 - RNA, 22 nt, Human
auuacaggcaccugccaccaug

SEQ ID NO: 1411966 - RNA, 20 nt, Human
auuacaggcaccugccacca

SEQ ID NO: 1411967 - RNA, 15 nt, Human
auuacagcuggagaa

SEQ ID NO: 1411968 - RNA, 21 nt, Human
auuacagaugggcaaauuaag

SEQ ID NO: 1411969 - RNA, 19 nt, Human
auuacagaugggcaaauua

SEQ ID NO: 1411970 - RNA, 17 nt, Human
auuacaggcgugagcca

SEQ ID NO: 1411971 - RNA, 19 nt, Human
auuacaguggggaaugaag

SEQ ID NO: 1411972 - RNA, 19 nt, Human
auuagauguucucuaucau

SEQ ID NO: 1411973 - RNA, 21 nt, Human
auuagauguucucuaucauuu

SEQ ID NO: 1411974 - RNA, 23 nt, Human
auuagauguucucuaucauuuaa

SEQ ID NO: 1411975 - RNA, 17 nt, Human
auuagccagugaaaaac

SEQ ID NO: 1411976 - RNA, 14 nt, Human
auuagccugaguag

SEQ ID NO: 1411977 - RNA, 16 nt, Human
auuagccugaguagaa

SEQ ID NO: 1411978 - RNA, 17 nt, Human
auuagccugaguagaaa

SEQ ID NO: 1411979 - RNA, 22 nt, Human
auuagcaauugacugucacugu

SEQ ID NO: 1411980 - RNA, 18 nt, Human
auuagcagucccuccaca

SEQ ID NO: 1411981 - RNA, 19 nt, Human
auuagcauuugucaacaaa

SEQ ID NO: 1411982 - RNA, 14 nt, Human
auucuugauguaaa

SEQ ID NO: 1411983 - RNA, 12 nt, Human
auucuugaugua

SEQ ID NO: 1411984 - RNA, 19 nt, Human
auucuuucccaacaccucu

SEQ ID NO: 1411985 - RNA, 16 nt, Human
auucuuucccaacacc

SEQ ID NO: 1411986 - RNA, 17 nt, Human
auucuucugagcacugu

SEQ ID NO: 1411987 - RNA, 21 nt, Human
auucuucugaacucaaacuga

SEQ ID NO: 1411988 - RNA, 22 nt, Human
auucuucuuccaacguggccca

SEQ ID NO: 1411989 - RNA, 16 nt, Human
auucugaaggagcccc

SEQ ID NO: 1411990 - RNA, 15 nt, Human
auucugaaggagccc

SEQ ID NO: 1411991 - RNA, 19 nt, Human
auucugaacuaaagugcug

SEQ ID NO: 1411992 - RNA, 22 nt, Human
auucugaacuaaagugcugcac

SEQ ID NO: 1411993 - RNA, 22 nt, Human
auucucuuguauaagauccuag

SEQ ID NO: 1411994 - RNA, 18 nt, Human
auucauaguaacuucuua

SEQ ID NO: 1411995 - RNA, 20 nt, Human
auucucuuguauaagauccu

SEQ ID NO: 1411996 - RNA, 17 nt, Human
auucauaguaacuucuu

SEQ ID NO: 1411997 - RNA, 16 nt, Human
auucauaguaacuucu

SEQ ID NO: 1411998 - RNA, 13 nt, Human
auucuucugaacu

SEQ ID NO: 1411999 - RNA, 14 nt, Human
auucugaccuuaaa

SEQ ID NO: 1412000 - RNA, 22 nt, Human
auucugaaugcuucuaaguaaa

SEQ ID NO: 1412001 - RNA, 19 nt, Human
auucugaaugcuucuaagu

SEQ ID NO: 1412002 - RNA, 17 nt, Human
auucugaaugcuucuaa

SEQ ID NO: 1412003 - RNA, 16 nt, Human
auucugaaugcuucua

SEQ ID NO: 1412004 - RNA, 15 nt, Human
auucugaaugcuucu

SEQ ID NO: 1412005 - RNA, 20 nt, Human
auucuuucccagucugucga

SEQ ID NO: 1412006 - RNA, 19 nt, Human
auucuuucccagucugucg

SEQ ID NO: 1412007 - RNA, 21 nt, Human
auucuuucccaauucacaucu

SEQ ID NO: 1412008 - RNA, 17 nt, Human
auucuugauguaaaauc

SEQ ID NO: 1412009 - RNA, 16 nt, Human
auucuugauguaaaau

SEQ ID NO: 1412010 - RNA, 19 nt, Human
auugcuagagcuccucccu

SEQ ID NO: 1412011 - RNA, 18 nt, Human
auugcuagagcuccuccc

SEQ ID NO: 1412012 - RNA, 16 nt, Human
auugcuagagcuccuc

SEQ ID NO: 1412013 - RNA, 23 nt, Human
auugcuagagcuccucccucuca

SEQ ID NO: 1412014 - RNA, 15 nt, Human
auugcuagagcuccu

SEQ ID NO: 1412015 - RNA, 14 nt, Human
auugcuagagcucc

SEQ ID NO: 1412016 - RNA, 18 nt, Human
auugauagaguguuauca

SEQ ID NO: 1412017 - RNA, 22 nt, Human
auugaguaaugguguagaacac

SEQ ID NO: 1412018 - RNA, 19 nt, Human
auugauaaccuugaaaaaa

SEQ ID NO: 1412019 - RNA, 16 nt, Human
auugaguuuucagugg

SEQ ID NO: 1412020 - RNA, 15 nt, Human
auugaguuuucagug

SEQ ID NO: 1412021 - RNA, 13 nt, Human
auugaguuggaau

SEQ ID NO: 1412022 - RNA, 15 nt, Human
auugagucaaauggu

SEQ ID NO: 1412023 - RNA, 20 nt, Human
auugaguaaugguguagaac

SEQ ID NO: 1412024 - RNA, 19 nt, Human
auugaguaaugguguagaa

SEQ ID NO: 1412025 - RNA, 19 nt, Human
auugcuuccuccuccccaa

SEQ ID NO: 1412026 - RNA, 16 nt, Human
auugcuuccuccuccc

SEQ ID NO: 1412027 - RNA, 23 nt, Human
auugcuuauuuauuguauucugg

SEQ ID NO: 1412028 - RNA, 20 nt, Human
auugcuuauuuauuguauuc

SEQ ID NO: 1412029 - RNA, 17 nt, Human
auugcuuauuuauugua

SEQ ID NO: 1412030 - RNA, 21 nt, Human
auugcugccccaucagugcuc

SEQ ID NO: 1412031 - RNA, 20 nt, Human
auugcugccccaucagugcu

SEQ ID NO: 1412032 - RNA, 16 nt, Human
auugcugacuguagcu

SEQ ID NO: 1412033 - RNA, 16 nt, Human
auugcugaaauuuuau

SEQ ID NO: 1412034 - RNA, 13 nt, Human
auugcugaaauuu

SEQ ID NO: 1412035 - RNA, 23 nt, Human
auugcucacccagugcccucucc

SEQ ID NO: 1412036 - RNA, 16 nt, Human
auugcucacccagugc

SEQ ID NO: 1412037 - RNA, 12 nt, Human
auugcugaaauu

SEQ ID NO: 1412038 - RNA, 12 nt, Human
auuguaaaguaa

SEQ ID NO: 1412039 - RNA, 23 nt, Human
auuguaaacaaacuguguaacug

SEQ ID NO: 1412040 - RNA, 20 nt, Human
auuguaaaauuauuucauga

SEQ ID NO: 1412041 - RNA, 12 nt, Human
auuguaaucacu

SEQ ID NO: 1412042 - RNA, 16 nt, Human
auuguaaucugaauaa

SEQ ID NO: 1412043 - RNA, 13 nt, Human
auuguaaucacug

SEQ ID NO: 1412044 - RNA, 19 nt, Human
auuguuacguagccuaagg

SEQ ID NO: 1412045 - RNA, 21 nt, Human
auuguuacauuauguggaaaa

SEQ ID NO: 1412046 - RNA, 20 nt, Human
auuguuacauuauguggaaa

SEQ ID NO: 1412047 - RNA, 19 nt, Human
auuguguggauucuuuaaa

SEQ ID NO: 1412048 - RNA, 15 nt, Human
auuguuguccuuuuc

SEQ ID NO: 1412049 - RNA, 13 nt, Human
auuguuguccuuu

SEQ ID NO: 1412050 - RNA, 14 nt, Human
auuguugcauugcu

SEQ ID NO: 1412051 - RNA, 16 nt, Human
auuguugcauugcuuu

SEQ ID NO: 1412052 - RNA, 12 nt, Human
auuguugcauua

SEQ ID NO: 1412053 - RNA, 19 nt, Human
auuguugagcuauugcugu

SEQ ID NO: 1412054 - RNA, 16 nt, Human
auuguugagcuauugc

SEQ ID NO: 1412055 - RNA, 18 nt, Human
auuguuguccuuuucaua

SEQ ID NO: 1412056 - RNA, 17 nt, Human
auuguuguccuuuucau

SEQ ID NO: 1412057 - RNA, 16 nt, Human
auuguuguccuuuuca

SEQ ID NO: 1412058 - RNA, 16 nt, Human
auuguugucugcaacu

SEQ ID NO: 1412059 - RNA, 20 nt, Human
ccucccaauuucagacuccc

SEQ ID NO: 1412060 - RNA, 19 nt, Human
ccucccaauuucagacucc

SEQ ID NO: 1412061 - RNA, 14 nt, Human
ccucccaagcaguu

SEQ ID NO: 1412062 - RNA, 21 nt, Human
ccuccaaggaggggcuguaaa

SEQ ID NO: 1412063 - RNA, 20 nt, Human
ccuccaaggaggggcuguaa

SEQ ID NO: 1412064 - RNA, 23 nt, Human
ccucauguggcuggaagauccug

SEQ ID NO: 1412065 - RNA, 18 nt, Human
ccucauguggcuggaaga

SEQ ID NO: 1412066 - RNA, 19 nt, Human
ccucauguucuuaauucuu

SEQ ID NO: 1412067 - RNA, 21 nt, Human
ccucagccucccaaagugcug

SEQ ID NO: 1412068 - RNA, 17 nt, Human
ccucauguggcuggaag

SEQ ID NO: 1412069 - RNA, 16 nt, Human
ccucauguggcuggaa

SEQ ID NO: 1412070 - RNA, 15 nt, Human
ccucauguggcugga

SEQ ID NO: 1412071 - RNA, 13 nt, Human
ccucauguggcug

SEQ ID NO: 1412072 - RNA, 13 nt, Human
ccucauguucuua

SEQ ID NO: 1412073 - RNA, 22 nt, Human
ccucagccucccaaguagcugg

SEQ ID NO: 1412074 - RNA, 19 nt, Human
ccucagccucccaaagugc

SEQ ID NO: 1412075 - RNA, 15 nt, Human
ccucaagcugcaucu

SEQ ID NO: 1412076 - RNA, 17 nt, Human
ccucaagaugaaggcaa

SEQ ID NO: 1412077 - RNA, 18 nt, Human
ccucaacguauuguuucg

SEQ ID NO: 1412078 - RNA, 19 nt, Human
ccucaacguugcuccccau

SEQ ID NO: 1412079 - RNA, 19 nt, Human
ccuauugugcaauguaaau

SEQ ID NO: 1412080 - RNA, 18 nt, Human
ccuauuuccauucaacaa

SEQ ID NO: 1412081 - RNA, 16 nt, Human
ccuauuuccagaaaua

SEQ ID NO: 1412082 - RNA, 15 nt, Human
ccuauuuuaauaaac

SEQ ID NO: 1412083 - RNA, 16 nt, Human
ccuagauuuaauauaa

SEQ ID NO: 1412084 - RNA, 16 nt, Human
ccuagauucagggaaa

SEQ ID NO: 1412085 - RNA, 21 nt, Human
ccuagauguauaacuaggagc

SEQ ID NO: 1412086 - RNA, 22 nt, Human
ccuagauguauaacuaggagcu

SEQ ID NO: 1412087 - RNA, 20 nt, Human
ccuagauguauaacuaggag

SEQ ID NO: 1412088 - RNA, 16 nt, Human
ccuagauccuaagggu

SEQ ID NO: 1412089 - RNA, 14 nt, Human
ccuagauccuaagg

SEQ ID NO: 1412090 - RNA, 12 nt, Human
ccuagaguccca

SEQ ID NO: 1412091 - RNA, 15 nt, Human
ccuagcacagauggc

SEQ ID NO: 1412092 - RNA, 14 nt, Human
ccuaggauucuaaa

SEQ ID NO: 1412093 - RNA, 11 nt, Human
ccuaggauucu

SEQ ID NO: 1412094 - RNA, 15 nt, Human
ccuaggaggguccuc

SEQ ID NO: 1412095 - RNA, 16 nt, Human
ccuaggcauucuggac

SEQ ID NO: 1412096 - RNA, 21 nt, Human
ccgucuccaggggcugcuucc

SEQ ID NO: 1412097 - RNA, 20 nt, Human
ccgucuccaggggcugcuuc

SEQ ID NO: 1412098 - RNA, 21 nt, Human
ccgucucaguguugagccuuu

SEQ ID NO: 1412099 - RNA, 18 nt, Human
ccguccaggagccugugc

SEQ ID NO: 1412100 - RNA, 16 nt, Human
ccguccaggagccugg

SEQ ID NO: 1412101 - RNA, 12 nt, Human
ccgucagugcug

SEQ ID NO: 1412102 - RNA, 17 nt, Human
ccgucaccccuguuucu

SEQ ID NO: 1412103 - RNA, 21 nt, Human
ccgucaccacgacuggccagg

SEQ ID NO: 1412104 - RNA, 20 nt, Human
ccgucaccacgacuggccag

SEQ ID NO: 1412105 - RNA, 19 nt, Human
ccgucaccacgacuggcca

SEQ ID NO: 1412106 - RNA, 22 nt, Human
ccgucaagagugaauucccuca

SEQ ID NO: 1412107 - RNA, 23 nt, Human
ccgucaagagugaauucccucac

SEQ ID NO: 1412108 - RNA, 22 nt, Human
ccgucaaaacagauuguuugca

SEQ ID NO: 1412109 - RNA, 18 nt, Human
ccggcuaauuuuuguaau

SEQ ID NO: 1412110 - RNA, 15 nt, Human
ccggcuaauuuuugu

SEQ ID NO: 1412111 - RNA, 19 nt, Human
ccggcuaauuuuuguauuu

SEQ ID NO: 1412112 - RNA, 16 nt, Human
ccguagguuauuuuca

SEQ ID NO: 1412113 - RNA, 20 nt, Human
ccuaagcagaaagugccuuu

SEQ ID NO: 1412114 - RNA, 19 nt, Human
ccuaagcagaaagugccuu

SEQ ID NO: 1412115 - RNA, 17 nt, Human
ccuaagcagaaagugcc

SEQ ID NO: 1412116 - RNA, 15 nt, Human
ccuaagcagaaagug

SEQ ID NO: 1412117 - RNA, 14 nt, Human
ccuaagcagaaagu

SEQ ID NO: 1412118 - RNA, 19 nt, Human
ccuaagaggcugcccuccu

SEQ ID NO: 1412119 - RNA, 16 nt, Human
ccuaagaggcugcccu

SEQ ID NO: 1412120 - RNA, 18 nt, Human
ccgucuggcccaccaggg

SEQ ID NO: 1412121 - RNA, 17 nt, Human
ccgucuggcccaccagg

SEQ ID NO: 1412122 - RNA, 16 nt, Human
ccgucuggcccaccag

SEQ ID NO: 1412123 - RNA, 16 nt, Human
ccuaagcaucuaaguu

SEQ ID NO: 1412124 - RNA, 12 nt, Human
ccuaagcaucua

SEQ ID NO: 1412125 - RNA, 23 nt, Human
ccuaagcagaaagugccuuucag

SEQ ID NO: 1412126 - RNA, 13 nt, Human
ccuaagcaucuaa

SEQ ID NO: 1412127 - RNA, 18 nt, Human
ccuaagcuggagugcagu

SEQ ID NO: 1412128 - RNA, 21 nt, Human
ccuaagggucgaaagcucuag

SEQ ID NO: 1412129 - RNA, 19 nt, Human
ccuaagggucgaaagcucu

SEQ ID NO: 1412130 - RNA, 19 nt, Human
ccuaagcuggagugcagug

SEQ ID NO: 1412131 - RNA, 22 nt, Human
ccuaagggucgaaagcucuaga

SEQ ID NO: 1412132 - RNA, 23 nt, Human
ccuaagggucgaaagcucuagaa

SEQ ID NO: 1412133 - RNA, 14 nt, Human
ccuaauaaagcugu

SEQ ID NO: 1412134 - RNA, 21 nt, Human
ccuagagucccagguuggcuc

SEQ ID NO: 1412135 - RNA, 15 nt, Human
ccuaauccaggcaga

SEQ ID NO: 1412136 - RNA, 14 nt, Human
ccuaauccaggcag

SEQ ID NO: 1412137 - RNA, 13 nt, Human
ccuaauccaggca

SEQ ID NO: 1412138 - RNA, 19 nt, Human
ccuaauaauaucccacugg

SEQ ID NO: 1412139 - RNA, 20 nt, Human
ccuaauaauaucccacuggg

SEQ ID NO: 1412140 - RNA, 21 nt, Human
ccuaauaaaguucuguacuca

SEQ ID NO: 1412141 - RNA, 16 nt, Human
ccuaauaaaguucugu

SEQ ID NO: 1412142 - RNA, 23 nt, Human
ccuaauaaagcuguguggcaguc

SEQ ID NO: 1412143 - RNA, 10 nt, Human
cccuggcuuu

SEQ ID NO: 1412144 - RNA, 24 nt, Human
cccuggcuuucauuuucucucagg

SEQ ID NO: 1412145 - RNA, 23 nt, Human
cccuggcuuucauuuucucucag

SEQ ID NO: 1412146 - RNA, 23 nt, Human
cccuggcugggacguggcucagc

SEQ ID NO: 1412147 - RNA, 17 nt, Human
cccuggccccucucccu

SEQ ID NO: 1412148 - RNA, 18 nt, Human
cccuggccccucucccuu

SEQ ID NO: 1412149 - RNA, 11 nt, Human
cccuggccccu

SEQ ID NO: 1412150 - RNA, 20 nt, Human
cccuggcccccucccuggau

SEQ ID NO: 1412151 - RNA, 21 nt, Human
cccuggcccccucccuggaug

SEQ ID NO: 1412152 - RNA, 13 nt, Human
cccuggcccccuc

SEQ ID NO: 1412153 - RNA, 14 nt, Human
cccuggccccagga

SEQ ID NO: 1412154 - RNA, 13 nt, Human
cccuggccccagg

SEQ ID NO: 1412155 - RNA, 9 nt, Human
cccuggccc

SEQ ID NO: 1412156 - RNA, 20 nt, Human
cccuggcaugucaacagcgu

SEQ ID NO: 1412157 - RNA, 22 nt, Human
cccuggcagagaugccucccug

SEQ ID NO: 1412158 - RNA, 21 nt, Human
cccuggcagagaugccucccu

SEQ ID NO: 1412159 - RNA, 12 nt, Human
cccuggcagaga

SEQ ID NO: 1412160 - RNA, 16 nt, Human
cccucacccugccuua

SEQ ID NO: 1412161 - RNA, 13 nt, Human
cccucacccugcc

SEQ ID NO: 1412162 - RNA, 20 nt, Human
cccuauuuagaugauaaaga

SEQ ID NO: 1412163 - RNA, 18 nt, Human
cccucacaguauugcuca

SEQ ID NO: 1412164 - RNA, 11 nt, Human
cccucacccau

SEQ ID NO: 1412165 - RNA, 13 nt, Human
cccucacccaucc

SEQ ID NO: 1412166 - RNA, 17 nt, Human
cccucacccauccuaga

SEQ ID NO: 1412167 - RNA, 17 nt, Human
cccugugccuccucccu

SEQ ID NO: 1412168 - RNA, 13 nt, Human
cccugugccccca

SEQ ID NO: 1412169 - RNA, 19 nt, Human
cccugugcccccagggucc

SEQ ID NO: 1412170 - RNA, 12 nt, Human
cccugugccccc

SEQ ID NO: 1412171 - RNA, 22 nt, Human
cccugugccuugucacgccaga

SEQ ID NO: 1412172 - RNA, 20 nt, Human
cccugugccuugucacgcca

SEQ ID NO: 1412173 - RNA, 15 nt, Human
cccugugccuuguca

SEQ ID NO: 1412174 - RNA, 19 nt, Human
cccugugccuccucccucc

SEQ ID NO: 1412175 - RNA, 13 nt, Human
cccuucucuguau

SEQ ID NO: 1412176 - RNA, 12 nt, Human
ccgcccccuccu

SEQ ID NO: 1412177 - RNA, 14 nt, Human
ccgcccccagguag

SEQ ID NO: 1412178 - RNA, 20 nt, Human
ccgcccccagcccccuccug

SEQ ID NO: 1412179 - RNA, 20 nt, Human
ccgccauucucaagcccugc

SEQ ID NO: 1412180 - RNA, 21 nt, Human
ccgccauucucaagcccugca

SEQ ID NO: 1412181 - RNA, 15 nt, Human
ccgccagcucuguuc

SEQ ID NO: 1412182 - RNA, 14 nt, Human
ccgccagcucuguu

SEQ ID NO: 1412183 - RNA, 13 nt, Human
ccgccagcucugu

SEQ ID NO: 1412184 - RNA, 16 nt, Human
ccgccacuggggcuca

SEQ ID NO: 1412185 - RNA, 20 nt, Human
ccgccacuggggcucagagc

SEQ ID NO: 1412186 - RNA, 14 nt, Human
ccgccacuggggcu

SEQ ID NO: 1412187 - RNA, 13 nt, Human
ccgccacuggggc

SEQ ID NO: 1412188 - RNA, 16 nt, Human
ccgaccccaagaguuu

SEQ ID NO: 1412189 - RNA, 14 nt, Human
ccgaaugugucuuu

SEQ ID NO: 1412190 - RNA, 13 nt, Human
ccgaaugugucuu

SEQ ID NO: 1412191 - RNA, 15 nt, Human
ccgaaugugucuuua

SEQ ID NO: 1412192 - RNA, 23 nt, Human
ccgaaucucuuuuugcuuucgaa

SEQ ID NO: 1412193 - RNA, 12 nt, Human
cccuucuucccu

SEQ ID NO: 1412194 - RNA, 23 nt, Human
cccuucugcucagcucugggcca

SEQ ID NO: 1412195 - RNA, 14 nt, Human
cccuucugcucagc

SEQ ID NO: 1412196 - RNA, 17 nt, Human
cccuucuuuccacagaa

SEQ ID NO: 1412197 - RNA, 17 nt, Human
ccuggccccucucccuu

SEQ ID NO: 1412198 - RNA, 20 nt, Human
ccuggccccucucccuuggg

SEQ ID NO: 1412199 - RNA, 16 nt, Human
ccuggccccucucccu

SEQ ID NO: 1412200 - RNA, 15 nt, Human
ccuggccccucuccc

SEQ ID NO: 1412201 - RNA, 14 nt, Human
ccuggccccucucc

SEQ ID NO: 1412202 - RNA, 13 nt, Human
ccuggccccucuc

SEQ ID NO: 1412203 - RNA, 20 nt, Human
ccuggccgcccccugccccc

SEQ ID NO: 1412204 - RNA, 15 nt, Human
ccuggccgcccccug

SEQ ID NO: 1412205 - RNA, 23 nt, Human
ccuggcccugcuuccugcuugcc

SEQ ID NO: 1412206 - RNA, 21 nt, Human
ccuggcccugcuuccugcuug

SEQ ID NO: 1412207 - RNA, 17 nt, Human
ccuggcccugcuuccug

SEQ ID NO: 1412208 - RNA, 16 nt, Human
ccuggcccugcuuccu

SEQ ID NO: 1412209 - RNA, 14 nt, Human
ccuggcccugcuuc

SEQ ID NO: 1412210 - RNA, 13 nt, Human
ccuggcccugcuu

SEQ ID NO: 1412211 - RNA, 14 nt, Human
ccuggccgcccccu

SEQ ID NO: 1412212 - RNA, 12 nt, Human
ccuggccgcccc

SEQ ID NO: 1412213 - RNA, 19 nt, Human
ccuggccgaguccaagcug

SEQ ID NO: 1412214 - RNA, 18 nt, Human
ccuggccgaguccaagcu

SEQ ID NO: 1412215 - RNA, 23 nt, Human
ccuggaggccccaacccuguccu

SEQ ID NO: 1412216 - RNA, 16 nt, Human
ccuggaggcccaguuc

SEQ ID NO: 1412217 - RNA, 14 nt, Human
ccuggaggcccagu

SEQ ID NO: 1412218 - RNA, 13 nt, Human
ccuggaggcccag

SEQ ID NO: 1412219 - RNA, 12 nt, Human
ccuggaggccca

SEQ ID NO: 1412220 - RNA, 22 nt, Human
ccuggaggcacugaagugcuua

SEQ ID NO: 1412221 - RNA, 14 nt, Human
ccuggaggcacuga

SEQ ID NO: 1412222 - RNA, 21 nt, Human
ccuggaggaccugagccugcc

SEQ ID NO: 1412223 - RNA, 22 nt, Human
ccuggaggaccugagccugccg

SEQ ID NO: 1412224 - RNA, 20 nt, Human
ccuggaggaccugagccugc

SEQ ID NO: 1412225 - RNA, 19 nt, Human
ccuggaggaccugagccug

SEQ ID NO: 1412226 - RNA, 18 nt, Human
ccuggaggaccugagccu

SEQ ID NO: 1412227 - RNA, 17 nt, Human
ccuggaggaccugagcc

SEQ ID NO: 1412228 - RNA, 16 nt, Human
ccuggaggaccugagc

SEQ ID NO: 1412229 - RNA, 15 nt, Human
ccuggaggaccugag

SEQ ID NO: 1412230 - RNA, 14 nt, Human
ccuggaggaccuga

SEQ ID NO: 1412231 - RNA, 13 nt, Human
ccuggaggaccug

SEQ ID NO: 1412232 - RNA, 12 nt, Human
ccuggaggaccu

SEQ ID NO: 1412233 - RNA, 21 nt, Human
ccuggagcccuggagacccca

SEQ ID NO: 1412234 - RNA, 21 nt, Human
ccugccccaacucuccccuga

SEQ ID NO: 1412235 - RNA, 17 nt, Human
ccugccccaacuccuuc

SEQ ID NO: 1412236 - RNA, 15 nt, Human
ccugccccaacuccu

SEQ ID NO: 1412237 - RNA, 14 nt, Human
ccugccccaacucc

SEQ ID NO: 1412238 - RNA, 16 nt, Human
ccugcccaugggagcu

SEQ ID NO: 1412239 - RNA, 22 nt, Human
ccugcccaguugcacucaggug

SEQ ID NO: 1412240 - RNA, 16 nt, Human
ccugcccaguugcacu

SEQ ID NO: 1412241 - RNA, 16 nt, Human
ccugcccauuggagag

SEQ ID NO: 1412242 - RNA, 22 nt, Human
ccugcccagugcacuugcugga

SEQ ID NO: 1412243 - RNA, 18 nt, Human
ccugcccagugcacuugc

SEQ ID NO: 1412244 - RNA, 22 nt, Human
ccugccccaacuccuuccagcu

SEQ ID NO: 1412245 - RNA, 21 nt, Human
ccuggagggggaauggcagca

SEQ ID NO: 1412246 - RNA, 22 nt, Human
ccuggagggggaauggcagcag

SEQ ID NO: 1412247 - RNA, 22 nt, Human
ccuggaguguaugacugcacau

SEQ ID NO: 1412248 - RNA, 14 nt, Human
ccuggaugauacua

SEQ ID NO: 1412249 - RNA, 16 nt, Human
ccuggaugacauuaaa

SEQ ID NO: 1412250 - RNA, 14 nt, Human
ccuggaucucccug

SEQ ID NO: 1412251 - RNA, 17 nt, Human
ccuggaucagcguggcc

SEQ ID NO: 1412252 - RNA, 16 nt, Human
ccuggaucagcguggc

SEQ ID NO: 1412253 - RNA, 14 nt, Human
ccuggaucagcgug

SEQ ID NO: 1412254 - RNA, 17 nt, Human
ccuggaucagaacagga

SEQ ID NO: 1412255 - RNA, 20 nt, Human
ccuggaucagcguggccuug

SEQ ID NO: 1412256 - RNA, 19 nt, Human
ccuggaucagcguggccuu

SEQ ID NO: 1412257 - RNA, 18 nt, Human
ccuggaucagcguggccu

SEQ ID NO: 1412258 - RNA, 18 nt, Human
ccucugcugaccugcuga

SEQ ID NO: 1412259 - RNA, 20 nt, Human
ccucugcugcugucccuccc

SEQ ID NO: 1412260 - RNA, 19 nt, Human
ccucugcugcugucccucc

SEQ ID NO: 1412261 - RNA, 14 nt, Human
ccucugcugcuguc

SEQ ID NO: 1412262 - RNA, 15 nt, Human
ccucugcuucucacg

SEQ ID NO: 1412263 - RNA, 17 nt, Human
ccucugcugaccugcug

SEQ ID NO: 1412264 - RNA, 23 nt, Human
ccucucugcagacuucccagcua

SEQ ID NO: 1412265 - RNA, 22 nt, Human
ccucucugcagacuucccagcu

SEQ ID NO: 1412266 - RNA, 23 nt, Human
ccucucugcaggucccuaauaaa

SEQ ID NO: 1412267 - RNA, 21 nt, Human
ccucucugcaggucccuaaua

SEQ ID NO: 1412268 - RNA, 22 nt, Human
ccucucugcaggucccuaauaa

SEQ ID NO: 1412269 - RNA, 13 nt, Human
ccucucugcaggu

SEQ ID NO: 1412270 - RNA, 21 nt, Human
ccucucugcagacuucccagc

SEQ ID NO: 1412271 - RNA, 17 nt, Human
ccucucugcagacuucc

SEQ ID NO: 1412272 - RNA, 15 nt, Human
ccucucugcaggucc

SEQ ID NO: 1412273 - RNA, 22 nt, Human
ccugcaggaaggagcugccugg

SEQ ID NO: 1412274 - RNA, 21 nt, Human
ccugcaggaaggagcugccug

SEQ ID NO: 1412275 - RNA, 23 nt, Human
ccugcaggaaggagcugccugga

SEQ ID NO: 1412276 - RNA, 20 nt, Human
ccugcaggaaggagcugccu

SEQ ID NO: 1412277 - RNA, 19 nt, Human
ccugcaggaaggagcugcc

SEQ ID NO: 1412278 - RNA, 17 nt, Human
ccugcaggaaggagcug

SEQ ID NO: 1412279 - RNA, 14 nt, Human
ccugcaggaaggag

SEQ ID NO: 1412280 - RNA, 18 nt, Human
ccugagagauuuaacauu

SEQ ID NO: 1412281 - RNA, 17 nt, Human
ccugagaaagcucaaag

SEQ ID NO: 1412282 - RNA, 14 nt, Human
ccugagaaagcuca

SEQ ID NO: 1412283 - RNA, 15 nt, Human
ccugagacaaaugga

SEQ ID NO: 1412284 - RNA, 19 nt, Human
ccugagacaaauggaggcc

SEQ ID NO: 1412285 - RNA, 20 nt, Human
ccugagacaaauggaggccu

SEQ ID NO: 1412286 - RNA, 21 nt, Human
ccugagacaaauggaggccug

SEQ ID NO: 1412287 - RNA, 14 nt, Human
ccugagguuacugg

SEQ ID NO: 1412288 - RNA, 21 nt, Human
ccugaguacuccacacugcac

SEQ ID NO: 1412289 - RNA, 21 nt, Human
ccugaguagaaaggccuuuaa

SEQ ID NO: 1412290 - RNA, 23 nt, Human
ccugaguacuccacacugcacaa

SEQ ID NO: 1412291 - RNA, 14 nt, Human
ccugaguagaaagg

SEQ ID NO: 1412292 - RNA, 20 nt, Human
ccugaguagaaaggccuuua

SEQ ID NO: 1412293 - RNA, 18 nt, Human
ccugaguacuccacacug

SEQ ID NO: 1412294 - RNA, 17 nt, Human
ccugaguacuccacacu

SEQ ID NO: 1412295 - RNA, 13 nt, Human
ccugcaggaagga

SEQ ID NO: 1412296 - RNA, 21 nt, Human
ccugcagcuuguagccagccg

SEQ ID NO: 1412297 - RNA, 20 nt, Human
ccugcagcuuguagccagcc

SEQ ID NO: 1412298 - RNA, 19 nt, Human
ccugcagcuuguagccagc

SEQ ID NO: 1412299 - RNA, 18 nt, Human
ccugcagcuuguagccag

SEQ ID NO: 1412300 - RNA, 17 nt, Human
ccugcagcuuguagcca

SEQ ID NO: 1412301 - RNA, 16 nt, Human
ccugcagcuuguagcc

SEQ ID NO: 1412302 - RNA, 12 nt, Human
ccugcagcuugu

SEQ ID NO: 1412303 - RNA, 15 nt, Human
ccugcagacucacug

SEQ ID NO: 1412304 - RNA, 18 nt, Human
ccugcagacccugcccuu

SEQ ID NO: 1412305 - RNA, 17 nt, Human
ccugcagacccugcccu

SEQ ID NO: 1412306 - RNA, 16 nt, Human
ccugcagacccugccc

SEQ ID NO: 1412307 - RNA, 15 nt, Human
ccugcagacccugcc

SEQ ID NO: 1412308 - RNA, 14 nt, Human
ccugcagacccugc

SEQ ID NO: 1412309 - RNA, 13 nt, Human
ccugcagacccug

SEQ ID NO: 1412310 - RNA, 16 nt, Human
ccugcagaauuugggu

SEQ ID NO: 1412311 - RNA, 23 nt, Human
ccugcagaaccggagagccagcu

SEQ ID NO: 1412312 - RNA, 22 nt, Human
ccugcagaaccggagagccagc

SEQ ID NO: 1412313 - RNA, 21 nt, Human
ccugcagaaccggagagccag

SEQ ID NO: 1412314 - RNA, 17 nt, Human
ccucuugagcaguggcu

SEQ ID NO: 1412315 - RNA, 16 nt, Human
ccucuugagcaguggc

SEQ ID NO: 1412316 - RNA, 15 nt, Human
ccucuugagcagugg

SEQ ID NO: 1412317 - RNA, 14 nt, Human
ccucuugagcagug

SEQ ID NO: 1412318 - RNA, 20 nt, Human
ccucuugaccaggcugccuc

SEQ ID NO: 1412319 - RNA, 13 nt, Human
ccucuugagccuu

SEQ ID NO: 1412320 - RNA, 19 nt, Human
ccucuugagccuugaacuu

SEQ ID NO: 1412321 - RNA, 15 nt, Human
ccugaccuggccccc

SEQ ID NO: 1412322 - RNA, 14 nt, Human
ccugaccugucuca

SEQ ID NO: 1412323 - RNA, 14 nt, Human
ccugaccuggcccc

SEQ ID NO: 1412324 - RNA, 24 nt, Human
ccucuugagcaguggcugguccag

SEQ ID NO: 1412325 - RNA, 19 nt, Human
ccucuugagcaguggcugg

SEQ ID NO: 1412326 - RNA, 13 nt, Human
ccugaccucaggc

SEQ ID NO: 1412327 - RNA, 23 nt, Human
ccugacccuccaccgcagaagga

SEQ ID NO: 1412328 - RNA, 12 nt, Human
ccucuuuagagu

SEQ ID NO: 1412329 - RNA, 17 nt, Human
ccucuuuagaguuagac

SEQ ID NO: 1412330 - RNA, 19 nt, Human
ccucuuuagaguuagacug

SEQ ID NO: 1412331 - RNA, 16 nt, Human
ccccgacuucauccca

SEQ ID NO: 1412332 - RNA, 13 nt, Human
ccccgacuggggc

SEQ ID NO: 1412333 - RNA, 14 nt, Human
ccccgacuuuuguu

SEQ ID NO: 1412334 - RNA, 13 nt, Human
ccccggcagcagc

SEQ ID NO: 1412335 - RNA, 18 nt, Human
ccccggcagcagccccca

SEQ ID NO: 1412336 - RNA, 22 nt, Human
ccccaaacaccuuccagcuccu

SEQ ID NO: 1412337 - RNA, 18 nt, Human
ccccaaacaccuuccagc

SEQ ID NO: 1412338 - RNA, 19 nt, Human
ccccaaaagcgugagcuua

SEQ ID NO: 1412339 - RNA, 20 nt, Human
cccauuuaaauuuuuuuccu

SEQ ID NO: 1412340 - RNA, 23 nt, Human
ccccaucucaugccccuggcugg

SEQ ID NO: 1412341 - RNA, 21 nt, Human
ccccaucucaugccccuggcu

SEQ ID NO: 1412342 - RNA, 17 nt, Human
ccccaucucaggccaga

SEQ ID NO: 1412343 - RNA, 14 nt, Human
ccccaucucaggcc

SEQ ID NO: 1412344 - RNA, 13 nt, Human
ccccaucucaggc

SEQ ID NO: 1412345 - RNA, 22 nt, Human
ccccaucguugcccccauuucu

SEQ ID NO: 1412346 - RNA, 19 nt, Human
ccccaucguugcccccauu

SEQ ID NO: 1412347 - RNA, 16 nt, Human
ccccaucugcauuccc

SEQ ID NO: 1412348 - RNA, 18 nt, Human
ccccauuuagguuucuga

SEQ ID NO: 1412349 - RNA, 14 nt, Human
ccccauuucugagg

SEQ ID NO: 1412350 - RNA, 16 nt, Human
ccccagagcccccggg

SEQ ID NO: 1412351 - RNA, 14 nt, Human
ccccagagcccagg

SEQ ID NO: 1412352 - RNA, 13 nt, Human
ccccagagcccag

SEQ ID NO: 1412353 - RNA, 23 nt, Human
ccccagacuuguuggcguaggcu

SEQ ID NO: 1412354 - RNA, 16 nt, Human
ccccagagcccaggcu

SEQ ID NO: 1412355 - RNA, 12 nt, Human
ccccucugucca

SEQ ID NO: 1412356 - RNA, 23 nt, Human
ccccucuggucgcuccugcccac

SEQ ID NO: 1412357 - RNA, 20 nt, Human
ccccucuggucgcuccugcc

SEQ ID NO: 1412358 - RNA, 19 nt, Human
ccccucuggucgcuccugc

SEQ ID NO: 1412359 - RNA, 12 nt, Human
ccccucuggucg

SEQ ID NO: 1412360 - RNA, 14 nt, Human
cccgggagcucagg

SEQ ID NO: 1412361 - RNA, 21 nt, Human
cccggcugcagaggccagagg

SEQ ID NO: 1412362 - RNA, 16 nt, Human
cccggcugcagaggcc

SEQ ID NO: 1412363 - RNA, 22 nt, Human
cccggcuccuggucaccuagga

SEQ ID NO: 1412364 - RNA, 18 nt, Human
cccggcuccuggucaccu

SEQ ID NO: 1412365 - RNA, 15 nt, Human
cccggcuccugguca

SEQ ID NO: 1412366 - RNA, 13 nt, Human
cccggcuccuggu

SEQ ID NO: 1412367 - RNA, 13 nt, Human
cccuauuaaccua

SEQ ID NO: 1412368 - RNA, 23 nt, Human
ccccuuuccuggacacucagacc

SEQ ID NO: 1412369 - RNA, 22 nt, Human
ccccuuuccuggacacucagac

SEQ ID NO: 1412370 - RNA, 10 nt, Human
ccccuuuccu

SEQ ID NO: 1412371 - RNA, 14 nt, Human
ccccuuucccaccc

SEQ ID NO: 1412372 - RNA, 13 nt, Human
ccccuuucccacc

SEQ ID NO: 1412373 - RNA, 19 nt, Human
ccccuuucacaggcagcca

SEQ ID NO: 1412374 - RNA, 21 nt, Human
ccccuuucacaggcagccagu

SEQ ID NO: 1412375 - RNA, 16 nt, Human
ccccuuucacaggcag

SEQ ID NO: 1412376 - RNA, 15 nt, Human
ccccuuucacaggca

SEQ ID NO: 1412377 - RNA, 20 nt, Human
ccccuuuagaucucugaagc

SEQ ID NO: 1412378 - RNA, 18 nt, Human
ccccuuguccuuucccuu

SEQ ID NO: 1412379 - RNA, 15 nt, Human
ccccuuguccuuucc

SEQ ID NO: 1412380 - RNA, 19 nt, Human
ccccuugggcccacaccuc

SEQ ID NO: 1412381 - RNA, 18 nt, Human
ccccuugggcccacaccu

SEQ ID NO: 1412382 - RNA, 16 nt, Human
ccccuugggcccacac

SEQ ID NO: 1412383 - RNA, 16 nt, Human
ccccuugccugugcca

SEQ ID NO: 1412384 - RNA, 11 nt, Human
ccccuugccug

SEQ ID NO: 1412385 - RNA, 22 nt, Human
ccccucuguccaggcacugaga

SEQ ID NO: 1412386 - RNA, 14 nt, Human
ccccucuguccagg

SEQ ID NO: 1412387 - RNA, 12 nt, Human
ccccucugucuu

SEQ ID NO: 1412388 - RNA, 22 nt, Human
ccccuuuucggccccauguauc

SEQ ID NO: 1412389 - RNA, 16 nt, Human
cccacuucugcacuug

SEQ ID NO: 1412390 - RNA, 14 nt, Human
cccacuucugcacu

SEQ ID NO: 1412391 - RNA, 12 nt, Human
cccacuucugca

SEQ ID NO: 1412392 - RNA, 12 nt, Human
cccacucccaca

SEQ ID NO: 1412393 - RNA, 19 nt, Human
cccacuccaucugguagaa

SEQ ID NO: 1412394 - RNA, 18 nt, Human
cccacuccaucugguaga

SEQ ID NO: 1412395 - RNA, 14 nt, Human
cccacuccaucugg

SEQ ID NO: 1412396 - RNA, 22 nt, Human
cccacuagcucuuguugagccg

SEQ ID NO: 1412397 - RNA, 15 nt, Human
cccacuagcucuugu

SEQ ID NO: 1412398 - RNA, 20 nt, Human
cccacccuggccuagaccag

SEQ ID NO: 1412399 - RNA, 13 nt, Human
cccacccuggccu

SEQ ID NO: 1412400 - RNA, 14 nt, Human
cccacucccucaca

SEQ ID NO: 1412401 - RNA, 13 nt, Human
cccacucccucac

SEQ ID NO: 1412402 - RNA, 16 nt, Human
cccacucccaggacca

SEQ ID NO: 1412403 - RNA, 14 nt, Human
cccacugccuuuga

SEQ ID NO: 1412404 - RNA, 14 nt, Human
cccacuuacauuua

SEQ ID NO: 1412405 - RNA, 22 nt, Human
cccacugugccucagagaccag

SEQ ID NO: 1412406 - RNA, 15 nt, Human
cccacugugccucag

SEQ ID NO: 1412407 - RNA, 16 nt, Human
cccacugugccucaga

SEQ ID NO: 1412408 - RNA, 13 nt, Human
cccacuucagccu

SEQ ID NO: 1412409 - RNA, 15 nt, Human
cccacuucagccucc

SEQ ID NO: 1412410 - RNA, 13 nt, Human
cccacccccagcu

SEQ ID NO: 1412411 - RNA, 15 nt, Human
cccacccucuuccua

SEQ ID NO: 1412412 - RNA, 13 nt, Human
cccacccucuucc

SEQ ID NO: 1412413 - RNA, 22 nt, Human
cccacccucguggacaccugcc

SEQ ID NO: 1412414 - RNA, 23 nt, Human
cccacccucguggacaccugccc

SEQ ID NO: 1412415 - RNA, 14 nt, Human
cccacccccggcag

SEQ ID NO: 1412416 - RNA, 21 nt, Human
cccacccucggggaugugucc

SEQ ID NO: 1412417 - RNA, 20 nt, Human
cccacccucguggacaccug

SEQ ID NO: 1412418 - RNA, 22 nt, Human
cccagggcccagagcccagcuc

SEQ ID NO: 1412419 - RNA, 20 nt, Human
cccagggcccagagcccagc

SEQ ID NO: 1412420 - RNA, 19 nt, Human
cccagggcccagagcccag

SEQ ID NO: 1412421 - RNA, 17 nt, Human
cccagggcccagagccc

SEQ ID NO: 1412422 - RNA, 16 nt, Human
cccagggcccagagcc

SEQ ID NO: 1412423 - RNA, 15 nt, Human
cccagggcccagagc

SEQ ID NO: 1412424 - RNA, 14 nt, Human
cccagggcccagag

SEQ ID NO: 1412425 - RNA, 13 nt, Human
cccagggcccaga

SEQ ID NO: 1412426 - RNA, 21 nt, Human
cccauaugcuaccaccagcug

SEQ ID NO: 1412427 - RNA, 20 nt, Human
cccauaugcuaccaccagcu

SEQ ID NO: 1412428 - RNA, 19 nt, Human
cccauauuguaaaacaggu

SEQ ID NO: 1412429 - RNA, 18 nt, Human
cccauauuguaaaacagg

SEQ ID NO: 1412430 - RNA, 15 nt, Human
cccauauuguaaaac

SEQ ID NO: 1412431 - RNA, 19 nt, Human
cccaggcuggagugcagug

SEQ ID NO: 1412432 - RNA, 16 nt, Human
cccaggaaaggcccag

SEQ ID NO: 1412433 - RNA, 19 nt, Human
cccaggaaaggcaggauug

SEQ ID NO: 1412434 - RNA, 14 nt, Human
cccauccuagaggc

SEQ ID NO: 1412435 - RNA, 19 nt, Human
ccauguccaaagaggcugc

SEQ ID NO: 1412436 - RNA, 18 nt, Human
ccauguccaaagaggcug

SEQ ID NO: 1412437 - RNA, 20 nt, Human
ccauguccaaagaggcugcc

SEQ ID NO: 1412438 - RNA, 20 nt, Human
ccauguaacugccuagaaac

SEQ ID NO: 1412439 - RNA, 16 nt, Human
ccaugucaaacaaaua

SEQ ID NO: 1412440 - RNA, 17 nt, Human
ccauguccaaagaggcu

SEQ ID NO: 1412441 - RNA, 14 nt, Human
ccauguccaaagag

SEQ ID NO: 1412442 - RNA, 13 nt, Human
ccauguccaaaga

SEQ ID NO: 1412443 - RNA, 20 nt, Human
ccaugacccugccucuccca

SEQ ID NO: 1412444 - RNA, 19 nt, Human
ccaugacccugccucuccc

SEQ ID NO: 1412445 - RNA, 18 nt, Human
ccaugacccugccucucc

SEQ ID NO: 1412446 - RNA, 17 nt, Human
ccaugacccugccucuc

SEQ ID NO: 1412447 - RNA, 16 nt, Human
ccaugacccugccucu

SEQ ID NO: 1412448 - RNA, 12 nt, Human
ccaugagcuccu

SEQ ID NO: 1412449 - RNA, 19 nt, Human
ccauguaacugccuagaaa

SEQ ID NO: 1412450 - RNA, 18 nt, Human
ccauguaacugccuagaa

SEQ ID NO: 1412451 - RNA, 17 nt, Human
ccauguaacugccuaga

SEQ ID NO: 1412452 - RNA, 14 nt, Human
ccauguaacugccu

SEQ ID NO: 1412453 - RNA, 11 nt, Human
ccauguaacug

SEQ ID NO: 1412454 - RNA, 20 nt, Human
ccaugguuaagaguccaaga

SEQ ID NO: 1412455 - RNA, 17 nt, Human
ccauggugcuaggaaga

SEQ ID NO: 1412456 - RNA, 19 nt, Human
ccauggugugaucgucuga

SEQ ID NO: 1412457 - RNA, 18 nt, Human
ccauggugugaucgucug

SEQ ID NO: 1412458 - RNA, 22 nt, Human
ccauggugcuaggaagaggagu

SEQ ID NO: 1412459 - RNA, 20 nt, Human
ccauggucggaaaacaugcu

SEQ ID NO: 1412460 - RNA, 15 nt, Human
ccaugacccugccuc

SEQ ID NO: 1412461 - RNA, 14 nt, Human
ccaugacaucaaga

SEQ ID NO: 1412462 - RNA, 22 nt, Human
ccaugacaacuucuaauugcca

SEQ ID NO: 1412463 - RNA, 21 nt, Human
ccaguuucuaaacuggagacu

SEQ ID NO: 1412464 - RNA, 20 nt, Human
ccaguuucuaaacuggagac

SEQ ID NO: 1412465 - RNA, 19 nt, Human
ccaguuucuaaacuggaga

SEQ ID NO: 1412466 - RNA, 17 nt, Human
ccaguuucuaaacugga

SEQ ID NO: 1412467 - RNA, 16 nt, Human
ccaguuuccuugggag

SEQ ID NO: 1412468 - RNA, 21 nt, Human
ccaguuguuagauuaagaaau

SEQ ID NO: 1412469 - RNA, 22 nt, Human
ccaguugucccgauuguaacuc

SEQ ID NO: 1412470 - RNA, 21 nt, Human
ccaguugucccgauuguaacu

SEQ ID NO: 1412471 - RNA, 13 nt, Human
ccaguucacccug

SEQ ID NO: 1412472 - RNA, 18 nt, Human
ccaguucauugcacuuug

SEQ ID NO: 1412473 - RNA, 17 nt, Human
ccaguucauugcacuuu

SEQ ID NO: 1412474 - RNA, 17 nt, Human
ccaggguaugaagagug

SEQ ID NO: 1412475 - RNA, 18 nt, Human
ccagggucccucugugua

SEQ ID NO: 1412476 - RNA, 17 nt, Human
ccagggucccucugugu

SEQ ID NO: 1412477 - RNA, 16 nt, Human
ccagggucccucugug

SEQ ID NO: 1412478 - RNA, 15 nt, Human
ccaggcaccaggcag

SEQ ID NO: 1412479 - RNA, 17 nt, Human
ccaggcaccaaaagaag

SEQ ID NO: 1412480 - RNA, 19 nt, Human
ccaggcagauccaggacua

SEQ ID NO: 1412481 - RNA, 18 nt, Human
ccaggcagauccaggacu

SEQ ID NO: 1412482 - RNA, 17 nt, Human
ccaggcagauccaggac

SEQ ID NO: 1412483 - RNA, 16 nt, Human
ccaggcagauccagga

SEQ ID NO: 1412484 - RNA, 15 nt, Human
ccaggcagauccagg

SEQ ID NO: 1412485 - RNA, 13 nt, Human
ccaggcagaucca

SEQ ID NO: 1412486 - RNA, 15 nt, Human
ccaggcacugucuua

SEQ ID NO: 1412487 - RNA, 16 nt, Human
ccaggcacugcuaggc

SEQ ID NO: 1412488 - RNA, 13 nt, Human
ccaggcacugcaa

SEQ ID NO: 1412489 - RNA, 12 nt, Human
ccaggcacugca

SEQ ID NO: 1412490 - RNA, 13 nt, Human
ccagggguuucuc

SEQ ID NO: 1412491 - RNA, 22 nt, Human
ccagggcuguaacugccaggcu

SEQ ID NO: 1412492 - RNA, 20 nt, Human
ccagggcuguaacugccagg

SEQ ID NO: 1412493 - RNA, 19 nt, Human
ccagggcuguaacugccag

SEQ ID NO: 1412494 - RNA, 21 nt, Human
ccagggcugggaggaaggacu

SEQ ID NO: 1412495 - RNA, 19 nt, Human
ccagggcugggaggaagga

SEQ ID NO: 1412496 - RNA, 18 nt, Human
ccagggcugggaggaagg

SEQ ID NO: 1412497 - RNA, 15 nt, Human
ccagggcugggagga

SEQ ID NO: 1412498 - RNA, 23 nt, Human
ccaggcucguggacugaguggga

SEQ ID NO: 1412499 - RNA, 21 nt, Human
ccaggcucguggacugagugg

SEQ ID NO: 1412500 - RNA, 20 nt, Human
ccaggcucguggacugagug

SEQ ID NO: 1412501 - RNA, 18 nt, Human
ccaggcucguggacugag

SEQ ID NO: 1412502 - RNA, 17 nt, Human
ccaggcucggccugccc

SEQ ID NO: 1412503 - RNA, 16 nt, Human
ccaggcucggccugcc

SEQ ID NO: 1412504 - RNA, 23 nt, Human
ccagcagcugccaggagcacggc

SEQ ID NO: 1412505 - RNA, 22 nt, Human
ccagcagcuuuagaaucccagc

SEQ ID NO: 1412506 - RNA, 20 nt, Human
ccagcagcugccaggagcac

SEQ ID NO: 1412507 - RNA, 10 nt, Human
ccagcagcug

SEQ ID NO: 1412508 - RNA, 14 nt, Human
ccagcagcaccugc

SEQ ID NO: 1412509 - RNA, 20 nt, Human
ccagcagcaccugcccuacc

SEQ ID NO: 1412510 - RNA, 18 nt, Human
ccagcagauuuccagccu

SEQ ID NO: 1412511 - RNA, 23 nt, Human
ccaggaaacucugcauucuagua

SEQ ID NO: 1412512 - RNA, 22 nt, Human
ccagcucaauggacuggaaggg

SEQ ID NO: 1412513 - RNA, 22 nt, Human
ccagcuacccuuuuucuccagc

SEQ ID NO: 1412514 - RNA, 21 nt, Human
ccagcuacccuuuuucuccag

SEQ ID NO: 1412515 - RNA, 16 nt, Human
ccagcuacccuuuuuc

SEQ ID NO: 1412516 - RNA, 20 nt, Human
ccagccccucuuggagaagu

SEQ ID NO: 1412517 - RNA, 21 nt, Human
ccagccccucuuggagaaguc

SEQ ID NO: 1412518 - RNA, 18 nt, Human
ccagccccucuuggagaa

SEQ ID NO: 1412519 - RNA, 13 nt, Human
ccagccccucuug

SEQ ID NO: 1412520 - RNA, 23 nt, Human
ccagccccucuggucgcuccugc

SEQ ID NO: 1412521 - RNA, 22 nt, Human
ccagccccucuggucgcuccug

SEQ ID NO: 1412522 - RNA, 17 nt, Human
ccagccccucuggucgc

SEQ ID NO: 1412523 - RNA, 15 nt, Human
ccagccccucugguc

SEQ ID NO: 1412524 - RNA, 10 nt, Human
ccaggaagcc

SEQ ID NO: 1412525 - RNA, 14 nt, Human
ccaggaacugggcc

SEQ ID NO: 1412526 - RNA, 17 nt, Human
ccaggaagaucccccag

SEQ ID NO: 1412527 - RNA, 18 nt, Human
ccaggaagaucccccaga

SEQ ID NO: 1412528 - RNA, 19 nt, Human
ccaggaagaucccccagaa

SEQ ID NO: 1412529 - RNA, 19 nt, Human
ccaggaacagcaaaugcaa

SEQ ID NO: 1412530 - RNA, 20 nt, Human
ccagcuuauagucauauaua

SEQ ID NO: 1412531 - RNA, 20 nt, Human
ccaggaaagcgccuccaacc

SEQ ID NO: 1412532 - RNA, 22 nt, Human
ccagagucccugccuggaccag

SEQ ID NO: 1412533 - RNA, 19 nt, Human
ccagagucccugccuggac

SEQ ID NO: 1412534 - RNA, 18 nt, Human
ccagagucccugccugga

SEQ ID NO: 1412535 - RNA, 17 nt, Human
ccagagucccugccugg

SEQ ID NO: 1412536 - RNA, 16 nt, Human
ccagagucccugccug

SEQ ID NO: 1412537 - RNA, 16 nt, Human
ccagauccagccuggg

SEQ ID NO: 1412538 - RNA, 15 nt, Human
ccagauccagccugg

SEQ ID NO: 1412539 - RNA, 14 nt, Human
ccagauccagccug

SEQ ID NO: 1412540 - RNA, 13 nt, Human
ccagauccagccu

SEQ ID NO: 1412541 - RNA, 15 nt, Human
ccagauccuggaaau

SEQ ID NO: 1412542 - RNA, 18 nt, Human
ccagagugcugaaggaau

SEQ ID NO: 1412543 - RNA, 20 nt, Human
ccuucugggcagaccuugac

SEQ ID NO: 1412544 - RNA, 16 nt, Human
ccuggccuccugccuc

SEQ ID NO: 1412545 - RNA, 11 nt, Human
ccuucugcugc

SEQ ID NO: 1412546 - RNA, 17 nt, Human
ccuucugcucagcucug

SEQ ID NO: 1412547 - RNA, 12 nt, Human
ccuucugcucag

SEQ ID NO: 1412548 - RNA, 22 nt, Human
ccuucugagcuccuguccccug

SEQ ID NO: 1412549 - RNA, 21 nt, Human
ccuucugagcuccuguccccu

SEQ ID NO: 1412550 - RNA, 17 nt, Human
ccuucugagcuccuguc

SEQ ID NO: 1412551 - RNA, 15 nt, Human
ccuucugagcuccug

SEQ ID NO: 1412552 - RNA, 14 nt, Human
ccuucugagcuccu

SEQ ID NO: 1412553 - RNA, 21 nt, Human
ccuggccuccugccucuacug

SEQ ID NO: 1412554 - RNA, 18 nt, Human
ccuggccuccugccucua

SEQ ID NO: 1412555 - RNA, 17 nt, Human
ccuggccuccugccucu

SEQ ID NO: 1412556 - RNA, 20 nt, Human
ccuugccucaaugccaguaa

SEQ ID NO: 1412557 - RNA, 19 nt, Human
ccuugccucaaugccagua

SEQ ID NO: 1412558 - RNA, 16 nt, Human
ccuugccucaaugcca

SEQ ID NO: 1412559 - RNA, 15 nt, Human
ccuugccucaaugcc

SEQ ID NO: 1412560 - RNA, 21 nt, Human
ccuuuugaaauuaaccucuca

SEQ ID NO: 1412561 - RNA, 14 nt, Human
ccuuuucuguucua

SEQ ID NO: 1412562 - RNA, 13 nt, Human
ccuuuucugacca

SEQ ID NO: 1412563 - RNA, 18 nt, Human
ccuuuucugaccaaagag

SEQ ID NO: 1412564 - RNA, 12 nt, Human
ccuuuucugacc

SEQ ID NO: 1412565 - RNA, 19 nt, Human
ccuuucccaggugcuacac

SEQ ID NO: 1412566 - RNA, 22 nt, Human
ccuuucccaccccaaccugcuc

SEQ ID NO: 1412567 - RNA, 18 nt, Human
ccuuucccaccccaaccu

SEQ ID NO: 1412568 - RNA, 12 nt, Human
ccuuucccaccc

SEQ ID NO: 1412569 - RNA, 11 nt, Human
ccuuucccacc

SEQ ID NO: 1412570 - RNA, 18 nt, Human
ccuuuccauccauggcca

SEQ ID NO: 1412571 - RNA, 22 nt, Human
ccuuuccauaaauccuugauga

SEQ ID NO: 1412572 - RNA, 20 nt, Human
ccuuuccauaaauccuugau

SEQ ID NO: 1412573 - RNA, 17 nt, Human
ccuuuagaucucugaag

SEQ ID NO: 1412574 - RNA, 17 nt, Human
ccuuggacauccuccuc

SEQ ID NO: 1412575 - RNA, 16 nt, Human
ccuuggacauccuccu

SEQ ID NO: 1412576 - RNA, 18 nt, Human
ccuuggacaacuuuucuc

SEQ ID NO: 1412577 - RNA, 12 nt, Human
ccuugcuuguua

SEQ ID NO: 1412578 - RNA, 13 nt, Human
ccuuuagguucuu

SEQ ID NO: 1412579 - RNA, 23 nt, Human
ccuuuccaccacagccagcaccu

SEQ ID NO: 1412580 - RNA, 16 nt, Human
ccuuuagaucucugaa

SEQ ID NO: 1412581 - RNA, 16 nt, Human
ccuuggacacgcucag

SEQ ID NO: 1412582 - RNA, 17 nt, Human
ccuuuuuuauacauaaa

SEQ ID NO: 1412583 - RNA, 18 nt, Human
ccuuuuuuauacauaaac

SEQ ID NO: 1412584 - RNA, 22 nt, Human
ccuuuuuuaggaagcaagcuua

SEQ ID NO: 1412585 - RNA, 21 nt, Human
cgacaguggaugcugggucca

SEQ ID NO: 1412586 - RNA, 19 nt, Human
ccuuuuuuauacauaaaca

SEQ ID NO: 1412587 - RNA, 16 nt, Human
ccuuuuucuccagcug

SEQ ID NO: 1412588 - RNA, 14 nt, Human
ccuuuuucuccagc

SEQ ID NO: 1412589 - RNA, 17 nt, Human
ccuuuuuccucuccaca

SEQ ID NO: 1412590 - RNA, 16 nt, Human
ccuuuuuccucuccac

SEQ ID NO: 1412591 - RNA, 15 nt, Human
ccuuuuuccucucca

SEQ ID NO: 1412592 - RNA, 13 nt, Human
ccuuuuuccucuc

SEQ ID NO: 1412593 - RNA, 12 nt, Human
ccuuuuuuauac

SEQ ID NO: 1412594 - RNA, 15 nt, Human
ccuuuuggguuucug

SEQ ID NO: 1412595 - RNA, 21 nt, Human
ccuuuuggguuucugcccugc

SEQ ID NO: 1412596 - RNA, 13 nt, Human
ccuuuuucauuua

SEQ ID NO: 1412597 - RNA, 13 nt, Human
cgaccgcccccuc

SEQ ID NO: 1412598 - RNA, 13 nt, Human
cgaccgccccagu

SEQ ID NO: 1412599 - RNA, 13 nt, Human
cgaccaucugauu

SEQ ID NO: 1412600 - RNA, 18 nt, Human
cgaguggagucugccacc

SEQ ID NO: 1412601 - RNA, 19 nt, Human
cgaguggagucugccaccc

SEQ ID NO: 1412602 - RNA, 14 nt, Human
cgaguggagucugc

SEQ ID NO: 1412603 - RNA, 15 nt, Human
cgagugcucauuuca

SEQ ID NO: 1412604 - RNA, 20 nt, Human
cgcccuuuccuccucaggca

SEQ ID NO: 1412605 - RNA, 15 nt, Human
cgccgucuccagggg

SEQ ID NO: 1412606 - RNA, 12 nt, Human
cgccgccucuuu

SEQ ID NO: 1412607 - RNA, 15 nt, Human
cgccggaucugaggg

SEQ ID NO: 1412608 - RNA, 21 nt, Human
cggagccacuccucugacuca

SEQ ID NO: 1412609 - RNA, 18 nt, Human
cggagccacuccucugac

SEQ ID NO: 1412610 - RNA, 17 nt, Human
cggagccacuccucuga

SEQ ID NO: 1412611 - RNA, 13 nt, Human
cggagccacuccu

SEQ ID NO: 1412612 - RNA, 11 nt, Human
cggagccacuc

SEQ ID NO: 1412613 - RNA, 20 nt, Human
cggcucggaggaagccccca

SEQ ID NO: 1412614 - RNA, 16 nt, Human
cggcucggaggaagcc

SEQ ID NO: 1412615 - RNA, 13 nt, Human
cggcuccugguca

SEQ ID NO: 1412616 - RNA, 19 nt, Human
cggcuccuggucaccuagg

SEQ ID NO: 1412617 - RNA, 11 nt, Human
cggcuccuggu

SEQ ID NO: 1412618 - RNA, 20 nt, Human
cggcuccucagggacucagg

SEQ ID NO: 1412619 - RNA, 14 nt, Human
cggcuccucaggga

SEQ ID NO: 1412620 - RNA, 13 nt, Human
cggcuccucaggg

SEQ ID NO: 1412621 - RNA, 23 nt, Human
cggcuccucgagaucccaacacu

SEQ ID NO: 1412622 - RNA, 17 nt, Human
cggcggccccuagcgcu

SEQ ID NO: 1412623 - RNA, 16 nt, Human
cggagguguggagccg

SEQ ID NO: 1412624 - RNA, 22 nt, Human
cggagguugggugggccggcuu

SEQ ID NO: 1412625 - RNA, 17 nt, Human
cggagucaaaaauuaaa

SEQ ID NO: 1412626 - RNA, 17 nt, Human
cuagccaaaccucacca

SEQ ID NO: 1412627 - RNA, 13 nt, Human
cuagccaaaccuc

SEQ ID NO: 1412628 - RNA, 19 nt, Human
cuagcauuucccaacacaa

SEQ ID NO: 1412629 - RNA, 23 nt, Human
cuagcauuguaaaauuauuucau

SEQ ID NO: 1412630 - RNA, 22 nt, Human
cuagcauuguaaaauuauuuca

SEQ ID NO: 1412631 - RNA, 21 nt, Human
cuagccaaaccucaccaacuc

SEQ ID NO: 1412632 - RNA, 20 nt, Human
cuagccaaaccucaccaacu

SEQ ID NO: 1412633 - RNA, 18 nt, Human
cuagccaaaccucaccaa

SEQ ID NO: 1412634 - RNA, 15 nt, Human
cuagccccuggggug

SEQ ID NO: 1412635 - RNA, 21 nt, Human
cuagcaguggcaggcagaggc

SEQ ID NO: 1412636 - RNA, 20 nt, Human
cuagcaguggcaggcagagg

SEQ ID NO: 1412637 - RNA, 18 nt, Human
cuagcaguggcaggcaga

SEQ ID NO: 1412638 - RNA, 15 nt, Human
cuagcaguggcaggc

SEQ ID NO: 1412639 - RNA, 13 nt, Human
cuagcaguggcag

SEQ ID NO: 1412640 - RNA, 22 nt, Human
cuagaacacaggcaaaauccuu

SEQ ID NO: 1412641 - RNA, 21 nt, Human
cuagaacacaggcaaaauccu

SEQ ID NO: 1412642 - RNA, 19 nt, Human
cuagaacacaggcaaaauc

SEQ ID NO: 1412643 - RNA, 14 nt, Human
cuagaacacaggca

SEQ ID NO: 1412644 - RNA, 20 nt, Human
cuaccugacacucccuuggg

SEQ ID NO: 1412645 - RNA, 19 nt, Human
cuaccugacacucccuugg

SEQ ID NO: 1412646 - RNA, 18 nt, Human
cuagggccaagcccagca

SEQ ID NO: 1412647 - RNA, 17 nt, Human
cuagggccaagcccagc

SEQ ID NO: 1412648 - RNA, 16 nt, Human
cuagggccaagcccag

SEQ ID NO: 1412649 - RNA, 23 nt, Human
cuagggaucccucaucugucccu

SEQ ID NO: 1412650 - RNA, 17 nt, Human
cuagggaucccucaucu

SEQ ID NO: 1412651 - RNA, 13 nt, Human
cuagggaucccuc

SEQ ID NO: 1412652 - RNA, 19 nt, Human
cuagcccucucacauuuau

SEQ ID NO: 1412653 - RNA, 18 nt, Human
cuagcccucucacauuua

SEQ ID NO: 1412654 - RNA, 13 nt, Human
cuagcccucucac

SEQ ID NO: 1412655 - RNA, 19 nt, Human
cuagcccuccuuuuuccaa

SEQ ID NO: 1412656 - RNA, 18 nt, Human
cuagcccuccuuuuucca

SEQ ID NO: 1412657 - RNA, 17 nt, Human
cuagcccuccuuuuucc

SEQ ID NO: 1412658 - RNA, 13 nt, Human
cuagccucagggg

SEQ ID NO: 1412659 - RNA, 20 nt, Human
cuagccucaggggucugagc

SEQ ID NO: 1412660 - RNA, 17 nt, Human
cuauaagaacuuugagc

SEQ ID NO: 1412661 - RNA, 16 nt, Human
cuauaaccagacacau

SEQ ID NO: 1412662 - RNA, 16 nt, Human
cuaguucuguagaaau

SEQ ID NO: 1412663 - RNA, 17 nt, Human
cuaguucuguagaaaug

SEQ ID NO: 1412664 - RNA, 23 nt, Human
cuaguucuguagaaaugguugua

SEQ ID NO: 1412665 - RNA, 21 nt, Human
cuaguucuucaucccacucca

SEQ ID NO: 1412666 - RNA, 22 nt, Human
cuaguucuuuguucauagccca

SEQ ID NO: 1412667 - RNA, 23 nt, Human
cuaguugaucagcuuauugucua

SEQ ID NO: 1412668 - RNA, 14 nt, Human
cuaagucuuuccau

SEQ ID NO: 1412669 - RNA, 11 nt, Human
cuaauuuaaca

SEQ ID NO: 1412670 - RNA, 22 nt, Human
cuaauuggcaugaaggugucau

SEQ ID NO: 1412671 - RNA, 18 nt, Human
cuaauugcuuauuuauug

SEQ ID NO: 1412672 - RNA, 14 nt, Human
cuaauugcuuauuu

SEQ ID NO: 1412673 - RNA, 13 nt, Human
cuaauugcuuauu

SEQ ID NO: 1412674 - RNA, 16 nt, Human
cuaagugauauaaauc

SEQ ID NO: 1412675 - RNA, 14 nt, Human
cuaagugauauaaa

SEQ ID NO: 1412676 - RNA, 12 nt, Human
cuaauugcuuau

SEQ ID NO: 1412677 - RNA, 11 nt, Human
cuaauugcuua

SEQ ID NO: 1412678 - RNA, 13 nt, Human
cuaagugauauaa

SEQ ID NO: 1412679 - RNA, 16 nt, Human
cuaagucuuuccauug

SEQ ID NO: 1412680 - RNA, 10 nt, Human
cuacaaauca

SEQ ID NO: 1412681 - RNA, 20 nt, Human
cuacaaagguuuaaaugaac

SEQ ID NO: 1412682 - RNA, 19 nt, Human
cuacaaagguuuaaaugaa

SEQ ID NO: 1412683 - RNA, 18 nt, Human
cuacaaagguuuaaauga

SEQ ID NO: 1412684 - RNA, 17 nt, Human
cuacaaagguuuaaaug

SEQ ID NO: 1412685 - RNA, 15 nt, Human
cuacaaagguuuaaa

SEQ ID NO: 1412686 - RNA, 15 nt, Human
cuacaaccaauggaa

SEQ ID NO: 1412687 - RNA, 22 nt, Human
cuacaaagguuuaaaugaacaa

SEQ ID NO: 1412688 - RNA, 21 nt, Human
cuacaaagguuuaaaugaaca

SEQ ID NO: 1412689 - RNA, 16 nt, Human
cuacaaccuccgccuc

SEQ ID NO: 1412690 - RNA, 18 nt, Human
cuaauuuuuauuuuugcu

SEQ ID NO: 1412691 - RNA, 17 nt, Human
cuaauuuuuauuaauuu

SEQ ID NO: 1412692 - RNA, 22 nt, Human
cuaauuuuuauuaauuuuaguu

SEQ ID NO: 1412693 - RNA, 22 nt, Human
cuaauuuuuaagaauugaguaa

SEQ ID NO: 1412694 - RNA, 12 nt, Human
cuaauuuauaaa

SEQ ID NO: 1412695 - RNA, 20 nt, Human
cuaauuuuuguaauuuuagu

SEQ ID NO: 1412696 - RNA, 14 nt, Human
cuaauuuuuguaau

SEQ ID NO: 1412697 - RNA, 21 nt, Human
cuaauuuuuauuuuugcugag

SEQ ID NO: 1412698 - RNA, 11 nt, Human
cuaauuuuugu

SEQ ID NO: 1412699 - RNA, 16 nt, Human
cuaauuuuuuguuguu

SEQ ID NO: 1412700 - RNA, 14 nt, Human
cuaauuuuuuguug

SEQ ID NO: 1412701 - RNA, 23 nt, Human
cuaauuuuuguauuuuuaguaga

SEQ ID NO: 1412702 - RNA, 13 nt, Human
cuaauuuuuguau

SEQ ID NO: 1412703 - RNA, 20 nt, Human
cuaauuuuuguauuuuuagu

SEQ ID NO: 1412704 - RNA, 21 nt, Human
cuaauuuuuuuguauuuuagc

SEQ ID NO: 1412705 - RNA, 20 nt, Human
cuaauuuuuuuguauuuuag

SEQ ID NO: 1412706 - RNA, 16 nt, Human
cuaauuuuuuuguauu

SEQ ID NO: 1412707 - RNA, 13 nt, Human
cuaauuuuuuugu

SEQ ID NO: 1412708 - RNA, 19 nt, Human
cuacaguuuuaacugugga

SEQ ID NO: 1412709 - RNA, 20 nt, Human
cuacaguuuuaacuguggau

SEQ ID NO: 1412710 - RNA, 18 nt, Human
cuacaguuuuaacugugg

SEQ ID NO: 1412711 - RNA, 17 nt, Human
cuacaguuuuaacugug

SEQ ID NO: 1412712 - RNA, 15 nt, Human
cuacauaauuuaguu

SEQ ID NO: 1412713 - RNA, 13 nt, Human
cuacaugagaaca

SEQ ID NO: 1412714 - RNA, 18 nt, Human
cuacaugaaacagaaaca

SEQ ID NO: 1412715 - RNA, 16 nt, Human
cuacaugaaacagaaa

SEQ ID NO: 1412716 - RNA, 15 nt, Human
cuacaugaaacagaa

SEQ ID NO: 1412717 - RNA, 17 nt, Human
cuacaugagaacaaaca

SEQ ID NO: 1412718 - RNA, 14 nt, Human
cuacaugagaacaa

SEQ ID NO: 1412719 - RNA, 18 nt, Human
cuaccucuccagccucag

SEQ ID NO: 1412720 - RNA, 21 nt, Human
cuaaagauggaguuucuaagg

SEQ ID NO: 1412721 - RNA, 20 nt, Human
cuaaagauggaguuucuaag

SEQ ID NO: 1412722 - RNA, 19 nt, Human
cuaaagauggaguuucuaa

SEQ ID NO: 1412723 - RNA, 18 nt, Human
cuaaagauggaguuucua

SEQ ID NO: 1412724 - RNA, 17 nt, Human
cuaaagauggaguuucu

SEQ ID NO: 1412725 - RNA, 21 nt, Human
cuaaccugccgagaguccauc

SEQ ID NO: 1412726 - RNA, 19 nt, Human
cuaaccugccgagagucca

SEQ ID NO: 1412727 - RNA, 17 nt, Human
cuaaagauucuauaguu

SEQ ID NO: 1412728 - RNA, 14 nt, Human
cuaaagauucuaua

SEQ ID NO: 1412729 - RNA, 12 nt, Human
cuaaagauucua

SEQ ID NO: 1412730 - RNA, 23 nt, Human
cuaaagauggaguuucuaagguc

SEQ ID NO: 1412731 - RNA, 12 nt, Human
cuaaccugccga

SEQ ID NO: 1412732 - RNA, 20 nt, Human
cuaaccuugccugguacagu

SEQ ID NO: 1412733 - RNA, 17 nt, Human
cuaaccuugccugguac

SEQ ID NO: 1412734 - RNA, 16 nt, Human
cuaaccuugccuggua

SEQ ID NO: 1412735 - RNA, 13 nt, Human
cuaaccuugccug

SEQ ID NO: 1412736 - RNA, 18 nt, Human
cuaaagauucuauaguuc

SEQ ID NO: 1412737 - RNA, 15 nt, Human
cuaacuucaccauau

SEQ ID NO: 1412738 - RNA, 21 nt, Human
cuaaccuuuacaugaggacuc

SEQ ID NO: 1412739 - RNA, 13 nt, Human
cuaaccuuuacau

SEQ ID NO: 1412740 - RNA, 21 nt, Human
cuaaccuugccugguacagua

SEQ ID NO: 1412741 - RNA, 16 nt, Human
cuaacuucaccauauu

SEQ ID NO: 1412742 - RNA, 15 nt, Human
cuaagaaagaacacg

SEQ ID NO: 1412743 - RNA, 12 nt, Human
cuaagaaagaac

SEQ ID NO: 1412744 - RNA, 21 nt, Human
cuaagaaacauuuauauugau

SEQ ID NO: 1412745 - RNA, 20 nt, Human
cuaagaaacauuuauauuga

SEQ ID NO: 1412746 - RNA, 19 nt, Human
cuaagaaacauuuauauug

SEQ ID NO: 1412747 - RNA, 22 nt, Human
cuaagaaacauuuauauugaua

SEQ ID NO: 1412748 - RNA, 16 nt, Human
cuaagaaacuuaaauu

SEQ ID NO: 1412749 - RNA, 23 nt, Human
cggcugaccaugcucaucugcug

SEQ ID NO: 1412750 - RNA, 22 nt, Human
cggcugaccaugcucaucugcu

SEQ ID NO: 1412751 - RNA, 16 nt, Human
cggcugaccaugcuca

SEQ ID NO: 1412752 - RNA, 15 nt, Human
cggcugaccaugcuc

SEQ ID NO: 1412753 - RNA, 14 nt, Human
cggcugaccaugcu

SEQ ID NO: 1412754 - RNA, 11 nt, Human
cggcugaccau

SEQ ID NO: 1412755 - RNA, 17 nt, Human
cggcucuguccccagcc

SEQ ID NO: 1412756 - RNA, 19 nt, Human
cggcucuguccccagccug

SEQ ID NO: 1412757 - RNA, 16 nt, Human
cggcucuguccccagc

SEQ ID NO: 1412758 - RNA, 15 nt, Human
cggcucuguccccag

SEQ ID NO: 1412759 - RNA, 14 nt, Human
cggcucugucccca

SEQ ID NO: 1412760 - RNA, 18 nt, Human
cggcucucaccuggcccu

SEQ ID NO: 1412761 - RNA, 16 nt, Human
cggcucucaccuggcc

SEQ ID NO: 1412762 - RNA, 13 nt, Human
cggcucucaccug

SEQ ID NO: 1412763 - RNA, 20 nt, Human
cgugacgucuggguggcccu

SEQ ID NO: 1412764 - RNA, 15 nt, Human
cgugacgucugggug

SEQ ID NO: 1412765 - RNA, 22 nt, Human
cgugaccugcuaggccagagcc

SEQ ID NO: 1412766 - RNA, 20 nt, Human
cgugaccggacuuuucugca

SEQ ID NO: 1412767 - RNA, 13 nt, Human
cgugggugugugc

SEQ ID NO: 1412768 - RNA, 18 nt, Human
cguggggugugcugggag

SEQ ID NO: 1412769 - RNA, 17 nt, Human
cguggggugugcuggga

SEQ ID NO: 1412770 - RNA, 15 nt, Human
cguggggugugcugg

SEQ ID NO: 1412771 - RNA, 20 nt, Human
cgugagcauguuuggaaggg

SEQ ID NO: 1412772 - RNA, 23 nt, Human
cgugugagaagugaaugcuggga

SEQ ID NO: 1412773 - RNA, 21 nt, Human
cgugugagaagugaaugcugg

SEQ ID NO: 1412774 - RNA, 22 nt, Human
cgugugagaagugaaugcuggg

SEQ ID NO: 1412775 - RNA, 21 nt, Human
cgugucuggcacagccuggcu

SEQ ID NO: 1412776 - RNA, 14 nt, Human
cgugucuggcacag

SEQ ID NO: 1412777 - RNA, 15 nt, Human
cguggugauuuagca

SEQ ID NO: 1412778 - RNA, 20 nt, Human
cuaaacuuccccaucuucua

SEQ ID NO: 1412779 - RNA, 16 nt, Human
cuaaacuuccccaucu

SEQ ID NO: 1412780 - RNA, 17 nt, Human
cuaaacuggagacugug

SEQ ID NO: 1412781 - RNA, 15 nt, Human
cuaaacuggagacug

SEQ ID NO: 1412782 - RNA, 14 nt, Human
cuaaacuggagacu

SEQ ID NO: 1412783 - RNA, 13 nt, Human
cuaaacuggagac

SEQ ID NO: 1412784 - RNA, 12 nt, Human
cuaaacuggaga

SEQ ID NO: 1412785 - RNA, 13 nt, Human
cgugugcaggagc

SEQ ID NO: 1412786 - RNA, 19 nt, Human
cuaaacuggagacugugug

SEQ ID NO: 1412787 - RNA, 12 nt, Human
cucccugagaug

SEQ ID NO: 1412788 - RNA, 20 nt, Human
cucccugcagaggggcugag

SEQ ID NO: 1412789 - RNA, 14 nt, Human
cucccuccucugcc

SEQ ID NO: 1412790 - RNA, 12 nt, Human
cucccuccucca

SEQ ID NO: 1412791 - RNA, 13 nt, Human
cucccuccucugc

SEQ ID NO: 1412792 - RNA, 19 nt, Human
cucccuccuaaccuagaga

SEQ ID NO: 1412793 - RNA, 20 nt, Human
cucccuccgcccccagguag

SEQ ID NO: 1412794 - RNA, 18 nt, Human
cucccuccgcccccaggu

SEQ ID NO: 1412795 - RNA, 16 nt, Human
cucccuccgcccccag

SEQ ID NO: 1412796 - RNA, 15 nt, Human
cucccuccgccccca

SEQ ID NO: 1412797 - RNA, 15 nt, Human
cuccccuccccaacu

SEQ ID NO: 1412798 - RNA, 16 nt, Human
cuccccuccccaacug

SEQ ID NO: 1412799 - RNA, 23 nt, Human
cuccccuccaucccuggcccccu

SEQ ID NO: 1412800 - RNA, 19 nt, Human
cuccccuccaucccuggcc

SEQ ID NO: 1412801 - RNA, 16 nt, Human
cuccccuccaucccug

SEQ ID NO: 1412802 - RNA, 15 nt, Human
cuccccuccaucccu

SEQ ID NO: 1412803 - RNA, 14 nt, Human
cuccccuccauccc

SEQ ID NO: 1412804 - RNA, 13 nt, Human
cuccccuccagcu

SEQ ID NO: 1412805 - RNA, 12 nt, Human
cuccccuccagc

SEQ ID NO: 1412806 - RNA, 20 nt, Human
cuccccuccaaaaugugccu

SEQ ID NO: 1412807 - RNA, 21 nt, Human
cuccccucagccucuccccug

SEQ ID NO: 1412808 - RNA, 16 nt, Human
cuccccucagccucuc

SEQ ID NO: 1412809 - RNA, 15 nt, Human
cuccccucagccucu

SEQ ID NO: 1412810 - RNA, 13 nt, Human
cuccccucagccu

SEQ ID NO: 1412811 - RNA, 12 nt, Human
cuccccucagcc

SEQ ID NO: 1412812 - RNA, 17 nt, Human
cuccccgauaaagaaug

SEQ ID NO: 1412813 - RNA, 19 nt, Human
cucccacccggcugcagag

SEQ ID NO: 1412814 - RNA, 17 nt, Human
cucccacccggcugcag

SEQ ID NO: 1412815 - RNA, 20 nt, Human
cucccacccucuuccuacug

SEQ ID NO: 1412816 - RNA, 18 nt, Human
cucccaccuagcagcacc

SEQ ID NO: 1412817 - RNA, 21 nt, Human
cucccacccucuuccuacugg

SEQ ID NO: 1412818 - RNA, 16 nt, Human
cucccacccucuuccu

SEQ ID NO: 1412819 - RNA, 15 nt, Human
cucccacccucuucc

SEQ ID NO: 1412820 - RNA, 14 nt, Human
cucccacccucuuc

SEQ ID NO: 1412821 - RNA, 12 nt, Human
cucccacccucu

SEQ ID NO: 1412822 - RNA, 16 nt, Human
cuccgccuggccuggc

SEQ ID NO: 1412823 - RNA, 15 nt, Human
cuccgcucuguagug

SEQ ID NO: 1412824 - RNA, 13 nt, Human
cuccaaccugcaa

SEQ ID NO: 1412825 - RNA, 23 nt, Human
cuccaggggcugcuuccuccugg

SEQ ID NO: 1412826 - RNA, 22 nt, Human
cuccaggggcugcuuccuccug

SEQ ID NO: 1412827 - RNA, 16 nt, Human
cuccagggugugugcu

SEQ ID NO: 1412828 - RNA, 19 nt, Human
cuccaggguggcagcaaca

SEQ ID NO: 1412829 - RNA, 23 nt, Human
cuccagguauucguuaucuaaua

SEQ ID NO: 1412830 - RNA, 21 nt, Human
cucaggcccccaccuggcuca

SEQ ID NO: 1412831 - RNA, 20 nt, Human
cucaggcccccaccuggcuc

SEQ ID NO: 1412832 - RNA, 21 nt, Human
cucagccuugccagagaucca

SEQ ID NO: 1412833 - RNA, 20 nt, Human
cucagccuugccagagaucc

SEQ ID NO: 1412834 - RNA, 19 nt, Human
cucagccuugccagagauc

SEQ ID NO: 1412835 - RNA, 18 nt, Human
cucagccuugccagagau

SEQ ID NO: 1412836 - RNA, 17 nt, Human
cucagccuugccagaga

SEQ ID NO: 1412837 - RNA, 16 nt, Human
cucagccuugccagag

SEQ ID NO: 1412838 - RNA, 15 nt, Human
cucagccuugccaga

SEQ ID NO: 1412839 - RNA, 19 nt, Human
cucagccuucagacagaga

SEQ ID NO: 1412840 - RNA, 17 nt, Human
cucagccuucagacaga

SEQ ID NO: 1412841 - RNA, 16 nt, Human
cucagccuucagacag

SEQ ID NO: 1412842 - RNA, 15 nt, Human
cucagccuucagaca

SEQ ID NO: 1412843 - RNA, 18 nt, Human
cucaggccagagccaagg

SEQ ID NO: 1412844 - RNA, 17 nt, Human
cucaggccagagccaag

SEQ ID NO: 1412845 - RNA, 16 nt, Human
cucaggccagagccaa

SEQ ID NO: 1412846 - RNA, 13 nt, Human
cucaggccagagc

SEQ ID NO: 1412847 - RNA, 22 nt, Human
cucagccuugccagagauccaa

SEQ ID NO: 1412848 - RNA, 17 nt, Human
cucagccucccaaagug

SEQ ID NO: 1412849 - RNA, 15 nt, Human
cucagccucccaaag

SEQ ID NO: 1412850 - RNA, 18 nt, Human
cucagccucccaaguaac

SEQ ID NO: 1412851 - RNA, 17 nt, Human
cucaucuucuucaccau

SEQ ID NO: 1412852 - RNA, 20 nt, Human
cucaguguccucaggggccu

SEQ ID NO: 1412853 - RNA, 12 nt, Human
cucaugaaugua

SEQ ID NO: 1412854 - RNA, 21 nt, Human
cucaugaaccucaagcugcau

SEQ ID NO: 1412855 - RNA, 12 nt, Human
cucaugaaccuc

SEQ ID NO: 1412856 - RNA, 14 nt, Human
cucaucuuuuuacu

SEQ ID NO: 1412857 - RNA, 16 nt, Human
cucaucuuucuuccaa

SEQ ID NO: 1412858 - RNA, 16 nt, Human
cucaguggggcagagg

SEQ ID NO: 1412859 - RNA, 22 nt, Human
cucaguggcccauggcauuuua

SEQ ID NO: 1412860 - RNA, 20 nt, Human
cucagucucugagcagugaa

SEQ ID NO: 1412861 - RNA, 14 nt, Human
cucagucucugagc

SEQ ID NO: 1412862 - RNA, 13 nt, Human
cucagucucugag

SEQ ID NO: 1412863 - RNA, 19 nt, Human
cucagucucucuucucucc

SEQ ID NO: 1412864 - RNA, 17 nt, Human
cucagucucucuucucu

SEQ ID NO: 1412865 - RNA, 12 nt, Human
cucagucucucu

SEQ ID NO: 1412866 - RNA, 14 nt, Human
cucaugaauguaaa

SEQ ID NO: 1412867 - RNA, 13 nt, Human
cucaugaauguaa

SEQ ID NO: 1412868 - RNA, 14 nt, Human
cucauguucuuaau

SEQ ID NO: 1412869 - RNA, 18 nt, Human
cucauguucuuaauucuu

SEQ ID NO: 1412870 - RNA, 19 nt, Human
cucauguucuuaauucuua

SEQ ID NO: 1412871 - RNA, 22 nt, Human
cuccaacaccaagcacagcagc

SEQ ID NO: 1412872 - RNA, 18 nt, Human
cuccaacaccaagcacag

SEQ ID NO: 1412873 - RNA, 16 nt, Human
cuccaacaccaagcac

SEQ ID NO: 1412874 - RNA, 15 nt, Human
cuccaacaccaagca

SEQ ID NO: 1412875 - RNA, 12 nt, Human
cuccaacaauaa

SEQ ID NO: 1412876 - RNA, 23 nt, Human
cuccaaagucauaauugcauuga

SEQ ID NO: 1412877 - RNA, 21 nt, Human
cuccaaagucauaauugcauu

SEQ ID NO: 1412878 - RNA, 20 nt, Human
cuccaaagucauaauugcau

SEQ ID NO: 1412879 - RNA, 19 nt, Human
cuccaaagucauaauugca

SEQ ID NO: 1412880 - RNA, 17 nt, Human
cuccaaagucauaauug

SEQ ID NO: 1412881 - RNA, 12 nt, Human
cuccaaagucau

SEQ ID NO: 1412882 - RNA, 16 nt, Human
cuccaaagucucugga

SEQ ID NO: 1412883 - RNA, 20 nt, Human
cuccaacccaaccucauccu

SEQ ID NO: 1412884 - RNA, 19 nt, Human
cuccaacaucacagcccag

SEQ ID NO: 1412885 - RNA, 21 nt, Human
cuccaacaccaccucuccaga

SEQ ID NO: 1412886 - RNA, 23 nt, Human
cuccaacaccaagcacagcagcc

SEQ ID NO: 1412887 - RNA, 18 nt, Human
cuccaacccuagcaaaag

SEQ ID NO: 1412888 - RNA, 18 nt, Human
cucugcuauuaggccagc

SEQ ID NO: 1412889 - RNA, 22 nt, Human
cucugcgugucaccugugcuuc

SEQ ID NO: 1412890 - RNA, 23 nt, Human
cucugcacucccaccugacacac

SEQ ID NO: 1412891 - RNA, 23 nt, Human
cucugcagcaauaaagcagcguu

SEQ ID NO: 1412892 - RNA, 18 nt, Human
cucugcagcaauaaagca

SEQ ID NO: 1412893 - RNA, 19 nt, Human
cucugcagcaauaaagcag

SEQ ID NO: 1412894 - RNA, 18 nt, Human
cucugcacuacugacaug

SEQ ID NO: 1412895 - RNA, 16 nt, Human
cucugcacuacugaca

SEQ ID NO: 1412896 - RNA, 20 nt, Human
cucugcacucccaccugaca

SEQ ID NO: 1412897 - RNA, 19 nt, Human
cucugcacucccaccugac

SEQ ID NO: 1412898 - RNA, 22 nt, Human
cucugcacuacugacauguggg

SEQ ID NO: 1412899 - RNA, 20 nt, Human
cucugcacuacugacaugug

SEQ ID NO: 1412900 - RNA, 23 nt, Human
cucuguaaguagaugcauuuggg

SEQ ID NO: 1412901 - RNA, 21 nt, Human
cucuguaaagcuaaaauaaag

SEQ ID NO: 1412902 - RNA, 15 nt, Human
cucuguaaagcuaaa

SEQ ID NO: 1412903 - RNA, 22 nt, Human
cucugguuguuucuguuccaaa

SEQ ID NO: 1412904 - RNA, 23 nt, Human
cucugguuguuucuguuccaaau

SEQ ID NO: 1412905 - RNA, 20 nt, Human
cucugguuguuucuguucca

SEQ ID NO: 1412906 - RNA, 18 nt, Human
cucugguuguuucuguuc

SEQ ID NO: 1412907 - RNA, 17 nt, Human
cucugguuguuucuguu

SEQ ID NO: 1412908 - RNA, 16 nt, Human
cucuguaauugcaaaa

SEQ ID NO: 1412909 - RNA, 15 nt, Human
cucuguaauugcaaa

SEQ ID NO: 1412910 - RNA, 14 nt, Human
cucuguaauugcaa

SEQ ID NO: 1412911 - RNA, 19 nt, Human
cucuguaauugaauauuau

SEQ ID NO: 1412912 - RNA, 18 nt, Human
cucuguaauugaauauua

SEQ ID NO: 1412913 - RNA, 22 nt, Human
cucuguaucaggacccagagga

SEQ ID NO: 1412914 - RNA, 20 nt, Human
cucugucacuccucaugccu

SEQ ID NO: 1412915 - RNA, 22 nt, Human
cucuguauuugaaucagccuac

SEQ ID NO: 1412916 - RNA, 15 nt, Human
cucuuagaugcaguu

SEQ ID NO: 1412917 - RNA, 18 nt, Human
cuccgugugggagaccgg

SEQ ID NO: 1412918 - RNA, 16 nt, Human
cuccguuagcuccugu

SEQ ID NO: 1412919 - RNA, 15 nt, Human
cuccguuagcuccug

SEQ ID NO: 1412920 - RNA, 14 nt, Human
cuccgugugggaga

SEQ ID NO: 1412921 - RNA, 12 nt, Human
cuccguguggga

SEQ ID NO: 1412922 - RNA, 22 nt, Human
cuccguccaggagccugugccu

SEQ ID NO: 1412923 - RNA, 20 nt, Human
cuccguccaggagccugugc

SEQ ID NO: 1412924 - RNA, 19 nt, Human
cuccguccaggagccuggc

SEQ ID NO: 1412925 - RNA, 18 nt, Human
cuccguccaggagccugg

SEQ ID NO: 1412926 - RNA, 19 nt, Human
cucugaagccacaaauagg

SEQ ID NO: 1412927 - RNA, 17 nt, Human
cucugaagccacaaaua

SEQ ID NO: 1412928 - RNA, 12 nt, Human
cucucuggagaa

SEQ ID NO: 1412929 - RNA, 16 nt, Human
cucuccccagguccag

SEQ ID NO: 1412930 - RNA, 15 nt, Human
cucuccccaggucca

SEQ ID NO: 1412931 - RNA, 22 nt, Human
cucuccccagggaagcagcagc

SEQ ID NO: 1412932 - RNA, 20 nt, Human
cucuccccagggaagcagca

SEQ ID NO: 1412933 - RNA, 20 nt, Human
cucuccccagcccagagaca

SEQ ID NO: 1412934 - RNA, 19 nt, Human
cucuccccagcccagagac

SEQ ID NO: 1412935 - RNA, 18 nt, Human
cucuccccagcccagaga

SEQ ID NO: 1412936 - RNA, 17 nt, Human
cucuccccagcccagag

SEQ ID NO: 1412937 - RNA, 16 nt, Human
cucuccccagcccaga

SEQ ID NO: 1412938 - RNA, 15 nt, Human
cucuccccagcccag

SEQ ID NO: 1412939 - RNA, 13 nt, Human
cucuccccagccc

SEQ ID NO: 1412940 - RNA, 21 nt, Human
cucucagcccucacacacccu

SEQ ID NO: 1412941 - RNA, 13 nt, Human
cucucagcccuca

SEQ ID NO: 1412942 - RNA, 22 nt, Human
cucuccuaggcauucuggaccu

SEQ ID NO: 1412943 - RNA, 21 nt, Human
cucuccuaggcauucuggacc

SEQ ID NO: 1412944 - RNA, 15 nt, Human
cucuccuagccccug

SEQ ID NO: 1412945 - RNA, 15 nt, Human
cucuccggucucucu

SEQ ID NO: 1412946 - RNA, 24 nt, Human
cucuccccagggaagcagcagccu

SEQ ID NO: 1412947 - RNA, 24 nt, Human
cucuccgacucacaccacuagccu

SEQ ID NO: 1412948 - RNA, 23 nt, Human
cucuccccagguccagcucugga

SEQ ID NO: 1412949 - RNA, 20 nt, Human
cucuccccagguccagcucu

SEQ ID NO: 1412950 - RNA, 18 nt, Human
cucuccccagguccagcu

SEQ ID NO: 1412951 - RNA, 15 nt, Human
cucuccccaugaugu

SEQ ID NO: 1412952 - RNA, 17 nt, Human
cucucaacacccaguuu

SEQ ID NO: 1412953 - RNA, 22 nt, Human
cucucaacaccaugauuccuuu

SEQ ID NO: 1412954 - RNA, 18 nt, Human
cucucaacaccaugauuc

SEQ ID NO: 1412955 - RNA, 15 nt, Human
cucucaacaccauga

SEQ ID NO: 1412956 - RNA, 14 nt, Human
cucucaacaccaug

SEQ ID NO: 1412957 - RNA, 17 nt, Human
cucucaaagcaaauaau

SEQ ID NO: 1412958 - RNA, 23 nt, Human
cucuauucgccacacaguauuuu

SEQ ID NO: 1412959 - RNA, 13 nt, Human
cucuauucuuuaa

SEQ ID NO: 1412960 - RNA, 20 nt, Human
cucuauucgccacacaguau

SEQ ID NO: 1412961 - RNA, 22 nt, Human
cucuauuaugaaugugaagccu

SEQ ID NO: 1412962 - RNA, 23 nt, Human
cucuauuaugaaugugaagccuu

SEQ ID NO: 1412963 - RNA, 21 nt, Human
cucuauuaugaaugugaagcc

SEQ ID NO: 1412964 - RNA, 15 nt, Human
cucuauuaugaaugu

SEQ ID NO: 1412965 - RNA, 14 nt, Human
cucuauuaugaaug

SEQ ID NO: 1412966 - RNA, 18 nt, Human
cucucaauauucaauaaa

SEQ ID NO: 1412967 - RNA, 10 nt, Human
cucucaauau

SEQ ID NO: 1412968 - RNA, 19 nt, Human
cucucaauauucaauaaag

SEQ ID NO: 1412969 - RNA, 15 nt, Human
cucucacucccuccc

SEQ ID NO: 1412970 - RNA, 21 nt, Human
cucucacuuguuuuauuuaac

SEQ ID NO: 1412971 - RNA, 19 nt, Human
cugaccuuaaaugcaacca

SEQ ID NO: 1412972 - RNA, 15 nt, Human
cugaccuuaaaugca

SEQ ID NO: 1412973 - RNA, 21 nt, Human
cugaccugugagcccagcugg

SEQ ID NO: 1412974 - RNA, 20 nt, Human
cugaccugugagcccagcug

SEQ ID NO: 1412975 - RNA, 18 nt, Human
cugaccugugagcccagc

SEQ ID NO: 1412976 - RNA, 17 nt, Human
cugaccugugagcccag

SEQ ID NO: 1412977 - RNA, 17 nt, Human
cugaccuccgccaucca

SEQ ID NO: 1412978 - RNA, 19 nt, Human
cugaccuccgccauccacc

SEQ ID NO: 1412979 - RNA, 16 nt, Human
cugaccuccgccaucc

SEQ ID NO: 1412980 - RNA, 14 nt, Human
cugaccuccgccau

SEQ ID NO: 1412981 - RNA, 17 nt, Human
cugaccucaagugaucu

SEQ ID NO: 1412982 - RNA, 19 nt, Human
cugaaggggccaugauggc

SEQ ID NO: 1412983 - RNA, 15 nt, Human
cugaaggggccauga

SEQ ID NO: 1412984 - RNA, 23 nt, Human
cugaaggggccaugauggcaaca

SEQ ID NO: 1412985 - RNA, 20 nt, Human
cugaagggggcggccuauga

SEQ ID NO: 1412986 - RNA, 17 nt, Human
cugaagggguucucaca

SEQ ID NO: 1412987 - RNA, 16 nt, Human
cugaagggggcggccu

SEQ ID NO: 1412988 - RNA, 15 nt, Human
cugaagggggcggcc

SEQ ID NO: 1412989 - RNA, 21 nt, Human
cugaagggguucucacagugg

SEQ ID NO: 1412990 - RNA, 21 nt, Human
cugaaggguugacuuuaccca

SEQ ID NO: 1412991 - RNA, 22 nt, Human
cucuugcuugugggacuagccu

SEQ ID NO: 1412992 - RNA, 15 nt, Human
cucuuggagaagucu

SEQ ID NO: 1412993 - RNA, 13 nt, Human
cucuuggagaagu

SEQ ID NO: 1412994 - RNA, 17 nt, Human
cugaaaacacugugcac

SEQ ID NO: 1412995 - RNA, 21 nt, Human
cucuuggagaagucucagcua

SEQ ID NO: 1412996 - RNA, 19 nt, Human
cucuuggagaagucucagc

SEQ ID NO: 1412997 - RNA, 18 nt, Human
cucuuggagaagucucag

SEQ ID NO: 1412998 - RNA, 13 nt, Human
cugaaaaugugcu

SEQ ID NO: 1412999 - RNA, 12 nt, Human
cugaaaaugugc

SEQ ID NO: 1413000 - RNA, 19 nt, Human
cugaaaauguccuugugau

SEQ ID NO: 1413001 - RNA, 18 nt, Human
cugaaaauguccuuguga

SEQ ID NO: 1413002 - RNA, 17 nt, Human
cugaaaauguccuugug

SEQ ID NO: 1413003 - RNA, 16 nt, Human
cugaaaauguccuugu

SEQ ID NO: 1413004 - RNA, 14 nt, Human
cugaaaauguccuu

SEQ ID NO: 1413005 - RNA, 17 nt, Human
cugaaaauuauuuaaac

SEQ ID NO: 1413006 - RNA, 22 nt, Human
cugaaaauugaugggauuuggu

SEQ ID NO: 1413007 - RNA, 21 nt, Human
cucuuagaugcaguucugaag

SEQ ID NO: 1413008 - RNA, 20 nt, Human
cucuuagaugcaguucugaa

SEQ ID NO: 1413009 - RNA, 19 nt, Human
gugcaauguguauaaacaa

SEQ ID NO: 1413010 - RNA, 17 nt, Human
gugcaauguguauaaac

SEQ ID NO: 1413011 - RNA, 15 nt, Human
gugcaauguguauaa

SEQ ID NO: 1413012 - RNA, 20 nt, Human
gugcaauguaaauauuuuaa

SEQ ID NO: 1413013 - RNA, 22 nt, Human
gugcaauguaaauauuuuaaag

SEQ ID NO: 1413014 - RNA, 17 nt, Human
gugcaauguaaauauuu

SEQ ID NO: 1413015 - RNA, 13 nt, Human
gugcaauguaaau

SEQ ID NO: 1413016 - RNA, 14 nt, Human
gugcaaggcagccg

SEQ ID NO: 1413017 - RNA, 15 nt, Human
gugcaaggcagccgu

SEQ ID NO: 1413018 - RNA, 12 nt, Human
gugcaaggcagc

SEQ ID NO: 1413019 - RNA, 19 nt, Human
gugcaaggaccuaaaacau

SEQ ID NO: 1413020 - RNA, 15 nt, Human
gugcaaggaccuaaa

SEQ ID NO: 1413021 - RNA, 23 nt, Human
gugcaaccucuuggccugaucag

SEQ ID NO: 1413022 - RNA, 18 nt, Human
gugcacaucugugucuug

SEQ ID NO: 1413023 - RNA, 14 nt, Human
gugcacaggagggg

SEQ ID NO: 1413024 - RNA, 13 nt, Human
gugcacaggaggg

SEQ ID NO: 1413025 - RNA, 12 nt, Human
gugcacaggagg

SEQ ID NO: 1413026 - RNA, 19 nt, Human
gugcacagcacaaauuagu

SEQ ID NO: 1413027 - RNA, 15 nt, Human
gugcacaaauauuua

SEQ ID NO: 1413028 - RNA, 18 nt, Human
gugcacaaaacccagacc

SEQ ID NO: 1413029 - RNA, 20 nt, Human
gugcaauuucaagguucuaa

SEQ ID NO: 1413030 - RNA, 19 nt, Human
gugcaauuucaagguucua

SEQ ID NO: 1413031 - RNA, 18 nt, Human
gugcaauuucaagguucu

SEQ ID NO: 1413032 - RNA, 23 nt, Human
gugcaauguguauaaacaagaaa

SEQ ID NO: 1413033 - RNA, 20 nt, Human
gugcaauguguguauaugga

SEQ ID NO: 1413034 - RNA, 20 nt, Human
gugcacaccccacucccaca

SEQ ID NO: 1413035 - RNA, 20 nt, Human
gugcacaaauauuuauuuuc

SEQ ID NO: 1413036 - RNA, 21 nt, Human
gugccucgcuccccacucugc

SEQ ID NO: 1413037 - RNA, 20 nt, Human
gugccucgcuccccacucug

SEQ ID NO: 1413038 - RNA, 19 nt, Human
gugccucgcuccccacucu

SEQ ID NO: 1413039 - RNA, 15 nt, Human
gugccucgcucccca

SEQ ID NO: 1413040 - RNA, 22 nt, Human
gugccuccucccucccucuccg

SEQ ID NO: 1413041 - RNA, 21 nt, Human
gugccuccucccucccucucc

SEQ ID NO: 1413042 - RNA, 16 nt, Human
gugccuccucccuccc

SEQ ID NO: 1413043 - RNA, 14 nt, Human
gugccuccucccuc

SEQ ID NO: 1413044 - RNA, 13 nt, Human
gugccuccucccu

SEQ ID NO: 1413045 - RNA, 23 nt, Human
gugccuccagaggggcucagguc

SEQ ID NO: 1413046 - RNA, 16 nt, Human
gugccagagaacccag

SEQ ID NO: 1413047 - RNA, 14 nt, Human
gugccagaagcuac

SEQ ID NO: 1413048 - RNA, 18 nt, Human
gugccacuuaauguaugu

SEQ ID NO: 1413049 - RNA, 15 nt, Human
gugccacuuaaugua

SEQ ID NO: 1413050 - RNA, 22 nt, Human
gugccuguguccaugcgcucag

SEQ ID NO: 1413051 - RNA, 13 nt, Human
gugccugugucca

SEQ ID NO: 1413052 - RNA, 20 nt, Human
gugccugucccacccccacc

SEQ ID NO: 1413053 - RNA, 15 nt, Human
gugccugucccaccc

SEQ ID NO: 1413054 - RNA, 21 nt, Human
gugccaauuucaaguuccaag

SEQ ID NO: 1413055 - RNA, 14 nt, Human
gugcauucuccagc

SEQ ID NO: 1413056 - RNA, 23 nt, Human
gugcauuaucuagauacuguauc

SEQ ID NO: 1413057 - RNA, 15 nt, Human
gugcauuaucuagau

SEQ ID NO: 1413058 - RNA, 19 nt, Human
gugcauuaucuagauacug

SEQ ID NO: 1413059 - RNA, 18 nt, Human
gugauggagugcuguuuu

SEQ ID NO: 1413060 - RNA, 23 nt, Human
gugauggagugcuguuuuguuau

SEQ ID NO: 1413061 - RNA, 16 nt, Human
gugauggagugcuguu

SEQ ID NO: 1413062 - RNA, 23 nt, Human
gugaugagggcagcagccagccc

SEQ ID NO: 1413063 - RNA, 22 nt, Human
gugaugagggcagcagccagcc

SEQ ID NO: 1413064 - RNA, 21 nt, Human
gugaugagggcagcagccagc

SEQ ID NO: 1413065 - RNA, 20 nt, Human
gugaugagggcagcagccag

SEQ ID NO: 1413066 - RNA, 19 nt, Human
gugaugagggcagcagcca

SEQ ID NO: 1413067 - RNA, 18 nt, Human
gugaugagggcagcagcc

SEQ ID NO: 1413068 - RNA, 17 nt, Human
gugaugagggcagcagc

SEQ ID NO: 1413069 - RNA, 16 nt, Human
gugaugagggcagcag

SEQ ID NO: 1413070 - RNA, 14 nt, Human
gugaugagggcagc

SEQ ID NO: 1413071 - RNA, 14 nt, Human
gugaugaauacugu

SEQ ID NO: 1413072 - RNA, 24 nt, Human
aacuucuuauggaauugauuugca

SEQ ID NO: 1413073 - RNA, 19 nt, Human
aacuucuuauggaauugau

SEQ ID NO: 1413074 - RNA, 17 nt, Human
aacuucuuauggaauug

SEQ ID NO: 1413075 - RNA, 16 nt, Human
aacuucuuauggaauu

SEQ ID NO: 1413076 - RNA, 15 nt, Human
aacuucuuauggaau

SEQ ID NO: 1413077 - RNA, 18 nt, Human
aacuucuugcuucuuucu

SEQ ID NO: 1413078 - RNA, 12 nt, Human
aacuucuugcuu

SEQ ID NO: 1413079 - RNA, 18 nt, Human
aacuguacagugucuuuu

SEQ ID NO: 1413080 - RNA, 17 nt, Human
aacuguacagugucuuu

SEQ ID NO: 1413081 - RNA, 16 nt, Human
aacuguacagugucuu

SEQ ID NO: 1413082 - RNA, 11 nt, Human
aacuguacagu

SEQ ID NO: 1413083 - RNA, 10 nt, Human
aacuguacag

SEQ ID NO: 1413084 - RNA, 13 nt, Human
aacuguaauacaa

SEQ ID NO: 1413085 - RNA, 14 nt, Human
aacuguaaagaugu

SEQ ID NO: 1413086 - RNA, 13 nt, Human
aacuguaaauaaa

SEQ ID NO: 1413087 - RNA, 18 nt, Human
aacuggguaaugaaacaa

SEQ ID NO: 1413088 - RNA, 20 nt, Human
aacuucauauaugaggacuu

SEQ ID NO: 1413089 - RNA, 19 nt, Human
aacuucaguuucacagaaa

SEQ ID NO: 1413090 - RNA, 16 nt, Human
aacuucauuucagagu

SEQ ID NO: 1413091 - RNA, 18 nt, Human
aacuuccccaucuucuaa

SEQ ID NO: 1413092 - RNA, 17 nt, Human
aacuuccccaucuucua

SEQ ID NO: 1413093 - RNA, 22 nt, Human
aacuuccagguguuacuguaau

SEQ ID NO: 1413094 - RNA, 19 nt, Human
aacuuccagguguuacugu

SEQ ID NO: 1413095 - RNA, 18 nt, Human
aacuuccagauccuggaa

SEQ ID NO: 1413096 - RNA, 19 nt, Human
aacuggaaucagcucagga

SEQ ID NO: 1413097 - RNA, 16 nt, Human
aacuggaaucagcuca

SEQ ID NO: 1413098 - RNA, 12 nt, Human
aacuggaaagaa

SEQ ID NO: 1413099 - RNA, 13 nt, Human
aacuggaaagaag

SEQ ID NO: 1413100 - RNA, 21 nt, Human
aacuggaaaacagaacacuua

SEQ ID NO: 1413101 - RNA, 20 nt, Human
aacuggaaaacagaacacuu

SEQ ID NO: 1413102 - RNA, 19 nt, Human
aacuggaaaacagaacacu

SEQ ID NO: 1413103 - RNA, 17 nt, Human
aacuggaaaacagaaca

SEQ ID NO: 1413104 - RNA, 15 nt, Human
aacuggaaaacagaa

SEQ ID NO: 1413105 - RNA, 20 nt, Human
aacugcuuucuguuccaaau

SEQ ID NO: 1413106 - RNA, 18 nt, Human
aacugcuuucuguuccaa

SEQ ID NO: 1413107 - RNA, 17 nt, Human
aacugcuuucuguucca

SEQ ID NO: 1413108 - RNA, 15 nt, Human
aacugcuuucuguuc

SEQ ID NO: 1413109 - RNA, 14 nt, Human
aacugcuuucuguu

SEQ ID NO: 1413110 - RNA, 13 nt, Human
aacugcugccacu

SEQ ID NO: 1413111 - RNA, 14 nt, Human
aacugcugccacug

SEQ ID NO: 1413112 - RNA, 12 nt, Human
aacugcugccac

SEQ ID NO: 1413113 - RNA, 13 nt, Human
aacugcuccuccu

SEQ ID NO: 1413114 - RNA, 17 nt, Human
aacugcucccaccuccu

SEQ ID NO: 1413115 - RNA, 20 nt, Human
aacugccucgaaacacagaa

SEQ ID NO: 1413116 - RNA, 17 nt, Human
aacugccuagaaacaac

SEQ ID NO: 1413117 - RNA, 14 nt, Human
aacugccuagaaac

SEQ ID NO: 1413118 - RNA, 13 nt, Human
aacugccuagaaa

SEQ ID NO: 1413119 - RNA, 13 nt, Human
aacugcaggcccu

SEQ ID NO: 1413120 - RNA, 22 nt, Human
aacugccuagaaacaacacugu

SEQ ID NO: 1413121 - RNA, 19 nt, Human
aacugcuaaucuacuuucu

SEQ ID NO: 1413122 - RNA, 18 nt, Human
aacuggccauggccugca

SEQ ID NO: 1413123 - RNA, 21 nt, Human
aacuggccaagcugaggugcc

SEQ ID NO: 1413124 - RNA, 19 nt, Human
aacuggccaagcugaggug

SEQ ID NO: 1413125 - RNA, 17 nt, Human
aacuggccaagcugagg

SEQ ID NO: 1413126 - RNA, 16 nt, Human
aacuggccaagcugag

SEQ ID NO: 1413127 - RNA, 14 nt, Human
aacuggcaggcagg

SEQ ID NO: 1413128 - RNA, 22 nt, Human
aacuggcaggcaggcucccagg

SEQ ID NO: 1413129 - RNA, 12 nt, Human
aacuggagcccc

SEQ ID NO: 1413130 - RNA, 16 nt, Human
aacuggauuaaacuua

SEQ ID NO: 1413131 - RNA, 15 nt, Human
aacuggauuaaacuu

SEQ ID NO: 1413132 - RNA, 14 nt, Human
aacuggacccuguu

SEQ ID NO: 1413133 - RNA, 17 nt, Human
aacuggacccuguugcu

SEQ ID NO: 1413134 - RNA, 18 nt, Human
aacuggacccuguugcua

SEQ ID NO: 1413135 - RNA, 19 nt, Human
aacuggacccuguugcuaa

SEQ ID NO: 1413136 - RNA, 20 nt, Human
aacuggacccuguugcuaag

SEQ ID NO: 1413137 - RNA, 21 nt, Human
aacuggacccuguugcuaagc

SEQ ID NO: 1413138 - RNA, 22 nt, Human
aacuggacccuguugcuaagcc

SEQ ID NO: 1413139 - RNA, 18 nt, Human
aacuggcccuauuuagau

SEQ ID NO: 1413140 - RNA, 22 nt, Human
aacuggcccuauuuagaugaua

SEQ ID NO: 1413141 - RNA, 17 nt, Human
aacugggacaggggaga

SEQ ID NO: 1413142 - RNA, 22 nt, Human
aacugggaaccccuuucccacc

SEQ ID NO: 1413143 - RNA, 21 nt, Human
aacugggaaccccuuucccac

SEQ ID NO: 1413144 - RNA, 20 nt, Human
aacugggaaccccuuuccca

SEQ ID NO: 1413145 - RNA, 18 nt, Human
aacugggaaccccuuucc

SEQ ID NO: 1413146 - RNA, 16 nt, Human
aacugggggaaaagau

SEQ ID NO: 1413147 - RNA, 16 nt, Human
aacuggggcuccucca

SEQ ID NO: 1413148 - RNA, 21 nt, Human
aacugggggagggugaaguga

SEQ ID NO: 1413149 - RNA, 22 nt, Human
aacugggggagggugaagugaa

SEQ ID NO: 1413150 - RNA, 16 nt, Human
gugagggucccaugug

SEQ ID NO: 1413151 - RNA, 15 nt, Human
gugagggucccaugu

SEQ ID NO: 1413152 - RNA, 18 nt, Human
gugaggguaaguauuuuc

SEQ ID NO: 1413153 - RNA, 17 nt, Human
gugagggggggcucccu

SEQ ID NO: 1413154 - RNA, 17 nt, Human
gugaggccagggcagag

SEQ ID NO: 1413155 - RNA, 15 nt, Human
gugaggccagggcag

SEQ ID NO: 1413156 - RNA, 14 nt, Human
gugaggccagggca

SEQ ID NO: 1413157 - RNA, 21 nt, Human
gugaacuggacccuguugcua

SEQ ID NO: 1413158 - RNA, 22 nt, Human
gugaacuggacccuguugcuaa

SEQ ID NO: 1413159 - RNA, 23 nt, Human
gugaacuggacccuguugcuaag

SEQ ID NO: 1413160 - RNA, 19 nt, Human
gugaacuggacccuguugc

SEQ ID NO: 1413161 - RNA, 20 nt, Human
gugaacuggacccuguugcu

SEQ ID NO: 1413162 - RNA, 19 nt, Human
gugagucuuugguucuaag

SEQ ID NO: 1413163 - RNA, 17 nt, Human
gugagucuuugguucua

SEQ ID NO: 1413164 - RNA, 22 nt, Human
gugagucucucugggccuuagg

SEQ ID NO: 1413165 - RNA, 18 nt, Human
gugagucucucugggccu

SEQ ID NO: 1413166 - RNA, 16 nt, Human
gugagucguuuccccu

SEQ ID NO: 1413167 - RNA, 22 nt, Human
aacucuguugcaagugcaauaa

SEQ ID NO: 1413168 - RNA, 19 nt, Human
aacucuguugcaagugcaa

SEQ ID NO: 1413169 - RNA, 23 nt, Human
aacucuguuacacuuuuuggaag

SEQ ID NO: 1413170 - RNA, 22 nt, Human
aacucuguuacacuuuuuggaa

SEQ ID NO: 1413171 - RNA, 15 nt, Human
aacucuuauaaauuu

SEQ ID NO: 1413172 - RNA, 22 nt, Human
aacucuuauaaauuucuauuuu

SEQ ID NO: 1413173 - RNA, 16 nt, Human
aacucuucaaggucug

SEQ ID NO: 1413174 - RNA, 19 nt, Human
aacucuucaaggucugcuu

SEQ ID NO: 1413175 - RNA, 13 nt, Human
aacugaaaauuau

SEQ ID NO: 1413176 - RNA, 12 nt, Human
aacugaaaauua

SEQ ID NO: 1413177 - RNA, 12 nt, Human
aacugaaaaugu

SEQ ID NO: 1413178 - RNA, 17 nt, Human
aacugaaaauuauuuaa

SEQ ID NO: 1413179 - RNA, 13 nt, Human
aacugaaaucaua

SEQ ID NO: 1413180 - RNA, 12 nt, Human
aacugaaaucau

SEQ ID NO: 1413181 - RNA, 20 nt, Human
aaccccggggugcccacagg

SEQ ID NO: 1413182 - RNA, 15 nt, Human
aaccccccuguacac

SEQ ID NO: 1413183 - RNA, 23 nt, Human
aaccccuccccuccaucccuggc

SEQ ID NO: 1413184 - RNA, 21 nt, Human
aaccccuccccuccaucccug

SEQ ID NO: 1413185 - RNA, 20 nt, Human
aaccccuccccuccaucccu

SEQ ID NO: 1413186 - RNA, 21 nt, Human
aaccccuacaugaaacagaaa

SEQ ID NO: 1413187 - RNA, 16 nt, Human
aacccagcccaccccc

SEQ ID NO: 1413188 - RNA, 14 nt, Human
aacccagacucaga

SEQ ID NO: 1413189 - RNA, 12 nt, Human
aacccagacuca

SEQ ID NO: 1413190 - RNA, 23 nt, Human
aacccagaccuguuagcagacag

SEQ ID NO: 1413191 - RNA, 22 nt, Human
aacccagaccuguuagcagaca

SEQ ID NO: 1413192 - RNA, 23 nt, Human
aacccacuuuaaaauaucuacau

SEQ ID NO: 1413193 - RNA, 19 nt, Human
aacccacuuuaaaauaucu

SEQ ID NO: 1413194 - RNA, 18 nt, Human
aacccagacucagacauu

SEQ ID NO: 1413195 - RNA, 16 nt, Human
aacccagacucagaca

SEQ ID NO: 1413196 - RNA, 15 nt, Human
aacccagacucagac

SEQ ID NO: 1413197 - RNA, 14 nt, Human
aacccagauaaagg

SEQ ID NO: 1413198 - RNA, 17 nt, Human
aaccugaccccugcuca

SEQ ID NO: 1413199 - RNA, 16 nt, Human
aaccugaccccugcuc

SEQ ID NO: 1413200 - RNA, 20 nt, Human
aaccugagauuuauuaaaga

SEQ ID NO: 1413201 - RNA, 15 nt, Human
aaccugagauuuauu

SEQ ID NO: 1413202 - RNA, 14 nt, Human
aaccugagauuuau

SEQ ID NO: 1413203 - RNA, 19 nt, Human
aaccugaccccugcucagu

SEQ ID NO: 1413204 - RNA, 19 nt, Human
aaccucgcuggacucucag

SEQ ID NO: 1413205 - RNA, 14 nt, Human
aaccucgcuggacu

SEQ ID NO: 1413206 - RNA, 16 nt, Human
aaccucgggccugcug

SEQ ID NO: 1413207 - RNA, 24 nt, Human
aaccucuaaauucuuucauuuuag

SEQ ID NO: 1413208 - RNA, 12 nt, Human
aaccucuaaauu

SEQ ID NO: 1413209 - RNA, 18 nt, Human
aaccccuuucccacccca

SEQ ID NO: 1413210 - RNA, 15 nt, Human
aacccgaggcccgca

SEQ ID NO: 1413211 - RNA, 16 nt, Human
aacccgaggcccgcau

SEQ ID NO: 1413212 - RNA, 17 nt, Human
aaccccuguaggccuca

SEQ ID NO: 1413213 - RNA, 20 nt, Human
aaccucagccuggccagaca

SEQ ID NO: 1413214 - RNA, 23 nt, Human
aacccgagucauucguucugugg

SEQ ID NO: 1413215 - RNA, 22 nt, Human
aacccgaggcugagaaucagac

SEQ ID NO: 1413216 - RNA, 13 nt, Human
aaccuccaccucc

SEQ ID NO: 1413217 - RNA, 20 nt, Human
aaccucauccuccuucuuca

SEQ ID NO: 1413218 - RNA, 14 nt, Human
aaccucaguaauuu

SEQ ID NO: 1413219 - RNA, 18 nt, Human
aaccucaguaauuuagaa

SEQ ID NO: 1413220 - RNA, 16 nt, Human
aaccucaucuucuuca

SEQ ID NO: 1413221 - RNA, 14 nt, Human
aaccucauccucuc

SEQ ID NO: 1413222 - RNA, 17 nt, Human
aaccauuaaccagaucu

SEQ ID NO: 1413223 - RNA, 19 nt, Human
aaccauuauaaccuuaauu

SEQ ID NO: 1413224 - RNA, 20 nt, Human
aaccauguguuauguuuucg

SEQ ID NO: 1413225 - RNA, 14 nt, Human
aacccaauccaaau

SEQ ID NO: 1413226 - RNA, 19 nt, Human
aacccaagguaccauccua

SEQ ID NO: 1413227 - RNA, 21 nt, Human
aacccaagaugcaagaaggag

SEQ ID NO: 1413228 - RNA, 19 nt, Human
aaccauuugaaaccccugu

SEQ ID NO: 1413229 - RNA, 16 nt, Human
aaccauuuccucagac

SEQ ID NO: 1413230 - RNA, 15 nt, Human
aaccauuuccucaga

SEQ ID NO: 1413231 - RNA, 12 nt, Human
aaccauuuccuc

SEQ ID NO: 1413232 - RNA, 20 nt, Human
gucucccuggaucagaacag

SEQ ID NO: 1413233 - RNA, 17 nt, Human
aacaguugguaacuuuu

SEQ ID NO: 1413234 - RNA, 20 nt, Human
aacaguugcauguaguaaca

SEQ ID NO: 1413235 - RNA, 18 nt, Human
aacaguugcauguaguaa

SEQ ID NO: 1413236 - RNA, 14 nt, Human
aacaguugcaugua

SEQ ID NO: 1413237 - RNA, 14 nt, Human
aacaguugguaacu

SEQ ID NO: 1413238 - RNA, 22 nt, Human
aacaguugcauguaguaacacu

SEQ ID NO: 1413239 - RNA, 21 nt, Human
aacaguugcauguaguaacac

SEQ ID NO: 1413240 - RNA, 19 nt, Human
gucucccuccucugcccgg

SEQ ID NO: 1413241 - RNA, 20 nt, Human
aaccaagcugaguuuccuau

SEQ ID NO: 1413242 - RNA, 19 nt, Human
aaccaagcugaguuuccua

SEQ ID NO: 1413243 - RNA, 18 nt, Human
aaccaagcugaguuuccu

SEQ ID NO: 1413244 - RNA, 20 nt, Human
aaccaagugaucaaacuaca

SEQ ID NO: 1413245 - RNA, 12 nt, Human
aacucauuucua

SEQ ID NO: 1413246 - RNA, 15 nt, Human
aacucauuagacugg

SEQ ID NO: 1413247 - RNA, 23 nt, Human
aacucauuagacuggaacuugaa

SEQ ID NO: 1413248 - RNA, 17 nt, Human
aacucaucugucaccaa

SEQ ID NO: 1413249 - RNA, 15 nt, Human
aacucgaaucugugu

SEQ ID NO: 1413250 - RNA, 16 nt, Human
aacucgaaucugugug

SEQ ID NO: 1413251 - RNA, 13 nt, Human
aacuccugugacc

SEQ ID NO: 1413252 - RNA, 21 nt, Human
aacuccugugaccacaacaug

SEQ ID NO: 1413253 - RNA, 19 nt, Human
aacucguauagcaugcauc

SEQ ID NO: 1413254 - RNA, 15 nt, Human
aacucguauagcaug

SEQ ID NO: 1413255 - RNA, 15 nt, Human
gugaacccaggacaa

SEQ ID NO: 1413256 - RNA, 13 nt, Human
gugaacccaggac

SEQ ID NO: 1413257 - RNA, 17 nt, Human
gugaacccaggacaagc

SEQ ID NO: 1413258 - RNA, 21 nt, Human
aacucguauagcaugcaucug

SEQ ID NO: 1413259 - RNA, 20 nt, Human
aacuacuaccuguaaugaca

SEQ ID NO: 1413260 - RNA, 17 nt, Human
aacuacuaauagaauaa

SEQ ID NO: 1413261 - RNA, 21 nt, Human
aaccuuggguuagaccuacag

SEQ ID NO: 1413262 - RNA, 18 nt, Human
aaccuugccugguacagu

SEQ ID NO: 1413263 - RNA, 19 nt, Human
aaccuugccugguacagua

SEQ ID NO: 1413264 - RNA, 16 nt, Human
aaccuugccugguaca

SEQ ID NO: 1413265 - RNA, 13 nt, Human
aaccuugccuggu

SEQ ID NO: 1413266 - RNA, 20 nt, Human
aaccuugaaaaaaaacagug

SEQ ID NO: 1413267 - RNA, 17 nt, Human
aaccuugaaaaaaaaca

SEQ ID NO: 1413268 - RNA, 11 nt, Human
aacuaucuugg

SEQ ID NO: 1413269 - RNA, 18 nt, Human
aacuaucuuggugaauuu

SEQ ID NO: 1413270 - RNA, 22 nt, Human
aacuagaggugagaaauuuaaa

SEQ ID NO: 1413271 - RNA, 23 nt, Human
aacuaugcauggugccccaggac

SEQ ID NO: 1413272 - RNA, 22 nt, Human
aacuaugcauggugccccagga

SEQ ID NO: 1413273 - RNA, 17 nt, Human
aacuaugcauggugccc

SEQ ID NO: 1413274 - RNA, 16 nt, Human
aacuaugauuauuaac

SEQ ID NO: 1413275 - RNA, 14 nt, Human
aacuacuguguuau

SEQ ID NO: 1413276 - RNA, 17 nt, Human
aacuacuguguuaugca

SEQ ID NO: 1413277 - RNA, 21 nt, Human
aacuagaggugagaaauuuaa

SEQ ID NO: 1413278 - RNA, 20 nt, Human
aacuagaggugagaaauuua

SEQ ID NO: 1413279 - RNA, 21 nt, Human
aacuagaguuuagcuggaaaa

SEQ ID NO: 1413280 - RNA, 16 nt, Human
gucuuuugguuaugaa

SEQ ID NO: 1413281 - RNA, 14 nt, Human
gucuuuuggaggac

SEQ ID NO: 1413282 - RNA, 12 nt, Human
gucuuuuggagg

SEQ ID NO: 1413283 - RNA, 16 nt, Human
gucuuuugcuuuuggc

SEQ ID NO: 1413284 - RNA, 22 nt, Human
gucuuuugcuuuugcccauuuu

SEQ ID NO: 1413285 - RNA, 14 nt, Human
gucuuuugcuuuug

SEQ ID NO: 1413286 - RNA, 13 nt, Human
gucuuuugcuuuu

SEQ ID NO: 1413287 - RNA, 12 nt, Human
gucuuuugcuuu

SEQ ID NO: 1413288 - RNA, 15 nt, Human
gucuuuuguucgcau

SEQ ID NO: 1413289 - RNA, 16 nt, Human
gucuuuuuagaugccc

SEQ ID NO: 1413290 - RNA, 23 nt, Human
gucuucuaaacuuccccaucuuc

SEQ ID NO: 1413291 - RNA, 14 nt, Human
gucuucuaaacuuc

SEQ ID NO: 1413292 - RNA, 16 nt, Human
gucuuucacagcuccu

SEQ ID NO: 1413293 - RNA, 15 nt, Human
gucuuucacagcucc

SEQ ID NO: 1413294 - RNA, 24 nt, Human
gucuuuagauagcccuguccuggu

SEQ ID NO: 1413295 - RNA, 22 nt, Human
gucuuuagauagcccuguccug

SEQ ID NO: 1413296 - RNA, 21 nt, Human
gucuuuagauagcccuguccu

SEQ ID NO: 1413297 - RNA, 16 nt, Human
gucuuuagauagcccu

SEQ ID NO: 1413298 - RNA, 17 nt, Human
gucuuugguucuaagga

SEQ ID NO: 1413299 - RNA, 15 nt, Human
gucuuugguucuaag

SEQ ID NO: 1413300 - RNA, 15 nt, Human
gucuuugguucagcu

SEQ ID NO: 1413301 - RNA, 22 nt, Human
gucuuuggagaaaugcuuagaa

SEQ ID NO: 1413302 - RNA, 18 nt, Human
gucuuuggagaaaugcuu

SEQ ID NO: 1413303 - RNA, 16 nt, Human
gucuuucacauuuaaa

SEQ ID NO: 1413304 - RNA, 20 nt, Human
aaccugaugaaaauaaagaa

SEQ ID NO: 1413305 - RNA, 19 nt, Human
aaccugaugaaaauaaaga

SEQ ID NO: 1413306 - RNA, 17 nt, Human
aaccugaugaaaauaaa

SEQ ID NO: 1413307 - RNA, 20 nt, Human
aaccugagucguacagaaag

SEQ ID NO: 1413308 - RNA, 22 nt, Human
aaccugagauuuauuaaagaaa

SEQ ID NO: 1413309 - RNA, 21 nt, Human
aaccugagauuuauuaaagaa

SEQ ID NO: 1413310 - RNA, 23 nt, Human
gucuggcaaugccacagcccugu

SEQ ID NO: 1413311 - RNA, 22 nt, Human
gucuggcaaugccacagcccug

SEQ ID NO: 1413312 - RNA, 23 nt, Human
aaccugaugaaaauaaagaaugg

SEQ ID NO: 1413313 - RNA, 18 nt, Human
gucuggcaaugccacagc

SEQ ID NO: 1413314 - RNA, 22 nt, Human
aaccugaugaaaauaaagaaug

SEQ ID NO: 1413315 - RNA, 21 nt, Human
aaccugaugaaaauaaagaau

SEQ ID NO: 1413316 - RNA, 19 nt, Human
gucuggcacagccuggcug

SEQ ID NO: 1413317 - RNA, 17 nt, Human
gucuggcacagccuggc

SEQ ID NO: 1413318 - RNA, 19 nt, Human
gucuggcaguuuauauuua

SEQ ID NO: 1413319 - RNA, 11 nt, Human
gucuguaaaau

SEQ ID NO: 1413320 - RNA, 12 nt, Human
gucuguaaaauc

SEQ ID NO: 1413321 - RNA, 13 nt, Human
gucuguaaaaucu

SEQ ID NO: 1413322 - RNA, 14 nt, Human
gucuguaaaaucuu

SEQ ID NO: 1413323 - RNA, 15 nt, Human
gucuguaaaaucuuu

SEQ ID NO: 1413324 - RNA, 18 nt, Human
gucuguaaaaucuuucuu

SEQ ID NO: 1413325 - RNA, 17 nt, Human
gucuggccccccugguc

SEQ ID NO: 1413326 - RNA, 15 nt, Human
gucuggcccaccagg

SEQ ID NO: 1413327 - RNA, 22 nt, Human
gucuggcagccucccauccagg

SEQ ID NO: 1413328 - RNA, 12 nt, Human
gucuggcagccu

SEQ ID NO: 1413329 - RNA, 20 nt, Human
gucuguagguugcacacuuu

SEQ ID NO: 1413330 - RNA, 22 nt, Human
gucuguagugucacucaaggcg

SEQ ID NO: 1413331 - RNA, 19 nt, Human
gucuguagguugcacacuu

SEQ ID NO: 1413332 - RNA, 18 nt, Human
gucuguagguugcacacu

SEQ ID NO: 1413333 - RNA, 17 nt, Human
gucuguagguugcacac

SEQ ID NO: 1413334 - RNA, 16 nt, Human
gucuguagguugcaca

SEQ ID NO: 1413335 - RNA, 14 nt, Human
gucugucugucugu

SEQ ID NO: 1413336 - RNA, 16 nt, Human
gucugucugucugucc

SEQ ID NO: 1413337 - RNA, 19 nt, Human
gucuuccugaguggugcca

SEQ ID NO: 1413338 - RNA, 15 nt, Human
aacagguaauauaaa

SEQ ID NO: 1413339 - RNA, 22 nt, Human
aacagggaaggcaggcagggcu

SEQ ID NO: 1413340 - RNA, 23 nt, Human
aacagggaaggcaggcagggcuc

SEQ ID NO: 1413341 - RNA, 20 nt, Human
aacagggaaggcaggcaggg

SEQ ID NO: 1413342 - RNA, 15 nt, Human
aacagggaaggcagg

SEQ ID NO: 1413343 - RNA, 13 nt, Human
aacagggaaggca

SEQ ID NO: 1413344 - RNA, 17 nt, Human
aacagugcaacacuggu

SEQ ID NO: 1413345 - RNA, 15 nt, Human
aacagguauauacuu

SEQ ID NO: 1413346 - RNA, 18 nt, Human
aacagguaauauaaaaag

SEQ ID NO: 1413347 - RNA, 21 nt, Human
aacagaucuggaaccucagcc

SEQ ID NO: 1413348 - RNA, 22 nt, Human
aacagaucuggaaccucagccu

SEQ ID NO: 1413349 - RNA, 13 nt, Human
aacagaucuggaa

SEQ ID NO: 1413350 - RNA, 14 nt, Human
aacagaucaguaaa

SEQ ID NO: 1413351 - RNA, 21 nt, Human
aacagaagggagggcagagcu

SEQ ID NO: 1413352 - RNA, 21 nt, Human
aacagaaugucucuuccuggu

SEQ ID NO: 1413353 - RNA, 22 nt, Human
aacagaagggagggcagagcug

SEQ ID NO: 1413354 - RNA, 18 nt, Human
aacagaagggagggcaga

SEQ ID NO: 1413355 - RNA, 19 nt, Human
gucccuuguauccccugca

SEQ ID NO: 1413356 - RNA, 20 nt, Human
gucccuuguauccccugcag

SEQ ID NO: 1413357 - RNA, 21 nt, Human
gucccuugccccccuggccuc

SEQ ID NO: 1413358 - RNA, 19 nt, Human
gucccuugccucaaugcca

SEQ ID NO: 1413359 - RNA, 14 nt, Human
gucccuugccucaa

SEQ ID NO: 1413360 - RNA, 13 nt, Human
gucccuugccuca

SEQ ID NO: 1413361 - RNA, 20 nt, Human
gucccuugccccccuggccu

SEQ ID NO: 1413362 - RNA, 19 nt, Human
gucccuugccccccuggcc

SEQ ID NO: 1413363 - RNA, 18 nt, Human
gucccuugccccccuggc

SEQ ID NO: 1413364 - RNA, 15 nt, Human
gucccuugccccccu

SEQ ID NO: 1413365 - RNA, 13 nt, Human
gucccuugccccc

SEQ ID NO: 1413366 - RNA, 13 nt, Human
guccccccacccu

SEQ ID NO: 1413367 - RNA, 22 nt, Human
guccccccacccucauucuacu

SEQ ID NO: 1413368 - RNA, 12 nt, Human
aacagaaaugua

SEQ ID NO: 1413369 - RNA, 13 nt, Human
aacagaaauguac

SEQ ID NO: 1413370 - RNA, 14 nt, Human
aacagaaauguaca

SEQ ID NO: 1413371 - RNA, 15 nt, Human
aacagaaauguacag

SEQ ID NO: 1413372 - RNA, 22 nt, Human
guccaagaauccacauuucuaa

SEQ ID NO: 1413373 - RNA, 18 nt, Human
guccaaaaccgccagcuc

SEQ ID NO: 1413374 - RNA, 17 nt, Human
guccaaaaccgccagcu

SEQ ID NO: 1413375 - RNA, 15 nt, Human
guccaaaaccgccag

SEQ ID NO: 1413376 - RNA, 20 nt, Human
gucauuuuuacaauguaauu

SEQ ID NO: 1413377 - RNA, 23 nt, Human
gucauuuuuuuucuuugaauaaa

SEQ ID NO: 1413378 - RNA, 22 nt, Human
gucauuuuuacaauguaauuau

SEQ ID NO: 1413379 - RNA, 17 nt, Human
gucauuuuuacaaugua

SEQ ID NO: 1413380 - RNA, 18 nt, Human
gucauuuugguacuuugg

SEQ ID NO: 1413381 - RNA, 20 nt, Human
gucauuuugguacuuuggug

SEQ ID NO: 1413382 - RNA, 19 nt, Human
gucauuuuuuuuaagaaaa

SEQ ID NO: 1413383 - RNA, 21 nt, Human
gucauuuuuuuuaagaaaaag

SEQ ID NO: 1413384 - RNA, 19 nt, Human
aacacagaaaccuuuuuaa

SEQ ID NO: 1413385 - RNA, 23 nt, Human
aacacacuaccgaaugugucuuu

SEQ ID NO: 1413386 - RNA, 19 nt, Human
aacacacuaccgaaugugu

SEQ ID NO: 1413387 - RNA, 17 nt, Human
aacacacuaccgaaugu

SEQ ID NO: 1413388 - RNA, 17 nt, Human
aacacaacuauauuguu

SEQ ID NO: 1413389 - RNA, 12 nt, Human
guccccccaccc

SEQ ID NO: 1413390 - RNA, 11 nt, Human
guccccccacc

SEQ ID NO: 1413391 - RNA, 20 nt, Human
gucccccacucuaaagcaaa

SEQ ID NO: 1413392 - RNA, 17 nt, Human
guccccauacuccuaug

SEQ ID NO: 1413393 - RNA, 16 nt, Human
guccccauacuccuau

SEQ ID NO: 1413394 - RNA, 13 nt, Human
guccccagccugg

SEQ ID NO: 1413395 - RNA, 23 nt, Human
gucccacccccacccccagcuca

SEQ ID NO: 1413396 - RNA, 22 nt, Human
gucccacccccacccccagcuc

SEQ ID NO: 1413397 - RNA, 21 nt, Human
gucccacccccacccccagcu

SEQ ID NO: 1413398 - RNA, 19 nt, Human
gucccacccccacccccag

SEQ ID NO: 1413399 - RNA, 15 nt, Human
gucccacccccaccc

SEQ ID NO: 1413400 - RNA, 14 nt, Human
gucccacccccacc

SEQ ID NO: 1413401 - RNA, 16 nt, Human
guccauaucacacaca

SEQ ID NO: 1413402 - RNA, 15 nt, Human
guccauaucacacac

SEQ ID NO: 1413403 - RNA, 14 nt, Human
guccauaucacaca

SEQ ID NO: 1413404 - RNA, 20 nt, Human
guccaagauuccggauccua

SEQ ID NO: 1413405 - RNA, 16 nt, Human
guccaagauuccggau

SEQ ID NO: 1413406 - RNA, 23 nt, Human
guccaagaauccacauuucuaaa

SEQ ID NO: 1413407 - RNA, 24 nt, Human
guccagugggaggugagaccaccu

SEQ ID NO: 1413408 - RNA, 15 nt, Human
guccaguguuucuuu

SEQ ID NO: 1413409 - RNA, 15 nt, Human
aacaaugcuguauuu

SEQ ID NO: 1413410 - RNA, 12 nt, Human
aacaauaaaaga

SEQ ID NO: 1413411 - RNA, 23 nt, Human
aacaauugaaguaaacuuuuugu

SEQ ID NO: 1413412 - RNA, 17 nt, Human
aacaauugaaguaaacu

SEQ ID NO: 1413413 - RNA, 16 nt, Human
aacaauugaaguaaac

SEQ ID NO: 1413414 - RNA, 19 nt, Human
aacaauucuaaaaugauug

SEQ ID NO: 1413415 - RNA, 22 nt, Human
aacaauucuaaaaugauuguag

SEQ ID NO: 1413416 - RNA, 14 nt, Human
aacaauucuaaaau

SEQ ID NO: 1413417 - RNA, 12 nt, Human
aacaauucuaaa

SEQ ID NO: 1413418 - RNA, 16 nt, Human
aacacaacuauauugu

SEQ ID NO: 1413419 - RNA, 15 nt, Human
aacacaacuauauug

SEQ ID NO: 1413420 - RNA, 22 nt, Human
aacaaugcuguauuuuaaaaga

SEQ ID NO: 1413421 - RNA, 17 nt, Human
aacaaugcuguauuuua

SEQ ID NO: 1413422 - RNA, 19 nt, Human
aacaagagcacuacauuca

SEQ ID NO: 1413423 - RNA, 21 nt, Human
aacaagagaagcauucucauu

SEQ ID NO: 1413424 - RNA, 17 nt, Human
aacaagagaagcauucu

SEQ ID NO: 1413425 - RNA, 16 nt, Human
aacaagagaagcauuc

SEQ ID NO: 1413426 - RNA, 15 nt, Human
aacaagagaagcauu

SEQ ID NO: 1413427 - RNA, 23 nt, Human
aacaagaccucagugccuuccug

SEQ ID NO: 1413428 - RNA, 22 nt, Human
aacaagaccucagugccuuccu

SEQ ID NO: 1413429 - RNA, 15 nt, Human
aaauuuuuuguugac

SEQ ID NO: 1413430 - RNA, 21 nt, Human
aaauuuuuuuagaaagcauuu

SEQ ID NO: 1413431 - RNA, 18 nt, Human
aaauuuuuuguugacauu

SEQ ID NO: 1413432 - RNA, 13 nt, Human
aaauuuuuuuaga

SEQ ID NO: 1413433 - RNA, 15 nt, Human
aaauuuuuuuagaaa

SEQ ID NO: 1413434 - RNA, 14 nt, Human
aaauuuuuuguuga

SEQ ID NO: 1413435 - RNA, 11 nt, Human
aaauuuuuugu

SEQ ID NO: 1413436 - RNA, 20 nt, Human
aaauuuuuguaguagcguuu

SEQ ID NO: 1413437 - RNA, 23 nt, Human
aaauuuuccuguccucuuucagc

SEQ ID NO: 1413438 - RNA, 22 nt, Human
aaauuuuccuguccucuuucag

SEQ ID NO: 1413439 - RNA, 23 nt, Human
aaauuuuagcgugcucacugacc

SEQ ID NO: 1413440 - RNA, 12 nt, Human
aaauuuuauaug

SEQ ID NO: 1413441 - RNA, 20 nt, Human
aaauuuuuucucuaggaaau

SEQ ID NO: 1413442 - RNA, 18 nt, Human
aaauuuugauguuuuaag

SEQ ID NO: 1413443 - RNA, 23 nt, Human
aaauuuugauguuuuaaggaugc

SEQ ID NO: 1413444 - RNA, 22 nt, Human
gucaggcccuuauuuucaagaa

SEQ ID NO: 1413445 - RNA, 21 nt, Human
gucaggcccuuauuuucaaga

SEQ ID NO: 1413446 - RNA, 13 nt, Human
gucaggcagggug

SEQ ID NO: 1413447 - RNA, 18 nt, Human
gucaggcacugggcauga

SEQ ID NO: 1413448 - RNA, 16 nt, Human
gucaggcacugggcau

SEQ ID NO: 1413449 - RNA, 23 nt, Human
gucaggauugcgagagaugugug

SEQ ID NO: 1413450 - RNA, 22 nt, Human
gucaggauugcgagagaugugu

SEQ ID NO: 1413451 - RNA, 21 nt, Human
gucaggauugcgagagaugug

SEQ ID NO: 1413452 - RNA, 19 nt, Human
gucaggauugcgagagaug

SEQ ID NO: 1413453 - RNA, 18 nt, Human
gucaggauugcgagagau

SEQ ID NO: 1413454 - RNA, 14 nt, Human
gucagacccuggag

SEQ ID NO: 1413455 - RNA, 13 nt, Human
gucaacaguaaac

SEQ ID NO: 1413456 - RNA, 12 nt, Human
gucacagccacc

SEQ ID NO: 1413457 - RNA, 20 nt, Human
gucacacaguguuggagguu

SEQ ID NO: 1413458 - RNA, 19 nt, Human
gucacacaguguuggaggu

SEQ ID NO: 1413459 - RNA, 13 nt, Human
gucagaauagaaa

SEQ ID NO: 1413460 - RNA, 17 nt, Human
gucagaauagaaauuag

SEQ ID NO: 1413461 - RNA, 22 nt, Human
gucaguaccuucaaacuagggc

SEQ ID NO: 1413462 - RNA, 13 nt, Human
gucagucacagcc

SEQ ID NO: 1413463 - RNA, 14 nt, Human
aaauuugauugauu

SEQ ID NO: 1413464 - RNA, 18 nt, Human
gucauaacuaaauaaagc

SEQ ID NO: 1413465 - RNA, 16 nt, Human
gucagucacagccacc

SEQ ID NO: 1413466 - RNA, 14 nt, Human
gucagucacagcca

SEQ ID NO: 1413467 - RNA, 15 nt, Human
aaauuuguucuugua

SEQ ID NO: 1413468 - RNA, 14 nt, Human
aaauuuguugcaua

SEQ ID NO: 1413469 - RNA, 13 nt, Human
aaauuuguugcau

SEQ ID NO: 1413470 - RNA, 18 nt, Human
aaauuuguucuuguauuu

SEQ ID NO: 1413471 - RNA, 19 nt, Human
aaauuuguuauuuugcaac

SEQ ID NO: 1413472 - RNA, 20 nt, Human
aaauuuguacuauuuaacug

SEQ ID NO: 1413473 - RNA, 19 nt, Human
aaauuuguacuauuuaacu

SEQ ID NO: 1413474 - RNA, 17 nt, Human
aaauuuguacuauuuaa

SEQ ID NO: 1413475 - RNA, 13 nt, Human
aaauuuguacuau

SEQ ID NO: 1413476 - RNA, 12 nt, Human
aaauuuguacua

SEQ ID NO: 1413477 - RNA, 11 nt, Human
aaauuuguacu

SEQ ID NO: 1413478 - RNA, 17 nt, Human
aaauuugcauuaaauua

SEQ ID NO: 1413479 - RNA, 17 nt, Human
aaauuugauugauuuga

SEQ ID NO: 1413480 - RNA, 15 nt, Human
aaauuugauugauuu

SEQ ID NO: 1413481 - RNA, 12 nt, Human
aaauuugccaag

SEQ ID NO: 1413482 - RNA, 20 nt, Human
guaacacuaauauauuuaaa

SEQ ID NO: 1413483 - RNA, 22 nt, Human
guaacacuaauauauuuaaaaa

SEQ ID NO: 1413484 - RNA, 19 nt, Human
guaacacuaauauauuuaa

SEQ ID NO: 1413485 - RNA, 17 nt, Human
guaacacuaauauauuu

SEQ ID NO: 1413486 - RNA, 16 nt, Human
guaacacuaauauauu

SEQ ID NO: 1413487 - RNA, 15 nt, Human
guaacacuaauauau

SEQ ID NO: 1413488 - RNA, 18 nt, Human
guaacaauacaaauggau

SEQ ID NO: 1413489 - RNA, 21 nt, Human
guaacaauuguguagccuuuu

SEQ ID NO: 1413490 - RNA, 17 nt, Human
guaacaauacaaaugga

SEQ ID NO: 1413491 - RNA, 14 nt, Human
guaacaauacaaau

SEQ ID NO: 1413492 - RNA, 22 nt, Human
guaaauuggcauggaaauuuaa

SEQ ID NO: 1413493 - RNA, 14 nt, Human
aaaugguccaggag

SEQ ID NO: 1413494 - RNA, 21 nt, Human
aaaugguccaauuaguuuccu

SEQ ID NO: 1413495 - RNA, 16 nt, Human
aaaugguaucuuuugg

SEQ ID NO: 1413496 - RNA, 19 nt, Human
aaaugguaggcauuuccua

SEQ ID NO: 1413497 - RNA, 18 nt, Human
aaaugguacuguacagcu

SEQ ID NO: 1413498 - RNA, 23 nt, Human
aaaugguucagaauuaaacuuuu

SEQ ID NO: 1413499 - RNA, 13 nt, Human
aaaugguuguauu

SEQ ID NO: 1413500 - RNA, 14 nt, Human
aaaugguucagaau

SEQ ID NO: 1413501 - RNA, 22 nt, Human
aaaugguccaauuaguuuccuu

SEQ ID NO: 1413502 - RNA, 20 nt, Human
aaauggucucuaacauuucc

SEQ ID NO: 1413503 - RNA, 20 nt, Human
aaauguaaggcuguguaaga

SEQ ID NO: 1413504 - RNA, 17 nt, Human
aaauguaaggcugugua

SEQ ID NO: 1413505 - RNA, 13 nt, Human
aaauguaaggcug

SEQ ID NO: 1413506 - RNA, 22 nt, Human
aaauguaagauuauagauucua

SEQ ID NO: 1413507 - RNA, 21 nt, Human
aaauguaagauuauagauucu

SEQ ID NO: 1413508 - RNA, 20 nt, Human
aaauguaagauuauagauuc

SEQ ID NO: 1413509 - RNA, 18 nt, Human
aaauguaacuuuuguaag

SEQ ID NO: 1413510 - RNA, 17 nt, Human
aaauguaacuuuuguaa

SEQ ID NO: 1413511 - RNA, 13 nt, Human
aaauguaaagcca

SEQ ID NO: 1413512 - RNA, 22 nt, Human
aaauguaaagauauuuuuaucu

SEQ ID NO: 1413513 - RNA, 15 nt, Human
aaaugguucagaauu

SEQ ID NO: 1413514 - RNA, 20 nt, Human
aaaugguuguauuagauguu

SEQ ID NO: 1413515 - RNA, 22 nt, Human
aaaugguuguauuagauguucu

SEQ ID NO: 1413516 - RNA, 14 nt, Human
aaaugguuguauua

SEQ ID NO: 1413517 - RNA, 16 nt, Human
aaaugguuguauuaga

SEQ ID NO: 1413518 - RNA, 17 nt, Human
aaaugguuguauuagau

SEQ ID NO: 1413519 - RNA, 19 nt, Human
aaaugguuguauuagaugu

SEQ ID NO: 1413520 - RNA, 20 nt, Human
guaguguuggagaagaacug

SEQ ID NO: 1413521 - RNA, 14 nt, Human
guaguugaauauug

SEQ ID NO: 1413522 - RNA, 18 nt, Human
aaauguaaggcuguguaa

SEQ ID NO: 1413523 - RNA, 17 nt, Human
guaguugccuuaaaaua

SEQ ID NO: 1413524 - RNA, 19 nt, Human
guauaaaaauaaaaaagau

SEQ ID NO: 1413525 - RNA, 16 nt, Human
guauaaaaauaaaaaa

SEQ ID NO: 1413526 - RNA, 17 nt, Human
guaguuuuuucaucuuc

SEQ ID NO: 1413527 - RNA, 15 nt, Human
guaguuuuuucaucu

SEQ ID NO: 1413528 - RNA, 14 nt, Human
guaguuuuuucauc

SEQ ID NO: 1413529 - RNA, 13 nt, Human
guaguuuuuucau

SEQ ID NO: 1413530 - RNA, 20 nt, Human
guaguuuuuauauguuguaa

SEQ ID NO: 1413531 - RNA, 16 nt, Human
guaguugucuuuccug

SEQ ID NO: 1413532 - RNA, 12 nt, Human
guaguugucuuu

SEQ ID NO: 1413533 - RNA, 19 nt, Human
guauaaaacuuuccucgcc

SEQ ID NO: 1413534 - RNA, 18 nt, Human
guauaaaacuuuccucgc

SEQ ID NO: 1413535 - RNA, 16 nt, Human
guauaaaacuuuccuc

SEQ ID NO: 1413536 - RNA, 15 nt, Human
guauaaaacuuuccu

SEQ ID NO: 1413537 - RNA, 19 nt, Human
guauaaaagggacugagaa

SEQ ID NO: 1413538 - RNA, 16 nt, Human
guaugcauguugucua

SEQ ID NO: 1413539 - RNA, 12 nt, Human
guaugcauguug

SEQ ID NO: 1413540 - RNA, 20 nt, Human
guauccagguucccucccag

SEQ ID NO: 1413541 - RNA, 19 nt, Human
guauccacuuugcacagcu

SEQ ID NO: 1413542 - RNA, 14 nt, Human
guauccacuuugca

SEQ ID NO: 1413543 - RNA, 18 nt, Human
guaucaugcccugugcaa

SEQ ID NO: 1413544 - RNA, 17 nt, Human
guaucaugcccugugca

SEQ ID NO: 1413545 - RNA, 13 nt, Human
guaucaucagugu

SEQ ID NO: 1413546 - RNA, 15 nt, Human
guaucauagaaaugu

SEQ ID NO: 1413547 - RNA, 12 nt, Human
guaucauagaaa

SEQ ID NO: 1413548 - RNA, 19 nt, Human
guaucaaauacauuuaaaa

SEQ ID NO: 1413549 - RNA, 15 nt, Human
guauauuuuccuaua

SEQ ID NO: 1413550 - RNA, 14 nt, Human
guauauuuuccuau

SEQ ID NO: 1413551 - RNA, 14 nt, Human
guaucaaauacauu

SEQ ID NO: 1413552 - RNA, 13 nt, Human
guaucaaauacau

SEQ ID NO: 1413553 - RNA, 23 nt, Human
guauaaaaauaaaaaagauccca

SEQ ID NO: 1413554 - RNA, 21 nt, Human
guauaaaacuuuccucgccug

SEQ ID NO: 1413555 - RNA, 11 nt, Human
guauaaaagau

SEQ ID NO: 1413556 - RNA, 21 nt, Human
guauaaaauaauuuuuauauu

SEQ ID NO: 1413557 - RNA, 15 nt, Human
guauaaaauaauuuu

SEQ ID NO: 1413558 - RNA, 20 nt, Human
guauauuguguuuguguauu

SEQ ID NO: 1413559 - RNA, 19 nt, Human
guauauuguguuuguguau

SEQ ID NO: 1413560 - RNA, 13 nt, Human
guauauuguguuu

SEQ ID NO: 1413561 - RNA, 13 nt, Human
aaauuauuuaaac

SEQ ID NO: 1413562 - RNA, 12 nt, Human
aaauuauuuaaa

SEQ ID NO: 1413563 - RNA, 20 nt, Human
aaauuauuguuuuucuuuuu

SEQ ID NO: 1413564 - RNA, 12 nt, Human
aaauuauuguuu

SEQ ID NO: 1413565 - RNA, 18 nt, Human
aaauuauuaauuuaugca

SEQ ID NO: 1413566 - RNA, 14 nt, Human
aaauuauuaaugaa

SEQ ID NO: 1413567 - RNA, 13 nt, Human
aaauuauagaagu

SEQ ID NO: 1413568 - RNA, 13 nt, Human
aaauuaguuauau

SEQ ID NO: 1413569 - RNA, 13 nt, Human
aaauuaagacuuu

SEQ ID NO: 1413570 - RNA, 15 nt, Human
aaauuaagaaggcaa

SEQ ID NO: 1413571 - RNA, 14 nt, Human
aaauuaagaaggca

SEQ ID NO: 1413572 - RNA, 14 nt, Human
aaauuaagaaagga

SEQ ID NO: 1413573 - RNA, 13 nt, Human
aaauguuaaaaug

SEQ ID NO: 1413574 - RNA, 20 nt, Human
aaaugugggauuauggguca

SEQ ID NO: 1413575 - RNA, 22 nt, Human
aaaugugggauuaugggucaca

SEQ ID NO: 1413576 - RNA, 22 nt, Human
aaaugugauguucuaaggcucu

SEQ ID NO: 1413577 - RNA, 20 nt, Human
aaaugugauguucuaaggcu

SEQ ID NO: 1413578 - RNA, 19 nt, Human
aaaugugauguucuaaggc

SEQ ID NO: 1413579 - RNA, 18 nt, Human
aaaugugauguucuaagg

SEQ ID NO: 1413580 - RNA, 15 nt, Human
aaaugugauguucua

SEQ ID NO: 1413581 - RNA, 21 nt, Human
aaaugugaugaauacuguauu

SEQ ID NO: 1413582 - RNA, 12 nt, Human
aaauguguuguu

SEQ ID NO: 1413583 - RNA, 13 nt, Human
aaaugugaugaau

SEQ ID NO: 1413584 - RNA, 16 nt, Human
aaaugugaguguuuuu

SEQ ID NO: 1413585 - RNA, 19 nt, Human
aaaugucuuuaaugcaaua

SEQ ID NO: 1413586 - RNA, 18 nt, Human
aaaugucuuuaaugcaau

SEQ ID NO: 1413587 - RNA, 14 nt, Human
aaaugucuuuaaug

SEQ ID NO: 1413588 - RNA, 13 nt, Human
aaaugucuugugu

SEQ ID NO: 1413589 - RNA, 18 nt, Human
aaaugucaugcugccuua

SEQ ID NO: 1413590 - RNA, 15 nt, Human
aaaugucaugcugcc

SEQ ID NO: 1413591 - RNA, 20 nt, Human
aaaugucacuuuuugaggca

SEQ ID NO: 1413592 - RNA, 22 nt, Human
aaaugucacuuuuugaggcaaa

SEQ ID NO: 1413593 - RNA, 16 nt, Human
aaaugucacuuuuuga

SEQ ID NO: 1413594 - RNA, 15 nt, Human
aaaugucacuuuuug

SEQ ID NO: 1413595 - RNA, 14 nt, Human
aaaugucacuuuuu

SEQ ID NO: 1413596 - RNA, 13 nt, Human
aaaugucacuuuu

SEQ ID NO: 1413597 - RNA, 15 nt, Human
aaauguccuugugau

SEQ ID NO: 1413598 - RNA, 22 nt, Human
aaauguccuugugaugugcacg

SEQ ID NO: 1413599 - RNA, 16 nt, Human
aaaugucaugcugccu

SEQ ID NO: 1413600 - RNA, 19 nt, Human
aaauguauuuuauguuaua

SEQ ID NO: 1413601 - RNA, 21 nt, Human
aaauguauuuuauguuauaua

SEQ ID NO: 1413602 - RNA, 18 nt, Human
aaauguauuuuauguuau

SEQ ID NO: 1413603 - RNA, 16 nt, Human
aaauguauuuuauguu

SEQ ID NO: 1413604 - RNA, 15 nt, Human
aaauguauuuuaugu

SEQ ID NO: 1413605 - RNA, 20 nt, Human
aaauguaugcauguugucua

SEQ ID NO: 1413606 - RNA, 19 nt, Human
aaauguaugcauguugucu

SEQ ID NO: 1413607 - RNA, 16 nt, Human
aaauguaugcauguug

SEQ ID NO: 1413608 - RNA, 15 nt, Human
aaauguaugcauguu

SEQ ID NO: 1413609 - RNA, 14 nt, Human
aaauguaugcaugu

SEQ ID NO: 1413610 - RNA, 13 nt, Human
aaauguaugcaug

SEQ ID NO: 1413611 - RNA, 13 nt, Human
guaugucuccagu

SEQ ID NO: 1413612 - RNA, 15 nt, Human
aaauguauuacagug

SEQ ID NO: 1413613 - RNA, 16 nt, Human
guaugguuuuguggau

SEQ ID NO: 1413614 - RNA, 15 nt, Human
guaugguugacacua

SEQ ID NO: 1413615 - RNA, 13 nt, Human
guauguauuauuu

SEQ ID NO: 1413616 - RNA, 18 nt, Human
guauguacuucaugcugu

SEQ ID NO: 1413617 - RNA, 21 nt, Human
gucaaacuuggauacuuggau

SEQ ID NO: 1413618 - RNA, 13 nt, Human
gucaaacuuggau

SEQ ID NO: 1413619 - RNA, 12 nt, Human
gucaaacaaaua

SEQ ID NO: 1413620 - RNA, 17 nt, Human
gucaaacuuggauacuu

SEQ ID NO: 1413621 - RNA, 17 nt, Human
gucaacacuaacaugau

SEQ ID NO: 1413622 - RNA, 18 nt, Human
gucaaaauagugccacua

SEQ ID NO: 1413623 - RNA, 20 nt, Human
gucaaaacagauuguuugca

SEQ ID NO: 1413624 - RNA, 15 nt, Human
gucaaaacagauugu

SEQ ID NO: 1413625 - RNA, 13 nt, Human
gucaaaacagauu

SEQ ID NO: 1413626 - RNA, 14 nt, Human
gucaaaacacuugu

SEQ ID NO: 1413627 - RNA, 13 nt, Human
guauuuuucuuga

SEQ ID NO: 1413628 - RNA, 22 nt, Human
aaauuuauuucaauauuagcaa

SEQ ID NO: 1413629 - RNA, 13 nt, Human
aaauuuauuuccu

SEQ ID NO: 1413630 - RNA, 20 nt, Human
aaauuuauuuccuaguucug

SEQ ID NO: 1413631 - RNA, 23 nt, Human
aaauugugcaguacuuugugcau

SEQ ID NO: 1413632 - RNA, 15 nt, Human
aaauuguacagccgg

SEQ ID NO: 1413633 - RNA, 14 nt, Human
aaauuguacagccg

SEQ ID NO: 1413634 - RNA, 14 nt, Human
aaauuguauauuca

SEQ ID NO: 1413635 - RNA, 15 nt, Human
aaauuguauauucac

SEQ ID NO: 1413636 - RNA, 16 nt, Human
aaauuguauauucacu

SEQ ID NO: 1413637 - RNA, 13 nt, Human
aaauuauuugcau

SEQ ID NO: 1413638 - RNA, 15 nt, Human
aaauucugcucagau

SEQ ID NO: 1413639 - RNA, 16 nt, Human
aaauucugucucugga

SEQ ID NO: 1413640 - RNA, 19 nt, Human
aaauuguaagcaugcacaa

SEQ ID NO: 1413641 - RNA, 18 nt, Human
aaauucugucucuggauu

SEQ ID NO: 1413642 - RNA, 20 nt, Human
aaauuguaagcaugcacaaa

SEQ ID NO: 1413643 - RNA, 22 nt, Human
aaauucugugccuuguuuuuug

SEQ ID NO: 1413644 - RNA, 16 nt, Human
aaauucugugccuugu

SEQ ID NO: 1413645 - RNA, 15 nt, Human
aagaggcugaggccu

SEQ ID NO: 1413646 - RNA, 22 nt, Human
aagaggcugaggcuggcacagg

SEQ ID NO: 1413647 - RNA, 20 nt, Human
aagaggcugaggccuggacu

SEQ ID NO: 1413648 - RNA, 18 nt, Human
aagaggcugaggccugga

SEQ ID NO: 1413649 - RNA, 21 nt, Human
aagaggcugccccucucacca

SEQ ID NO: 1413650 - RNA, 17 nt, Human
aagaggcugccccucuc

SEQ ID NO: 1413651 - RNA, 16 nt, Human
aagaggcugcccuccu

SEQ ID NO: 1413652 - RNA, 23 nt, Human
aagaggcugccccucucaccaaa

SEQ ID NO: 1413653 - RNA, 22 nt, Human
aagaggcugccccucucaccaa

SEQ ID NO: 1413654 - RNA, 15 nt, Human
aagaguagaauugca

SEQ ID NO: 1413655 - RNA, 20 nt, Human
aagaguagaaacugcaggga

SEQ ID NO: 1413656 - RNA, 18 nt, Human
aagaucuguccucagccu

SEQ ID NO: 1413657 - RNA, 17 nt, Human
aagaucuguccucagcc

SEQ ID NO: 1413658 - RNA, 23 nt, Human
aagaucugcagggggugugucug

SEQ ID NO: 1413659 - RNA, 11 nt, Human
aagaugaauga

SEQ ID NO: 1413660 - RNA, 23 nt, Human
aagaugaacccgaggcugagaau

SEQ ID NO: 1413661 - RNA, 22 nt, Human
aagaugaacccgaggcugagaa

SEQ ID NO: 1413662 - RNA, 23 nt, Human
aagaugaaggagaggcaacaucc

SEQ ID NO: 1413663 - RNA, 16 nt, Human
aagaugaaagagcagu

SEQ ID NO: 1413664 - RNA, 14 nt, Human
aagauggaguuucu

SEQ ID NO: 1413665 - RNA, 15 nt, Human
aagauggaguuucua

SEQ ID NO: 1413666 - RNA, 20 nt, Human
aagauggaauuuaucaaacc

SEQ ID NO: 1413667 - RNA, 12 nt, Human
aagaugcuuuua

SEQ ID NO: 1413668 - RNA, 22 nt, Human
aagaugcuuuuaacagagucug

SEQ ID NO: 1413669 - RNA, 19 nt, Human
guguguccaaaacugccuc

SEQ ID NO: 1413670 - RNA, 15 nt, Human
guguguauuugcuaa

SEQ ID NO: 1413671 - RNA, 18 nt, Human
guguguccaaaacugccu

SEQ ID NO: 1413672 - RNA, 20 nt, Human
gugugguacagagaagccag

SEQ ID NO: 1413673 - RNA, 19 nt, Human
gugugguacagagaagcca

SEQ ID NO: 1413674 - RNA, 18 nt, Human
gugugguacagagaagcc

SEQ ID NO: 1413675 - RNA, 17 nt, Human
gugugguacagagaagc

SEQ ID NO: 1413676 - RNA, 16 nt, Human
gugugguacagagaag

SEQ ID NO: 1413677 - RNA, 15 nt, Human
gugugguacagagaa

SEQ ID NO: 1413678 - RNA, 14 nt, Human
gugugguacagaga

SEQ ID NO: 1413679 - RNA, 24 nt, Human
guguccaaaaccgccagcucuguu

SEQ ID NO: 1413680 - RNA, 23 nt, Human
guguccaaaaccgccagcucugu

SEQ ID NO: 1413681 - RNA, 22 nt, Human
guguccaaaaccgccagcucug

SEQ ID NO: 1413682 - RNA, 20 nt, Human
guguccaaaaccgccagcuc

SEQ ID NO: 1413683 - RNA, 18 nt, Human
guguccaaaaccgccagc

SEQ ID NO: 1413684 - RNA, 17 nt, Human
guguccaaaaccgccag

SEQ ID NO: 1413685 - RNA, 16 nt, Human
gugucauuucucaucc

SEQ ID NO: 1413686 - RNA, 20 nt, Human
gugucauccucacagugaac

SEQ ID NO: 1413687 - RNA, 19 nt, Human
gugucaggcacugggcaug

SEQ ID NO: 1413688 - RNA, 22 nt, Human
gugucaggcacugggcaugagg

SEQ ID NO: 1413689 - RNA, 15 nt, Human
gugugaaugaacacu

SEQ ID NO: 1413690 - RNA, 14 nt, Human
gugugaaugaacac

SEQ ID NO: 1413691 - RNA, 12 nt, Human
guguccaccccc

SEQ ID NO: 1413692 - RNA, 11 nt, Human
guguccacccc

SEQ ID NO: 1413693 - RNA, 20 nt, Human
aagauggggaccagcagccc

SEQ ID NO: 1413694 - RNA, 18 nt, Human
aagauggggaccagcagc

SEQ ID NO: 1413695 - RNA, 22 nt, Human
aagaugggcaucuuuuguauua

SEQ ID NO: 1413696 - RNA, 20 nt, Human
aagaugggcaucuuuuguau

SEQ ID NO: 1413697 - RNA, 19 nt, Human
aagaugggcaucuuuugua

SEQ ID NO: 1413698 - RNA, 15 nt, Human
aagauggggucugua

SEQ ID NO: 1413699 - RNA, 17 nt, Human
aagauggggucuguaaa

SEQ ID NO: 1413700 - RNA, 18 nt, Human
aagauggggucuguaaaa

SEQ ID NO: 1413701 - RNA, 19 nt, Human
aagauggggucuguaaaau

SEQ ID NO: 1413702 - RNA, 20 nt, Human
aagauggggucuguaaaauc

SEQ ID NO: 1413703 - RNA, 21 nt, Human
aagauggggucuguaaaaucu

SEQ ID NO: 1413704 - RNA, 22 nt, Human
aagauggggucuguaaaaucuu

SEQ ID NO: 1413705 - RNA, 19 nt, Human
guguauuuggaaauaaagu

SEQ ID NO: 1413706 - RNA, 14 nt, Human
guguauuugcuuuu

SEQ ID NO: 1413707 - RNA, 19 nt, Human
guguauuugcuaauuuuua

SEQ ID NO: 1413708 - RNA, 10 nt, Human
guguauuugc

SEQ ID NO: 1413709 - RNA, 21 nt, Human
guguauuuacgcuuugauuca

SEQ ID NO: 1413710 - RNA, 17 nt, Human
guguauuuacgcuuuga

SEQ ID NO: 1413711 - RNA, 22 nt, Human
gugucacucaaggcggugcuug

SEQ ID NO: 1413712 - RNA, 19 nt, Human
gugucaacucuuuguuauu

SEQ ID NO: 1413713 - RNA, 21 nt, Human
gugucacucaaggcggugcuu

SEQ ID NO: 1413714 - RNA, 20 nt, Human
gugucagacccuggaggccc

SEQ ID NO: 1413715 - RNA, 21 nt, Human
guguauuuggaaauaaaguca

SEQ ID NO: 1413716 - RNA, 17 nt, Human
guguauuuuuuuacuaa

SEQ ID NO: 1413717 - RNA, 23 nt, Human
guguauuuuuuuacuaauagaca

SEQ ID NO: 1413718 - RNA, 16 nt, Human
aacuugccugccuuuc

SEQ ID NO: 1413719 - RNA, 13 nt, Human
aacuugccugccu

SEQ ID NO: 1413720 - RNA, 14 nt, Human
aacuugcaucacuu

SEQ ID NO: 1413721 - RNA, 19 nt, Human
aacuugauccauuucuaau

SEQ ID NO: 1413722 - RNA, 17 nt, Human
aacuugauccauuucua

SEQ ID NO: 1413723 - RNA, 23 nt, Human
aagagcaucaugccucugaggcc

SEQ ID NO: 1413724 - RNA, 24 nt, Human
aagagcaucaugccucugaggcca

SEQ ID NO: 1413725 - RNA, 22 nt, Human
aagagcaucaugccucugaggc

SEQ ID NO: 1413726 - RNA, 21 nt, Human
aagagcaucaugccucugagg

SEQ ID NO: 1413727 - RNA, 20 nt, Human
aagagcaucaugccucugag

SEQ ID NO: 1413728 - RNA, 19 nt, Human
aagagcaucaugccucuga

SEQ ID NO: 1413729 - RNA, 18 nt, Human
aagagcaucaugccucug

SEQ ID NO: 1413730 - RNA, 17 nt, Human
aagagcaucaugccucu

SEQ ID NO: 1413731 - RNA, 15 nt, Human
aagagcaucaugccu

SEQ ID NO: 1413732 - RNA, 17 nt, Human
aagagcaggacuccagg

SEQ ID NO: 1413733 - RNA, 22 nt, Human
aagagcaggacuccaggcccaa

SEQ ID NO: 1413734 - RNA, 22 nt, Human
aagagcagcaccuccucagccu

SEQ ID NO: 1413735 - RNA, 14 nt, Human
aagacuugacagug

SEQ ID NO: 1413736 - RNA, 23 nt, Human
aagacuugguugguaggguggga

SEQ ID NO: 1413737 - RNA, 13 nt, Human
aagacuugacagu

SEQ ID NO: 1413738 - RNA, 20 nt, Human
aagacuucucuuugccucaa

SEQ ID NO: 1413739 - RNA, 19 nt, Human
aagacuucucuuugccuca

SEQ ID NO: 1413740 - RNA, 18 nt, Human
aagacguuuuauaagcau

SEQ ID NO: 1413741 - RNA, 17 nt, Human
aagacguuuuauaagca

SEQ ID NO: 1413742 - RNA, 15 nt, Human
aagacguuuuauaag

SEQ ID NO: 1413743 - RNA, 20 nt, Human
aagacgugaugccaggacca

SEQ ID NO: 1413744 - RNA, 17 nt, Human
aagacgccuuucuccuc

SEQ ID NO: 1413745 - RNA, 22 nt, Human
aagacgcacuuuggcuuauaau

SEQ ID NO: 1413746 - RNA, 21 nt, Human
aagacuagaaaauuagacugu

SEQ ID NO: 1413747 - RNA, 23 nt, Human
aagacugaguacguugugcauuu

SEQ ID NO: 1413748 - RNA, 17 nt, Human
aagacugcauuauauuu

SEQ ID NO: 1413749 - RNA, 16 nt, Human
aagacugcacaucaaa

SEQ ID NO: 1413750 - RNA, 21 nt, Human
gugggaagcccauccugacca

SEQ ID NO: 1413751 - RNA, 20 nt, Human
gugggaagcccauccugacc

SEQ ID NO: 1413752 - RNA, 19 nt, Human
guggccuuugcgcuccugg

SEQ ID NO: 1413753 - RNA, 20 nt, Human
guggccuuugcgcuccuggc

SEQ ID NO: 1413754 - RNA, 17 nt, Human
guggccuuugcgcuccu

SEQ ID NO: 1413755 - RNA, 20 nt, Human
guggccuuguucugucacca

SEQ ID NO: 1413756 - RNA, 14 nt, Human
guggggccugggag

SEQ ID NO: 1413757 - RNA, 12 nt, Human
guggggccuggg

SEQ ID NO: 1413758 - RNA, 12 nt, Human
guggggcuuggg

SEQ ID NO: 1413759 - RNA, 17 nt, Human
guggggccgccgccucu

SEQ ID NO: 1413760 - RNA, 15 nt, Human
guggccuggucccug

SEQ ID NO: 1413761 - RNA, 14 nt, Human
guggccuggucccu

SEQ ID NO: 1413762 - RNA, 21 nt, Human
guggccucuugagcaguggcu

SEQ ID NO: 1413763 - RNA, 20 nt, Human
guggccucuugagcaguggc

SEQ ID NO: 1413764 - RNA, 17 nt, Human
guggccucuugagcagu

SEQ ID NO: 1413765 - RNA, 21 nt, Human
guggcccuuccuggacagcug

SEQ ID NO: 1413766 - RNA, 17 nt, Human
guggcccuuccuggaca

SEQ ID NO: 1413767 - RNA, 16 nt, Human
guggcccuuccuggac

SEQ ID NO: 1413768 - RNA, 15 nt, Human
guggcccuuccugga

SEQ ID NO: 1413769 - RNA, 14 nt, Human
guggcccuuccugg

SEQ ID NO: 1413770 - RNA, 13 nt, Human
guggcccuuccug

SEQ ID NO: 1413771 - RNA, 23 nt, Human
guggcccuuaugacugccaagac

SEQ ID NO: 1413772 - RNA, 20 nt, Human
guggcccuuaugacugccaa

SEQ ID NO: 1413773 - RNA, 15 nt, Human
aagaggcaccaggaa

SEQ ID NO: 1413774 - RNA, 23 nt, Human
guggcccuuucggauccagggag

SEQ ID NO: 1413775 - RNA, 18 nt, Human
guggcccuuccuggacag

SEQ ID NO: 1413776 - RNA, 22 nt, Human
guggccuaaccugccgagaguc

SEQ ID NO: 1413777 - RNA, 18 nt, Human
guggccgaaccagaacca

SEQ ID NO: 1413778 - RNA, 21 nt, Human
guggccuaaccugccgagagu

SEQ ID NO: 1413779 - RNA, 22 nt, Human
aagaggaggggaagaggccugu

SEQ ID NO: 1413780 - RNA, 21 nt, Human
aagaggaggggaagaggccug

SEQ ID NO: 1413781 - RNA, 20 nt, Human
aagaggaggggaagaggccu

SEQ ID NO: 1413782 - RNA, 17 nt, Human
aagaggaggggaagagg

SEQ ID NO: 1413783 - RNA, 23 nt, Human
aagaggagcccccacccuguucc

SEQ ID NO: 1413784 - RNA, 14 nt, Human
aagagccacugcca

SEQ ID NO: 1413785 - RNA, 19 nt, Human
aagaggaauuacgugcucu

SEQ ID NO: 1413786 - RNA, 19 nt, Human
aagccucagauuccuuccc

SEQ ID NO: 1413787 - RNA, 23 nt, Human
aagccucaagguuuuagguucua

SEQ ID NO: 1413788 - RNA, 21 nt, Human
aagccucaagguuuuagguuc

SEQ ID NO: 1413789 - RNA, 18 nt, Human
aagccucaaaacaaaggc

SEQ ID NO: 1413790 - RNA, 16 nt, Human
aagccucaaaacaaag

SEQ ID NO: 1413791 - RNA, 15 nt, Human
aagccucaaaacaaa

SEQ ID NO: 1413792 - RNA, 22 nt, Human
aagccuagugaaggcuucucuc

SEQ ID NO: 1413793 - RNA, 14 nt, Human
aagccuaagaaucu

SEQ ID NO: 1413794 - RNA, 18 nt, Human
guucaagcgauucucuug

SEQ ID NO: 1413795 - RNA, 17 nt, Human
guucaagcgauucucuu

SEQ ID NO: 1413796 - RNA, 19 nt, Human
guucagcuaagcuaggaau

SEQ ID NO: 1413797 - RNA, 22 nt, Human
guucagcgcugucaggauugcg

SEQ ID NO: 1413798 - RNA, 22 nt, Human
guucagcuaagcuaggaaugaa

SEQ ID NO: 1413799 - RNA, 22 nt, Human
aagccugcacaauaaaaauguu

SEQ ID NO: 1413800 - RNA, 21 nt, Human
aagccugcacaauaaaaaugu

SEQ ID NO: 1413801 - RNA, 15 nt, Human
aagccugaugcugac

SEQ ID NO: 1413802 - RNA, 22 nt, Human
aagccugaguacuccacacugc

SEQ ID NO: 1413803 - RNA, 24 nt, Human
aagccugagggaaaggccagcacu

SEQ ID NO: 1413804 - RNA, 22 nt, Human
aagccugagggaaaggccagca

SEQ ID NO: 1413805 - RNA, 21 nt, Human
aagccugagggaaaggccagc

SEQ ID NO: 1413806 - RNA, 16 nt, Human
aagccugagggaaagg

SEQ ID NO: 1413807 - RNA, 14 nt, Human
aagcuaggaaugaa

SEQ ID NO: 1413808 - RNA, 16 nt, Human
aagcuagcaaauagua

SEQ ID NO: 1413809 - RNA, 22 nt, Human
aagcucaaagguuuggaaggag

SEQ ID NO: 1413810 - RNA, 20 nt, Human
aagcucaaagguuuggaagg

SEQ ID NO: 1413811 - RNA, 21 nt, Human
aagcuauuuuucuaacuacaa

SEQ ID NO: 1413812 - RNA, 16 nt, Human
aagcuauuuuucuaac

SEQ ID NO: 1413813 - RNA, 14 nt, Human
aagcuauuuuucua

SEQ ID NO: 1413814 - RNA, 13 nt, Human
aagcuauuuuucu

SEQ ID NO: 1413815 - RNA, 23 nt, Human
aagcuauuugauguaauacuucu

SEQ ID NO: 1413816 - RNA, 18 nt, Human
aagcuauuugauguaaua

SEQ ID NO: 1413817 - RNA, 16 nt, Human
aagcuauuugauguaa

SEQ ID NO: 1413818 - RNA, 14 nt, Human
aagcuauuugaugu

SEQ ID NO: 1413819 - RNA, 13 nt, Human
aagcuauuuaaag

SEQ ID NO: 1413820 - RNA, 18 nt, Human
aagcuauuuaaagcaucu

SEQ ID NO: 1413821 - RNA, 21 nt, Human
aagcucaaagguuuggaagga

SEQ ID NO: 1413822 - RNA, 20 nt, Human
aagcucacagaccuuugaac

SEQ ID NO: 1413823 - RNA, 15 nt, Human
aagcucagcugcauu

SEQ ID NO: 1413824 - RNA, 14 nt, Human
aagcuccagguaga

SEQ ID NO: 1413825 - RNA, 13 nt, Human
aagcuccagguag

SEQ ID NO: 1413826 - RNA, 23 nt, Human
guucaacaaagaaacaaagaugu

SEQ ID NO: 1413827 - RNA, 22 nt, Human
guucaacaaagaaacaaagaug

SEQ ID NO: 1413828 - RNA, 13 nt, Human
guucaacaaagaa

SEQ ID NO: 1413829 - RNA, 14 nt, Human
guucaaagcugccu

SEQ ID NO: 1413830 - RNA, 13 nt, Human
guucaaagccagc

SEQ ID NO: 1413831 - RNA, 12 nt, Human
guucaaagccag

SEQ ID NO: 1413832 - RNA, 16 nt, Human
guucaagaaauaaguu

SEQ ID NO: 1413833 - RNA, 19 nt, Human
guucaacuuuuccuuugaa

SEQ ID NO: 1413834 - RNA, 14 nt, Human
guucaacuuauuaa

SEQ ID NO: 1413835 - RNA, 21 nt, Human
guuauuuuuuaauuauuauuu

SEQ ID NO: 1413836 - RNA, 20 nt, Human
guucaaagauauuuugcuuu

SEQ ID NO: 1413837 - RNA, 21 nt, Human
guucaaagauauuuugcuuug

SEQ ID NO: 1413838 - RNA, 22 nt, Human
guucaaagauauuuugcuuugu

SEQ ID NO: 1413839 - RNA, 17 nt, Human
guuauuuuguuuuuccu

SEQ ID NO: 1413840 - RNA, 13 nt, Human
guuauuuugcaac

SEQ ID NO: 1413841 - RNA, 16 nt, Human
guuauuuuuuaauuau

SEQ ID NO: 1413842 - RNA, 20 nt, Human
guuagggacugaccagcagc

SEQ ID NO: 1413843 - RNA, 22 nt, Human
guuauuaucugggcuuauaucu

SEQ ID NO: 1413844 - RNA, 17 nt, Human
guuauuaucugggcuua

SEQ ID NO: 1413845 - RNA, 19 nt, Human
guuagggacugaccagcag

SEQ ID NO: 1413846 - RNA, 23 nt, Human
guuagggaaaacauuccauccuu

SEQ ID NO: 1413847 - RNA, 19 nt, Human
guuagaaaugcagaauccu

SEQ ID NO: 1413848 - RNA, 14 nt, Human
guuacuucugaggu

SEQ ID NO: 1413849 - RNA, 19 nt, Human
guuaagacuugacagugga

SEQ ID NO: 1413850 - RNA, 20 nt, Human
guuagcuccuguggccccac

SEQ ID NO: 1413851 - RNA, 16 nt, Human
guuagcuccuguggcc

SEQ ID NO: 1413852 - RNA, 15 nt, Human
guuagggaaaacauu

SEQ ID NO: 1413853 - RNA, 20 nt, Human
guuagggaaaacauuccauc

SEQ ID NO: 1413854 - RNA, 18 nt, Human
aagccccugccccuccuc

SEQ ID NO: 1413855 - RNA, 19 nt, Human
aagcccccagagcccaggc

SEQ ID NO: 1413856 - RNA, 23 nt, Human
aagcccccagcuaagaaccugga

SEQ ID NO: 1413857 - RNA, 21 nt, Human
aagcccccagcuaagaaccug

SEQ ID NO: 1413858 - RNA, 16 nt, Human
aagcccccagcuaaga

SEQ ID NO: 1413859 - RNA, 18 nt, Human
aagcccccagagcccagg

SEQ ID NO: 1413860 - RNA, 17 nt, Human
aagcccccagagcccag

SEQ ID NO: 1413861 - RNA, 16 nt, Human
aagcccccagagccca

SEQ ID NO: 1413862 - RNA, 15 nt, Human
aagcccccagagccc

SEQ ID NO: 1413863 - RNA, 14 nt, Human
aagcccccagagcc

SEQ ID NO: 1413864 - RNA, 13 nt, Human
aagcccccagagc

SEQ ID NO: 1413865 - RNA, 12 nt, Human
aagcccccagag

SEQ ID NO: 1413866 - RNA, 20 nt, Human
aagcccccaccgugggcagg

SEQ ID NO: 1413867 - RNA, 14 nt, Human
aagcccccaccgug

SEQ ID NO: 1413868 - RNA, 20 nt, Human
aagcccucccagguguuaac

SEQ ID NO: 1413869 - RNA, 13 nt, Human
aagcccucccagg

SEQ ID NO: 1413870 - RNA, 18 nt, Human
aagcccggcuccugguca

SEQ ID NO: 1413871 - RNA, 22 nt, Human
aagcccggcuccuggucaccua

SEQ ID NO: 1413872 - RNA, 15 nt, Human
aagcccggcuccugg

SEQ ID NO: 1413873 - RNA, 17 nt, Human
guuaagacuugacagug

SEQ ID NO: 1413874 - RNA, 16 nt, Human
guuaagacuugacagu

SEQ ID NO: 1413875 - RNA, 15 nt, Human
guuaagacuugacag

SEQ ID NO: 1413876 - RNA, 16 nt, Human
guuaagaccuggcagc

SEQ ID NO: 1413877 - RNA, 14 nt, Human
guuaagaccuggca

SEQ ID NO: 1413878 - RNA, 13 nt, Human
guuaagaccuggc

SEQ ID NO: 1413879 - RNA, 22 nt, Human
guuaagacaugauuuccuugaa

SEQ ID NO: 1413880 - RNA, 19 nt, Human
guuaagacaugauuuccuu

SEQ ID NO: 1413881 - RNA, 17 nt, Human
guuaagacaugauuucc

SEQ ID NO: 1413882 - RNA, 13 nt, Human
aagccguccuggc

SEQ ID NO: 1413883 - RNA, 16 nt, Human
aagcccauccugacca

SEQ ID NO: 1413884 - RNA, 15 nt, Human
aagcccauccugacc

SEQ ID NO: 1413885 - RNA, 14 nt, Human
aagcccauccugac

SEQ ID NO: 1413886 - RNA, 22 nt, Human
aagcccagugcacugaaaguca

SEQ ID NO: 1413887 - RNA, 22 nt, Human
aagcccauaugcuaccaccagc

SEQ ID NO: 1413888 - RNA, 17 nt, Human
aagcccagugcacugaa

SEQ ID NO: 1413889 - RNA, 20 nt, Human
aagcccauccugaccagcug

SEQ ID NO: 1413890 - RNA, 18 nt, Human
aagcccauccugaccagc

SEQ ID NO: 1413891 - RNA, 16 nt, Human
aagcccauucauucca

SEQ ID NO: 1413892 - RNA, 21 nt, Human
aagcccauucauuccauucug

SEQ ID NO: 1413893 - RNA, 22 nt, Human
aagccccacccaggccaggcau

SEQ ID NO: 1413894 - RNA, 14 nt, Human
aagccccagcaagc

SEQ ID NO: 1413895 - RNA, 18 nt, Human
aagccccacccaggccag

SEQ ID NO: 1413896 - RNA, 17 nt, Human
aagccccacccaggcca

SEQ ID NO: 1413897 - RNA, 16 nt, Human
aagccccacccaggcc

SEQ ID NO: 1413898 - RNA, 23 nt, Human
aagcccauucauuccauucugga

SEQ ID NO: 1413899 - RNA, 15 nt, Human
aagcagguucuuguu

SEQ ID NO: 1413900 - RNA, 14 nt, Human
aagcagguucuugu

SEQ ID NO: 1413901 - RNA, 23 nt, Human
gugugugcccucugggcucugag

SEQ ID NO: 1413902 - RNA, 21 nt, Human
gugugugcccucugggcucug

SEQ ID NO: 1413903 - RNA, 19 nt, Human
gugugugcccucugggcuc

SEQ ID NO: 1413904 - RNA, 17 nt, Human
gugugugcccucugggc

SEQ ID NO: 1413905 - RNA, 14 nt, Human
gugugugcccucug

SEQ ID NO: 1413906 - RNA, 17 nt, Human
gugugugaaugaacacu

SEQ ID NO: 1413907 - RNA, 17 nt, Human
aagcaguauuuuucuug

SEQ ID NO: 1413908 - RNA, 19 nt, Human
aagcagguuucaaggaagu

SEQ ID NO: 1413909 - RNA, 17 nt, Human
aagcagguuucaaggaa

SEQ ID NO: 1413910 - RNA, 16 nt, Human
aagcagguuucaagga

SEQ ID NO: 1413911 - RNA, 19 nt, Human
aagcagucgugccuguguc

SEQ ID NO: 1413912 - RNA, 18 nt, Human
aagcagucgugccugugu

SEQ ID NO: 1413913 - RNA, 17 nt, Human
aagcagucgugccugug

SEQ ID NO: 1413914 - RNA, 18 nt, Human
aagcaguauuuuucuuga

SEQ ID NO: 1413915 - RNA, 22 nt, Human
aagcaucauuauuuauguauug

SEQ ID NO: 1413916 - RNA, 23 nt, Human
aagcaucauuauuuauguauugu

SEQ ID NO: 1413917 - RNA, 21 nt, Human
aagcaucauuauuuauguauu

SEQ ID NO: 1413918 - RNA, 23 nt, Human
aagcauaaaagaugaaagagcag

SEQ ID NO: 1413919 - RNA, 22 nt, Human
aagcauaaaagaugaaagagca

SEQ ID NO: 1413920 - RNA, 12 nt, Human
aagccaaaacaa

SEQ ID NO: 1413921 - RNA, 18 nt, Human
aagccaaaacaauguuua

SEQ ID NO: 1413922 - RNA, 17 nt, Human
aagcauuuuguaauaau

SEQ ID NO: 1413923 - RNA, 14 nt, Human
aagcauuuuguaau

SEQ ID NO: 1413924 - RNA, 17 nt, Human
aagcauuugaaugcauu

SEQ ID NO: 1413925 - RNA, 23 nt, Human
aagcauuuuguaaguugaagcaa

SEQ ID NO: 1413926 - RNA, 15 nt, Human
aagcauuugaaugca

SEQ ID NO: 1413927 - RNA, 16 nt, Human
aagcauuugaaugcau

SEQ ID NO: 1413928 - RNA, 16 nt, Human
aagcauuuagaaaacu

SEQ ID NO: 1413929 - RNA, 17 nt, Human
aagcauuguaaaauaau

SEQ ID NO: 1413930 - RNA, 15 nt, Human
aagcauuguaaaaua

SEQ ID NO: 1413931 - RNA, 14 nt, Human
aagcauuguaaaau

SEQ ID NO: 1413932 - RNA, 13 nt, Human
aagcauugaaugg

SEQ ID NO: 1413933 - RNA, 12 nt, Human
aagcauuugaau

SEQ ID NO: 1413934 - RNA, 13 nt, Human
aagcauuugaaug

SEQ ID NO: 1413935 - RNA, 14 nt, Human
aagcauuugaaugc

SEQ ID NO: 1413936 - RNA, 18 nt, Human
aagcauuguaaaauaauu

SEQ ID NO: 1413937 - RNA, 16 nt, Human
aagcauugaauggcua

SEQ ID NO: 1413938 - RNA, 13 nt, Human
aagcauucugucu

SEQ ID NO: 1413939 - RNA, 16 nt, Human
aagcauuuagauguau

SEQ ID NO: 1413940 - RNA, 23 nt, Human
aagcauucucauuggaaauuuag

SEQ ID NO: 1413941 - RNA, 22 nt, Human
aagcauucucauuggaaauuua

SEQ ID NO: 1413942 - RNA, 18 nt, Human
aagcauucucauuggaaa

SEQ ID NO: 1413943 - RNA, 17 nt, Human
aagcauucucauuggaa

SEQ ID NO: 1413944 - RNA, 15 nt, Human
aagcauucucauugg

SEQ ID NO: 1413945 - RNA, 15 nt, Human
aagcauucagaagaa

SEQ ID NO: 1413946 - RNA, 21 nt, Human
aagcauucagaagaaaaagaa

SEQ ID NO: 1413947 - RNA, 13 nt, Human
aagcauucacaac

SEQ ID NO: 1413948 - RNA, 12 nt, Human
aagcauucacaa

SEQ ID NO: 1413949 - RNA, 18 nt, Human
aagcaucuaaguuauaag

SEQ ID NO: 1413950 - RNA, 19 nt, Human
aagcaucuggcucuaauuc

SEQ ID NO: 1413951 - RNA, 17 nt, Human
aagcaucuggcucuaau

SEQ ID NO: 1413952 - RNA, 13 nt, Human
aagcaucuggcuc

SEQ ID NO: 1413953 - RNA, 13 nt, Human
aagcaucuaaguu

SEQ ID NO: 1413954 - RNA, 13 nt, Human
aagcaucccucac

SEQ ID NO: 1413955 - RNA, 14 nt, Human
aagcaucccucacc

SEQ ID NO: 1413956 - RNA, 23 nt, Human
aagcaucccucacccauccuaga

SEQ ID NO: 1413957 - RNA, 16 nt, Human
aagugaagacuggaag

SEQ ID NO: 1413958 - RNA, 13 nt, Human
aagugaagacugg

SEQ ID NO: 1413959 - RNA, 13 nt, Human
aagugaagacaga

SEQ ID NO: 1413960 - RNA, 17 nt, Human
aagugaagacaaugacu

SEQ ID NO: 1413961 - RNA, 19 nt, Human
aagugaagacaaugacuua

SEQ ID NO: 1413962 - RNA, 14 nt, Human
aagugaaauaaugu

SEQ ID NO: 1413963 - RNA, 16 nt, Human
aagugaaauaaugugu

SEQ ID NO: 1413964 - RNA, 11 nt, Human
aagugaaauaa

SEQ ID NO: 1413965 - RNA, 14 nt, Human
aagugaaaaugguc

SEQ ID NO: 1413966 - RNA, 14 nt, Human
aagugaaaauauag

SEQ ID NO: 1413967 - RNA, 12 nt, Human
aagugaaaauau

SEQ ID NO: 1413968 - RNA, 12 nt, Human
aagugaaaacuu

SEQ ID NO: 1413969 - RNA, 18 nt, Human
aagucuuuuguucgcaug

SEQ ID NO: 1413970 - RNA, 16 nt, Human
guuuuucggacaguuu

SEQ ID NO: 1413971 - RNA, 18 nt, Human
guuuuuccuuuuuuugua

SEQ ID NO: 1413972 - RNA, 22 nt, Human
guuuuuccuuccaaugucugga

SEQ ID NO: 1413973 - RNA, 18 nt, Human
guuuuucauuaaauaaau

SEQ ID NO: 1413974 - RNA, 15 nt, Human
guuuuucauaaagca

SEQ ID NO: 1413975 - RNA, 13 nt, Human
aagucauuggcuu

SEQ ID NO: 1413976 - RNA, 20 nt, Human
aagucauuggcuuuauccuc

SEQ ID NO: 1413977 - RNA, 13 nt, Human
aaguauuugggaa

SEQ ID NO: 1413978 - RNA, 22 nt, Human
aaguauuucaaauuggagcuuc

SEQ ID NO: 1413979 - RNA, 21 nt, Human
aaguauuucaaauuggagcuu

SEQ ID NO: 1413980 - RNA, 13 nt, Human
aaguauuucaaau

SEQ ID NO: 1413981 - RNA, 22 nt, Human
aaguauuuucauaaguauuuca

SEQ ID NO: 1413982 - RNA, 17 nt, Human
aaguauuuucauaagua

SEQ ID NO: 1413983 - RNA, 21 nt, Human
aaguauuuguuaauuuagaaa

SEQ ID NO: 1413984 - RNA, 19 nt, Human
aaguauuuguuaauuuaga

SEQ ID NO: 1413985 - RNA, 20 nt, Human
aaguauuuguuaauuuagaa

SEQ ID NO: 1413986 - RNA, 14 nt, Human
aagucuuuuguucg

SEQ ID NO: 1413987 - RNA, 23 nt, Human
aagucuuucucuuucccuggucc

SEQ ID NO: 1413988 - RNA, 22 nt, Human
aagucuuucucuuucccugguc

SEQ ID NO: 1413989 - RNA, 20 nt, Human
aagucuuucucuuucccugg

SEQ ID NO: 1413990 - RNA, 18 nt, Human
aagucuuucucuuucccu

SEQ ID NO: 1413991 - RNA, 17 nt, Human
aagucuuucucuuuccc

SEQ ID NO: 1413992 - RNA, 16 nt, Human
aagucuuucucuuucc

SEQ ID NO: 1413993 - RNA, 16 nt, Human
aagucuuucacauuua

SEQ ID NO: 1413994 - RNA, 13 nt, Human
guuucugcccugc

SEQ ID NO: 1413995 - RNA, 20 nt, Human
guuucugaguuccugcaugc

SEQ ID NO: 1413996 - RNA, 23 nt, Human
guuuuggcugaaauucuccugga

SEQ ID NO: 1413997 - RNA, 22 nt, Human
guuuuggcugaaauucuccugg

SEQ ID NO: 1413998 - RNA, 20 nt, Human
guuuuggcugaaauucuccu

SEQ ID NO: 1413999 - RNA, 17 nt, Human
guuuuggacaguuuacc

SEQ ID NO: 1414000 - RNA, 18 nt, Human
guuuuggacaguuuacca

SEQ ID NO: 1414001 - RNA, 17 nt, Human
guuuugcuacauaauua

SEQ ID NO: 1414002 - RNA, 19 nt, Human
aaguaaugauaacuggaaa

SEQ ID NO: 1414003 - RNA, 14 nt, Human
aaguaaugauaacu

SEQ ID NO: 1414004 - RNA, 13 nt, Human
aaguacacuguuu

SEQ ID NO: 1414005 - RNA, 18 nt, Human
aaguacacuguuucaaac

SEQ ID NO: 1414006 - RNA, 23 nt, Human
aaguacacuguuucaaacuuuac

SEQ ID NO: 1414007 - RNA, 19 nt, Human
aaguacacuguuucaaacu

SEQ ID NO: 1414008 - RNA, 20 nt, Human
aaguacacuguuucaaacuu

SEQ ID NO: 1414009 - RNA, 17 nt, Human
aaguacagagaagccau

SEQ ID NO: 1414010 - RNA, 22 nt, Human
aaguacagagaagccaucaccu

SEQ ID NO: 1414011 - RNA, 16 nt, Human
aaguacagagaagcca

SEQ ID NO: 1414012 - RNA, 15 nt, Human
aaguacagagaagcc

SEQ ID NO: 1414013 - RNA, 14 nt, Human
aaguacagagaagc

SEQ ID NO: 1414014 - RNA, 13 nt, Human
aaguacagagaag

SEQ ID NO: 1414015 - RNA, 12 nt, Human
aaguacagagaa

SEQ ID NO: 1414016 - RNA, 11 nt, Human
aaguacagaga

SEQ ID NO: 1414017 - RNA, 13 nt, Human
aaguaccagacua

SEQ ID NO: 1414018 - RNA, 12 nt, Human
aaguaccagacu

SEQ ID NO: 1414019 - RNA, 16 nt, Human
aaguauuuagguuuuu

SEQ ID NO: 1414020 - RNA, 11 nt, Human
aaguauuuagg

SEQ ID NO: 1414021 - RNA, 10 nt, Human
aaguauuuag

SEQ ID NO: 1414022 - RNA, 23 nt, Human
aaguauuuaauuagugcuaagug

SEQ ID NO: 1414023 - RNA, 19 nt, Human
aaguauuuaauuagugcua

SEQ ID NO: 1414024 - RNA, 20 nt, Human
aaguauuuaauuagugcuaa

SEQ ID NO: 1414025 - RNA, 21 nt, Human
aaguauuuaauuagugcuaag

SEQ ID NO: 1414026 - RNA, 22 nt, Human
aaguauuuaauuagugcuaagu

SEQ ID NO: 1414027 - RNA, 13 nt, Human
aaguauuagaaua

SEQ ID NO: 1414028 - RNA, 16 nt, Human
aaguauuuaauuagug

SEQ ID NO: 1414029 - RNA, 17 nt, Human
aaguauuuaauuagugc

SEQ ID NO: 1414030 - RNA, 18 nt, Human
aaguauuuaauuagugcu

SEQ ID NO: 1414031 - RNA, 19 nt, Human
aagugcccucucccacccu

SEQ ID NO: 1414032 - RNA, 23 nt, Human
aagugcccucucccacccucuuc

SEQ ID NO: 1414033 - RNA, 15 nt, Human
aagugcccucuccca

SEQ ID NO: 1414034 - RNA, 13 nt, Human
aagugcccucucc

SEQ ID NO: 1414035 - RNA, 18 nt, Human
aagugcccuccaggcuuu

SEQ ID NO: 1414036 - RNA, 12 nt, Human
aagugcccucca

SEQ ID NO: 1414037 - RNA, 20 nt, Human
uaaaauaugaagacauaaac

SEQ ID NO: 1414038 - RNA, 17 nt, Human
aagugagucucucuggg

SEQ ID NO: 1414039 - RNA, 21 nt, Human
aagugagggcucacucagcca

SEQ ID NO: 1414040 - RNA, 19 nt, Human
aagugagggcucacucagc

SEQ ID NO: 1414041 - RNA, 17 nt, Human
aagugagggcucacuca

SEQ ID NO: 1414042 - RNA, 21 nt, Human
aagugaucaaacuacauauug

SEQ ID NO: 1414043 - RNA, 19 nt, Human
uaaaauaugaagacauaaa

SEQ ID NO: 1414044 - RNA, 14 nt, Human
uaaaauaucuacau

SEQ ID NO: 1414045 - RNA, 20 nt, Human
uaaaauacuuuuacucugcc

SEQ ID NO: 1414046 - RNA, 21 nt, Human
uaaaauacuuuuacucugccu

SEQ ID NO: 1414047 - RNA, 19 nt, Human
uaaaauacuuuuacucugc

SEQ ID NO: 1414048 - RNA, 14 nt, Human
uaaaauacuuuuac

SEQ ID NO: 1414049 - RNA, 16 nt, Human
uaaaauaauucugagu

SEQ ID NO: 1414050 - RNA, 21 nt, Human
uaaaauaauuuuguaauguau

SEQ ID NO: 1414051 - RNA, 16 nt, Human
uaaaauaauuuuguaa

SEQ ID NO: 1414052 - RNA, 15 nt, Human
uaaaauaauuuugua

SEQ ID NO: 1414053 - RNA, 22 nt, Human
uaaaauaccagccaguaaaugg

SEQ ID NO: 1414054 - RNA, 20 nt, Human
uaaaauaauuuuuauauuug

SEQ ID NO: 1414055 - RNA, 14 nt, Human
uaaaauaauuuugu

SEQ ID NO: 1414056 - RNA, 13 nt, Human
uaaaauaauuuug

SEQ ID NO: 1414057 - RNA, 22 nt, Human
uaaaauaauuuuaucucuuucu

SEQ ID NO: 1414058 - RNA, 21 nt, Human
uaaaauaauuauauaacugua

SEQ ID NO: 1414059 - RNA, 20 nt, Human
uaaaauaauuauauaacugu

SEQ ID NO: 1414060 - RNA, 19 nt, Human
uaaaauaauuauauaacug

SEQ ID NO: 1414061 - RNA, 18 nt, Human
uaaaauaauuauauaacu

SEQ ID NO: 1414062 - RNA, 22 nt, Human
uaaaaguuuuuuauuaugcauu

SEQ ID NO: 1414063 - RNA, 21 nt, Human
uaaaaguuuuuuauuaugcau

SEQ ID NO: 1414064 - RNA, 23 nt, Human
uaaaagugggcuugauucugcag

SEQ ID NO: 1414065 - RNA, 16 nt, Human
uaaaagacucauccgu

SEQ ID NO: 1414066 - RNA, 22 nt, Human
uaaaagugggcuugauucugca

SEQ ID NO: 1414067 - RNA, 14 nt, Human
uaaaagacucaucc

SEQ ID NO: 1414068 - RNA, 13 nt, Human
uaaaagacucauc

SEQ ID NO: 1414069 - RNA, 12 nt, Human
uaaaagacucau

SEQ ID NO: 1414070 - RNA, 20 nt, Human
uaaaagacagugaaagaaaa

SEQ ID NO: 1414071 - RNA, 14 nt, Human
guuuuugagauauu

SEQ ID NO: 1414072 - RNA, 13 nt, Human
guuuuugagauau

SEQ ID NO: 1414073 - RNA, 17 nt, Human
uaaaaagugcuuuugug

SEQ ID NO: 1414074 - RNA, 16 nt, Human
guuuuugagauauuaa

SEQ ID NO: 1414075 - RNA, 18 nt, Human
uaaaaauaaaaaacacug

SEQ ID NO: 1414076 - RNA, 19 nt, Human
uaaaaauaaaaaacacugg

SEQ ID NO: 1414077 - RNA, 16 nt, Human
uaaaaauaagucaaca

SEQ ID NO: 1414078 - RNA, 19 nt, Human
uaaaaauaagucaacagua

SEQ ID NO: 1414079 - RNA, 15 nt, Human
uaaaaaucucaaauu

SEQ ID NO: 1414080 - RNA, 16 nt, Human
uaaaaaucucaaauuu

SEQ ID NO: 1414081 - RNA, 17 nt, Human
uaaaaaucucaaauuuc

SEQ ID NO: 1414082 - RNA, 17 nt, Human
uaaaaauaaaaaagauc

SEQ ID NO: 1414083 - RNA, 16 nt, Human
uaaaaauaaaaaagau

SEQ ID NO: 1414084 - RNA, 20 nt, Human
uaaaaaguuuuaguuuugau

SEQ ID NO: 1414085 - RNA, 21 nt, Human
uaaaaauaaaaaacacuggga

SEQ ID NO: 1414086 - RNA, 15 nt, Human
uaaaaauaagucaac

SEQ ID NO: 1414087 - RNA, 21 nt, Human
uaaaaauaaaaaagaucccaa

SEQ ID NO: 1414088 - RNA, 19 nt, Human
uaaaaauaaaaaagauccc

SEQ ID NO: 1414089 - RNA, 16 nt, Human
uaaaaauaaacauguu

SEQ ID NO: 1414090 - RNA, 18 nt, Human
uaaaacccguugauuacu

SEQ ID NO: 1414091 - RNA, 17 nt, Human
uaaaacccguugauuac

SEQ ID NO: 1414092 - RNA, 18 nt, Human
uaaaacgcaguugcaaac

SEQ ID NO: 1414093 - RNA, 11 nt, Human
uaaaacuaaga

SEQ ID NO: 1414094 - RNA, 19 nt, Human
uaaaaaucucaaauuucua

SEQ ID NO: 1414095 - RNA, 20 nt, Human
uaaaaaucucaaauuucuaa

SEQ ID NO: 1414096 - RNA, 21 nt, Human
uaaaaaucucaaauuucuaaa

SEQ ID NO: 1414097 - RNA, 19 nt, Human
uaaaacccauuuaaauuuu

SEQ ID NO: 1414098 - RNA, 15 nt, Human
uaaaacuuugaaguu

SEQ ID NO: 1414099 - RNA, 13 nt, Human
uaaaacuuuccuc

SEQ ID NO: 1414100 - RNA, 14 nt, Human
uaaaacuuugaagu

SEQ ID NO: 1414101 - RNA, 17 nt, Human
uaaaacuuuccucgccu

SEQ ID NO: 1414102 - RNA, 15 nt, Human
uaaaacuuuccucgc

SEQ ID NO: 1414103 - RNA, 12 nt, Human
uaaaagaaugau

SEQ ID NO: 1414104 - RNA, 22 nt, Human
guugggaucagggguaggaaug

SEQ ID NO: 1414105 - RNA, 17 nt, Human
guuggaauggauuuuuc

SEQ ID NO: 1414106 - RNA, 23 nt, Human
guugggagagggcgcaggccgug

SEQ ID NO: 1414107 - RNA, 15 nt, Human
guuggaauggauuuu

SEQ ID NO: 1414108 - RNA, 22 nt, Human
guuggaaugaauuaaauaaacc

SEQ ID NO: 1414109 - RNA, 17 nt, Human
guugcguuccuuucuuu

SEQ ID NO: 1414110 - RNA, 18 nt, Human
aaggccuaggauucuaaa

SEQ ID NO: 1414111 - RNA, 16 nt, Human
aaggccuaggauucua

SEQ ID NO: 1414112 - RNA, 15 nt, Human
aaggccuaggauucu

SEQ ID NO: 1414113 - RNA, 22 nt, Human
aaggccuaauucuaugccuguc

SEQ ID NO: 1414114 - RNA, 12 nt, Human
guugccuuuuau

SEQ ID NO: 1414115 - RNA, 20 nt, Human
aaggcccgagcagcugagca

SEQ ID NO: 1414116 - RNA, 19 nt, Human
aaggcccgagcagcugagc

SEQ ID NO: 1414117 - RNA, 18 nt, Human
aaggcccgagcagcugag

SEQ ID NO: 1414118 - RNA, 17 nt, Human
aaggcccgagcagcuga

SEQ ID NO: 1414119 - RNA, 16 nt, Human
aaggcccgagcagcug

SEQ ID NO: 1414120 - RNA, 21 nt, Human
aaggcccgagcagcugagcag

SEQ ID NO: 1414121 - RNA, 22 nt, Human
aaggccaucugggcuccuccag

SEQ ID NO: 1414122 - RNA, 24 nt, Human
aaggccauaaaacagguaauauaa

SEQ ID NO: 1414123 - RNA, 18 nt, Human
aaggccauaaaacaggua

SEQ ID NO: 1414124 - RNA, 17 nt, Human
aaggccauaaaacaggu

SEQ ID NO: 1414125 - RNA, 14 nt, Human
aaggccauaaaaca

SEQ ID NO: 1414126 - RNA, 13 nt, Human
aaggccagcacuc

SEQ ID NO: 1414127 - RNA, 19 nt, Human
aaggaguguagcaacuaca

SEQ ID NO: 1414128 - RNA, 18 nt, Human
aaggagucacugagacca

SEQ ID NO: 1414129 - RNA, 20 nt, Human
aaggagucagacauuuuaag

SEQ ID NO: 1414130 - RNA, 17 nt, Human
aaggagucacugagacc

SEQ ID NO: 1414131 - RNA, 14 nt, Human
aaggaguuuauguu

SEQ ID NO: 1414132 - RNA, 13 nt, Human
aaggaguuuaugu

SEQ ID NO: 1414133 - RNA, 12 nt, Human
aaggaguuuaug

SEQ ID NO: 1414134 - RNA, 11 nt, Human
aaggauaaagu

SEQ ID NO: 1414135 - RNA, 13 nt, Human
aaggauacaaaag

SEQ ID NO: 1414136 - RNA, 21 nt, Human
aaggauacaaaagcaugugag

SEQ ID NO: 1414137 - RNA, 19 nt, Human
aaggauagaugcuggccca

SEQ ID NO: 1414138 - RNA, 15 nt, Human
aaggauagaugcugg

SEQ ID NO: 1414139 - RNA, 17 nt, Human
aaggaguuuauguucca

SEQ ID NO: 1414140 - RNA, 17 nt, Human
aaggcaucugacaugca

SEQ ID NO: 1414141 - RNA, 22 nt, Human
aaggcaucgucaugcacaguau

SEQ ID NO: 1414142 - RNA, 17 nt, Human
aaggcauggcggccccc

SEQ ID NO: 1414143 - RNA, 19 nt, Human
aaggcauuauaaaaagaau

SEQ ID NO: 1414144 - RNA, 17 nt, Human
aaggagucaaaacuaca

SEQ ID NO: 1414145 - RNA, 17 nt, Human
aaggaggggcuguaaaa

SEQ ID NO: 1414146 - RNA, 18 nt, Human
aaggagcugccuggaccc

SEQ ID NO: 1414147 - RNA, 19 nt, Human
aaggagcugccuggacccg

SEQ ID NO: 1414148 - RNA, 18 nt, Human
aaggaggcuaugcucagg

SEQ ID NO: 1414149 - RNA, 17 nt, Human
aaggagcugccuggacc

SEQ ID NO: 1414150 - RNA, 16 nt, Human
aaggagcugccuggac

SEQ ID NO: 1414151 - RNA, 13 nt, Human
aaggagcugccug

SEQ ID NO: 1414152 - RNA, 12 nt, Human
aaggagcugccu

SEQ ID NO: 1414153 - RNA, 11 nt, Human
aaggagcugcc

SEQ ID NO: 1414154 - RNA, 21 nt, Human
aaggagccugugaacccagga

SEQ ID NO: 1414155 - RNA, 22 nt, Human
aaggagccugugaacccaggac

SEQ ID NO: 1414156 - RNA, 13 nt, Human
aaggagccuguga

SEQ ID NO: 1414157 - RNA, 12 nt, Human
aaggagccugug

SEQ ID NO: 1414158 - RNA, 10 nt, Human
aaggagccug

SEQ ID NO: 1414159 - RNA, 18 nt, Human
aaggagaugucuuggaac

SEQ ID NO: 1414160 - RNA, 17 nt, Human
aaggagauuuacaacug

SEQ ID NO: 1414161 - RNA, 14 nt, Human
aaggagauuuacaa

SEQ ID NO: 1414162 - RNA, 20 nt, Human
aaggagaggcaacauccaaa

SEQ ID NO: 1414163 - RNA, 23 nt, Human
aaggaagcauuguaaaauaauuc

SEQ ID NO: 1414164 - RNA, 18 nt, Human
aaggaagcauuguaaaau

SEQ ID NO: 1414165 - RNA, 22 nt, Human
aaggaagcauuguaaaauaauu

SEQ ID NO: 1414166 - RNA, 16 nt, Human
aaggaaccaacaaucu

SEQ ID NO: 1414167 - RNA, 17 nt, Human
aaggaaccaacaaucuu

SEQ ID NO: 1414168 - RNA, 13 nt, Human
aaggaaccaacaa

SEQ ID NO: 1414169 - RNA, 12 nt, Human
aaggaaagaaaa

SEQ ID NO: 1414170 - RNA, 13 nt, Human
aagcuccaagccc

SEQ ID NO: 1414171 - RNA, 15 nt, Human
aaggaaagaaaacau

SEQ ID NO: 1414172 - RNA, 19 nt, Human
guuuauuuucaagaauaau

SEQ ID NO: 1414173 - RNA, 13 nt, Human
guuucaaacuuua

SEQ ID NO: 1414174 - RNA, 14 nt, Human
guuucaaacuuuac

SEQ ID NO: 1414175 - RNA, 16 nt, Human
guuucaaacuuuacua

SEQ ID NO: 1414176 - RNA, 17 nt, Human
guuucaaacuuuacuau

SEQ ID NO: 1414177 - RNA, 11 nt, Human
guuuacagaau

SEQ ID NO: 1414178 - RNA, 20 nt, Human
guuuaaugaagaucuaaaua

SEQ ID NO: 1414179 - RNA, 22 nt, Human
guuuauuuaacuuuuaguaaag

SEQ ID NO: 1414180 - RNA, 14 nt, Human
guuuacaugcuuau

SEQ ID NO: 1414181 - RNA, 19 nt, Human
guuuacaugcuuauuccau

SEQ ID NO: 1414182 - RNA, 22 nt, Human
guugggcagggugacccugaag

SEQ ID NO: 1414183 - RNA, 19 nt, Human
guuuaauccccaguaaaau

SEQ ID NO: 1414184 - RNA, 21 nt, Human
guuuaauccccaguaaaauug

SEQ ID NO: 1414185 - RNA, 22 nt, Human
guuucugaggcuuuaugauaau

SEQ ID NO: 1414186 - RNA, 13 nt, Human
guuucugacucug

SEQ ID NO: 1414187 - RNA, 17 nt, Human
guuucugacucugagcu

SEQ ID NO: 1414188 - RNA, 12 nt, Human
guuucugacucu

SEQ ID NO: 1414189 - RNA, 17 nt, Human
guuucuauuuuuugaaa

SEQ ID NO: 1414190 - RNA, 18 nt, Human
aagguauuuaauagguuu

SEQ ID NO: 1414191 - RNA, 12 nt, Human
aaggucauuuuu

SEQ ID NO: 1414192 - RNA, 18 nt, Human
aaggucauuuuuuuuaag

SEQ ID NO: 1414193 - RNA, 16 nt, Human
aaguaaggaauuuuau

SEQ ID NO: 1414194 - RNA, 21 nt, Human
aaggcucugagagucuagauu

SEQ ID NO: 1414195 - RNA, 20 nt, Human
aaggcucugagagucuagau

SEQ ID NO: 1414196 - RNA, 17 nt, Human
aaggcucugagagucua

SEQ ID NO: 1414197 - RNA, 16 nt, Human
aaggcucugagagucu

SEQ ID NO: 1414198 - RNA, 14 nt, Human
aaggcucugagagu

SEQ ID NO: 1414199 - RNA, 13 nt, Human
aaggcucugagag

SEQ ID NO: 1414200 - RNA, 12 nt, Human
aaggcucugaga

SEQ ID NO: 1414201 - RNA, 21 nt, Human
aaggcucuaugagucuagaug

SEQ ID NO: 1414202 - RNA, 20 nt, Human
aaggcucuaugagucuagau

SEQ ID NO: 1414203 - RNA, 16 nt, Human
aaggcucuaugagucu

SEQ ID NO: 1414204 - RNA, 13 nt, Human
aaggcucuagauc

SEQ ID NO: 1414205 - RNA, 12 nt, Human
aaggcucuagau

SEQ ID NO: 1414206 - RNA, 11 nt, Human
aaggcucuaga

SEQ ID NO: 1414207 - RNA, 22 nt, Human
aaggcucugagagucuagauuc

SEQ ID NO: 1414208 - RNA, 14 nt, Human
aaggcucuuuugua

SEQ ID NO: 1414209 - RNA, 13 nt, Human
aaggggcuucagg

SEQ ID NO: 1414210 - RNA, 14 nt, Human
aaggggccugagca

SEQ ID NO: 1414211 - RNA, 15 nt, Human
aaggggccugagcag

SEQ ID NO: 1414212 - RNA, 13 nt, Human
aaggggccugagc

SEQ ID NO: 1414213 - RNA, 23 nt, Human
aaggggccucaccgagugggggc

SEQ ID NO: 1414214 - RNA, 17 nt, Human
aaggggccagaggcucg

SEQ ID NO: 1414215 - RNA, 22 nt, Human
aagggucgaaagcucuagaauc

SEQ ID NO: 1414216 - RNA, 21 nt, Human
aagggucgaaagcucuagaau

SEQ ID NO: 1414217 - RNA, 19 nt, Human
aagggucgaaagcucuaga

SEQ ID NO: 1414218 - RNA, 18 nt, Human
aagggucgaaagcucuag

SEQ ID NO: 1414219 - RNA, 22 nt, Human
aagguacuuucauauuuuaaac

SEQ ID NO: 1414220 - RNA, 19 nt, Human
aagguacuuucauauuuua

SEQ ID NO: 1414221 - RNA, 18 nt, Human
aagguacuuucauauuuu

SEQ ID NO: 1414222 - RNA, 14 nt, Human
aagguacuucaaau

SEQ ID NO: 1414223 - RNA, 20 nt, Human
aaucacucuaauuaauugua

SEQ ID NO: 1414224 - RNA, 21 nt, Human
aaucacucuaauuaauuguaa

SEQ ID NO: 1414225 - RNA, 18 nt, Human
aaucacucuaauuaauug

SEQ ID NO: 1414226 - RNA, 14 nt, Human
aauauuuucuuuuc

SEQ ID NO: 1414227 - RNA, 17 nt, Human
aaucagccuacaggccu

SEQ ID NO: 1414228 - RNA, 21 nt, Human
aaucagccaauuauguuaaac

SEQ ID NO: 1414229 - RNA, 16 nt, Human
aaucagccuaguugau

SEQ ID NO: 1414230 - RNA, 14 nt, Human
aaucagccaauuau

SEQ ID NO: 1414231 - RNA, 18 nt, Human
aaucagccaauuauguua

SEQ ID NO: 1414232 - RNA, 19 nt, Human
aaucagccaauuauguuaa

SEQ ID NO: 1414233 - RNA, 20 nt, Human
aaucagccaauuauguuaaa

SEQ ID NO: 1414234 - RNA, 20 nt, Human
aaucagcuccuuccuggaga

SEQ ID NO: 1414235 - RNA, 15 nt, Human
aaucagcuauuuugu

SEQ ID NO: 1414236 - RNA, 14 nt, Human
aaucaguaagaggu

SEQ ID NO: 1414237 - RNA, 22 nt, Human
aaucaguaagagguguuauuug

SEQ ID NO: 1414238 - RNA, 18 nt, Human
aaucagggaggucauuuu

SEQ ID NO: 1414239 - RNA, 20 nt, Human
aaucaggaauauuuuccaaa

SEQ ID NO: 1414240 - RNA, 18 nt, Human
aaucaggaauauuuucca

SEQ ID NO: 1414241 - RNA, 17 nt, Human
aaucagcuauuuuguga

SEQ ID NO: 1414242 - RNA, 16 nt, Human
aaucagcuauuuugug

SEQ ID NO: 1414243 - RNA, 15 nt, Human
aaucaggcuuuuguu

SEQ ID NO: 1414244 - RNA, 16 nt, Human
aaucagguggcuuuug

SEQ ID NO: 1414245 - RNA, 19 nt, Human
aaucagggaggucauuuug

SEQ ID NO: 1414246 - RNA, 16 nt, Human
uaagacucucacacuc

SEQ ID NO: 1414247 - RNA, 22 nt, Human
uaagacucaaauguucuaaguu

SEQ ID NO: 1414248 - RNA, 21 nt, Human
uaagacucaaauguucuaagu

SEQ ID NO: 1414249 - RNA, 19 nt, Human
uaagacucaaauguucuaa

SEQ ID NO: 1414250 - RNA, 18 nt, Human
uaagacucaaauguucua

SEQ ID NO: 1414251 - RNA, 15 nt, Human
uaagacucaaauguu

SEQ ID NO: 1414252 - RNA, 18 nt, Human
uaagacuuacucuaagau

SEQ ID NO: 1414253 - RNA, 17 nt, Human
uaagacuuacucuaaga

SEQ ID NO: 1414254 - RNA, 20 nt, Human
aauauuuugaaucaauaaua

SEQ ID NO: 1414255 - RNA, 22 nt, Human
aauauuuugaaucaauaauaua

SEQ ID NO: 1414256 - RNA, 18 nt, Human
aauauuuugaaucaauaa

SEQ ID NO: 1414257 - RNA, 16 nt, Human
aauauuuugaaucaau

SEQ ID NO: 1414258 - RNA, 15 nt, Human
aauauuuugaaucaa

SEQ ID NO: 1414259 - RNA, 14 nt, Human
aauauuuugaauca

SEQ ID NO: 1414260 - RNA, 13 nt, Human
aauauuuugaauc

SEQ ID NO: 1414261 - RNA, 20 nt, Human
aauauuuuccuccugagugc

SEQ ID NO: 1414262 - RNA, 15 nt, Human
aauauuuauuuuaau

SEQ ID NO: 1414263 - RNA, 18 nt, Human
uaagauuauagauucuaa

SEQ ID NO: 1414264 - RNA, 17 nt, Human
uaagauuauagauucua

SEQ ID NO: 1414265 - RNA, 16 nt, Human
uaagauuauagauucu

SEQ ID NO: 1414266 - RNA, 15 nt, Human
uaagauuauagauuc

SEQ ID NO: 1414267 - RNA, 22 nt, Human
uaagauuacaaaucagaaguca

SEQ ID NO: 1414268 - RNA, 19 nt, Human
uaagauuacaaaucagaag

SEQ ID NO: 1414269 - RNA, 17 nt, Human
aaucagucucagaaugu

SEQ ID NO: 1414270 - RNA, 24 nt, Human
aaucagucucagaaugucauuuug

SEQ ID NO: 1414271 - RNA, 22 nt, Human
uaagcucacguccugagaaagc

SEQ ID NO: 1414272 - RNA, 21 nt, Human
uaagcuauuuuucuaacuaca

SEQ ID NO: 1414273 - RNA, 17 nt, Human
uaagcuauuuuucuaac

SEQ ID NO: 1414274 - RNA, 16 nt, Human
uaagcuauuuuucuaa

SEQ ID NO: 1414275 - RNA, 14 nt, Human
uaagcuauuuuucu

SEQ ID NO: 1414276 - RNA, 23 nt, Human
uaagcuauuugauguaauacuuc

SEQ ID NO: 1414277 - RNA, 22 nt, Human
uaagcuauuugauguaauacuu

SEQ ID NO: 1414278 - RNA, 21 nt, Human
uaagcuauuugauguaauacu

SEQ ID NO: 1414279 - RNA, 19 nt, Human
uaagcuauuugauguaaua

SEQ ID NO: 1414280 - RNA, 18 nt, Human
uaagcuauuugauguaau

SEQ ID NO: 1414281 - RNA, 15 nt, Human
uaagcuauuugaugu

SEQ ID NO: 1414282 - RNA, 14 nt, Human
uaagcuauuugaug

SEQ ID NO: 1414283 - RNA, 23 nt, Human
uaagcauaaaagaugaaagagca

SEQ ID NO: 1414284 - RNA, 23 nt, Human
uaagauuauagauucuaaagauu

SEQ ID NO: 1414285 - RNA, 22 nt, Human
uaagauuauagauucuaaagau

SEQ ID NO: 1414286 - RNA, 21 nt, Human
uaagauuauagauucuaaaga

SEQ ID NO: 1414287 - RNA, 20 nt, Human
uaagauuauagauucuaaag

SEQ ID NO: 1414288 - RNA, 19 nt, Human
uaagauuauagauucuaaa

SEQ ID NO: 1414289 - RNA, 22 nt, Human
uaagcagguggaucuauuucau

SEQ ID NO: 1414290 - RNA, 18 nt, Human
uaagcagugucuguguuu

SEQ ID NO: 1414291 - RNA, 21 nt, Human
uaagcagguggaucuauuuca

SEQ ID NO: 1414292 - RNA, 21 nt, Human
uaagcauaagcuuaugcuuaa

SEQ ID NO: 1414293 - RNA, 17 nt, Human
uaaggaaccaacaaucu

SEQ ID NO: 1414294 - RNA, 14 nt, Human
uaaggaaccaacaa

SEQ ID NO: 1414295 - RNA, 20 nt, Human
uaaggaaaucaacuugcuua

SEQ ID NO: 1414296 - RNA, 19 nt, Human
uaaggaaaucaacuugcuu

SEQ ID NO: 1414297 - RNA, 12 nt, Human
uaagcucugagc

SEQ ID NO: 1414298 - RNA, 16 nt, Human
uaagcucugagcuguc

SEQ ID NO: 1414299 - RNA, 10 nt, Human
uaagcucuga

SEQ ID NO: 1414300 - RNA, 22 nt, Human
uaagcucccagggccugucuca

SEQ ID NO: 1414301 - RNA, 19 nt, Human
uaagcucacguccugagaa

SEQ ID NO: 1414302 - RNA, 22 nt, Human
uaaggaauuuuauuuuuuucug

SEQ ID NO: 1414303 - RNA, 22 nt, Human
uaaggaccugaaauuccaaagu

SEQ ID NO: 1414304 - RNA, 21 nt, Human
uaaggaccugaaauuccaaag

SEQ ID NO: 1414305 - RNA, 15 nt, Human
uaaggaccugaaauu

SEQ ID NO: 1414306 - RNA, 18 nt, Human
uaagguuuuaauuuagua

SEQ ID NO: 1414307 - RNA, 18 nt, Human
uaaggauccggaaagaag

SEQ ID NO: 1414308 - RNA, 17 nt, Human
uaaggauccggaaagaa

SEQ ID NO: 1414309 - RNA, 15 nt, Human
uaagguucuaaggcc

SEQ ID NO: 1414310 - RNA, 18 nt, Human
uaaggaugcuuguacaua

SEQ ID NO: 1414311 - RNA, 19 nt, Human
uaaggagaaaucuauagaa

SEQ ID NO: 1414312 - RNA, 17 nt, Human
uaagguuuuaauuuagu

SEQ ID NO: 1414313 - RNA, 20 nt, Human
uaaguaaugauaacuggaaa

SEQ ID NO: 1414314 - RNA, 22 nt, Human
uaaguacagagaagccaucacc

SEQ ID NO: 1414315 - RNA, 18 nt, Human
uaaguacagagaagccau

SEQ ID NO: 1414316 - RNA, 17 nt, Human
uaaguacagagaagcca

SEQ ID NO: 1414317 - RNA, 16 nt, Human
uaaguacagagaagcc

SEQ ID NO: 1414318 - RNA, 14 nt, Human
uaaguacagagaag

SEQ ID NO: 1414319 - RNA, 13 nt, Human
uaaguacagagaa

SEQ ID NO: 1414320 - RNA, 12 nt, Human
uaaguacagaga

SEQ ID NO: 1414321 - RNA, 11 nt, Human
uaaguacagag

SEQ ID NO: 1414322 - RNA, 18 nt, Human
uaaguacacaauaagcaa

SEQ ID NO: 1414323 - RNA, 15 nt, Human
uaauaaaaagcuuuu

SEQ ID NO: 1414324 - RNA, 16 nt, Human
uaauaaaaagauugaa

SEQ ID NO: 1414325 - RNA, 13 nt, Human
uaauaaaaagauu

SEQ ID NO: 1414326 - RNA, 23 nt, Human
uaaguuucuaagauucuaaaggu

SEQ ID NO: 1414327 - RNA, 21 nt, Human
uaaguuucuaagauucuaaag

SEQ ID NO: 1414328 - RNA, 20 nt, Human
uaaguuucuaagauucuaaa

SEQ ID NO: 1414329 - RNA, 19 nt, Human
uaaguuucuaagauucuaa

SEQ ID NO: 1414330 - RNA, 18 nt, Human
uaaguuucuaagauucua

SEQ ID NO: 1414331 - RNA, 17 nt, Human
uaaguuucuaagauucu

SEQ ID NO: 1414332 - RNA, 16 nt, Human
uaaguuucuaagauuc

SEQ ID NO: 1414333 - RNA, 15 nt, Human
uaaguuucuaagauu

SEQ ID NO: 1414334 - RNA, 14 nt, Human
uaaguuucuaagau

SEQ ID NO: 1414335 - RNA, 13 nt, Human
uaaguuucuaaga

SEQ ID NO: 1414336 - RNA, 12 nt, Human
uaaguuucuaag

SEQ ID NO: 1414337 - RNA, 18 nt, Human
uaaguuauagugaauacu

SEQ ID NO: 1414338 - RNA, 14 nt, Human
uaaguuauaagacu

SEQ ID NO: 1414339 - RNA, 20 nt, Human
uaaguuaguuccacugagac

SEQ ID NO: 1414340 - RNA, 20 nt, Human
uaaguauuuagguuuuuguu

SEQ ID NO: 1414341 - RNA, 12 nt, Human
uaaguauuuagg

SEQ ID NO: 1414342 - RNA, 21 nt, Human
uaaguacagagaagccaucac

SEQ ID NO: 1414343 - RNA, 19 nt, Human
uaaguuaguuccacugaga

SEQ ID NO: 1414344 - RNA, 17 nt, Human
uaaguuaguuccacuga

SEQ ID NO: 1414345 - RNA, 14 nt, Human
uaaguuaauuuaaa

SEQ ID NO: 1414346 - RNA, 13 nt, Human
uaaguauuucaaa

SEQ ID NO: 1414347 - RNA, 17 nt, Human
uaaguguguguuuuuca

SEQ ID NO: 1414348 - RNA, 19 nt, Human
aaucccagcccccugacca

SEQ ID NO: 1414349 - RNA, 23 nt, Human
aaucaguucauuagaaauauuuu

SEQ ID NO: 1414350 - RNA, 20 nt, Human
aaucaguucauuagaaauau

SEQ ID NO: 1414351 - RNA, 19 nt, Human
aaucaguucauuagaaaua

SEQ ID NO: 1414352 - RNA, 18 nt, Human
aaucaguucauuagaaau

SEQ ID NO: 1414353 - RNA, 17 nt, Human
aaucaguucauuagaaa

SEQ ID NO: 1414354 - RNA, 21 nt, Human
aaucccaaauuugauugauuu

SEQ ID NO: 1414355 - RNA, 13 nt, Human
uaauaaaaauaaa

SEQ ID NO: 1414356 - RNA, 22 nt, Human
aaucccugcuuuuuguguuuuu

SEQ ID NO: 1414357 - RNA, 14 nt, Human
aaucccugcuuuuu

SEQ ID NO: 1414358 - RNA, 13 nt, Human
aaucccugcuuuu

SEQ ID NO: 1414359 - RNA, 19 nt, Human
aaucccucaccuucugagu

SEQ ID NO: 1414360 - RNA, 23 nt, Human
aauccccuucuccccugcacugu

SEQ ID NO: 1414361 - RNA, 20 nt, Human
aauccccuucuccccugcac

SEQ ID NO: 1414362 - RNA, 17 nt, Human
aauccccuucuccccug

SEQ ID NO: 1414363 - RNA, 16 nt, Human
aauccccuucuccccu

SEQ ID NO: 1414364 - RNA, 15 nt, Human
aauccccuucucccc

SEQ ID NO: 1414365 - RNA, 16 nt, Human
aaucccgauucacccu

SEQ ID NO: 1414366 - RNA, 14 nt, Human
aauccccuucuccc

SEQ ID NO: 1414367 - RNA, 13 nt, Human
aauccccuucucc

SEQ ID NO: 1414368 - RNA, 18 nt, Human
aauccccaacaugcacug

SEQ ID NO: 1414369 - RNA, 15 nt, Human
aauccccaguaaaau

SEQ ID NO: 1414370 - RNA, 16 nt, Human
aauccccaguaaaauu

SEQ ID NO: 1414371 - RNA, 17 nt, Human
aauccccaguaaaauug

SEQ ID NO: 1414372 - RNA, 21 nt, Human
aauccccaguaaaauugccau

SEQ ID NO: 1414373 - RNA, 18 nt, Human
aauccucucucuguguua

SEQ ID NO: 1414374 - RNA, 14 nt, Human
aauccucccagaaa

SEQ ID NO: 1414375 - RNA, 12 nt, Human
aaucuaaaugga

SEQ ID NO: 1414376 - RNA, 21 nt, Human
aaucuauggucgggagacagc

SEQ ID NO: 1414377 - RNA, 12 nt, Human
aaucuguaaacu

SEQ ID NO: 1414378 - RNA, 11 nt, Human
aaucuguaaac

SEQ ID NO: 1414379 - RNA, 11 nt, Human
aaucuguaaaa

SEQ ID NO: 1414380 - RNA, 21 nt, Human
aaguguauuuggaaauaaagu

SEQ ID NO: 1414381 - RNA, 15 nt, Human
aaguguauuuggaaa

SEQ ID NO: 1414382 - RNA, 13 nt, Human
aaguguauuugga

SEQ ID NO: 1414383 - RNA, 22 nt, Human
aagugcguccacgagcuguuua

SEQ ID NO: 1414384 - RNA, 21 nt, Human
aagugccuuucaggaucuauu

SEQ ID NO: 1414385 - RNA, 20 nt, Human
aagugccuuucaggaucuau

SEQ ID NO: 1414386 - RNA, 19 nt, Human
aagugccuuucaggaucua

SEQ ID NO: 1414387 - RNA, 14 nt, Human
aagugccuuucagg

SEQ ID NO: 1414388 - RNA, 13 nt, Human
aagugccuuucag

SEQ ID NO: 1414389 - RNA, 13 nt, Human
uaaaugaacaaga

SEQ ID NO: 1414390 - RNA, 23 nt, Human
uaaaucuuuuauaggauuuauuu

SEQ ID NO: 1414391 - RNA, 19 nt, Human
uaaaucuuuuauaggauuu

SEQ ID NO: 1414392 - RNA, 18 nt, Human
aaguguauuuuuuuacua

SEQ ID NO: 1414393 - RNA, 21 nt, Human
aaguguauuuuuuuacuaaua

SEQ ID NO: 1414394 - RNA, 12 nt, Human
uaaaugaauguu

SEQ ID NO: 1414395 - RNA, 12 nt, Human
uaaaugaagaaa

SEQ ID NO: 1414396 - RNA, 23 nt, Human
uaaaugaacaagagaagcauucu

SEQ ID NO: 1414397 - RNA, 17 nt, Human
uaaaugaacaagagaag

SEQ ID NO: 1414398 - RNA, 16 nt, Human
uaaaugaacaagagaa

SEQ ID NO: 1414399 - RNA, 15 nt, Human
uaaaugaacaagaga

SEQ ID NO: 1414400 - RNA, 19 nt, Human
uaaauguuaugacuaugua

SEQ ID NO: 1414401 - RNA, 21 nt, Human
uaaauguuaugacuauguaaa

SEQ ID NO: 1414402 - RNA, 19 nt, Human
uaaauuaacuuuuauaaac

SEQ ID NO: 1414403 - RNA, 20 nt, Human
uaaauuaacuuuuauaaacu

SEQ ID NO: 1414404 - RNA, 20 nt, Human
uaacaaaauguaugucuggu

SEQ ID NO: 1414405 - RNA, 18 nt, Human
uaaauuauuguuuuucuu

SEQ ID NO: 1414406 - RNA, 19 nt, Human
uaacaaaauguaugucugg

SEQ ID NO: 1414407 - RNA, 16 nt, Human
uaacaaaauguauguc

SEQ ID NO: 1414408 - RNA, 15 nt, Human
uaacaaaauguaugu

SEQ ID NO: 1414409 - RNA, 16 nt, Human
uaaauuauguaaauua

SEQ ID NO: 1414410 - RNA, 13 nt, Human
uaaauuauguaaa

SEQ ID NO: 1414411 - RNA, 22 nt, Human
uaaauuaucaggcaaauuugca

SEQ ID NO: 1414412 - RNA, 20 nt, Human
uaaauguuaugacuauguaa

SEQ ID NO: 1414413 - RNA, 21 nt, Human
uaaauuaacuuuuauaaacuu

SEQ ID NO: 1414414 - RNA, 22 nt, Human
uaaauuaacuuuuauaaacuuu

SEQ ID NO: 1414415 - RNA, 14 nt, Human
uaacaaucagcucc

SEQ ID NO: 1414416 - RNA, 20 nt, Human
uaacaauacaaauggauuuu

SEQ ID NO: 1414417 - RNA, 19 nt, Human
uaacaauacaaauggauuu

SEQ ID NO: 1414418 - RNA, 18 nt, Human
uaacaauacaaauggauu

SEQ ID NO: 1414419 - RNA, 17 nt, Human
uaacaauacaaauggau

SEQ ID NO: 1414420 - RNA, 16 nt, Human
uaacaauacaaaugga

SEQ ID NO: 1414421 - RNA, 14 nt, Human
uaacaauacaaaug

SEQ ID NO: 1414422 - RNA, 13 nt, Human
uaacaauacaaau

SEQ ID NO: 1414423 - RNA, 13 nt, Human
uaacaaugcugua

SEQ ID NO: 1414424 - RNA, 15 nt, Human
aauagcaugucacua

SEQ ID NO: 1414425 - RNA, 12 nt, Human
aauagcauguca

SEQ ID NO: 1414426 - RNA, 14 nt, Human
aauagcagccuuuc

SEQ ID NO: 1414427 - RNA, 18 nt, Human
aauagcaaagaauugacu

SEQ ID NO: 1414428 - RNA, 15 nt, Human
aauagcaaagaauug

SEQ ID NO: 1414429 - RNA, 14 nt, Human
aauagcaaagaauu

SEQ ID NO: 1414430 - RNA, 20 nt, Human
aauagcaaaagaagaaguuu

SEQ ID NO: 1414431 - RNA, 19 nt, Human
aauagcaaaagaagaaguu

SEQ ID NO: 1414432 - RNA, 16 nt, Human
aauagcaaaagaagaa

SEQ ID NO: 1414433 - RNA, 13 nt, Human
aauagcaaaagaa

SEQ ID NO: 1414434 - RNA, 16 nt, Human
aauagagccugaggga

SEQ ID NO: 1414435 - RNA, 14 nt, Human
aauagagccugagg

SEQ ID NO: 1414436 - RNA, 16 nt, Human
aauagacuuaaaucuc

SEQ ID NO: 1414437 - RNA, 12 nt, Human
aauaccugcuca

SEQ ID NO: 1414438 - RNA, 21 nt, Human
aauaccacucuguaauugcaa

SEQ ID NO: 1414439 - RNA, 20 nt, Human
aauaccacucuguaauugca

SEQ ID NO: 1414440 - RNA, 21 nt, Human
aauacccaugucuacacagau

SEQ ID NO: 1414441 - RNA, 19 nt, Human
aauacauuauauuucuauu

SEQ ID NO: 1414442 - RNA, 23 nt, Human
aauacaugcuaagagaaguagaa

SEQ ID NO: 1414443 - RNA, 22 nt, Human
aauacaugcuaagagaaguaga

SEQ ID NO: 1414444 - RNA, 21 nt, Human
aauacaugcuaagagaaguag

SEQ ID NO: 1414445 - RNA, 23 nt, Human
aauacaugacauuuauuuuucau

SEQ ID NO: 1414446 - RNA, 17 nt, Human
aauacaugacauuuauu

SEQ ID NO: 1414447 - RNA, 16 nt, Human
aauacagggcauuuug

SEQ ID NO: 1414448 - RNA, 23 nt, Human
aauacaggaaacaguugcaugua

SEQ ID NO: 1414449 - RNA, 18 nt, Human
aauacaggaaacaguugc

SEQ ID NO: 1414450 - RNA, 16 nt, Human
aauacaggaaacaguu

SEQ ID NO: 1414451 - RNA, 15 nt, Human
aauacaggaaacagu

SEQ ID NO: 1414452 - RNA, 13 nt, Human
aauacaggaaaca

SEQ ID NO: 1414453 - RNA, 15 nt, Human
aauacagaucaucuu

SEQ ID NO: 1414454 - RNA, 18 nt, Human
aauacagcaacaauuuau

SEQ ID NO: 1414455 - RNA, 21 nt, Human
aauacagauuuugauagcaaa

SEQ ID NO: 1414456 - RNA, 23 nt, Human
aauacagauuuugauagcaaagc

SEQ ID NO: 1414457 - RNA, 16 nt, Human
aauacagaucaucuug

SEQ ID NO: 1414458 - RNA, 19 nt, Human
aauacagauuuugauagca

SEQ ID NO: 1414459 - RNA, 20 nt, Human
aauacagauuuugauagcaa

SEQ ID NO: 1414460 - RNA, 19 nt, Human
aauacagauauauuuucuu

SEQ ID NO: 1414461 - RNA, 15 nt, Human
aauacagauauauuu

SEQ ID NO: 1414462 - RNA, 14 nt, Human
aauacagauauauu

SEQ ID NO: 1414463 - RNA, 13 nt, Human
aauacagauauau

SEQ ID NO: 1414464 - RNA, 12 nt, Human
aauacagauaua

SEQ ID NO: 1414465 - RNA, 15 nt, Human
aauacagacuggaug

SEQ ID NO: 1414466 - RNA, 19 nt, Human
aauaccacucuguaauugc

SEQ ID NO: 1414467 - RNA, 18 nt, Human
aauaccacucuguaauug

SEQ ID NO: 1414468 - RNA, 17 nt, Human
aauaccacucuguaauu

SEQ ID NO: 1414469 - RNA, 17 nt, Human
aauaccagccaguaaau

SEQ ID NO: 1414470 - RNA, 19 nt, Human
aauaccagccaguaaaugg

SEQ ID NO: 1414471 - RNA, 23 nt, Human
aauacauuuaaaacauuaaaaua

SEQ ID NO: 1414472 - RNA, 22 nt, Human
aauacauuuaaaacauuaaaau

SEQ ID NO: 1414473 - RNA, 21 nt, Human
aauacauuuaaaacauuaaaa

SEQ ID NO: 1414474 - RNA, 20 nt, Human
aauacauuuaaaacauuaaa

SEQ ID NO: 1414475 - RNA, 17 nt, Human
aauacauuuaaaacauu

SEQ ID NO: 1414476 - RNA, 14 nt, Human
aauacauuuaaaac

SEQ ID NO: 1414477 - RNA, 23 nt, Human
aauaccacaggaaccacaagacu

SEQ ID NO: 1414478 - RNA, 17 nt, Human
aauagucggugaagaaa

SEQ ID NO: 1414479 - RNA, 16 nt, Human
aauaguggugugauuu

SEQ ID NO: 1414480 - RNA, 21 nt, Human
aauagcuaaauaccucaauca

SEQ ID NO: 1414481 - RNA, 19 nt, Human
aauagcguucuuguaauuu

SEQ ID NO: 1414482 - RNA, 18 nt, Human
aauagcguucuuguaauu

SEQ ID NO: 1414483 - RNA, 16 nt, Human
aauagcguucuuguaa

SEQ ID NO: 1414484 - RNA, 15 nt, Human
aauagcguucuugua

SEQ ID NO: 1414485 - RNA, 14 nt, Human
aauagcguucuugu

SEQ ID NO: 1414486 - RNA, 23 nt, Human
aauaguuaagacaugauuuccuu

SEQ ID NO: 1414487 - RNA, 22 nt, Human
aauaguuaagacaugauuuccu

SEQ ID NO: 1414488 - RNA, 21 nt, Human
aauaguuaagacaugauuucc

SEQ ID NO: 1414489 - RNA, 21 nt, Human
aauauauucagccuggcuuca

SEQ ID NO: 1414490 - RNA, 15 nt, Human
aauauauuuaagaua

SEQ ID NO: 1414491 - RNA, 16 nt, Human
aauauauuuaaaaaua

SEQ ID NO: 1414492 - RNA, 14 nt, Human
aauauauuuaaaaa

SEQ ID NO: 1414493 - RNA, 22 nt, Human
aauauauuauuacuuguaaaua

SEQ ID NO: 1414494 - RNA, 20 nt, Human
aauauauuuaagauaauuau

SEQ ID NO: 1414495 - RNA, 19 nt, Human
aauauauuuaagauaauua

SEQ ID NO: 1414496 - RNA, 21 nt, Human
aauauauuuuaagacgaaaca

SEQ ID NO: 1414497 - RNA, 20 nt, Human
uaacaugaauauuuaguguu

SEQ ID NO: 1414498 - RNA, 21 nt, Human
uaacaugaauauuuaguguuc

SEQ ID NO: 1414499 - RNA, 22 nt, Human
uaacauguccugccuauuaucu

SEQ ID NO: 1414500 - RNA, 15 nt, Human
uaacauguaggaagu

SEQ ID NO: 1414501 - RNA, 22 nt, Human
uaacauguguuaaguauuuuca

SEQ ID NO: 1414502 - RNA, 19 nt, Human
uaacaugugaaaagaauag

SEQ ID NO: 1414503 - RNA, 18 nt, Human
uaacgccugagcccaggg

SEQ ID NO: 1414504 - RNA, 14 nt, Human
uaacgccugagccc

SEQ ID NO: 1414505 - RNA, 13 nt, Human
uaacgccugagcc

SEQ ID NO: 1414506 - RNA, 12 nt, Human
uaacgccugagc

SEQ ID NO: 1414507 - RNA, 17 nt, Human
uaacgcaaguucccagu

SEQ ID NO: 1414508 - RNA, 22 nt, Human
uaacagggaaggcaggcagggc

SEQ ID NO: 1414509 - RNA, 23 nt, Human
uaacagggaaggcaggcagggcu

SEQ ID NO: 1414510 - RNA, 20 nt, Human
uaacagggaaggcaggcagg

SEQ ID NO: 1414511 - RNA, 19 nt, Human
uaacagggaaggcaggcag

SEQ ID NO: 1414512 - RNA, 19 nt, Human
aauauauuuuguuuacaaa

SEQ ID NO: 1414513 - RNA, 21 nt, Human
aauauauuuucuguuuucuuu

SEQ ID NO: 1414514 - RNA, 15 nt, Human
aauauauuuucuguu

SEQ ID NO: 1414515 - RNA, 19 nt, Human
uaacaugaauauuuagugu

SEQ ID NO: 1414516 - RNA, 12 nt, Human
uaacuaggagcu

SEQ ID NO: 1414517 - RNA, 20 nt, Human
uaacuucccugaaaaaucua

SEQ ID NO: 1414518 - RNA, 23 nt, Human
uaacuuccacagggucccacagc

SEQ ID NO: 1414519 - RNA, 20 nt, Human
uaacuuccacagggucccac

SEQ ID NO: 1414520 - RNA, 13 nt, Human
uaacuucacauau

SEQ ID NO: 1414521 - RNA, 16 nt, Human
uaacguugagccccug

SEQ ID NO: 1414522 - RNA, 23 nt, Human
uaacggucuguucuguuucaagg

SEQ ID NO: 1414523 - RNA, 22 nt, Human
uaacggucuguucuguuucaag

SEQ ID NO: 1414524 - RNA, 20 nt, Human
uaacguuuaagccaaaacaa

SEQ ID NO: 1414525 - RNA, 17 nt, Human
uaacguuuaagccaaaa

SEQ ID NO: 1414526 - RNA, 19 nt, Human
uaacgccugagcccaggga

SEQ ID NO: 1414527 - RNA, 21 nt, Human
uaacggaucagaaauacagau

SEQ ID NO: 1414528 - RNA, 14 nt, Human
uaacggaucagaaa

SEQ ID NO: 1414529 - RNA, 19 nt, Human
uaacggaucagaaauacag

SEQ ID NO: 1414530 - RNA, 14 nt, Human
uaacggaccaaagc

SEQ ID NO: 1414531 - RNA, 13 nt, Human
uaacggaucagaa

SEQ ID NO: 1414532 - RNA, 17 nt, Human
uaacgcgucuuccugag

SEQ ID NO: 1414533 - RNA, 16 nt, Human
uaacgcgucuuccuga

SEQ ID NO: 1414534 - RNA, 15 nt, Human
uaacgcgucuuccug

SEQ ID NO: 1414535 - RNA, 13 nt, Human
uaacguauaaaag

SEQ ID NO: 1414536 - RNA, 17 nt, Human
uaacguauaaaagccug

SEQ ID NO: 1414537 - RNA, 12 nt, Human
uaacuuggcuca

SEQ ID NO: 1414538 - RNA, 19 nt, Human
uaacuucuuauggaauuga

SEQ ID NO: 1414539 - RNA, 18 nt, Human
uaacuucuuauggaauug

SEQ ID NO: 1414540 - RNA, 17 nt, Human
uaacuucuuauggaauu

SEQ ID NO: 1414541 - RNA, 21 nt, Human
uaacuucccugaaaaaucuaa

SEQ ID NO: 1414542 - RNA, 16 nt, Human
uaacuuuaauguuuuu

SEQ ID NO: 1414543 - RNA, 17 nt, Human
uaagaaggcaaaaaugu

SEQ ID NO: 1414544 - RNA, 13 nt, Human
uaagaaggcaaaa

SEQ ID NO: 1414545 - RNA, 17 nt, Human
uaagaauuauuuugaug

SEQ ID NO: 1414546 - RNA, 12 nt, Human
uaagaauuauuu

SEQ ID NO: 1414547 - RNA, 18 nt, Human
uaagaaggcaaaaaugua

SEQ ID NO: 1414548 - RNA, 22 nt, Human
uaagaauugaguaaugguguag

SEQ ID NO: 1414549 - RNA, 21 nt, Human
uaagaauugaguaauggugua

SEQ ID NO: 1414550 - RNA, 20 nt, Human
uaagaauugaguaauggugu

SEQ ID NO: 1414551 - RNA, 19 nt, Human
uaagaauugaguaauggug

SEQ ID NO: 1414552 - RNA, 18 nt, Human
uaagaauugaguaauggu

SEQ ID NO: 1414553 - RNA, 16 nt, Human
uaagaauugaguaaug

SEQ ID NO: 1414554 - RNA, 15 nt, Human
uaagaauucagacau

SEQ ID NO: 1414555 - RNA, 16 nt, Human
uaagaauucagacauc

SEQ ID NO: 1414556 - RNA, 18 nt, Human
uaagaccuggcagcucug

SEQ ID NO: 1414557 - RNA, 17 nt, Human
uaagaccuggcagcucu

SEQ ID NO: 1414558 - RNA, 23 nt, Human
uaagacaaaaagcuacuuauugu

SEQ ID NO: 1414559 - RNA, 13 nt, Human
uaagacaaauaug

SEQ ID NO: 1414560 - RNA, 14 nt, Human
uaccaugucuuucu

SEQ ID NO: 1414561 - RNA, 15 nt, Human
uaccauguaauggca

SEQ ID NO: 1414562 - RNA, 18 nt, Human
uaccauguaauggcaguu

SEQ ID NO: 1414563 - RNA, 18 nt, Human
uaccaugcuucacaaugu

SEQ ID NO: 1414564 - RNA, 19 nt, Human
uaccaguuaauuuuuccaa

SEQ ID NO: 1414565 - RNA, 18 nt, Human
uaccaguuaauuuuucca

SEQ ID NO: 1414566 - RNA, 20 nt, Human
uaccauuaaaccaucucccu

SEQ ID NO: 1414567 - RNA, 16 nt, Human
uaccauuaaaccaucu

SEQ ID NO: 1414568 - RNA, 15 nt, Human
uaccauuaaaccauc

SEQ ID NO: 1414569 - RNA, 22 nt, Human
uaccauuaaaccaucucccugg

SEQ ID NO: 1414570 - RNA, 14 nt, Human
uaccauuaaaccau

SEQ ID NO: 1414571 - RNA, 20 nt, Human
uaccaguauuuagaagccaa

SEQ ID NO: 1414572 - RNA, 19 nt, Human
uaccaguauuuagaagcca

SEQ ID NO: 1414573 - RNA, 18 nt, Human
uaccaguauuuagaagcc

SEQ ID NO: 1414574 - RNA, 15 nt, Human
uaccaguauuuagaa

SEQ ID NO: 1414575 - RNA, 12 nt, Human
uaccaguauuua

SEQ ID NO: 1414576 - RNA, 21 nt, Human
uaccaggcaccaaaagaagua

SEQ ID NO: 1414577 - RNA, 18 nt, Human
uaccaggcaccaaaagaa

SEQ ID NO: 1414578 - RNA, 17 nt, Human
uaccaggcaccaaaaga

SEQ ID NO: 1414579 - RNA, 20 nt, Human
uaccagcgaggaggcuccag

SEQ ID NO: 1414580 - RNA, 15 nt, Human
uaccagcgaggaggc

SEQ ID NO: 1414581 - RNA, 13 nt, Human
uaccagcgaggag

SEQ ID NO: 1414582 - RNA, 12 nt, Human
uaccagaugcag

SEQ ID NO: 1414583 - RNA, 23 nt, Human
uaccagauaacuuuuuuuuuucu

SEQ ID NO: 1414584 - RNA, 15 nt, Human
uaccagauaacuuuu

SEQ ID NO: 1414585 - RNA, 14 nt, Human
uaccagauaacuuu

SEQ ID NO: 1414586 - RNA, 18 nt, Human
uaccagccaguaaauggg

SEQ ID NO: 1414587 - RNA, 15 nt, Human
uacauucauuuagcu

SEQ ID NO: 1414588 - RNA, 13 nt, Human
uacauucauuuag

SEQ ID NO: 1414589 - RNA, 13 nt, Human
aauguuuaaaaca

SEQ ID NO: 1414590 - RNA, 14 nt, Human
uacauuccaacucg

SEQ ID NO: 1414591 - RNA, 12 nt, Human
uacauucuguua

SEQ ID NO: 1414592 - RNA, 13 nt, Human
uacauuuccuaaa

SEQ ID NO: 1414593 - RNA, 15 nt, Human
aauguuguuauuuaa

SEQ ID NO: 1414594 - RNA, 22 nt, Human
aauguugggacugcuaaauaaa

SEQ ID NO: 1414595 - RNA, 12 nt, Human
aauuaacuuuua

SEQ ID NO: 1414596 - RNA, 13 nt, Human
aauuaacuuuuau

SEQ ID NO: 1414597 - RNA, 15 nt, Human
aauuaacuuuuauaa

SEQ ID NO: 1414598 - RNA, 16 nt, Human
aauuaacuuuuauaaa

SEQ ID NO: 1414599 - RNA, 21 nt, Human
aauguuauuuuuuaauuauua

SEQ ID NO: 1414600 - RNA, 23 nt, Human
aauguuggucauuuuauguuaag

SEQ ID NO: 1414601 - RNA, 21 nt, Human
aauguugggacugcuaaauaa

SEQ ID NO: 1414602 - RNA, 13 nt, Human
aauguugggacug

SEQ ID NO: 1414603 - RNA, 21 nt, Human
aauguuggacaccuuuagguu

SEQ ID NO: 1414604 - RNA, 20 nt, Human
aauguuggacaccuuuaggu

SEQ ID NO: 1414605 - RNA, 17 nt, Human
aauguucucagauuucu

SEQ ID NO: 1414606 - RNA, 20 nt, Human
aauguucuaaguuucuaaga

SEQ ID NO: 1414607 - RNA, 19 nt, Human
aauguucuaaguuucuaag

SEQ ID NO: 1414608 - RNA, 17 nt, Human
aauguucuaaguuucua

SEQ ID NO: 1414609 - RNA, 16 nt, Human
aauguucuaaguuucu

SEQ ID NO: 1414610 - RNA, 14 nt, Human
aauguucuaaguuu

SEQ ID NO: 1414611 - RNA, 13 nt, Human
aauguucuaaguu

SEQ ID NO: 1414612 - RNA, 23 nt, Human
aauguucuaaguuucuaagauuc

SEQ ID NO: 1414613 - RNA, 22 nt, Human
aauguucuaaguuucuaagauu

SEQ ID NO: 1414614 - RNA, 21 nt, Human
aauguucuaaguuucuaagau

SEQ ID NO: 1414615 - RNA, 21 nt, Human
aauguggccccugaacaagaa

SEQ ID NO: 1414616 - RNA, 22 nt, Human
aauguggcaaggaaaaacaggu

SEQ ID NO: 1414617 - RNA, 21 nt, Human
uacagggggucuggcuggugu

SEQ ID NO: 1414618 - RNA, 19 nt, Human
uacagggggucuggcuggu

SEQ ID NO: 1414619 - RNA, 18 nt, Human
uacagggggucuggcugg

SEQ ID NO: 1414620 - RNA, 22 nt, Human
uacagggggucuggcugguguu

SEQ ID NO: 1414621 - RNA, 17 nt, Human
uacagggggucuggcug

SEQ ID NO: 1414622 - RNA, 16 nt, Human
uacagggggucuggcu

SEQ ID NO: 1414623 - RNA, 14 nt, Human
uacagggggucugg

SEQ ID NO: 1414624 - RNA, 17 nt, Human
aauguuagccucaauuu

SEQ ID NO: 1414625 - RNA, 16 nt, Human
aauguuacauuauuau

SEQ ID NO: 1414626 - RNA, 15 nt, Human
aauguuacauuauua

SEQ ID NO: 1414627 - RNA, 20 nt, Human
aauguuauuuuuuaauuauu

SEQ ID NO: 1414628 - RNA, 19 nt, Human
aauguuauuuuuuaauuau

SEQ ID NO: 1414629 - RNA, 18 nt, Human
aauguucacaauauauuu

SEQ ID NO: 1414630 - RNA, 23 nt, Human
aauguuaucuucucaaguucuaa

SEQ ID NO: 1414631 - RNA, 22 nt, Human
aauguuaucuucucaaguucua

SEQ ID NO: 1414632 - RNA, 17 nt, Human
aauguuaucuucucaag

SEQ ID NO: 1414633 - RNA, 16 nt, Human
aauguuaucuucucaa

SEQ ID NO: 1414634 - RNA, 19 nt, Human
aauguuaugacuauguaaa

SEQ ID NO: 1414635 - RNA, 22 nt, Human
aauguuaugacuauguaaacua

SEQ ID NO: 1414636 - RNA, 13 nt, Human
aauucaauucaaa

SEQ ID NO: 1414637 - RNA, 15 nt, Human
aauucaauucaaagc

SEQ ID NO: 1414638 - RNA, 23 nt, Human
aauucaaggaauuucuuaacuuc

SEQ ID NO: 1414639 - RNA, 17 nt, Human
aauucaaggaauuucuu

SEQ ID NO: 1414640 - RNA, 16 nt, Human
aauucaaggaauuucu

SEQ ID NO: 1414641 - RNA, 12 nt, Human
aauuauuugcau

SEQ ID NO: 1414642 - RNA, 22 nt, Human
aauuauuucaugauuagaaauu

SEQ ID NO: 1414643 - RNA, 17 nt, Human
aauucauaaucacucua

SEQ ID NO: 1414644 - RNA, 16 nt, Human
aauucaguuucauaaa

SEQ ID NO: 1414645 - RNA, 15 nt, Human
aauucaguuucauaa

SEQ ID NO: 1414646 - RNA, 14 nt, Human
aauucaguuucaua

SEQ ID NO: 1414647 - RNA, 13 nt, Human
aauucaguuucau

SEQ ID NO: 1414648 - RNA, 19 nt, Human
aauucagguuuuuccuuuu

SEQ ID NO: 1414649 - RNA, 21 nt, Human
aauucagacaucugagguuuu

SEQ ID NO: 1414650 - RNA, 16 nt, Human
aauucagacaucugag

SEQ ID NO: 1414651 - RNA, 13 nt, Human
aauucacaaacuu

SEQ ID NO: 1414652 - RNA, 17 nt, Human
aauucaauuuggauuua

SEQ ID NO: 1414653 - RNA, 15 nt, Human
aauucagguuuuucc

SEQ ID NO: 1414654 - RNA, 14 nt, Human
aauucagcauuuga

SEQ ID NO: 1414655 - RNA, 22 nt, Human
aauucagacaucugagguuuua

SEQ ID NO: 1414656 - RNA, 21 nt, Human
aauuauuauucuucauaacaa

SEQ ID NO: 1414657 - RNA, 13 nt, Human
aauuauuauucuu

SEQ ID NO: 1414658 - RNA, 18 nt, Human
aauuauuacaguguuuau

SEQ ID NO: 1414659 - RNA, 14 nt, Human
aauuauuacagugu

SEQ ID NO: 1414660 - RNA, 23 nt, Human
aauuauuacaguguuuauccuuu

SEQ ID NO: 1414661 - RNA, 22 nt, Human
aauuauuaaugaaaauaagaau

SEQ ID NO: 1414662 - RNA, 17 nt, Human
aauuauuaaugaaaaua

SEQ ID NO: 1414663 - RNA, 16 nt, Human
aauuauuaaugaaaau

SEQ ID NO: 1414664 - RNA, 19 nt, Human
aauuauguuaaacuagcau

SEQ ID NO: 1414665 - RNA, 23 nt, Human
aauuauguuaaacuagcauaucu

SEQ ID NO: 1414666 - RNA, 21 nt, Human
aauuauuauuuauauauguau

SEQ ID NO: 1414667 - RNA, 18 nt, Human
aauuauuauuuauauaug

SEQ ID NO: 1414668 - RNA, 16 nt, Human
aauuauuauuuauaua

SEQ ID NO: 1414669 - RNA, 13 nt, Human
aauuauuauuuau

SEQ ID NO: 1414670 - RNA, 11 nt, Human
aauuauuauuu

SEQ ID NO: 1414671 - RNA, 22 nt, Human
aauuauuuaaaccgcuaaaaga

SEQ ID NO: 1414672 - RNA, 16 nt, Human
aauuauuguuuuucuu

SEQ ID NO: 1414673 - RNA, 17 nt, Human
aauuagacacuuuggaa

SEQ ID NO: 1414674 - RNA, 16 nt, Human
aauuagacacuuugga

SEQ ID NO: 1414675 - RNA, 23 nt, Human
aauuacuuuggggcuaauuuaac

SEQ ID NO: 1414676 - RNA, 21 nt, Human
aauuaccaugcuucacaaugu

SEQ ID NO: 1414677 - RNA, 21 nt, Human
aauuaccacaccaucucccau

SEQ ID NO: 1414678 - RNA, 15 nt, Human
aauuaccaaccuguu

SEQ ID NO: 1414679 - RNA, 22 nt, Human
aauuacuuuggggcuaauuuaa

SEQ ID NO: 1414680 - RNA, 23 nt, Human
aauuagacugugauucagaaaau

SEQ ID NO: 1414681 - RNA, 21 nt, Human
aauuagacugugauucagaaa

SEQ ID NO: 1414682 - RNA, 20 nt, Human
aauuagacugugauucagaa

SEQ ID NO: 1414683 - RNA, 19 nt, Human
aauuagacugugauucaga

SEQ ID NO: 1414684 - RNA, 15 nt, Human
aauuagacugugauu

SEQ ID NO: 1414685 - RNA, 15 nt, Human
aauuaugugacauuu

SEQ ID NO: 1414686 - RNA, 17 nt, Human
aauuaugugacauuuua

SEQ ID NO: 1414687 - RNA, 20 nt, Human
aauuaugugacauuuuacau

SEQ ID NO: 1414688 - RNA, 22 nt, Human
aauuaugugccagauuuaugca

SEQ ID NO: 1414689 - RNA, 22 nt, Human
aauuaugugacauuuuacauua

SEQ ID NO: 1414690 - RNA, 13 nt, Human
aauuauguuaaac

SEQ ID NO: 1414691 - RNA, 14 nt, Human
aauuauguuaaacu

SEQ ID NO: 1414692 - RNA, 15 nt, Human
aauuauguuaaacua

SEQ ID NO: 1414693 - RNA, 21 nt, Human
uaccuguugagcaucacagaa

SEQ ID NO: 1414694 - RNA, 14 nt, Human
uaccuguugagcau

SEQ ID NO: 1414695 - RNA, 13 nt, Human
uaccuguugagca

SEQ ID NO: 1414696 - RNA, 20 nt, Human
uaccuguguuucuugccuca

SEQ ID NO: 1414697 - RNA, 21 nt, Human
uaccuguguuucuugccucau

SEQ ID NO: 1414698 - RNA, 17 nt, Human
uaccuguguuucuugcc

SEQ ID NO: 1414699 - RNA, 16 nt, Human
uaccuguguggacagg

SEQ ID NO: 1414700 - RNA, 12 nt, Human
uaccuguggaua

SEQ ID NO: 1414701 - RNA, 12 nt, Human
uaccugugccug

SEQ ID NO: 1414702 - RNA, 18 nt, Human
uaccugauuuuuuuuccu

SEQ ID NO: 1414703 - RNA, 12 nt, Human
uaccugauuuuu

SEQ ID NO: 1414704 - RNA, 11 nt, Human
uaccugagggu

SEQ ID NO: 1414705 - RNA, 15 nt, Human
uaccugagggucugu

SEQ ID NO: 1414706 - RNA, 20 nt, Human
uaccugacacucccuugggc

SEQ ID NO: 1414707 - RNA, 14 nt, Human
aauuacauuuguau

SEQ ID NO: 1414708 - RNA, 13 nt, Human
aauuacauuugua

SEQ ID NO: 1414709 - RNA, 17 nt, Human
uaccugacacucccuug

SEQ ID NO: 1414710 - RNA, 21 nt, Human
uaccugaaaacacugugcaca

SEQ ID NO: 1414711 - RNA, 20 nt, Human
uaccugaaaacacugugcac

SEQ ID NO: 1414712 - RNA, 13 nt, Human
uaccugaaaacac

SEQ ID NO: 1414713 - RNA, 23 nt, Human
uaccugaagcuaucguaaaauua

SEQ ID NO: 1414714 - RNA, 15 nt, Human
uacccccugugccuu

SEQ ID NO: 1414715 - RNA, 14 nt, Human
uacccuaaccaagu

SEQ ID NO: 1414716 - RNA, 16 nt, Human
uacccuaaccaaguuc

SEQ ID NO: 1414717 - RNA, 17 nt, Human
uacccuaaccaaguucc

SEQ ID NO: 1414718 - RNA, 15 nt, Human
uacccucauguucuu

SEQ ID NO: 1414719 - RNA, 22 nt, Human
uaccucuugagccuugaacuuu

SEQ ID NO: 1414720 - RNA, 23 nt, Human
uaccucuugagccuugaacuuug

SEQ ID NO: 1414721 - RNA, 21 nt, Human
uacaauucauuguguuaccug

SEQ ID NO: 1414722 - RNA, 16 nt, Human
uacaauucauuguguu

SEQ ID NO: 1414723 - RNA, 19 nt, Human
uacaauuaaagcuguuauu

SEQ ID NO: 1414724 - RNA, 22 nt, Human
uacaauuaaaaaaaaagaucug

SEQ ID NO: 1414725 - RNA, 18 nt, Human
uacaauuaaaaaaaaaga

SEQ ID NO: 1414726 - RNA, 13 nt, Human
uacaaugcugugc

SEQ ID NO: 1414727 - RNA, 14 nt, Human
uacaaugcugugcc

SEQ ID NO: 1414728 - RNA, 16 nt, Human
uacaaugcugugcccu

SEQ ID NO: 1414729 - RNA, 23 nt, Human
uaauuuuuauuuuugcugagacu

SEQ ID NO: 1414730 - RNA, 14 nt, Human
uaauuuuuccaacu

SEQ ID NO: 1414731 - RNA, 13 nt, Human
uaauuuuuccaac

SEQ ID NO: 1414732 - RNA, 17 nt, Human
uaauuuuucacuucaaa

SEQ ID NO: 1414733 - RNA, 18 nt, Human
uaauuuuuauuucuuccu

SEQ ID NO: 1414734 - RNA, 17 nt, Human
uaauuuuuauuucuucc

SEQ ID NO: 1414735 - RNA, 16 nt, Human
uaauuuuuauuucuuc

SEQ ID NO: 1414736 - RNA, 22 nt, Human
uaauuuuuauuaauuuuaguuu

SEQ ID NO: 1414737 - RNA, 23 nt, Human
uaauuuuugauacuaagcauuga

SEQ ID NO: 1414738 - RNA, 16 nt, Human
uaauuuuuccuauauu

SEQ ID NO: 1414739 - RNA, 14 nt, Human
uaauuuuuguaauu

SEQ ID NO: 1414740 - RNA, 20 nt, Human
uaauuuuugauacuaagcau

SEQ ID NO: 1414741 - RNA, 21 nt, Human
uaauuuuugauacuaagcauu

SEQ ID NO: 1414742 - RNA, 21 nt, Human
uaauuuuuuucaccuagauuu

SEQ ID NO: 1414743 - RNA, 18 nt, Human
aaugcugggacucagccu

SEQ ID NO: 1414744 - RNA, 21 nt, Human
aaugcuguauuuuaaaagaau

SEQ ID NO: 1414745 - RNA, 22 nt, Human
aaugcuucuaaguaaauacaau

SEQ ID NO: 1414746 - RNA, 23 nt, Human
aaugcuucuaaguaaauacaauu

SEQ ID NO: 1414747 - RNA, 21 nt, Human
aaugcuucuaaguaaauacaa

SEQ ID NO: 1414748 - RNA, 20 nt, Human
aaugcuucuaaguaaauaca

SEQ ID NO: 1414749 - RNA, 19 nt, Human
aaugcuucuaaguaaauac

SEQ ID NO: 1414750 - RNA, 18 nt, Human
aaugcuucuaaguaaaua

SEQ ID NO: 1414751 - RNA, 14 nt, Human
aaugcuucuaagua

SEQ ID NO: 1414752 - RNA, 22 nt, Human
aaugcuguauuuuaaaagaaug

SEQ ID NO: 1414753 - RNA, 18 nt, Human
aauguaaggcuguguaag

SEQ ID NO: 1414754 - RNA, 17 nt, Human
aauguaaggcuguguaa

SEQ ID NO: 1414755 - RNA, 15 nt, Human
aauguaaggcugugu

SEQ ID NO: 1414756 - RNA, 13 nt, Human
aauguaaggcugu

SEQ ID NO: 1414757 - RNA, 22 nt, Human
aauguaaggcuguguaagauuu

SEQ ID NO: 1414758 - RNA, 21 nt, Human
aauguaaauauuuuaaagaau

SEQ ID NO: 1414759 - RNA, 20 nt, Human
aauguaaauauuuuaaagaa

SEQ ID NO: 1414760 - RNA, 19 nt, Human
aauguaaauauuuuaaaga

SEQ ID NO: 1414761 - RNA, 17 nt, Human
aauguaaauauuuuaaa

SEQ ID NO: 1414762 - RNA, 16 nt, Human
aauguaaauauuuuaa

SEQ ID NO: 1414763 - RNA, 19 nt, Human
aauguaaagcuugucugau

SEQ ID NO: 1414764 - RNA, 23 nt, Human
aauguaaaggagucaaaacuaca

SEQ ID NO: 1414765 - RNA, 21 nt, Human
aauguaaaggagucaaaacua

SEQ ID NO: 1414766 - RNA, 20 nt, Human
aauguaaaggagucaaaacu

SEQ ID NO: 1414767 - RNA, 15 nt, Human
aauguaaagccaugc

SEQ ID NO: 1414768 - RNA, 14 nt, Human
aauguaaagccaug

SEQ ID NO: 1414769 - RNA, 15 nt, Human
aauguaaagacaaaa

SEQ ID NO: 1414770 - RNA, 17 nt, Human
aauggaucacaagaugg

SEQ ID NO: 1414771 - RNA, 18 nt, Human
aauggaucacaagaugga

SEQ ID NO: 1414772 - RNA, 16 nt, Human
aauggaucacaagaug

SEQ ID NO: 1414773 - RNA, 13 nt, Human
aauggaucacaag

SEQ ID NO: 1414774 - RNA, 17 nt, Human
aauggaggccauugugu

SEQ ID NO: 1414775 - RNA, 19 nt, Human
aauggaggggcagagccag

SEQ ID NO: 1414776 - RNA, 20 nt, Human
aauggaggggcagagccagg

SEQ ID NO: 1414777 - RNA, 21 nt, Human
aauggaggggcagagccagga

SEQ ID NO: 1414778 - RNA, 22 nt, Human
aauggaggggcagagccaggaa

SEQ ID NO: 1414779 - RNA, 21 nt, Human
uacagagaagucacagggcag

SEQ ID NO: 1414780 - RNA, 22 nt, Human
uacagagaagucacagggcagu

SEQ ID NO: 1414781 - RNA, 20 nt, Human
uacagagaagucacagggca

SEQ ID NO: 1414782 - RNA, 13 nt, Human
uacagagaaguca

SEQ ID NO: 1414783 - RNA, 24 nt, Human
uacagagaagccuucaagcucuga

SEQ ID NO: 1414784 - RNA, 23 nt, Human
uacagagaagccuucaagcucug

SEQ ID NO: 1414785 - RNA, 22 nt, Human
uacagagaagccuucaagcucu

SEQ ID NO: 1414786 - RNA, 21 nt, Human
uacagagaagccuucaagcuc

SEQ ID NO: 1414787 - RNA, 20 nt, Human
uacagagaagccuucaagcu

SEQ ID NO: 1414788 - RNA, 19 nt, Human
uacagagaagccuucaagc

SEQ ID NO: 1414789 - RNA, 18 nt, Human
uacagagaagccuucaag

SEQ ID NO: 1414790 - RNA, 17 nt, Human
uacagagaagccuucaa

SEQ ID NO: 1414791 - RNA, 17 nt, Human
aauguaauuauuuaugu

SEQ ID NO: 1414792 - RNA, 22 nt, Human
aauguaauuauuuauguauggu
